United States Patent 12,569,549 (FLAVIVIRUS VACCINE) - sequence listing, part 75

SEQ ID NO: 25540 - RNA, 9876 nt, synthetic construct
  misc_feature 1..9876: note = derived and/or modified CDS sequence (opt11) from DENV-2__KU365901__SS-prME
  source 1..9876: mol_type = other RNA
accgccggcatcatcatcatgatgattcccaccgtgatggccttccacctgacgacccggaacggggaaccccatatgatcgtcagccggcaggagaagggcaagtccctactgttcaagactgagaacggtgtgaacatgtgcaccctgatggcgatggacctcggcgaactgtgcgaggacaccataacctacaactgccccctgctgcgtcagaatgagcctgaggacatcgattgctggtgtaacagcacatccacctgggtaacctacgggacctgcaccgctaccggcgaacaccggcgcgagaagcgcagcgtcgccctggtgccccacgtgggcatgggtctggagacacgcactgagacctggatgtccagcgagggagcctggaagcacgcccagcggatagaaacctgggtcctccgccaccccgggttcacgatcatggcggccatcctggcgtacaccatcggcacaacctacttccagcgagtcctgatcttcatcttgctgacggccgtggcgccctccatgaccatgcgctgcatcgggatcagtaaccgggacttcgtcgagggcgtgtccggcggaagctgggtggacatcgtcctggaacatggctcctgcgtgaccaccatggcgaagaacaagcccacgctcgactttgagctcatcaagaccgaggccaagcaccccgccaccctgcggaagtactgcatcgaggccaagctgaccaatacgaccaccgcgagccggtgccccacccagggggaaccctcccttaacgaggagcaggataagcgcttcgtgtgcaagcacagcatggtcgaccggggctggggcaatgggtgcggcctgttcgggaagggcggaatagtgacctgtgctatgttcacttgcaagaaaaacatggagggcaagatcgtgcagcccgaaaaccttgagtacactatcgtgataacgcctcactccggcgaggagaatgccgtggggaacgacacggggaagcatgggaaggagatcaaggtgacgccacaaagctccatcaccgaggccgagctgaccggctacgggaccgtcacgatggagtgcagcccccgcaccggcctggacttcaacgagatggtgctcctgcagatggaaaacaaggcctggctggtacaccggcagtggttcctcgacctgccactaccctggctcccgggcgcggacacacaagggtcgaactggatccagaaggagaccctggtgacgtttaagaacccccatgccaaaaagcaggacgtggtggtactgggctctcaggagggggcgatgcacaccgccctaaccggtgccaccgagatccagatgagctcagggaacctgctgttcacgggccacctcaaatgccgcctgcggatggacaagctgcaactcaagggcatgtcctactccatgtgcactgggaagttcaaggtggttaaggagatcgcggagacccagcacggaaccattgtgatccgcgtgcagtacgagggggacggcagcccctgcaagatccccttcgagatcatggacctggagaagcggcacgtcttggggcgcctcatcacggtgaacccgattgtgaccgaaaaggactcccctgtcaacatcgaagccgagccgcccttcggagacagttatatcataatcggggtggagccggggcagctgaagctgtcctggttcaagaagggcagctccatcgggcagatgttcgagaccaccatgcgcggcgccaagcggatggccatcctcggcgatacggcctgggacttcgggagcctgggcggagtgttcaccagcatcggcaaggcgctgcaccaggtcttcggagccatctatggcgccgccttcagcggcgtttcttggaccatgaagattctgatcggggtggtcatcacctggatcggcatgaacagccgctccacgagcctatccgtgagcttggttctggtcggggtggtgaccctctacctgggcgtcatggtgcaggcggactccggatgcgtggtcagctggaagaacaaagagctgaagtgcggtagcggcatcttcatcaccgacaacgtgcatacctggacggagcaatacaagtttcagcccgagtcccccagcaagctcgcctccgctatccagaaggcccacgaggagggcatttgtggaatccggagcgtaacccgcctggagaatctgatgtggaagcagatcacccaggagctcaaccacatcctgagcgagaacgaggtgaagctgaccatcatgacgggggatatcaagggcataatgcaagccgggaagcggagcctccgcccccagccgacagagctgaaatattcatggaagacgtggggcaaggcgaagatgcttagcaccgagctccacaaccacacgttcctgattgacggccccgagaccgccgagtgccccaataccaaccgggcgtggaattccttagaggtggaggactacgggttcggcgtgttcaccacgaacatctggctaaaactgaaggagaaacaggacgtcttttgcgacagcaagctgatgtccgccgccataaaggacaaccgtgcggtccacgccgacatggggtactggatcgagagcgccctaaatgacacctggaagatcgagaaggcatccttcatcgaggtcaagagctgcaactggccgaagtcccacaccctgtggagcaacggggtgttagagtccgagatgatcatccccaagaacttcgccggccccgtgagccagcataactaccggcccggctaccatacccagaccgcggggccgtggcacctagggcgcctggagatggacttcgagttctgcgagggcacgactgtggtggtgaccgaagactgtgggaaccggggacccagcctgcgcaccacgaccgcctccggcaagctcatcaccgagtggtgctgccggagctgcaccctgccgcccctgcgctaccgcggtgaggacggctgctggtacgggatggagatccgcccgttaaaggagaaagaagagaacctggtgaactccctggtcacggcaggccacgggcagatcgacaacttcagcctcggcgtgctaggcatggccctgttcctcgaagagatgctgcggacgcgcgtggggaccaagcacgctatcctgctcgtcgccgtgaccttcgtgacgctgatcaccggcaacatgtccttccgagacctggggcgcgtcatggtgatggtgggcgccaccatgaccgacgacatcgggatgggggtcacgtacctcgcactgctggcggcgttcaaggtgcgcccaaccttcgctgccggcctgttgctgaggaagttaaccagcaaggagctgatgatggccaccattgggatcgttctgctctcccagagcacgatccccgagaccatcctggagctgaccgacgccttagctctgggaatgatggtcctgaagatcgttcgcaacatggagaagtaccagctcgccgtcaccatcatggcaatcctgtgcgtgcccaacgccgtgatcctgcagaacgcctggcgggtatcctgcacgaccctcgcggtggtgagcgtctccccgttactgctcacctcctcccagcaaaaggccgactggatccccctggccctgaccatcaagggcctcaaccccaccgctatcttcctgacaactctaagccgcacctccaagaagcggagctggcccctcaatgaggcgataatggccgtgggcatggtgtccatcctagccagctccctgttgaaaaacgatatcccgatgacgggccccctggtcgccgggggcttactcaccgtttgctacgtcctgacagggcgcagcgccgacctggagctcgagcgggcggccgatgtccgttgggaagagcaagccgagatctcggggtccagccccattctgtccatcaccatctcagaggatgggtccatgagcatcaagaacgaggaggaggagcagacgctgaccattctcatccggaccggcctgctggtgatctccggccttttccccgtgagcatccccatcaccgccgccgcgtggtacctgtgggaagtaaagaagcagcgagccggggtgttatgggacgtgcccagcccgccgcccgtaggaaaggccgagctcgaggacggggcctaccggatcaaacagaaaggcatcctggggtactcacagatcggcgccggcgtgtacaaggaggggaccttccacacgatgtggcacgtgacccgcggcgcggtcttaatgcacaaggggaaacgcatagagccctcctgggccgacgtgaagaaggacctcatcagctacgggggaggctggaaactggagggcgagtggaaggagggtgaggaggtgcaggtcctggcgctcgaacccggcaagaacccccgcgctgtgcagacaaaacccgggcttttcaagaccaacacgggcaccatcggggccgtgtctctggacttcagccccggcacttccggcagccccatcgtcgacaagaaggggaaggtagtgggcttatacgggaacggcgtcgtgacccggtccggcacgtacgtcagcgcgatagcccagaccgagaagtccatcgaggacaacccggagattgaggacgatatcttccgcaagaaacggctcaccatcatggacctgcaccccggggccggcaagaccaagcgctacctgccagccatcgtccgggaggcgatcaagcgcgggctccggacgttgatcttggcccccaccagggtggtggccgccgagatggaagaggccctccgcgggctgcctatccggtaccaaacccctgcgatccgcgccgagcacaccgggcgggagatcgtcgatctgatgtgccacgccacgttcaccatgcggctcctgtctcccatccgagtgcctaattacaatctgatcatcatggacgaggcccacttcaccgacccggccagcatcgcagcccgcggttacatctccactcgggtggagatgggcgaggccgccgggatcttcatgacggccacgccccccggcagccgcgaccccttcccgcagtccaacgcgcccatcatggacgaggagcgggagatacccgagcggagttggaattccgggcacgagtgggtcaccgatttcaagggcaagaccgtatggttcgtgcccagcatcaaggcagggaacgacatagccgcctgcctacgcaagaacggcaagaaagtcatccagctgtcccgaaagactttcgactctgagtacatcaagacccggaccaacgactgggacttcgtggtgacgacggacatttctgagatgggcgcgaacttcaaggccgagcgcgtgatcgatccgcggcgctgcatgaagcccgttatcctgaccgacggggaggagcgggttatactcgccggccctatgcccgtcacgcatagctccgcggcccagcgccggggacgcgtgggccgcaatccgaagaatgagaacgaccagtatatctacatgggggagcccctggagaacgacgaagattgcgcgcactggaaggaggccaagatgctactcgacaacatcaacactcccgaggggatcatacccagcatgttcgagcccgagcgggagaaagttgacgccatcgacggcgagtaccgcttgcgcggggaggctcgcaaaacgttcgttgacctgatgcggcgcggcgacctccccgtgtggctggcctacagggttgcggccgaggggatcaactacgccgaccgccgttggtgcttcgacggggttaagaacaaccagatcctggaggagaacgtcgaagtcgaaatctggaccaaggaaggggaacgcaagaagctcaagccgcggtggctggacgcccgcatctactccgacccgttagccctgaaggagttcaaggagttcgcggctggacgcaagagccttaccttaaacctcatcaccgagatgggccggctgcccacgttcatgactcagaaggcccggaacgccctggacaatttggcggtgctgcacaccgccgaagccgggggccgcgcctacaaccacgccctgtccgagctccccgagaccctggaaacgttactactgttgaccctcctcgcgaccgtgaccgggggcatctttttattcctcatgagcggcaaggggattggcaagatgaccctggggatgtgttgcatcatcacggcctccattctgttatggtacgcccagatccagccgcactggatcgccgccagcatcatcctagagtttttcctgatcgtgcttcttatacctgagcccgagaagcagcgcacgcctcaggataaccagctgacctacgtagtgatcgcgatcctcaccgtcgtggctgccacgatggccaatgagatggggttcctggagaaaacaaagaaggatttcgggctgggctccatcaccacccagcaacctgagagcaacatcctcgacatcgacctgcgcccggccagcgcatggactctgtacgccgtggccaccacctttatcacccccatgctccggcactccatcgagaactcaagtgtgaacgtgagcctgacggccatcgcgaaccaggcgactgtgctgatgggcctcgggaagggctggccactgtctaagatggacatcggcgtccccctgctggcaatcggctgctacagccaggtgaacccaatcaccctgaccgccgccctcctcttgctggtggcgcactacgccatcatagggcccggcctccaggccaaggccacgcgcgaggcccagaagcgggcggccgccggcatcatgaagaaccccaccgtcgacgggatcaccgtgatcgatctggaccccatcccgtacgaccccaagttcgagaagcagctggggcaggtgatgctcctagtcctctgcgtcacccaagtgttaatgatgagaacgacctgggccctgtgcgaggccctgaccctcgcgactgggcccatctccacgctgtgggaaggcaaccccgggcgcttctggaacaccaccatcgccgtcagcatggccaacatcttccggggatcctacctggccggcgccgggctcctgttctcaatcatgaagaacaccgcgaacacgcgccggggcaccggcaacaccggtgagaccctgggcgagaaatggaagaaccgcctcaacgccctggggaagagtgaattccagatctacaagaagtccggtatccaagaggtggaccggactctggcgaaggaggggatcaagcgaggcgagactgatcaccacgccgtgagccgggggagcgcgaagctccgctggttcgtcgagcggaatttagtgacccccgagggcaaggtggtagacctgggctgcgggcgcggcggctggtcctactactgcggcgggctcaagaacgttaaggaagtgaagggcctcaccaagggcgggcccggccacgaggagcccatccccatgagcacgtacgggtggaacctggtccggctgcagtccggcgtcgacgtcttcttcaccccgcccgagaaatgcgacaccctgttatgcgacataggggagagctcccccaaccctaccgtcgaggccggccgtaccctccgggtcctgaatcttgtggagaactggctcaacaacaacacgcagttctgcatcaaggtcctgaacccgtacatgcccagtgttatcgaaaagatggaagccctgcagcgcaagtacggcggggccctggtgcggaacccactcagccgcaactccacccacgaaatgtactgggtcagcaatgcttccggaaacatcgtgagctcggtaaatatgatcagcaggatgctgatcaaccgcttcaccatgcggcacaaaaaagcgacctacgagccggacgtagacctggggtccggtacgcgcaacatcggtatagagtctgagaccccgaaccttgacatcatcggcaagcgcatcgagaagatcaagcaggagcacgagacctcctggcactacgaccaggaccacccctacaagacttgggcctaccacggctcgtacgagacgaagcagactgggtccgccagctccatggtaaacggcgtggtccggctgctgaccaagccttgggacgtgatcccgatggtgacccagatggccatgacggacactacgcccttcgggcaacagcgcgtcttcaaagaaaaggttgacacccggacgcaggagccgaaggagggcaccaagaagctgatgaagatcaccgccgagtggctgtggaaggagctgggccgcaagaagacgccccggatgtgcacgcgcgaggagttcacccggaaggtccgcagcaacgcggccctcggggcgatcttcaccgacgagaacaagtggaagagtgcccgggaggccgtggaggactcgggcttctgggagctagtggacaaggagcgcaacctgcacctcgagggcaagtgcgagacctgtgtttacaacatgatgggcaagcgggaaaagaagctgggagagtttggaaaggcgaaggggtcccgcgccatctggtacatgtggctgggggcccgcttcctcgagttcgaggccctgggcttcctgaacgaggaccactggttcagccgcgagaattcccttagcggggtagaaggcgaggggctgcacaagctgggctacatcctccgggacgtgtctaagaaggagggcggggcgatgtatgccgacgacacggccggctgggacacccgcatcaccctggaggacctgaagaacgaggagatggtcaccaaccacatggagggggagcacaagaagctcgccgaggccatcttcaaactgacgtaccagaacaaggtggtgcgggtccagcgaccaacgccgcggggcaccgtgatggacatcatctccagacgggaccagcgggggtcaggccaggtggtcacctacggactgaataccttcactaacatggaggcgcagttaattcgccagatggagggagagggcgtatttaagtctatccagcagctgaccgtgaccgaggagatcgcggttaagaactggctggcccgggtggggagggaacgcctctcacgaatggctatctccggtgatgactgtgtagtaaagcccctggacgaccggttcgccagcgcgctgacggcgctgaacgacatgggcaaggtacgcaaggacatacaacagtgggagccctcccggggatggaacgattggacccaggtgccgttctgcagccaccacttccacgagctgataatgaaggacggccgcgtcctggtggtgccctgccgcaaccaggacgagctcatcgggcgcgcccggatctcccagggcgccgggtggagcctgcgcgagaccgcctgcctgggcaagtcctatgctcaaatgtggagcctcatgtacttccaccgtcgcgacctgcgactggccgccaacgcaatctgctccgctgtccccagccactgggtgcccacatcgcgcacaacgtggagcatccacgcgacgcacgagtggatgaccaccgaggacatgctaacggtgtggaaccgggtctggatccaggagaacccgtggatggaggacaagaccccggtggagtcctgggaggagatcccctacctgggcaagcgcgaagaccagtggtgcgggagcctgataggattaaccagccgggccacctgggccaagaacatccagacggcaatcaatcaggtgcgctccctgatcggaaacgaagagtacaccgactatatgccaagcatgaagcgcttcaggcgcgaggaggaggaggcgggtgtcctgtggtga

SEQ ID NO: 25541 - RNA, 9876 nt, synthetic construct
  misc_feature 1..9876: note = derived and/or modified CDS sequence (opt11) from DENV-2__GQ398258__SS-prME
  source 1..9876: mol_type = other RNA
accgccgggatgatcatcatgctgatacccaccgtgatggccttccacctcaccacacgcaatggggagccccacatgatcgtaagccggcaggagaagggcaagagtctgctcttcaaaaccgaggacggggtgaacatgtgcaccctcatggcgatggacctgggcgagctgtgcgaggacactatcacatacaactgccccctgctgcgccaaaacgagcccgaggacatcgattgctggtgcaacagcactagcacctgggtcacatacgggacctgcaccgccaccggcgagcaccggcgcgagaagagaagcgtcgccttggtgccccacgtcggcatggggctcgagacccgcaccgaaacctggatgtcttcggagggcgcctggaagcacgctcagcgcatcgagacctggatcctgcgccacccggggttcaccattatggcggccattctggcctacaccatcggtaccacctacttccagcgagtcttgatcttcatcctgctcactgccgttgcgccctcgatgaccatgcgctgcatcgggataagcaaccgggacttcgtagagggcgtctccggcgggagctgggtggacatcgtgctcgagcacggctcctgcgtcaccaccatggccaagaacaagcccacgcttgacttcgagctaatcaaaacggaggctaagcagcccgccaccctccgcaagtactgcatcgaggccaagctgaccaatacgaccaccgcgagccggtgcccgacccagggagaaccctccctgaacgaggagcaggacaagaggttcgtatgtaaacacagcatggtggaccggggctggggcaatgggtgtggcctctttgggaagggcgggatcgttacgtgcgccatgttcacgtgtaagaagaatatggagggcaaggtggtgcaacccgaaaacctggagtacaccatcgtcatcacgcctcactccggtgaggaaaacgccgtggggaacgacacgggtaagcacgggaaagagatcaagatcaccccgcagagttccatcaccgaggctgagttaaccggttacgggaccgttacgatggagtgcagcccccgcaccggcctcgactttaacgagatggtcctgctgcaaatggaaaacaaggcctggctcgtgcaccggcagtggttcctggacctgcctctcccctggctgccgggcgcggacacccaggggtccaactggatccagaaggagaccctggtaacgttcaagaacccacacgccaagaagcaggacgtcgtagtcctaggcagccaggagggggcgatgcacaccgccctgaccggcgccaccgagatccagatgagctccgggaacctcctgttcacgggccatctgaagtgcagactgaggatggacaagctccagctgaagggcatgtcatactccatgtgcaccgggaagttcaaagtcgtaaaggagatcgcggagacccagcacggcaccatcgtcatccgagtgcagtacgagggggacggctcgccctgcaagatccccttcgagataatggacctggaaaagcggcacgtgctcggccgcctgatcacggtcaatccaatcgtgaccgagaaggactcccccgtgaacatcgaggccgaaccccccttcggggatagctacatcatcatcggcgtcgagccagggcaactgaagctcaactggttcaagaagggcagtagcatcgggcagatgtttgagaccaccatgcgcggcgcaaagcggatggccatcctgggcgatacggcctgggacttcgggtccctgggcggggtgttcacaagcatcggcaaggcgctccaccaggtcttcggagccatatacggcgccgccttctccggcgtcagctggaccatgaagatcctgatcggtgtcgtgatcacctggatcggcatgaactcccgcagcacgtccctgagcgtctccctcgtgctcgtgggtgtcgtgacactgtacctgggcgtgatggtccaggcagactcagggtgcgtggtgtcctggaagaacaaggaactcaagtgcgggagcggcatctttatcacagacaacgtccatacctggacggagcaatacaagttccagcccgagagcccctccaagctggccagcgccatccagaaggcccacgaagaggggatctgcggtatccggtccgtgacccgcctggagaacctcatgtggaagcagatcactccagagttgaaccacatcctgtcggagaacgaggtgaagttaacaatcatgacgggggacatcaagggcatcatgcaggccgggaagcggtccctgcgcccgcagcccaccgagctgaagtacagctggaagacctggggcaaggcgaagatgctctctaccgagctccataaccagacgttcttgatcgacggtcccgagaccgccgagtgcccgaacaccaaccgggcctggaatagcctcgaggtcgaggactatgggttcggcgtgttcacaacgaacatctggttgaaactgaaggagcgccaggacgtgttttgcgaccccaagctcatgtccgccgcaatcaaggacaaccgggcggtccacgccgatatggggtactggatcgagagcgccttaaatgacacctggaagatagagaaggcctccttcatcgaggtcaagagctgccactggcccaagtcccacaccctgtggtctaacggcgtgctcgagtccgagatgatcatccccaagaacttcgcaggccctgtgagccagcacaactatcgccctggttaccacacccagaccgcaggcccctggcacctggggaagctagagatggacttcgacttctgcgagggcactaccgtggtggtcaccgaagactgcggtaaccggggtcctagcttacgcaccacgaccgcatcgggcaagctgatcaccgaatggtgctgccggagctgcacgctgccgcccctccgctacaagggtgaggacggctgctggtacgggatggagatccggcccctgaaagagaaggaggagaacctggtgaactccctcgttactgccggccacgggcagatcgacaacttcagcctaggtgtgctgggcatggccctcttcctggaggagatgctgcgtacccgggtggggaccaagcacgcgatcctactggtggccgtttccttcgtgaccctcatcacgggcaacatgagcttccgcgaccttggacgggtgatggtcatggtgggcgctaccatgaccgacgacatcgggatgggagtgacctacctggccctgctcgcagcgttcaaggtccgccccacgttcgccgccggtctgctgctccggaagctgacctccaaggagctgatgatgaccacgatcgggatcgtgctcctgagccaatccacgatcccggagaccatcctggagctcaccgacgccctggcactgggcatgatggttctcaagatcgtgaagaacatggagaagtaccagctggccgtgaccatcatggccatcctgtgcgtccccaacgccgtgatcctacagaacgcctggaaggtgagctgcacaatcctggccgtcgtgtccgtgagccccctgttactgacctccagccagcaaaaggcggactggatacccctggccttgaccatcaaggggctcaacccgaccgccatttttctgacaaccctatcccggaccagcaagaaacgatcctggcccttaaatgaggccattatggcagtcggcatggtctcaatcctggcctccagcctcctgaagaacgacatccccatgaccggccccctggtcgccgggggcctcctgaccgtctgctacgtgctgaccgggcggtccgccgacctcgaactggagcgggccgcggacgtccggtgggaggaccaggccgagatcagcggctcctccccgatcctgtcgatcaccatctccgaggacgggagcatgtccatcaagaacgaggaagaggaacagaccctcacgatactgatacgcaccggcctgcttgtcatcagcggtctgtttcctgtgtccatccccattactgccgccgcctggtacctgtgggaggtgaagaagcagcgggcgggggtcctctgggacgttcccagcccgccacccgtggggaaggccgagctggaggacggggcctacaggatcaagcaaaaaggcatactggggtattctcagatcggcgccggcgtctacaaggaagggaccttccacaccatgtggcacgtgacgcgcggcgccgttctcatgcacaaggggaagcgcattgagccgagctgggcggacgtgaagaaggacctgatctcctacggcggcggctggaagctggagggcgagtggaaagagggggaggaggtacaggtgcttgcccttgagcccggcaagaacccccgggccgtccagactaagcccgggttgttcaagaccaacaccggaacgataggggccgtgagccttgacttctccccgggcaccagcggctcccccatcgtggataagaaggggaaggtcgtgggcctgtacggtaacggcgtggtaaccaggagcggcacatacgtgtccgcgatcgcgcagacggagaagtccatagaggacaatcccgagatcgaggacgacatcttccggaaaaagcgcctgaccatcatggacctgcaccccggggccggcaagaccaagcggtacctgccggccatcgtgcgcgaagccatcaagcgggggttgcgaacgctgatcctcgcgcccacgcgggtcgtggccgccgaaatggaggaggccctgcgcggactgcccattcggtaccagacccctgccatccgcgcggagcacaccgggcgcgagatcgtggacttgatgtgccatgccacatttacaatgcggctgctgtccccagtgcgcgtgccaaactacaacctcatcatcatggacgaggcccacttcacggaccccgccagcatcgcggcccggggctacatcagcacccgagtggagatgggcgaggccgccggaatcttcatgaccgccaccccgccgggcagccgggacccctttccccagagcaacgcccccataatggacgaggagcgcgagatcccggagcgctcctggaatagcgggcacgaatgggtcaccgactttaagggcaagaccgtgtggttcgtgccctccatcaaggcggggaacgacatcgctgcctgcctacgaaagaacggcaaaaaggtgatacagctgtctcggaagaccttcgactccgagtacatcaagacgcgcaccaacgattgggacttcgtggtgacaaccgacatcagcgagatgggcgccaatttcaaggcggaaagagtcatcgacccccgccggtgcatgaagcccgtgatcctcacggacggtgaggagcgtgtgatcttggccggcccgatgcccgtcacccactccagcgccgcccagaggcgcgggcgtatcggccgcaaccccaagaacgagaacgaccaatacatctacatgggggagccactggagaacgacgaggactgcgcccactggaaggaggcgaagatgctcctagacaacatcaataccccggagggcattatcccctccatgtttgagccagaacgggaaaaggtggacgccatcgacggcgaataccgcctgcgcggggaggcccggaagaccttcgtggaccttatgcgccggggcgatctgccggtctggctggcctaccgcgtggcagcggaagggatcaactacgccgaccggcgctggtgcttcgatggcatcaagaataaccagattctcgaggagaatgtcgaggttgagatttggacgaaggagggggagcggaagaagctcaagccccgctggctggacgcccggatctactcagaccccctcgccctgaaggagttcaaggagtttgcggcgggccgaaagtccctgactttgaacctgatcaccgagatgggacggctgcccaccttcatgacgcagaaggcccgcaacgctctcgacaacctagccgtgctgcacaccgcggaagccggcggccgggcatacaaccacgcactcagcgagctgccggaaaccctggagaccctcctgctgctcacgctgctggctaccgtcaccgggggtatcttcctcttcctgatgtccgggaagggaatcggcaagatgacgctggggatgtgctgcattattaccgcgagcatcctcctgtggtacgcccagatccagccacactggatcgccgcctccatcatcctggagttcttcctcatcgtgcttcttatccccgagcccgagaagcagcgcacgccgcaggataaccagctaacttacgtggtgatcgccatcctgaccgtagtggcggccaccatggccaacgagatgggcttcctggagaagaccaagaaggacttcggactcggcagcatcgccacccaccagccagagtccaacatccttgacatcgacctgcggcccgccagcgcgtggaccctctacgccgtcgcaaccacgttcattacccccatgctccgccacagcatcgagaactcaagcgtgaatgtgtcgctgaccgccatcgctaaccaggcgaccgtcctcatgggcttggggaaggggtggccactgagcaagatggacatcggggtgcccctcctggccatcggctgctactcccaggtgaaccccattacgctcaccgccgccctcttactgctcgttgctcactatgccataatcgggcccggcctgcaggccaaggccacccgggaggcccagaaacgcgcagccgctggcatcatgaagaacccgacggtagacggtatcactgtgattgacctggatcccataccctacgatcccaagttcgagaagcagctcggccaggttatgctgctggtgctctgcgtgacccaggtcctgatgatgcggactacctgggcactgtgcgaggccttgacgctggcgaccgggcctataagcaccctgtgggagggcaaccccgggcgcttctggaacaccacgatcgccgtgtccatggccaacatcttccggggaagctacctcgccggcgccgggctgctgttttccattatgaagaacacagccaatacccgcagaggcacgggcaacaccggcgagaccctcggcgagaagtggaagaaccggctgaacgccctgggaaagtccgagttccagatatacaagaagtccggcatccaggaggtggaccgcaccttggccaaggagggcatcaagcggggagagaccgaccaccacgccgttagccgcgggtccgcgaagctgcggtggtttgtggagcgcaaccttgtgacgcccgaaggcaaggtcgtggacctcggctgcggtagaggtgggtggagctactattgcggtgggctgaagaacgttcgagaagtcaagggcctgaccaagggcggacccggccacgaggagccgatccccatgtccacctacggatggaacctcgtgcggctgcagagtggcgtggacgtgttcttcacgccacccgagaagtgcgacacgctgctttgcgacatcggagagagtagcccgaaccccacggtggaggccggccgcaccctgcgggtgctgaacctcgtggagaactggctcaacaacaacacccagttctgcatcaaagtgctgaacccctacatgccgagtgtgatcgagaaaatggaagccctgcagcgcaagtacggcggagccctcgtccggaaccccctgtcacgcaacagtacacacgagatgtactgggtatccaatgccagtggcaacatcgtatccagcgtcaacatgatctcccggatgctcatcaaccgcttcacgatgcgacacaagaaggccacctacgagcccgatgtagacctcgggagcggcacgcgcaacatcgggatcgagtccgagacccccaacctggacatcatcggcaagcgtatcgagaaaatcaagcaggagcatgagacgagctggcactacgaccaggatcacccgtacaagacctgggcctatcacggctcctacgagaccaagcagactgggagcgccagctccatggtgaacggggtcgtgcgcctgctcacgaagccctgggacgtgatccccatggtcacccagatggccatgaccgacacaacgcccttcgggcagcagcgcgtgttcaaggagaaggtggacacccggacccaggagccgaaggagggcaccaagaagctcatgaagatcacggccgagtggctgtggaaggagctcggaaagaaaaagacaccccgcatgtgcaccagagaagagttcacccgaaaggtccggtccaacgcggccctcggcgcgatattcacagacgagaataaatggaagtcagcccgcgaggccgtggaggactcccggttctgggagctggtcgacaaggagcgcaatctccacctggaaggcaagtgcgagacctgcgtgtacaacatgatggggaaacgggagaagaagctgggggagttcggcaaggccaagggaagccgtgccatctggtacatgtggctcggcgcccggttcctagagttcgaggccctggggttcctcaacgaggaccactggttctcccgtgagaacagcttgtccggcgtggagggtgagggcctgcacaaattggggtacattttacgtgacgtcagcaagaaggagggcggcgcgatgtacgccgacgacacggccgggtgggatacccgcatcacgctcgaggacctcaagaacgaggaaatggtaaccaaccacatggagggcgagcacaagaagctggcagaggccatcttcaagctgacctaccagaacaaggtggtccgggtgcagcggcccacgccccgggggacggtgatggacatcatcagccgccgggaccagcgcggatccggccaggtcggcacctacggcctcaacaccttcaccaacatggaggcgcagttaatccggcagatggagggggagggcgtgttcaagagcattcagcacctgacggtgaccgaagagatcgcggtccagaactggctcgcccgcgtggggcgcgaacggctgtcccgcatggccatcagcggggacgactgcgtggtcaagccactagacgaccggttcgcctccgcgctcaccgccctgaacgatatgggcaaagtgcgcaaggacatacagcagtgggagcccagccgggggtggaacgactggacccaggtgcctttctgctcccaccacttccatgagctgatcatgaaggacggccgcgttctcgtggtgccatgccggaaccaggacgaactgatcgggcgcgcccggatctcgcagggcgccggatggtcgctgagagagacggcctgcctcggcaagagctacgcacagatgtggtccctgatgtacttccaccggcgcgacctacggctcgcagccaacgccatctgctccgccgtcccgtcccattgggtgccaaccagccgcactacctggtccatccatgcgaggcacgagtggatgaccacggaggacatgctgactgtgtggaaccgcgtctgggtgcaggagaacccctggatggaggataaaaccccggtggagagctgggaggagatcccgtacctgggcaagcgggaggaccagtggtgcgggtccctcatcggcctaaccagccgcgccacgtgggccaagaacatccagacggccatcaaccaggttcggagcctgattggaaacgaggagtataccgactacatgccgtccatgaagcggtttagacgggaggaggaggaagcgggcgtgctttggtga

SEQ ID NO: 25542 - RNA, 9876 nt, synthetic construct
  misc_feature 1..9876: note = derived and/or modified CDS sequence (opt11) from DENV-2__GQ398259__SS-prME
  source 1..9876: mol_type = other RNA
accgccggaatgatcatcatgctcatcccgaccgttatggcgttccatctcaccacgcgcaacggggagcctcacatgattgtgtcccggcaggagaagggcaagagtctgctgttcaagaccgaggacggggttaacatgtgcaccctcatggcgatggacctgggtgagctgtgcgaggacaccatcacctacaactgccccctcctgcgccagaacgagcccgaggacattgattgctggtgcaacagcacctccacttgggtgacctacgggacctgcaccgccaccggtgaacacagacgcgagaagcggagcgtcgcccttgtgccgcacgtgggcatggggctcgagacccgcaccgagacctggatgtccagcgagggcgcctggaagcatgcccagcggatagagacgtggatcctgagacaccccggtttcacgataatggcagccatcctggcctatacaatcggcaccacctacttccagcgggtcctcatcttcatcctgctgacggccgttgcgccctcgatgaccatgcgctgcatcgggatcagcaacagggacttcgttgaaggcgtctccggcgggagctgggtggacatcgttctcgagcacggctcctgcgtcaccaccatggcgaagaacaagcctacgctcgacttcgaattgataaaaaccgaggccaaacaacccgccaccctccgcaagtactgcatcgaggccaagctaaccaacacgacgaccgcgagccggtgcccgacccagggagagcccagtctcaacgaggagcaggacaagcgcttcgtgtgcaagcacagcatggttgaccggggctggggcaacgggtgtggccttttcgggaagggcgggattgtcacgtgcgccatgtttacgtgcaagaagaacatggaaggaaaggtggtgcagcccgagaatctggagtacaccatcgtcatcacgccccactccggtgaagagaacgccgtggggaacgacacgggcaagcacgggaaggagataaagatcaccccgcagagctctatcaccgaggccgagctgacaggctacgggaccgttacgatggaatgcagcccccgcaccggcctggactttaacgagatggtgttgctgcagatggagaacaaggcctggctcgttcaccggcagtggttcctggacctgcccctcccctggctgccgggcgcggacacccaggggtccaactggattcagaaagagacgctagtgactttcaaaaacccccacgcgaagaaacaggatgtagtggtcctcggctcccaggagggggccatgcacaccgccctgaccggtgcaacggagatccaaatgagctctgggaatctcctgttcacgggccacctgaagtgtcgcttacgaatggataagctccagctgaaaggcatgagttattccatgtgcaccgggaagttcaaggtggtgaaggagatagcggagacccagcacgggaccatcgtcatccgggtgcagtacgaaggagacggctccccgtgcaagattccgttcgagatcatggacctggaaaagcggcacgtactcggccgcctgataacggtcaatcccatcgtgaccgagaaggactcccccgtgaacatcgaggccgagccgcccttcggtgacagctacatcataatcggcgtcgagccggggcagcttaagctcaattggttcaagaagggatcctctatcgggcagatgttcgagacgaccatgcgcggcgccaagcggatggcaatcctcggggacacggcctgggacttcgggtccctgggcggggttttcacctctatcggcaaggcgctccaccaggtttttggggccatctacggagccgccttctccggcgttagctggaccatgaagatcctgatcggggtggtgataacctggatcggcatgaattcgcgttctacgtccctgagcgtatcccttgtgctcgtgggcgtcgtgaccctgtacctgggcgtgatggtccaagcggatagcgggtgcgtggtgtcctggaagaacaaggagctgaaatgcggcagcgggatcttcatcaccgacaacgtccatacctggacggagcagtacaaattccagcccgagagcccttccaagctggcctctgcgatccagaaagcccatgaggaggggatatgtggcatcagatccgtcacacgcctggagaacctcatgtggaaacagatcacccccgagctgaaccacatcttaagcgagaacgaggtgaagctcaccatcatgacaggggatatcaaaggcatcatgcaggcagggaagcggtccctgcgcccgcagccaaccgaactgaagtacagctggaaaacctggggaaaggcgaagatgctctccaccgagctgcacaaccaaacgttcctgatcgacggccccgagaccgccgagtgcccgaacacaaaccgggcctggaacagcctcgaggtcgaggactacgggttcggcgtgttcaccaccaacatctggctgaagctgaaggaacgccaagacgtgttttgtgactccaagctcatgagcgccgccatcaaagacaaccgggctgtccatgccgacatggggtattggattgagtccgccctgaacgacacatggaaaatcgagaaggccagcttcatcgaggtcaaatcatgccactggcctaagagccacaccctgtggtccaatggcgtgctcgagagcgagatgatcatccccaagaacttcgcaggcccagtctcccagcacaactatcgcccggggtatcacacccagaccgcgggaccatggcacctcgggaagctggagatggacttcgatttctgcgaggggacgaccgttgtggtcaccgaggactgcgggaatcgggggccgagcctccgcaccacgaccgcctctggcaagctaatcaccgagtggtgctgccggtcctgtaccctgccccccctccgctataagggggaggacggctgctggtatgggatggaaatccggcccctgaaggagaaagaagagaacctggtgaacagcctagtgacggccggccacggacagatcgataatttcagcctgggcgtactgggcatggccctcttcctggaggagatgctgcgcactcgcgtagggaccaagcacgcgatcctccttgtggccgtcagtttcgtgaccctgattacgggcaacatgtccttcagggacctcgggagggtgatggtcatggtgggcgctaccatgacagacgacataggaatgggagtgacctacctagccctgctcgccgcgttcaaagtccgccccacgttcgctgccggcctgctgctccgcaaactgaccagcaaggagctgatgatgaccaccatcggaatagtgctcttatctcagagcacgattcccgagaccatcctggaattaaccgacgcccttgctctgggcatgatggtgctcaagattgtcaagaacatggagaagtaccaactggccgtgactatcatggccatcctgtgtgtacctaacgccgttatcctccagaacgcctggaaggtgtcttgcacgatcctggccgtcgtaagcgtgagccccctgctcctgacctcttcccagcagaaggcggactggatccccctggccctcaccataaagggtctgaaccccacagccatcttcctgacgacactctctcggacctccaagaaacgctcttggccgctaaacgaggccatcatggccgtaggcatggtgtctatcctggcaagctctctcctgaagaacgacattccaatgaccggccccctggtcgctggcggcctccttacggtgtgctatgtgttaaccgggaggtctgccgacctcgagctcgagcgtgccgctgatgtacggtgggaggaccaggccgagataagcggctccagccccatcctgtccatcacgatcagcgaggacgggtccatgagcataaagaacgaagaagaggagcagaccctcacgatcctgattcgtacaggtctgctcgtcatcagtggactgttccctgtgagcatccccatcaccgccgccgcctggtacctgtgggaggtgaagaagcagcgagcgggtgtcctctgggacgtgcctagcccgccgcctgtgggcaaggccgagttagaggacggtgcctaccgcatcaagcagaagggcatcctggggtacagccagattggtgccggcgtgtacaaggagggtaccttccacaccatgtggcacgtgacgcggggcgccgtactcatgcacaaggggaagcgaatcgagccctcctgggccgacgttaagaaagacctgatcagctatggcggggggtggaagctggagggcgagtggaaggagggggaggaggtccaggtgcttgcgctggagcccggcaaaaacccccgtgccgtccagactaaacccgggttgttcaagaccaacaccggcactatcggtgccgtgtcgctcgacttcagtcccggcacctctggcagtccgatagttgacaagaaggggaaggtcgtggggctgtacgggaacggtgtggtcacccgctccggtacctatgtctctgccatcgcgcaaacggagaaatccatcgaggacaatcccgagatagaggacgatatcttccggaagaagcgcctgaccatcatggacctgcacccgggggccggcaagaccaaacggtacctccctgccatcgtgcgcgaggccatcaagcgggggctgcgcactttgatcctcgcgccgacacgcgtggttgccgcggagatggaggaggccctgcgcggtctgcccatccggtaccagacccccgccatccgcgccgagcacaccggccgcgagatcgtggacctcatgtgccacgccaccttcacgatgcggctactgtctccggtccgtgtgcccaactataacctcatcatcatggacgaggcccacttcacagaccctgccagcatcgccgcgcggggctacatctccacccgagtggagatgggcgaggctgccgggatcttcatgaccgccacgccgcctggtagccgggacccgtttccgcagagcaatgcccccatcatggacgaagaacgagagatccccgaacggagctggaactccgggcacgagtgggtcaccgattttaaggggaagacagtgtggttcgtcccgagcatcaaggccgggaatgacatcgcagcctgcttgcgcaaaaacggcaagaaagtcatccagctgagccggaagaccttcgacagcgagtacatcaagacgcgcactaatgactgggactttgtggtgaccacagatatctccgagatgggtgccaacttcaaggcagagcgggtcatcgacccccgccggtgcatgaaacccgtgatcctcaccgacggggaggagcgcgtgatcctggccggccccatgccggtcacccacagctccgccgcccagcgcagggggcggatcggccgcaaccccaagaacgagaatgaccagtacatctacatgggagagcctctggagaacgacgaggactgcgcgcactggaaggaggcaaagatgctcctggacaacatcaacacccccgagggcatcataccgagcatgttcgagccagagcgggagaaggtggacgccatcgacggagagtaccgccttcggggggaagccaggaaaactttcgtggatctcatgcgccgcggcgacctgcccgtctggctagcctaccgcgtagcggcggaagggatcaactacgctgaccggcgctggtgcttcgatggaatcaagaacaatcaaattttggaggagaacgtagaagtggagatctggacgaaggagggcgagcggaagaagttaaagccgcgctggctggacgcacggatctactccgacccgttagccctgaaggagttcaaggagttcgccgcgggccgcaagtctctgacgttaaacctgatcacagagatgggccggctgcccaccttcatgacacaaaaagcccggaacgccctcgacaacctggccgtgttgcacaccgccgaagccggggggcgggcctacaaccacgctctatccgagctgcccgagaccctggagaccctcctgttactgacgctgctggccacggttaccgggggcatattcctcttcctgatgagcggcaaggggatcggcaaaatgacactagggatgtgctgtatcatcaccgcctccatcctcctatggtacgcccagatacagccgcactggatagcagcaagcatcatactggagttcttcctcatcgtgctgttaatcccggaacccgagaagcagcggacgccacaggacaatcagctgacctacgtggtcatcgccatcctgaccgtggttgcggccaccatggccaacgagatggggttcttggagaaaacgaagaaggacttcgggttgggatccattgccacccaccaaccggagagcaacatcctggacatcgacctgcggcccgcctcggcttggacgctctacgccgtcgccaccacgttcataacccccatgctgcgacactccatcgagaacagctcagtgaacgtgagcctgaccgcgatcgccaaccaggcgaccgtgctgatgggcctggggaagggctggcccctgtccaagatggacataggtgtacccctcttagctatcggttgctacagccaggtcaatcccatcaccctgaccgccgcgctcctgctgctcgtcgcgcactatgccattataggccccggcctgcaggccaaggccacgagggaggcccaaaaacgcgcggccgccggcattatgaagaaccccaccgtggacgggatcacggtgatcgacctcgacccgatcccctacgaccccaagttcgagaagcagctcggccaggttatgctgctggtgctctgcgtgacccaggtcttgatgatgcgtaccacatgggccctgtgcgaagccctcactctagcgacggggccgatctccaccctctgggagggcaacccagggcgcttctggaacaccacgatcgccgtgagcatggccaacatctttcggggctcctacctcgccggcgcgggactgttgttttctatcatgaaaaacaccgcgaacacccgccgcggcaccgggaacacgggggagaccctcggcgagaagtggaaaaaccgtctgaacgccctggggaagtcagaattccagatctacaagaagtccggcattcaggaagtggatcgaaccttagcgaaggaggggatcaagcggggcgagaccgaccaccacgcagtctcccgcgggagcgcgaagctgcggtggttcgtggagcgtaacttagtgacgcccgagggcaaggtcgtggacctcggctgcgggcgaggggggtggtcctactactgcggaggactcaagaacgtgcgcgaggtcaagggcttgaccaagggcgggcccggccacgaggagcccatccccatgagcacctacgggtggaacctcgttcgtctgcagtccggcgttgacgtcttcttcacaccgccggagaaatgcgatacgctgctgtgcgacatcggtgagagctcacccaacccgaccgtggaggccggccgcaccctacgggtgctcaacctggtcgagaactggctgaacaacaacactcagttctgcatcaaggtgctgaacccctacatgcccagcgtgatcgagaagatggaggccctgcaacggaagtacgggggagcgctcgtacggaacccgctgagccgcaactccacccacgagatgtactgggttagcaacgccagcggtaacatcgtttcctccgtcaacatgataagccggatgctcatcaaccgcttcacgatgcggcacaagaaggcgacctacgagcccgacgtggacctcgggagcggcacccgcaacatcgggatcgagagcgagacccccaacctggacatcattggcaagcggatagaaaagatcaaacaggagcatgagacgtcctggcactacgaccaggaccacccctacaagacctgggcgtaccacggaagctatgaaaccaagcagaccgggtccgctagctccatggtgaacggcgtcgtacgcctgctcacgaagccatgggacgtgatccccatggtcacacagatggccatgacagatacgacgccattcgggcagcagagagtcttcaaggagaaggtggacaccaggacccaggagcccaaggagggcaccaagaagctgatgaagatcactgccgagtggctgtggaaggaattgggaaagaagaagacaccgaggatgtgcacgcgcgaggagttcacccgtaaagtcagaagcaacgcggccctgggggccatcttcaccgatgagaacaagtggaagtccgcccgcgaggcggtggaggacagccggttctgggagctggtcgataaggagagaaacctccacctggagggcaaatgcgaaacgtgcgtgtacaacatgatggggaaaagagagaagaaactgggcgagttcgggaaggccaagggctcccgcgccatctggtacatgtggttaggcgcccggttcttagagttcgaggccctggggttcctcaacgaggatcactggttcagccgcgagaactctctgagcggcgtggagggggagggcctgcacaagctagggtacatactgcgggacgtcagcaagaaggagggcggagctatgtacgccgacgacaccgctgggtgggacacccgcattacgctggaggacctcaagaacgaggagatggtgaccaaccacatggaaggggagcacaagaagctagccgaagccatcttcaagctgacataccagaacaaagtggtccgggtacagcggcccacgccccgggggacagtgatggacatcatctcccgccgagatcagcgcggcagcggacaggtcggcacctacggcctcaacacgttcaccaatatggaggcgcagctgatccggcagatggagggcgagggcgtgttcaagtcaatccagcacctgacggtgaccgaagagatcgcggtgcagaactggctcgcccgcgtggggcgagagagactgagccgcatggccatctccggagacgactgcgttgtaaagcccctggatgaccggttcgcgtcggcgctaaccgctctgaacgacatggggaaggtgcgcaaggacatccagcagtgggagccgtcccgggggtggaacgactggactcaagtgcccttctgcagccatcatttccatgagctgatcatgaaagacggccgcgtcctcgtggtgccctgccggaaccaggacgagttaatcgggcgcgcacgtatctcgcagggcgccgggtggagtttacgcgagaccgcctgcctgggcaagtcctatgctcaaatgtggagccttatgtactttcaccggcgcgacctacggctagccgccaacgccatctgctccgccgtcccctctcactgggtgcccacttccaggaccacctggagcatccacgcgcggcatgagtggatgaccactgaagacatgctgaccgtgtggaaccgcgtctgggtacaagaaaacccctggatggaggacaagacccccgtggagtcctgggaggaaatcccttacctgggcaagcgggaggaccagtggtgtgggagcttgataggtctgaccagccgtgccacgtgggccaaaaacatccagaccgccatcaatcaggtccgttccctaattgggaacgaggagtacacagactacatgccgagcatgaagcgcttccggcgggaggaggaggaggcgggcgtgctctggtga

SEQ ID NO: 25543 - RNA, 9876 nt, synthetic construct
  misc_feature 1..9876: note = derived and/or modified CDS sequence (opt11) from DENV-2__GQ398268__SS-prME
  source 1..9876: mol_type = other RNA
actgccggcatgataatcatgctgatccctaccgtgatggccttccacctcaccacccggaacggggaaccccatatgatcgtaagcaggcaggagaaaggcaaatccttactgttcaagaccgaagacggggtgaacatgtgcaccctaatggcgatggacctgggcgaactatgcgaggacaccatcacatataagtgcccgctcttacggcaaaacgagcccgaggatatcgactgttggtgcaatagcacctccacgtgggtgacctacgggacctgcaccaccaccggagagcatagacgcgagaagcggagtgtggccctggtgccacacgtgggaatggggctagagacccgcaccgagacctggatgtcctccgagggggcctggaagcacgcccagcgaatcgaaacatggatcctgcgccaccccgggttcacaatcatggcagcgatcctggcctatactataggcaccacgcacttccagagggccctcatcttcatcctgctgaccgcagtcgcgccctccatgaccatgcgctgtatcgggatcagcaaccgggactttgtggagggcgtatccggcgggagctgggtcgacatcgtactcgagcatggctcctgcgtgaccacgatggccaagaataagcccaccctggacttcgagttgattaagaccgaggccaagcagcccgccaccttaagaaagtactgcatcgaggccaagttaacgaacaccaccacggagagccggtgcccgacgcagggggagccctccctgaacgaagaacaagacaagcgctttgtctgcaagcatagtatggtggatcggggctgggggaacggttgtggactcttcggtaagggcgggatcgtgacctgcgcgatgttcacttgcaagaaaaacatggagggtaaggtcgttcagcccgagaacctggagtacacgattgtcatcacgccacactccggcgaggaacacgctgtcgggaacgacacaggaaagcacgggaaagagatcaagatcactcctcagtcttccatcaccgaggctgagctgaccggctacgggacggttacaatggagtgcagcccccgcaccggactcgacttcaacgaaatggtactgctgcagatggagaacaaagcctggctcgtccatcggcagtggtttctagacctgccactcccctggctgccgggcgcggacacgcaggggtccaattggattcagaaggagacgttagtcaccttcaagaacccccatgcgaagaagcaagatgtagtagtgctcggctcgcaggagggcgcaatgcacaccgcccttacgggcgccacggagatacaaatgtcgagcggtaacctcctgttcaccggccatctgaagtgccgcttgcgaatggacaaattgcagttaaagggcatgagctacagtatgtgtaccgggaagttcaaggtagtaaaggagatcgccgagacccagcacggcacgatcgtcatcagggtccagtacgagggggacgggtccccctgcaagatcccgttcgagatcatggacctggagaagaggcacgtgcttggtcgcctgatcacggtgaaccccatcgtcaccgagaaggactccccggtgaacatcgaggcggagccaccgttcggcgatagctatatcataatcggcgtagagccgggacagctgaagctcaattggttcaagaaaggctccagcatcgggcagatgttcgagaccacgatgcgcggcgccaagcggatggccatcctgggcgacacagcctgggatttcggttccctgggcggggtctttacaagcatcggtaaggccctccaccaggtgttcggggcgatctacggcgccgccttctccggcgtgagctggaccatgaagatattaatcggggtaatcattacgtggatcggcatgaactcccggagcacctccctgagcgtgtccctagtgctcgtaggggtcgtaacattgtacttaggcgtcatggtgcaggcagacagcgggtgcgtggtctcctggaagaacaaggagctcaagtgcggaagcggcatcttcatcaccgacaatgtgcatacgtggacggagcagtacaagttccagcccgaaagcccctcaaagctcgcgagcgctattcagaaggcccacgaggaagggatctgcggaatacggtccgtcactagactggagaacttgatgtggaaacagattacccccgagctgaaccatatcttaagcgagaacgaggtaaaactcacgatcatgaccggggacatcaagggcatcatgcaagctgggaagcgttccctgcggcctcagcccaccgaactgaagtacagttggaagacctggggcaaggcgaagatgctgagtacggagtcgcacaaccagaccttcctgatcgacggccccgagaccgcggagtgcccgaacacgaaccgggcgtggaactccctggaggtagaggactacgggttcggcgtatttacgaccaatatttggctcaagctgcgcgagaagcaggacgtcttctgcgacagcaagctgatgtccgccgccatcaaagacaaccgggccgtgcacgcagatatgggatactggatcgaaagcgccctcaacgacacttggaaaattgagaaggcctctttcatcgaggtgaaaagctgccactggcccaaatcccacacactgtggagcaacggcgtacttgagtccgagatgatcatcccaaagaactttgccgggcccgtgtcgcaacataattaccggcccgggtaccatacgcagacggccggcccctggcatctcggtaagctggagatggacttcgatttctgcgaggggacgacggtggtagtgaccgaggactgcggaaaccgaggacctagcctcagaacaaccaccgcgtccggcaagctgatcacagagtggtgctgtaggagctgcacgttacccccgttacgctatcgcggggaagacggctgctggtacggaatggagatccgccccctcaaggagaaggaggaaaacctggtgaactccctggtaactgccggccacggtcagatcgacaacttctccctcggcgtattgggcatggctttattccttgaggaaatgttacggacacgcgttgggaccaaacacgcaatactgctcgtagcggtgtcctttgtgacgctgatcaccggcaacatgagcttcagggacctcgggcgcgtcatggtgatggtgggtgccacaatgacggacgatattgggatgggcgtcacgtacctcgcccttctggccgccttcaaggtgcgccctacctttgcggccggcctcttactccggaagctcacctccaaggagctgatgatgaccacgatcgggatcgtcttgctatcacagtcaaccatccctgagaccatcctggagctgacggacgccctggccctgggcatgatggtcctgaagatggtccgcaagatggaaaagtaccagcttgccgtgacgattatggcgatcctgtgcgttcccaacgcggtcatcctgcagaacgcttggaaggtctcatgtaccatcttggctgtggtctccgtaagcccgctgctgctcacatcctcgcagcagaaggccgattggatccccctggcgctgaccatcaaggggctcaatcccacggccatctttctgacgaccttgtcccgcaccaacaagaagcgtagctggcctcttaacgaggccatcatggcggtgggcatggtaagtatcctggcgagttccctgctcaagaacgatattcccatgacgggcccgctggtcgccgggggtctgcttaccgtctgttacgtgctgaccgggcggtcggccgatttagagttggaacgcgcagccgatgtcaagtgggaagaccaagcggagatctccggctcgtctcccatcctgtccatcaccataagcgaggatgggtccatgagcatcaagaacgaggaggaggagcagacgctcaccatcctcataaggaccggcctgctggtgatatcggggctctttcctgtttcaatcccaatcactgcggctgcctggtatctgtgggaggtcaagaaacagcgcgccggggtcctgtgggacgtgccatctccgccgcctgtcggcaaagcggagctcgaggacggggcctaccggatcaagcagaagggcatcctggggtacagccagataggcgccggcgtgtacaaggagggaacgttccacacgatgtggcacgtgacccgcggcgccgtgctgatgcataaggggaagaggatagagccgtcctgggcggacgtgaagaaggacctcatcagctacggcgggggctggaagctggagggagagtggaaagagggagaggaggtacaggtgctggcgctagaaccgggcaagaacccacgcgcagtgcagactaagcccggactattcaagaccaacgccgggacaatcggggccgtgtccttggatttcagcccaggcacctccggaagccccattattgacaagaaagggaaagtcgtcggactctacgggaatggcgtcgtaacccggtccggcgcctacgtgtccgcgatcgcccagaccgaaaagtccatcgaggacaatccagagatcgaggatgacatatttcgcaagcggaagctgacgataatggacctgcaccccggagccggcaagacaaagcgctatttacccgccatcgtacgggaggcaattaagcgcggtcttcggaccctgattctggccccgacccgcgtcgttgcagcggagatggaggaggccctccggggtctgcccatcagataccagacgcccgcgatccgcgccgaacacaccgggcgggagatcgtggacttaatgtgccacgccacgttcaccatgcgtctgctgagtcctgttcgggtgcctaactacaacctcatcataatggacgaggcccacttcactgaccccgcgagcatcgccgcccgcggctacatttcgacgcgggtggagatgggcgaagcggccgggatctttatgaccgccacaccccctggaagccgcgacccgttccctcagtccaacgccccgatcatggacgaggagcgggagatccccgagcgaagctggagtagcggtcacgagtgggtcacggacttcaagggcaaaaccgtgtggttcgttccctcgatcaaggccggaaacgacattgccgcctgcctccgaaagaacggcaagaaggtcatccagctgtctagaaagaccttcgacagtgagtacgtcaagacccggacgaacgattgggacttcgtggtcacgaccgacattagtgagatgggcgctaatttcaaagccgagcgcgtgatcgacccccggcgttgcatgaagcccgtgatattgacggacggggaggagagggtcatcctcgcaggccccatgccggtgacgcactccagcgccgcccagcgccggggtaggattggccggaacccgaaaaacgaaaatgatcagtacatctacatgggggagcctctggagaacgatgaggactgcgcgcattggaaggaagccaaaatgctgctcgacaacattaacacacccgagggaataatcccgtctatgttcgagccagaacgcgagaaggtcgacgccatcgacggcgaataccgcttacgcggggaggcccgcaagacctttgtcgacctgatgcggcgcggcgacctccccgtgtggctggcataccgggtggcggccgagggcatcaactacgccgaccgccggtggtgtttcgacggtatcaagaacaaccagatactcgaagagaacgtagaggtggagatttggacaaaggagggggagcgcaagaagctcaaaccgcggtggctggacgcccgcatctactcggaccccctcgctcttaaggagttcaaggagttcgcggccggccggaagagtttgacactgaacctcatcaccgagatgggacgcctgcccaccttcatgactcaaaaggccagagacgccctcgacaacttggcggtactgcacacggccgaggcgggtggccgggcatacaaccacgctttaagcgagctccccgagaccttagagaccctgctcctgttaactctcctggctacggtgactgggggcattttcctgttcctcatgtccggtcgggggatcggcaagatgacactgggaatgtgctgcatcatcaccgccagcatcctgttgtggtacgcccagatccagccgcactggatcgccgcttccattatactggagttctttcttatagtcttactgatcccagagcctgagaagcagcgcacgccccaggataaccaactgacgtacgttgtgatcgccatcctcactgtggttgcggccactatggccaacgagatgggcttcctggagaagaccaagaaggacctgggtttaggcagcatcactacacagcagccggagagcaacatcctggacattgacctgaggcccgccagtgcgtggacgttatacgctgttgccaccacctttgtcacccccatgctgcgccacagtatcgaaaattccagtgtgaacgtgtccctgactgcaatagccaaccaagcgaccgtgctcatgggattggggaagggctggcccctgtcgaagatggatatcggggtcccgctcttagccattggctgctactcccaggtgaatccaatcacgttgacggccgccctactgctactcgtggcccactacgcaatcatagggccaggcctgcaggccaaagcaactagagaggcccaaaaacgcgccgcggccggcattatgaagaaccccaccgtagacgggattaccgtgattgatctggacccgattccatacgaccccaagttcgaaaagcagctcggacaggttatgttactggtcttgtgtgtgacacaggtgctgatgatgcggaccacttgggctctctgcgaagccctgaccctcgccaccggccctatcagcaccctgtgggagggtaaccctgggcgcttttggaacaccactatcgctgtctccatggccaacatctttcgcggtagctatctggccggagccgggctattgttcagcattatgaagaacaccaccaacactcggcgcggcacagggaacatcggtgagaccctcggcgagaaatggaagtctagactgaacgcgctgggaaagtctgagttccagatttacaagaagagtggaatccaggaagtcgaccgcaccctcgccaaggagggtatcaagcgaggcgagaccgaccaccacgctgtttcgcgagggtccgccaagctgcggtggttcgtcgaacgcaacatggtgacacccgaaggcaaggtggtcgacctgggctgtgggcggggtggttggtcctattactgcggcgggttaaagaacgtgcgcgaagttaagggcctgaccaaaggcgggcctggccacgaggagcccatcccgatgagcacatacgggtggaacctggtgcggctccagtcgggcgtcgatgtgttcttcacgccgccagagaagtgcgacacgctgttgtgcgacatcggcgagagcagtcccaacccgacggtcgaggctggccgaaccttgcgggtgctgaaccttgtcgagaactggttaaacaataacacccagttctgtatcaaggtcctgaacccctacatgccttccgtgattgagaaaatggaggccctgcaaaggaaatacggtggtgcactggtgcggaacccgctcagccgcaattccacccacgagatgtactgggtcagcaacgcgagtggaaacatagtgtcctccgtgaacatgatctcacggatgctgatcaaccgcttcaccatgcggcacaagaaagccacctacgagcccgatgtcgacctgggctccggcacacggaacatcggtatcgaaagcgagatccccaacctcgatatcatcgggaagagaatcgagaagataaagcaggagcatgagacatcctggcactatgaccaggaccacccctacaagacgtgggcttaccacggcagctacgagaccaagcagaccgggtccgctagctccatggtgaacggcgtggtccggcttctcaccaagccgtgggacgtggtgcccatggtcacgcaaatggccatgaccgacaccacccctttcggccaacagcgtgtgttcaaagagaaagtggacacgcggacacaggagcccaaggagggcaccaaaaagctcatgaaaatcaccgccgagtggctgtggaaagagttgggcaagaagaagacgccgcgcatgtgtacccgggaggagttcacccgaaaggtccgaagcaacgccgcgctcggggccattttcaccgatgagaacaagtggaagtcggctagagaggcagtggaggacagccggttttgggagcttgtcgataaagagcgcaatctacacctcgagggcaaatgcgagacatgcgtgtacaacatgatggggaaacgggagaagaagctgggcgagtttggcaaggcgaaaggatcacgcgcgatctggtatatgtggctgggcgcccggttccttgagttcgaagccctgggcttcttaaacgaagatcactggtttagcagggagaactctctctccggcgtggagggggagggcctgcataagctaggctacatactccgtgacgtgagcaagaaagagggaggcgccatgtacgccgatgacacggccgggtgggacacaaggatcaccctggaggacctgaaaaacgaggaaatggtgactaaccacatggagggcgagcacaagaagctcgccgaggctattttcaagctgacctaccagaacaaggtcgtccgcgtgcagcgccccacgccccgggggaccgtgatggacatcatctctcgccgggaccagcgcggctcggggcaagtcggcacctatgggctgaacaccttcaccaatatggaggcccagctcatcaggcaaatggagggggagggggtgttcaagtcaatccagcatttgaccgtgacggaagagatcgcggtccagaactggctagcccgagttgggcgcgagcggctcagccgcatggccatcagtggcgacgactgcgtggtaaagcccctggatgatcgcttcgccagcgccctaaccgcgctaaacgacatggggaaggtgcgcaaggacatccagcagtgggagccgtcccgggggtggaacgactggacccaggtgcccttctgtagccaccacttccacgagctaataatgaaggacggccgggtcttagtggtgccctgccggaaccaggatgagctcatcgggcgcgcccgaatatcccagggcgctgggtggagcctgagagagaccgcctgtctgggaaagagttatgcccagatgtggagcctgatgtacttccaccgacgcgacctgcggctggctgctaatgccatatgctccgccgtccccagccactgggtaccgacctcgcgcacgacctggagcatccacgcaaaacacgagtggatgactacggaggatatgctaacggtgtggaacagggtttggatccaggaaaatccctggatggaggacaaaactcccgtggagtcttgggaggaaatcccctacctgggcaagagggaggaccagtggtgcgggtcgcttatcggactcaccagccgggcgacgtgggccaagaacatccagacggccatcaatcaggtgcgctccctaatagggaacgaggaatacaccgactacatgcctagcatgaaaagatttcgtcgcgaggaggaggaggccggtgtactgtggtga

SEQ ID NO: 25544 - RNA, 9876 nt, synthetic construct
  misc_feature 1..9876: note = derived and/or modified CDS sequence (opt11) from DENV-2__GQ398263__SS-prME
  source 1..9876: mol_type = other RNA
acagccgggatgatcatcatgatgatccccaccgtaatggccttccacctgaccacccggaacggggagccccacatgatcgtcagtcggcaggagaagggcaagagcctcctgttcaagaccgaagacggggtgaacatgtgcaccctgatggcgatggacctcggggagctctgcgaagacaccatcacctacaactgccccctgctccggcaaaacgaacccgaagacatagactgctggtgcaacagcactagcacctgggtgacgtatgggacctgcaccgccacgggcgagcatcggcgcgagaagcggagcgtcgctctggtgccacacgtcggcatggggctggagacgcgcaccgagacttggatgtcctcggagggcgcctggaagcacgcccagcggatcgagacctgggtcctccgccaccccgggttcacgataatggcggccatcctcgcctacaccatcggcaccacctacttccagcgggtgctgatcttcatcttacttacggccgtggcgccctccatgaccatgcgctgcattggcatcagcaacagagactttgtcgagggagtgtccggcgggagctgggtggatatcgtcctggagcacggctcctgcgttaccaccatggccaagaacaagcccaccctcgactttgaactaatcaagaccgaggccaagcaccccgcgacactgcgcaaatattgcatagaggccaagctcactaacactaccaccgcgtcgcggtgcccgacccagggggagccctccctgaacgaggaacaggataaacgctttgtctgtaaacacagcatggtcgacaggggctggggcaacgggtgcggactgttcggtaagggcgggatcgtgacatgcgcaatgttcacgtgcaagaagaacatggagggcaaggtggtccagcccgagaacctcgagtacaccatcgtgatcacgccccattcaggcgaagagaacgcagtgggaaacgacacgggcaagcacggcaaggaaattaagatcacaccgcagagctccatcaccgaggccgagctgaccgggtacggcaccgtgacgatggagtgcagcccccgcaccggcctggacttcaacgagatggtgctcctccaaatggagaacaaggcctggcttgtgcaccgacagtggtttttggacctacccctgccgtggctcccgggcgcggacacccaggggagtaactggatccagaaggaaaccctggttacgttcaagaacccccacgccaagaagcaagacgtggtcgtgctgggcagccaggagggggccatgcacaccgcgctcacgggcgcaaccgagatccagatgagctcagggaatctgctgttcaccggccacctcaagtgccgcctgcggatggacaagctgcagctaaagggcatgagctattccatgtgcaccggtaagtttaaggtggtcaaggagatcgcggagacccagcacggcaccatcgtcgtgcgcgtccagtacgagggggacggcagcccctgcaagattcccttcgagatcatggacctagagaaacggcacgtgctgggccgcctcatcacggtgaacccaatcgtcaccgagaaggactcccccgtgaacattgaagccgagcccccgttcggggatagctacatcatcatcggcgtggagccggggcagctgaagctgtcctggttcaagaaggggagctccatcgggcagatgttcgaaaccactatgcgcggcgcaaagagaatggccatcctcggggatacggcctgggacttcggttctctgggcggggtgttcaccagcatcggcaaggcccttcatcaggtgtttggcgcaatctacggcgctgccttcagcggtgtgtcctggaccatgaagatcctcatcggggtcgtgatcacctggatcggcatgaacagccgctccacgagcctgtccgtctcgctcgttctggtgggggtggtcaccctctacctgggcgtcatggtccaggcggactccgggtgcgtcgtgagctggaaaaacaaggaactgaagtgtggatctggcatcttcatcaccgacaacgtgcacacctggacggagcagtacaaattccagcccgagtcccctagcaagctcgccagcgccatccagaaggctcacgaggaggggatctgcggcatccggagcgtaacccgcctggagaacctgatgtggaagcaaatcacccccgaactcaatcacatcctctccgagaatgaggtgaagctgaccataatgacaggggacatcaagggcataatgcaggcgggcaagcggagcctccgcccgcagcccaccgagctgaagtactcctggaaaacctggggcaaggcgaagatgctgtccactgagctccacaaccacacgttcttgatcgatggccccgagaccgccgagtgcccaaccaccaacagagcctggaattcccttgaggtggaggattacgggtttggcgttttcacgaccaatatctggctcaaactcaaggagcgtcaggacgtgctgtgcgacagcaagctcatgtccgcggccatcaaggacaaccgggcggttcacgccgatatgggttactggatcgaaagcgcactgaatgacacctggaagatagagaaggcctccttcatcgaagtgaagagctgccattggcccaagtcccacacactgtggtctaacggcgtgctcgagtccgagatgatcattcctaagaacttcgccgggcccgtgagccagcacaactaccgtccggggtaccacacccagacggcaggtccgtggcacctcggaaagctcgagatggacttcgatttctgtgagggcaccaccgtagtcgtgaccgaggactgcgggaaccggggaccaagcctcagaaccaccaccgcctccggcaaacttatcaccgagtggtgttgccggagttgcacgctgcccccgctacgctacagaggggaggatggctgctggtacgggatggaaatcaggcccttgaaggacaaggaggagaatcttgtcaactctctcgtgactgccggccacgggcagatcgataatttcagcttgggcgtgctgggcatggccctcttccttgaagagatgctgcggacccgcgtagggactaagcacgcgatactcttagtggccgtgtccttcgtcacgctgatcaccggcaacatgtctttccgggacctcgggcgcgtgatggtgatggtcggagccaccatgaccgacgatatagggatgggcgtaacgtacctggccctgctcgccgcgttcaaggtgcgccccacctttgcagccggcctgctgctacggaagctaacctccaaggagctcatgatgaccacgatcggaatcgtcctcctgagccagtcaaccatccctgaaaccatcctggagctaacggacgcgctggccctcgggatgatggtgctcaaaatcgtccgcaacatggagaagtaccagctggcagttacgattatggccattttatgcgtaccgaacgccgtcattctccagaacgcgtggaaagtgagctgcaccatactagccgtggtctctgtttctcccctgctcctgacctccagccagcagaaggcggactggatccccctagccctcaccatcaaagggctgaaccccacggccatctttctgaccaccctctccagaaccagcaagaagcgctcgtggcctctaaatgaggccatcatggcggtgggcatggtcagcatcctggcctccagcttgcttaagaacgacatccccatgacaggccccctggtggccggcggcctcttgacagtgtgctacgtcctgaccgggcggagcgctgatctcgaactggagagagccgcggacgtgcggtgggaggaccaggccgagatcagtggtagctcacccatactgtccatcaccatctccgaggacgggagcatgtcaatcaagaacgaggaagaggagcagacgcttaccatcctgattaggaccggcctgctagtgatctcaggtctcttcccggtcagtatccccatcaccgccgccgcctggtacctgtgggaggtgaagaagcagcgggcgggggtgctctgggacgtccccagcccgcccccagtggggaaagccgaactggaggatggcgcctaccgcatcaagcagaagggaatactggggtactcccagatcggcgccggagtgtacaaggaagggaccttccacaccatgtggcacgtgacccggggcgccgtgctcatgcacaaggggaagaggatcgagccaagctgggcggacgttcggaaggatctgatctcctacggcggggggtggaagctggaaggggagtggaaggagggggaggaggtccaagtgctagccctagagcccgggaagaacccccgcgccgtgcagactaagcccgggctgttcaaaaccaatacggggaccattggtgccgtgagcctcgacttctcccccggcaccagcggatcccccatcgtggataagaaggggaaggtcgtcggcctgtacgggaatggtgtggtaacgcggagcggcacgtatgtctcagccatcgcgcagaccgagaagtccatcgaggacaaccccgagatagaagatgacatcttccgcaagaagcggttaaccatcatggacctgcaccccggggcaggcaaaaccaagcgctacttacccgccatcgtacgggaagccatcaagcgcgggctgcggacgctgatcctagcgccgacccgcgtggtcgcggccgagatggaggaggccctgcgcggcctgcccatccggtaccagacccccgccatccgcgcggagcacaccggacgggagatagtcgaccttatgtgtcacgccacgttcaccatgcgcctgctgagccccgtgagggtcccgaactacaacctcatcatcatggacgaggcccacttcaccgaccccgcttccatcgccgcgcgcggctacatcagcacccgggtggagatgggggaggccgccggaatcttcatgaccgccacgccgcccggctctcgcgacccgttcccccagagtaatgcacccatcatggacgaggagagagagatccccgaacgcagctggaatagcgggcacgagtgggtgactgacttcaagggcaagaccgtctggttcgtgccgtccatcaaagcggggaacgacatcgcagcctgcctgcgcaagaacggcaagaaagtcatccagttaagccgcaagacgtttgactcagagtacatcaagacccggacaaacgactgggactttgtcgtcaccacggacatctcggagatgggcgccaatttcaaggcagagagagttatcgacccacgacgctgcatgaagcccgtgatcttaaccgacggtgaggagcgggtgatcttagccggccccatgccggtgactcactccagcgccgcacaacgccgtgggcggatcggccgcaaccctaagaatgagaacgaccagtacatttacatgggggagccactggaaaacgacgaggactgcgcccactggaaggaggcaaagatgcttctggacaacatcaacactcccgagggaatcatcccctccatgttcgaacccgagcgggagaaggtcgacgccatcgacggagagtaccgcctgcgcggggaagcccgcaaaaccttcgtagaccttatgcggcgcggcgacctgcccgtgtggctggcctacagggtggccgcggaggggattaactacgccgatcgcaggtggtgctttgacggcataaagaacaaccaaatcctagaggagaacgtggaagtcgagatctggaccaaggagggggaacgcaagaagttgaaaccgcggtggctggacgcccgcatttactccgaccccctcgcgctgaaggagttcaaggagtttgccgcgggccgaaagtccctcacccttaatctgatcacggagatgggccgcctgcccaccttcatgacgcagaaggcccggaacgctctcgacaacctggcggtgctgcacactgccgaagccgggggtcgcgcctacaaccacgcgctcagcgagttacccgagaccctggagacgctcctgttgctcacactgctggccaccgtgaccggggggatctttctcttcctgatgtccggcaaggggataggcaagatgaccctggggatgtgctgcatcattacggcgagcatcttactgtggtacgcccagatacaaccgcattggatcgccgcctccatcattctggagtttttcctgatcgtccttctgatccctgagcccgagaagcaacggacgccccaggacaaccagctcacctacgtggtgatcgccatcctgaccgtcgtggcggccacgatggccaacgaaatgggctttctggagaagacaaagaaggacttcgggctcggcagcatcgccacccagcagccagagagcaacatcctggacatcgatttacgccccgcctccgcttggaccctctacgccgtagccactactttcatcactccaatgctgcgacacagcattgagaacagtagcgtaaatgtgtctctgaccgccattgccaatcaggcgacggtgctcatgggcctggggaagggatggccccttagcaagatggacatcggggttccgcttctggccatcggctgctactcccaggttaaccccatcacccttaccgccgccctcctgttactcgttgcgcactacgcgatcatcgggccaggcctccaggcgaaggccacacgcgaggcccagaaacgtgcggccgcaggcatcatgaagaaccccacggtcgacggaatcaccgtaatcgacctggacccgatcccctacgacccaaagttcgagaagcagctcgggcaggtgatgctcctggtcctctgcgtgacccaggtgttgatgatgcgcaccacgtgggccttatgtgaggcgctcaccctcgcgacggggccgatcagcacactgtgggaagggaatcctggccgcttctggaacacgaccatcgccgtttcgatggccaacatcttccggggctcctacctcgccggcgcaggattactgttctccatcatgaaaaacaccgctaacacacgccggggcacgggtaacaccggtgagaccctcggtgagaagtggaagaatcgcttgaacgccctggggaagagcgagttccagatctacaagaagtccggcatccaagaggtggacaggaccctcgccaaggaaggaatcaagcgcggcgagacggatcaccacgccgtgagccgagggtccgctaaactgcgctggtttgtcgagcggaacttggtgacacccgagggcaaggtcgttgacctcggctgcgggagaggaggatggagctattactgcggcgggctgaagaatgtgaaggaggtgaaaggcttaaccaagggcggtcccggccacgaggagcccattccgatgtccacgtacggttggaaccttgttcgactgcagagcggcgtggacgtgttcttcaccccgcccgagaaatgcgacaccctgctctgtgacattggtgagagtagcccgaacccgaccgtggaggccggccgcaccctccgggtgcttaacctcgtggagaactggctgaataacaacacccagttctgcataaaggtcctcaacccctacatgcccagcgtgatcgaaaagatggaggccttacaacggaagtacggcggggcactcgtgcggaacccgttaagtcgcaacagcacacacgagatgtattgggtcagcaacgccagcggcaacatcgtgtccagcgtgaacatgatctcccggatgctgatcaacaggttcaccatgcgccacaagaaggcgacttacgagcccgacgtcgacttggggagcggaacacgcaatatcgggatcgagtccgagatcccaaaccttgacgtgatcggcaagaggatagagaagatcaaacaggagcacgagacgtcttggcactacgaccaggaccacccctacaagacctgggcctatcatgggtcctacgagaccaagcagaccgggagcgcctccagcatggtgaacggagtcgtccggctgctcactaaaccgtgggacgtaatccccatggtcacccagatggccatgactgacacgacgcctttcgggcaacagcgcgtgttcaaggaaaaagtcgacacccgaacccaggagcccaaggagggcaccaagaagttgatgaagatcacggccgagtggctgtggaaggagctcggcaagaagaagaccccgcggatgtgcacccgggaggagttcactcgcaaggtgcggtccaacgcggccctgggggcgatctacacggacgagaacaagtggaagtccgctcgcgaagcagtagaggactcccggttctgggaactggtcgacaaggaacgcaacctccacttggaggggaaatgcgagacgtgcgtatacaacatgatggggaagcgggagaaaaagctgggcgagttcgggaaggcgaagggcagtcgcgcaatctggtatatgtggctcggtgccagattcctggagttcgaggcattggggttcctgaatgaggaccattggttctcccgcgagaacagcctgtcgggcgtggagggggagggcctgcataagctcgggtacatcctgcgggacgtctcgaaaaaggagggcggcgcgatgtacgccgacgacactgcagggtgggataccagaatcacactggaggacctcaagaacgaggagatggtaaccaaccacatggagggcgagcacaagaagctagctgaggccattttcaagctcacctaccagaacaaggtcgtacgcgtgcagcgccccacgccccgggggacggtcatggacatcatcagccgccgggatcagcggggttccggacaggtcgtcacctacggccttaacacgtttaccaacatggaggcgcagctgatccgtcagatggagggcgagggggtattcaagagcattcagcacctgacggtcaccgaggagatcgccgtaaaaaattggctggcccgggtgggccgcgaacggctgtcccgtatggccatcagcggggacgactgcgtcgtgaagcccctggacgaccggttcgcctccgcgctgaccgccctgaacgacatgggcaaggtgcgcaaggatatacagcagtgggagccgtctcggggctggaacgactggacccaggtccccttctgctcccaccacttccacgagctgatcatgaaggatgggcgcgtgctcgtcgtcccctgtcggaaccaggacgagctgatcggccgcgcccggattagccaaggggccgggtggtcccttcgagagacggcctgcctcggcaagagctacgcgcagatgtggtcacttatgtacttccatcggagagatctgcggctcgccgccaacgccatctgcagcgccgtcccctcccactgggtgccgaccagcagaaccacctggtctatacacgcgacacacgaatggatgacgaccgaggacatgcttaccgtctggaaccgggtgtggatccaggagaacccctggatggaggacaagacccccgtggagagctgggaggagatcccatacctgggcaagcgcgaggaccagtggtgtggctccttgatcgggttaacgtcccgggccacctgggccaagaacatccagaccgcaataaatcaggtccgaagcctgattggcaacgaggagtacaccgactacatgcccagcatgaagcgcttccggagagaggaagaggaagcgggcgtgctctggtga

SEQ ID NO: 25545 - RNA, 9876 nt, synthetic construct
  misc_feature 1..9876: note = derived and/or modified CDS sequence (opt11) from DENV-2__GQ398264__SS-prME
  source 1..9876: mol_type = other RNA
accgccgggatgatcatcatgatgatccccaccgtgatggccttccacctgacaacacggaacggggaaccccacatgatcgtctcgaggcaagagaagggcaagagcctcctgttcaagaccgagaacggggttaacatgtgcaccctgatggcgatggatttaggcgaactgtgtgaggacacgatcacgtacaattgccccctgctccgccagaacgagcccgaggacatcgactgctggtgcaatagcaccagcacgtgggtgacctacgggacatgtacagccacaggcgaacatcggcgcgagaagcggagcgtggcactggtgccacacgtgggtatggggctggagacacgcaccgaaacctggatgagcagcgaaggcgcctggaagcatgcgcaacggatcgaaacctgggtcctccgccatccggggttcaccatcatggcggccatcctggcctacaccatcggcaccacctacttccagcgtgtactgatcttcatcctcctgaccgccgttgcgcccagcatgaccatgcgctgtatcgggatcagtaaccgggatttcgtcgagggggtctccggcgggagctgggtggacatcgtgctggagcacggctcatgcgtgactacaatggccaagaacaagccgacgcttgacttcgagctgatcaagaccgaagccaagcaccccgccaccctgcggaagtactgcatagaggccaagctcaccaatacgaccaccgcgagccgttgcccgactcaaggggagccctccttgaacgaggaacaagacaagcgtttcgtgtgcaagcactcaatggtcgacagaggctggggcaacgggtgcggcctcttcgggaagggcgggatcgttacgtgcgctatgtttacctgcaaaaagaacatggaaggcaaggtcgtccagcccgagaacctcgaatacactatcgtgatcacgccccactccggcgaagagaacgccgtggggaacgacacgggcaagcacgggaaagagatcaaaatcaccccccagagctctatcacggaggccgagctgacaggctacgggaccgtcaccatggaatgtagcccgaggacgggcttggacttcaacgaaatggtgctcctgcaaatggaaaacaaggcatggctggtgcaccggcaatggttccttgacctgcctctgccctggctcccgggcgcggacacccaggggagtaattggatccagaaggagaccctggtcacgtttaagaacccccacgccaagaagcaggatgttgttgtgttgggaagccaggagggggccatgcataccgcgctcaccggcgcaaccgagatccagatgagctcagggaatctcctgttcactggccacctgaagtgccgcttgcggatggacaagcttcagctgaagggtatgagctactccatgtgcaccgggaaatttaaggtggtcaaggaaatcgcggagacccagcatggcaccattgtgatccgcgtgcagtacgagggtgacggctccccctgtaagatccccttcgagatcatggatctggagaagcggcacgtcctgggccgcctcatcacggtcaacccgatcgtgaccgagaaggactcccccgtaaacatagaggctgaaccgcccttcggggacagctacataatcataggcgtggaaccggggcagttaaaactgtcctggtttaagaaggggagctccatcgggcagatgttcgagacaaccatgcggggagccaagcggatggctatcctcggggacacggcctgggacttcgggtccctgggcggtgtcttcacgagtattggcaaagcgctccaccaagtcttcggtgccatctacggtgccgccttcagcggcgtgtcctggacgatgaagatccttatcggtgttgtcatcacctggatcggcatgaatagtcgatctacgagcctgtcagtgagcctggtgcttgtcggggtggtgaccctctatctgggcgtcatggtccaggccgactccgggtgcgttgtcagttggaagaacaaggagctgaagtgcggcagcggcatctttatcaccgacaatgtgcacacctggacggagcagtacaagttccagcccgagtcccccagcaagttggcctctgccatccagaaggcccatgaggaggggatctgtggcatccggagcgtgacccgcctggagaaccttatgtggaagcagatcaccccagagcttaatcacatcctgtccgagaacgaagtcaagctgaccatcatgacgggggatatcaaaggcataatgcaggccggcaagcggagcctacgcccgcagccaacggagctgaaatattcctggaagacctggggcaaagctaagatgttatctaccgagctccacaatcacaccttcctcatcgacggacccgagacggccgaatgcccgaacacaaaccgggcctggaacagccttgaggttgaggattatggtttcggcgttttcaccacaaacatttggctcaagctgaaggagcgccaggacgtcttttgcgactccaagctgatgtccgccgccatcaaggacaaccgcgctgtgcatgccgacatgggttactggatcgagtcagcactcaacgatacctggatgatcgagaaagcttcctttatcgaggtcaaaagctgccattggcccaagtcccataccttatggtcaaacggcgtgctggagtctgagatgatcatccccaaaaacttcgccggcccggtgagccagcacaactatcgcccggggtaccacacccaaaccgcgggcccctggcagctcgggaagctggagatggacttcgacttctgcgagggcacgaccgtagtcgtgaccgaggattgcgggaacagaggccccagcctgagaacaacgaccgcttccggcaagctcatcacggagtggtgctgccggagctgcaccctgccccccctacgatacagaggggaggacggttgctggtacgggatggaaatccgcccgttgaaggagaaagaggagaacttagtgaactccctggtcacggctggccacgggcagatcgataactttagcctcggcgttttgggaatggcccttttcctcgaagagatgctgcggaccagagtggggacgaagcacgcgatcctgctggtcgccgtctcgttcgtgacactgatcacgggcaacatgagcttcagagacctggggcgggtcatggttatggtgggcgcgacgatgaccgacgatatagggatgggcgtcacctacctcgcgctcctggccgcgtttaaggtccgccccacgtttgccgccggtctactattacggaagctcacctccaaggagctgatgatgaccaccatcgggattgtgctgctctcacagtctaccatcccggagaccatactagagctgaccgacgccctcgcgctgggcatgatggtactgaagatcgtaagaaacatggagaaatatcaactcgcagtcactatcatggccattttgtgcgtgccgaacgccgtgatcctgcagaacgcttggaaagtcagctgcacgaccctggctgtggtgtccgtctcgcctttactgttgacctcttcgcagcagaaggcggactggattcccctggccctgaccattaaggggctcaaccccacggctatcttcctgactaccctgtcccggactagcaaaaagcgctcctggcctctcaacgaggccatcatggcagtgggcatggtgtctatcctggcctcctcactgctcaaaaatgacatccccatgacgggccccctggtagcaggaggcctgctcaccgtgtgctacgtcctcacggggcggtctgcagacctggagttagagcgcgccgcggacgtccggtgggaagaccaggccgaaatttcaggtagctcgcctatcctgagcatcaccatctccgaggacgggagcatgtccataaagaacgaggaagaggaacagacgctgaccatcctcatccgcacagggttattagtaatcagcggcctcttcccagtgtccatccccataacggccgccgcctggtacttgtgggaagtgaagaagcagagagcgggggtgctgtgggacgtaccaagcccgccccctgtcggaaaggccgagctcgaggacggggcctaccgcatcaaacagaagggcatcctggggtactcccagatcggcgctggcgtctacaaggaggggacgttccatacgatgtggcatgttacgcggggcgccgtcctgatgcacaagggcaaacggatcgagcccagctgggcggacgtgcgaaaggatctcatcagttacggcggtggctggaagttggagggcgagtggaaggaaggggaggaggtgcaagttctggccctcgagcccggtaagaacccccgcgccgtgcagaccaaaccagggctgttcaagaccaacaccgggaccatcggcgccgtgagcctggacttctccccaggcaccagcggctcccccatcgtcgacaagaaggggaaggtggtgggcctatacgggaacggggtggtgacccggagcggcacgtacgtgtctgctatcgcgcagaccgagaagtccattgaggataacccagaaatagaggacgacatcttccgcaagaagcggctgaccatcatggatctgcaccctggggccggcaagaccaaacgctatctgcccgctatcgtgagggaagccatcaagcgcggtctccggacactcatcctggcgccgactcgcgtcgtggccgccgagatggaggaggccctccgcggcctgcccattcggtatcaaactcccgccatccgtgcggagcacaccgggcgggagatcgtcgacctgatgtgccatgccacgttcacgatgcgcctcctgagccccgtacgtgtgccgaactataacctgatcatcatggacgaggctcattttaccgaccctgcttccattgccgcgcgcggctacattagcacccgggtcgagatgggcgaggccgccgggatcttcatgactgccacgccgcccggatcccgcgaccctttcccgcagagcaatgccccgatcatggacgaggagcgggagatccccgagcgatcctggaacagcggacatgaatgggtcaccgattttaagggaaagactgtctggttcgtcccatcaattaaggcggggaacgacatcgccgcctgcctccgcaaaaacggtaagaaggtgatccagctgagccgcaaaacgttcgattccgaatatatcaagacccgaaccaacgactgggatttcgtggttaccaccgatatcagcgagatgggagccaacttcaaggcggagcgagtgattgacccccggcgctgcatgaaaccagtgatcctcaccgatggcgaggagcgggtcatcctcgcaggcccgatgccggtgacccactctagcgccgcccaacgccgagggcgcgtgggtcgcaaccctaagaacgagaacgaccagtacatctacatgggggagccccttgagaatgacgaggactgcgcccactggaaggaagccaaaatgctgctcgacaacatcaacacgcccgagggcatcatcccgagcatgttcgagcccgagcgggagaaggtcgatgccatagacggcgagtatcgccttcgcggggaggcccgcaaaacgttcgtggacctgatgcggcgcggcgacctccctgtctggctcgcttacagagtggcggcggagggtatcaactatgccgaccgccggtggtgctttgatggtgtgaagaacaaccaaatcctggaggaaaacgtcgaggtagaaatctggacaaaagaaggtgagcgcaagaagctcaagcctcggtggcttgacgcccgcatctacagcgaccccctggccttaaaggagttcaaagaattcgccgcgggccggaagagcttaaccctgaacctgataaccgagatgggccgacttcccactttcatgacccagaaggcccggaacgctctagacaatctcgcagtgctacacaccgctgaggccggaggccgtgcctacaatcatgccctttccgagctgcccgaaaccctcgagacgctcctcctgctaacccttttagcaaccgtcaccgggggaatcttcctgttcctgatgtccggcaaggggatcggcaaaatgaccctggggatgtgctgcatcatcacggcgtcgatcctgctctggtatgcacagatacaaccgcactggatcgccgcctccatcatcctggagtttttcctgattgtgctcctgatccccgagcccgagaaacagcggacaccacaggacaaccagctgacctacgtggtcatcgccatcctcaccgtggtcgcggccacgatggccaacgaaatgggcttcctagaaaagaccaagaaagacttcgggctcggctcaaccgccacacagcaaccggagtcaaacatcttagacatagacctgcgccccgcctcagcgtggacgctatatgccgtcgccaccaccttcattacccccatgttacggcactcgatagagaattctagcgttaacgtgagcttgacggccattgccaatcaggccaccgtcctgatgggcctcggtaaaggctggccactgagcaagatggatatcggggtgccactgctcgcaatcggctgctactcccaggtgaaccccatcactctgaccgccgcccttctgctgctagtcgcgcactatgccatcatcgggcccggtctccaggcgaaggccacgcgcgaggcacagaagcgggcggcagccggcatcatgaagaacccgaccgtggacgggatcaccgtcatcgacctagacccgatcccctacgaccccaaattcgagaagcagctaggccaggtcatgctcctggtgctgtgcgtgacccaagtcctcatgatgcgcacgacatgggccctgtgtgaggccctgaccctcgcgaccggacccatcagcacactatgggaggggaaccccgggcgcttctggaacaccacaatcgccgtgtccatggcgaacatcttccggggtagctacctggccggtgccgggcttctgttttccatcatgaagaacaccgcgaatacgcgtcggggcaccgggaacactggcgagaccctgggcgaaaagtggaaaaaccgcttaaacgccttaggcaagagcgagttccagatctacaagaaaagcggcatccaagaagtggatcggacgctggcgaaggaagggatcaagcgcggtgagaccgaccaccacgctgtgagccgggggtccgcgaagctccgctggttcgtagagcggaatctcgtgaccccggaaggcaaggtggtagacctgggctgcgggcggggcgggtggtcttactactgtggcgggttgaagaacgtcaaggaggtgaagggcctgaccaagggcggccccggccacgaggagccgattcctatgtccacgtacgggtggaacctggtgcggctccagagcggtgtagacgtattcttcacgccgcctgagaagtgcgacaccctgctatgtgatatcggggagtcctcgcccaaccccacagtggaagccggccgcaccctacgggtcctgaaccttgtcgagaactggctcaacaacaatacgcaattctgcatcaaggtgctgaacccctacatgcccagcgtaatcgaaaagatggaggcactgcagagaaagtacggcggggccctggtccggaatccgctctctcgcaacagcacccacgagatgtattgggtgtctaacgcctctgggaacatcgtgtcctctgtcaatatgatctctcggatgctgatcaacagattcaccatgcggcacaagaaggcgacgtatgagccggacgtggacctggggagcggtacacgcaacatcgggatagagagcgagacccccaatctcgacattatcggcaagcgcatcgaaaagatcaagcaggagcacgaaacctcgtggcactacgaccaggaccacccctacaagacctgggcctaccatggctcctatgagacgaagcagaccgggagcgccagcagcatggtgaacggcgttgtgcggctgctgaccaagccgtgggatgtgatacccatggtaacccagatggccatgacggacaccacccccttcggtcagcagcgcgttttcaaggagaaggtcgacaccaggacacaggagcccaaagagggaaccaagaagcttatgaagatcaccgccgagtggctatggaaggaactgggcaaaaagaagacaccacgcatgtgcacgcgggaagagtttactcgcaaagtcaggtccaacgccgcactcggtgccatcttcaccgacgagaacaagtggaaatccgctcgcgaggctgtggaagactcgggcttctgggagctcgtcgacaaagagcgaaatctgcacctcgaagggaaatgtgaaacctgtgtgtacaacatgatgggcaagagggagaagaagctgggggagttcggcaaggcgaagggcagccgcgccatatggtacatgtggcttggggctcgcttcctcgaatttgaggccctgggcttcctaaacgaggaccactggttctcccgggagaactctctctctggtgtggagggcgagggtctgcacaagctcggttatatcctccgcgacgtctccaagaaggagggcggtgcgatgtacgccgacgacactgccggatgggacacccggatcacactcgaagacctaaagaacgaggagatggtgacgaatcatatggaaggcgaacacaagaagctcgccgaggccatattcaaactgacgtaccagaataaggtagtccgcgtgcagcggcccacgcctcgggggaccgttatggatatcatcagccgacgcgaccagcgggggtccggccaagtggtcacctacggccttaacacatttaccaacatggaagcgcagctcatccgccagatggagggggagggtgtgttcaaaagcatacagcacctgaccgtcaccgaggagatcgccgtgaagaactggctggcccgggtggggagagagcgactctccaggatggcgatcagcggcgacgactgcgtggtgaagcccctcgacgaccgatttgccagtgctctgaccgcccttaacgacatgggcaaggtgcggaaggacatccagcaatgggagccgtcaagggggtggaatgactggactcaggtccctttctgttcccaccacttccacgagctgatcatgaaggacggcagggtgctggttgtcccctgtcgtaaccaggacgagctgatcgggcgcgcccgcatcagccaaggggctgggtggtccctgcgggagacagcctgcctgggcaaaagctacgcgcaaatgtggtccttgatgtacttccaccgacgcgacctacgcctggccgcgaatgccatttgcagcgccgtgccctcccattgggtcccgaccagccggaccacgtggtccattcacgccacccacgagtggatgaccaccgaggatatgcttacggtctggaaccgcgtgtggatacaggagaacccctggatggaggacaagacccccgtggagtcgtgggaggagatcccctacctgggcaagcgagaggaccagtggtgcgggagcctgatcggcctcacctcccgggccacctgggccaaaaacattcagacagccatcaaccaggtaagaagcttgatcgggaacgaagaatataccgattacatgccgtccatgaagcgctttcgccgggaagaggaggaggcgggcgtgctgtggtga

SEQ ID NO: 25546 - RNA, 9876 nt, synthetic construct
  misc_feature 1..9876: note = derived and/or modified CDS sequence (opt11) from DENV-2__GQ398260__SS-prME
  source 1..9876: mol_type = other RNA
acggctggcatgatcatcatgctgattcccaccgtgatggctttccacctcaccacccggaacggggagccgcatatgatcgtctcccgacaggagaaaggtaagtccttactgttcaagaccgaggatggggtgaacatgtgcactctcatggcaatggacttgggcgagctgtgcgaagacacgatcacctacaattgccccctcctgcgtcagaatgagcccgaggacatcgactgctggtgtaacagcacctccacctgggtaacctacgggacctgcaccgccaccggcgagcaccgccgcgagaagcggagcgtcgccctggtgccccacgtgggcatgggactcgagacccgcacggagacctggatgtcatcagagggcgcttggaagcacgcccaaagaatcgagacctggatcctgcgccaccctgggttcaccatcatggcggccatcttggcctacaccatcggcaccacctacttccagcgggtgctcatcttcatcctgctgaccgccgtggcgccctcgatgaccatgcgctgcatcggaatctcaaaccgggacttcgtggagggggtcagcggggggagctgggtggacatcgtcctcgagcacggatcctgcgtcactaccatggctaagaacaagccaaccttggacttcgaactgataaagaccgaggccaaacagcccgccaccttacgcaagtactgtatcgaggccaagcttaccaacacgaccactgcaagcaggtgcccgacccagggggagcccagcctgaatgaggagcaggacaagcgcttcgtgtgcaagcacagtatggtcgaccggggctggggcaacgggtgcggcctattcgggaagggcgggatcgtcacgtgcgccatgttcacatgcaaaaagaacatggaaggcaaggttgttcagcccgagaacctggagtacaccatcgtcataacgccccactccggagaggagaacgccgtgggtaacgacacgggaaagcacggtaaggaaatcaagatcacgccccagagcagcatcaccgaggccgagttgatcggatacggaaccgtcaccatggagtgcagccctagaacaggcttggatttcaacgagatggtcctgctccagatggagaacaaagcctggctcgttcaccggcagtggttcttggacctacctctcccctggttaccgggcgcggatacccaggggtcgaactggattcaaaaggagaccctggtgactttcaaaaacccacacgccaagaaacaggacgtcgtggtcctcggtagccaggagggggccatgcacacggccctgactggcgcaaccgaaatccaaatgagctccgggaacctcctgttcaccggccacctgaagtgccgcctccggatggataagctccagctcaagggcatgtcatactcaatgtgtacggggaaattcaaagtggtgaaggagattgcggagactcagcacggcacgatcgtcataagggtgcaatacgaaggggatggcagcccctgcaagatccccttcgagatcatggacctggagaagcgtcatgtgctcgggaggctgatcactgtgaacccgatcgtgacggagaaagactctcccgtgaatatcgaggccgaaccgcctttcggggatagctacatcataatcggtgtcgaaccgggacagctgaagctcaactggtttaaaaagggttccagcatcggacagatgtttgagaccacaatgcgcggcgccaagcggatggccatccttggcgacacggcctgggacttcgggtccttaggcggggtcttcacttcaatcggcaaggcgctccaccaggtgtttggggcgatctacggcgccgccttctctggcgtctcatggaccatgaagatactgattggggtggtgatcacctggattggcatgaattcccgatctacatccctgagcgtctccctcgtgctcgtgggggtcgtgacgctgtatttaggcgtgatggtccaagccgactctgggtgcgttgtgtcctggaagaacaaggagctcaagtgcggcagcggtatcttcgtcaccgacaacgtgcacacctggacggagcagtacaagttccagcccgaatcaccctcaaagctggccagcgccatccagaaggcccacgaggagggcatctgcggcatccggtccgttacgagactggagaacctgatgtggaagcagatcactcccgagctgaaccacatcctgagcgagaatgaggtcaagctcaccataatgaccggggacatcaagggaatcatgcaggccgggaagcggagcctgcgtccgcagcctactgagttgaagtacagctggaagacgtgggggaaagcgaagatgcttagcacggagctgcacaaccaaaccttcttgatcgacggccccgagacggccgagtgcccgaacaccaacagggcctggaatagcctcgaggtggaggattacggcttcggcgtgttcactacgaacatctggctgaaactgaaggaacgccaggacgttttctgcgactcaaagctcatgagcgccgccatcaaggacaacagagcggtccacgccgacatgggatactggatcgagagtgcactgaacgacacgtggaaaattgagaaggcctcattcatcgaggtgaagtcttgccactggcccaagagccacaccctatggtcgaacggcgtcctcgagagcgagatgatcatccctaagaattttgccggccccgtgtcccagcataactaccgcccggggtaccacacccagaccgcgggaccgtggcacctggggaagctggagatggacttcaacttttgcgagggcaccacggtggtcgtgactgaggactgcgggaaccggggccctagcctccgcacaaccacggcctcaggcaagctcataacagagtggtgctgccggtcctgcacgctgcccccgctccgttatcgcggggaggacggttgctggtacggtatggagattcgccccctgaaggagaaagaggagaatctggtgaacagcctcgtcaccgccggccacgggcagatcgacaacttctccctgggcgtgctgggcatggccctcttccttgaggaaatgctacgcacgagggtggggaccaagcatgcaatcctcctggtcgccgtcagcttcgtgactctgatcaccggcaatatgtccttccgggatctcgggcgcgtcatggttatggtgggcgccacgatgaccgacgacatcggcatgggggtcacatacctggccctcctcgccgcgttcaaagtgcgcccaaccttcgccgccggcctgctgctccgcaagctgacgagcaaggagctgatgatgacaacaatcgggatcgtcctcctgtcccagagcaccatccccgagactatcctggaactcaccgacgccttggccttgggcatgatggttctcaagatagtgcgcaatatggagaagtatcagctcgcagtcaccatcatggcgattctttgcgtgccgaacgccgtgattctacagaacgcctggaaagtctcgtgcaccatcctggccgtggtgagcgtcagccccttgttgctgacgagctcccagcagaaagcggactggattcccctggcccttacaatcaaggggctgaatcccaccgccatcttcctgaccacgctcagccggacttccaagaagcgcagctggcctttgaacgaggccatcatggcggtgggcatggtgtccatcctggccagctccttgctgaaaaacgacattcccatgaccggcccactggtcgccgggggcctcctgactgtgtgctacgtactgacgggccggagcgccgacctcgaactggagcgtgctgcggacgtccggtgggaggatcaggccgagataagcggctccagccccatactgtccatcacaatcagcgaggacggctccatgagcatcaagaatgaggaggaggagcagaccctcacaatcctaatccgaacgggcctgctcgtgatcagtgggctgtttccggtgagtatccccatcaccgccgctgcgtggtatctatgggaggtcaaaaagcagcgggctggggtgttatgggacgtgccctcaccaccgcccgtaggcaaggccgagctagaggacggtgcttaccgcatcaagcaaaagggtatactaggttatagccaaatcggcgccggcgtgtacaaggagggtaccttccataccatgtggcacgtgactcggggcgcagtcctcatgcataaggggaagcggatcgagccctcctgggcggacgtgaagaaggacctgataagctacggcggtggctggaaactggagggcgaatggaaggagggggaggaggtgcaggtcctcgccctggagcccggcaagaatccccgggccgtgcagacgaaacccgggctgttcaaaaccaatacgggcaccattggggccgtgtccctcgatttctcgcccggtacgtccggctcaccaatcgttgacaagaaggggaaagtcgtggggctgtacgggaacggcgtcgtgacccgctcgggcacctacgtgagcgcgatcgcgcagaccgagaagagcatcgaggacaaccccgagattgaggacgatatcttccggaagaaacgcctaactataatggacctgcacccaggggccggcaagaccaagcgctatctcccagccatcgtcagggaggcaatcaaacgggggctgcgcacacttatccttgcgccgactcgggtggtggccgccgagatggaggaggccctgcgcggcctgcccatccgctaccagacgcccgctatccgggccgagcacaccgggagggagatcgtggacctcatgtgccacgccaccttcaccatgcggttgctgtcgcccgtgcgggtgccgaactacaacctcataattatggacgaggcgcacttcacggaccccgcctccatagccgcgcggggctatatatccacaagagtagagatgggcgaggctgccgggatcttcatgaccgctacgccacctggcagccgcgaccccttcccgcagagcaacgcccccatcatggatgaggagcgggagattcccgagcggtcctggaattccggacacgagtgggttacggacttcaaaggcaagacggtgtggttcgttccaagcatcaaggcggggaatgacatcgccgcctgcctgcgaaagaacggcaagaaggtgatccagctgtcccggaagaccttcgacagcgagtacatcaagacccggacgaacgattgggacttcgtggtgaccactgacatctccgagatgggcgcgaacttcaaggcggagcgggtgatcgacccccgccggtgcatgaagcccgtaatactcacagacggggaagagcgcgttatcttagccggccccatgccggttacgcacagctccgccgcccagcggcgtggacgcataggccgcaaccccaagaacgagaacgaccaatacatctacatgggggaacccctggagaacgacgaggactgcgctcactggaaggaagcgaagatgctgctagataacatcaatacccccgagggcatcatcccaagcatgttcgagccggagcgcgagaaggtggacgccattgacggcgagtaccgattgaggggcgaagcccgcaaaaccttcgtagatctcatgcgtcggggcgacttaccggtgtggctggcctatcgcgtagcagcggaggggatcaactacgcggatcggcgctggtgcttcgacggtatcaaaaacaaccaaatcttagaggagaacgtggaggtggaaatctggaccaaggagggtgaacggaaaaagctgaaacctcgctggctagacgcccggatctactctgaccccctcgccttaaaggagttcaaggagtttgccgctggcagaaaaagcctgacattaaatctaatcaccgagatcggccggttgcccactttcatgacccaaaaggctcgcaacgccttggacaatctggccgtcctgcacacagcggaggccggtggcagggcctataaccatgccctctctgagctgcctgagaccctggagaccctactgctgctaaccctcctggccacagtgaccggcggcatctttttattcctgatgagcggcaaggggatcggcaagatgaccctgggcatgtgctgcatcataaccgcaagcattctgctgtggtatgcccagattcagccgcactggatcgccgcaagtatcatcctggagtttttcctcatcgtgctactgatccccgagcccgagaagcagcgcacgccccaggacaaccagctcacgtacgtcgttatcgccattctgacggtggtcgcagccaccatggccaacgagatgggcttcctggagaagaccaagaaagacttcgggcttgggtccatcgcgacgcagcagccggagtctaatatcttagatatcgacttgcggcccgcaagcgcgtggaccctctacgctgtagcaaccacctttatcacgccaatgctgcgtcattccatagagaacagctccgtcaacgtctccctaaccgccatcgccaaccaggcaacggtgctcatggggctgggaaagggctggccgctgtccaagatggacatcggagtacccctcctcgctatcggctgctattcccaagtcaatcccatcacgctgacggccgccctccttttactcgtggcgcactatgccataatagggcccggcctgcaggccaaggccacccgggaggcccagaagcgcgcggcagccggcattatgaagaaccccaccgtggacggaatcaccgtaatagacttagacccgatcccctatgaccccaaattcgagaaacagttgggccaggtgatgttactggtgctctgcgtcacccaggtgctgatgatgcgaaccacctgggctttgtgcgaggctctcacactagccacggggcctatctccaccctgtgggagggcaacccggggcgcttctggaacaccaccatcgcagtgtcaatggcaaacatctttcggggctcctatctcgccggcgcagggttgctattcagcattatgaaaaacaccgcaaacactcggcgaggcaccgggaacaccggcgagacgctcggcgagaagtggaagaatcggctgaacgccctggggaagagcgagtttcagatctacaagaagagcggaattcaggaggtcgaccgaaccctcgccaaggaggggatcaagcggggtgaaaccgaccaccacgccgtgtcccgagggagcgcgaaactccggtggttcgtcgagcggaacctggtcacccccgagggcaaggttgtggaccttggctgtgggcgcggcgggtggtcatactactgcggcgggttaaagaacgtccgcgaggtgaagggcctcacgaagggggggcccggccacgaggagccgatccccatgagcacctacggttggaatctcgtgagactgcagtccggcgtagacgtgttcttcacgccacccgagaagtgcgatactctactctgcgacattggggagagctcccccaacccgacgatcgaggccggccgcaccctgcgcgtgcttaaccttgtcgagaactggctgaacaataacacccagttttgcattaaggtgcttaacccttacatgccttcggttatcgaaaagatggaggccctgcagcgcaagtacggcggggccctcgtcagaaacccgttgagcagaaattccactcatgagatgtactgggtttcgaacgcctccggcaatatagtaagctccgtcaatatgatctcccggatgctgattaacagattcaccatgcggcacaagaaagcgacttatgagccggatgtggacctcggcagtggcacgcgcaacatcgggatcgagtccgagacgcccaacctggacatcatcggcaagcgcatcgagaagattaagcaggagcatgagacctcttggcactacgaccaggaccacccctacaagacgtgggcataccacggtagctacgagaccaagcagaccggctctgcctcttcgatggtcaacggcgtcgtgcggctgctcacaaagccgtgggacgtgatccccacagtcacccaaatggccatgaccgacaccacgccattcgggcagcagcgcgtgttcaaggagaaggtagatactcggacccaagaacccaaggagggtaccaagaaactgatgaaaatcacggccgagtggctgtggaaggaactcggcaaaaagaagaccccacgtatgtgtacccgggaagagttcacccgcaaggtccggagcaacgcggcccttggagctatcttcactgacgaaaataagtggaaaagcgcccgcgaggccgtggaagactcgcggttctgggagctggtcgacaaggagcgcaacctccatctggagggcaagtgcgagacctgcgtgtacaacatgatggggaagcgtgagaagaagctgggcgagttcgggaaggccaagggctcccgcgccatatggtatatgtggttaggcgcccggttcctggagttcgaggccctggggttcctaaatgaggatcactggttcagccgcgagaactctctgagcggcgtggagggggagggcctgcacaagctcgggtacatcctgcgggacgtaagcaagaaggagggcggcgcgatgtacgccgacgacaccgccggctgggacaccaggattacgctagaggacctcaagaatgaggaaatggtcacaaaccacatggagggcgagcacaagaaacttgccgaggccatcttcaagctgacctaccagaacaaggtggtccgggtgcaacggcccacgccccggggaacggtgatggacatcatctcccgccgggaccaacggggtagcgggcaggtgggcacttatggcctcaacaccttcactaacatggaggcgcagcttattcgccagatggagggtgaaggggtgttcaagagcattcagcacttaacggttaccgaggagatcgccgtccagaactggctcgcccgggtggggcgcgagcggctgagtcggatggcgatctccggtgacgactgcgtggtcaagcccctggacgatcggttcgcgagcgctctgactgccctaaacgacatgggcaaagtgcgcaaggacatccagcagtgggagccgtcccgtgggtggaacgactggacccaggtgcccttctgctctcaccattttcacgagctgatcatgaaggacggccgcgttctggtggtcccatgccggaaccaagacgagctgatagggcgggctcggatttcccaaggggccgggtggtcactgcgggaaacggcctgcttaggcaagtcatacgctcagatgtggagcttgatgtacttccaccggcgggacctccggttggcagccaatgccatatgctccgccgttcccagtcactgggtgcctacctcccgcaccacctggtctattcacgcgaggcatgagtggatgactacggaggatatgctgaccgtctggaaccgagtgtggatccaagagaacccgtggatggaggacaaaacgccggtggagtcctgggaggagattccctatctcggcaagcgggaggatcagtggtgcgggagcctcatcggactgaccagccgcgccacgtgggccaagaatatacagaccgccatcaatcaggttcgctccctaatcgggaacgaggagtacaccgactacatgccgagcatgaagcggttcaggcgcgaggaggaggaggcgggcgtcctctggtag

SEQ ID NO: 25547 - RNA, 9876 nt, synthetic construct
  misc_feature 1..9876: note = derived and/or modified CDS sequence (opt11) from DENV-2__GQ398262__SS-prME
  source 1..9876: mol_type = other RNA
accgccggcatgatcatcatgctaattcccaccgtgatggccttccatctcaccaccaggaacggggagccccacatgatagtgagccggcaggagaaaggcaagtccctcttgttcaaaaccgaggacggagtgaacatgtgcaccctcatggctatggacctgggcgagctgtgcgaggataccatcacctacaactgccctctcctgcgccagaacgaacccgaagacatcgactgctggtgtaattcgacctcaacttgggtgacctacgggacctgcaccgccaccggcgagcaccggcgcgagaagcggagcgtcgccctggtgccccacgtgggcatggggctcgagacccgcaccgagacatggatgtcctcggagggcgcgtggaagcacgcccagagaatcgagacctggattctccgtcatcccgggttcacgattatggcggcaatactggcgtacactatcggcaccacctacttccagcgggtcctcatatttatcctgctcacggccgtagccccctccatgaccatgaggtgcatcgggatttcaaaccgggactttgtggagggtgtatccgggggaagctgggttgacatagtgcttgagcatgggtcctgtgttacgaccatggccaaaaacaaaccgacgctggacttcgagctgatcaagaccgaagctaagcagccggccaccctccgaaagtactgcatcgaggctaagctgaccaacacgactaccgcgagccggtgcccgacgcagggggagccctccttaaacgaggagcaagacaagcggttcgtgtgcaagcattcaatggtcgaccggggctggggcaacgggtgcggcctcttcgggaaaggcgggatcgtcacgtgcgccatgttcacgtgcaagaagaacatggaaggcaaggtcgtgcagccagagaatctagagtacaccatcgtaatcacgcctcactcaggcgaggagaacgccgtggggaacgacacgggcaaacacgggaaagagatcaagatcaccccgcagagctccatcaccgaggccgagctgaccggctacgggaccgtgacgatggaatgcagcccccgcaccgggttggacttcaatgagatggtgctgctgcagatggagaacaaagcttggctcgtccaccggcagtggttcctggaccttcccctcccctggctcccgggcgcggacacccaggggtctaattggatccaaaaggagacacttgtgacgttcaaaaacccccacgcaaagaagcaggacgtcgtggtcctcggcagccaggagggagccatgcacaccgccctgaccggcgccaccgagatccagatgtcatccgggaacctcctattcacgggtcacctgaagtgccgcctgcggatggacaagctccagcttaagggtatgagctactccatgtgcaccgggaagttcaaggtcgtgaaggagatcgctgagacccagcacggcaccatcgtcatccgcgttcagtacgaaggggacggcagcccatgcaagatcccttttgagatcatggacctggagaagcgtcacgtgctaggccgcctgatcacagtcaatccgatcgtgaccgagaaagactcccccgtgaacattgaggctgagccccccttcggggatagctatatcatcatcggcgtagagccggggcagctaaagctcaattggtttaagaagggctccagtatcgggcagatgttcgagacaaccatgcgcggcgccaagcgaatggctatcctaggggacacggcttgggactttgggtcgctgggcggcgtgttcactagcataggtaaagcgctccaccaggtgttcggtgcgatctacggcgccgccttctccggcgtaagctggaccatgaagatactgataggggtggttattacctggataggaatgaactcccggagcaccagcctgtcggtcagcctggtgctcgtgggggtcgtgaccctgtacctgggcgtgatggtccaggcggacagcgggtgcgtcgtgtcgtggaagaacaaggagctcaagtgcggcagcgggatcttcatcaccgacaacgtccacacatggacggagcagtacaagtttcaacccgagagcccctccaagctcgccagcgccatccaaaaggcccacgaggaggggatctgcggaatcaggagcgtgacccgcctggagaatctcatgtggaagcagatcacccccgagctgaaccacatcctgtccgagaacgaggtaaggctcaccatcatgacgggggatataaaggggatcatgcaggccgggaagcgctcgctgcggcctcagccaaccgagctgaaatacagctggaagacctggggcaaagcgaagatgttaagtacggagcttcataaccagacgttcctgattgacgggcccgagacggccgagtgcccgaacaccaaccgcgcctggaactctctcgaggttgaggactacggtttcggtgtgttcacaactaacatatggttgaagctgaaggaaagacaggatgtgttctgcgattccaagctcatgagcgcagccatcaaagataaccgcgcggtccacgccgacatggggtactggatcgaatccgccctgaacgacacctggaagattgagaaggccagctttatagaggtgaagtcctgccactggcccaagagccacaccctctggtccaacggcgtgctcgagagcgagatgatcatacccaagaacttcgccggccccgtctcccaacataattaccggcctgggtaccacacccaaactgcgggcccatggcacttggggaagctagagatggacttcaacttctgcgagggcacgacagtggttgtcaccgaagactgcgggaaccgcggtcccagccttcggaccactacagccagcggcaagctcatcactgaatggtgctgccgctcctgcacactgcccccgctccggtaccgcggggaagacgggtgctggtacgggatggagatccggcccctgaaggagaaggaggaaaatctagtgaacagtctcgtgacggccgggcatgggcagatagacaacttctccctcggagtcctgggcatggctctcttcctggaggagatgcttcgcacccgggtgggaacgaaacacgcgatcctcctggtcgccgtgagcttcgtcaccctgatcaccggcaacatgtcattccgcgacctagggcgcgtaatggttatggtcggcgcaacgatgactgacgacatagggatgggagtgacatacctggcccttctcgccgcgttcaaagtccgtcccacgttcgccgccggcctgctgctcaggaagctgaccagtaaagagctgatgatgaccactatcggaatagtgttgttatcccagagcacgatacccgaaacgatcctggaacttaccgacgctctggcactgggaatgatggtcttaaagatcgtccggaatatggaaaagtaccagctggccgtcaccatcatggccatcttatgtgtcccgaacgccgtgatcctccaaaatgcatggaaagtgagctgcacgattctggccgtcgtgagtgtcagcccactgctcttaaccagctcccagcagaaggcggactggatacccctggccctcaccatcaaggggctgaaccccaccgccatcttcctgacgaccctcagccgcacatccaagaaacggtcatggccgctgaacgaggccataatggcggttggcatggtgagtatcttggcgagcagtctcctgaagaacgacattcccatgaccggccccctggtggccggaggcctcctcacggtatgttacgtgctgaccgggagaagtgccgacctcgagctggagcgggcggcggacgtgcgctgggaagaccaggccgagatcagcggttccagccccatcctttccatcaccatcagcgaggacgggtcgatgagcatcaagaacgaggaggaggagcagacgctcacgatactgatccggaccggcctgctcgtcatcagcggtctcttcccggtatcaatcccaatcaccgccgctgcatggtacctgtgggaggtgaagaaacagcgcgccggggtcctgtgggacgtgcccagcccgccgcccgtgggcaaggccgagctggaggacggtgcctaccggatcaagcagaaaggcatcctggggtacagccagatcggagccggtgtgtataaagaagggaccttccacaccatgtggcacgtgacgagaggggccgtgctcatgcacaaggggaagcggatcgagccgtcctgggcggacgttaagaaggacctgatatcgtacggcgggggttggaaactggagggcgagtggaaggagggggaggaagtccaggttcttgccctggagcccggcaaaaacccccgggccgtgcagacgaagcccgggctgttcaagactaacaccggtacgatcggggccgtgagcctcgatttcagtcccggcacatcgggcagccccatagttgacaagaaaggcaaggtcgttggcctgtacgggaatggcgtggtcacccggtcaggcacatacgtatcggccatcgcccagacggagaaatctattgaagataaccccgagatcgaggatgacatcttccgcaagaagcggttgactatcatggacttacaccccggggccggcaagaccaagcgctatctccccgcgatcgtgagagaagccatcaagcgcggcctgcggaccctgatcttggcgccgacgcgcgtcgtggccgcggagatggaggaggccctgcgcggcctgcccatccgttaccagacccccgccatccgagcggaacacaccgggcgcgaaatcgtggacctgatgtgtcacgccacatttacgatgcgcctattgtctcccgtgcgcgtgccgaactacaacttaatcatcatggacgaggcccacttcaccgaccctgccagcatcgcggcgcgcggctacatatccacccgggtggagatgggggaggccgccgggatcttcatgactgccactccgcccggcagccgcgaccccttcccacagagcaacgcccccatcatggacgaagagcgggaaattcccgaacgcagctggaactccgggcacgagtgggtcacagacttcaaaggcaaaacggtgtggttcgtgcccagcatcaaagcggggaacgacatagccgcctgcctgcggaagaacggcaagaaggtcatccagctaagccgcaagaccttcgacagcgagtacatcaagacacggaccaatgactgggatttcgtagtgaccaccgacatttccgagatgggtgccaatttcaaggcggagcgcgtcatcgaccctcggaggtgtatgaaaccagtgattctgacagatggagaagagcgggtgatcttagccggccccatgccagtcacacacagctccgcagcccaaagacgtgggcgcatcggcagaaaccccaagaacgaaaacgaccaatatatctacatgggggagcctctggagaacgacgaggactgtgctcactggaaggaggcgaagatgctcctggacaatatcaacacccccgaaggcattatccctagcatgttcgagccagagcgggagaaggtcgatgccatagacggcgagtaccgcctgcgcggagaggcccgtaagacctttgtggatctcatgcggcggggcgacttaccggtctggctggcttaccgggtggccgccgaaggtattaactatgcggaccgacggtggtgtttcgacggcataaaaaataaccagatactcgaagagaatgtcgaagtggaaatatggaccaaggaaggggagcgcaagaagttgaagccccggtggttagatgcccggatctactcagacccgctcgccctgaaggagttcaaggagttcgccgccggccggaagtccctgaccctcaacctgatcaccgaaatggggcgcctccccaccttcatgacgcagaaagccagaaacgctctcgacaacctggccgtgctgcatacagcggaggctgggggccgcgcctataaccacgcgctctccgagctgcccgaaaccctggagaccctcctgctgctcacactgctggccaccgtcaccgggggcatcttcctgttcctcatgagcggcaaagggatcggcaagatgaccctgggaatgtgctgcataattacggcgtccatcctcctgtggtacgcccagatccagccgcactggatcgcagcgagcatcattctggagttcttcctcatcgtgctgctgatccccgagcccgagaagcagcgaacgcctcaggacaaccagctcacatatgtcgtcatagccattttaaccgtcgtggcggcgaccatggccaacgagatgggtttcctggaaaaaaccaaaaaggacttcgggctcggctccatcgccacccaacagccggagagcaacatcctggacatcgaccttcgccccgcctctgcgtggaccctctatgccgtggctaccacgtttataacgcccatgctgcggcactccatcgagaatagctcggtaaacgtgagcctaaccgccattgcgaaccaggcgacggtccttatgggtctgggtaaagggtggccactgtccaagatggacataggggtgccgctactggctatcggctgctacagccaggtgaaccccatcacgttaaccgccgcgctcctgttgctcgttgcgcattatgccatcatcgggccgggcctgcaggcaaaggccacgcgcgaggctcagaagcgggcggccgccgggatcatgaaaaaccccacagtggacgggatcacggttatcgaccttgatccgatcccatatgaccccaaattcgagaaacagctcggccaggtcatgctgctggttttatgcgtgacccaggtcctgatgatgcgcaccacatgggccctgtgtgaggccctcacgctggcaacggggcccatttccaccctgtgggaggggaacccggggcggttctggaatactacgatcgccgtctctatggccaacatcttcaggggttcctacttagccggggccgggctgctgttcagcattatgaagaacacagcgaacacccgtcggggcactgggaacacgggcgagacgctcggcgaaaaatggaagaaccgcctgaacgctttggggaagtccgaattccaaatctacaagaagtccgggatccaggaggtggaccggaccctcgccaaggagggtataaagcgcggggagaccgaccaccacgcggtttcccgaggaagcgccaagctgcgctggttcgtggagcggaacctggtgacgcccgagggcaaggtcgttgacctaggctgtgggcgcggcgggtggtcgtattattgcggcgggttgaagaacgtacgggaggtgaagggcttaaccaagggcgggcccggtcacgaggagcctatcccgatgagcacgtacgggtggaatctagtgcgactccagtccggagtggacgtcttcttcacgccccccgagaaatgcgacactctgctctgcgatataggggagagttcccccaatcccactgtagaagccgggcggacactgcgcgtgctgaacctcgtggaaaattggctgaacaacaacacccagttttgcatcaaggtgctgaacccatatatgcccagcgtgatcgagaagatggaagctctgcagcggaaatacggcggggcccttgtaagaaaccccctgagccggaactctacccacgagatgtactgggttagcaacgcctccggcaacatcgtgagctcagttaacatgatcagccgcatgctgatcaataggttcacgatgagacacaagaaggcgacctacgaacccgacgtggacctagggtccggaacccgcaatattgggatcgagagcgagacccccaatttagacatcattggaaagagaatcgagaaaatcaagcaggagcacgagacgtcatggcactacgatcaggaccatccctataagacctgggcctaccacggcagctacgaaaccaagcagaccgggtccgcctcgtccatggtgaatggtgtagtgcgcctgctcacaaagccgtgggatgtcatccccatggtcacccagatggccatgacggacaccactccctttgggcagcaaagggtgtttaaagagaaggtggacacccgcacacaagagccgaaggaaggcaccaaaaagctcatgaagatcacggccgagtggttgtggaaagagctcggcaagaagaagaccccgcgcatgtgcacgcgcgaagagttcacccggaaggtccgcagcaacgccgccttaggcgccatcttcacggacgagaacaagtggaagtctgcccgggaggccgtcgaggacagccgcttctgggagttggtcgacaaggagcggaacctccacctggaagggaagtgcgagacctgcgtgtataacatgatggggaagcgcgagaagaagctgggggagttcgggaaggcgaaagggtctagagccatctggtacatgtggttgggcgcccgcttcctggagttcgaggcccttgggttcctcaacgaggaccactggttcagccgggagaactccctgtccggcgtggagggggagggcctgcacaagctcgggtacatcctgcgcgacgtcagcaagaaggaggggggagcgatgtacgccgacgacaccgccggttgggacactcgaatcacgctggaagacctcaagaacgaggagatggtgaccaaccatatggagggtgagcacaagaagttagccgaggcgatcttcaagctgacgtaccagaacaaggtggtccgcgtgcagcggcccacgccccgggggacggtgatggatatcatcagccggcgagaccagcgcggcagcgggcaagtcggcacctacggcctcaacaccttcactaacatggaggcgcagctgatcaggcagatggagggggaaggcgtgttcaaatccatccagcacctgacggtaaccgaagagatagcagtacagaactggttagcccgcgtgggccgtgaacgtctgagccggatggcgatctccggcgacgactgcgtggtcaagccactggacgacaggttcgccagtgcgctcaccgccctgaacgacatgggtaaggtgcggaaagacattcagcagtgggagccttcccgcgggtggaatgactggactcaggtgcccttctgcagccaccacttccatgagctaataatgaaagacggccgggtcctggtagtgccttgtagaaaccaggacgagcttattgggcgggcccgcatctcacaaggggcggggtggagcctgcgggagacggcctgtcttggcaagtcctacgcgcagatgtggagcctgatgtatttccaccgccgtgaccttcggctcgccgccaatgctatctgctccgccgtcccctcacactgggtgccgacctcccggaccacctggagcatccatgcgcgccacgaatggatgacgacggaggatatgctgaccgtttggaatcgggtgtggatccaggagaacccctggatggaggacaagactcccgtggagtcctgggaggagatcccctacctgggcaaacgcgaggaccagtggtgcgggagcctcataggcctgacaagccgcgctacctgggccaagaacatccagaccgccatcaatcaagtgcggtccctgatcgggaacgaggagtacactgactacatgccaagcatgaagcgcttccgtagggaggaggaagaggcgggcgtgctttggtga

SEQ ID NO: 25548 - RNA, 9876 nt, synthetic construct
  misc_feature 1..9876: note = derived and/or modified CDS sequence (opt11) from DENV-2__GQ398261__SS-prME
  source 1..9876: mol_type = other RNA
accgccggtatgataatcatgttgatccccaccgtcatggctttccacttgacgaccaggaacggcgagccccacatgatcgtcagccggcaggagaagggcaagagcctactgttcaagaccgaggacggagtcaacatgtgcaccctcatggcgatggacctgggggagctgtgcgaggacaccatcacctacaattgccccctcctccggcagaacgagcccgaagatatagactgctggtgcaactcaacatcaacgtggatcacgtacgggacgtgcaccgcgaccggcgagcatcggcgggagaagcggagcgtggccttggtcccccacgttggcatggggctcgaaaccaggaccgagacctggatgtcaagcgagggcgcttggaaacacgcccagcggattgagacctggatcctgcgtcaccccgggttcacgatcatggcggccatcttagcctacacaatcggcacgacctacttccaacgggtactcatcttcatcctcttgacggcggtcgcgccctcaatgaccatgcgctgtatcggtatctcgaaccgggacttcgtggagggcgtctccggcgggagctgggtagacatcgtactcgagcacggcagttgcgtgaccaccatggcgaagaacaagcccacgctggacttcgagctaatcaagacagaggccaagcagcccgctaccctccgcaagtattgtatcgaagccaagctgacgaacacaaccaccgctagccgctgcccgacacagggtgagccttctttaaatgaggaacaagataagcggtttgtgtgcaagcatagcatggttgaccggggctgggggaacgggtgcggcctcttcgggaaaggcgggatcgtgacgtgcgctatgtttacgtgtaaaaagaacatggagggtaaagtcgtgcagccggagaatctggagtacaccatcgtgatcacgccccacagcggcgaagaaaacgccgttgggaatgatactggcaagcacgggaaggagatcaagatcaccccgcagagttcaatcaccgaagccgaactgaccggctacgggaccgtgactatggagtgtagccccagaaccggcctcgacttcaacgagatggtgttgctgcagatggaaaacaaggcctggctcgtacaccggcagtggttcctcgatctgcctctgccatggctgccgggcgcggacacccagggatcaaactggatccaaaaggagaccctggtgacgttcaagaacccccacgccaaaaagcaggacgtggtcgtgctcggctcgcaagagggggcgatgcacactgcactgactggcgccactgagatccaaatgtcctccgggaacctactgttcactggccacctcaagtgccgcctgaggatggacaaactccagttaaagggcatgagttacagtatgtgcactggtaaattcaaggtcgtgaaggagatcgcggagacccagcacggcaccatagtcgtacgcgtgcagtacgagggcgacggcagcccctgcaaaatcccctttgagatcatggatcttgagaagagacacgtgctaggccgtctgatcacggtcaacccaattgtgaccgaaaaggacagtccggtcaatattgaggccgagccgcccttcggggacagctacatcattattggcgttgagccggggcagctgaagctcaactggtttaagaaggggtccagcattgggcagatgttcgaaacgaccatgcgcggcgctaagcggatggccattctgggtgacacggcatgggacttcgggagtctgggaggggtgttcaccagcatcggcaaggcgctccaccaggttttcggggccatatacggcgccgccttctccggagtcagttggacaatgaagatactgattggggtggtgatcacatggattggcatgaacagtcgaagcacatccctgagcgtctccctcgtgctcgtcggtgtcgtgaccctgtacctgggcgttatggtccaggcggattctgggtgcgtagtgtcttggaagaataaggagctcaagtgtggctcaggcattttcgtcaccgacaacgtccacacctggacggagcagtacaagttccaacccgagagcccctcgaagctggccagcgcgatccagaaggcccacgaggaggggatctgcgggatccggtccgtgactcggctggaaaacttgatgtggaagcagatcaccccggagctcaatcacattctgtccgagaatgaagtaaagctcaccattatgacgggagacattaagggcatcatgcaggccgggaagcgatccttgagaccgcagcccaccgaactgaagtacagttggaaaacttgggggaaggccaagatgttgtccacggagctccacaaccagaccttcctgatcgacggccccgagaccgcagaatgtccgaacaccaaccgcgcttggaacagcctcgaggtggaggactacgggttcggcgtgtttaccaccaatatctggctgaagctgaaagagcgacaggacgtcttttgcgactctaagcttatgagcgccgccatcaaagataaccgggcggtacacgccgatatgggatactggatagagtctgccctgaatgacacctggaaaatcgaaaaggccagcttcatcgaggtgaagtcctgccattggcccaagagccataccttgtggtccaacggcgttctggagagcgagatgatcatccccaagaacttcgcgggacccgtgagtcagcacaactaccgcccggggtaccacacccagacggccggaccctggcacctggggaagttagaaatggactttaacttctgcgagggcaccaccgtcgtcgtgaccggagactgtggcaaccggggccccgcgctacgcaccacgaccgccagcgggaaattaatcactgagtggtgctgccgaagctgcaccctgcccccgttaaggtaccggggtgaggacgggtgctggtacggcatggagatccgcccattaaaggagaaggaggagaacctggtgaactccctcgtcacggccgggcatggccagattgacaacttctcactgggcgtgctggggatggccctctttctggaggagatgctgcggacccgcgtaggcacgaagcacgccatcctcctggtcgccgtctccttcgtgactctgatcacggggaatatgagcttccgggacctcggccgcgtcatggtaatggtcggggccaccatgacagacgacatcggcatgggggtcacatatctggccctgctcgccgctttcaaggttcgccccacgttcgccgcgggtctgctgctccggaagctgacctcgaaggaactgatgatgacaacgatcggcatcgttctcctaagccagtccacgattcccgagacaatcctggagctcactgatgccctagcgctggggatgatggtgctcaaaattgtgcgcaacatggagaagtaccaactggcagtgaccatcatggcgatcctttgcgtgccgaatgcggtcatcctccagaacgcatggaaagtttcctgtacaatcctcgcggtggtatctgtctctcccctgctcctgacctcctcccaacaaaaagcggactggatccctcttgccctcaccatcaagggcctgaaccccaccgcgatattcttgaccaccctctcccggacaagcaagaaaaggagctggcccctgaacgaggcaatcatggccgttggcatggtatcgatcctggcatccagcctcctgaagaacgacatccccatgaccggtccgctggtggccggcgggctgctgacggtgtgctacgtgctgaccggccggagtgccgatctcgagctagagagggcagccgacgtccgctgggaagaccaggcagagatctctgggagctcgcccatcctgagcatcaccatctccgaggacggctctatgtccatcaagaatgaggaagaggaacagacgctcacgatcctgatccgcaccggactgcttgttatcagcgggctgtttccggtgtccatccccatcaccgcagctgcatggtacctgtgggaggtcaaaaagcaacgagcaggtgtgctctgggacgtgccgagccccccgccggtagggaaggccgaactggaggacggcgcgtaccgcataaaacaaaagggcatcctgggctactcccagatcggcgccggggtgtataaagagggcaccttccacaccatgtggcatgtgacccgcggggcggttctcatgcacaagggcaaacgcatcgagcctagctgggccgacgttaagaaggacctgatctcctacggaggggggtggaagctagagggtgagtggaaggagggagaggaggtccaggtcctcgctctggagcccgggaagaaccctcgggccgtgcagaccaagcccggtctgttcaaaacaaataccgggactatcggggccgtttcactcgacttcagccccggaacctctggatcccctatcgtcgacaagaagggcaaggtggtggggctgtacggcaacggcgtcgtgacccgctcggggacatacgtttccgcgatcgcccagacggaaaagtcgatagaggacaaccccgagatcgaggacgacatcttccgaaaaaagcgtctgaccatcatggacctacatcccggtgccggaaagacaaagcggtacctccccgctatcgtccgagaggcgatcaagcggggtctgcgcaccctgatcctcgcgccgacgcgggtagtggcagcggagatggaggaggccctgcgcgggctgccgattcgctaccagacccccgcaatacgggcagagcacaccggccgcgaaattgttgacttaatgtgccatgccacgttcactatgcggttattgtcccctgtgcgcgtgccgaactacaacctcatcattatggacgaggcccactttacggaccccgctagcatcgccgcccgggggtacattagcacccgcgtagagatgggggaggccgccggcatcttcatgaccgccacgccacccggctcgcgggaccctttcccgcaaagtaatgctccgattatggacgaggagcgcgaaatccccgagcggtcctggaatagcggccatgagtgggtgaccgacttcaagggaaagacggtctggttcgtcccatccatcaaggccggcaatgacatcgccgcctgcttgcgcaagaacggaaaaaaagttatccagctgtcacggaagaccttcgatagtgaatatatcaagacacgcaccaacgattgggactttgtagtcaccaccgacattagcgagatgggggcgaacttcaaggccgagcgagtgatcgatccacgccggtgcatgaagcccgttatactcacggacggcgaggagcgcgtcatcctcgccgggcccatgccggtcacacactccagcgctgcccaacggcgcgggcggatcgggcggaatcctaagaacgaaaatgaccaatatatctacatgggcgagcccttagagaacgatgaggactgcgcgcactggaaagaggccaagatgctgctggacaatatcaacaccccagagggcataattccgagtatgttcgagcccgagcgcgaaaaggtggacgccatcgatggggagtaccgcttacggggggaggcccggaagaccttcgtcgacctcatgcgccgtggggacctacccgtctggctggcctaccgcgtagcggccgagggcattaactacgctgaccggcgctggtgcttcgacgggataaagaacaaccaaatcctcgaggagaacgtcgaagtggaaatatggacgaaggaaggtgagcggaaaaagctgaaaccacgctggctggacgcccggatctacagcgacccgttggctctgaaggaatttaaggagttcgcggccggccgcaagagcctgaccctcaatctgatcaccgaaatcgggcgactgcccactttcatgacgcagaaggcccgcaacgctctcgacaatttagcggtcctgcacacggctgaggccggtgggcgagcctacaaccacgccctcagcgagctgcccgaaaccctggaaaccttactgctgcttaccctgctggctaccgtgactggcggcatattcttattcttgatgtcgggaaaaggaatcgggaagatgactctggggatgtgctgcatcataaccgcctctattctcctttggtacgcccagatccagccgcattggatcgccgcctccatcatcttggagttctttctgatcgtgctgcttatccccgaaccagagaagcaacgcacgccccaggacaatcagttaacctacgtggtgatcgcgatcctgaccgtggtcgctgccacgatggccaatgaaatggggttcctagagaagaccaagaaggatttcggcttagggagcatcgcgacccagcagccagaatccaacatactggatatcgacctgcggccagcgagtgcctggaccctatacgccgtagccaccacgttcataacccctatgctgcgccacagcatcgagaattcgagcgtgaacgtatcgctgaccgctatcgcgaaccaggccaccgtgctcatggggctgggaaaggggtggcccttgagcaagatggacatcggggtgccgctcctggcgatcgggtgttactcccaggtcaacccaatcactctgaccgccgcgctcctgctcctcgtggcccactatgccatcatcggccctggcttacaggccaaggccacccgggaggcacagaagcgagcggccgccgggataatgaagaatcccaccgtggacggaataacggtcatcgacctggatccgataccctacgacccaaagttcgagaagcagctcgggcaggtgatgctcctggtcttgtgcgtaacccaggtgctgatgatgaggaccacttgggccctatgcgaggcgctcacgctcgccaccggccccattagcaccctgtgggaagggaatccaggtcgcttctggaacacgacgatcgcggtctccatggccaacatcttccgcggcagctacttagccggggccggcctgctgttttccatcatgaagaacaccgctaacacgcggcgcggaaccggcaacacgggcgaaaccctcggcgagaagtggaagaaccgcctaaacgccctgggcaaaagcgaattccagatctacaagaaatctgggatccaggaggtcgacagaaccctcgctaaggagggtatcaagcgcggggagaccgaccaccatgccgtgtcacgcggctctgccaagctgcggtggtttgtcgagcgcaacctggtgacgcccgagggcaaggtggtggatctagggtgtgggcgcggcgggtggtcttactactgcggcggtctgaagaacgtacgagaagtgaaggggctgaccaaaggtgggcccgggcacgaggagcctattcctatgtcaacatacggctggaacctcgtgaggctgcagagcggggtagacgtgttcttcacaccacccgagaagtgcgacacgcttctctgcgacatcggcgagtcgtctcccaaccctaccatcgaggccggccgtaccctgcgggtgctgaacctcgtcgaaaactggctgaacaacaacacccagttctgcataaaggtgctgaacccttacatgccgtcagtaattgaaaagatggaggccttgcagcgcaagtacgggggcgccctcgtgagaaaccctctgtcccgcaattcaacccacgaaatgtactgggtctccaacgcgagcggtaacatcgtgtccagcgtcaacatgatctcccggatgctgatcaatagattcaccatgcggcataagaaagccacatacgagcccgacgtggacctcggcagcggtacacgaaacatcggcatcgagtcagaaacacccaacctggacattattggcaagcgcatcgagaagatcaagcaggagcacgagacgtcctggcactatgatcaggaccacccctataagacctgggcctatcatggttcctacgagaccaagcagaccggcagcgcctcctcgatggtgaacggggtcgtgcggctgttaacgaagccgtgggacgtaattcccaccgtcacccaaatggccatgaccgacacgacgccgttcggccagcagcgtgttttcaaggagaaggtggacaccaggacacaggaaccaaaagagggcacgaagaaactgatgaagatcacagctgagtggctgtggaaggagctcgggaagaagaagaccccgcgcatgtgcacccgtgaggagtttactcgtaaggtccgttccaatgctgctctcggagccatcttcaccgatgagaacaagtggaagtccgcgcgcgaggcggtggaggattcccgattttgggagctcgttgataaggaacgtaacctccatctggaagggaagtgcgagacctgtgtgtacaacatgatgggcaagcgagagaagaagttgggcgagttcggaaaggccaaaggctcgcgcgccatctggtacatgtggctcggtgcccggtttctggagtttgaggcgctggggttcctcaacgaggaccactggttttcccgcgagaacagtctcagcggggtggagggagaggggctgcacaagctcggctatatactgcgggacgtaagcaagaaggagggcggagccatgtacgccgacgacacggccggctgggatactcgcatcaccctagaggacctcaaaaacgaggagatggtgacgaaccacatggagggcgagcataaaaagctggctgaagcgatcttcaagcttacctaccaaaacaaagtggttcgggtacagcgccctactccccggggcaccgtgatggacatcataagccgcagggaccagcgcggttccggtcaggtcggtacttacgggctcaacacgtttaccaatatggaggcgcagcttattcgccagatggagggagagggagtgttcaagagcatccagcacctgaccgttaccgaagagatcgccgtccaaaactggctcgcccgggttggacgcgagaggctatcccgcatggcaatcagcggagacgactgtgtggtcaagcccctggacgaccggttcgcttcggccctgaccgccctgaacgacatggggaaggtgagaaaagatatccaacagtgggagccgagcagaggttggaacgactggactcaggtgccgttctgctcccaccacttccacgagctgattatgaaggacggccgagtcctggtggtgccctgccggaaccaggacgaactgatcggacgcgctcggatatctcagggggctggatggtccctgcgcgagaccgcgtgcttgggcaagagctacgcccagatgtggagcctgatgtatttccatcggcgggacctgcggctcgccgcaaacgccatctgctcagccgtcccatcacactgggtacccacaagccgcaccacatggtcgatccatgctcggcacgagtggatgacgaccgaggatatgctaacggtgtggaacagagtctggatccaggagaacccctggatggaagacaagaccccggttgagtcttgggaagagatcccctatctggggaagcgggaggaccaatggtgtgggtccctcatcgggctgacttctcgcgccacctgggcaaaaaacatccaaaccgcgataaatcaggtgaggagtctcatcgggaacgaggagtacactgattatatgccgtccatgaagcgatttcgccgggaagaggaagaagctggagtattgtggtga

SEQ ID NO: 25549 - RNA, 9876 nt, synthetic construct
  misc_feature 1..9876: note = derived and/or modified CDS sequence (opt11) from DENV-2__GQ398313__SS-prME
  source 1..9876: mol_type = other RNA
accgcaggcgtgatcattatgttaattccgaccgcgatggctttccacctcaccacccggaacggggagccccacatgatcgtcggacggcaggagaagggcaagagcctcctattcaagacagaggacggcgtgaatatgtgtaccctcatggctatagacctgggggagctgtgcgaggacaccatcacatacaagtgccccctcctacgccagaacgaacccgaggacatcgactgctggtgcaatagcaccagcacatgggtcacttacgggacctgcaccaccacgggcgagcaccggcgcgaaaagcggagcgtcgctctggttccccacgttggcatgggccttgagacccggaccgagacctggatgtctagcgagggggcctggaagcacgtccagcgtatcgagacctggatcctgcgccacccgggcttcaccatcatggcggcgatcctggcctacaccatcgggaccacccatttccagcgggccctcatcttcatccttttaaccgccgtggcgcctagcatgactatgcgctgcattggcatctccaacagggacttcgtggagggcgtcagcggcggatcctgggtggatattgtgctcgaacacggcagctgcgtcacaacgatggctaagaacaagccgaccctggacttcgagctgatcaagaccgaggcaaagcagcccgccaccctcaggaagtactgcatagaggccaagctgacgaacaccaccaccgagtctcggtgcccgacgcaaggtgagcccagcttaaacgaggagcaggacaagcgcttcgtgtgcaagcattccatggtggaccggggctgggggaatggctgcggactcttcggcaagggtggcatcgtgacatgcgcaatgtttacttgtaagaagaacatggagggcaaggtggtgctgcccgagaaccttgagtataccatagtcatcacgccccacagcggggaagaacacgccgtgggcaacgacaccggtaagcatggaaaggagatcaagatcaccccgcaatccagcataaccgaggctgaactcaccgggtacggcactgtgaccatggagtgcagccccaggaccggcctggacttcaacgagatggtactactccaaatggaggacaaggcctggctggttcaccggcagtggttcctggacctccccctgccctggctgccgggggcagacacccagggcagcaactggatccagaaggagacgctggtgacgttcaagaacccccacgcgaaaaagcaggacgtcgtcgtcctggggtcccaggagggcgctatgcacaccgccctgacgggggccacggagatccagatgagcagcggcaacttactgttcaccggccacctgaagtgccgcctccggatggacaagctgcaactaaaggggatgtcgtacagcatgtgtacaggtaagttcaaaatcgtgaaggagatcgccgagactcaacacgggacaatcgtgatccgcgtccaatacgagggcgacggctcaccatgcaagatccccttcgagatcatggacctcgagaagcggcacgtgctggggcggctgatcaccgtgaacccgattgtcgcggagaaggacagcccggtgaacatcgaggccgagccgcctttcggcgattcctacatcataataggggtggagcccggccagctaaagctgaattggttcaagaaggggagctctattggccaaatgttcgaaaccaccatgcgcggcgcgaagcgaatggccatactgggggacacggcctgggacttcgggagtctcgggggtgtattcacctccatcgggaaggcactgcaccaggtgttcggcgccatttacggcgccgccttttcaggggtgtcatggaccatgaaaattctgatcggcgtcatcatcacctggatcggaatgaacagccgctccacgagcttgagtgtaagcctagtgctggtcggcgtggtcaccctgtatctcggagcgatggtacaggccgacagtggctgcgtggtgagctggaaatcaaaggagctgaagtgcggcagcgggatcttcataaccgacaacgtccacacttggacggagcagtacaagttccagcccgagagcccgtccaagctggcctcggctatacagaaggcccacgaggagggcatctgcgggatccggtccgtgacccgcctcgagaaccttatgtggaaacagatcacccccgagctgaaccacatcctcagcgagaacgaggtcaagttaaccatcatgacgggcgatatcaaggggatcatgcaggcgggcaaacgttccctgaggccgcagcccaccgagctcaagtacagctggaagacgtgggggaaggccaagatgctgtccactgagagccacaaccagacgttcttgatagacgggcccgagaccgccgagtgcccgaacaccaaccgggcctggaactcactcgaggtcgaggactatggattcggggtgttcaccacgaatatctggttaaagctgcgcgagaagcaggacgtcttctgcgacagcaagctcatgtccgccgcgatcaaggataaccgggccgttcacgccgacatgggctactggatagagagcgccctaaacgacacctggaaaatggagaaggcttccttcatcgaggtcaagagctgccactggcccaagagtcacaccttatggagcaacggcgtgctcgagtccgagatgatcatccccaagaatttcgcggggcccgtgagccagcacaattaccgcccgggataccacacccaaaccgccggcccctggcacctgggtaagctggagatggacttcgacttctgcgaggggacaacggtggtggtcaccgaggactgcggtaaccggggccccagcctccggaccacgaccgccagcggtaagttgattaccgaatggtgctgtcggagctgcaccctacccccgctccgctaccgcggcgaagacgggtgctggtacggaatggagattcgccccctgaaggagaaggaagagaacctagtaaactccctcgtgacggcagggcacggccagatcgacaacttcagcctgggcgtcctgggaatggcccttttcctggaggagatgctgcgaacccgcgtgggcaccaagcacgccatgctcctggtggccgttagtttcgtgacgctgatcacgggaaacatgagcttccgggacctcggccgagtgatggtcatggttggtgcaaccatgaccgacgacatcggcatgggcatcacctacctggctctgctcgcggcctttaaggtgagacccacgttcgccgccgggctgctgctccggaagctgaccagtaaggaactgatgatggccaccatcggcatcgcgctgctgagccagtccactatcccggagactatccttgagctcaccgatgcgctggccctagggatgatggtcctgaagattgtgcgcaacatggagaagtaccagctggcagtgacaatcatggcaatctcctgcgtcccgaacgcggtgatcttacagaacgcttggaaggtgagttgcacgatcctcgccgccgttagcgtgagccccctgttgctcactagctcccagcagaaggcggactggatcccactagccctgaccatcaagggcctcaaccccaccgccatcttcttgaccacgctatcacggacctccaagaagcgcagctggccgcttaacgaggccgtcatggccgtgggcatggtgtcaatcctggcgagcagcctgctcaagaacgatatccccatgaccggacccctagtcgccgggggactgctcactgtctgctacgttctgactgggcggtccgctgacctggagctcgagcgcgccgccgacgtcaagtgggaggaccaggcggagatctcggggtcctctcccatcctgtccataacgatctccgaggacggctccatgagcatcaagaacgaggaggaggagcagaccctgaccatcctcattcggacgggcctgctggtgatctctggggtgttccctgttagcatccccattacagctgccgcctggtacctttgggaggtgaagaagcagcgtgcaggcgtgctgtgggacgtcccgagtcccccgcccgtggggaaggcagagctggaggacggcgcataccggatcaagcagagagggatcctcggatattcccagatcggcgccggggtttacaaggagggcaccttccacactatgtggcacgtaacccgaggggcggtgctgatgcaccgcggcaagcggatcgagccctcgtgggccgacgtcaagaaggacctgataagctacggtggcgggtggaagctcgagggggagtggaaggagggcgaggaggtccaggtgctggcgttagaacccgggaagaaccccagagccgtgcagaccaagcccggtctcttcaagaccaacaccgggactatcggcgccgtctccctggacttcagccccggaacatccgggagcccaatcgtggaccggaaaggcaaggtggtagggctgtacggcaacggcgtggtgacccgctccggggcatacgtcagcgcgatagcccagactgagaagtccatagaggacaatcccgagattgaggatgacatcttcagaaagaaaaggctcaccatcatggatctgcaccccggcgccgggaagactaagcggtacctgcccgcgatcgtgcgtgaagccatcaagcggggcctgcgcaccctcatccttgcgccgacgcgcgttgtcgccgccgagatggaagaggccctgcgggggctccctatccgctatcagacccccgccatccgggcggagcacacgggccgcgaaatcgtggacctgatgtgccatgcaaccttcaccatgcgactgctctccccggtgcgcgtcccgaactacaatctgatcatcatggacgaggcccactttaccgaccccgcctcgatcgccgcgcggggctacatttccacgcgggttgagatgggtgaggccgccgggatcttcatgaccgccacgccgcccggcagccgggatccgtttccgcagtccaacgcccccattatggacgaggagcgtgagatccccgagcggagctggaactccggccacgaatgggtgacggatttcaaagggaagacggtctggttcgtgccgagtatcaaggcgggcaacgacatcgcagcctgcctgcgaaagaacggcaagaaagtcatccagctaagccggaaaaccttcgatagcgagtacgtgaagacccgcgccaatgattgggacttcgtggtgaccacggacatctccgagatgggggcgaacttcaaagccgagcgggtaatcgacccccgccggtgcatgaagcccgtgattctgaccgacggcgaggagcgcgtgatcctggccggccccatgccggtcacccactcctcagccgcccaacggagaggcaggatcgggcggaaccccaagaacgagaacgaccagtacatctacatgggggagccactcgagaacgatgaggactgcgcgcactggaaggaggccaagatgctgctggacaacatcaataccccagagggcatcatcccgagcatgttcgaacccgaacgcgagaaggtggacgccatcgatggggagtaccgtctccgcggggaagcccggaagacgtttgtggacctgatgcggcgcggggacctgcccgtgtggctcgcctaccgcgtggctgccgagggcatcaactacgcggaccggagatggtgttttgacgggatcaagaacaaccaaatcctggaggaaaacgtggaggtcgagatttggaccaaggagggcgagcggaagaagctgaagccgcggtggctcgatgcccggatctactccgacccactggcgctgaaagagtttaaggagttcgccgccggccgcaagtcactcactctgaacctcatcaccgagatggggcggctccctactttcatgacccagaaagcccgagacgccctggataaccttgcggtgctccacaccgccgaggcgggcggccgggcgtacaatcacgccctgtccgagcttcccgagaccctcgaaacgttgctgctcttgaccctcttggcgaccgtcaccggcggcatcttcctgttcttaatgtcagggaagggcatcgggaagatgaccctgggcatgtgctgcatcatcaccgccagtatcctgctgtggtacgcccagatccaaccgcactggatcgccgcgagcataatcctcgagttcttccttatcgtgctgctcatccccgagcccgagaagcagcgcacgccacaagacaaccagctgacctacgtggtgatcgcgatcctgaccgttgtggcagcaacaatggctaacgagatggggttcctcgagaaaacaaagaaggaccttggcctgggcagcatcgccacccaggagtctgagtcaaacatcctcgacatagacctgaggccggcctccgcctggacactgtacgccgttgccaccactttcgtgacgccgatgctccggcactccatcgagaactccagcgtgaacgtatccctgacggcaattgcgaaccaggcaacggtgctgatggggctcggcaaggggtggccattgtcaaaaatggacatcggtgtgcccctgctcgccatcggatgctactctcaggtcaacccgattaccttaacggccgcgctgctcctgctggtagcccattacgccatcatcggccccggactccaggccaaggcaacccgggaagcccagaagcgcgctgctgccgggatcatgaagaaccccacggtggacggcatcaccgtcatcgacctggaacccatcccctacgatccgaagttcgagaagcagctggggcaagtcatgcttctgatcttatgcgtgacccaggtcttaatgatgcgcaccacgtgggccctctgcgaggccctgaccctcgccacaggccccatcagcaccctgtgggaggggaaccccggccggttctggaacacgaccatcgcagtgtccatggcaaatatctttcgtggcagctatctggcgggtgccggactcctgttctccatcatgaagaacaccaccaacacccgacgcggcaccggcaacatcggcgagaccttgggggagaagtggaagtcacggctcaacgccctgggcaagtccgagttccagatctacaagaagagtgggattcaggaagtggaccgcaccctagctaaggagggtattaagcgcggggagacggaccaccacgccgtgtcccgcggcagcgcgaagctccgctggttcgtggagagaaacatggtgaccccagaagggaaggtagtggatctggggtgcggccgcggtgggtggtcctattactgtggcggattaaagaacgtgcgcgaggtgaaggggctcaccaaaggagggcccgggcatgaagaacctatacccatgagcacctacggctggaacctggtcagactgcagtcgggtgtggacgtcttcttcacgccgcccgagaagtgcgataccctgttgtgcgacatcggagagtcaagcccaaaccccacaattgaggccggcagaacccttcgggtgctcaacctggtggagaactggctcaacaacaacactcagttctgcatcaaggtcctcaacccgtatatgcccagtgtaatcgagaaaatggagaccctgcagcgaaagtacgggggcgcactggtgcggaatcccctgagccgaaactccacccacgagatgtactgggtcagtaacgccaccgggaacatcgtgtcgagcgtgaacatgatctcccgaatgctcatcaaccggtttaccatgaagcacaagaaagctacgtacgagccggatgtcgaccttggcagcgggacccgcaacatcggcatcgagtccgagatccccaacctggacataatcggcaagcgcatcgagaagatcaagcaggagcatgaaaccagctggcactacgatcaggaccacccttacaagacctgggcgtaccacggctcatacgagacgaagcagactgggtccgcgtcaagtatggtcaacggggtggtccgacttctgacaaagccctgggacgtagtaccgatggttacccagatggccatgacggacaccactcctttcggccaacagcgggtattcaaggagaaggtggacacccgcacgcaggagccgaaggaaggcaccaaaaagctgatgaagatcaccgccgagtggctctggaaagagcttgggaagaagaagacgccccgaatgtgcacgcgcgaggagttcaccagaaaggtacgttccaacgccgcgctaggtgccatcttcaccgacgagaacaagtggaagtccgcccgggaggccgtggaggactcccgcttctgggaactcatcgaccgggaacgcaacctgcacttagaggggaagtgtgagacctgcgtgtacaacatgatgggcaagcgggagaagaaactcggggagttcggaaaggcgaagggcagccgtgccatctggtacatgtggctgggggcccggttcctggagttcgaggccctcggcttcctgaacgaggaccattggttctctcgcgggaactccctttctggcgtcgagggggagggcctccataggctgggctacatcctccgcgacgtgagcaaaaaggagggcggggcaatgtacgcggatgacacggccggatgggatacccggatcaccctcgaggatcttaagaacgaggagatggtcactaaccatatgaagggcgaacacaagaaattggctgaggcgatcttcaagctgacgtaccagaacaaggtggtgcgcgtccagcggccgacgccccgggggaccgtgatggacatcatatcccgccgggaccagagaggctccggccaggtggggacctatggcctgaacacgttcactaacatggaggcccagctaatccggcagatggagggggaaggcatcttcaagagcatccagcacctaaccgtaacagaggagatcgcggtacaaaactggctggcgcgcgtgggtcgcgagcgcctgtcccggatggcaatcagcggggacgactgtgtcgtgaagcccctcgatgaccgcttcgcctccgccctgacggctctgaacgacatgggcaaggtgcggaaggacatccagcagtgggaaccatcccgcgggtggaacgactggacccaggtcccgttctgcagtcaccacttccacgagctcgtgatgaaggatggccgggtgctggtagtgccctgccggaaccaggatgagctgatcgggagagcccgcatttcacagggggccggctggtccctcaaggagactgcatgcctgggcaaaagctacgcgcagatgtggaccctgatgtacttccatcgacgcgatctccggctcgcggctaacgccatctgcagtgccgtgcccagccattgggtccctacgtctcgcacgacctggagcatccacgcgaagcatgagtggatgacgacggaagatatgcttgccgtctggaaccgggtctggattcaggaaaacccgtggatggaggacaagacgcctgtcgagagctgggaggaggtgccctacctcggcaaacgcgaggaccagtggtgcgggtccctgataggcctgaccagccgcgccacctgggccaagaacatccagaccgcgatcaaccaagtgcggtccctcatcgggaacgaggagtacacagactacatgcccagcatgaagcgattcagacgcgaggaggaggaggcgggcgtcctttggtaa

SEQ ID NO: 25550 - RNA, 9876 nt, synthetic construct
  misc_feature 1..9876: note = derived and/or modified CDS sequence (opt11) from DENV-2__GQ398285__SS-prME
  source 1..9876: mol_type = other RNA
acggccggggttataattatgttgataccaaccgcgatggccttccacctaaccacccgcaacggggaaccacatatgatcgtggggcgacaggaaaaagggaaatccctactgttcaaaacggaagacggtgtcaatatgtgcaccctaatggctattgatctaggggaactctgtgaagacacgataacttataaatgcccgctgctacggcagaatgaacctgaagatatagactgttggtgcaacagtaccagcacatgggtcacgtatggaacctgcacgacgaccggcgaacacaggcgggaaaaacgatcagtggcgcttgtaccccacgtcggtatggggttggaaacccgtacggagacgtggatgtcgtccgaaggagcctggaaacacgttcagcgaatagaaacctggatactaaggcatcccggattcacaatcatggccgcgatactcgcgtacacgattggaacaacgcacttccagagggccctcatatttatactcctgaccgcggtcgcacccagcatgaccatgcggtgcatcgggatcagcaatcgcgacttcgtagagggggtatccggcggatcatgggtggacatcgtcctcgagcacggaagctgcgtgacaacgatggcgaaaaacaaaccaacattagacttcgaactgattaaaaccgaggcgaaacaaccagccactctaaggaaatactgcatcgaggctaagttaactaatacaacgaccgagtcaaggtgccccactcaaggggagccgagcctcaacgaagaacaggacaaaaggtttgtgtgcaagcattctatggtagatcgcggatggggcaacggttgcgggttattcgggaaaggagggattgtgacatgtgcgatgttcacatgcaagaaaaacatggagggcaaggtggtcctgccagagaacctcgaatatacaatcgtcataacaccacatagtggcgaagaacatgccgtaggcaatgacacaggtaagcacggaaaggaaatcaaaataacaccccagagcagcatcaccgaagcagaattaacagggtacggaactgtaacgatggaatgctcaccccgaatgggacttgatttcaacgaaatggtgctattacagatggaagacaaagcatggctggtgcaccggcagtggttcctggacctccccttgccgtggctaccaggcgctgacactcagggcagcaactggatacaaaaggagacccttgtaacattcaaaaacccgcatgcgaagaaacaagacgtggtagtactaggatcgcaggaaggagccatgcacacagcgctcacgggagcgaccgaaatccaaatgagctcagggaacctgctatttaccggacacttaaagtgcaggctgcgaatggacaaactccaactgaaagggatgtcatattccatgtgtacagggaagtttaagattgtaaaggagatagccgaaacacagcacggaacaatcgttatacgggtgcaatacgagggggatgggagcccctgtaaaatacctttcgagataatggatttagaaaaacgccacgttttgggaaggctgatcacggtgaaccctatagtgacagaaaaagactcgcccgtcaatatagaggcagaaccaccctttggagatagctacatcatcataggagtggaaccgggtcagcttaaactgaactggttcaagaaaggaagctcgataggacagatgttcgagaccacaatgaggggcgcaaaacgtatggcaatcctaggggacacagcgtgggacttcggctcactgggcggcgtgtttaccagcatagggaaagcactacaccaggtgtttgggaccatatacggagcggcattctccggcgtttcgtggacaatgaaaattctgataggcgtaatcatcacctggatagggatgaactctcgttcaacaagcctaagcgtatcactcgtcctcgtaggggtcgtaacactgtatttgggagccatggtgcaagctgactccggctgcgttgtctcttggaagtcaaaggagctcaaatgcggtagtggaatattcatcaccgacaacgtgcacacctggactgagcaatacaagtttcagccggaatccccttcgaaattagcaagcgcaatccagaaggcccacgaggagggaatttgcggcatccggagcgtcacccgcctagaaaacctgatgtggaagcagatcacgccagaactaaatcacattctcagcgagaatgaagtgaaattaacgattatgacaggagggataaaaggcatcatgcaggcgggtaaaaggagcctaaggccacagccgacggagctaaaatattcctggaaaacgtggggaaaagctaaaatgctatctacagaaagtcataatcagaccttcttgatcgacgggccggaaacagcggagtgtccgaacactaatagggcatggaacagcttggaggttgaggactatggattcggagtgttcacaacaaatatatggctaaaactaagggaaaagcaagacgtgttttgcgacagtaaactcatgagtgcagcaattaaagacaatcgcgcagtccacgccgatatgggctactggatcgaatctgcgctgaacgacacatggaagatggagaaggcttccttcatcgaagtaaaatcgtgccactggcccaagagccatacgctatggtctaacggagtacttgagagtgagatgattattcccaagaacctagcgggccccgtgtcacaacacaactacagacccgggtaccacactcaaaccgccggaccatggcatctcgggaagttagagatggatttcgatttctgcgaaggtacaaccgtagtggtaaccgaagattgcgggaaccgagggccctctctgaggaccacgacagcaagcggcaagctagtcaccgagtggtgctgcagatcgtgcacattacccccactacgctaccggggcgaggacggatgctggtacggaatggaaataagacccctaaaggagaaggaggaaaacctagtaaacagcctagtcaccgcaggacacggacagatagataacttttctctaggcgtgctaggaatggccctatttctagaagagatgctgagaactcgggtaggcacgaaacacgccatcctgctcgtcgccgttagcttcgtgacgcttattacaggtaatatgagcttcagggacttagggagggttatggtcatggtgggggcaacgatgaccgacgatattggaatgggagtcacataccttgcacttttagccgccttcaaagtgaggcctacgttcgcggccggccttctactgaggaagctaaccagcaaagagctgatgatggccacaataggcatcgcacttttatcacagtcaacaatccccgagacgatactagaactcacggacgcactcgcactaggtatgatggtactgaaaatagtcagaaacatggaaaaataccaactggccgtcaccatcatggccatcagctgtgtcccaaacgctgttatactacaaaacgcgtggaaagtctcgtgcacgatactagccgcagtttcggtatctccactcctattaacgtcgtcacaacaaaaagccgactggatacccctcgcgctgacgataaaagggcttaacccaaccgccatatttctcacaaccctaagccgaacgagcaagaaaagatcgtggcccctcaacgaggcaatcatggccgtaggaatggtcagcatccttgcttcctcactcctcaaaaacgacataccgatgacggggccgctagtagcagggggattgctcaccgtgtgctatgtcctcaccggccggagcgcggatctggaactagaacgagcggcggatgttaagtgggaagatcaggccgaaatatcagggtcgtcgccaatactcagtatcacaatctccgaagatgggtctatgtcaatcaaaaatgaggaagaagaacagacccttaccatcctcatcagaacgggcttgctggtaatctccggagtatttccagtctcaataccaatcaccgcagccgcatggtacctatgggaagtgaagaagcaacgcgcaggagtgctctgggacgtccccagcccgcccccggtcggaaaggcagagctggaagacggagcctatcgaatcaaacagaggggcatactaggatatagtcaaatcggcgccggggtgtataaggaagggacctttcacacaatgtggcatgtaacacggggagcagtgttgatgcacagaggcaagagaatcgaaccgtcatgggccgacgtgaaaaaggacttaatctcctacggcgggggatggaaactggagggtgaatggaaagaaggagaggaggtacaagtcctggcactcgaaccaggcaagaatccccgcgctgtacaaacaaagcccggactgtttaaaaccaacacagggaccatcggggccgtatcccttgacttcagtcccgggaccagcggctcgccgatagtcgacagaaagggaaaagtagtagggctatacggcaacggagttgtaactcgcagcggagcctacgtcagtgcaatagctcaaaccgaaaagtccattgaagacaacccggagatagaagacgacatattcaggaagaaacggctgacgattatggacctacaccccggggcaggcaagaccaagcgctacctccctgccatagtgcgagaggcaatcaaaagaggacttcggacactaatcctagcgccgacgcgggttgtagcggccgaaatggaggaagcattgcgcggtctgccaatccgctaccagacgccagcaatccgcgcagagcacacgggcagagagatcgtagacctgatgtgccatgccacattcacgatgagactactaagcccggtcagggtcccaaactacaacttgataatcatggacgaagcacacttcacggatcccgcaagtatcgcagcacgagggtacatctccactcgagtagagatgggagaggcagccggaatttttatgacagcaacaccacccggaagccgagacccattcccccaaagcaacgctcccatcatggacgaagaaagggaaatccccgaacgatcgtggaatagcggacatgagtgggtaaccgacttcaagggtaaaacggtctggttcgtcccgagcattaaggcaggaaacgacatcgcggcgtgcctaagaaagaacgggaaaaaggttatccagttgtcccgaaagacatttgacagcgaatacgtcaagaccagggccaatgattgggacttcgtcgtgaccaccgatataagtgagatgggcgccaattttaaggcagaacgtgtcattgacccaaggcgctgcatgaagccggtaatactgacggacggggaggaacgggtaatcctggccggccctatgccggtgacccactcaagtgcggcacaacgcagagggcgtatagggcgaaacccgaaaaacgaaaacgaccaatacatatacatgggagaaccactggagaacgatgaagactgcgcacactggaaagaggccaaaatgctactagacaacataaacacccctgagggaatcattccaagcatgtttgagccagagagggagaaagttgacgcgatagatggcgagtaccgactaaggggcgaagcgcgaaaaacgttcgtagacctcatgcgcagaggggaccttcccgtatggctagcatatagagttgcggcagagggcataaactacgcggaccgacgctggtgctttgacgggatcaaaaacaatcaaatccttgaagaaaacgtagaggtcgagatctggaccaaagagggcgaacgcaaaaagctaaaacccagatggctggacgcaagaatctactcggacccactagcattaaaagagttcaaagaatttgcagccggccggaaatcacttaccctgaatcttataacagaaatgggccgcctacccaccttcatgacacaaaaagcaagaaacgcgctcgacaacctcgcagtgctccacacagccgaggcaggcggtcgagcatacaaccacgcactatcagagctccccgaaacactagaaaccctcctgctactaaccctactagcaactgtcacaggtgggatattcctttttctgatgtcaggaaaaggtataggcaagatgacattgggcatgtgctgcatcattacagcctcgattttgctctggtacgcccaaatacaaccccactggattgcggcttcaatcatcctcgagttctttctcatagtgctgctgatacccgagccggagaagcagcgcaccccgcaggataaccagctgacctacgtagtaatcgccattctaacggtggtcgcggcaacaatggcaaacgaaatggggtttttggagaagactaagaaggacctaggcttaggctccatcacaacgcaggaaagtgagtcgaatatcctcgatatagacctccggccggcaagcgcctggacactatacgcggtagccacaaccttcgtgacaccgatgctacgccactcaatagagaacagctccgtcaacgtaagcctgacggctatagcaaatcaggccacggtcttgatgggtctagggaaaggttggccactatcgaagatggacattggtgtcccactactggccatcgggtgctactcacaggtaaatccaatcaccctgacagcagcgctgctgttactggtcgcacattacgctataataggacccggacttcaggcaaaagcgactcgtgaggcacaaaaacgcgccgccgctggcataatgaaaaatcccacggtcgacggaattacagttatagacctggaaccgatcccctacgatccgaagttcgaaaaacagctaggccaggtgatgctcctaatcctatgcgtaacacaggtactgatgatgagaaccacctgggccctgtgcgaagccttaacactggcaaccggacctatctctacactatgggaaggaaaccctggacgtttctggaacaccacaatcgcggtatcgatggccaacatcttcagaggatcatacctcgcaggcgcagggctcctcttctccataatgaaaaacacgacgaatacacggagggggaccgggaatattggcgaaacgctcggagagaagtggaagtcacgattaaacgcattggggaaatcagagttccaaatttacaaaaagtccggtatacaagaggtcgatagaacgctcgcaaaggagggtataaaaaggggagaaaccgaccaccatgccgtgagccgtggaagtgcaaaattacgctggttcgtcgaaaggaacatggttaccccagaggggaaagtggttgatctaggttgcgggagaggcgggtggagctactactgcggagggttaaagaatgttagagaggtaaaagggttaacgaaagggggcccgggccatgaagaacccatccctatgtcaacatacgggtggaatctggtacgactccaatccggagtagacgttttctttactccgcctgaaaagtgcgacacactcctatgcgacataggggaatcgtccccaaacccaacgatagaggcagggcggacgctacgggtccttaatttggtggaaaattggttgaacaataatacgcagttctgcatcaaggtccttaatccttacatgcccagcgtcatagagaaaatggagacgctccagcgcaaatatggcggggcccttgtcagaaatcccctatcgcggaatagcacgcatgagatgtactgggtaagcaatgcaaccggcaacatagtgtcgagtgtaaacatgatatcacgaatgctaatcaacaggtttaccatgaagcacaaaaaggcaacatacgagcccgatgtggatctgggctccggaactcgcaatataggcatagaatcagaaattccaaacttagatataatcgggaaaaggatcgagaaaataaaacaggaacatgagacaagctggcactatgaccaagatcatccgtacaaaacatgggcgtaccacggttcgtacgagactaaacaaaccgggtcggccagtagcatggtaaacggagtcgttcgcctcctgacgaagccatgggacgttgtgcccatggtaacgcaaatggcaatgaccgataccacgccattcggacaacaaagggtatttaaagaaaaagtagacacgcggacgcaagaacccaaagaaggcaccaagaaactcatgaagataactgctgaatggctctggaaagaactcggcaaagagaaaacccccaggatgtgtacccgagaggagttcgcccgtaaagtgagatctaatgcagcgctcggcgccatattcacggacgaaaacaagtggaaatcagcgagagaagcagtcgaagatagccggttctgggaactaatagatagagaaagaaaccttcacctcgaaggtaaatgcgaaacatgcgtatacaacatgatgggcaaacgagagaagaaactgggagaatttggaaaggcaaaaggctccagggccatctggtacatgtggcttggtgcgcgattcctagagtttgaagcgctaggattcttaaacgaagaccactggttcagccgcgagaactcgctgtcgggggtggaaggggaagggcttcaccgactaggctatatcctaagagacgtttcaaagaaagagggcggcgccatgtacgcggacgacacggcgggatgggatacacgaataacgttagaggatctcaaaaacgaagaaatggtaacaaaccacatgaaaggtgaacacaagaaactggcggaagccatcttcaagctgacgtaccaaaacaaagttgtgcgagtgcaaagaccaacgccccgcggaacagtaatggacataatcagccgacgagatcagcgaggctcaggccaggtaggcacctatgggctgaacacattcaccaacatggaggcgcaactgatacgtcagatggagggcgaggggatctttaagtcgatccaacacctaacagccacagaagaaatcgcagttcagaactggctagcaagggtcgggagggaacgtttaagtaggatggcgataagcggtgacgactgtgtcgtcaagccgctcgacgaccgcttcgcgagtgcacttacagcactgaacgacatggggaaagttaggaaagacatacaacaatgggaacccagccgaggatggaatgactggacccaagtccccttctgcagtcaccacttccacgagctggtgatgaaagatggtcgagtgctagttgtgccatgtcgcaatcaggatgaactcataggcagggcacgaatctcgcaaggggccggatggtcgctcaaggagacagcttgcctcggaaaatcctacgcccagatgtggaccctcatgtacttccaccgccgcgatctccgactagcggcgaacgccatatgctcagcagtaccgagccactgggtcccgaccagccgtactacatggagcatccacgcgaaacacgaatggatgacaacggaagacatgctggcggtatggaacagagtctggatccaagaaaatccgtggatggaagataaaacaccagttgaatcctgggaagaagtaccttacttgggtaaaagggaggaccagtggtgcggcagcttaatcggcctaacaagcagggcaacatgggcgaaaaacatacagaccgcaatcaaccaagtacggagtttgataggaaacgaagaatacacagactacatgccctcaatgaagcgattccggagggaggaggaagaggcaggggtactatggtaa

SEQ ID NO: 25551 - RNA, 9876 nt, synthetic construct
  misc_feature 1..9876: note = derived and/or modified CDS sequence (opt11) from DENV-2__GQ398298__SS-prME
  source 1..9876: mol_type = other RNA
accgcaggcgttatcatcatgctcatccctacggcaatggcatttcacttaaccacccgcaatggcgaaccgcacatgatagtagggcggcaggaaaaagggaaaagcctactattcaaaactgaagacggtgtaaacatgtgtaccctgatggcaatcgatttgggcgaactttgcgaagacaccataacgtataaatgtcctttactacgccagaacgaaccggaagatatagactgctggtgtaactcaaccagcacatgggtgacgtacggaacatgtacaacaacgggcgaacaccggcgggaaaaacggtcagtcgctctcgtgcctcatgtcggcatgggactggaaacaaggacggaaacgtggatgagttccgaaggcgcctggaaacatgtacaacggatagaaacttggatactacgccatccgggattcacaattatggcagcaatccttgcatataccatcggcactacacactttcaacgcgcactcatattcatactccttacagcagtagcgccaagcatgacaatgcgatgtattggaatatcgaaccgggacttcgtcgagggcgtatccggaggaagctgggtggatatagtactagaacacggttcctgcgtcacaacaatggcgaaaaacaaacccacactagacttcgaacttataaaaaccgaagcgaaacaacccgcaacactacgcaaatactgtatagaagcaaaactaacaaacacaacgacggaatcacggtgtcccacgcagggggaaccgtcgctgaatgaagaacaggacaaacgcttcgtgtgcaaacatagcatggtggatagggggtggggcaatggatgcggactttttgggaaagggggcatagtgacatgtgctatgttcacatgtaagaaaaatatggaaggaaaagtagtactgccagaaaacctagagtacacgatagtaatcactccgcacagcggggaggaacacgccgtaggtaatgacacgggcaagcacggaaaagaaattaaaataacaccccaaagcagcatcacggaagctgaactcacgggctacgggacagtgacaatggaatgtagcccccgcacggggttagatttcaacgagatggttctgcttcaaatggaagacaaagcctggctagtacacagacagtggttcttggatctaccgttaccctggcttccaggagccgacacacaagggagcaactggatccaaaaagaaacgctcgtgacattcaaaaatccccatgccaagaaacaagatgtcgtagtcctcggttcacaagagggcgccatgcacacagcactcaccggagcgacagagatccaaatgtcgtcgggcaacctcttgtttaccggccatctgaaatgccgtcttagaatggacaagctccaactcaaaggaatgtcgtatagtatgtgcactgggaaattcaagatcgtaaaagagatcgccgagacccagcatggaaccatcgtaatcagagtacaatacgaaggtgacggcagcccgtgcaaaataccctttgagattatggacctggagaagcgccatgtcctaggcagactaatcacggtcaatccaattgtagcggaaaaagattccccagtgaacatagaagcggagcccccatttggcgactcctacatcataatcggcgtagagccaggccaactgaagttaaattggttcaagaaaggctcgtcgatcggacagatgttcgagacaacaatgagaggggctaaacggatggctattctcggcgacacggcatgggacttcggaagcctcgggggagtattcacaagcataggtaaagccctacatcaggtgttcggagcaatatacggcgccgcattcagtggcgtcagttggaccatgaagatattgataggagtcataatcacgtggatagggatgaacagccgaagtaccagtctaagcgtatccctggtgcttgtgggggtggtaacactgtacctaggcgcaatggtgcaggccgacagcggctgcgtggtctcgtggaagtcgaaagaactgaaatgcgggtcgggcatctttataaccgacaacgtgcacacctggaccgagcaatataagttccaaccagaatcgccctccaagttagcgagcgcgatccaaaaagctcacgaagaaggcatctgcggcatcaggagtgtcacgagactcgagaacctaatgtggaaacaaataacgcccgagctcaaccatattctctcggagaacgaagttaaattaacaatcatgaccggagatataaaaggcatcatgcaagcagggaaacggagtctgcgcccccaaccgacggaattaaaatacagctggaaaacctggggcaaggcgaaaatgctctctacggaatcacacaatcagacgttcctcatagacggaccagagacagcagaatgcccaaatacgaatcgtgcgtggaactccctagaggtcgaagactacggattcggagtgttcacaacaaacatctggctcaaactacgcgagaagcaagacgtgttctgcgactcaaagctaatgagcgccgcaattaaggacaatcgagccgtacacgctgacatgggatattggatagaaagtgcacttaacgacacatggaaaatggaaaaagccagctttatcgaggtcaaaagttgccattggcccaaatcgcacacgctatggagtaacggtgtgttggagtctgagatgataattcccaaaaactttgcgggacccgtcagccaacacaattaccgccccggttatcacacacagacggcaggaccgtggcacttaggaaagctagaaatggattttgacttttgcgaaggcacgaccgtcgtagtcaccgaggattgtggaaatagagggccgtccttacgaacaacgaccgcctcaggaaagctcataacagaatggtgctgccggtcctgcaccctaccacccctccgctaccgaggggaggacggatgttggtacggaatggaaatccgaccgctgaaggagaaagaagaaaatctagtaaacagcttggtgacagccgggcacgggcaaatcgacaacttcagcctgggactactcggcatggccctattcttggaagaaatgctgagaacacgagtcgggaccaagcacgcaatgctgctagtagtagttagctttgtcacactaataacagggaacatgtctttccgcgaccttgggcgcgtaatggtgatggtaggagccaccatgactgacgacatcggaatgggaatcacatacctagcactcctggcggcatttaaagttagaccgacattcgccgcaggcctgttgctccgaaaactcacatctaaggaacttatgatggcaacgattggcatagcgctcctgtcgcagtcaacaatcccggaaacaattctcgaacttaccgacgcactggcgcttggcatgatggtcctcaagatagtccgcaacatggagaaatatcagctagcggtcacaatcatggcaatatcttgcgtaccaaacgcagtgattctgcagaatgcctggaaagtaagctgcacgatactagccgccgttagcgtcagccccctcctactaacctcaagccaacaaaaggcggactggataccacttgccctaactattaagggcctaaatccgacggcaatattcctgacgactctgagtcgcacctccaaaaagcggtcgtggccgttgaacgaagccataatggcagtaggaatggtatcaatactggcctctagccttctgaagaacgatattccgatgactgggcccctagtagcaggagggctactcaccgtctgttacgtactcacgggacgctccgccgacctagaactcgaaagagcggctgacgtcaaatgggaggaccaagccgaaatttcaggctcatcgccaatactgtcgataacaattagtgaggacgggagcatgagcatcaagaacgaggaggaggagcagacgctcacaatcctcatacggacgggactgctagtcatctctggcgtatttccagtctcgatacccataacagccgccgcttggtacttatgggaggtaaagaagcaacgagccggagtattatgggacgtcccgagcccaccgcccgtaggaaaagcggaattagaggacggtgcgtacagaattaagcagcgtggcatactagggtactcccagattggggccggagtatacaaagagggcacctttcacacgatgtggcacgtaaccagaggggctgtactgatgcaccgtggcaagcgaattgaaccgtcctgggcagacataaagaaagacctgatcagttacggcggtggatggaaattagagggagaatggaaggagggagaggaagtacaggtcctcgcattggagcccggcaagaacccacgagccgtccagactaagccaggattattcaaaacaaacacaggtacgatcggcgccgtctcactcgacttcagccctggaacgagcggcagccccatcgtcgaccgaaagggcaaggtcgtggggctctacgggaatggagtagtgacgagatcaggtgcttacgtgtcagctatagcgcaaaccgaaaagtcgatagaggacaaccccgagatcgaagacgacatcttcagaaagaaacgactaaccatcatggacttacaccccggcgccggcaaaacaaaacggtacctgccagcgatcgtacgcgaagcgatcaaacgcgggttgagaacgctcatactagcaccaacacgagtagtagcagccgaaatggaggaggcactacgaggactgcccatacgctaccaaacgcccgccataagagcggagcacacgggacgcgaaattgtggacctgatgtgccatgctacgtttacaatgaggctcttatcaccagttagagtcccaaactacaacctaattattatggacgaagcacactttacagatccggcctccatagcggccaggggatacatcagcacgcgagtagagatgggggaagccgcaggcatcttcatgaccgcgaccccacccggaagtcgagacccattcccacagtcaaacgcgcctataatggacgaagaaagagaaatccctgaacgcagctggaatagcgggcacgaatgggtgacagacttcaagggtaagacagtatggttcgtacctagcatcaaggccggtaacgacatcgctgcgtgcctgcgaaagaacggtaagaaagtcattcaattatcgcgtaaaacgtttgactccgaatatgtcaagacaagagcaaatgactgggacttcgtcgtcacaacagacatatccgaaatgggagcgaacttcaaagcagaaagagttatcgatcctcgacgctgcatgaagccggtaatcctcactgacggggaggagcgtgtaatattggccggacccatgcccgtaacacactctagcgcagcgcagagacgcgggcgaatagggcggaaccccaagaatgaaaatgaccaatacatctacatgggcgagccccttgaaaatgatgaggattgtgcacactggaaagaggccaagatgttactggacaacatcaatacccctgaagggataataccttccatgttcgaaccagagcgagaaaaagtagacgcaattgatggagagtacaggctgagaggggaagcaagaaagaccttcgtcgacttaatgaggcgaggagatctaccagtgtggctagcgtacagagtggcggcagaaggaatcaactatgccgatcgcagatggtgctttgacgggatacgcaacaatcaaatactggaggagaatgtagaggttgaaatctggaccaaggagggagagaggaagaaactgaaaccacgctggctggacgcccgaatctattcagacccactagccttaaaggagttcaaagagttcgcggccggaagaaagtcccttaccctaaacctgatcactgaaatgggacgactccccaccttcatgacgcagaaggcacgagacgccttggacaacctggcagtactccacaccgcagaggcaggaggacgcgcctacaaccacgcactcagcgaactgccggagaccctagaaaccctactcctcctcaccctcctcgccacagtcacaggaggcatcttcctattcctcatgtctggtaaggggataggtaagatgacactaggaatgtgctgcattatcacggcgagcatcctgctgtggtacgcccagatacaaccgcactggatcgccgcatcaataattctcgagttcttcctaatagtcctactgatccctgagcccgaaaaacaacgaactccgcaagacaatcagttaacttacgtagtgatagccatcttaacagtggtcgccgccacgatggccaacgagatgggatttttggagaaaacgaagaaagacctaggactgggctcgatagccacgcaagaaagcgagtcgaatatcctggacatagacctacgccccgcgagtgcctggacattatacgcagtcgctactacgttcgtcaccccaatgttacgccactccatagagaacagcagcgttaatgttagtttgaccgcaatcgcaaatcaggccaccgtactaatggggctgggcaaaggatggccgttaagcaagatggacatcggggtacccttactcgcaatcggttgctacagccaggtcaaccctatcacccttaccgcggctctcctcctcctcgtggcccactatgccataataggaccgggattacaggccaaagcgacccgggaagcccagaaaagggcagccgcgggtataatgaaaaacccaacagtggacggcataacggtgatagacctagaaccgataccatacgatcctaaatttgaaaaacaactaggccaagtcatgctccttatactgtgtgtcactcaggtacttatgatgagaacaacgtgggcgctgtgcgaagccctaaccctagccactggccctatatccaccctctgggaagggaaccccggtcgattttggaacaccaccatagcagtttcaatggccaacatattcagagggagttatctggctggcgcaggcctcctattctccataatgaaaaacacaaccaacacgcggagaggcacgggaaacatcggtgaaactttgggtgagaaatggaaatcccggctgaacgctctcggcaaatcagagtttcagatatacaagaaatcagggatacaggaagtggacagaacgttggccaaagagggaataaaacgcggtgagactgaccatcacgccgtcagccgggggagcgcgaagctcagatggttcgtcgaacgaaacatggtaacgcccgaaggaaaggttgtagacttagggtgcgggcgcggagggtggagttattattgtggaggactcaagaatgtgagagaagtaaaaggactaacaaaaggcgggccgggtcacgaggaaccgatcccaatgagcacatacggatggaacctggtaagactgcaatcaggagtcgatgtgtttttcacgcctcccgaaaaatgcgacacactactgtgtgacataggcgagagcagcccaaacccaacgattgaagcaggccgtacattacgcgttctgaacctggtcgaaaattggctgaacaataacacacaattctgcatcaaagtactaaacccttacatgccttcagtgatcgagaaaatggaaacactgcagaggaagtatggaggtgctctagtacggaacccattatccagaaactcgacccatgaaatgtactgggtgagcaacgctactggcaacatagtatcatcggtgaacatgatcagccgcatgctcataaaccggttcacgatgaaacacaagaaagcgacctatgagccagacgtcgacctaggttcggggacccgcaacatcggcatagaaagcgaaataccgaacctggacatcataggcaaaagaatcgagaagattaaacaggaacacgagactagctggcactacgaccaagaccacccatacaagacatgggcctatcacggaagctacgagacgaaacaaacggggtccgcctcatcgatggtgaacggcgttgtgagattgttgacgaagccttgggatgtggtgccaatggtaacgcaaatggcaatgacagacaccaccccctttggccagcagagagtgttcaaagagaaagtcgacacaagaacccaggagccgaaggagggcacgaagaaactaatgaaaatcaccgctgaatggctctggaaagaactaggtaaaaagaaaaccccaagaatgtgtacgagagaagagttcacccggaaggtcagatcaaacgccgctctgggagcgatatttacggacgagaacaagtggaagtcagcaagggaagcggtggaggacagtcggttctgggagctcatagacagagaacgcaaccttcacctggagggtaaatgcgagacgtgcgtctacaacatgatgggaaaacgtgagaaaaagttgggtgagttcggcaaggccaagggctctagagcaatatggtatatgtggttaggagccaggtttctcgagttcgaagcactgggattcctgaacgaagaccactggttctcccgcggaaactcactgtcgggggtagaaggcgaggggttacacagactcggctacatcctacgagatgtctccaagaaagaaggaggcgcaatgtacgcagacgataccgccggctgggataccaggataaccctcgaagatcttaaaaacgaagaaatggtaacgaaccacatgaagggagagcacaagaagctagctgaagcgatattcaaactaacctaccaaaacaaagtcgtcagggtacagcgaccaacgccaagggggacagtcatggacataataagccgacgcgatcagcgaggctcaggacaggtaggaacttacggccttaacaccttcacgaacatggaagctcaactcatacgacaaatggaaggggagggcatctttaaatcaatccaacacttaacagtgactgaagaaatcgcggtacagaactggctagcacgagtcggaagagaacgactctcacgcatggccatcagtggggacgactgcgtcgtgaaaccactggacgatcgcttcgcgagcgcgctcactgcacttaacgacatggggaaggtgaggaaggacatacagcaatgggaaccctctcggggatggaacgactggacgcaggtccctttctgttcgcatcacttccacgaacttgttatgaaggacggacgcgttctagtcgtcccttgccgtaatcaggacgaactcataggccgagcacgcataagtcagggcgccggatggagcctgaaagagacagcctgcctgggaaagagctacgcacaaatgtggacactgatgtacttccaccgccgagacctaagactcgcagccaatgcaatctgttcggcggtaccctctcattgggtcccaacgagtcggactacttggtcgatccacgccaaacatgagtggatgaccacggaagacatgcttgccgtatggaaccgggtctggatacaagaaaatccatggatggaggacaaaacaccggtggagagctgggaggaagtaccctacctaggcaagcgagaggaccagtggtgcggaagcctcatcgggttaacatcaagagccacctgggcgaaaaacattcagacagccattaaccaagtacgaagtctcatcggtaacgaggagtacacggattatatgcctagcatgaaaaggttcagacgtgaagaggaagaagcaggagtcttgtggtaa

SEQ ID NO: 25552 - RNA, 9876 nt, synthetic construct
  misc_feature 1..9876: note = derived and/or modified CDS sequence (opt11) from DENV-2__GQ398301__SS-prME
  source 1..9876: mol_type = other RNA
accgcgggggttattatcatgctgatccccaccgccatggcgttccacttaaccaccagaaacggggagcctcacatgatcgtcggccggcaggagaaggggaagtccctgctgtttaagaccgaagacggcgtgaacatgtgcaccctcatggcgatcgacctgggggagctgtgtgaggacaccatcacctacaagtgcccactgctccgccagaacgagcccgaggacatcgactgctggtgcaatagtactagcacctgggtgacatacgggacctgcaccactacgggcgagcaccggcgcgagaagcggtccgtagccctggtgccccacgtgggtatgggcctcgaaacacggaccgagacctggatgagctctgagggagcgtggaagcacgtccagcggatcgagacctggatcctgcgccacccgggcttcaccatcatggcggcgatcctggcttacaccatcgggacgacccacttccagcgggccctcatcttcatcctgctgaccgcggtggcgcccagcatgaccatgcgctgcatcggcatctccaaccgggatttcgtggagggcgtcagcggtgggtcctgggttgacatcgtgctcgaacacgggagctgcgtcaccacgatggcgaagaacaagcccaccctcgacttcgagctgatcaagaccgaggccaaacagcccgccaccctccgcaagtactgcatcgaggccaaattaactaacactacgaccgagtcccggtgccccacgcagggcgagcccagcctgaacgaggaacaagataaacgcttcgtgtgcaaacactcaatggtagaccgggggtgggggaatgggtgcggcttattcggcaaaggcgggatcgtgacatgcgctatgttcacgtgcaaaaagaacatggaggggaaggtggtgctccccgagaatctggagtacaccatcgtcatcacgccccacagcggggaggagcacgccgtgggcaacgacacagggaagcacggaaaggaaatcaagatcaccccgcagtccagcatcacagaggcggagctcaccggatacggcacggtgaccatggagtgcagcccccggaccggcctggacttcaacgaaatggtgctgctccagatggaggacaaggcctggcttgtgcaccggcagtggttcctggaccttcccctgccctggctgccgggggccgacacccagggcagcaactggatccagaaggagacgctcgtgaccttcaagaacccccacgcgaagaagcaggatgtcgtggtcctggggtcccaggagggcgccatgcacaccgcccttaccggggccacggagatccagatgagtagcggtaacctcctgttcaccggccaccttaagtgccgcctccggatggataagcttcagctgaaggggatgtcctactcaatgtgcaccggaaagttcaagatcgtgaaggagattgccgagacccagcatggaacgatcgtgatccgcgtccagtacgagggggacggaagcccctgcaaaatccccttcgaaatcatggacctcgagaagcgtcacgtcctggggcgcctgatcactgttaaccctatcgtcgcggagaaagacagcccggtgaacatcgaggccgagcctcccttcggcgactcctacataatcatcggggtggagccgggccagctcaagctgaactggttcaagaagggtagctccatcggccagatgttcgagaccacaatgcgcggcgccaaacggatggcaatcttgggggacacggcctgggactttggaagcctcgggggcgtcttcacctcgattgggaaggcgctgcaccaggtgttcggcgccatatacggcgctgccttctctggggtctcctggaccatgaagatcctgatcggcgtcatcatcacatggatcgggatgaacagcaggtccaccagcctgtccgtgagcttggtgctggtgggcgtggtgaccctgtacttaggagcgatggtccaggccgactccgggtgcgtggtgagctggaagtcgaaggagctgaagtgcggcagcgggatattcatcaccgacaacgtccatacctggacggagcagtacaagtttcagccggagagcccctccaagttggcttcggccatacagaaggcccacgaggagggcatctgcgggattcggtccgtaacgcgcctcgaaaacttgatgtggaagcagatcaccccagagctgaaccatatcctcagcgagaacgaggtgaagctgactataatgacgggtgacataaaggggatcatgcaggcggggaagcggtccctgcgcccgcagcccaccgagctcaagtacagttggaagacctggggcaaggcaaagatgctgtccaccgagtcccacaaccagacgttcctgatcgacgggccggagaccgccgagtgtcccaacacgaaccgggcctggaacagtcttgaggtcgaggactacggcttcggggtgtttaccacaaacatctggctgaagctgcgggaaaagcaggatgtgttctgcgacagcaagctcatgtccgccgcgataaaggacaaccgggccgtccacgccgacatgggctactggatcgagagcgccctaaatgatacgtggaagatggaaaaggcctcgttcatagaggtaaagagctgccactggcccaaatcccacacactgtggagcaacggggtcctcgagtcggagatgatcatcccaaaaaacttcgctggacccgtgtcgcaacacaactaccgcccgggctaccacactcagaccgctgggccttggcacctgggcaaactggagatggacttcgacttctgcgaggggacgaccgtagtggtcaccgaggactgcggcaaccgtggccccagcctccgcaccacgactgcctccgggaagctgatcaccgagtggtgctgcagaagctgcaccctgcccccgctgcgctacagaggcgaggacgggtgctggtacggcatggagattcgaccccttaaggagaaggaggaaaatctagtgaactcgctcgtaacagccgggcatggccagatcgacaacttcagccttggcgtgctcgggatggccctcttcctggaggagatgctgcggacccgcgtggggaccaagcacgccatgctcctggtggccgcctccttcgtcaccctgatcaccgggaacatgagcttccgcgacctcggtcgcgtgatggtaatggtcggagctactatgacagacgacataggaatgggcatcacctacctggcgctactcgccgccttcaaagtgcgccccacgttcgccgccgggctgctgctccggaaactgacgtccaaagaactgatgatggcaaccattggcatcgccctcctgagccagtccaccatccccgagaccatactggagttaaccgacgcactggcgctgggcatgatggtgctcaagatcgtccgcaacatggagaaataccagctggctgtgaccatcatggcgatcagctgcgttccgaacgccgtcatcctgcagaacgcctggaaggtgagctgcaccatcctcgccgcagtgagcgtcagcccgctgctgctcacgagctcccaacagaaggcggactggatcccgctggcccttacaataaagggcctcaaccccactgccatctttctgaccacgctgagccggacatccaagaagcgcagctggccgctgaacgaggccattatggctgtgggcatggtctccatcctggccagctccctgcttaagaacgacattcccatgaccggccccctggtggccggagggctgctcactgtgtgttacgtactgacgggccggtccgccgacctcgagttggaacgcgccgcggatgtgaagtgggaggatcaggccgagataagcgggtccagccctatactgtccattaccatcagcgaagacggctccatgagcataaagaacgaggaggaggaacaaaccctaaccatcctcatccggacgggcctgctggtgatttcaggagtattcccagtgagcataccaatcacagccgccgcctggtacctgtgggaggtgaagaaacaacgagcgggggtcctgtgggacgtgcccagcccgccgccagtggggaaggccgaactggaggacggcgcctaccggattaagcagcgcgggatcctcggctacagccagatcggcgccggcgtttacaaggagggaaccttccacaccatgtggcatgtgacgcgcggtgccgtactcatgcaccgcggcaagcggatcgagccctcctgggcggatgtaaagaaggacctgatcagctacggtggaggctggaagctcgagggggagtggaaggagggagaggaggtccaggtgttagcgctggagcccgggaagaacccccgcgccgtgcagacaaagcccggactctttaagactaacaccgggaccatcggagccgtgtccctagacttcagccccggcacctccgggagcccaatcgtggaccggaaaggtaaagtcgtggggctgtacggcaacggcgtggtcacacggtccggggcgtacgtgagcgccatcgcacagaccgagaaatccatagaagataaccctgaaatcgaggacgacatcttcaggaagaagcgactgacaatcatggatttacatcccggcgccgggaaaacgaaacgatatctgcccgccattgtgagggaggcgatcaagcggggcctgagaaccctgatcttagccccgacccgcgtcgtggcggccgagatggaggaggccttgcggggcctccccatccgctaccagactcccgccatccgggccgaacatacgggccgcgagatcgtggatctgatgtgccacgccactttcacaatgcggctgctcagccccgtccgcgtgccgaactacaatctgatcattatggatgaagcgcatttcaccgaccccgcctcgatcgcggccaggggctacatcagcacgcgagtggagatgggcgaggccgccggcatattcatgaccgcgacgccacccgggagccgggatccgttcccccagtccaacgcccccataatggacgaggagcgtgagattcccgagcggagctggaactccggccacgaatgggtcacagacttcaaggggaagaccgtgtggttcgttccgagcatcaaggccggcaacgacatcgccgcctgcctgcgcaagaatggcaagaaggtcatacagctatcccggaagaccttcgacagcgagtacgtgaagacccgcgccaacgactgggacttcgtggttaccacggacatctccgagatgggtgcgaatttcaaggccgagagggtgatcgacccccgcagatgcatgaagcccgtgatcttaaccgacggcgaggagcgcgtcattctggcggggcccatgccggtgacccacagcagcgccgcgcagcgccgcggccgcatcgggcggaaccccaagaacgagaacgatcagtatatatacatgggcgagcccctagagaatgacgaggactgcgcccactggaaggaggccaagatgctgctggacaatatcaacacccccgagggcatcatcccgagcatgtttgagcccgagcgcgagaaggtggatgcaatcgacggggaatacaggttacggggcgaggcccggaagaccttcgtcgacctgatgcgcagaggggacctgcctgtgtggctagcgtacagagtggccgcggaaggcatcaactatgccgaccggcgttggtgcttcgacggtatcaagaacaaccagatcctggaggagaacgttgaggtggagatctggaccaaggagggcgagagaaagaagctgaagccgcggtggctcgacgcgcggatctattccgaccccctggccttaaaggaattcaaagagttcgccgccggccgcaaatctctcaccctgaacctgatcaccgaaatgggccggttgccgacgtttatgacacagaaagctcgcgacgcgctagacaacttagccgtgctccacaccgcagaggccggcgggcgggcctacaaccacgcgctgtccgagctgcccgagactctcgaaacgctgttactcctgaccctcttagccacggtcacgggcgggatcttcctgttccttatgagtgggaagggcatcggtaagatgactctcggcatgtgctgcatcatcaccgcctcaatcctcctgtggtacgcccagatccagccacactggatcgccgcctctataatcttagagttcttcctcatcgtgctgctcattcccgagcccgagaagcagcgcacgccccaagacaaccagctgacctacgtcgtgatcgccatcctgaccgtggtcgcagccacgatggccaacgagatggggttcctcgagaagaccaaaaaagatctcggactgggcagcatcgctacgcaggagtctgaaagcaacatcctcgacatcgacctgcggccggcctcggcctggaccctgtacgccgtggcgacgacgttcgtgacccccatgctccgccacagcatcgaaaactccagcgtcaacgtgtccctgaccgccatcgctaaccaagccacggtgctcatggggctcggcaaagggtggccactgagcaagatggatattggtgtccccctactcgccatcgggtgctactcccaggtgaacccgataaccctgacggcggccctactcctgctggtggcccactacgccatcattggcccgggcctccaggccaaggctactcgggaggcacagaagcgcgctgcagccgggattatgaagaaccccacggtggacggcatcaccgtgattgacctggagcccatcccgtacgaccccaagttcgagaagcagctgggccaggtgatgctcctgatcctgtgcgtcacccaggtactcatgatgcgcaccacgtgggcactgtgcgaggcgctgaccctcgccaccggccccatcagcaccctgtgggaggggaatcccggccggttctggaatacgaccatcgctgtgagcatggcgaacatcttcaggggctcctacttggccggcgcaggcctcctgttctccatcatgaagaacaccaccaacactcggcggggcacgggcaatatcggcgagaccctgggagagaaatggaaatcccgtctcaacgccctgggcaagtccgagttccagatctacaagaagtcggggatccaggaagtcgaccgcaccctggccaaggagggcatcaagcgcggtgagacggaccaccacgccgtttcccgcggctctgccaaactccggtggttcgttgagcgcaacatggtcaccccggagggcaaggtggttgacctgggatgcggtcgcggcgggtggtcctactactgcggcgggctgaagaacgtgagagaggtgaaggggctcaccaagggcgggcccgggcacgaggagcccatccccatgagcacctacggctggaatttagtgcggctgcaaagcggggtcgacgtgttcttcacccctccggagaagtgtgacaccctcctatgcgacatcggcgagtcgagccccaaccccaccatcgaagccggccggaccctgcgggtgctcaatctggtggagaattggctgaacaacaacacgcagttttgcatcaaggttctaaacccgtacatgccctccgttatcgagaagatggagaccctgcagcggaagtatgggggcgccctcgtccggaaccccctgtctcgcaactccacccacgagatgtactgggtgagcaacgccaccgggaacatcgtctccagcgtcaacatgatatcccgaatgctcatcaaccgctttaccatgaagcacaaaaaagctacgtacgaaccggacgtggacctgggctccgggacccgcaacatcggtatcgaatccgagattcccaacctggacatcatcggcaagcggatcgagaagatcaagcaggagcacgagacctcgtggcattacgaccaggaccacccctacaaaacctgggcctaccacggatcctacgagaccaaacagaccggcagcgcctccagcatggtgaacggggtcgtgcgcctcttaaccaagccctgggacgtggtcccgatggtgacccagatggccatgaccgacacgacacccttcggccagcagcgggtgttcaaagagaaggtcgacacccgcacgcaggagcccaaggagggcaccaagaagctgatgaagatcacggccgagtggctctggaaggagctggggaaagagaagacacccagaatgtgcacgcgggaggagttcacccggaaggtgcgcagcaacgctgcactgggcgccattttcacagacgagaacaagtggaagtctgcccgggaggcggtggaagactcacgcttctgggagctcatcgaccgcgagcgcaacctgcacctggaggggaagtgtgagacttgcgtctacaacatgatgggaaagcgagagaagaaactcggtgagttcggtaaggccaagggctctcgagccatctggtacatgtggctgggggcccgtttccttgagttcgaggctctgggcttcctgaacgaggaccactggttcagcagggggaactccctgagcggggtggagggggagggcctccacagactgggctacatcctgcgcgacgtgtccaaaaaggagggcggggcgatgtacgccgacgacaccgcggggtgggacacccggatcaccctcgaggacctgaagaacgaggagatggtcacaaaccatatgaagggcgaacacaagaagctggcggaggcgatcttcaagttaacgtaccaaaataaggtcgtacgcgtgcagcggccgacaccccgggggaccgtgatggacatcatcagccgccgtgaccagcgcggttccgggcaagtcgggacatacggcctgaacacgttcaccaacatggaggcgcagcttatacggcagatggaaggggagggcatctttaagagcatccagcacctcacagttacagaggagatcgccgtgcagaactggctggcccgcgtcggccgggagcgcctgtcccggatggccattagcggggacgactgcgtcgtgaagcctctcgacgaccgcttcgcctccgcgttaacggcgctgaatgacatgggcaaggtccggaaggacatccagcagtgggagcccagccgcgggtggaacgactggacccaggtcccattctgctcccaccactttcacgagctcgtgatgaaggacggccgggtcctggtagtgccctgccgcaaccaggacgaattaattggcagagcccgtatcagccaaggcgcgggctggagcctcaaggagaccgcctgcctaggtaagagctacgcgcagatgtggaccctgatgtacttccaccgtcgcgaccttcggctggcggccaacgccatctgctccgccgtccccagccactgggtgcccacgtcccgcaccacctggagcatccacgccaagcacgaatggatgaccaccgaagacatgctcgccgtatggaaccgcgtctggattcaggagaacccctggatggaggacaaaactcccgtagaaagctgggaggaagtgccctacctcggcaagcgcgaggaccagtggtgtgggagcctgatcgggctgacaagccgcgccacctgggccaagaacatccagactgcgatcaaccaggtccgctccctaatagggaacgaagagtacactgactacatgcccagcatgaagcgcttcagacgcgaagaggaggaggccggcgtgctgtggtga

SEQ ID NO: 25553 - RNA, 9876 nt, synthetic construct
  misc_feature 1..9876: note = derived and/or modified CDS sequence (opt11) from DENV-2__GQ398312__SS-prME
  source 1..9876: mol_type = other RNA
accgcaggggtaatcataatgctgatacccacggcaatggctttccacttgacgactcgtaatggcgaaccccacatgatagtggggcggcaagaaaaaggaaaatccttactcttcaaaacggaagatggcgtcaacatgtgtaccctcatggcaatagacttgggcgaattatgcgaagacacaatcacatacaagtgtccactacttcgacaaaacgaacccgaagatatcgactgttggtgcaactccaccagtacctgggtaacctacggtacatgtacgaccaccggcgaacaccgaagagagaaaaggagcgtagcactggtcccacatgtcgggatgggccttgaaacccgcaccgaaacatggatgagctcagaaggagcctggaaacacgtacaacgaatagaaacttggatacttagacaccccgggttcacaatcatggcagctatcttagcatacacaatcggaaccacccacttccagcgtgctctgattttcattttactaacagcagtggcgccatccatgaccatgaggtgtatcggaatcagtaaccgggatttcgtggaaggagttagtggtggatcctgggtagatatcgtccttgaacatgggtcatgcgtaaccacaatggcgaagaacaaaccaacgctagactttgaacttatcaaaacggaggccaaacaaccagcgacactgaggaaatactgcattgaggctaaactcacaaacacaacaacagagagtcgatgcccgacccagggcgaaccgtcactaaacgaggaacaagacaaacggtttgtctgcaaacacagcatggttgatcggggatgggggaacggctgtgggttattcggtaaaggcggaatcgtgacttgcgcaatgtttacctgcaagaagaatatggagggcaaggtggtcctgccggagaacctcgagtacacaattgtaatcactccgcactccggcgaagaacacgcagtgggtaacgataccgggaagcatggaaaagaaataaaaatcacaccccagagtagtataactgaggccgagctaaccgggtacggaacagtaaccatggaatgtagccccaggacgggcctggactttaatgagatggtactcctccaaatggaggataaagcctggttggtccaccggcaatggttcctcgacctccctctcccgtggctgccaggcgcagatacccaaggcagtaactggatccagaaagagaccctcgtgacgttcaagaacccacacgccaagaaacaagacgtcgttgtactcggttcacaagaaggtgccatgcacacggcgctgacaggtgctacggagatacaaatgagttcaggaaaccttctatttactggacatctgaaatgcagactccggatggataagctgcagctcaaagggatgtcatactcgatgtgcacaggcaaattcaagatagtaaaagaaatcgctgaaacgcagcacggcactatcgtaattagagtacaatacgagggagacggaagcccctgtaagataccgttcgagataatggacctggaaaagcggcacgtactcggccgattgattacagtaaacccaatcgtggctgaaaaagactctcccgtaaacatagaagcggaaccgccgttcggtgactcatatatcataatcggcgtcgaaccagggcagctcaagctgaactggttcaagaaaggatcttcaatcgggcagatgttcgaaacaacgatgagaggagccaaaagaatggcaatcctcggggacacggcgtgggatttcgggtccctaggaggagtgttcacatcaatcggcaaagcactacaccaggtttttggggcaatttacggagccgctttcagcggcgtgagttggacgatgaaaatcttgataggcgtgattatcacctggatagggatgaactcgagaagcacatcactgtctgtcagcctagtcctcgtaggcgtggtgaccctttatctaggcgccatggtacaagctgacagtgggtgcgtcgtatcctggaaatcgaaggagcttaaatgcgggtccggaatctttatcacagacaatgtgcatacctggacggaacaatacaagttccaacccgaatccccaagtaagctagctagcgcaattcagaaagcccatgaagagggcatctgcggtatccgaagtgtcaccaggctcgaaaacctgatgtggaagcaaatcaccccagagttgaaccacatcctcagcgagaatgaggtcaagctcactataatgaccggagatataaagggcataatgcaggctggaaaaagaagccttcgcccacagcctacagaactgaagtactcgtggaaaacatggggcaaagcgaaaatgctatcgacggagtcgcacaaccaaacattcctcatagatgggcccgagacagcggaatgcccgaacacgaaccgcgcatggaacagcctcgaagttgaggactacgggttcggagtgtttagcacaaatatatggttaaaactccgcgaaaaacaagacgtattctgtgattcaaaacttatgtcggcagcaatcaaggacaatcgcgcagtccacgccgatatgggatactggatcgagtcggcgttaaacgacacttggaaaatggaaaaggcttcttttatagaagtcaagagctgccactggccgaaaagccacacattgtggtcgaatggggtactggaaagcgagatgataataccgaaaaacttcgcaggacccgtaagccagcacaactacaggccaggatatcatacacaaaccgcaggcccctggcacctgggaaaactggaaatggatttcgacttctgtgaggggactactgtagtggtgacagaagactgcggcaatcgaggacccagcctacgcaccacgaccgccagtggaaaactgatcaccgaatggtgctgtcgcagctgcacacttccaccgctacgctatcgcggagaagacggctgctggtacgggatggaaattagacccttaaaggaaaaagaagaaaacttagtcaactcacttgtaacagctggacacgggcagatagacaacttcagcctgggagtgctcggaatggccttattcctcgaagaaatgctaagaacacgcgtaggaaccaagcatgctatgctccttgtcgccgtatcattcgtgacgctgatcactggcaacatgtcgttcagggacctaggacgcgtgatggtcatggtcggagccacgatgacggacgacataggcatgggcataacctacctggccctcctggccgcattcaaggtcagacccacattcgccgcaggcctcctgctacgaaaacttaccagcaaagagctgatgatggcgacaatcggaatcgcgctattgtcgcaaagtaccataccggaaacaattcttgaactaacggatgcgctcgctctcgggatgatggtactaaagatcgtacgaaacatggaaaaataccaactagcggtgacaattatggcgataagctgcgtgccgaacgcagtgatattgcaaaacgcatggaaagtcagctgcacgatattggcagccgtgagtgtaagcccactactactaaccagctcacaacaaaaagctgattggatacctctggcattgacaataaaaggcttaaaccccaccgccatattcctaacaaccctcagcaggacctccaagaagagatcctggcccctaaacgaggcgatcatggcggtcggaatggtgtccatactagcatcaagcctgctcaagaacgatattcccatgaccgggccactcgttgcaggaggtctactaacggtctgctacgtcttgactgggcgctcagccgacctagaattggaacgggccgccgacgtcaaatgggaggatcaggctgaaattagtggatcttcacccatcctgtcgatcacaatatcagaagacggctcaatgagcatcaaaaacgaagaggaagaacaaaccctcacaatattgatacgcacagggctcttagtaatttcaggggtattcccggtctccattcccataaccgcagcggcctggtatttgtgggaagtgaagaaacaacgtgccggagtcctgtgggatgttcctagtccaccacctgtaggaaaagcggaacttgaagacggcgcatataggattaaacaacgcgggatactgggatactcccaaatcggagctggcgtatacaaggagggaacatttcacacaatgtggcacgtcacacgaggcgccgttctaatgcaccgcggaaagagaattgaaccgagctgggcggatgtcaagaaagacctcatcagctacggaggaggatggaagttagagggggaatggaaagaaggagaagaggtccaagtcttagccctcgagcccgggaaaaaccctcgcgcagtccagaccaaacccgggctatttaagacgaatacagggaccataggtgcagtgagcctagatttctcccctggaacgtcaggatcaccaattgtagacaggaaaggtaaagtagttggactctacggaaacggtgtagtaacgcgctcgggggcgtacgttagcgccatcgctcagacggagaaatcaatcgaggataacccagaaatagaggacgacatcttccgaaagaaaaggctgacgataatggacctgcatcccggagcgggcaaaactaagcggtacctcccggcgatagtcagagaggcaataaagcggggactgcgcacactaatcctcgcacccacacgggtagttgccgcagaaatggaagaagcgctcagaggactgccgatcaggtaccagacaccggcgataagggcggagcacacgggccgcgagatcgtcgacctcatgtgccacgcaacgttcacaatgagactactatccccagtccgcgtaccgaactacaatttaattataatggacgaagcgcacttcacggacccggcatcaatcgcggcacgcggctacatctcgactcgcgtagagatgggcgaagccgcagggatattcatgacagcaactccacccggcagccgagaccccttcccccagtccaacgctccaatcatggacgaggaacgagagatacccgagcgaagttggaactcaggacatgagtgggtaacggatttcaaaggcaaaacggtatggtttgtcccatccatcaaagccgggaacgatatcgcggcgtgcctacggaagaacggtaaaaaggtaatacagctgagcagaaagactttcgattcggagtatgtaaagacgagggcaaacgactgggacttcgtagtcacaaccgacatcagcgaaatgggcgcgaacttcaaggccgaacgcgtaatagacccaaggcgatgtatgaagcccgtcatactaactgacggtgaagaacgcgtcatccttgccggcccgatgccagtcacgcacagttcagcggctcagcggcgggggcggatcggtcgcaatccgaaaaacgaaaacgatcaatacatttacatgggtgaaccactagagaacgacgaagattgtgcacattggaaagaggccaaaatgctcctggacaatattaacacgccagaaggtattatacccagcatgttcgagccggaaagagagaaggttgacgctattgatggcgaatacagactccgaggggaagcccgaaaaacgttcgtcgacttaatgcggagaggcgacctgccagtatggctcgcctaccgcgttgccgccgagggcatcaactacgccgaccgacgatggtgtttcgacggtatcaaaaacaaccaaatattggaagagaacgtcgaagtcgagatatggacgaaggaaggagagcgaaagaagctcaaaccgaggtggctagacgcgcgaatctacagcgaccccctagccctcaaagagttcaaagaatttgccgctggcagaaaatcactcacccttaacctcataactgagatgggcagattaccaaccttcatgacacagaaggcgagagacgctctcgacaatctagccgtgctccataccgccgaggctggtgggcgggcgtataatcatgcattaagtgagttaccagagacgctggaaaccctactgctccttaccctcttagcgactgtaacaggaggaatcttcctattcctaatgtcagggaaggggatcggcaaaatgaccttagggatgtgctgtataattacagcttccatattgctatggtacgcacaaatccagccccattggatcgcggccagcattatactagaatttttcctcatagtgttactaataccagaaccagaaaaacaaagaacgccgcaagacaatcaacttacatatgtagtcattgccatactaacagtagtcgcagcgaccatggcaaacgaaatgggattccttgagaaaaccaagaaagatctagggcttgggtccatagcaacccaagaatccgaatccaacatcctcgatatagatctgcgcccggcaagtgcatggacactatacgcagtagccacgactttcgtaacgccaatgctccgtcacagcatcgaaaacagctcagtaaatgtaagcctgaccgccatcgccaaccaagcaacagtcttgatggggctgggaaagggatggcctctaagcaagatggacataggcgtgccactgctcgcaataggatgttactctcaagtaaacccgatcacactcattgccgcgttactactcctggtggcacactacgcaataataggccctggattacaagcaaaagccacgcgagaagcacagaaaagggcagccgccggaataatgaagaatcctacggtagacggtataaccgtgatagatctagaaccaataccatacgaccccaaattcgaaaaacaactgggacaggtcatgttactcattctatgcgtcacccaagtcctaatgatgaggacaacgtgggccctctgtgaagcgctaaccctggcaaccggcccgatatcaacgctctgggaaggcaatccaggccgattttggaacactacaatcgcagtcagcatggctaatattttccgaggcagctacctagcgggtgccggattgctattctcgattatgaagaataccacaaacacgagacgtggaaccgggaacatcggagaaacactaggggagaaatggaaaagccgcttaaacgcgctagggaaaagcgagttccagatatacaagaaatccggcatacaggaggtcgaccgaacactcgcgaaggaaggaataaaacgaggggagacggaccatcatgcggtaagcagaggtagtgcgaagctacggtggttcgtagagcgcaatatggtgacccctgagggaaaagtcgttgacctaggctgcggccgaggaggctggtcatattactgcggagggttaaagaatgtccgggaggttaaaggactaacgaagggcggacccggacatgaagaacctattcctatgagtacctacggctggaacctggtacgactccaaagcggcgtcgatgtcttctttaccccgcccgaaaagtgcgacacgctcctctgcgatattggggagtcgtcaccaaacccaacaatcgaggcaggacgaacactccgcgtgctgaacctggtcgaaaactggctcaacaacaatactcaattctgcattaaagtattaaacccatacatgccctcagtcatcgagaaaatggaaacattgcaacggaagtatggcggagcgctagtcagaaatccgctgagtcgaaacagcacacatgagatgtactgggtcagcaacgcgacgggaaacattgtatcgtcagttaacatgatatctaggatgttaattaataggtttaccatgaagcacaaaaaggccacctacgaaccagacgttgacctcgggtccggcacgaggaacattggcatagaatccgagatccctaacctggacataatagggaaacgcatcgagaaaatcaaacaggaacacgaaacgagctggcactatgaccaggaccacccatataagacatgggcctaccacggatcgtatgaaacgaaacagacgggctcagcctcgagcatggtcaacggcgtcgtacggttgctaacaaaaccgtgggacgtagtacccatggtcacacagatggcaatgacagacaccacgcccttcggccaacaaagagtttttaaggagaaagtagatacccgcacccaggaacccaaagagggcacgaagaaattaatgaagataaccgccgagtggctctggaaagaactagggaagaagaaaacaccccgcatgtgcacgagggaggagttcactaggaaagtacgtagcaatgccgccctaggcgcaattttcacagatgaaaacaaatggaaatccgccagagaagccgtggaggatagccggttctgggagctaatcgacagagaacgaaatctccacctagagggtaaatgtgagacatgcgtatacaatatgatgggaaaaagagagaagaaattgggtgagttcggtaaagccaaagggagccgcgcgatctggtacatgtggctgggagcccgttttctggagttcgaagcactaggattcctaaatgaggaccattggttctcaagagggaacagcctctcgggggtcgaaggcgagggactacatagactgggctacatactccgtgacgtgagcaagaaagaagggggagcaatgtatgccgatgacacagccggatgggacacaagaatcacactcgaagacctaaagaatgaagagatggtaacgaaccacatgaagggagagcataaaaagctggccgaggcaatattcaagctaacatatcagaataaggtagtcagggtgcagcgaccaacaccccgaggaacggttatggacataataagtcggagagaccagcgaggatcgggacaggttgggacgtatggtcttaatacattcacaaacatggaggctcaactaatccgacagatggagggggagggcatcttcaagtccatccaacacctaacagtcaccgaggaaatcgcagtgcaaaactggcttgcgcgcgtcggccgagaaagactatcacggatggccatcagcggagacgactgcgtcgtaaaacccctggacgacagatttgcgtcagcgttgactgcactaaacgacatgggaaaagtccgaaaggatatacagcaatgggaaccgagtagaggctggaacgactggacgcaggtcccgttctgtagccatcacttccacgagcttgtgatgaaagatggccgagtcctcgtggtcccgtgccggaatcaggacgaactaatcgggcgggcccgcatcagccaaggtgctgggtggagcctgaaagaaacagcctgcctggggaaatcgtacgcccagatgtggaccctaatgtacttccacagaagagatttgagactggcagcaaacgcaatttgcagtgccgtaccgtcccattgggttccaacatcaaggacaacctggagcatccacgccaaacacgaatggatgacaacggaggatatgctagccgtatggaacagggtatggatccaagagaatccatggatggaggacaaaacaccggttgaaagttgggaagaggtaccctacctaggcaaacgggaagatcagtggtgtgggagcttaatcgggctcacatctcgtgccacgtgggccaagaacatacagacagccatcaatcaagtacgctcactgataggaaacgaggaatataccgactatatgccctccatgaaaagattccgccgcgaagaagaagaagccggagtactttggtga

SEQ ID NO: 25554 - RNA, 9876 nt, synthetic construct
  misc_feature 1..9876: note = derived and/or modified CDS sequence (opt11) from DENV-2__GQ398289__SS-prME
  source 1..9876: mol_type = other RNA
acagctggagtcatcatcatgctgatccccactgccatggcgtttcacctcacgacccgcaacggggagccccacatgatcgtcggccgccaagagaaggggaagtccctgctgtttaagaccgaagacggcgtgaatatgtgcaccctcatggccattgaccttggggagctatgtgaggacactataacctacaagtgccccctcctgcgtcaaaacgagcccgaggatatcgactgctggtgcaacagcacgagcacctgggtgacctacgggacatgcacgaccacaggagagcaccggcgcgagaagcggtccgtcgccttagtgccccacgtggggatgggcctcgagacccgcaccgagacctggatgtcgagcgagggggcctggaagcacgtccagaggatcgagacctggatcctgcgccacccgggcttcgccatcatggcggccatcctagcctatacgatcgggaccacccacttccagcgggccctcatctttatcctgttaacagcggtggcccccagcatgacaatgcgctgcatcggcatctccaaccgggacttcgtggagggcgtcagcgggggctcctgggtggacatcgtgctagagcacgggagctgtgtcaccaccatggccaagaacaagccgacgctggattttgagctgatcaaaactgaggccaagcagcctgcgaccctcagaaagtactgcatcgaggcgaagctgaccaacacgaccaccgaatcgcggtgcccgacccagggcgagcccagcctaaatgaggagcaggacaagcgcttcgtctgtaagcactccatggtcgatcggggctgggggaacggctgcggcctcttcggcaagggcgggattgtcacatgtgccatgttcacctgcaagaagaacatggagggcaaggttgtgctgcccgagaacctggagtacaccatcgtcatcacgcctcacagcggagaagagcacgcagtcggaaacgacacgggtaagcatggcaaagagatcaagatcaccccgcagtcctctatcaccgaggccgagttgaccggttatggtaccgtgacgatggagtgcagcccccggaccggcctggactttaacgaaatggtcctgctccagatggaggacaaagcctggctggtgcatagacagtggttcctggacctccccctgccctggctgccgggggcggacacccagggctctaactggatccagaaggagaccctagtgacgttcaagaacccgcacgccaagaagcaggacgtcgtggttttagggtcccaggagggcgccatgcacaccgccttaactggcgccaccgagatccagatgagctcgggcaacctcctgttcacgggccacttaaagtgccgcctccggatggacaagctgcagctgaaaggcatgtcctacagcatgtgcaccggcaagttcaagatcgtgaaggagattgccgagacccagcacgggacaatcgtgatacgcgtccagtacgagggcgacggctccccatgcaagataccattcgagatcatggatctcgagaagcggcacgtgctgggtcgcctgatcacagtaaacccgatcgtaactgagaaggacagtcccgtgaacatcgaggccgagccgccctttggcgactcctacattatcatcggagtggagccaggtcagctcaagctgaactggtttaagaaggggagctccatcggccagatgttcgagaccaccatgcgcggcgccaagcggatggccatcctgggggatacggcctgggacttcggctctctcgggggcgttttcacctccatcgggaaggcgctgcaccaagtgttcggagccatctatggggccgccttttctggggtgtcctggactatgaagatcctgatcggcgtgatcatcacctggatcgggatgaactcccgatccacgagcctgtctgtgagcctcgtgcttgtcggcgtggtgaccctgtacctcggagcgatggtccaggctgactccggctgcgtggtgagctggaagtcgaaggagttgaaatgcggcagcgggatcttcatcaccgacaacgtccacacctggacggagcagtacaagttccagccagagagcccctccaagctggccagcgctatccagaaagcccacgaagaggggatatgcgggatccggtccgtgacccggctcgagaacctcatgtggaaacagatcaccccggaactgaaccacatcctgagtgagaacgaggtgaagctaaccattatgactggagataccaaggggatcatgcaggcgggcaagcggtccctgcgcccgcagcccaccgagctcaaatacagctggaagacctggggcaaggcaaagatgctatccacagagagccacaaccagaccttcctgatcgacgggcccgaaacggccgaatgcccgaacaccaatcgggcctggaactcactggaagtcgaggactacggcttcggggtgttcacgaccaacatctggctgaagctgcgtgaaaagcaggacgtgttctgtgacagcaagctcatgagtgccgcgatcaaggacaatcgtgctgtgcacgcggacatgggctactggatcgaaagcgccttaaatgacacctggaagatggagaaggcctccttcatcgaggtcaaaagctgtcattggccaaagtcccacaccttgtggagcaacggcgtgctcgagtccgagatgataatccccaagaacttcgcggggcccgtgagccagcataactaccggccgggctaccacacccaaacggccgggccctggcacctgggcaagctggagatggacttcgatttctgcgaggggaccactgtggtggttaccgaggactgcggcaaccggggccccagcctccggacgaccaccgcgtccggaaagctgatcaccgagtggtgttgccggagctgcacgctgcccccgctccgctaccggggggaggacgggtgctggtacggcatggagatccgacccctgaaggaaaaggaggagaacttagtgaattcccttgtgaccgccgggcacggccagattgataacttcagcctgggcgtcttagggatggccctctttctggaggaaatgctgcggaccagggtgggaaccaagcacgccatcctcctgatcgccgtgtcattcgtcacactgatcaccggtaacatgagcttccgggatctcggccgcgtgatggtgatggtcggggcgactatgaccgacgacatcggcatgggcgtgacgtacctggccctgctcgcggcctttaaggtgcgccccacattcgccgccgggctgctgttacggaagttgacttccaaggagctgatgatggccaccatcggcatcgcgctactaagccaatccacgatccccgagaccatcctggagctcactgacgcgttggcgctaggcatgatggtcctcaagatcgtgcgcaacatggagaagtaccaactggcagtcaccataatggcaatcagctgcgtaccgaacgcggtgatcctgcagaacgcttggaaggtgtcctgcacgattttggccgcagtctccgtaagcccgctgcttctaacctcatcccaacaaaaggcggattggattcccctggccctgaccatcaagggcctcaaccccaccgccatcttcctgacgaccctgagccggacctcgaagaagcgcagctggccgctcaatgaggcaatcatggccgtgggcatggtgagtattctggccagcagcctgctcaagaacgatattcccatgaccgggcccctggtggccggcgggctgctcacagtatgctatgtgctgaccggccggtccgccgacctggagctcgagcgcgcagcagacgtgaagtgggaggatcaagcggagattagcggctcaagccccatcctatccatcaccatctctgaggacggctccatgtcgatcaagaacgaggaagaagagcagacactgacgatcctgatccggaccggcctactggtcatctcgggggtgttcccggtgagcatccctataaccgccgctgcctggtacctgtgggaggtaaagaagcagcgcgccggcgtgctgtgggatgtgccctctccgccgcccgtggggaaggctgagttagaggacggcgcctaccgaatcaagcaacgcgggattctgggctatagtcagatcggggctggtgtgtacaaggagggcacctttcacaccatgtggcacgtgacgcgcggggcggtcctgatgcaccgcggcaagcggatagagccaagctgggcagacgtgaagaaggacctgatatcctatgggggcggctggaagctcgagggggagtggaaggagggtgaggaagtgcaggtcttggcgcttgagcccgggaaaaacccccgagcagtccaaacaaagcccggcttgttcaaaaccaacaccgggacgatcggcgccgtgtccttagacttcagccccggcacgtccggtagccccatcgtcgaccggaaggggaaggtggttgggctatacggcaacggcgtcgtgacccgctccggagcctacgtgtctgcgatcgctcagaccgagaagtccatcgaggacaaccccgagatcgaggacgatatcttccggaagaagcgcctaacgatcatggacctgcaccccggagccggcaaaaccaagcgctacctgccggccatagtccgtgaggccataaagcgaggtctgcggaccctcatcctggcgccgacccgggtggtggccgccgagatggaagaggccctgcgggggctccccatccgctaccagacgcccgccatccgggctgagcacaccggccgcgagatcgtcgacctgatgtgccacgccaccttcaccatgcggctgctgtcccccgtgagggtgcccaactacaacctgatcatcatggacgaggcccacttcacggacccagccagcatcgccgcgcggggctacatctctacccgcgtcgagatgggggaggccgccggaatcttcatgaccgccacgccgcccgggtcgcgggacccgttcccacagtccaatgctcccatcatggacgaggagcgtgagattccagaacggtcgtggaactccggccatgagtgggtcactgacttcaaggggaagaccgtgtggttcgtaccgtcgatcaaagctggcaacgacatcgccgcgtgcctgcgcaagaacggaaaaaaagtgatccagctctcgcggaagacttttgacagcgagtacgtgaagacccgcgccaacgattgggacttcgtcgtgaccaccgacatctccgaaatgggggcgaacttcaaagccgaacgggtgatcgacccccgccggtgcatgaaacccgtaatcctgaccgacggcgaggagcgcgtaatcctggccgggcccatgccggtaacccacagctccgcggcacagcggcgtggccgaatcgggaggaatcccaagaatgagaacgaccagtacatatacatgggcgagcctctcgagaacgacgaagattgtgcccactggaaggaggccaaaatgctgctggacaacatcaacacgcccgagggcatcatcccgagcctcttcgagccggaacgcgagaaggtcgacgccatcgacggggaataccggctccgcggcgaagcccggaagacgttcgtggacctgatgcgccgcggagatctccccgtgtggctggcctaccgcgttgctgccgagggaattaattacgccgaccggcgctggtgcttcgacggcatcaagaacaaccagatcctggaggagaacgtggaggtcgaaatctggaccaaggagggcgaacggaagaagctaaaaccacgctggctggacgcgcggatctactccgacccgctggcgttgaaggagttcaaagagttcgccgccggcagaaagagcctgaccctgaacctcataacggagatggggcgactgcccaccttcatgacccaaaaggcccgcgacgccctggacaacctcgcggtcctccataccgccgaggccggagggcgtgcctacaaccacgccctgtccgagttaccggagacgctggagacactgctcctgctgacgctcctagcgaccgtgactggcggcatcttccttttccttatgagtgggcgcggaatcgggaaaatgaccctgggcatgtgttgtatcatcaccgcctctatcctgctctggtacgcccagatccagccgcactggatcgccgccagcatcatcctagagttcttcctgatagtcctcctgatacccgagcccgagaagcagcggacgccccaggacaatcagctcacctacgtagtgatcgccatactcaccgtcgtcgccgccaccatggccaacgaaatgggcttcctggagaaaaccaaaaaggacctgggcctcggctccatcaccacgcaggagtcggagagcaacatcctggatatcgacctgcgcccggcctccgcgtggactctctacgccgtcgccaccaccttcgtcacgcccatgctgcggcacagcatagagaactccagcgtgaatgtgtccctcaccgccatcgcgaaccaagccactgtcctcatgggcctgggcaaggggtggcccctgagcaagatggacatcggagtgcccctcctcgccatcgggtgctactcccaggtgaaccctatcaccctcacggccgccctcctgctattggtggcgcattacgccatcatcggccccggcctgcaggccaaggccaccagggaggcccagaagcgcgcggcagcagggatcatgaagaaccccaccgtcgacggaatcactgtgatcgacctggaacccataccgtacgatcccaagttcgagaagcagctcgggcaggtgatgttgctaatactttgcgtgacccaggtcctgatgatgcgcaccacctgggcactatgcgaggccctcactttggccacgggtcccattagcactttatgggaggggaaccccggccgcttctggaatacgaccatcgccgtcagcatggccaacatcttccggggcagctacctcgccggggcgggactgctgtttagtattatgaagaacacaaccaacacccgccggggcacagggaacatcggcgaaacgctcggggaaaagtggaagtcgcgcctgaacgctctgggcaaatccgaatttcagatctacaagaaatccgggatccaggaggtggaccggaccctcgccaaagagggcatcaagcgcggggagactgaccatcacgccgtgagccggggcagcgccaagctgcgctggttcgtcgagaggaacatggtgaccccggagggcaaggttgtcgaccttggctgcggccgcgggggttggtcctactactgcgggggcctcaagaacgtgcgggaggtaaagggcctgacgaaaggcgggcccgggcacgaggagcccatccccatgagcacctatggttggaacctggtccgcctccagtccggggtggacgtcttcttcaccccgcccgagaaatgcgacaccttactgtgcgatatcggtgagtccagccccaaccccacgatcgaggcgggccggacgcttcgagtcctgaacctggtggagaactggctcaacaacaacacccagttctgtatcaaggtgctgaacccgtacatgccctccgtcatcgagaagatggagacacttcagcgcaagtatgggggcgccctggttcgcaacccacttagccggaactccacacacgagatgtactgggtgagcaacgccacggggaacatagtctccagcgtgaacatgatctcccgcatgctgatcaaccgctttaccatgaaacacaagaaagccacctacgagccggacgtcgaccttggcagcggcacgcggaacatcgggattgagtccgagatccccaacttagacatcataggcaagcgcattgagaaaatcaagcaagagcacgaaacttcctggcactacgaccaggaccacccctacaaaacctgggcataccatgggtcctacgagaccaagcagaccggcagcgcgtccagcatggtgaacggggtcgtgcgcctgctgacgaagccctgggacgtcgtgcctatggtgacccaaatggcaatgaccgacacgacccccttcgggcagcagcgcgtcttcaaggagaaagtggacacccggacgcaagagcccaaggaaggcacaaagaagctcatgaagatcactgccgaatggctgtggaaggagctgggcaagaaaaagacgccacggatgtgcacccgggaggagttcacgcgcaaggtccggtccaacgctgccctcggcgcgatcttcacagatgagaacaagtggaagtccgcgcgcgaggccgtcgaagactccaggttctgggagctgatcgatcgcgagcgtaacctgcacctcgaggggaagtgcgagacctgcgtctacaacatgatgggcaagcgagagaagaagctgggggagtttggcaaggccaagggcagcagagccatctggtacatgtggcttggggctcgcttcctcgaattcgaagccctgggcttcttaaacgaggaccactggttcagccgacggaactccctcagcggggtggagggcgaggggctgcaccggctgggctacatactccgcgacgtctccaagaaggagggcggggccatgtacgccgacgacactgcgggctgggacacccggattacgctggaggacctgaaaaacgaggaaatggtgaccaaccatatgaagggggagcataagaagctcgccgaggccatcttcaagctgacctaccagaacaaagtcgtgcgcgttcagcgcccgacgccgcggggcacggttatggacataattagccgccgggaccagcgcgggtccggccaggttggcacctacgggctaaacacgttcaccaacatggaggcccaactcatccggcagatggagggcgaggggattttcaagagcattcaacacctgacagtgaccgaggaaatcgccgtccagaactggctggcccgagtgggccgagagcgcctctcccggatggccatcagcggggacgactgcgtggtgaagcccctggacgaccgcttcgcctcggccctgacggccctcaacgacatggggaaggtgcggaaggacatccagcaatgggagccctcgcgcggctggaacgactggacgcaggtgccgttctgttcccaccacttccacgagctggtcatgaaggatggacgcgttctggtggtcccctgccgcaaccaggacgagctcatcggccgggcgcgcatcagccaaggggccggctggtcgctgaaggagacggcctgcctgggcaaaagctacgcccaaatgtggaccctcatgtacttccaccggcgcgacctgaggctcgctgcgaacgccatctgctccgcggtccccagccactgggtgcctacgtcccgaaccacctggagcatacacgcgaagcacgagtggatgacgaccgaggacatgctcgccgtctggaaccgagtttggatccaggagaacccttggatggaggacaaaacccccgtggagagttgggaggaggtgccctacctggggaagcgggaagaccagtggtgcggatccctgatcgggctcaccagccgcgccacctgggccaagaacattcagaccgccatcaaccaagtgaggtccctgattggcaacgaggagtacaccgactacatgcccagcatgaagagattccggcgcgaggaggaggaggccggcgtgctgtggtaa

SEQ ID NO: 25555 - RNA, 9876 nt, synthetic construct
  misc_feature 1..9876: note = derived and/or modified CDS sequence (opt11) from DENV-2__GQ398290__SS-prME
  source 1..9876: mol_type = other RNA
acagccggagttataatcatgctaatccctactgccatggccttccacttaaccactagaaacggggaaccacacatgattgtggggcgacaggaaaaaggcaaatcattactgttcaaaacggaagatggtgtgaacatgtgtacgctgatggccatcgacctaggggaattgtgcgaagacacgataacatacaaatgcccattactccgtcaaaacgaacctgaagacattgactgctggtgtaacagcacaagcacatgggttacatacggaacctgtacgacaaccggcgaacataggcgagaaaaacgtagcgtagcactggtaccccacgtcgggatgggcctagaaacacggactgaaacgtggatgagtagcgaaggagcgtggaaacacgttcagaggattgaaacatggatactccgacaccctgggttcaccataatggcggcaatattggcctacaccataggaacgacccacttccaacgtgccctcatattcattctactcactgcagtggccccgagcatgaccatgagatgtataggaatcagtaaccgtgacttcgttgaaggggtatcaggaggttcatgggtcgacatagtattagaacatgggagctgcgtaacaaccatggcgaaaaacaaaccgaccctcgactttgaattaatcaaaactgaagcgaagcaaccagctacattaagaaagtactgtatagaagccaagctgacaaacacgactaccgaatcccgctgccccacacaaggagaacctagcctaaacgaagaacaagacaagcgattcgtgtgcaagcacagcatggtagatcgagggtggggcaatggctgcggactgttcggcaaaggaggaatcgtaacatgcgcgatgtttacttgtaaaaagaacatggaaggtaaagtggtactgccagaaaacttcgagtacacaatagtgattacacctcactcgggagaagaacatgcggtgggcaacgatacaggaaaacacgggaaagagatcaagatcaccccacaatcgtcaataaccgaggcagaattgactgggtacggcacagttactatggaatgcagtccacgcaccgggttagatttcaatgagatggtcctactacaaatggaggataaagcctggctggtccatcgccaatggttcctcgacctaccgctcccatggcttcccggtgcagacacacagggaagtaactggatacagaaggagaccctagtgacattcaaaaacccccacgctaagaaacaagacgtagtagtcctcggaagtcaggaaggggcgatgcacaccgcattgacaggtgcaacagagatccaaatgtcgagcggtaaccttctctttacaggccacctaaaatgcagactacgaatggataaattacagctgaaagggatgagctacagcatgtgtaccggaaaattcaaaattgtgaaggaaatcgcagagacacagcacgggacaatagtaataagagtgcaatacgagggcgatggctccccgtgcaaaattccattcgagataatggatctagaaaagcgacacgtcctcggacggctcataactgtaaacccaattgtgaccgaaaaagatagccccgttaacatagaggcggaaccacccttcggagactcgtatataataataggagtggaaccgggccaactcaaactcaactggtttaagaaagggagcagtatagggcagatgtttgaaaccaccatgcgtggggccaagagaatggccatactcggtgacaccgcttgggactttggcagcctcggcggagtattcacgtcgatagggaaggcactgcaccaagttttcggggccatttatggcgccgcctttagtggcgtaagctggacgatgaagatacttatcggcgtgataataacctggataggtatgaatagccggagcacaagcctgtcggtgagcctcgtcctggtcggcgtagtcacactatacctgggggcgatggtgcaagccgatagcggatgcgttgtctcatggaagtcaaaagaactgaaatgcggatcaggaatctttataacggataatgtgcatacgtggacagaacagtacaagttccaacccgaaagcccatcaaaacttgcctcagcaatacaaaaggctcacgaggaaggaatttgcgggatccgaagcgtaacccgacttgagaacctcatgtggaagcaaattacacccgaactcaatcacatcctctctgaaaacgaagtaaaactcactatcatgacgggagacattaaaggaattatgcaagcaggcaagcgctcactacgcccacaaccgactgagcttaaatactcatggaagacgtggggaaaagcgaaaatgttatcaaccgagtcacataaccagaccttcctaatagatgggccggagacagcggaatgcccaaacacaaatcgggcatggaactccctggaagttgaggactacggcttcggggtattcacgacgaacatctggctaaagctccgcgaaaaacaagacgtgttttgcgactcgaaactgatgagcgccgcgatcaaggacaaccgtgcggtacatgcagacatggggtactggattgagagcgccctcaacgacacctggaaaatggaaaaagccagcttcatagaagtaaaatcgtgtcactggccaaaatcccacacgctgtggtccaacggggttctagaatccgaaatgattattccgaaaaacttcgcggggccagtgtcacaacacaactacagaccagggtaccatactcaaacggcaggaccctggcacctaggaaaattggagatggacttcgacctatgcgagggcactacggtggttgtaaccgaaaattgcggcaacaggggaccgagtctcagaaccacaaccgcatctgggaaactgataactgaatggtgctgcaggagctgcacactcccaccccttagataccgaggcgaagacggctgctggtacgggatggagatcaggcccctcaaggagaaggaagaaaacctcgtcaatagtctggtgacggcagggcacggtcagatagacaactttagcttaggtgtactgggcatggctttattcctggaggaaatgttgcgaacacgggtggggacgaagcatgcaatccttttagtagcggtatcctttgtgacacttatcaccgggaacatgtcgttcagagatctaggcagagtcatggtgatggtcggagccacaatgacagacgacataggaatgggagtcacgtacctagcgctactggcggcctttaaggtccgcccaacattcgccgctggactcctacttcgcaagctaacgtcaaaagaactcatgatggccaccatcgggatcgccctactatcgcaaagcacaatcccagagacgatactggaattaaccgatgcacttgccctagggatgatggtactaaaaatcgtgcggaacatggaaaaataccaactggcagtcacgatcatggccattagctgcgttcctaacgcggtaattttgcaaaacgcgtggaaagtgagctgcactatcttagccgcagtatccgtctcgcccttactactgacaagcagccaacaaaaggcagattggattccactggcgttaacgattaaaggccttaacccaaccgctatctttttaacaacactgagccgcacctccaagaaacgatcatggccactaaacgaagctatcatggcagtaggcatggtcagtatcctagcctcctcattactgaaaaacgacattcccatgacgggccctctggtggccggcgggttgctcaccgtgtgctacgtactgactggccgcagtgccgaccttgagctagagcgagcggccgacgttaaatgggaagatcaagctgagataagcggcagcagccccatcctttcaattacgatcagtgaagacggaagcatgtcgatcaaaaacgaagaagaggagcagacacttactatacttatccgaacgggactcctagtaataagtggtgtgttccccgtaagcataccaataaccgcagccgcatggtacttgtgggaggtcaaaaagcaaagggcgggagtcctttgggatgtccccagcccaccacctgtcggcaaagccgagctggaagacggagcataccgaataaagcaaagagggatcctgggttatagccagataggggcaggggtttataaagaagggacttttcacacaatgtggcacgtgaccagaggggcggttctgatgcaccgtggcaaaaggatcgaaccctcatgggcagacgtaaagaaggatctgatctcctacggaggcgggtggaagttagagggggaatggaaagaaggagaagaagtccaggtgctcgccctagaaccgggcaagaacccgcgtgcagtgcagacaaagccgggactcttcaaaaccaacacaggcactataggggccgtctccttagatttcagccccggtacctccgggtcacccatagtcgacagaaagggcaaggtagtgggattgtacggaaacggcgtggtaactcgaagcggagcatacgtatcggcgatcgcacaaacggagaaaagcatcgaggacaatcccgagatagaggacgacatattccgcaagaaacggttaacaatcatggacctccacccaggagcaggtaaaaccaagcgatacttacctgcaatcgtacgagaggccatcaaacgaggactccggacattgatcctcgcacccacccgagtagtggcagctgagatggaagaagcacttagagggctgcccattagatatcaaacgcccgccatacgggcagagcatacgggacgtgaaatcgtggacctcatgtgccacgcaacgtttaccatgcgactcctgtcaccagtacgtgtcccgaactacaaccttatcataatggacgaagcgcacttcacagatccagcgagtattgcggcccgtggatacatctccacgcgagtagagatgggagaggccgcgggtatattcatgacggcgacacctccgggatcgagggacccattcccgcaaagcaacgccccaataatggacgaggagcgagaaataccagaacgctcttggaacagcggacacgaatgggtcaccgacttcaagggcaaaaccgtatggttcgtccccagcataaaggccgggaatgacatcgcagcttgcctaaggaaaaacggaaagaaagttatccaactgtcacgcaagacattcgacagcgagtatgtgaagactcgagccaacgactgggatttcgtggtcactacagacataagcgagatgggagcgaattttaaagcggagcgggtaatagatccgagacgctgtatgaagccggtaatacttaccgatggcgaggagcgcgtcatcctcgcgggacccatgcccgtcacacactcaagcgctgcgcaacgaagagggcgaattgggaggaaccccaaaaacgaaaacgatcagtatatctacatgggtgagccgctagagaacgacgaagactgcgcccactggaaagaagcaaagatgctcctagacaacatcaatacaccagaagggataataccatccatgtttgaaccggagcgagagaaagttgatgcgattgacggggagtataggctgcgcggagaagcgcgaaagaccttcgtcgatttgatgcgaaggggcgacctgcccgtgtggctggcctatcgggtagcagctgaggggataaattacgcggaccggcgatggtgctttgacggcatcaagaataatcaaatcctcgaagagaacgtagaagtagaaatatggactaaagagggcgaacggaagaaactgaagcctcgttggctcgatgcgaggatctatagcgacccactcgctttaaaggagttcaaagagttcgcggccggccgtaagagcctgacattgaacttaataaccgagatgggccggctgccaacattcatgacacaaaaagcccgagatgcactagacaatcttgcagtactacacacggcagaagcaggaggtagagcatacaaccacgcgctcagcgagctgccagaaaccctggagaccctcctgctactgactctgctagcaactgttacaggaggaattttcctgtttcttatgagcggacgagggataggaaaaatgaccctaggaatgtgctgtatcataacagcgagcattctactatggtacgcccaaatccaaccacattggatcgccgcttccataatcctagagttcttcctcatagtgttgctaatcccggagccggagaaacaacggacaccacaagataaccaactgacctacgtagtcatcgccatccttaccgtagtcgcagccacgatggcaaacgaaatgggattcctggagaaaactaagaaggaccttggcctaggctcaataaccacgcaagaaagcgagtcaaacatactggacatagacctgcgcccagcaagcgcctggaccttatacgccgttgccacaacattcgtgacgccgatgctccgccacagcatagagaactcaagtgtgaacgtctccctaacagccatcgccaaccaagctaccgtactaatggggctcggtaaaggatggccgttaagcaaaatggacatcggagtaccactccttgctataggatgctactcgcaagtgaatccgattaccttgacagcagcattgcttcttctcgtggcccattacgcgataatcggccctggccttcaggcaaaagccacacgtgaagcgcagaaacgagcggccgccgggataatgaagaaccctaccgtagatggcatcaccgtgatagatctcgaaccgataccatacgatccgaagttcgaaaaacagctcggtcaagtaatgttactaatactctgcgtcactcaagtactcatgatgcgcaccacatgggcactctgcgaagctctgacactcgcaaccggcccgatctcaacactatgggagggaaaccctgggaggttttggaacacaaccatcgcagtgtcgatggcaaatatcttcaggggaagctacctggcgggtgcggggctgctgttcagcattatgaaaaacaccacgaatacgcgaagaggaacaggaaatataggggaaactctaggagagaagtggaaaagcaggcttaataccctggggaaatcagagttccagatctacaagaagtcgggaatacaagaagtcgataggaccctggcaaaagaaggaatcaagcgaggcgagaccgaccaccacgcggtgtctcgagggagcgccaagctaaggtggtttgtggagcgaaacatggtcacgcccgaaggaaaagttgtggacctcggctgcgggagaggaggatggtcctattattgcggagggctcaaaaacgtaagagaggtgaaaggcttgacgaaaggaggacccgggcatgaggagcctatcccaatgtcaacatacgggtggaatttagtacgcttacaatcgggcgtagacgtcttcttcacaccacccgagaaatgcgacaccctactgtgcgatatcggagaaagcagcccgaatcccacaatcgaagctggccgtaccctacgcgtccttaacctcgtagagaattggctaaacaataacacccaattttgcataaaagttctgaacccctacatgccgagcgtcatagagaaaatggagaccctccaacgtaagtatgggggcgctcttgtgaggaacccgctatcccgaaacagcacacacgagatgtactgggtcagtaacgcgaccggaaacatagtatcgtcagtcaacatgatctcaaggatgctaatcaaccgctttactatgaagcacaaaaaggcaacctacgaaccggacgtagacctcggatcaggaacccgcaacatcgggatagagtccgagattccaaatctagacatcatcggcaaaagaatagagaaaataaaacaagaacatgaaacgtcctggcactacgaccaggaccacccatacaagacttgggcgtatcacgggtcctatgaaaccaaacaaacaggtagcgctagtagtatggtcaacggagtagtgcgcctcctcacgaaaccatgggacgtcgtccccatggtaacgcaaatggcaatgacagatactactccctttggtcaacagcgagtcttcaaagagaaggtagacacacgaacgcaggagccaaaagaaggaacaaagaaactgatgaagataacagcagagtggctctggaaggaactaggcaagaagaaaacaccgcgaatgtgcactagagaggagttcacgagaaaagtcagaagcaacgcagccttaggcgctatcttcaccgacgaaaacaaatggaagtcagcgcgagaggccgtcgaagacagcagattttgggaactcatcgatagggagcgtaacttacaccttgagggaaaatgtgaaacatgcgtgtacaacatgatgggaaagagggagaagaaattaggagagttcggaaaggcgaaaggctcacgcgcaatctggtatatgtggcttggagcaaggtttctcgagtttgaggccctaggctttctaaacgaggaccactggttcagtagaggaaattcactctcaggcgtcgaaggcgaaggtttacaccgactgggctacattctcagggacgtatccaagaaagaaggaggggccatgtacgccgatgacaccgcaggctgggacactcgaattaccttggaggaccttaagaacgaggagatggtaaccaatcatatgaagggggaacacaaaaagctagccgaggcgatattcaaattaacataccaaaacaaggtcgtaagggtacaacgccccacaccacgcgggacggttatggacattatttccagaagagatcaacgtggaagtggacaagtaggcacctacgggctcaatacattcacgaatatggaagcgcaactaatcagacaaatggaaggtgaaggcatatttaagagcatacaacacctaacagctacggaggagatcgcagtacagaattggcttgcccgagtcggccgtgagcggctcagccgaatggccatcagcggcgatgactgcgtggttaagcccctggatgatcgcttcgccagcgcgctcacagccctcaacgacatgggcaaagtacgtaaagacattcagcaatgggaaccgagtagaggctggaacgattggactcaagtaccattctgttcacatcacttccatgaactcgtaatgaaagacggaagggtgctggtcgtcccctgtcgtaaccaagacgaactaattggacgcgcaaggatcagtcaaggagcaggatggagcctaaaagaaacggcctgcttaggcaagtcctacgcacaaatgtggaccctgatgtacttccaccgccgagacctcagactagccgccaacgcaatatgtagcgccgtccccagccactgggtcccaacatcgcgcaccacgtggtccatacacgcaaaacatgaatggatgactacagaggacatgctggccgtatggaacagggtatggatccaagagaacccctggatggaagataaaacgcctgttgaatcctgggaggaggtgccatatctgggcaagagagaagatcagtggtgcggctccctgattggactcacttcgagggccacatgggcaaagaacatccaaacggcaataaaccaagtccggtccttaatcggaaacgaggagtatacggactacatgcccagcatgaaacgattccgcagagaagaagaggaggcaggagtactgtggtag

SEQ ID NO: 25556 - RNA, 9876 nt, synthetic construct
  misc_feature 1..9876: note = derived and/or modified CDS sequence (opt11) from DENV-2__GQ398284__SS-prME
  source 1..9876: mol_type = other RNA
accgctggcgttattatcatgctgattcccaccgcgatggcgttccacttaaccacacggaacggggaaccccacatgatagtggggaagcaggagaaggggaagtccctgctgttcaagaccgaggatggtgtgaacatgtgcaccttgatggccatcgatctgggggagctgtgcgaggacaccataacgtataagtgtcccttgctgcggcaaaacgaacccgaagacatcgactgctggtgcaattcaacgagcacctgggtgacctacgggacctgcacaacaacgggcgagcaccgccgagagaagcgatcggtcgccctggtgccccacgtggggatgggcttagagacccgaaccgagacctggatgtccagcgagggggcatggaagcacgtccagcgcatcgagacgtggatcctgagacacccaggattcaccatcatggcggcgatcttagcctacaccatcgggaccacgcacttccaacgcgccctcatcttcatcctgctgaccgccgtggcgccctccatgaccatgcggtgcatcggcatctccaacagggacttcgtggagggcgtcagcggaggatcctgggtggacatagtgctcgaacatgggagctgcgttaccaccatggccaagaacaagcccaccctggacttcgaactaataaagacggaggccaaacagcccgccaccctccggaagtactgcatcgaggccaagttgactaacaccaccaccgagtccaggtgcccgacgcagggcgaaccctccttgaacgaggagcaggacaagcggttcctctgtaagcactccatggttgaccgcggatggggtaatggctgcgggctgttcggcaagggcgggatcgtgacctgcgcgatgttcacttgcaaaaagaacatggagggcaaggttgtgcaacccgagaacctggagtacactatcgtgattacgccccactcaggggaggagcacgccgtcggcaacgacaccgggaagcacggcaaggagatcaaaataaccccgcagagcagcatcaccgaggccgagctcaccgggtacggcacggtcaccatggagtgcagcccccggacgggccttgactttaacgagatggtgctgttacagatggaggacaaggcttggctggtgcaccgacagtggttcctagacttgcccctgccgtggttaccgggagccgatacccaaggcagcaactggatccagaaggaaacgctcgtcacctttaagaacccccacgcgaagaaacaagacgtggtcgccctggggtcccaggagggggccatgcacacagccctgacaggggcgacggaaattcaaatgagcagcggcaacctactgtttacgggccatctgaagtgccggctcaggatggacaagttacagctgaagggaatgtcctacagcatgtgcaccggtaaattcaagatcgtgaaggagatcgcggagacccagcacggcaccatcgtcatccgcgtgcagtacgaaggcgacggctccccctgcaagatacccttcgagatcatggatctcgaaaagcgccatgtgctgggtagactgatcaccgtcaacccgatcgtgaccgagaaggacagccccgtgaatattgaggccgagccgcccttcggcgactcctacatcatcatcggggtcgagccgggccaactcaagttgaactggttcaaaaaagggagctccatcggccagatgttcgagaccacgatgcgaggcgccaagcgcatggccatcctgggcgacaccgcctgggatttcggcagtttggggggggtgttcacctccatcgggaaggctctgcaccaggtgttcggcgccatttaccgtgccgccttctcgggcgtctcctggaccatgaagatcctgatcggggtgataatcacctggatcggcatgaattcccgatccacctcgctgtcagtgtcgctcgtcctggttggggtggtcaccctgtacctcggagcgatggtacaggccgactccgggtgtgtggtcagctggaaaaataaggaactgaagtgtgggtcaggcatcttcatcaccgataacgtgcacacgtggaccgagcagtataagttccaacccgagagcccaagcaagctggcttccgccatccagaaggcccacgaggaggggatctgtggcatccggtctgtgacccgcctcgagaacctgatgtggaaacaaatcacccccgagctcaaccacatcctcagcgagaacgaggtcaagctgacgatcatgaccggggacatcaagggcatcatgcaggcggggaaacggagcctgcgcccgcagcccaccgaactaaagtactcctggaagacctggggcaaggctaaaatgctgagcacggaatcccataaccagaccttcctgatcgatggtcccgagaccgcggagtgcccgaacaccaatcgggcctggaacagcctcgaggtagaggactacggattcggcgtgttcacgaccaacatctggctgaagctgagggagaagcaggacgtcttctgcgactccaaactcatgagcgccgcaataaaggacaaccgggccgtgcacgccgacatggggtattggatagagtccgccctgaatgacacttggaagatggagaaagcaagcttcatagaggtgaagtcctgccactggcccaagagccataccttatggtcgaatggggtcctcgagagcgagatgatcatccccaagaacttcgcgggcccagtgagccagcacaactaccgcccggggtaccatactcaaacggccggcccctggcatctggggaaactggagatggatttcgacttctgcgagggcaccaccgtggtcgtcaccgaggattgcgggaaccggggccccagcctgcgcacgaccaccgctagcggtaagctgatcactgaatggtgttgcagatcttgcacgctgcccccgcttcgctaccgtggagaggacggctgttggtatgggatggagatacgccctctcaaggagaaggaggagaacctggtgaacagcctcgtaaccgccgggcacgggcagatcgacaacttctccctcggcgtactgggaatggcgctcttcctggaggagatgctgcgaacgcgcgtggggaccaagcacgccatcctcttagtggccgtgagcttcgtgacgctcatcaccgggaatatgtcctttcgggacctcgggcgcgtcatggtgatggtgggcgccaccatgacggacgacatcgggatgggcgtcacatacctggccctgctcgcggcctttaaggtgcgcccaaccttcgccgccggcctactgctccggaagctgaccagcaaggagctgatgatggccaccatcggcatcgcgctcctgtcccagagcaccatccccgagaccatcctggagctcaccgacgccctggccctgggcatgatggtgctcaagatcgtccgcaacatggagaagtatcagctggccgtaaccatcatggccatatcatgcgtgccgaacgcggtaattctgcagaacgcttggaaggtcagctgcacgatcctcgctgccgtgtccgtcagccctctgctgctcacctccagccagcagaaggcagactggatccccctggccctgaccatcaaggggctcaacccgaccgccatcttcctgacgaccttatccagaaccagcaagaagcgctcctggccgctcaacgaggccatcatggccgtaggaatggtcagcattctggcgtccagcttgctaaaaaacgacatccccatgactggccccctggttgcagggggactgctcacggtgtgctacgttctgaccgggcggagcgccgacctggagctcgagcgcgccgccgatgtgaagtgggaggatcaggcggagatctccggctcgtcccccatcctgagcatcactatatcagaggacgggagcatgtccatcaaaaatgaggaagaggaacagactctgacaatcctcatccggaccggcctgctggtgataagtggcgtcttcccggtgtccatccccatcaccgcggccgcctggtatctctgggaggtgaagaagcagcgcgccggggtcctgtgggacgtgccttcacctccgcccgtgggaaaggctgagctggaggacggggcctatcggataaaacagcgcggaatcttggggtacagccaaatcggcgctggcgtctacaaggaggggacctttcacaccatgtggcacgtgacgcggggagccgttctgatgcaccgcgggaagcgcatcgagccaagctgggccgacgtcaagaaggacctgatctcctacggcgggggctggaagctcgaaggcgaatggaaggagggggaggaagtccaggtgctggcgctggagcccggcaagaacccccgcgcggtccagaccaaaccaggcctcttcaaaaccaacaccggcactataggggccgttagcctggacttctctcccggcaccagcggctcccctatcgtggaccggaagggaaaagtcgttggcctgtacggaaacggcgtggtcacccgcagcggcgcctacgtgtccgcgatcgcgcagaccgagaagagtatcgaggacaatcccgagatcgaggacgacatcttccgcaagaagcgtttaacgatcatggatttacatcccggggccggcaaaacgaagcggtacttgcccgccatagtgcgcgaggccatcaagcgggggctgaggaccctcatcctggcgcccacccgagtcgtggccgccgaaatggaagaggccttacggggactgcccatccgctaccaaacgcccgccatacgtgcggagcacactgggcgagagatcgtggacctgatgtgccacgccacattcaccatgcggctcctcagccccgtcagggtgcctaactacaacctgatcatcatggacgaggcgcacttcacggaccccgcctctatcgccgcgcggggctatatcagcacccgcgtggagatgggagaggccgccgggatcttcatgaccgcgacgccgccgggatcccgggacccattcccccagagcaacgcccctataatggacgaggagcgcgagatccccgagcggtcatggaacagtgggcacgagtgggtcacagacttcaagggcaagaccgtctggttcgtgccgtccattaaggctgggaacgacatcgcggcgtgcctgcgcaagaacggcaagaaggtaatccagcttagccggaagacattcgactcggagtacgtgaagacgcgcgccaatgactgggacttcgtggttacaacagacattagcgagatgggtgcgaacttcaaggccgagagggtaatcgacccccgccggtgcatgaagcccgtgatcctgaccgacggggaggagcgcgtcatcctggccggccccatgcccgtgacccattccagcgccgcccaacggcgcggccgcatagggcggaaccccaagaacgagaatgaccagtacatctacatgggggagcccttggagaacgacgaggactgcgcgcactggaaggaggcaaagatgctgcttgacaatatcaacacgcccgagggcatcattccgtccatgttcgaaccggagcgcgagaaggtggacgccatcgacggcgagtaccggctccgcggggaggcccgcaagaccttcgtcgacctgatgcgcagaggcgacctccccgtgtggctcgcctaccgcgtggcggcagaagggatcaactacgccgaccgacgctggtgcttcgacggtataaagaacaaccagatcctggaggagaacgttgaggtggagatctggaccaaggaaggggagcggaagaaactgaagccgcgctggctcgacgctcgcatctacagcgaccccctggcgctgaaggagttcaaagagttcgccgccggccgaaagtcccttacactgaacctgatcaccgagatgggccggctccccaccttcatgacgcagaaggcccgcgacgccctggacaacctggcggtgctccacaccgccgaggcgggcggcaaagcctataaccatgccctgtctgagctgcccgaaacgctcgagaccttactgctactgacccttttagcgaccgtgaccggagggatcttcctgttcctgatgagtgggaaagggattggcaaaatgaccttggggatgtgctgtatcatcaccgccagcatcctgctgtggtacgcccagatccagcctcactggatagccgcctccatcatcctcgagttctttctgattgtcctgctcatccccgagcccgaaaagcagcggacgccacaggataaccagctgacctacgtcgtgatagcgattctgacggtggtcgccgccaccatggccaacgagatgggctttctagagaagaccaagaaggacctggggctgggcagcatcataacccaggagtcggagtccaacatcctcgacatagacctgcgaccggcaagcgcgtggacgctgtacgccgttgccaccacctttgttacccccatgctccggcactccatcgagaactcgtccgtcaacgtgagtctgaccgcgatagcgaaccaggccaccgttctgatgggcctcgggaagggatggcccctatccaagatggacatcggcgtcccccttctcgccatcggctgctacagccaggttaacccgatcacgctgaccgccgccctgctcctgctggtggcacactatgcaatcatcgggcccgggctccaggcaaaagccactcgcgaggcccagaagcgggcggccgccggcattatgaagaaccccaccgtcgacgggatcaccgtgatcgaccttgagcccatcccgtacgaccccaagttcgagaagcagctgggccaggtgatgctcctgatcttgtgcgtcacacaagtgctcatgatgcggacgacctgggccctgtgcgaggccctgactctcgctaccgggcccatcagtacgctatgggagggcaaccccgggcgcttttggaacacaaccattgccgttagcatggcaaacatctttcggggctcttacctggccggggcggggctcttatttagcatcatgaagaacactacgaacacacgacgggggaccgggaacatcggagagactctgggcgagaagtggaagagccgcctcaacgccttgggcaagtccgagttccagatctataagaagagcggcatccaggaggtcgatcgaacgttggccaaggaggggatcaagcgcggcgagaccgaccaccatgccgtgagccgggggtccgccaaactccggtggtttgtcgagcggaacatggtcaccccggagggcaaggtggtggacctcggctgcgggaggggcggttggagttactactgcggggggctgaagaacgtccgggaggtgaagggactcaccaagggcgggcctggccacgaggagcccatccccatgtccacgtacgggtggaacctggtacgccttcagtctggcgttgacgtgttcttcaccccgcccgaaaagtgcgacacgctcctatgcgatataggggagtcttcccccaaccccaccatcgaggcgggacggacgctgagggttctcaatctggttgagaactggctgaacaacaacacccagttttgcattaaggtcttaaacccgtacatgccctcagtcatcgagaagatggagaccctgcaacgcaagtacggcggggcactggtccgcaaccccttatcccggaacagcacgcacgagatgtactgggtgtccaacgccaccggcaacatcgtcagctccgtcaacatgatcagccgcatgctcatcaaccggttcacgatgaagcacaagaaggccacctacgaaccggacgtggacctagggtcaggcacccgcaacatcgggatcgagagcgagatcccaaacctggacataatcggcaagcgcatagagaagataaaacaagaacacgagacatcctggcactacgaccaggatcatccctataagacttgggcctaccacgggagctatgagactaagcaaaccgggtccgcgtcctccatggtgaacggcgtcgtgcggcttctcaccaagccctgggacgttgtaccgatggtgacgcagatggccatgaccgacaccacccccttcggccagcagcgcgtgtttaaggagaaagtcgacacgcggacccaggagcccaaggagggcaccaagaagctgatgaaaatcaccgccgagtggctctggaaggagctcgggaagaagaagactccccgaatgtgcacccgggaggagtttaccaggaaggtccggtccaacgccgccctgggggctatcttcaccgatgagaacaaatggaagtccgcacgcgaggccgtggaggatagcaggttctgggagctcgtcgatcgcgagcgaaacctgcaccttgaggggaagtgcgagacgtgtgtgtataacatgatgggaaagcgcgagaagaagctcggcgagttcggtaaggctaaggggtcccgcgcaatctggtacatgtggcttggagcgcgcttcctggaattcgaagctctcgggttccttaacgaggaccactggttcagcagaggcaacagcctatcgggggtggagggcgagggtctccacagactgggctacatcctgcgggacgtaagcaaaaaggagggcggggccatgtacgccgatgacaccgcgggctgggacacgcggatcaccctcgaggacctgaagaatgaggagatggtgacgaatcacatgaagggggagcacaagaagctggccgaggcaatctttaaactcacctaccaaaacaaggtcgtgcgggtgcagcgaccgacgccccgcggcactgtcatggacatcatctccagacgggaccaacgggggtcgggccaggtgggtacgtacgggctgaacaccttcaccaatatggaagcccagcttatccgccagatggagggcgaggggattttcaagtcgatccagcacctcacggtaaccgaggagatcgccgtccagaactggctggcgcgggtgggccgcgagcggctgagcagaatggccatttccggcgacgactgcgttgtcaagcccttggatgaccggttcgccagcgctctgaccgccctgaacgacatggggaaagtgcgcaaggatatacagcagtgggagcccagcagaggctggaatgattggacccaggtgccgttctgcagccatcatttccacgaactcgtcatgaaggacgggcgcgtgctggtggtcccttgccggaaccaagacgagctgatcggccgcgcacggatcagccagggggccggctggagcctcaaagagaccgcatgcctgggcaaatcttatgcccagatgtggactctgatgtacttccaccgtcgggacctccgcctggcggcgaacgccatctgcagcgccgtgccctcccactgggtgcccaccagcaggactacctggtccatccacgccaaccacgaatggatgaccacggaggacatgctggcggtatggaaccgcgtttggatccaggagaacccttggatggaggacaagacccccgtggagagctgggaggaggtcccatacctcgggaagcgggaggaccagtggtgcggcagcctcattgggctgacctcgcgtgccacctgggccaagaatatccaaacagccattaaccaggtgcgcagcctcattggcaacgaggaatataccgactacatgccttccatgaagcgtttccgtcgggaagaggaggaggccggcgtgctgtggtga

SEQ ID NO: 25557 - RNA, 9876 nt, synthetic construct
  misc_feature 1..9876: note = derived and/or modified CDS sequence (opt11) from DENV-2__GQ398308__SS-prME
  source 1..9876: mol_type = other RNA
accgccggcgtgatcatcatgctgatccccaccgccatggcgttccacttgaccacccggaatggggagcctcatatgatcgtcggccggcaggagaaggggaagtccctgctgttcaaaactgaggacggggtgaatatgtgcaccctcatggccatagatctgggggaactgtgcgaagacaccatcacctacaagtgccccctcctacgccagaatgagcccgaagacatcgactgttggtgtaacagcaccagcacctgggtcacctacgggacctgtaccaccaccggagagcacagacgcgagaagcggtccgtcgcactggtgccccatgtggggatgggtctcgaaacccggaccgaaacctggatgagcagtgagggggcctggaagcacgtccagcggatcgagacgtggatcctgcggcacccgggcttcacaatcatggccgcgattctggcgtacaccatcgggacaacgcacttccagcgagccctcatattcatcctgctgaccgcagtggcgccctcgatgaccatgcgctgcatcggcatttccaatcgtgactttgtggagggggtcagcggcggctcctgggtggacatcgttttagagcacgggtcttgtgtcaccacgatggccaagaataagcccaccctggactttgagctgataaagaccgaggccaagcagcccgccaccctccggaagtactgcatcgaggccaagttgacaaacacaaccaccgaatcgcggtgccccacgcagggagagccatcactgaacgaggaacaggacaagcgttttgtatgcaaacactccatggtcgaccgcggctgggggaatggctgcggcctctttggcaagggcgggatcgtaacctgtgcgatgtttacgtgtaaaaagaacatggagggcaaggtggtactgcccgagaacctggagtataccatcgttattacgccccacagcggcgaggagcacgccgtgggcaacgacaccgggaaacacggcaaagagattaagatcaccccgcagtccagcatcaccgaggccgaactcaccggatacgggacggtaaccatggagtgctccccccgtaccggtctggattttaatgagatggtcctgctccagatggaagacaaggcctggctggttcaccgacagtggttcctcgacctccccctcccttggctcccgggcgcggacacccagggcagcaactggatccagaaggagaccctcgtgaccttcaagaacccccatgctaagaagcaggacgtcgtggtactggggtcccaagagggcgccatgcacaccgccctgacaggagcgacggagatccagatgtcaagcggcaacctcctgttcaccggtcacctgaagtgccgcctcagaatggacaagctgcagctgaagggaatgtcctactctatgtgcactggcaagttcaagatcgtgaaggagattgccgaaacccagcacgggacgatcgtgattcgggtccaatacgagggcgacggctccccctgtaagatccccttcgagatcatggatctcgagaagcggcatgtgctggggcgcttgatcacagtgaacccgatcgtcgcggagaaggactcgcccgtgaacatcgaggccgaaccaccctttggcgactcttatattatcatcggggtggagccaggccagctcaagctgaactggttcaagaaagggtcttccatcggccagatgttcgagactaccatgcgcggcgccaagagaatggcgatcttgggggacacggcctgggacttcggcagtctcgggggcgttttcacctcaatcgggaaggcgctgcaccaagtgttcggcgcaatctacggcgccgccttcagcggggtctcctggaccatgaagattctgatcggcgtcatcatcacctggatagggatgaacagcagatccacttccctctccgtgagcctagtgctggtaggcgtcgtgaccctgtacctcggagcgatggttcaggccgactccggttgcgtggtgagttggaagtccaaggagctgaagtgcggcagcggaatattcattaccgataacgtgcacacctggacggagcagtacaagttccagccggagagcccctccaagctggctagtgccatccagaaggcgcacgaggagggcatctgcgggatccggtccgtgacccgcctcgagaacctgatgtggaagcagatcacccccgagctgaaccacatcctcagcgagaatgaggtgaagctcacaatcatgacgggcgacatcaaggggatcatgcaggcgggcaagcggagcctaaggccgcagcccactgagctcaaatacagctggaagacctggggaaaggcaaagatgctgtccaccgagagccacaaccagacgttcctaatcgacggcccagaaaccgccgagtgcccgaataccaaccgggcctggaattccctagaggtggaggactacggcttcggggtcttctctaccaatatttggctgaagctgcgagagaagcaggacgtgttctgcgactccaagttgatgagcgccgcgatcaaggacaacagggctgttcatgccgacatgggctactggatcgagtccgccctgaatgatacgtggaagatggagaaggcttcgttcattgaggtgaagtcctgccactggcccaagagccacaccctgtggtccaacggcgtgctcgagagcgagatgatcatccccaaaaacttcgcggggccggtcagccagcacaattaccgtccgggctaccatacccagaccgcagggccctggcacttgggcaaactggagatggacttcgacttctgtgaggggaccacggtggtagtcaccgaggactgcgggaatcggggtccctccctcagaaccactacggcgagcgggaagctgatcaccgagtggtgctgccggtcctgcaccctgccacccctccggtaccggggcgaggacgggtgctggtacgggatggagatccgccccctgaaggaaaaggaggagaacctggtgaacagcctggtgaccgccgggcacggtcagatcgacaacttctccctgggtgtccttgggatggccctcttcctggaagaaatgctacggacgagggtaggcaccaaacacgccatgctcctggtggccgtcagcttcgtgaccctcatcaccgggaacatgtcctttcgggatttaggccgagtaatggtcatggtgggggccacgatgaccgacgacataggcatgggcatcacctacctcgccctgctggcagcgttcaaggtccgccccacattcgccgccgggctgctactgcggaagctgacgagcaaggagctgatgatggctaccatcggcatcgcgctcctgtctcagtctaccatccccgagaccatcttggagctcacggacgccctggccctggggatgatggtcctcaagatcgtgcgcaacatggaaaagtaccagctggccgttaccattatggcgatcagctgcgtcccgaacgccgtgatcctgcagaacgcctggaaggtgagctgcaccattctcgccgccgtctccgtgagccccctgctgcttacctcctcgcagcagaaggcggactggatccccttagccctgactatcaagggcctcaaccccacagccatcttcctgaccactctgagccggacgagcaagaagcgctcctggcctctcaacgaggcaatcatggccgtcggcatggtgtcgatcctggcgagctccctgctcaagaacgacatacccatgaccgggcccctagttgccggcggtctgctcactgtctgctacgtgcttaccggccggagcgccgacctggagctcgagcgtgccgccgatgtgaagtgggaagaccaagctgagatctccgggtcgtcccccatcctgagcatcacgatctccgaagacggcagcatgagcatcaaaaacgaggaggaggagcagaccctgaccatcctcatccgtacaggcctgctggtcattagcggcgtgttcccggtatccattcccatcacggccgccgcctggtacctctgggaggtgaagaagcagcgcgccggcgtgctttgggacgttccgtcgccgccacccgtcgggaaggcggagctggaggacggcgcctatcggatcaagcagagggggatcctcggctattcccaaatcggcgccggtgtgtacaaggagggtaccttccacaccatgtggcacgtgacccgcggggcggttcttatgcaccgcggcaagcggatcgagcccagctgggcagacgtgaagaaggacctgatctcgtacggggggggctggaagttagagggggagtggaaggagggcgaggaggtgcaggtcctggcactggagcccgggaagaacccccgcgccgtgcagacgaagcccggcctgttcaagaccaacacgggtacaattggcgctgtgagcctggacttcagtcccggtaccagtggctccccgatcgtcgaccggaagggtaaggtggtgggactttacggcaacggcgtcgtgacgcgcagcggcgcctatgtaagcgcgatcgcgcaaacggagaagtccatagaagacaaccccgaaatcgaggatgacatcttccgaaagaagcgcctcaccatcatggacctacaccccggcgccgggaagaccaagcggtatttgcccgccatcgtccgcgaggccatcaagcggggtctgcgcacgctcatattggcgccgaccagggtggtcgcggccgagatggaagaggccctgcgggggttgcccatccgctatcagactcccgccattcgggcggagcacaccggccgcgagatcgtagatctgatgtgccacgcaacgttcacgatgagactgcttagccctgtgagggtgccgaactacaacctgatcatcatggacgaggcccacttcaccgaccccgcctccatcgccgcgcgcggctacatctctacccgcgtggaaatgggggaagccgccggaattttcatgacggccactccacccggatccagagacccgttcccccagtcgaacgcgccaataatggacgaggagagagagatccccgagcggtcctggaactcggggcacgagtgggtgaccgacttcaaggggaagaccgtgtggttcgtcccatccatcaaggccggcaacgacattgcggcctgcctgcgcaagaacggcaagaaggtcatccaactgagccggaagacgttcgactccgagtacgtcaagaccagagccaacgattgggactttgtcgtgactacggacatctcagagatgggggcgaacttcaaggcggagcgggttatcgacccccgccggtgcatgaagcccgtcatcctgacggacggcgaggaacgcgttatcctggcaggacccatgccggtgacccactccagcgccgctcagcggcgcggccgaatcgggcgaaaccccaagaacgagaacgaccagtacatatacatgggcgagcccctcgagaacgacgaagactgcgcccattggaaggaggccaagatgctgctggacaacatcaacacccccgaggggattatcccgtcgatgttcgagcccgagcgagagaaggtcgacgccattgacggggagtaccggctccgcggcgaggcccggaagaccttcgtcgacctgatgcgccgcggggacctgccggtctggctagcctaccgcgtcgcggccgaggggatcaattacgctgaccggcgctggtgcttcgacgggatcaagaacaaccagatcctggaggagaacgtggaggtggaaatctggacgaaggaaggggagcggaaaaagctgaagccgcgctggttggacgcccggatctacagcgaccctctggcgctgaaggaatttaaagagttcgccgccggccgcaagtcccttaccctcaacctgatcaccgagatggggcgtctccccaccttcatgacgcagaaagcccgcgacgcgctggacaatctggcggtcttacataccgccgaggccggcgggcgggcctacaaccacgccctgagcgaattacccgagactctcgaaactctacttctcctgacgctcctcgcgaccgtgaccggcggcatcttcctgttcctgatgtctgggaagggcatcggtaagatgaccctcggcatgtgctgcatcataacggccagcatcctgctgtggtacgcgcagatccaaccgcactggatcgcggccagcatcatacttgagttcttcctcatcgtcctgctcatccccgagcccgaaaagcaacgtacaccccaggacaaccagctgacatacgtcgtgatcgcgatcctcaccgtcgtggccgccacgatggccaacgagatggggttcctcgagaagacgaagaaggatctcggcttaggctccatcgccacccaggagagcgagtccaacatcctcgacatcgacctgcggccggctagcgcctggaccctatacgccgtagccaccacgttcgtcacacccatgctgaggcactcaatagagaacagctccgtgaacgtaagcctgaccgcgatcgccaaccaggccacggtcttaatggggctcggcaagggatggcccctgagtaaaatggacatcggcgtgcctctgctcgccatcggttgctacagccaggtgaacccgataacgctgaccgccgcgctgctacttctggtcgcccactacgcgatcatcggccccggcttgcaggccaaggcgacccgagaggcgcagaaacgcgccgccgcggggatcatgaagaatcccaccgtggacggcataacggtgattgacctcgaacccatcccctacgaccccaagttcgagaagcagctggggcaggtcatgctcctgatcctttgcgtgacccaggtgctcatgatgcgaacgacctgggcattgtgcgaagcgctgacattggccaccggccccatttccaccctgtgggaggggaacccgggccggttctggaacaccacgatcgccgtcagcatggccaacatcttccgcggctcctatctcgcgggagcaggtctcctgttctcgatcatgaagaataccaccaacacccggagagggacgggcaacatcggcgagaccctgggggagaagtggaagtcccgcctaaacgcgctgggcaagagcgagttccagatctacaaaaaatccgggatccaggaggtggaccgcaccctggccaaggagggcattaagcgcggggagacggaccaccacgccgtgtccagaggctccgcgaagctccggtggttcgtcgagcgcaacatggtcacgccggagggcaaggtggtagatctggggtgcggccgcggcgggtggagttactactgcggcgggctgaaaaatgtgcgcgaggtaaagggattaaccaagggcgggcccgggcacgaagagcccatccccatgagcacctacggctggaacctggtgcggctgcagtccggggtggacgtgttcttcaccccgcccgagaagtgcgacacgctattatgcgacatcggcgagtcctcccccaaccccacaatcgaagccggccgcaccctgcgggtcctcaacctggtcgagaattggcttaataacgatacccaattctgcatcaaagtgctcaacccgtacatgcccagcgtgatcgagaagatggagacgctgcagaggaagtacggtggagccatcgtgcggaacccactgtcgcgcaactcgacccacgagatgtactgggtgtccaacgctaccgggaacatagttagctccgtgaacatgatcagccggatgctgataaaccgctttaccatgaagcacaagaaggccacctacgaaccggatgtggaccttggctccgggacacgcaacatcggtatcgagagcgagatccccaacttggacatcatcgggaagcggatcgaaaagataaagcaggagcacgagacctcgtggcactacgaccaggatcacccctacaagacctgggcataccacggaagctacgagaccaagcagacgggctcggccagctccatggtcaacggagtcgtgcgcctgctcaccaagccctgggacgtcgtaccgatggtgacccaaatggccatgaccgacacgacccccttcggtcagcagcgggtcttcaaggaaaaagtggacacccgcacccaggagcccaaggagggcactaaaaagctgatgaagatcaccgccgagtggctgtggaaggagctcgggaagaaaaaaacgccccggatgtgcacacgcgaggagttcacgcgaaaggtgcgcagcaacgccgcgttaggagccattttcaccgacgagaacaagtggaagtccgcccgggaggccgtcgaggatagccgcttctgggagctgatcgacagagagcgtaacctccacctggagggaaagtgtgagacctgcgtgtacaacatgatgggcaagcgagagaagaagctcggggagttcggcaaggcgaagggcagccgtgcaatctggtatatgtggctcggggcacgtttcctggaattcgaggccttaggcttcctcaacgaggaccactggttctcccgcgggaatagcctgtcgggagtggaaggagagggcttgcaccggctcggctacatcttgcgggacgtctctaagaaggagggcggagccatgtacgcggacgacaccgctggatgggacactcggatcaccctggaggacctcaagaacgaagagatggtgaccaaccacatgaagggtgagcacaagaagctcgccgaggccatcttcaagttaacctaccagaacaaggtcgtgcgcgttcagagaccgacgccgcgtgggaccgtcatggacatcatctcccgtcgggatcagcgcggcagcggccaggtcgggacctacggactcaacaccttcacgaatatggaggcgcagctgatccggcagatggagggggaaggcatcttcaagtccatccagcatctgaccgtgaccgaggagatagcggtccagaactggctcgcccgcgttggccgggagaggctgagccggatggccatctccggggacgactgcgtggtcaagccgctggacgaccgcttcgcgagcgccctcaccgcgctgaacgacatgggcaaggtacggaaggacatccagcagtgggagccatcgcgcggctggaacgactggacccaggtcccgttctgcagccaccactttcacgagctggtcatgaaggacggacgggtgctcgtggtcccctgccgcaaccaggacgaattgatcgggcgggcccgcatctcccagggcgccggatggagcctcaaggagaccgcctgcctcgggaagtcctatgcacagatgtggacgttgatgtacttccaccggcgcgacctgcggctcgcggctaacgccatctgcagcgccgtgccctctcactgggtacccaccagtcgtacgacctggagcatccacgccaagcatgaatggatgaccacagaggacatgctgaccgtctggaacagagtttggatccaggagaacccgtggatggaggacaaaacccccgtggagagttgggaggaggtaccctacctggggaaacgcgaggaccagtggtgcgggagcctgatcggcctgacctctcgcgccacttgggccaagaacatccagacagccataaaccaagtgagaagcctgatcgggaacgaggagtacacagactacatgccctccatgaaacgctttcggcgcgaggaggaggaggccggcgtcctctggtag

SEQ ID NO: 25558 - RNA, 9876 nt, synthetic construct
  misc_feature 1..9876: note = derived and/or modified CDS sequence (opt11) from DENV-2__GQ398287__SS-prME
  source 1..9876: mol_type = other RNA
actgctggtgtgatcatcatgctgatccccaccgccatggccttccacctcactacccgcaacggggagccgcacatgatcgtcggccggcaggaaaaggggaagtccctcttattcaagaccgaggacggcgttaacatgtgcaccctcatggccatcgacctgggtgagctgtgcgaggacaccataacatacaaatgtcccctcctgcgccagaacgagccagaggacattgactgctggtgcaactcaacaagcacctgggtgacctacgggacgtgcaccaccacgggcgagcaccggcgcgagaagcggtctgtcgcactggtaccccacgtggggatggggctcgaaacccgcaccgaaacttggatgagctccgagggggcctggaagcacgtccagcgaatcgagacctggatcctgcgccacccgggcttcgcaatcatggcggccattctggcctacaccatcgggaccacccacttccagagggcccttatcttcatcctgctgacggcggtggcccccagcatgaccatgcgctgtatcggcatctccaacagagacttcgtggagggcgtctccggtgggagttgggtggacatcgtgctggaacacgggagctgtgtcaccaccatggccaagaacaagcccacgctggacttcgagctcatcaaaaccgaggccaagcagcccgcgaccttgcgcaaatactgcatcgaggcgaaactgaccaacaccaccaccgagtcacggtgccccacgcagggcgagcctagcctcaacgaggaacaagataaacgtttcgtgtgtaagcattccatggtggaccggggctggggtaacggctgcggcctgtttggcaagggcgggatcgtcacgtgcgccatgtttacctgcaagaagaacatggagggcaaggtggtgttacccgagaacctggagtataccatcgtcattacgccccacagcggggaggagcacgctgtgggcaacgacacagggaagcacggcaaggagatcaagatcacccctcagtccagcatcaccgaggccgaactcactgggtatggcactgtgacgatggagtgcagcccccgcaccggcctcgactttaatgagatggtactgctccagatggaggacaaggcctggcttgtccaccggcagtggttcctggacttaccgctgccctggctgccgggcgcggacacccagggcagcaactggatccaaaaggaaacgctcgtgacgttcaaaaacccacatgctaagaagcaggacgtcgtggtactggggtcccaggagggcgccatgcacacggccttgacaggggccaccgagatccagatgagcagcggtaatctcttgttcacgggacacctgaagtgccgcctacgaatggacaagctgcagctgaaggggatgtcctacagcatgtgtacaggcaagttcaagatagtgaaagagatcgcggagacgcagcatggcaccatcgtaatccgcgtgcagtacgagggtgacggctccccgtgcaagatccccttcgagataatggaccttgagaaaaggcacgtgctggggcgcttgatcacggtcaaccctatcgtcaccgagaaggacagccccgtaaacatcgaggccgagccgcccttcggcgactcctacatcatcatcggagtagagccggggcagctcaagctgaactggttcaagaaggggagctccatcggccagatgttcgaaaccacgatgcgcggcgccaagcggatggccatcctgggggacacggcatgggacttcggcagcctagggggcgttttcacctccatcggaaaggcactgcaccaagtgttcggcgcaatctacggcgccgcttttagcggggtgtcctggaccatgaagatcctgattggcgtaatcatcacttggatcgggatgaatagtcgttccacctctctgtccgtgagcttggtgctggtaggcgtagtgaccttatacctaggggcgatggtccaggccgactccggctgcgtagtgagctggaagtccaaggagctgaagtgcggcagcgggatcttcatcaccgacaacgtccacacctggacggaacagtataagttccagccagaatctccctccaaactggccagcgctatccagaaggcacacgaggaagggatctgcggtatccggtccgttacccgcctcgagaacctgatgtggaaacagatcacccccgagctgaaccatatcctcagcgagaacgaggtgaagctgaccataatgacgggcgacataaaggggataatgcaggcggggaagaggtccctgcgtccgcagcctaccgagctcaagtacagctggaagacatggggcaaagccaagatgctgagtaccgagagccacaaccagacgttcctgatcgacggacccgagaccgccgaatgcccgaacaccaaccgggcttggaactccctggaagtcgaggactacggtttcggcgtgtttaccacgaacatatggctgaagctgcgcgaaaagcaagacgtgttctgcgacagcaaactaatgtccgccgctatcaaggacaatcgggcagtccacgccgacatgggctactggatagaaagcgccttgaacgatacctggaagatggagaaggccagcttcattgaggtcaagagctgccactggcccaagtcgcacacactatggagcaacggtgtgctcgaaagtgaaatgattatccccaagaacctggccgggcccgtgagccagcacaactaccgcccgggctaccacacccagaccgcagggccctggcatctggggaaactcgagatggacttcgacttctgcgaggggacgacagtggtagtcaccgaggactgcggaaaccggggacccagcctgcgcaccacgaccgcgtccggaaagctaatcaccgagtggtgctgcagaagctgcactctaccacccctgaggtaccggggcgaggacgggtgttggtatggcatggagatccgccccttaaaggagaaggaagagaacctcgtgaactccctggtgacggccggccacggtcagatagacaacttctcgttgggagtcttaggaatggcactcttcctggaggagatgcttcggacccgcgtgggcaccaagcacgccatcttgctgatcgcagtatcctttgtcaccctcatcacggggaacatgagcttccgtgacctgggccgcgtgatggtcatggtcggggccacgatgaccgacgacatcggcatgggcgtgacctacctggccctcctggcggccttcaaggtgcgccccacgttcgccgctgggctgctcttgcggaagctcacatccaaggagttaatgatggcaaccataggaatcgcgctgctgagccagtccacaatcccggagacgatattggagctaacagacgcccttgccctcggcatgatggtcctgaagatcgttagaaacatggagaagtaccagctggctgtgaccatcatggctatcagctgcgtacccaacgcggtgatcctccaaaacgcctggaaggtgtcctgtactatcctggccgcggtcagcgtgagcccactgctcctgacgagctcccagcagaaggcagactggatccccctggcactcaccatcaaaggcttaaaccccacagctatcttcctgaccacgctctcgcggacctccaagaaaaggagctggccgctgaacgaggctatcatggccgtcggcatggtttccatcctggcaagctccctccttaagaacgacatccctatgaccgggcccctggtggccggcgggctgttgaccgtgtgctacgtactgacgggacggtccgctgacctcgagctagagcgcgccgcagacgtgaagtgggaagaccaggcggagatcagtgggtctagccccatcctgtccatcaccattagcgaggacggctccatgtcgatcaagaatgaggaggaggagcaaaccctaactatactgatccggacgggcttgctcgtcatctccggggtgttcccggtatccatccccatcactgccgccgcctggtacctgtgggaggtcaagaagcagagagccggcgtcctgtgggacgtgcccagcccgccgcccgtcgagaaggcagagctcgaggacggggcctaccggatcaagcagcgcggaatcctgggatacagccagatcggagccggcgtgtacaaggaggggaccttccacaccatgtggcacgtgaccaggggcgccgtcctgatgcaccgagggaagcgcatcgagccgtcctgggccgatgtgaagaaggacctcatctcctacggcggtggctggaagctggagggtgagtggaaagagggtgaggaggtgcaggtcctggcgctcgagcccggcaagaacccccgcgcggtccagacgaagcccgggctgttcaagaccaacaccggcaccataggggccgtgtccctggacttcagccccggcacgagtggcagccccatagtcgaccggaaggggaaggtggtgggcctctacgggaacggtgtcgtgacccgctccggcgcctacgtgagcgcgatcgcccagaccgaaaagagcatcgaggacaaccccgagatcgaggatgacattttccggaagaaacgcctgaccatcatggacctccaccccggcgccggcaagaccaaacggtacctgccagccatcgttcgcgaggccatcaagcgggggcttcgcaccctgatcctggcgccgacccgcgtggtggcagcggagatggaggaggccctccgcggtctacccataagataccagacccccgccatcagggctgagcacacgggtcgcgaaatcgtcgacctgatgtgccacgccaccttcaccatgcggcttctgagccctgtgcgtgtgccgaactacaaccttatcatcatggacgaggcgcacttcaccgaccccgccagcatcgcagcccgcggctacatttcgacgcgcgtggagatgggcgaggccgctgggatcttcatgaccgccacgccgccgggcagccgggatccgttcccccagtccaacgcacctattatggacgaggagcgcgagatccctgagcggagctggaactccggacatgagtgggtgaccgacttcaagggcaagacggtgtggttcgtcccgagcatcaaggccgggaacgacatcgccgcctgcttgcggaagaacggcaagaaggtgatccagctgtcccggaagaccttcgacagcgagtatgtgaaaactagggccaatgactgggacttcgtcgtgaccacggacatctccgagatgggcgcgaacttcaaggccgagcgggtgatcgatccccggcggtgcatgaagcccgtcatcctgaccgatggtgaggaacgcgtgatcctcgcaggccccatgccggtgacccacagctccgccgcccaacggcgcggcaggatcggccggaaccccaaaaatgagaacgaccagtacatatacatgggcgagcccctggaaaacgacgaagattgcgcgcactggaaggaggctaaaatgctgctcgacaatatcaacacccccgagggcatcatcccgagcctgttcgaaccggagcgcgagaaggtcgacgccatcgacggagaataccgtctcagaggggaggcccggaagacgttcgtggacctcatgcgaagaggcgacctccccgtatggctggcataccgcgtcgcggccgaggggattaactacgcggaccggagatggtgctttgacggcatcaagaacaatcagatcctcgaggagaacgttgaggtggaaatctggaccaaggagggggagcggaagaagctgaagccccgctggctagatgcgcggatctactccgacccgttagcgctaaaggagttcaaggagttcgccgcaggccgcaagtcgctgaccctcaacctgatcaccgagatgggacggctgcccacgttcatgacccagaaagcccgcgacgccctcgacaacctggcggtcctgcataccgcggaggccgggggtagagcctacaaccatgccctatccgagctgccagaaaccctggagacgctcctactgctcaccctgctggcgaccgtgaccgggggtatcttcctcttcctgatgagcggccgcgggattggtaagatgacgcttgggatgtgctgcatcatcaccgcctcaatactcttgtggtacgcccagatccagccgcactggatcgccgccagcatcatccttgagttcttcctcatcgtcctgctgattccagagcccgagaagcagcgtacgccccaggacaaccagctcacctacgtggtgatcgcgatcctgaccgttgtggccgctacaatggccaacgaaatgggattcctggagaaaaccaagaaggacctggggctgggcagcatcaccacccaggaaagcgaaagcaacatcctggacatagacctccgcccggcctcagcgtggacgctttacgccgtggccaccaccttcgtcaccccaatgctgcggcacagcattgagaactccagcgtcaacgtctccctcacggccatcgcgaatcaagccaccgtcctgatgggcctggggaaaggctggcccctcagcaagatggacattggggtgcccctcctagctatcggctgctattcccaggtgaacccaatcaccctcacagccgccctgctgctcctggtcgcacactacgccatcatagggcccgggcttcaggctaaggccacgagagaagcccagaagcgcgcggccgctggcatcatgaaaaaccccacagtggatgggatcaccgtgatcgacctcgagcccatcccgtacgaccccaaattcgagaagcagctgggccaggtcatgctgctcatcctatgtgtgacacaggtgctgatgatgcggaccacgtgggcgctctgtgaggccttaaccctggctaccgggcccatcagcacgctgtgggagggcaaccccgggcgcttctggaacaccaccattgccgtctccatggccaacatcttccgtggcagctatttggctggcgcaggcctcctcttcagtatcatgaagaataccacgaacacacgccggggcaccgggaacatcggggagaccctgggcgagaaatggaagtccaggctcaacgccctaggaaagagcgagttccagatctacaaaaagtccggtatacaggaagtggacagaacgttggccaaggaggggataaagcgcggggagacagatcaccacgcagtgtcccggggtagcgccaaactgcgctggttcgttgagcggaacatggtgacccccgagggcaaggtggtcgatctcggttgtggtcgaggcggttggtcctattactgtggcgggctgaaaaacgtgcgggaggtcaagggtttgaccaagggcgggcccggacacgaagaacccatccccatgagcacgtacggttggaacctcgtccgcctgcagagcggtgtggacgttttctttacaccacctgaaaagtgtgacaccgtcttgtgcgacatcggggagtccagtcctaatcccaccatcgaggcgggccggacgctccgagtgctgaacctggtggagaactggctcaataacaacactcagttctgcatcaaggtcctaaacccgtacatgccgtctgtgatcgagaagatggaaaccttgcagcggaaatatggcggggctctggtgcgcaaccccttaagccgcaactccacgcacgaaatgtactgggtctcaaacgccaccggcaacatcgtgtccagcgtgaacatgatctcgcgcatgctgattaatcgcttcacgatgaagcacaaaaaggccacctacgagccggacgtcgacttgggatcaggcaccagaaacatcggcattgagtccgagatcccaaacctcgatatcatcgggaagcgtatcgagaagattaagcaggagcacgagaccagctggcattacgaccaggatcacccctacaagacgtgggcgtaccacggctcctacgagaccaagcagaccggcagcgcgtccagcatggttaatggcgtggtccggctcctgaccaagccctgggacgttgtgcctatggtcacgcagatggccatgaccgataccacccccttcgggcagcagcgcgtgttcaaggagaaggtggacacacggacccaggagcccaaggagggcaccaaaaagctcatgaagatcaccgccgagtggctatggaaggagttaggcaaaaagaagacgcctcgcatgtgcactagggaggagttcaccagaaaggtccgctccaacgccgccctcggggcgatcttcaccgacgagaataagtggaagtccgcccgcgaggctgtcgaggactcacggttctgggagctgattgatcgagagcggaacctgcacctcgagggcaagtgcgagacgtgcgtgtacaacatgatggggaagcgcgagaagaagctgggcgagttcgggaaggcaaaggggagccgagccatctggtacatgtggctgggcgcccgcttcctcgagttcgaggcactggggttcctgaacgaggaccactggttcagccggcgcaacagtctcagcggcgtcgagggcgagggcctgcacaggctggggtacatcctccgcgacgtatcgaagaaggaaggtggcgccatgtacgctgacgatacagccgggtgggacacccggataacccttgaggacctgaagaacgaggagatggtcacgaaccacatgaagggcgagcacaagaagctcgctgaggccatcttcaagctgacctatcagaacaaggtggtgcgtgtccagcgcccgacaccccggggcaccgtaatggacatcatctcacgccgggaccagcgcggttccggccaggtgggcacctatggcctcaacaccttcaccaacatggaggcccagctcattcggcagatggaaggagagggcattttcaagagcatccagcacctgacggtcacggaggagatcgccgtgcaaaactggctggcgcgggtggggcgggaacgcctctcccggatggccatttcaggcgatgactgcgtcgtgaagcctttagacgaccgctttgcctccgccctgaccgccctcaacgacatgggcaaggtgcggaaggacatccaacagtgggagccgagccgcgggtggaacgactggacacaggtcccgttctgctcacaccatttccatgagcttgtgatgaaagacggccgggtgctggtcgtgccctgccgcaaccaggacgagctcatcgggcgggcgcgcatctcccagggcgccgggtggtccctgaaagagaccgcctgcctgggaaagagctacgcccagatgtggaccctcatgtatttccaccggcgcgacctgaggctggccgcgaacgcaatctgcagtgcggtgcccagccactgggtcccaacctcccgcaccacgtggagcatccacgcaaagcacgagtggatgaccacggaagacatgctcgcggtttggaacagggtgtggatccaggaaaacccgtggatggaggacaagacccccgtcgagagctgggaggaagtgccctatctgggcaagcgggaggaccagtggtgcgggtcgttaataggcctcaccagccgcgcaacctgggccaagaacatccagacggccatcaaccaggtgcggtccctgatcgggaacgaggaatataccgactacatgcccagcatgaagagattccggcgcgaggaggaggaggccggcgtactgtggtga

SEQ ID NO: 25559 - RNA, 9876 nt, synthetic construct
  misc_feature 1..9876: note = derived and/or modified CDS sequence (opt11) from DENV-2__GQ398302__SS-prME
  source 1..9876: mol_type = other RNA
accgcaggggttattatcatgctgatccccaccgccatggccttccacctcaccaccagaaacggagagccccacatgatcgtctctaggcaggagaagggcaagtctctgttgttcaaaactgaggatggtgtcaatatgtgcaccctgatggccatagatctgggagagctatgcgaggacaccatcacctacaaatgtcccctcctgcgccagaacgagcctgaggacatcgactgctggtgcaatagtacttccacctgggtgacgtatggaacctgcaccaccaccggcgaacaccgccgcgagaagcgctccgtagccctggtgccacacgtgggcatggggctcgagacccgcaccgagacctggatgagcagcgaaggagcctggaagcacgtccagcgtatcgaaacctggatcctacgccaccctgggttcacaattatggccgcaatattggcatacacaatcgggacaacgcactttcagcgggccctcatattcatacttctaaccgcggtggcgccgtcgatgaccatgcgctgcatagggattagcaaccgggacttcgtggagggcgtcagcggaggcagctgggtggacattgtcttagaacacggttcatgtgtcaccacgatggcaaagaacaaaccaaccctcgacttcgagctaatcaagaccgaagccaagcagccagccaccctccgcaagtactgcattgaagccaagctgacaaacactaccaccgagagccggtgcccgactcagggggagccctccctgaacgaggagcaggacaagcgcttcgtgtgcaaacactctatggtcgatcgggggtgggggaacggatgcggcctattcggaaagggcggtattgtgacctgcgcgatgttcacgtgcaagaaaaatatggaagggaaagtggtgctccccgagaacctggagtacacgatagtcatcacgccccactccggtgaagaacacgccgtggggaacgacaccgggaaacacgggaaagagatcaagatcacgccgcagtcatccatcaccgaggcggagctcactggctacggcacagtcacaatggagtgttccccaagaaccggcttggattttaacgaaatggtgttactgcagatggaagacaaggcctggctcgtgcatcggcagtggttcttagacctccccctgccctggctgccgggcgctgatacacaggggagtaactggatccagaaggaaacgctcgtaacctttaaaaacccccacgcgaagaagcaggatgtagtggtactgggatcacaagagggggccatgcatacagcgctgaccggcgctacggagatccaaatgagctccggcaatctgcttttcactggtcacctgaagtgccgcctccggatggataagctccaactgaagggcatgtcgtactccatgtgcacggggaagttcaagatcgtaaaagagattgccgagacccagcacggtactattgtgatccgagtccagtacgagggggatggtagtccttgtaagatcccattcgagatcatggacttagagaagcggcatgtgctgggccgcctaatcaccgtaaatcccatcgttgctgagaaggattcacccgttaatatcgaagccgaaccaccatttggtgacagctatattatcattggggtggagccgggtcagcttaagctgaactggttcaagaagggctcaagcatcgggcaaatgttcgagaccacgatgcgcggcgccaagcgcatggccatcctgggcgacacggcgtgggatttcggttccttaggcggggtctttacttcgataggcaaggcgctccaccaggtgttcggtgccatctatggcgccgctttctccggcgttagctggactatgaaaatactgatcggggtaataattacctggataggaatgaactcccggagcacgtccttatctgtgtccctcgtgctggttggagtggtaaccctgtacctcggcgcgatggtccaggccgactcaggttgcgtagtatcctggaagtccaaggaactcaagtgcggtagcggcatcttcatcaccgataatgtccacacgtggacggaacaatacaagttccagcccgagtcccccagtaagctggctagcgccatccagaaagcccacgaggaggggatatgcgggatccggagcgtgacccgcttagagaacttgatgtggaaacagataacacccgagctgaaccacatcctcagtgagaacgaggtcaaactgacaatcatgacaggtgacataaagggaatcatgcaagctgggaaacggtctctgcgccctcagcccaccgagctcaagtactcctggaaaacgtggggaaaggccaagatgctgagcaccgaatcacacaatcagacgtttctgatcgacggccccgagaccgctgaatgcccgaacaccaaccgggcttggaacagccttgaggtggaggactacggtttcggcgtgttcaccacgaacatatggctgaaacttcgcgaaaagcaggatgtgttctgcgattccaagctgatgtcggccgcaataaaggacaaccgggccgtccacgccgatatggggtactggatagagtccgccctcaacgacacatggaagatggaaaaggcgagcttcatcgaggttaaaagttgtcattggcccaaaagccacaccctgtggtccaatggtgtgcttgagagcgagatgattatccccaaaaacttcgctggtcccgtctcacagcacaattacaggccgggctaccacacccagaccgcgggcccctggcacctcgggaagctggaaatggactttgatttctgtgagggcacgaccgtggtagtcaccgaggactgcgggaatagaggcccctccttgaggaccacgaccgccagcggcaagctgatcacggagtggtgctgccggtcctgtaccctgccccctctccgctaccgcggggaggacggatgctggtacgggatggaaattcgcccactgaaggagaaggaggaaaatctggtgaacagccttgtgacggctggacatgggcagatcgacaacttttccctgggcgtcttaggcatggccctcttccttgaggagatgctgcgaacccgcgtaggtaccaagcacgccatgctgctggttgccgtcagctttgtgaccttgatcacgggcaacatgtccttccgggatctgggccgcgtgatggtcatggtgggcgctacaatgaccgacgatatcgggatgggcataacctacctggccctgctcgcggcattcaaggtccgccctacgttcgcggcgggtttgctgctacgaaaactgaccagcaaggaactgatgatggctaccatcgggattgcgctcctttcccagagcacaatacccgagacaatcctggagctcacagatgctctggcgctgggcatgatggtattgaagatcgtgcgcaatatggagaagtaccagctggctgtgacgatcatggccatttcctgtgtacctaacgcggtgattctgcagaatgcctggaaggtctcctgcacgatcctcgcggccgtcagtgtcagccccctgctgctcacctccagccagcagaaggcggattggatcccgctggctttaacgatcaaggggctgaatccaaccgctatcttcctaaccacgctctccagaaccagtaagaagcgctcctggccgctcaacgaggctatcatggccgtcggcatggtgagcattctggcgagctcccttctcaagaatgacatcccaatgactgggccgctggtggccggaggcctactcacagtctgctacgtgctgacggggcggtcggccgacctggagctcgaacgcgctgccgacgttaagtgggaagaccaggcggagatctcgggcagctctcccatcctgagcatcacaatctccgaggatggaagcatgtccatcaagaacgaagaggaggagcagacgctaacaattttgatacgtacgggtctgctggtcatcagcggtgtcttcccggtgtccatccctattacggcggcggcgtggtacctctgggaggtgaaaaagcagcgcgccggagtgctgtgggacgtacccagcccaccgcccgtcggaaaagcagagctggaggacggagcctatcggattaagcagcgcggtatcctcggctacagccagattggcgctggcgtatacaaggaggggactttccacaccatgtggcacgttaccagaggggcagtcctgatgcaccgtgggaagcggattgagcccagctgggccgacgtgaaaaaggacctgatctcctatggcgggggatggaagttagagggcgaatggaaggagggagaagaagtacaagtcctggcgctagaacccggtaaaaaccctcgcgccgttcagacgaagcccgggctgttcaagacgaatacaggaacaatcggtgccgtgagcctggacttttctccagggacgagcggctcaccaatcgtcgatcggaaaggtaaggtggtgggcctatacggaaacggcgttgtgacccggagcggcgcctatgttagcgctatcgcacagactgagaagtccatcgaggacaatcccgagattgaagacgacatctttcggaagaagcgcctcacgatcatggacttgcacccaggagccggtaaaacgaagcggtacttgcccgcaatcgtgcgcgaagcaattaagcgcgggctgcgcaccctaatcctggcgcctacccgcgtggttgccgccgagatggaggaggcgctgcggggactccccatacgataccagacgcccgctatccgggcagagcacacggggcgcgagatcgtagatcttatgtgccatgctacattcacaatgcggctactatcacccgtgagggtgccaaactataacctgatcataatggatgaggcacacttcaccgaccccgcgtctatcgcagcgaggggctatatcagcacccgcgtcgaaatgggcgaggcagccgggattttcatgacagcgacgcctccaggatcccgggacccgttcccccagagcaatgcgcccatcatggacgaggagcgagagatcccagaacgtagctggaactcggggcacgaatgggtaacagatttcaagggaaaaacggtgtggtttgttccgtcgatcaaggctgggaacgacatcgcggcctgcctgcgcaagaacggcaaaaaggtgatacagctgagccgaaagactttcgactccgagtacgtgaaaactcgagccaacgactgggactttgttgttacaaccgacatctctgagatgggtgcgaacttcaaggccgagagagtaatcgacccccgtcggtgcatgaagcccgtcatcctgacagacggggaggaacgggtaatcttggccggccccatgccagtgacccattccagcgcagcccagcggagagggcgaatcggcagaaaccctaagaatgaaaacgaccagtacatctacatgggggagcccttggagaacgacgaagactgtgcgcactggaaggaagcaaagatgctactagacaacatcaacacccccgaaggaataattccgtcgatgttcgaacctgagcgcgagaaggtggacgcgatcgacggcgagtataggttacgcggagaagcccgaaagacttttgttgacctgatgcgccggggtgacctacccgtttggctcgcctaccgcgtcgcggccgaaggtatcaactatgccgacagacgctggtgcttcgacggcatcaagaacaaccagatcctggaagagaatgtggaagtggagatttggacaaaagagggggagcggaagaaacttaagccgcgatggctcgacgcccggatctatagcgatccgctggcgttgaaggagttcaaggagtttgcagccggtcgcaagtccctcaccctcaacctgattaccgagatgggacggctaccaacgtttatgacccagaaggcccgagacgcgttggacaaccttgcagtcctgcacaccgccgaggccgggggtcgggcctacaaccacgcgctgagcgagctgcccgagaccctggaaacgctactgctcctgacattgctcgcgacagtaaccggcgggatcttcctattccttatgtccggcaaggggatcggcaaaatgacgctcggaatgtgctgcatcataaccgcatcaatcctcctgtggtatgcccagattcagccgcattggatcgcagccagtatcatactcgaatttttcctaatcgttctgctcatcccggaacccgaaaaacagcgcactccacaggataaccaattaacatacgtggtgatcgcaatcttaaccgtcgttgcggccacgatggccaacgagatggggttcctcgagaagaccaaaaaggatctagggctcggctccatcgctacccaagagtcagaatccaacatcctcgacatcgacttgaggccggccagcgcctggaccctctacgccgtggcgacgaccttcgtcacacccatgttgcggcactcaatcgaaaatagctccgtgaacgtgtctttgaccgcgatcgcaaaccaggcgacagtactgatgggcctcggaaagggctggccactttccaagatggacatcggtgtgcccttattggccatcggctgctacagccaggtgaacccgataactctaacggccgctctgcttcttctcgttgcccactatgccatcatagggcccggcctccaggcaaaagccaccagggaggcacaaaagcgggcggccgccggcatcatgaagaaccccacggtggacgggataactgtcatagacctcgagccgatcccgtacgaccccaagttcgagaagcagttgggacaggtcatgctcctgatcctgtgtgtgacccaagtgctcatgatgcgcaccacgtgggctctgtgtgaggcgctgactctggcgacgggtcccatatccacactgtgggaagggaaccccgggcgcttctggaacacgaccatcgccgtcagtatggctaatatattccgcggctcctacctggccggtgctgggttactcttcagcattatgaagaacaccaccaacactcggagaggcacagggaacataggcgagacactgggcgagaaatggaagtcccggctcaacgccctaggcaagagcgagtttcagatttataagaaaagcggtatacaggaggtggaccgaacattagcgaaagagggaatcaagcggggcgagacggaccatcacgccgtgtctcgcggtagtgcgaaacttcgctggtttgtggagcggaacatggttactccagagggcaaagtggtcgacttaggctgcggaagagggggctggagctactattgcggtgggctgaagaacgtgcgcgaggtgaagggcctcaccaagggaggtcccggccacgaggagcctatcccgatgagcacctacgggtggaaccttgtccggctgcagtctggtgtcgatgtattcttcaccccacctgagaaatgcgacacactcctgtgcgatatcggggagagctccccaaaccccaccatcgaggctggccgcaccctgcgggtcctcaacctggtggagaactggctgaacaacaacacccagttttgcatcaaggtgctcaacccttatatgcccagcgtcatcgaaaagatggagacactgcaacgcaagtacgggggcgccctggttcgcaaccccctatcgcgaaacagcactcacgaaatgtattgggtgtccaacgccactgggaacatcgttagctcggtcaacatgatcagccggatgctcatcaatcgctttacaatgaagcataagaaggccacgtacgagccggacgtggatctgggatccggaactcgcaatatagggatcgagtctgaaatccccaacctggacatcatcggcaaacggatcgagaagattaagcaagagcatgagacctcctggcactacgaccaggaccatccgtacaagacgtgggcatatcacggctcatatgagacgaagcagaccggaagcgccagcagtatggtcaacggcgttgtgcgcctccttaccaagccctgggacgtggtcccgatggtgacacagatggccatgacggacaccaccccctttgggcagcagcgagtattcaaggagaaggtagacacccgtacgcaggagcccaaggagggaaccaagaaactgatgaagattaccgcggagtggctgtggaaggaactgggcaaaaagaaaacaccccggatgtgcactcgcgaggagtttacccggaaagtgcgaagtaacgccgccctgggggcaatcttcaccgacgagaacaaatggaagtccgcccgggaagccgtcgaagactcacgtttctgggagctcatcgacagggagcgcaacctgcacctcgaaggcaagtgcgagacatgcgtatacaacatgatggggaagcgggagaagaagctcggcgagttcggtaaagcgaaaggctctcgcgcgatctggtacatgtggctgggcgcccggttcttagagttcgaagccttagggtttctgaacgaggaccactggttctcccgaggcaactcactgtcgggtgtggagggcgagggactccaccgactaggctacatactgcgcgacgtatcgaagaaggagggcggagccatgtacgccgatgacactgcaggctgggacactcggatcactctcgaggacctgaagaacgaggaaatggtgaccaaccacatgaagggggagcacaaaaagttggcggaggccattttcaaactcacgtaccagaataaggtcgtccgcgtgcagcggccgactccacggggaaccgtaatggacattatctcccgacgggaccagcgggggtccggccaggtgggcacttacgggctgaatacgtttaccaatatggaggcccagttaatccgacagatggagggcgaagggatcttcaaatccatccaacacctcaccgttactgaggagatcgcggtccagaactggctagcccgcgttggccgcgagcggctgagccgtatggccatcagtggtgacgactgcgtcgtcaagcccctcgacgatcgtttcgctagcgccctcacggcacttaatgacatggggaaggtgcgcaaggacatccagcagtgggaaccgtcacgaggctggaacgattggacccaagtcccgttctgcagccaccacttccacgaactcgtcatgaaagacgggcgcgtgctcgtggtcccctgccgaaaccaggacgaactgattggacgggcccgcatatcccagggtgccggctggagcctaaaggaaacggcctgcctgggaaagtcctacgcccagatgtggaccctgatgtacttccaccggagggacctccggttggcggccaacgccatctgtagcgcagtgcccagccattgggttcctacgtctcgcaccacctggagcatccacgctaagcacgaatggatgaccacagaagacatgttagcagtctggaatagagtttggattcaggagaacccatggatggaagacaagacgcccgtggaaagttgggaggaggtgccctacctggggaagcgcgaggaccagtggtgcggcagcttaatcggcctgaccagtcgcgctacttgggcgaagaacatccagaccgctatcaaccaggtgcggtctctcatcggcaacgaggagtatacggactatatgccctccatgaagcgttttcgtcgcgaggaggaggaagcaggcgtcctgtggtga

SEQ ID NO: 25560 - RNA, 9876 nt, synthetic construct
  misc_feature 1..9876: note = derived and/or modified CDS sequence (opt11) from DENV-2__GQ398272__SS-prME
  source 1..9876: mol_type = other RNA
accgccggcgtgatcatcatgctgatcccaacggccatggcgttccacctcaccacccgcaacggagaaccccatatgatcgtgggccgccaagagaagggaaagtccctactgtttaaaaccgaggacggcgtgaacatgtgcaccctcatggctatcgacctaggagagctgtgtgaggataccattacctacaagtgccccctccttcggcaaaatgagccagaggacatcgactgctggtgcaacagcaccagcacgtgggtgacctatgggacctgtactaccaccggtgagcaccggcgagagaagagatccgtcgcccttgtgccacacgttgggatgggtttagagactcgcactgagacctggatgagctcggagggggcctggaagcacgttcagcgaatagagacctggatactgaggcatccaggcttcaccatcatggcggcgatcctggcttacaccattgggacgactcacttccaacgggctcttatatttatcctgctgacagccgtggcgcccagcatgaccatgcgctgcatcggaatctccaaccgggacttcgtggagggcgtctcagggggcagttgggtggacattgtgctagagcacgggagctgcgtcacgactatggccaagaacaagcccaccctggacttcgagctgataaagaccgaagctaagcaacccgccacgctccgaaagtactgcatagaggcaaagctaacgaacacgactaccgagtcccggtgcccgacgcagggcgagccctcattgaacgaggagcaggacaagcgcttcatatgtaagcactccatggtggaccgtggctgggggaacggctgtggtctcttcggcaagggcggcatcgtgacctgcgcgatgttcacatgcaagaagaacatggaagggaaagtcgtgctgcccgagaatctcgaatacacgatcgtgatcacgccacacagcggtgaagagcatgccgtcggcaatgacacagggaaacacggtaaggagatcaagattaccccgcagagtagcatcactgaagctgagctcacaggttatggaactgtgaccatggagtgcagcccccggacgggcctggacttcaacgagatggtgttattacagatggaagacaaggcctggctggtccacaggcagtggttcttagacctacccctgccctggttacccggggccgatacccagggctctaactggatccagaaggagacgctcgtgactttcaagaacccacacgctaaaaagcaggacgtcgtagtgctagggtcccaggaaggcgcgatgcataccgccctgaccggggcgacggagatccagatgagctcagggaacctcctgttcactggtcatctaaagtgccgcctccggatggacaagctgcagctgaaaggcatgtcttacagcatgtgcaccggcaagttcaagatcgtcaaggaaatcgcagagacccaacacggaacgattgttatccgcgtgcagtacgagggcgacggttccccgtgcaagattcccttcgaaattatggacctcgagaagcgccacgtgctgggacgcctaatcactgtgaacccgatcgtcaccgaaaaggacagcccagtcaacatcgaggcggaaccgcctttcggcgactcctacatcattatcggggtggagccaggccagctcaagttgaattggttcaagaaagggagctcaatcggccagatgttcgaaaccacgatgcgcggcgccaagcggatggctatccttggagataccgcctgggatttcgggagcctggggggcgtgttcacctcgattggtaaggccctacaccaggtcttcggcgcgatctacggcgccgcattcagcggagtaagttggacaatgaaaattctgatcggagtgataatcacgtggatcgggatgaacagccgcagtaccagcttaagcgtatccctcgtgctggtgggtgtcgtaaccctgtatctcggagtaatggtgcaggccgactccggctgcgtggttagctggaaaaacaaggagctgaagtgcggcagcggaatctttatcaccgacaacgtccatacgtggaccgagcagtacaagttccaacccgagagcccgagcaaactggcctccgccatacagaaggcccacgaggagggcatctgcggcatccggtcagtgacccgtttggagaacctaatgtggaagcaaatcacccccgaactgaaccacatcctctctgaaaacgaggtgaagctaacgatcatgaccggcgatatcaaagggataatgcaggccggcaagcgctcactgcgcccgcagcccaccgagctcaaatactcctggaagacctggggcaaggcaaagatgctgtcgacggagagccacaatcaaactttcctgatcgacgggcccgagaccgcggaatgcccgaacaccaaccgggcctggaacagcctggaggtcgaagactacgggttcggggtgttttccacgaacatctggctgaagctgcgcgagaagcaagacgtgttctgtgacagcaagctcatgtccgccgccatcaaggacaaccgagcagtccacgcggacatgggttactggatcgagtcagcccttaacgacacctggaaaatggagaaagcttccttcatcgaggttaagagctgccactggcccaagtcccacacgctatggagtaatggcgtgctcgaatccgagatgatcatccccaagaacttcgcaggtccggtgtcccagcacaactatcgccccggctaccacacccagaccgccggtccctggcacctgggcaagctggaaatggacttcgatttctgcgaggggacgaccgtggtcgtgaccgaggactgcggcaatcggggccccagcctgagaaccactaccgcatccgggaaactgatcaccgagtggtgctgccggagctgcacccttccgccactccgctaccgaggcgaggatggctgctggtacggcatggagatccgacccctgaaggaaaaggaggaaaacctggttaacagtctcgtcacggccggtcacggccaaatcgacaacttctctctgggcgttctggggatggccctcttccttgaggagatgctgcggacccgcgtgggcactaagcacgcgatcctactggtggctgtctccttcgtgaccctgatcactgggaatatgagtttccgtgacctcggacgcgtgatggtgatggtgggcgccacaatgaccgacgacatcggcatgggcgtgacctacctagccctccttgccgccttcaaggtccgtcccacgttcgcggccgggctgctgctgcggaagctcacctcgaaggagctgatgatggccaccatcggcatcgcgttactgagccagtccaccatccccgagacgatcttggagctcacagacgctctggcgctgggtatgatggtgctcaagatcgtgagaaacatggagaagtaccagctggccgtcacaatcatggccatcagctgcgttccgaacgccgtgattctgcaaaacgcatggaaggtctcatgcacgattctcgcggccgtatcggtcagcccactgctgctcacgtcatcacagcagaaggcagactggatccccctggctcttaccatcaagggcctcaaccctacggcgatcttcctgacgacgctgagccggaccagcaagaagcgcagctggccgctaaacgaggccgtgatggctgtgggcatggtttccatcctggcctcatccctcctcaaaaacgacatccccatgactgggcctctggttgcaggtgggctgttaaccgtctgctacgtcctcacgggccggtccgcggacctggagctcgagcgcgccgccgacgtgaagtgggaggaccaagccgagatcagcgggtcgagccccattctgtcgattacaatcagcgaagatggctccatgagtatcaagaacgaggaggaggagcagaccctgaccatactcatccggaccggccttctggtgatctccggggtcttcccggtcagcattcccataaccgccgcggcctggtacctctgggaggtgaagaagcagcgcgccggcgtcctgtgggacgtgcccagcccgccgcccgtggggaaggccgagttggaagacggagcttaccggatcaaacagcgcggtatcttcggctacagccagatcggcgcgggggtctacaaggaaggcacctttcacacgatgtggcacgtgacccgcggggctgttctcatgcaccgcggaaagcggatcgagccgtcctgggcggatgtcaagaaagacctaatctcttacgggggcggctggaagctggaaggagagtggaaagagggagaggaagtccaggtgctcgccctggagcccgggaagaacccgcgcgccgtccaaactaagccaggcctgttcaagaccaacaccgggaccataggtgcggtgtccctcgacttcagccccgggacgtccgggagccccatcgtagaccggaagggtaaagtcgtgggcctgtacggcaacggcgtggtcacccggtccggggcatacgtgtctgccatagcccaaaccgagaagtctatcgaggacaatccggagatcgaggacgacatctttcggaaaaagcgcctgaccattatggacctccaccccggcgcggggaaaacaaagcggtacctgccggccatcgtgcgcgaggcaatcaagaggggcttgcgcactcttattctcgccccgacccgcgtcgtcgccgccgagatggaggaggccctgcgggggctgcccatccgctaccagacccccgcgatccgggcagagcacacggggcgcgaaatcgtggacctcatgtgccacgccaccttcactatgcggctgctgtcccccgtccgcgtgcccaattacaatctgataattatggacgaggcgcacttcactgaccccgcaagcatcgccgccaggggatatatatccacgagggtggaaatgggggaggcagctggaattttcatgaccgccacgccgcccgggagccgagatccgttcccccagtccaacgcccccatcatggacgaggaaagggagatccccgagcggagctggaactccggccacgagtgggtcaccgatttcaaaggaaagacggtgtggttcgtgccgagcatcaaagccggtaacgacatcgcggcctgtctgcggaagaacggcaagaaggtcatccagctgtcccggaagaccttcgacagcgagtacgtgaagacccgtgccaacgactgggacttcgtggtcaccacagacatctcagagatgggggcaaacttccgggccgaaagagtgattgacccccgacgctgcatgaagcccgtgatcctcacggacggcgaggagagggtaatactcgctggtcccatgccagtgacacacagctcggccgcccagaggcgtggacggatcgggcgtaaccccaaaaacgagaatgatcaatatatctacatgggcgagcccctggagaacgacgaggactgcgcccactggaaagaggccaagatgctcctggacaacatcaacacccccgaaggcatcatcccgagcatgttcgaacccgagcgggagaaggtggacgcgatagacggcgagtaccgcctgcggggcgaagcccgcaagacgttcgtagacctcatgcggcgcggggacctgcctgtgtggctggcctaccgggtggcggccgaaggtataaactatgcggaccgacggtggtgttttgacgggatcaaaaacaaccagatcctcgaggagaacgtcgaggtggagatctggaccaaggagggcgagcgcaagaaactgaagcctcggtggctggacgctaggatctactccgacccactcgccctcaaggagtttaaagagttcgccgctggccggaagtcactgaccctgaacctgatcaccgaaatggggcgcctgcccacgttcatgacgcagaaggcgcgggacgccctcgataacctggccgtcctgcataccgccgaggttggcggtcgcgcgtacaaccacgccttatcagagctgccggaaaccctggagaccctcctgctgctcaccctgctggctaccgtgaccggcggcatctttctctttctgatgagcgggaagggcatcggaaagatgacgctgggaatgtgttgcatcataaccgcctccatcctcctctggtacgcccagatccaaccgcactggatcgcggctagcatcatcctggagtttttcctcattgtacttttaatccccgagcccgagaagcagcggacaccgcaggataaccaactcacgtacgtggtgatcgccatcttaaccgtcgtagccgcaacaatggcgaacgaaatggggttcttggagaagaccaaaaaggacctaggtctgggcagcatcatcacgcaggagtcggagtcgaacatcctggacatcgacctccgcccggccagtgcctggaccctgtacgccgtggccacgacattcgtcaccccgatgctgagacacagcatcgaaaactcctccgtcaatgtgtccctaaccgcgatcgccaaccaagccactgtcctaatgggactgggccgcgggtggcctctctctaaaatggatatcggcgtgccgttactggccatcgggtgttactcccaggtgaaccccatcaccttgatcgcagccttgctgctactggtagctcactatgccatcatcggcccgggcctgcaggctaaagccacccgcgaagcccagaaacgggcggctgccgggataatgaagaaccccaccgtggatgggatcacggtgatcgacttggagcccatcccgtacgaccctaagttcgagaagcagctggggcaggtcatgctgctcgtgctgtgcgtgacacaggtcctgatgatgagaacaacctgggccctgtgcgaggccttaacgctagccaccggccccatctctaccctgtgggaggggaaccccggccggttctggaacaccaccatcgcggtgtccatggccaacatcttccgcggatcctacctggcgggggctggcctcctcttctccatcatgaagaacaccaccaacaccaggcgcgggacgggcaacatcggcgaaaccctgggggagaaatggaagtcccggctgaacgccttgggcaagtccgagttccagatatacaagaagtccgggatccaggaggtggaccgcacactggccaaggagggtataaagcgcggggaaaccgatcaccacgcggtctcccgtggcagcgccaagctgcggtggtttgtggagcgtaacatggtgactccggagggtaaggtcgttgacttagggtgtggccgaggagggtggtcctactactgcggtggtttaaagaacgtgcgcgaagttaaggggctgaccaagggcggtcccgggcacgaggagcccatccccatgagcacctacggttggaacctcgtgcggctgcagtcaggggtcgatgtcttcttcaccccgcccgaaaagtgcgatacgctgctgtgtgacatcggcgaatccagccccaaccccaccatcgaggccgggcgcaccctgcgcgtgctaaacctcgtagagaactggctgaacaacaacacccagttttgcatcaaagtcctgaacccgtacatgccctccgtgattgagaagatggagacgctacaacgcaagtatggcggtgccctggtgcgtaacccgctgtctaggaactcgacccacgagatgtactgggtcagcaacgccacggggaacatcgtctccagcgtgaacatgatctccagaatgctgatcaaccggttcacgatgaagcataagaaggcaacctatgagccggacgtcgacctcggcagtggtacgagaaacatcggcatagagaatgaaatccccaacctggacatcatcggcaagagaatcgagaagatcaagcaggagcatgagacctcttggcactatgaccaggaccatccctacaagacgtgggcctaccacgggagctacgaaaccaagcagactggctcggccagctcgatggtgaatggcgtcgtgcgcctactaaccaagccctgggacgtggttcccatggtcacgcagatggccatgaccgacacgaccccgttcgggcagcagcgcgtcttcaaggagaaggtggacacccgcacccaggaacccaaggagggcactaagaagctgatgcggatcaccgccgagtggctgtggaaggagttggggaagaagaaaacgccacggatgtgcacaagagaggagttcacgcgtaaggttcggtctaacgcagctctgggcgcaatttttaccgacgagaacaagtggaagtccgccagagaggccgtggaggacagcagattctgggagctggtcgaccgcgagcggaacttgcatctggaggggaagtgtgagacctgcgtgtacaatatgatgggcaagcgcgaaaagaagctgggggaattcggcaaagcgaagggctcccgggccatttggtacatgtggctcggtgcacggttcctagagttcgaggccctgggctttctcaacgaggaccactggttcagccgggggaacagcctgtcgggtgtggagggggagggactgcacaagctcggctacatcctgcgagacgtttcaaagaaagagggcggcgcgatgtatgccgatgacaccgccggttgggacacgcggatcaccctagaggatctgaagaacgaggagatggttaccaaccacatgaagggcgaacacaagaagttggccgaggccatcttcaagctgacataccagaataaagtggtcagggtacagcgcccgacgccgcgcgggaccgtcatggacatcatatcccgcaaggaccaacggggctcaggccaggtcgggacctacggcctcaatacattcacgaacatggaggcgcagctgatccgtcagatggagggggagggcatcttcaagtcgatccagcacttaaccgtgaccgaggagatcgccgtgcagaactggctcgcccgagtcggccgcgagcggctaagccgcatggccatttccggggacgactgtgtggtgaagcccttagacgatcggttcgccagcgcgctcacagccctgaacgacatggggaaagtccgcaaggacatccagcagtgggagccttcccgggggtggaacgactggacccaagtgcctttctgcagtcaccacttccacgagttggtgatgaaagacggccgcgtcctcgttgtaccctgccggaaccaagatgagctgatcgggcgcgcccggatctcgcagggagccggctggagtctaaaggagaccgcctgtcttgggaagtcttacgcgcagatgtggactctgatgtacttccaccgccgcgacctgcgcctcgccgccaacgctatctgctcagccgtcccctcccattgggtgccgaccagcagaaccacctggtccatccacgcgaaacacgagtggatgaccaccgaagacatgctggccgtgtggaaccgcgtctggatccaggagaatccgtggatggaggacaagaccccggtggagagttgggaggaggtgccctatctcggcaagcgggaagaccaatggtgtgggtcgctaatcggcctgacgtcccgggccacctgggccaagaatatccaaaccgcgatcaatcaggtccgctcacttatagggaatgaggagtacactgattacatgccatccatgaagcgattccgcaaggaggaggaggaggccggtgtgctctggtga

SEQ ID NO: 25561 - RNA, 9876 nt, synthetic construct
  misc_feature 1..9876: note = derived and/or modified CDS sequence (opt11) from DENV-2__GQ398292__SS-prME
  source 1..9876: mol_type = other RNA
accgcgggggtctttatcatgctgatcccgaccgccatggcgttccacctcaccactcggaatggtgagccccacatgatcgtaggccggcaagagaaggggaaatccctgctgttcaagacggaggacggagtaaacatgtgcaccttaatggccatcgacttgggggagctgtgcgaggacaccattacctacaagtgccccctcctaaggcagaacgaaccggaggacatagactgttggtgcaactcgaccagcacctgggtgacctacgggacctgcaccactacgggcgagcatcggcgcgagaagcggtctgttgcactggtgccccacgtgggaatgggactggagacccggacggagacctggatgagtagcgagggtgcttggaagcatgtccaaagaatcgagacctggatcatgagacatccgggctttaccatcatggcagcaatcctggcgtacaccatcgggaccacccacttccagcgggcgctgatattcatccttctgaccgccgtagcgcccagcatgaccatgcgatgcattggcatctccaatcgggacttcgtggaaggcgtttcaggtggctcctgggtggatatcgtgttagagcacgggagctgcgtcactacgatggccaagaacaagcctacccttgacttcgagctgattaagaccgaggccaagcagcccgccacgctccgcaagtactgcatcgaggccaagcttacgaacaccaccaccgagtccagatgcccgactcagggggagcctagcctgaacgaggaacaggacaaacgctttgtgtgcaaacactctatggtagatagaggctgggggaacggctgcgggttgttcggcaagggggggatcgtgacttgcgcgatgttcacttgcaagaagaacatggagggcaaggtggtgctccccgagaacctggagtacaccatcgtgattacgccccacagcggggaggaacacgccgtgggcaatgacaccggaaagcacggcaaggagatcaagattacccctcagtccagcatcaccgaggccgaactaaccgggtacggcaccgttaccatggagtgcagtccccggaccggcctcgacttcaacgaaatggttctactgcagatggaggacaaggcctggttagtgcacaggcagtggtttctggacctgcccctcccctggctgccgggggccgacacccagggcagcaactggatacagaaggaaacactggtgaccttcaagaacccgcacgcgaagaagcaggacgtggtggtgctcgggtcccaggagggtgccatgcacaccgctctaaccggggccacggagatccagatgagcagcggcaacctgctcttcaccggccacctaaagtgtcgcctgcgcatggacaagctccaactgaaaggtatgagttatagcatgtgcaccggcaagttcaagatagtcaaggaaatcgccgagacccagcacgggacgatagtgatccgcgttcaatacgagggcgacggcagtccctgcaagatcccctttgagattatggacctggagaagcggcatgtgctcggacgcctgatcaccgtgaacccgatcgtcgccgagaaggactcccctgtgaacatcgaggccgagccaccattcggcgactcctatatcatcatcggggtcgaacctggccagctgaagctcaactggttcaagaagggcagctccatcggccagatgttcgaaaccaccatgcgcggtgcgaagcggatggcgatattaggggacacggcctgggacttcggctctctcggcggtgtctttacctcaattggcaaagcactccaccaggtgttcggggccatctacggcgccgcgttcagcggggtgtcctggacgatgaagatcctgatcggcgttattatcacctggatcgggatgaacagccgctccacaagcctgtccgtaagcctggtcctcgtcggagtggtgacactgtacctgggagcaatggtacaggcggactcaggctgcgtggtgagttggaagtccaaggagttgaagtgtggcagcgggatcttcatcaccgacaacgtccacacctggaccgagcagtacaaatttcaacccgagagccccagtaagctggcgtcagccatccagaaggcccacgaggagggcatctgtgggatccggtccgtgacacgcttagaaaatctaatgtggaagcagatcacccccgagctgaaccacatcctgagcgagaacgaggttaagctcaccatcatgacgggcgacatcaaggggatcatgcaggcgggcaaaagatccctgcgcccccaacccactgagctcaagtacagttggaagacctggggcaaggccaagatgttatccactgagtcacacaaccagactttccttatcgacgggcccgagaccgccgaatgccctaacaccaatcgggcctggaattcgctggaggtcgaggattatggattcggggttttcaccacgaacatctggctcaagctgcgagagaagcaagatgtcttctgcgacagcaaactgatgtccgctgcaatcaaggacaatcgggcagtgcacgccgacatgggctactggatcgagtccgccctcaatgatacctggaagatggagaaggcttcttttatagaggtcaagtcctgccactggcccaagtcccataccttgtggagcaacggcgtgctggagtccgaaatgatcatacccaagaactttgcgggacccgtgagccagcacaactaccgaccgggctaccacactcagaccgccgggccttggcatttgggcaagctggagatggacttcgacttctgcgagggaacgacggttgtggtaactgaggactgcggcaaccggggcccgagccttcgcaccacgaccgcctcggggaagttgattaccgaatggtgttgccgctcctgcaccctgccaccgctgcggtacaggggtgaggacgggtgttggtacggaatggagattaggcccctcaaggagaaggaggagaacctagtcaactccctggttactgccggtcatggccagatcgataacttctcactaggcgtcctcgggatggcgctgttcctcgaagagatgttgcggacccgcgtgggaaccaagcatgccatgctgctcgtggccgtctccttcgttaccctgataacggggaacatgagcttcagagatctgggccgcgtgatggtgatggtgggggcgaccatgaccgacgacatcggaatggggatcacgtacctcgctcttctggcggcctttaaggttcggcccacattcgccgccggacttctgttacgaaaactcacctccaaggaattgatgatggccaccatcgggatcgcgttgctcagccaatccaccatccccgaaaccatcctggaattaacagacgccctcgcgctggggatgatggtcctgaagatcgttcgcaatatggagaagtaccagctcgccgtgactatcatggccatcagctgcgtcccgaacgcggttatcctgcaaaacgcctggaaggtatcatgcaccatcctagccgccgtttccgtgagccccttactgctgacgagctcccagcaaaaagcggactggatcccgttagccctgaccatcaagggcctgaaccccacagccatcttcctcaccactctcagccggaccagtaagaaacgctcctggccgctaaacgaggccatcatggccgtcggcatggtgtccatcctcgcttcttccctgctgaagaacgatatacccatgaccgggcccctcgtggccggcggtctgctgaccgtctgctacgtcctcacgggacggtcggcggacttggagctcgagcgcgcagctgacgttaaatgggaggaccaggcggagattagtgggtccagccccattctctccatcaccatcagtgaggacggctccatgagcatcaaaaacgaggaggaggagcaaacgctgacgatcttaatcaggacgggtttactggtcatcagcggggtgtttccggtgagcatccccattaccgcggcagcctggtatctgtgggaggtcaagaaacagcgcgcgggcgtactctgggacgtgcccagcccgccgcctgtcgggaaagcggagttggaggatggcgcctatcggatcaagcagcgcgggatcctgggctacagccagatcggcgccggggtctacaaggaaggcaccttccacaccatgtggcacgtaacccgcggagcagtcctcatgcaccgcggcaagcgtatcgagccgtcctgggccgatgtgaagaaggacctgataagctacggtggtggttggaagcttgaaggcgagtggaaagagggcgaggaggtgcaggtcctcgcgctggagccggggaagaacccccgcgcagtgcaaacgaagcccggactgttcaaaaccaataccggcaccataggagccgtgtccctcgacttctcacccggcacgtcggggagtcccatcgtcgaccggaagggcaaggttgtggggctctacggcaacggggtcgtgaccagatccggagcctatgtgtctgcgatcgcccaaaccgagaagtccatcgaagacaatcccgagatcgaagatgacatcttccggaagaagcgcctgaccatcatggacttgcatcccggcgcggggaagacaaaaaggtacctgcccgctatcgtccgcgaagccatcaagcggggcctgcgcaccctgattcttgccccgactcgcgtggtggccgccgagatggaggaagccctgcgtggtcttcccatccgctaccaaacaccggccatccgggcggagcacacgggccgcgagatcgtcgacctcatgtgccacgccaccttcaccatgcggctgctgtcccccgttcgcgtgccaaactacaatctcatcatcatggacgaggcccactttactgacccggcctccatcgccgcgcgcggctacatctctacgcgagtcgagatgggagaagccgccggcatcttcatgaccgccacaccccccgggagccgggacccgttcccccaatccaacgcgccgataatggacgaggaaagagagatcccagagcggtcatggaactccggccatgagtgggtgaccgatttcaaagggaagacggtgtggttcgtccccagcatcaaggcaggcaacgacattgccgcctgcctgcgcaagaacggtaagaaggtgatccagctgtctaggaagacattcgacagcgagtacgtgaagacccgtgcaaacgactgggacttcgtggttaccacagatatcagtgagatgggcgcgaatttcaaggccgaaagggtgatagatccccgccggtgcatgaagccggtaatcctcaccgacggcgaggagcgcgtgatcctggcagggcccatgcccgtgacccacagctccgccgcccagcggcgcggccgcattgggcggaaccccaagaacgagaacgaccagtacatttacatgggagagcccctggagaacgacgaggactgcgcccactggaaagaggccaaaatgttgctggacaatataaacacgcccgagggcatcattccgagcatgttcgagccggagcgcgaaaaggttgacgcaatagacggggaataccggctgcgcggcgaggcccgaaagacgttcgtggacctcatgagaaggggggacctgcccgtctggcttgcatatcgcgtggcggccgagggcatcaactacgccgatcggcgctggtgtttcgatgggatcaagaacaaccagattctcgaggagaacgtggaggtggagatctggaccaaggagggcgagcggaaaaagctcaagccaagatggctcgatgcgcggatctattccgaccccctcgcgctgaaggagttcaaggagttcgccgccggccgcaagagtctgacgctcaacctgataacggagatggggcggctgcccacgttcatgacccagaaggcccgcgacgccctcgacaatctggcggtcctgcatacagccgaagccggcggtcgggcctacaaccacgccttgtcggagctgcccgagaccctggaaacactcctgctgctaaccctgcttgcgaccgtgaccggcggtatatttctcttcctgatgtcggggaagggcatcggtaagatgacgctgggcatgtgctgtatcatcactgcctccattctcttgtggtacgcccaaatccagccccactggatcgcggcaagcataatcctggaattcttcctcatcgtcctgttgatcccagagccagaaaaacagcgaacgccgcaggacaaccaactcacatacgtggtgatcgcgatcctgactgtcgtagccgccacgatggccaacgagatggggtttctggagaaaacaaagaaggacctcggcttaggctcgatcgccacacaggagtccgagagcaacatcctggacatagacctccgaccggcgtccgcctggactctgtacgcagtggccacgacgttcgtcacccccatgctgcgccacagcattgagaattccagcgttaacgtgtccctcaccgcgatagccaaccaggctacggtcctgatggggctgggcaagggatggccactcagcaagatggacataggggtccctctgctggcgatcgggtgctactcccaagtgaacccgataaccctcaccgccgcgttactgctcctggtcgctcactacgccatcattggccccggccttcaagccaaggctactcgggaggcgcaaaagcgcgccgccgcgggtataatgaagaaccccacggtggacggcatcaccgtgatcgacctcgagccgatcccctacgacccaaagtttgaaaagcagctggggcaggtcatgcttttgatcttgtgcgtgacccaagttctgatgatgcgcacaacgtgggccctctgcgaagcgttaaccctggccaccggccccatctccaccttatgggagggcaaccccgggcggttctggaacacaaccatcgccgtcagtatggccaacatctttagaggcagctatctggcgggggccggcctcctcttctccatcatgaagaacaccaccaatacgcggcgcggtactggcaacatcggcgagaccttgggggagaagtggaagtcacgactgaacgcgctcggcaaatccgaattccaaatctataagaagagtgggatccaagaagtagaccggaccctggccaaggagggcatcaaacgcggcgagacggaccaccacgccgtgagcaggggcagcgctaagttacggtggttcgtcgagcgcaacatggtgaccccagagggcaaggtcgtcgacctcgggtgcggccgcggcgggtggtcctactactgcggtggtctgaagaacgtccgtgaagtgaaggggctgaccaaaggcggacccggtcacgaggagcccattcccatgtccacttacggctggaatctggtccggttacagagcggtgttgacgtgtttttcacgccgcccgaaaagtgcgacaccctgctctgcgacatcggcgagtccagccccaaccccacaatcgaggccggtagaaccctgcgggtcctgaacctcgtggagaactggctgaacaataacacgcagttctgcatcaaggtgctgaacccgtatatgccgagcgtcatagaaaagatggaaacactacagcgcaagtacgggggcgccctggtgcggaaccccctaagccgcaatagcacccacgagatgtactgggtcagcaatgccaccgggaacatcgtcagcagcgtaaatatgatctcgcggatgctgatcaatcgtttcaccatgaagcacaagaaggccacgtacgagcccgacgtcgacctcgggtctggaacccggaacatcggcatcgagtccgagatacccaacctggacataatcggcaagcggatcgagaaaatcaagcaggagcacgagacctcttggcactatgaccaagaccacccatacaaaacctgggcgtaccacgggtcctacgagacaaagcaaaccggcagcgcttctagcatggtcaacggggtggttcgccttttaacaaagccctgggacgtcgtgcctatggtgacacagatggccatgacggacaccacccccttcggccagcagcgggtctttaaagagaaggtggacacccgaacacaggagccaaaggaggggaccaagaagctgatgaaaatcaccgccgaatggctgtggaaggagctcgggaagaagaaaacgccccggatgtgcacgagggaagagttcacccggaaagttcgctccaatgctgcgctgggcgcaatctttaccgacgagaataagtggaagtccgccagggaggctgtcgaggactcccgcttctgggagctgatcgacagggagcgcaacctccatctggaggggaagtgcgagacctgtgtgtacaacatgatgggcaagcgggagaagaaactaggtgagttcggcaaagcgaagggcagcagggctatctggtacatgtggctcggggcccgcttccttgagttcgaggccttaggctttctcaacgaggaccactggtttagtcgcgggaactccctcagtggggtggaaggggagggcctgcaccggctcgggtacatactgcgcgacgtctccaagaaggaaggcggcgccatgtatgcggacgacacggccgggtgggatactcggatcaccttggaggatcttaagaacgaagagatggtcaccaaccacatgaagggcgagcacaagaaactggctgaggccatcttcaagctcacgtaccagaacaaggtcgtgcgcgtgcagcggccaacacctcgggggacggtcatggatatcatcagccgccgtgaccagcgcggctccggccaggtggggacctacggcctcaacacgttcaccaacatggaggcccagctcatacggcagatggagggggaaggcatttttaagtcaatccagcacctaaccgtgaccgaggagatcgcggtccagaattggttagcacgcgtgggccgcgagcgcctgtccaggatggccatcagcggagacgactgcgtggtcaaacctttggacgacagattcgcgtctgccctcacggccttgaacgatatgggcaaagtgcggaaggacatacagcagtgggagcccagcaggggttggaacgactggacccaggtgccgttctgctcccaccatttccatgagttggtcatgaaagacggccgagtgctcgtggtcccatgccgcaatcaagacgagctgatcgggcgggcgcgcatcagccagggcgccggctggtcccttaaggagaccgcctgtctcggcaagagctacgcccagatgtggactttgatgtactttcaccggcgcgacctgcggctcgcggccaatgccatctgctccgccgtgcccagccactgggtgcccacgtcccgcaccacatggagcattcatgcgaaacacgagtggatgaccaccgaggacatgctggccgtctggaaccgggtgtggatccaggaaaacccatggatggaggacaaaacgcccgttgagtcatgggaagaggtgccttacctgggaaagagggaagaccagtggtgcgggtccttgattggccttactagccgcgccacctgggccaagaacatccagactgctatcaatcaggtacggtccctgatcggaaacgaagagtacacggactacatgccctctatgaagcggttccgccgcgaagaggaggaggccggcgtgctttggtaa

SEQ ID NO: 25562 - RNA, 9876 nt, synthetic construct
  misc_feature 1..9876: note = derived and/or modified CDS sequence (opt11) from DENV-2__GQ398267__SS-prME
  source 1..9876: mol_type = other RNA
accgccggtattataatcatgatgatacccaccgttatggccttccacctgaccacgcggaacggggaaccccacatgatcgtcagccggcaggagaagggcaagagcctcttgttcaagaccgaaaacggggtaaacatgtgcacccttatggcgatggacctcggcgagctgtgcgaggacacgatcacctataactgccccttactccgccagaacgagcctgaggatatcgactgctggtgcaactcaaccagcacatgggtgacctacgggacctgtaccgccaccggtgagcatcggcgggagaagcggagcgtcgccctggttccccacgtgggcatggggctggagactcgaaccgagacctggatgtccagcgagggagcctggaagcacgcccagcggatcgaaacatggattctccgccaccccggattcacaatcatggcagccatcctggcatacaccattggaacaacctatttccagcgagtcctgatcttcatcctgctaacggccgtgaccccatccatggcgatgagatgcatcgggatcagcaaccgcgacttcgtggagggagtatccggtgggagctgggtggatattgtgctggagcacggctcctgcgtcactactatggccaaaaacaaacccacgttggacttcgagctcatcaagaccgaagcgaagcaccccgccactctgcgcaagtactgcgtggaggccaagctcaccaatacgaccaccgcaagccggtgcccgacacagggagagccctccctgaacgaggagcaggacaagcgctttgtttgcaagcatagtatggtggaccggggctggggcaatgggtgcggcctgttcggtaagggtggcatcgtgacctgcgcaatgttcacgtgcaagaagaatatggaaggcaaggtggtgcagcccgagaacctcgagtacaccattgtgatcacgcctcactccggcgaggagaacgccgtagggaacgatacgggcaagcatgggaaggagatcaaagtcacaccgcagagctccatcacggaggcggagctgactggctacgggacagtcactatggagtgcagcccccgcaccggactggacttcaacgagatggtgttgctccagatggaaaacaaggcctggctggtccatcggcagtggttcctcgacctgcctctgccctggctcccgggtgcggacacccagggctccaactggatccagaaggagaccttggtgacgttcaagaatcctcatgccaagaagcaggacgtcgtggtgctgggctctcaggagggggccatgcacaccgcgctcaccggcgcaacagaaatacagatgtcctccgggaacctgctgttcacgggtcatctcaagtgccgcctgcggatggacaagctgcagctgaaaggcatgagctactccatgtgtacagggaagttcaaggtcgtcaaggagatcgcggagacccagcacggcaccatcgttataagagttcagtacgaaggggatggaagcccgtgtaagatacccttcgagatcatggacctggaaaaaagacacgtgctcggccgccttatcaccgtgaacccgatcgtcaccgagaaggactcccccgtgaatatcgaggcagagccgcccttcggggacagctacatcatcatcggggtggagccggggcagctgaagctgtcctggttcaagaagggcagctcaatcgggcagatgttcgagaccaccatgcgcggcgccaagcggatggctatcctcggagacacggcttgggactttgggagcctgggcggggtgttcacctcaattgggaaggcactgcatcaggtcttcggggccatttatggcgccgcattcagcggcgtgtcctggaccatgaagatcctcatcggggtggtgataacctggatcggcatgaacagccgttccacgagcctgtccgtctccctggtgctggtgggcgtggtcaccttatatttgggcgtgatggtgcaggcggactctggctgcgttgtgagctggaaaaataaggagctcaagtgcggtagcggcatcttcatcaccgacaacgtgcacacctggacggagcagtacaaattccagcctgagtccccaagcaagctcgcctccgcaatccagaaggctcacgaggaggggatctgtgggatccggagcgtcacccgcctggagaacctaatgtggaagcagatcacccccgagttaaatcacatcctgaccgagaacgaggtgaagttgaccatcatgacaggagacattaagggcatcatgcaggcgggaaagagatccctccgcccgcagcccaccgagttaaagtacagctggaaggcgtggggcaaagccaaaatgctttccaccgaactacacaatcataccttcctcatagacggccctgagactgccgaatgcccaaacaccaaccgagcctggaacagcctggaggtagaggactacgggttcggcgtcttcaccacgaacatatggctcaagctgaaggagcgccaggacgtattctgcgattccaagttgatgtcagcggccattaaggacaatcgggccgtgcatgctgacatggggtactggatcgagtccgccctcaatgacacctggaagatcgagaaggcctcattcatagaggtcaagtcctgccattggccgaagagccacaccctctggtccaacggcgttctagaatcagagatgattatccccaagaacttcgcgggccccgtttcccagcacaactaccgcccgggatatcacacccagaccgctggcccctggcacctcggacggctggagatggatttcgacttctgcgagggtacaaccgtcgtggtcaccgaggactgcgggaaccgcggccccagcttgcggactacgactgccagcggcaagctcattaccgagtggtgctgccgctcctgcactctcccccctctgcggtaccgcggggaggacgggtgctggtacgggatggaaatcagacccctcaaggagaaggaggaaaacctagtcaacagcctggtgacggccggccacgggcagatcgataacttctcgctcggtgtgctgggcatggcgctattcctcgaagagatgttacgcacccgagtcgggaccaagcacgccatcctgctcgtagccgtgagctttgtcaccttgatcacaggcaacatgtccttccgcgatctggggcgcgtgatggtcatggtaggagccaccatgacggatgacatagggatgggcgttacatacctcgccctgctagctgccttcaaggtacggccaactttcgcggccggcctcctgcttcggaagctaaccagcaaggagctaatgatgaccaccatcgggatcgtcttgctctctcagagcactattcccgagtcgatactggagctgacggacgccctcgctctgggcatgatggtgctgaagatagtccggaacatggagaagtaccagctagcggtgaccattatggcgatcctatgcgtgcccaacgccgtcatactgcagaacgcgtggaaggtaagctgcaccacgctagcggttgtgagcgtaagcccccttctgttaacgtcctcgcagcaaaaggcggactggatccccctggcccttactattaaggggctcaaccctacggccatcttcctgacgaccctgagccgcaccagcaagaagcggtcgtggccgctcaacgaggctattatggccgtgggtatggtgagcatcctagcctccagcctgctgaagaacgacatccccatgaccggcccactggtggcggggggcttactcacggtgtgctacgtcttaaccgggcggagcgccgatctggagctcgaacgggcggccgacgttcgctgggaggagcaggccgagatctcgggcagttcgcccatcctgagcattaccatctccgaggacgggtccatgtcaattaaaaacgaagaagaggagcaaacccttactatactcatcagaaccgggctgctggtgataagcggcctctttccggtctctatacccatcaccgctgccgcgtggtacctgtgggaggtgaagaaacagcgagccggcgtgctgtgggacgtccccagtccaccgcccgtgggcaaggccgaactcgaggacggggcctaccgcattaagcagaaaggaatactgggatattcccagatcggcgcaggcgtctacaaggaggggaccttccacaccatgtggcacgtcacgcgcggcgcggtgctgatgcacaaggggaaacggattgaaccaagctgggccgacgtaaaaaaggacctcatctcgtacggcggggggtggaagttggagggggaatggaaggagggggaagaggtccaggtgctggccctcgaacccggcaagaacccacgcgccgtgcagaccaagcccgggttgttcaagacgaacaccggtacgatcggggccgtcagcctggacttctcgcccggcacttctggcagcccaatcgtagacaagaaggggaaggtggtcggcctctacgggaacggcgtggtgacgaggagcggcacctacgttagtgcaatcgcccagacggagaagtccatcgaggacaaccccgagattgaggacgacatcttccgcaaaaagcgcctgactatcatggacctacaccccggggccgggaagacgaagcgctacctgcccgccatagtgcgggaggcgatcaaacgcggcctccggactttgatcctagccccgacccgcgtggtggctgcggagatggaggaagcccttcgcggcctccccatacggtaccaaacccccgctatccgcgccgagcacaccggacgggaaatcgtagacctgatgtgtcacgcgactttcacgatgcggctcctatcgcccatccgagtgccgaactataacttgatcatcatggacgaggcccacttcaccgaccctgccagcatcgcggccagaggctatatcagcacacgtgtcgagatgggggaggcagcaggaattttcatgaccgccacacctcccggctcccgcgacccgtttccccagagcaacgcgcccataatggatgaggaacgcgaaatacccgagcgctcctggaatagcgggcacgaatgggtgaccgacttcaagggcaagaccgtgtggttcgtcccgagtatcaaggccgggaacgacatcgccgcctgcttacggaagaatggcaagaaggtgatccagctaagccgcaagacgtttgactctgagtacatcaagacaaggaccaacgactgggatttcgtggtcactaccgacatctcagaaatgggcgccaacttcaaggccgagcgcgtgatagacccccgtcgctgtatgaagcccgtgatcctgacggatggggaagagcgggtcattctcgccgggcccatgccggtgactcactcgagcgctgcccagcgccgggggcgcgtgggccgtaaccccaagaacgaaaacgaccagtacatctacatgggggagcccttagagaacgatgaagactgcgcgcactggaaggaggccaagatgttgctcgacaacatcaacacccctgagggcatcatcccaagcatgttcgaacccgaacgggagaaggtggatgccatcgacggtgagtaccgcctgcgcggtgaagcccgcaagaccttcgtcgacctgatgcggcgcggcgacctccccgtctggctggcatatcgggtggccgccgaggggatcaactacgccgatcgccggtggtgcttcgatggagtgaagaacaaccagatcctggaggagaacgtcgaggtggagatctggactaaggaaggggagcggaagaagctcaagccgcgatggctggacgcccgtatctacagcgaccctctggccctcaaggagttcaaagagttcgcggccggccggaaatccctcaccctcaacctcatcacggagatgggccgcctgcccacctttatgacgcaaaaagccaagaacgccctggacaacctcgcggtcctgcataccgccgaggccggaggtcgggcctacaatcacgccctgagcgagctccccgagacactcgagacgctgctcctgctgaccttgctggcgaccgtcaccgggggcatctttctgttcctcatgtccggcaaggggatcggcaagatgacgttggggatgtgttgcatcataacagcctcgatcctgctctggtacgcccaaatccagccgcactggatcgctgcttccataatcttagagttcttcctgattgtgctcttaatccccgagcccgagaagcagcgcacgccgcaggacaaccaattaacctacgttgtcattgccatcctcaccgtggtggccgccacgatggcgaatgagatgggcttcctggagaagacgaagaaggacttcgggctgggtagcatcaccacgcagcagccggagagcaacatcctcgatatcgatcttcggcccgcctccgcgtggaccctttatgccgtcgctacgacattcatcaccccgatgctgaggcacagtatcgagaactcatcggtgaacgtatccttgaccgccattgcaaaccaggcgaccgtactgatgggcctggggaagggctggcccctcagcaagatggatatcggagtccctctactcgccatcggctgctactcccaggtgaacccaatcaccttaatcgcagccctactgctgctagtcgcgcattacgccattatcgggccagggctccaggccaaggccacccgtgaggcccaaaagcgagcggccgccggaatcatgaagaaccccaccgtagacgggatgaccgtgatcgacctcgacccgataccctacgaccccaaattcgagaagcagctgggccaggtcatgctcctagtgttgtgcgtgacccaggtcctcatgatgagaacgacctgggccctgtgtgaggcccttacgctcgcgaccgggcccatctccaccttatgggagggcaatccgggccgcttctggaacaccacaattgctgtgtccatggccaacatcttccgcggaagctacctggcgggcgccgggctattgttctctatcatgaagaacaccgcgaacactcggcgaggcacggggaacatcggcgagacgctgggcgagaagtggaagaaccggctcaacgccctgggcaagagcgagttccagatctacaaaaagtccggcattcaggaggtagaccggaccctcgccaaggaggggatcaagcgaggcgagacggaccaccacgccgttagccgcggctccgcgaagctccggtggttcgtagagcgaaatctggtgacccccgagggtaaggtcgtcgacctcggctgcgggcggggaggttggagctattactgcggagggctcaagaacgtgaaggaggtcaagggcctgacgaagggcgggcccggccacgaggagccaatcccgatgtccacttacgggtggaacttagtgcgcctccagtcaggcgtcgacgtcttctttacgccgcccgagaagtgcgacacactgctctgcgacattggggagtcctctcccaatccgacggtggaggctggccggaccttacgggtgctgaacttagtcgaaaactggctaaacaacaacacccagttttgcataaaggtgttgaacccgtacatgccaagcgtcatcgagaagatggaggccctgcagcgaaagtatggcggggccctggtacgcaacccgctctcccgaaacagcacccacgagatgtactgggtgtccaatgcctctggcaacatcgtgtcctccgtcaatatgatctcccgcatgttgatcaaccggttcaccatgcgtcacaagaaggcgacctacgagccggacgtggatctggggtcgggtacccggaatattgggatcgagtccgagacccccaacctagacatcataggcaaacgcatagagaagatcaagcaggagcacgagaccagctggcactacgaccaagaccacccctacaagacgtgggcctaccacggcagctacgagaccaagcagaccgggtccgcctcctcgatggtgaacggcgtagtgcgcctgctaaccaagccgtgggacgtgatcccgatggtcacgcagatggccatgaccgataccacccctttcgggcagcagcgtgttttcaaggagaaagtggatacgcgcactcaggagcccaaggagggcacgaagaaactcatgaagatcactgccgagtggctgtggaaggagctgggcaagaagaagaccccacggatgtgcacccgagaggaattcacccggaaggtccgctccaacgccgcactcggggctatcttcaccgatgagaacaagtggaagtccgcacgggaggccgtcgaggactccggcttttgggagctagtcgacaaggagcgcaacctccacttagaggggaagtgcgagacgtgcgtgtataatatgatgggcaagcgggagaagaagttgggggagttcggcaaggctaagggcagccgagccatctggtacatgtggctgggggcccggttccttgagttcgaagccctgggcttcttaaatgaggaccactggttctcccgcgagaacagcctctcgggtgtggaaggcgagggtttacacaagctgggttacatcctcagagatgtctccaagaaggagggtggggccatgtacgccgacgacaccgccggctgggacacccgcatcaccctggaggatctgaagaatgaggagatggttacgaaccacatggagggcgagcataaaaagctcgccgaggccatcttcaagctgacctaccagaacaaggttgtccgggtgcagcgccccacgccccggggcacagtaatggatatcatcagccgtcgtgaccaacgcgggtccggccaggtcgtaacgtacggcctcaacacattcacaaacatggaggcgcaactcatccggcagatggagggggagggcgtgttcaagagcatccagcagctgaccgtcaaagaggagatcgccgtgaagaattggcttatccgcgtggggcgcgagcggttatcacgcatggctatcagcggcgacgactgcgtcgtcaagcccttggatgaccggtttgcctccgccctgatcgctctcaacgacatgggaaaggtgcgtaaagacatccaacagtgggaaccgtctcgggggtggaacgactggactcaagtcccattctgctcgcaccacttccacgaactgatcatgaaggacggtcgcgtgctggtggtgccctgccggaaccaggatgagctaatagggcgcgcccggatcagccagggcgccggttggtccctgcgcgagaccgcttgtctcggcaagagctacgcccagatgtggtccctcatgtacttccaccggcgcgacctacggctagcggccaacgccatttgtagcgcagtaccctcccactgggtccccactagccgcaccacgtggtccatacatgccacccacgagtggatgaccaccgaggacatgctcaccgtctggaatcgggtgtggattcaggagaacccatggatggaagacaagactccagtggagagctgggaggagatcccttacctgggcaagcgagaggaccagtggtgcgggagcctgattggtttaacctcccgtgctacctgggccaagaacatccagaccgcaattaatcaggtccgaagtttaatcgggaacgaggaatatacagactacatgccttccatgaagaggttccgccgcgaagaggaagaggccggcgtgctttggtga

SEQ ID NO: 25563 - RNA, 9876 nt, synthetic construct
  misc_feature 1..9876: note = derived and/or modified CDS sequence (opt11) from DENV-2__GQ398266__SS-prME
  source 1..9876: mol_type = other RNA
accgcagggattataataatgatgataccaaccgttatggcgttccatctgactacgcgaaatggtgaaccccacatgatcgtatcccggcaggaaaaaggaaaatcactactattcaaaacggaaaatggagtgaatatgtgtacactgatggctatggatcttggagaactctgcgaagacaccatcacctataattgccccctactccggcagaatgaacccgaggatatcgattgttggtgcaacagcacaagcacctgggttacatacggcacctgtactgcaacaggagaacacagaagagagaaacggagcgtagccctagtacctcatgtaggcatggggcttgagactcgaacggagacgtggatgtctagcgagggcgcatggaaacacgcccaacggatcgagacgtggatactccggcacccaggattcacaatcatggcggccatattggcctacacgatagggactacttacttccaacgggtacttatattcatcctactcactgccgtcaccccttccatggccatgagatgtatagggatctctaaccgggacttcgtcgagggcgtgagcggaggatcctgggtcgacatcgtactggagcacggatcatgcgtaaccactatggccaaaaacaaacctacgctggacttcgagctaatcaaaactgaggcgaaacatcccgccacactccgcaaatactgcgtagaagcaaaactcacaaacacaaccaccgcatctcgctgcccaactcaaggggaacccagtctaaatgaagaacaggataaaagatttgtatgcaaacacagcatggtcgacagagggtgggggaacgggtgcggactatttggcaaaggcggaatcgtgacctgcgcaatgtttacctgcaagaaaaacatggaggggaaagtagtccaacccgaaaatttggagtacaccatcgtcataacaccccactccggggaagaaaacgcagtcggcaatgatactggcaaacacggaaaagagatcaaagttacaccacaaagctcgatcacagaagctgaactaaccggttacggcacggtcaccatggagtgctccccacgcacaggtctagatttcaacgaaatggtgttgctgcaaatggaaaacaaagcatggcttgtccacagacagtggttcctagatctacccctaccctggctacccggggccgacacccagggctctaactggatacaaaaagaaaccctcgtaacgttcaaaaacccccatgcgaagaaacaagatgttgtcgtgctaggatctcaggagggagcaatgcacacagccttgaccggagccaccgagatacagatgagcagtggaaatctattatttacaggccacctgaaatgtcggctaagaatggacaaactccaacttaaaggcatgtcatatagcatgtgcacaggaaaattcaaggtcgtaaaagaaatagcagagacgcaacacgggacgatcgtgatcagggtacaatacgaaggcgatggcagcccgtgcaagataccgttcgaaataatggacttggaaaagagacacgtgctcggccggctgatcacagtcaatcccatagtcacagagaaagattcgcccgttaacatcgaggcagagccaccattcggcgacagctacatcataattggagtcgagcccggacaactaaagctctcatggttcaagaaaggctcatcaatagggcaaatgttcgagacaacaatgagaggggctaaacgcatggcaatcctaggcgacacggcatgggactttggttcattaggcggtgtctttacatctattgggaaagctctccaccaggtattcggcgcgatatacggagccgcgtttagcggagtttcatggacaatgaaaattcttatcggagtggtcataacatggattggcatgaactccaggagcacatcgctcagcgtatccttagtcctagtaggggtagtaacactatacctaggcgtcatggtacaagcagacagcggttgtgtggtatcatggaaaaataaggaattgaagtgcggtagcggaatattcatcacggacaatgtacacacctggaccgaacaatataaattccaacctgagagccccagcaaacttgcgtctgccatccaaaaggcacatgaagagggcatatgcggaatccgctctgttactcgcctagaaaacctcatgtggaagcaaataacacccgaactcaatcacatcctgaccgaaaacgaggtaaagctcacaataatgacgggagacataaagggaatcatgcaagcgggaaaacggagtctgcgcccacaaccgacagagctaaaatactcgtggaaggcatggggcaaagcaaaaatgttatcaacagaactacacaatcacacgttcctgatagacggcccggaaacagccgaatgccctaatacaaatcgggcctggaacagcctagaagtagaggattacggcttcggcgtctttacaaccaacatctggctcaaactcaaggaaaggcaagatgttttctgtgacagcaaactcatgtccgccgcaatcaaagacaaccgagcagtacacgctgacatgggttactggatagaaagtgcgctaaatgacacttggaaaatagagaaggccagctttatagaagtcaaaagctgccactggcctaagagtcacaccctatggtccaacggtgtcctggaatccgagatgataatacccaaaaacttcgcagggccagtatcacagcacaactaccggccgggataccacacacaaacggcgggcccttggcatctgggaaggctggagatggacttcgacttttgcgaaggcaccaccgtcgtagtgacagaagactgcggaaatagggggccatcactccgcacaacgacagcgtcgggaaagctcataaccgaatggtgctgccgcagttgtacactaccaccgcttagataccggggagaagatgggtgctggtacgggatggaaattcgacctctcaaagagaaggaagagaacctggtcaactcactcgttacagccgggcacgggcagatcgacaacttcagcctgggggtcctaggaatggcactgttcttggaagaaatgctgcgtacacgggtaggcacgaaacacgccatcttgctagtcgcggttagcttcgtaaccctcatcacgggcaacatgtccttccgtgacctaggacgagttatggtgatggtaggagcaacaatgacagacgacatcggcatgggagtgacatatctcgcattgctcgcggcattcaaagtcaggcctacatttgccgcaggactcctgctcaggaaactaacatccaaggagctcatgatgactaccatcggcatagtgctgctatcccaatccaccataccagagtcaatcttagaacttacggacgccctggcactaggaatgatggtactaaagatagtcagaaacatggagaaataccaactcgccgtgacgatcatggcgatcttgtgtgtaccgaacgcagttatactacagaacgcctggaaagtgtcatgtacaaccctcgccgtggtgagcgtcagccccctacttcttacctccagccaacaaaaagccgactggatccccctggctctaacgattaaggggcttaaccctactgcaatattcttgacgaccttgtcccggaccaataaaaagcgatcctggccattaaacgaagccataatggcagtaggtatggtctcgattttagcgagttcactgctcaaaaacgacattccgatgaccggcccactcgtagcaggcggtctcctaaccgtctgctacgtgctaacgggccggtccgcagaccttgaactggaaagagcagcagacgtgcggtgggaggagcaggcagagataagcgggtcttcccccattctttcaatcacaatttccgaagacggatccatgagtatcaaaaacgaggaagaggagcaaacactgacaatcttaatcaggactggactcctagtgatttcaggattgttcccagtttcgatccccataacagccgctgcgtggtatctatgggaagtaaagaaacaacgcgctggtgtactatgggacgtcccatcaccaccaccggtagggaaggctgagctcgaagatggagcgtacagaataaaacagaaaggaatactgggatactcacagataggagcgggggtatacaaggaagggacgttccacacaatgtggcatgtgacacggggcgccgtactaatgcataaggggaagagaatagaaccgtcctgggcggacgtcaaaaaggacttaatatcttatggaggagggtggaaactagagggggaatggaaggagggggaggaggttcaagtactagctctcgagcccggcaaaaacccgcgagcagtccagacgaaacccggcctatttaaaacaaacaccggcacaatcggcgcagtcagcttagacttctcgccggggacatcaggctcccccatcgtagataagaaaggaaaagttgtagggctttacgggaacggagtagtaacgcgatccgggacctacgtatccgccattgcgcaaacggaaaagtcgattgaagataaccccgagatcgaagacgacatattcaggaagaaacgcctaacgatcatggatctccaccccggtgctggcaagaccaaacgctatctacccgccatagtaagagaagccatcaaaagaggcctccgcacgctgatacttgcacccacccgggtagtcgcagccgagatggaggaagcgctccgaggattaccaatacgttatcagacccccgcaatacgggccgagcacaccggtcgcgagatagtagatctgatgtgccacgccacgttcacaatgcgcctcctctcgcccatccgagtaccaaactacaatttaatcataatggacgaggcgcacttcacagaccccgctagcatagctgcgcgaggatacatctcgacccgagtggaaatgggcgaagcggcgggcatttttatgaccgcgacaccacccggaagccgagaccccttcccacagtcgaacgcccccataatggacgaagaacgcgagataccagaacgtagctggaactcgggacatgaatgggtgaccgatttcaagggcaagacagtctggttcgtgccgagtatcaaagcaggcaacgacatcgcggcctgtctgaggaaaaatggcaaaaaggtgatacagctctcgagaaaaacctttgacagcgaatacataaagacgcgtacaaacgactgggacttcgtagtaaccacagacatatcagaaatgggagcaaacttcaaggccgaaagagtcatcgacccccgacgttgcatgaaacccgtaatactcaccgatggggaagaacgtgtgatccttgcaggtccaatgccggtcactcattcctccgcagctcagcgtagaggaagggttggtcgaaacccaaagaacgaaaacgaccaatacatatatatgggcgagcccttagaaaacgacgaagattgcgcccactggaaggaagccaaaatgctactcgataacataaatacgccggaggggatcatacctagcatgttcgagcctgaacgagagaaagtagatgcaatagatggggaatatcgtctacgaggagaggcccgaaaaaccttcgtagacctgatgcgaagaggggatttgccagtctggttggcctaccgcgtggctgcagaaggtatcaactacgcagacaggcgatggtgcttcgatggggtaaagaataaccaaatactcgaggagaacgtggaggtagaaatttggacgaaggaaggtgaacgaaagaaattaaaaccacgatggctcgacgcccggatctattccgaccctttggccctgaaagaatttaaagagttcgctgcggggcgcaaaagcctcacgctgaacctgattacagaaatggggcggctaccgacattcatgacacagaaagccaaaaatgccctcgacaacctggcagtactccatacagcggaagccgggggtcgagcatacaatcatgccctatcagaactccccgagacactggaaacactgctcctactaacactactcgctacggttaccggaggtatcttcttatttctcatgtccggcaagggcattggaaagatgacgctaggcatgtgctgcataattacagcgagcatactcctttggtacgctcagatccaaccccactggatagcggcttcaataatcctggagttctttttaatagtactgcttatacccgaacctgaaaaacaaaggacaccccaggacaaccaactcacctacgtggtcatcgccatcctgacagtagtagcagcgacaatggctaacgaaatgggctttctggagaaaaccaaaaaggactttggactcggcagcataaccacccaacagcccgaaagcaacatactggatatcgacctccgaccggcctcggcatggaccctatacgcagtagcaacgaccttcataacacccatgttacgacacagcatagagaacagttcggtgaacgtatcactaactgcaatcgccaaccaggcaacagttctcatgggcctgggcaagggatggccgctctccaaaatggacataggtgtgccattactcgcgatcggctgctacagccaagtgaacccgatcacattgatagcagcactacttttgctggttgcacactacgccattatagggccaggcctacaggcaaaggccacacgtgaagcacagaaacgcgcagccgccggcattatgaaaaacccaacagtggacggtatgaccgtaatcgacctggatccaattccgtacgacccgaaatttgaaaaacagctcggccaggtaatgctcctcgtactgtgcgtcacacaggtactaatgatgcgcacaacctgggctctctgcgaagccctgaccctggcgaccggacctatctcaaccctatgggagggtaaccccgggaggttctggaacacaactatagcagtcagcatggctaacatcttccggggtagctacttagccggagcaggccttctattttcgataatgaaaaacacggcaaacacgcgcaggggaacagggaacacgggcgaaacactcggcgaaaaatggaaaaaccggctcaacgcgctaggcaagagcgagttccaaatatataaaaagtcagggattcaagaagtcgataggacgctagcaaaagaggggatcaagcgcggggagacagaccaccacgcggtgagccgcggaagcgcgaaactccggtggtttgtcgagaggaaccttgtgacgccagagggaaaggtggtcgatcttggctgcggacgagggggatggtcctactactgcggagggctcaaaaatgtcaaagaagtcaagggcttaacaaaaggcggcccaggccatgaagaacccattcctatgagtacctatggatggaacctcgtaagactccagtccggagtagacgtgttcttcactccacccgaaaagtgcgacactctattatgcgacataggcgagagtagcccaaaccctacagtagaggcagggcgaaccctccgagtcctaaacctggttgaaaactggctgaacaataatacgcaattttgcataaaagtgctaaacccctacatgccaagcgtaatcgagaaaatggaagcactgcagcggaaatatggcggagctctggtacggaacccgctgtccaggaactcgacacatgaaatgtattgggtcagcaacgcaagcggaaacatcgtctcgtccgtaaacatgatctccagaatgttgatcaacagatttacaatgaggcacaagaaagcaacatatgagcctgacgtggatctcggctccggcacaagaaatatcgggatcgaaagtgaaacaccaaacctcgacatcatcgggaagaggatagaaaagatcaaacaagaacacgaaacatcgtggcattacgatcaagatcatccatataaaacttgggcctaccatggctcttacgagacgaagcagactggatcggcatcatccatggttaatggggttgttcgcttgctcaccaagccttgggacgtcattccgatggtaacccagatggccatgactgatacaacgcccttcggccaacaaagagtgtttaaagagaaagtggacacgcgcactcaagagcctaaggagggtaccaagaaactcatgaaaattacagcagaatggctgtggaaagagctcggcaagaagaaaaccccacgaatgtgtacaagggaagagttcactcgcaaagtgaggagcaacgctgcactaggggctatatttacggacgagaataagtggaaaagcgcgcgagaagccgtcgaagattcagggttctgggagctagtagacaaggagagaaatcttcatctagaaggtaaatgtgagacgtgtgtctataacatgatgggaaagcgcgagaagaaactcggagagttcgggaaagccaaagggagccgcgcgatatggtacatgtggctaggtgcacggtttctcgagttcgaagcccttggctttctgaacgaggatcactggttctcgagagaaaatagtctaagcggcgtggaaggggaggggctccacaaactaggctacatcctgcgagatgtgtcgaagaaagaaggcggcgcaatgtacgcggacgatacggcagggtgggacacaagaatcaccctagaagatctcaaaaacgaggaaatggtcacaaaccacatggaaggagagcacaagaaactcgcggaggccatcttcaagctgacttaccaaaataaggttgtacgtgtacagagacccacaccccgcgggaccgtcatggacatcataagcagacgagaccaaagaggcagcgggcaggttgtgacatacggtctgaacaccttcaccaatatggaagcccagctgataagacaaatggaaggtgagggcgtattcaaatcgatccaacagctaacagtcaaagaagagatagcagtcaaaaactggctcattcgagtgggccgagagagactcagccgaatggccatctctggagatgactgcgtcgtaaagccgctggatgacagattcgccagtgcactaactgccctgaatgacatgggaaaggtgcgcaaggatattcagcagtgggaaccgtcccgaggctggaacgactggactcaagtgcccttctgcagccaccacttccacgagctgataatgaaggacggaagggtgcttgtcgtaccgtgccgcaaccaagatgaacttatcggacgcgcgcggatatcgcagggagcaggctggagcctacgcgaaaccgcgtgcttaggtaaaagctacgcccaaatgtggagcctcatgtactttcataggcgtgacctgcgcttggcggcaaacgccatctgctcagccgtccccagccactgggttcccacctcgcgaacaacgtggtcgatacatgcgactcacgaatggatgacgacggaagacatgctgaccgtgtggaaccgggtgtggatccaagagaacccatggatggaagacaaaaccccagtcgaatcatgggaggaaattccctacctgggcaagagagaggaccagtggtgcggcagcctaatcgggctgacgagccgagccacgtgggccaagaatatacagacggccatcaaccaagtaagatcgctaatagggaatgaggaatacacggattatatgccgagtatgaagcgcttcagaagggaagaagaagaggcgggggtgttatggtaa

SEQ ID NO: 25564 - RNA, 9876 nt, synthetic construct
  misc_feature 1..9876: note = derived and/or modified CDS sequence (opt11) from DENV-2__GQ398265__SS-prME
  source 1..9876: mol_type = other RNA
accgccggaatcatcatcatgatgatccccacggtgatggctttccacctgaccacccggaacggagaaccccacatgatcgtcagccggcaggaaaaggggaagagcctactgttcaagaccgagaatggggtgaacatgtgcaccttaatggcgatggacctcggcgaactgtgcgaggacacaatcacctataactgcccgctgctcaggcagaatgagcccgaggacatcgactgctggtgcaattccacctccacctgggtgacgtacggtacctgcaccgccaccggggagcatcgaagagaaaagcggtcagtcgccctcgtgccccacgtgggcatggggctggaaacgcgcactgaaacctggatgtccagcgaaggagcctggaagcacgcccagcggatcgagacctggatccttcgccaccccgggttcacgatcatggcggcaatcctggcttacacaatcggcaccacctacttccagagggtcctgatctttatcctcctgacggcagtgaccccgtccatggcgatgcgctgcatcgggataagcaaccgggacttcgtggagggcgtcagcggcgggagctgggtagacatcgtcttagagcacggctcctgcgtaaccacgatggcgaagaataagcccacgctcgacttcgagctgattaaaacagaggccaagcatccggccaccctgcgcaagtactgcgtagaggccaagctcaccaatactacaacagcgtcgcggtgcccaacccagggggagccctccctgaacgaggaacaagacaaacggttcgtgtgcaagcacagcatggtcgaccggggatggggcaacgggtgtggtctgttcgggaagggcgggattgtcacgtgtgcgatgtttacgtgcaaaaagaacatggaaggcaaagtggtccagcccgagaacttggagtatacaatcgtgatcacaccgcattctggcgaggagaacgccgtgggaaacgataccggtaagcacgggaaggagatcaaggtcaccccgcagtcatccatcaccgaagcggagctgacgggctacgggaccgtgaccatggagtgttctcctcgaaccggactggacttcaacgagatggttctcctgcagatggagaacaaggcctggctggttcatcggcagtggtttttagatctgcccctgccctggctgccgggtgcagacacgcaggggtcgaactggatccagaaggaaaccttagtcacttttaagaacccccacgcaaagaagcaggacgtcgttgtactgggctctcaggagggggctatgcacaccgccctcaccggtgccacagagatacagatgtcctccggaaacctgcttttcaccggccatctcaagtgccgactgcggatggacaagctgcagctcaagggcatgagctactccatgtgtaccgggaagttcaaggttgtaaaagagatcgcggagacacagcatggtacgatcgtcatccgcgtccagtatgagggggacggcagcccgtgcaagatacccttcgagatcatggacctggagaagcggcacgtgctcggcagactaatcaccgttaacccgatcgtcactgagaaggactcccctgtgaatatcgaagcagagccgccgttcggggacagctatatcatcatcggcgtggagccggggcagctgaagctgtcctggttcaaaaaggggtcatccatcgggcagatgttcgagaccaccatgcgcggtgcgaagcggatggccatcctaggcgacacggcctgggatttcggcagcctgggtggcgtcttcacctccatcggcaaagccctgcaccaggttttcggggccatctacggcgccgcgttcagcggcgtttcttggacgatgaagatcttgatcggggtcgtgatcacgtggatcggcatgaatagccgctcgactagcctgtccgtcagcctggtcctggtcggggttgtcaccttgtacttgggagtaatggtgcaagctgactccgggtgcgtcgtgtcgtggaagaataaggagctgaagtgcggctcgggtatcttcatcacggacaacgtgcacacatggaccgagcaatacaagttccagccggagtcccctagcaagctcgcctccgccatccagaaagcccacgaggaggggatttgtggcataagaagtgtgactcgcttggagaacctgatgtggaaacagatcacaccggagttgaatcacatcctgaccgagaacgaggtgaagctgactatcatgactggagacataaaaggcattatgcaggccgggaagcggtccctcaggccccagcctactgaactgaagtactcgtggaaggcgtggggcaaggccaagatgctgagcactgagctccacaatcacacgttcctgatagacggccccgagacggccgagtgtccgaacacgaaccgggcctggaacagcctggaagtcgaagactatgggttcggggtcttcaccacgaacatctggttgaagctgaaggagcgccaggatgtgttctgtgactccaagcttatgtctgctgcgatcaaggataaccgggcggttcacgctgacatggggtattggatcgaatccgccctcaacgacacctggaagatcgagaaggcgagcttcatcgaggtcaagtcctgccactggcccaagtcgcacaccctgtggtcgaacggcgtgctggagagtgagatgatcatacccaagaacttcgcaggccctgtcagccaacacaactaccgcccggggtaccacacccagacggctggcccctggcacctcggtcggctggagatggattttgacttctgcgaggggacgactgtcgtggtgaccgaggactgcgggaaccggggccccagcctgcggaccacgaccgcatcaggcaagttaatcaccgagtggtgctgcaggtcctgcactctgcccccactgcggtaccgcggggaggatggctgctggtacggcatggaaatccgtcctctcaaggagaaggaagagaacttagtcaactcactggtgacggcggggcacgggcagatcgacaacttctccctcggcgtgttaggtatggcgctgttcctcgaagagatgctgcgcacccgggtcgggaccaagcatgccatcctgctcgtggcagtatccttcgtcaccctgatcactggcaacatgtccttcagagacctgggccgcgtgatggtgatggttggagccaccatgaccgatgatatcggtatgggcgtgacctacctagccttgctggcggccttcaaggtgcggcccacgttcgccgcaggcctccttttacgaaagctcaccagcaaagagctgatgatgaccactatcgggatcgttctgctctcccagagcacgatccccgagtccatcctggagctaaccgacgccttagcgctgggcatgatggtgctgaagatcgtccggaacatggagaagtaccagcttgccgtgactatcatggccatcctgtgcgtgccgaacgccgtcatattacagaacgcctggaaggtgtcctgcacgacgcttgccgtggtctccgtcagccccctgctgctcacctcctcgcaacagaaagccgactggatcccgctggccctcaccatcaaggggctcaacccaaccgccatcttcctaactaccctgagcaggaccaacaagaaacggagctggccgctgaacgaggcgattatggctgtgggtatggtaagtatcctggctagctcactgctcaagaacgatatcccaatgaccggcccgctggttgccggaggccttctcacggtgtgttatgtcctgaccggccgcagcgccgacctggagctcgagcgggcggccgacgtaagatgggaggagcaggccgagatatcaggctctagccccattctttccataaccatcagcgaagacgggtccatgtcaatcaagaacgaggaggaggagcagactctgaccatccttatcagaaccggcctgttggtgatttcgggcctcttcccggtgagcatccccatcacagccgccgcgtggtacctgtgggaagtcaagaagcagcgcgccggggtgctgtgggatgtccccagcccacctcccgtgggcaaggctgaattagaagacggagcctaccggataaaacaaaagggcatcctggggtattctcagatcggagccggggtatacaaagaggggaccttccacaccatgtggcacgtcacgcgcggcgcggtgctcatgcacaagggcaagcggatcgagccctcctgggctgacgtgaagaaggacctcatcagctatggaggcggctggaagttggagggcgagtggaaagaaggggaggaagtccaagtgctggccctcgagccaggcaagaatccgcgcgccgtacaaaccaaacccgggctgttcaagaccaacaccggtacgataggggcagtctctctggactttagccccggcacatccgggagtcccatagtggacaaaaaggggaaggtagttggcctctacgggaacggcgttgtgacccggtccggcacatacgtctctgccatcgcccagacggaaaagtccatcgaggacaacccagagatcgaagacgacatcttccgaaaaaagcggctgaccatcatggacctgcaccccggggccggaaagaccaagcgatacctgcccgccatcgtgcgcgaggcaatcaagcgggggctccggaccctgatcttagccccgacgcgggttgtcgcagccgaaatggaggaggccctccgcggcctgcccatccggtaccagacacccgcgatccgcgctgagcacaccggacgggagatcgttgaccttatgtgccacgcaaccttcacgatgcggctcttaagccccattcgggtgccgaactacaacctaataatcatggacgaggcccacttcaccgaccctgccagcatagctgcccgcggatacatctccaccagagtagagatgggcgaagccgccgggatctttatgactgccacgccgcccggcagcagggacccgttcccccagtccaacgccccaatcatggacgaggagcgggagatccccgagcgctcatggaactcagggcacgagtgggtaaccgacttcaaggggaagacggtgtggtttgtcccgagcatcaaggccgggaacgacattgccgcctgcctgcggaagaacggcaagaaggtgatccagctatcacgcaagacatttgatagcgagtacataaagacgcggaccaacgactgggattttgtagtcaccacggacatctccgagatgggcgcgaactttaaggccgagcgcgttatcgacccacggcgctgcatgaagccagtaatcttgactgacggagaggagagggtgatcctcgcaggacctatgccggttactcatagttcggcagcccagcgcagggggcgcgtgggccgaaaccccaagaacgagaacgaccagtatatctacatgggggagcccttggagaacgacgaggactgtgcgcattggaaggaggccaagatgctcctagataatataaacacccccgagggtatcatcccgagcatgtttgagccggagcgggagaaggtggacgccatcgacggcgagtaccgcctgcgcggggaagcacgcaagaccttcgtagacttaatgcggcgcggcgacctccccgtctggctggcctaccgggtggcggccgagggtatcaactacgcggacagacggtggtgctttgacggcgtcaaaaacaaccagatcctggaggagaacgtcgaggttgagatatggacgaaggagggggagagaaagaagctcaagccgcggtggctggacgcccgcatctattcggaccccctggccctcaaggagttcaaggaatttgcggccgggcgaaagtcccttaccctaaacctcatcactgagatgggccgcctacccaccttcatgacacagaaggccaagaacgcgctggacaacctcgcggtcctacacacggccgaggccgggggacgggcctacaaccacgccctgagtgagctccccgagaccctggagaccctgttgctgctgacgctcctggcgaccgtcaccggaggcatatttctgttcctcatgtctggcaaggggatcggcaagatgacactggggatgtgctgtatcatcaccgcctccatcctgctctggtatgcccagatccagccgcactggatcgccgcctctatcatcctggaattcttcttgatcgttttacttatccccgagcccgaaaaacagcgcacgccccaagacaaccagctgacctatgtcgtcatcgctatcctcaccgtggtggccgccaccatggctaacgagatgggcttcttagagaagacgaagaaggacttcgggctgggctccatcaccacccagcaaccggaaagcaacattctcgacatagacctgcggcccgcctccgcgtggacgctctacgccgtcgcaaccaccttcatcacccccatgctccgacactccatagagaacagctccgtgaacgtgtctctgaccgccatcgctaaccaggcaacggtcctgatggggctcggcaaaggctggcccctgtccaagatggacatcggggtgccgctgctagccatcggctgctacagccaggtgaaccccatcaccctgaccgccgccctgctcttactggtcgcacactacgccatcatcgggcccggcctccaggccaaggccacgcgtgaggcccaaaaacgcgcggctgccggcataatgaagaaccccaccgtagatggaatgaccgtgatagacttggatccaattccctacgacccaaagttcgaaaagcagcttggccaggtcatgctcctggtgctgtgcgtgacccaagtcctcatgatgaggaccacgtgggctctgtgcgaggccctgaccctcgctaccgggcccatctccaccctttgggaggggaatcccgggcgattttggaacactaccatcgctgtgagcatggccaacatcttccgcggatcctacctggcgggcgccgggcttctgttcagcatcatgaagaacaccgcgaatacccgtcgcggaacgggaaacaccggcgagaccctgggcgagaagtggaagaaccgtctcaacgccctggggaagtcggagttccaaatctacaagaagtccggcattcaggaggtcgaccgcaccctcgccaaggaggggatcaaacggggcgagacggaccaccacgccgtctcccgagggagcgcgaagctcagatggtttgtggagaggaacttggtaacccccgagggcaaggtcgtcgacctgggctgtgggcggggtggttggtcctactactgcggcgggctcaagaatgtgaaggaggtcaagggactgaccaagggggggcccggccacgaagagcccatcccgatgtcaacgtatgggtggaacctcgtgcgactccagtccggcgtggacgttttcttcacgcccccggagaagtgtgacaccctgctgtgcgacatcggggaaagctcccccaaccccaccgtggaggccggccggaccctccgcgtgctaaacctggtcgagaactggctcaataacaacacccagttctgcatcaaggtgctcaacccatacatgccctccgtaatcgaaaagatggaagccctgcaacggaagtacggcggtgccctagtgcgtaacccgctctctcggaactccacgcacgagatgtactgggttagcaacgcttcaggcaacatcgtgagctccgttaacatgatcagccggatgctgatcaaccgattcaccatgcgtcataaaaaggctacttacgagcccgacgtggacctgggctccggtacccggaatattgggatcgagagcgagacgcccaacctcgacatcatcggcaagcgcatcgagaagatcaaacaggagcacgaaacctcctggcactacgaccaggaccacccctacaagacctgggcttatcacggatcatacgagaccaagcagacggggtccgccagctccatggtcaacggcgtcgtacgcctgctgaccaagccgtgggacgtgatccctatggtcacgcagatggccatgaccgacaccacccccttcgggcagcaacgggtgttcaaggagaaggtcgacacccgcacccaggagcccaaggagggcacgaagaaactaatgaagatcactgccgaatggttgtggaaggagctcggcaagaagaagaccccgaggatgtgcacccgcgaggagttcacgagaaaggttcgcagcaatgcggctctcggggcaatcttcaccgatgagaacaagtggaaatccgcccgggaggccgtggaggactcgggcttctgggagctggtcgataaggaaaggaacctccacctcgaggggaagtgcgagacatgtgtgtacaacatgatgggcaagcgggagaagaagctgggcgagttcggcaaggcaaagggctcccgcgccatctggtacatgtggctgggtgccaggtttctcgagttcgaagccctgggttttctgaacgaggaccactggttcagccgcgagaacagcctcagcggggtcgagggagaggggcttcacaagctaggctacatcctccgggacgtcagcaagaaagagggcggcgcgatgtacgctgacgatacggccggctgggacacgcgcatcaccctggaggacctgaagaacgaggaaatggtgactaaccacatggagggtgagcataagaaattggccgaggccatcttcaaactgacctatcaaaacaaggtggtgcgtgtgcaacgccccacgccccggggcaccgtgatggacatcatctcccgccgtgaccagcgaggcagcggccaagtcgtgacctacgggctcaataccttcacgaacatggaggcgcagctaatccggcagatggagggggagggagtcttcaagagcatccagcagctgaccgttaaggaagagatcgccgtgaagaattggcttatccgcgtggggcgcgaacggctcagcagaatggccatcagtggcgacgactgcgtagtgaaacccctggacgaccggttcgcgagcgccttaaccgcactcaacgacatgggcaaagtgcgcaaggatatccagcagtgggagccgtccagagggtggaacgactggacccaggtacccttctgctctcaccatttccacgagctgataatgaaggacggccgcgtgctagtggttccgtgccgtaaccaggacgagctcatcggtcgggcccgtatctctcagggcgccgggtggagcctccgagaaacggcctgtctcggaaagtcctacgcccagatgtggagccttatgtacttccaccgccgcgatctgcggctggcggccaacgcgatctgctccgccgttccctctcactgggtacctacttccagaaccacctggagcatacacgccacgcacgagtggatgacaaccgaggacatgctcacagtctggaaccgggtgtggatccaggagaacccatggatggaggacaaaacccccgtcgagtcttgggaggagatcccctatctgggcaagcgggaggatcaatggtgcgggagtctgatcgggttgacctcccgggctacatgggcaaaaaacatccagacagccatcaaccaggtccgctcccttatcggtaacgaggagtacactgattacatgccttcgatgaagagattccggcgcgaggaggaggaggccggcgtcttgtggtga

SEQ ID NO: 25565 - RNA, 9876 nt, synthetic construct
  misc_feature 1..9876: note = derived and/or modified CDS sequence (opt11) from DENV-2__KX702403__SS-prME
  source 1..9876: mol_type = other RNA
accgcgggagtgattgtcatgttgattcccaccgcaatggcgttccatctgacaacccgcaatggggaaccacatatgatagtaggacgccaagaaaaagggaaatcactactattcaaaactgaagacggtgtaaacatgtgcacactaatggcaatcgatctaggggaactctgtgaagacactataacatacaaatgcccattattacggcagaacgaacccgaagacatcgattgttggtgcaactctaccagtacatgggttacctacggcacctgtacaaccaccggggaacacaggcgcgaaaaacgttcggtcgccttagtgccacacgttggtatgggactcgaaaccagaacagaaacctggatgagcagcgaaggcgcatggaaacacgtgcaaaggatagaaacgtggatcctaaggcaccccggattcaccatcatggctgcaatactagcctacaccatcggaacgacacatttccaacgagccctcattctgatcctcctgacagcagtggccccgtcaatgaccatgcggtgtataggaatatcaaaccgagacttcgtggaaggcgtatccggagggagctgggtcgatatcgttctcgaacacgggtcgtgcgtaacaacaatggcgaaaaacaaacctacgctcgatttcgaactaatcaaaactgaggccaaacaaccagcaaccttgcgaaaatactgcatcgaagccaaacttacgaacactacaactgaatcccggtgtcctacgcagggcgagccatcattaaacgaagaacaagacaaacgtttcatctgcaaacactcgatggtagatcgaggctggggcaacggatgtgggctttttgggaaaggcggtatagtaacctgcgcaatgtttacctgcaaaaagaacatggagggaaaaatcgtacaaccagagaacctggagtacacgatagtgattaccccacactcaggtgaggaacacgcagtgggaaacgacacaggaaagcacggcaaggaaatcaaaataaccccgcaaagcagcacgacggaggccgaattaaccggatacgggaccgtaaccatggagtgcagcccacgcactggcctagacttcaatgagatggtcctccttcaaatggaagacaaggcatggttggtgcaccgccaatggtttctagacctgcccctcccctggctaccaggagcagatacacagggtagcaactggatccaaaaggagaccctcgtcaccttcaaaaatccacacgccaagaaacaggacgtcgtagtcctaggcagccaagagggcgccatgcataccgcgcttacaggggcaacggagatccagatgagctctggcaacttactatttacgggccacctaaaatgccgtctcaggatggataaacttcaactaaaaggcatgagctacagcatgtgcaccggaaagttcaaaattgtcaaggaaatagctgaaactcaacacggaaccatagtgatacgggtccagtacgagggagacggcagcccttgcaagatccctttcgagatcaccgacctcgagaaacgacatgtactcgggaggcttatcaccgtcaacccaatagtcaccgagaaggactcaccagtcaatatcgaagccgaaccgcctttcggtgacagctatatcatcgtgggggtcgagcccggccaactcaaactcaactggttcaaaaaggggagcagcatagggcaaatgtttgagacaaccatgcgaggcgcaaaaagaatggcaattctcggggacacagcatgggatttcggtagtctaggcggcgtgttcacatcaatcggaaaagcactgcaccaggtcttcggcgccatatacggagccgcgttcagcggcgtctcatggactatgaagatactgataggcgtaatcatcacatggataggcatgaactccaggtcgacaagtctaagcgtgagcctagtgctggtgggagtcgtcacgctctatttaggggccatggtccaagcggattcagggtgcatcgtatcctggaaaaacaaagagctaaagtgcggatctggaatctttataacagacaatgttcacacatggacagagcagtacaaattccaaccagagtcgccgtcgaagctggcatccgccattcaaaaagcacacgaagaaggaatctgtggaatccgcagcgtcacacgattggaaaatctcatgtggaaacaaatcaccccagaattgaaccacattctcagcgaaaatgaagtaaaactaactataatgacgggcgacataaaaggaatcatgcaagccggaaaaagatccctcagaccacagcccacagaactaaagtactcctggaagacctggggaaaggccaagatgttgtcaacggagagtcacaaccagacatttctcatagatggcccggaaacagcagagtgccctaatactaaccgcgcatggaatagcctcgaagtcgaggattacggtttcggagtattcacgacaaacatctggctaaaactaagagagaaacaagatgtcttctgcgactctaaacttatgtcggccgcgatcaaagacaaccgcgcggtgcatgcggacatgggatactggatcgaaagcgcgctcaacgatacgtggaaaatggaaaaagcgagcttcatcgaggtcaaaagctgccactggccgaaaagccacaccctatggagcaacggggtgttagagtccgagatgataattccgaagaacttcgcaggcccagtaagccaacacaattaccggcccggatatcatacacaaacagcagggccctggcatctgggaaaactagagatggacttcgatttctgcgagggcaccactgtagtggtgaccgaagactgcgaaaagcgaggaccgtccctcagaacaaccactgccagtggcaagctcattacagagtggtgttgccgcagctgcaccctcccacccctccgatatcgcggcgaagacggatgttggtacgggatggagatacgccctttaaaagaaaaggaagaaaacctggtcaactcactggtaacggcaggacatggacaaatagacaatttttcgctaggagtcttaggaatggcgttgttcctagaagaaatgcttcgcacgagggtgggaacgaagcatgctatactactcgtagcgctgagcttcgtaaccctaattacgggaaatatgagttttcgcgacctcggccgagtgatggtgatggtcggagccactatgacagacgatatcggaatgggagtaacctatctggctctactggcggcatttaaagttcgaccaacatttgctgccggactactgctgcgaaagctgacatctaaagagctaatgatggcaacaataggaatagcgttgctttcccagtccacgctacctgaaacgatcttagaactcacagacgccctcgccctcggcatgatggcacttaaaatagttcgcaacatggaaaagtatcaattagcggtgacaataatggcgatctcttgcgtacccaacgcagtaatcctccaaaacgcgtggaaagtatcatgtactatactagctgcagtgtccgtctccccgctgctactcaccagttcacaacaaaaagcagactggatcccactcgcgctgaccatcaagggcctcaaccccacagcgatattccttaccacactctcccgtacaagcaagaaacgctcttggccattaaatgaagcgatcatggctgtggggatggtatcaatattagcgagcagcttactaaagaacgacatcccaatgacagggccacttgttgcgggcggcctccttaccgtgtgttacgtactaaccggaaggtccgctgatcttgaactggagagagcagcagatgtaaagtgggaagaccaagcagaaatcagcggctctagccccatcctgtccatcacgatctcagaagatgggagtatgagtatcaagaatgaagaagaggagcagacgcttacgatactcatacgcacaggcctgctcgtaatctctggggtattcccagtgtccataccgataacagccgcagcgtggtacctatgggaggtcaagaaacagcgagcgggagtactgtgggacgtacccagtcccccgccggtggggaaggctgagttagaggatggcgcatacagaatcaaacaaagagggattcttggctactcccaaatcggagcaggagtttacaaggaaggaacattccacacgatgtggcatgtaacacgtggcgcggtgctcatgcacaggggaaagagaatcgaaccgtcctgggctgacgtgaagaaagacctaatctcttacggagggggatggaagctagaaggcgaatggaaggagggggaagaggtacaggtcctcgctcttgagccagggaaaaacccacgcgccgtacaaactaaaccaggaatcttcaagactaacaccggcacaataggggcggtgagcttggacttcagccccgggacgtcggggtcccccatagtcgaccgcaaggggaaggtcgtaggactttacggtaatggggtggtaaccagaagcggggcttatgtcagcgcaatagcccagactgagaagtcaatagaagataacccggaaatagaggatgacatctttcgaaagaaaagactcaccatcatggacctacacccaggcgccggaaaaacgaagagatacttgccggccatagtacgagaagcaataaagaggggactgagaaccctgatcctagccccgacccgagtagtagcggccgaaatggaggaagcactacgagggctgccgatcaggtaccagacacccgcaatccgggccgaacacacgggacgggagatcgtcgaccttatgtgccacgcgacgtttaccatgcggctactgtcccccgtgagggtgccaaactacaacttaatcatcatggacgaggcacactttacagaccctgcgagtatagccgcacgtggatacataagcacccgcgtcgaaatgggcgaagccgcaggtatatttatgaccgcgacgcccccggggtcaagggacccattcccacaaagcaacgcaccgataatggacgaggagcgtgaaataccggagcgctcatggaacagtggccatgaatgggtaacagattttaagggcaagacagtatggttcgtgccaagcataaaagccgggaatgacatcgcagcctgcttacgcaagaatggcaagaaagtaatacaacttagcagaaaaacatttgacagtgagtacgtaaaaactcgcgccaatgactgggatttcgtggtcacgacagatattagcgaaatgggagcaaacttcaaagccgagagggtgatcgacccaaggcgttgtatgaagccagttattttaaccgacggcgaagaaagagtcatactcgccgggccgatgcccgtaacgcattccagtgccgcccagcgacgaggaagaattggccgaaaccctaaaaacgagaatgaccaatacatatacatgggggaaccgctggaaaacgacgaagattgtgcccactggaaggaggccaaaatgctactcgacaacatcaacacgcccgaaggaatcatcccgagcatgtttgagcccgaacgggagaaagtagacgccatagacggtgaataccggttaagaggagaggcgcgcaaaactttcgtggacctaatgcggcgtggcgacctgcccgtctggttggcctacaaagtagccgcagagggaataaactatgcagaccgcaagtggtgcttcgacgggatcaaaaacaaccagatactagaggaaaacgttgaagtcgaaatctggactaaagaaggggagaggaagaaactcaaaccccggtggctcgacgctagaatatattcagacccgctcgcactaaaagagttcaaggagttcgctgcaggcagaaaaagcctaaccctgaacctgataaccgaaatggggcgattgcccaccttcatgacgcaaaaagcccgaaacgcgctcgacaacctagctgtattgcatacagccgaagtgggaggcaaggcttatacacacgcactcagtgaactcccagaaacactggagacattactgttactcactctactagcagctgtcacaggaggaatatttctcttcctcatgagcggcaagggtatcggcaaaatgaccctcggtatgtgctgcataattaccgctagcatactcctgtggtatgcacaaattcaaccacactggatagccgcaagcatcattctcgagttcttcctcattgtcctactaatacccgagccagagaagcagcgcactccccaagataatcaactaacatacgtcgtaattgcaatattaacagtggtcgctgccaccatggctaacgaaatgggtttcctagaaaagaccaaaaaggacctggggttcgggtcgattacgacgcaagaatccgaaagcaacatactggacatcgacctcaggcccgcatctgcgtggaccctttacgccgtcgcgactactttcgtaaccccgatgcttcgtcacagcatagagaactcatcggtcaatgtaagcctaaccgccatcgccaatcaggccacagttctgatgggattgggcaaagggtggccgctaagcaaaatggatatcggcgttcccctgctggcaatcgggtgttattcccaagtgaatcccatcacactgacggctgctctcttactactcgtagcacactatgcgataataggccccggcttgcaagccaaagccactcgagaagcccaaaaacgagcagcagcaggcataatgaagaacccgactgttgacgggatcacagtcatagacctagaaccgatcccgcacgatcctaaattcgagaaacagctgggtcaagtcatgttgcttatactgtgtgtaacgcaagtcttgatgatgcgaaccacctgggctctctgcgaagccctaactctggcgactgggcctatcagcaccctctgggaaggaaacccgggccgcttctggaataccacaatagccgttagtatggctaacatctttcggggctcgtacctcgctggagccggcctattattctcgattatgaagaatacaacgaacaccagacgtggaaccggtaatgtgggagagacgctaggagaaaaatggaaaagccgcctcaacgcactaggtaagagcgagtttcaaatatacaagaaatcaggtatccaggaggtcgaccgaacgcttgctaaggagggcatcaaacgaggagaaacggaccaccacgccgtcagcaggggaagcgcaaaattgagatggttcgtcgaaagaaacatggtgaccccggaaggtaaagtcgtagacctcggctgtggacggggaggctggagctactattgtgggggccttaagaatgtgagggaagtcaagggcctaacgaagggcgggccaggacacgaagaaccaatcccaatgagcacttacggatggaacctggtgcgcttgcagagcggagtcgacgtattctttacacccccggagaaatgcgacaccttgctgtgtgatattggtgaaagcagccccaaccctaccatagaggccgggcgaaccctgagagtactgaacctggtagaaaactggctgaataataatacccaattctgcatcaaggtactcaacccatatatgccatcagtcatagagaagatggaaaccctacagcgaaagtacggcggtgcacttgtaagaaatccccttagtcgaaatagcacacatgaaatgtactgggtgagcaacgcaactggcaacatcgtcagcagtgtgaacatgatctcacggatgctcatcaaccgatttacaatgaagcataaaaaggcgacctacgagcccgacgtcgacttgggaagtggcacgcggaacattggtatcgaaagcgaaacaccgaacctagacataataggaaaacggatagagaaaataaaacaagaacacgagacatcgtggcattacgaccaagaccatccctataaaacctgggcgtaccacggttcttacgaaactaagcaaacgggatcagcctccagtatggtgaatggcgtagttaggctcttgacaaagccatgggacgtggtacccatggtcacccagatggcaatgacagacacgaccccgtttggacagcaacgagtattcaaagaaaaggttgacacgagaacccaggaaccgaaagagggcacaaagaagttaatgaagattacagctgaatggctttggaaagagttagggaaggagaaaacaccccgcatgtgcacacgagaggagtttacgcgcaaagtaagaagtaacgcagccctgggcgccgtattcacagatgagaacaagtggaagagtgctcgtgaggccgtagaggacggccgtttctgggaactcgtggacagagaaagaaacctccacctcgaaggcaaatgcgaaacctgcgtctacaatatgatggggaaaagagagaagaaactgggtgagttcggcaaagccaaaggtagcagagctatatggtacatgtggcttggagcccgattccttgagttcgaagcactcggcttcctgaacgaagatcactggttcagccggggtaatagcctaagcggcgtagaaggcgagggcctccaccgcctcggctacatcttacgagaagtcgggaaaaaggaagggggtgcaatgtacgcagatgacaccgcagggtgggacacgcgaatcacgctggaggacctcaagaacgaggagatggtgacaaaccacatgaaaggcgaacataagaaattagcagaggccatatttaagctcacctaccaaaacaaagtagtccgcgtacaaagaccgacaccacgaggcacggtaatggacatcatctctagaaaagaccaacgcggttcaggccaagttggcacttacggcctcaacaccttcaccaacatggaggctcaactcatccgacagatggaaggagaaggcatcttcaaaagcattcagcatctgacggccacagaggaaaccgccgtacaaaactggctcgcacgagtaggacgagaaagattaagtaggatggcaatctcaggagacgactgtgtagtcaagccaatagatgaccggttcgctagtgccctgaccgctctcaacgacatgggaaaagtgcgaaaagatattcaacagtgggaaccatcacggggctggaacgactggactcaagtgccgttctgctcacaccactttcacgagctagtaatgaaggatggccgagtacttgtagtcccctgccgaaaccaagatgagctaataggtcgggccagaatcagccagggtgcgggatggagtctcaaagagacagcgtgcctcggaaaaagctacgcacaaatgtggacactcatgtacttccataggagagatctccgccttgccgcgaacgcaatatgttccgcagttccgtcacattgggtcccaacctcgagaacgacatggtcgatccacgccaaacacgaatggatgacaacggaggacatgttggcagtatggaatagggtctggattcaagagaatccgtggatggaagacaagacccccgttgagtcgtgggaagaagttccatacctcggaaaacgggaggaccaatggtgcggaagcctaatcggcctgacatcaagagcaacctgggcaaagaatatccagacggcgattaatcaagtgcggagcttgattggaaacgagggctacacagattacatgccgtccatgaaacgcttcagacgggaggaggaagaggcaggagtactatggtga

SEQ ID NO: 25566 - RNA, 9876 nt, synthetic construct
  misc_feature 1..9876: note = derived and/or modified CDS sequence (opt11) from DENV-2__KX702404__SS-prME
  source 1..9876: mol_type = other RNA
accgccggcgtgatcgtcatgcttatccccacggcaatggcgttccacctcaccactcggaacggggaaccccacatgatcgtgggccggcaggagaaaggaaagagcctcctgtttaagacggaggatggcgtgaacatgtgcacacttatggccatcgacctgggggagctgtgcgaggataccataacctataagtgcccgctcctacgccagaacgagcccgaggatatcgactgctggtgcaacagcaccagcacttgggtcacctacggcacctgcactaccacgggagagcaccgccgcgagaagaggtccgtggccctggtgccccatgtcgggatgggactcgagacccgcaccgagacctggatgagctccgagggggcctggaagcatgtccaacggattgagacctggatactgagacacccgggctttaccatcatggccgcaattctggcgtacaccatcgggaccacccatttccagcgcgcactcattttcatcctcctgaccgctgtggcgcccagcatgaccatgcgctgcattggcatatccaaccgagacttcgtagaaggcgtatcgggaggctcctgggtggacatcgtcctagagcacggtagctgtgtgacgacgatggccaagaacaagcccacactggatttcgagctgatcaagaccgaggccaagcaaccagccaccctccgcaagtactgcatcgaggccaagttgacgaacaccaccacggaatccagatgccccacgcaaggcgagccgagccttaacgaggagcaggacaagcgcttcatctgcaaacattcaatggtggatcggggctgggggaacggctgcggcctgttcggcaagggaggtatagtgacttgcgcgatgttcacatgcaaaaaaaacatggagggaaaggtggtgcagcctgaaaacctggagtacaccatcgtcatcacgccccactcaggggaggaacacgcagtcggcaacgatactgggaagcacgggaaggaaattaagatcaccccgcaatcaagcaccaccgaggccgagctgacaggatacggcaccgtgacgatggagtgttcccctcgcacgggtctcgatttcaacgagatggtcctgctccagatggaggataaggcctggctcgtgcacaggcagtggtttttagacctgcccctcccctggctgccaggggccgacacgcagggcagcaactggatccagaaggagacgctggtgaccttcaaaaacccccacgccaagaaacaggatgtcgtggttctcggatcccaggagggtgccatgcacaccgccctgacgggcgcaaccgagatccagatgagctctggcaacctcttattcaccggccacctgaagtgtcgcctgcggatggacaaacttcagctcaaagggatgtcctattccatgtgcactggcaaattcaaggtggtgaaggagattgcagaaacgcagcacggcaccatcgtcatccgcgtgcagtacgagggggacggctccccctgcaagatccccttcgagatcacagacctggagaagcgacacgtgttaggccgcctgatcacagtcaaccccatcgttacggaaaaggacagccccgttaacatcgaagctgagccccccttcggcgactcctatatcatcgtcggtgtagagccgggccaactgaagctcaactggttcaagaaggggtcgtccatcggccagatgtttgagaccaccatgcgaggtgccaagcggatggcgatattgggggacaccgcatgggacttcggcagcctcggaggcgtgttcacgagtatcgggaaggctctacatcaagtcttcggcgcgatctacggcgcagccttcagcggagtttcctggacaatgaagatactgatcggcgtgattatcacctggatcgggatgaactcgcgctccaccagcctatcagttagcctggtactcgtgggcgtggtgacgctgtacctgggggccatggttcaggcggactccggctgcgtcgttagctggaagaacaaggagctcaagtgcggctcagggatcttcatcactgacaacgtgcacacctggactgagcagtataagttccagcccgagagccccagtaagctggcctccgccatccagaaggcccatgaggagggcatctgcggcatccgcagcgtcacgcgcctggagaacctaatgtggaagcagatcactcccgagctcaaccacatcctgtccgagaacgagatcaagctaaccatcatgaccggcgatattaagggcatcatgcaggccggcaagcggtcacttagaccacagcccacggagctgaagtactcctggaagacctggggcaaggcgaaaatgctctccacagagtcccacaaccagaccttcttaatcgacgggccagaaactgccgaatgtcctaacaccaatcgggcctggaatagcctagaagtggaggactacgggttcggtgtgttcacaaccaacatctggttgaagctgcgcgaaaagcaggacgtcttctgcgactccaagcttatgagcgctgccatcaaggacaaccgggcggtgcacgccgacatgggctattggattgagtccgcgctcaacgatacctggaagatggagaaggcgagcttcattgaggtcaagtcctgccactggcccaagtcgcacacgctttggagcaacggcgtcctggagagcgaaatgattatcccgaagaacttcgccggccccgtgtcccagcacaactaccgccccgggtaccacacccagaccgcggggccctggcatctgggcaagctggagatggacttcgacttctgcgaagggaccacggtggtagttaccgaggactgcggcaaccggggtcctagcctccgtacaaccacggccagcgggaagttaatcaccgagtggtgctgccggtcctgtaccctgcctccattgaggtatcgcggcgaggacgggtgttggtacggcatggagatcagaccactaaaggaaaaggaggaaaacctggttaacagcttggtaaccgccgggcacggccagatcgacaacttctccctcggggtgctaggtatggcactcttcctcgaggagatgctgcgtacgcgggtgggcaccaaacacgcaattctgctcgtcgctctgtcattcgtgacgctaatcaccgggaacatgtccttccgggacctgggccgcgtaatggtcatggtaggagccacgatgaccgacgacatcggcatgggcgtgacatacctggccctgttggccgcgtttaaagtcaggccgaccttcgccgcagggctgctgctccggaagctcacgagcaaggaactgatgatggccacaatcggcatcgccttactgtcacagtctaccctgcccgagacgattctcgagctgacggacgctctcgctctcggtatgatggccctgaagatcgtccgtaacatggagaagtaccagttagcggtgaccatcatggccatctcctgcgtcccgaacgctgtgatcctgcagaacgcctggaaagtaagctgtaccattctggctgccgtctccgtgagccccctgctgctgacctcctctcagcagaaggccgactggatccccctggccctcaccataaagggccttaatcccaccgccatcttcctgactaccctctcccggacaagcaagaagaggtcatggcctctgaacgaggccatcatggcggtcggcatggtctcaatcctggcgtccagcctcctgaagaacgatatccccatgaccgggccactggtggccggaggactcctgacggtctgctacgtgctcaccggtcggagcgccgacctcgagctggagcgcgcggcagatgtgaagtgggaagaccaagcggagatttccgggagctcaccgatcctgagcatcacaatctcggaggacggcagcatgagtatcaaaaacgaggaggaggagcagacgctcaccatcctgatccgtactggcctgctagttatcagcggggtgttcccagtatccatccccatcaccgctgcagcttggtacctgtgggaggttaagaagcagcgcgccggcgtgctgtgggacgtgccctctccgccgccggttgagaaggcggagctggaggacggggcctaccggattaagcagcgcggcatcctaggttactctcagatcggcgccggcgtgtacaaggagggcacgttccacacgatgtggcatgtgacccgaggggcagtcctgatgcatcgggggaagaggatagagcctagctgggcggacgtgaagaaggacctcatctcctacggcggcggttggaagctcgagggcgagtggaaagagggcgaggaggtccaagtcctggcgctggagcccggaaaaaaccctagggccgtgcaaacaaagcccgggatcttcaagaccaacaccggaaccatcggcgcggtgagcctggacttctcgcccggcacgtcgggcagccccatcgtcgaccggaagggaaaagtagtcggtctgtatgggaatggggtcgtaactcgcagcggcgcctacgtgagtgcgatcgcgcaaaccgagaagtccatcgaggacaaccctgaaatagaggacgacatattcaggaaaaagcgcttgaccatcatggaccttcaccccggggctggcaagaccaagcgatacctgcccgcaattgtccgcgaggccatcaaacgggggctgcggactctcatcctggcacccacccgcgtagtggccgcggaaatggaggaggccctgagaggcttacccatacgctaccaaacccccgccatcagggcagagcataccgggcgcgagatcgtcgacctgatgtgccatgccacgttcaccatgcgcctgctcagcccagtgcgagtaccgaactacaacctgattataatggacgaagcccacttcaccgaccccgcttccatagccgcgcgcggctacatttcaacccgcgtcgaaatgggggaagccgccgggatcttcatgactgccacgccgcccggatcgcgagatccgtttccccagtccaacgctcccatcatggatgaagagagagaaattcccgagaggtcctggaacagcgggcacgaatgggtcaccgacttcaagggaaagaccgtgtggttcgttccaagcatcaaagctgggaacgacatcgccgcatgcctgcgtaagaacggcaagaaggtgatacagttgtcgcgcaagacgttcgactccgagtacgtgaagaccagggccaacgactgggactttgtcgtaaccaccgacatttccgagatgggcgctaacttcaaggccgagcgggttatcgacccccgccggtgcatgaagcccgtcatcctaacggacggggaggagagagtgattctggccggacctatgcctgtcacccattcctcagccgcacaacggcgcgggcgcattggccggaaccccaagaacgagaacgatcagtatatctacatgggcgagcctctcgaaaatgacgaggactgcgcacactggaaggaggctaagatgttgctggacaatatcaatacccccgagggtataattccatccatgttcgagcctgagcgcgagaaggtcgacgccatcgatggggagtaccgcctcaggggggaggcacgaaagacgttcgtggatctaatgcgccgcggcgacctacccgtgtggctcgcctacaaggtcgccgcagaggggatcaactacgccgaccgcaagtggtgcttcgacggcatcaagaacaaccagattcttgaagaaaatgtcgaggtggaaatctggacgaaggagggggagcggaagaagctgaaaccgcgctggcttgatgcccgcatttactcagaccccctggcgctcaaagaattcaaggagttcgccgccggacgtaagtccctcaccctgaacttaattactgaaatgggccggctgccgaccttcatgacgcagaaggccaggaatgccctggacaatcttgcggtactccacacggccgaagtcggcggcaaggcctacacccacgctcttagcgagttgccagagacgctcgagacgctgctgttactgacccttctcgctgcagtgactggaggcatcttcctgttcttgatgtcgggcaaagggatcggcaagatgacccttggtatgtgctgcataatcaccgcctcgattttgctgtggtacgcccagatacagccgcactggattgcggcgtccatcatactcgaattcttcctgatcgtgctactgattcccgagcccgaaaagcagcggacgccccaggataaccaactgacctacgtagtgatcgccatattaaccgttgttgccgccaccatggccaacgagatgggttttctcgagaagacgaagaaggatctggggtttggctctatcacaacccaggagtcagagtcgaacatactggacatcgacttacgtccggcaagcgcgtggaccctgtacgccgtcgccacgacattcgtgacgcccatgctgcggcactcaatcgaaaacagctccgtaaacgttagcctcaccgcaatcgcgaatcaggcaactgttctgatggggctggggaagggctggcccctcagtaaaatggacatcggggtcccgctgctggccatcggctgctacagccaggtcaacccgatcaccctcacagctgcccttctcctgctagtggcgcactatgcgatcatcgggcccggcctgcaggccaaggcaacccgcgaggcccagaaacgggcagccgccggcatcatgaaaaacccaacggtggacggaatcaccgtaatcgacctcgagcccatcccgtatgacccaaaattcgagaagcagcttggccaggtgatgcttcttattctgtgcgtcacacaagtgttaatgatgcgcactacctgggccttatgtgaagcccttacactggctaccgggcccatctccaccctctgggagggcaaccccggccggttctggaatacgacgatagccgtgagcatggccaacatcttccgaggatcatacctggccggcgcgggtctccttttcagtatcatgaaaaacactaccaacactcggcggggcaccgggaacgtgggcgaaaccctgggcgaaaagtggaagtcccgcttgaacgccctcggcaagagcgagttccagatttacaagaaatcgggcattcaagaggtcgatcggaccctggccaaggaagggattaaacgcggcgagacagaccaccacgccgtcagccggggtagcgccaagttgaggtggttcgtggagcggaacatggttaccccggaggggaaggtcgtagatctcggctgcggtcgcggcgggtggagctattactgtggagggctgaagaatgtccgggaggtgaagggcttgaccaagggcgggcctggacacgaggagcccatccccatgtccacttacgggtggaatctagttcgactgcagtccggcgtcgacgtgtttttcacgccgccagaaaagtgcgacaccctgttatgcgacatcggggagtcgagtccaaaccccacaattgaagcaggccggacccttcgcgttctgaaccttgtagagaactggctgaataacaacacccagttctgtataaaggtactgaacccgtatatgccaagcgtgattgagaaaatggagacgctgcagcggaagtacggcggggccctcgtcaggaaccccctgtcccggaatagcactcacgagatgtactgggtgtccaacgctaccggcaatatcgtgtcctccgtcaacatgatctcacgcatgctcatcaaccggtttaccatgaagcacaaaaaggccacgtatgagccagacgtggacctagggtccggcacccgcaacatcgggatcgagagcgaaatacctaacctcgacatcgtgggaaagcggattgaaaagattaaacaggagcacgagacctcatggcactacgaccaagatcacccctacaagacctgggcctaccacggatcttatgagacgaaacagaccggttccgcgtcatcaatggtcaacggcgttgtgcgcctgctcaccaagccctgggacgtcgtcccaatggttacacagatggctatgacggacaccacccccttcgggcaacagcgcgtcttcaaggaaaaggtggatacccggacgcaggagcctaaggagggcaccaagaagctgatgaagatcacagccgagtggttgtggaaggagctcgggaaggaaaagacgccccgaatgtgcacacgtgaggagtttactcgcaaagtgcgaagcaatgcagctctgggggcggtctttaccaacgagaataagtggaagtcggcccgagaagcagtggaagatggaagattttgggagttagtcgaccgcgagcggaacttgcacctggaggggaagtgtgagacgtgtgtgtacaacatgatgggcaaacgcgagaagaaacttggcgagttcggtaaggccaagggaagccgggcgatctggtacatgtggctcggggctcgtttcctcgagttcgaggcactcggtttcctcaacgaggaccactggttctcacgggggaacagcctgtcaggcgttgaaggggagggcctgcaccgcctcgggtacatcctacgggaggtagggaagaaagagggcggcgccatgtacgccgatgacaccgcaggatgggacacgcggatcacgctggaggatttgaagaacgaggagatggtgaccaaccacatgaagggggagcacaaaaagctggccgaggccatcttcaagctgacctaccaaaacaaggttgtccgggtgcagcgcccgaccccccggggaaccgtgatggacatcatctcgcgcaaggaccagaggggtagcgggcaggtcggcacctatggattgaacacgttcaccaacatggaagctcagctgatccgccagatggagggcgagggaattttcaaatccattcaacacctgaccgccaccgaggagatcgcggttcagaactggctcgcccgcgtggggcgggagaggcttagcaggatggccatttccggcgacgactgcgtagttaagcctatcgacgaccgatttgccagcgccctgacggccctcaacgacatgggcaaggtccggaaagacattcaacagtgggaaccatccaggggctggaacgattggacgcaggtcccgttctgtagccaccacttccatgagctggtgatgaaggacgggcgggtgctggtcgtcccctgccgaaaccaggacgagttgatcggccgggcccgcatctcgcagggggccgggtggtctctgaaggagaccgcgtgcctgggcaagtcctacgcccagatgtggacgctcatgtacttccaccgacgagacctgcggctggcggccaacgccatctgctccgcggtgccgtcccactgggtcccgaccagcaggacaacctggtcaatccacgcgaagcacgagtggatgacaaccgaggatatgctagccgtctggaaccgggtatggattcaggaaaacccgtggatggaagacaaaacccccgttgaaagctgggaggaggtgccctacctgggcaaacgcgaggaccagtggtgcggctcactgatcgggctcaccagtcgtgccacttgggccaagaacatccagaccgcgatcaaccaggtgcgcagcctcatcggcaacgaggggtacaccgactatatgcccagcatgaagcgcttccgccgcgaggaagaagaggctggtgtcctgtggtga

SEQ ID NO: 25567 - RNA, 9873 nt, synthetic construct
  misc_feature 1..9873: note = derived and/or modified CDS sequence (opt11) from DENV-2__JQ686088__SS-prME
  source 1..9873: mol_type = other RNA
accacaggcatgatcatcatgctgatacccacggtgatggcgttccacctaaccacccggaatggggaaccccacatgatcgtctcacggcaggataagggcaaaagtttgttgttcaagacgaaggacggtacaaatatgtgtaccctcatggctatggacttgggggaactctgcgaggacacaatcacgtacaaatgccccttcctcaaacagaatgaaccggaggatatagattgctggtgcaattcgacgtcgacctgggtgacctatgggacctgcactacgaccggggaacaccgccgggagaaacgaagcgtggcgctagtgcctcacgtcggaatggggctggaaaccagaacggagacctggatgtcatcggaaggtgcctggaagcacgcccagaggatcgagacgtggattctccggcatcccggcttcacaattatggccgccattttggcgtacacgatcggaacgacacatttccaacgcgttttgatctttatcctccttactgcggttgcgccctcaatgaccatgcggtgtatcggcatcgccaaccgagatttcgtagaaggtgtatcaggcgggtcctgggtcgacatagttctcgaacacggcagctgcgtaaccaccatggcgaaaaacaaacccacactcgacttcgaactgatcaagactgaggctaaacaacccgcaaccttacgcaagtattgcatcgaagcgaagctcaccaacaccaccactgacagtcgctgccccacacagggggagccttcgctgaatgaggaacaggacaagcgctttgtctgcaagcactccatggtcgacaggggatggggcaatgggtgtgggctattcggaaagggtggaatcgtcacttgtgccatgtttacgtgtaagaagaacatgaagggcaagatagttcagcccgagaacctggagtacaccattgtcatcacaccccattctggcgaggagcatgcggttggcaatgacacaggcaagcatgggaaggaggtcaaaatcacgccgcagtcctccatcactgaagccgagctcaccggctacggaaccgtcaccatggaatgttcgcctcggaccggcctggacttcaacgagatggtcctcctgcagatggaggacaaggcctggttggtacacagacagtggttcctagacctgcccttaccctggctcccgggcgccgacacccagggtagcaactggatccaaaaggagactttagtaaccttcaaaaatcctcatgccaagaaacaggacgtcgttgtgctgggaagtcaggagggcgccatgcacacggcgttaacaggagctaccgagatccagatgtcatctggcaacctgctgttcaccgggcacctcaaatgcagactgcgtatggacaagttgcagcttaagggcatgtcatacagcatgtgcaccggcaaattcaaagtcgtaaaggagattgctgaaacccagcacggcacaattgtgatacgggtccagtatgagggggacggctccccatgtaaaatccccttcgagatcatggacctagaaaagcgacatgtgctcgggcgtttgatcacggtgaacccgatagtcactgagaaggacagacccgtgaacatcgaagccgaaccgccgttcggagacagctatatcatcataggcgtggagcccggacaactgaagctgaactggtttaagaagggaagtagcatcgggcagatgttcgagacgacaatgcgcggtgcgaagaggatggcgatattaggcgataccgcctgggacttcggatccctgggcggcgtatttacgagcattggcaaggccctccaccaggtgttcggagctatctacggcgccgcctttagtggcgtgtcatggaccatgaagatcttaatcggcgtgatcatcacttggatcggcatgaactctcgctcaactagcctgtccgtgtccctggtgctggtaggaatagtgacgttgtacctgggcgtaatggtgcaagctgacagcggctgcgtggtgagctggaaaaacaaggagttaaagtgcggcaacggtattttcgtcaccgacaacgtgcacacttggaccgaacagtacaagttccagccggagtccccatccaaactcgccagtgcgattcagaaggcccacgaagaaggcatctgtggcatacggagcgtgacgaggttagagaacctgatgtggaagcagatcacgcccgaactaaaccacatcctatccgagaacgaagtcaagctgacaatcatgacgggggacattaagggaatcatgcaggtcggaaagcgtagcctccagcctcagcctacggaactgcgctactcatggaagacttggggcaaagccaagatgctcagcaccgagttgcacaatcagacgttcctaattgacggccctgaaacggcggaatgtccgaacactaaccgggcctggaactctctggaggtcgaggactacgggttcggcgtatttaccaccaacatctggttaaagctacgcgagaagcaggacgtgttctgtgactctaagctgatgtcagcggccataaaagacaaccgggcagtgcatgcagacatggggtactggatcgaaagcgcacttaacgacacctggaagatcgagaaggcgtcctttatcgaagttaaatcgtgccactggcccaagtcccacacactatggtcgaacggggtcctggagtcagagatgatcattcccaagaacctcgccgggcctgtgagccagcacaataaccgaccaggctattacacccagacggctggcccctggcacttggggaaactcgagatggatttcgacttctgcaaaggcaccacggtcgtggtgactgaggactgcggaaacagaggcccgagcctccgcaccaccacggcctcgggcaagctaatcactgagtggtgttgccgtagttgcaccctgccacccctgcggtaccgtggggaggacggctgctggtacggcatggagatcaggccgctgaaggaaaaggaggagaatctggtcaacagcttggttaccgccgggcatgggcaaatcgacaattttagcctgggaatactcggcatggctcttttcctggaggagatgctgcggactcgagtgggaaccaagcacgctatcctccttgtagcggtgagtttcgtgaccctgatcactggcaatatgagctttcgcgacctcgggcgtgtaatcgttatggtaggggccacgatgaccgacgacatcggcatgggcgtcacctacttagcactgctagccgctttcaaggtccgccccaccttcgctgccggcctgttactccgtaagctaacgtccaaggagctgatgatgaccaccatcgggatcgtcctcttgagccaatcctcgatccccgaaaccattctcgagctcacagacgcgctggccctgggcatgatgattctcaagatggtcaggaacatggaaaagtaccaactcgctgttaccattatggccatactgtgcgtcccgaacgccgtcatcttacagaatgcatggaaggtgtcctgcaccatcctggcagtcgtgtctgtgagccctctgcttctgacctcgtcccagcagaaggcggactggatccccatagccctaacgatcaaagggctaaaccccaccgccatcttcctgaccactttatctcggacgagcaagaaacggtcctggccactcaacgaagccataatggctgtgggtatggtgtccatcctggctagttcgctgctcaaaaacgatatcccgatgactgggccgctagtagccgggggcttgctcaccgtctgttacgtgctgaccgggcggagcgcggacctggagctcgagcgcgccgccgatgtaaagtgggaggatcaggccgagatctccggtagctctcccatactttccattaccataagtgaggacgggtccatgagcatcaaaaatgaggaagaggagcagacgctgaccatcctaatcaggaccggcctgctcgtcgtgtcaggtctcttcccggtaagtgtccctataactgcagcagcctggtacctgtgggaggtaaagaaacagcgcgcgggtgttctttgggacgtcccctcaccgccgccggctgggaaggctgagctggaggacggggcgtatcggatcaagcagaaaggcatcctggggtactctcagataggggccggcgtgtacaaggagggcacatttcacactatgtggcacgtgacgcggggagctgtgctgatgcacaagggaaagcggatcgagcccagttgggcagacgtaaagaaagacttgatcagctacggcggagggtggaagctggagggcgagtggaaagagggagaggaagtgcaggtactggctctagaacctggcaagaaccccagagcagtgcagactaagccaggtctgttcaagacgaacaccggtaccatcggggcggtttccctggacttctccccgggcacctcaggatcacccatcgtcgataagaagggaaaagttgtaggcctctacgggaacggagttgtaacgcgttccggtgcgtatgtgtcagccatcgctcagacagaaaagtccatcgaggacaatcctgagatcgaagacgacatcttcagaaagaggcgcctgaccatcatggatcttcaccctggagcgggcaagaccaaacgttatctgccagcaatagtgcgcgaagccatcaagcgtgggctacggacgctgattctggccccgacaagagtagtggccgccgaaatggaagaagccctccgaggattgcccgtccgctaccaaacccccgccatccgggccgagcacaccgggcgcgagatagtggacctgatgtgccacgccacgtttacgatgcggctgctaagcccgatcagggtgcccaattacaacctgataatcatggacgaggcccatttcaccgacccggcctcgatcgctgcccgtggctatatcagcaccagggtcgagatgggcgaggcggccgggattttcatgacggcgactccgccgggatcacgagatccgttcccccagtccaacgcaccgatcatggacgaggaacgcgaaattccggagcgatcatggaactccgggcacgagtgggtgacggacttcaaaggcaagacggtttggttcgtcccgagcattaagaccgggaacgacatcgctgcctgcctccgcaagaacgggaagagagtgatccagctatcccgcaagaccttcgacagtgagtacatcaagactcgcaccaacgactgggacttcgtggtcacgaccgacattagtgagatgggcgccaacttcaaagcccaacgggtgatcgacccaagacgttgtatgaagcccgtcatacttaccgatggggaggaacgggtaattctcgccggcccgatgccggtgacccatagctccgcggcccagcgtgggagagtgggccggaatcccaagaatgagaacgaccagtacatttacatgggggaacccctagaaaacgacgaggactgcgcccactggaaggaggccaaaatgctgctggacaatatcaacaccccagagggaataatcccaagcatgttcgagcctgaacgcgagaaggtcgacgccatagatggtgaataccgactgcgtggggaggcacggaagacgttcgtggatctgatgcgccggggcgacttacccgtgtggctggcctacaaggtagccgccgaggggattaactatgccgaccgccgctggtgttttgacggaactcgcaataaccagatcctggaggagaacgtcgaggtggagatctggaccaaggagggagagcgtaagaagctcaagccccgctggctggacgcacggatttacgcagatccactagccttgaaagagttcaaggagttcgccgctggccggaagagtctgacgcttaacttgattaccgagatgggacgcctgcccaccttcatgacccagaaggtccgcgatgcattggataacctcgccgtgttacacacggccgaagcgggcggcaaagcgtacaaccacgccttgaatgagctccctgagacactggagaccctgctactgctgacactcctggccaccgtcaccggcggaatttttctttttctcatgagtgggcgggggatcgggaaaatgactctgggtatgtgttgcattatcacggcttccatcctgctttggtacgcgcagatccagcctcattggatcgcggcaagcatcattctggagttcttcctgatcgtactcctgatcccagagccagagaagcagcggacgccccaggataaccagctcacctacgtggtcatcgccatactaacagtcgtggctgccaccatggcgaacgagatgggattcctggagaaaaccaagaaggatctcggcctcggctccatcgtgacgcaacaacctgagagtaatatcctggatatagaccttcggcccgcctcggcctggaccttgtacgccgttgctacgacgtttatcacgcccatgctgcgccactctatcgaaaacagctccgtgaatgtttcacttaccgcaatcgctaaccaagctacggtgctcatgggcttagggaaaggttggcccctgagtaaaatggatattggggtgccattattggccatcggctgttacagccaggtcaaccctatcaccctaacggctgctcttttcctgctggtggcccactacgccatcatcgggcccggcctacaggcaaaggccacccgtgaagcacagaaaagagcggcagccggaattatgaagaaccccaccgtggatgggataacagtaatcgacctggatccgatcccctatgaccccaaatttgagaagcagctgggccaggtgatgctcctggtgctgtgcgtcacgcaagtcctcatgatgcggaccacctgggctttatgtgaggccctcacactcgcgaccgggcccgtgtccaccctgtgggaggggaacccggggcgattctggaatactacgatcgccgtcagcatggcgaatatattccgcgggagctacttagccggcgccggcttactgttctccattatgaagaacacaacttcggccaggcgcgggaccggcaacataggtgaaacactaggagaaaaatggaaatcacggctcaatgctctggggaagtccgaatttcagatctacaagaaatccggcatacaagaagtcgaccgcacgctggccaaggaagggatcaagaggggagagactgatcatcacgccgtgtcccgtggcagcgcgaaactgcggtggtttgtcgagcgcaacttggtcacccccgagggcaaggtcgttgacctcggctgcgggaggggcggttggagttattattgcgggggcctcaaaaacgtgcgcgaggtaaaggggctgaccaaaggcggacccggccacgaagaacccatccccatgtccacgtacggctggaatctggttcggttacaatccggcgtagacgtctttttcataccgcctgagcgctgcgacaccctactctgtgacattggcgagtctagtcccagtccgaccgtcgaggcgggacggaccctacgcgtgctgaatctcgtggagaactggctctccaacaacacacagttctgcgtcaaggtgctgaacccctatatgccctctgtgattgagaagatggaggcgttgcagcggaagcacgggggcgcactggttcgcaatcccttgtcacggaactccacgcacgaaatgtactgggtatcaaacgcgtccggcaacatcgtgagcagtgtaaatatgatcagccgaatgctgatcaacaggttcaccatgcgtcataagaaggccacttacgaaccagacgtcgacctgggttcagggacccgcaacatcggtattgagtcggaaacgcccaatctcgacattatcggcaagcggatagagaagatcaaacaagagcatgaaacatcatggcactacgaccaggatcacccctacaagacatgggcctatcacggcagctacgaaaccaagcaaacagggtccgccagctctatggtaaatggcgtggtgcgcctgttaacgaagccgtgggacgtggtccccatggtgacccaaatggccatgaccgacacgactccttttggtcaacagcgggtattcaaggagaaggtggatacaagaacccaggagcccaaggaggggacaaagaagctcatgcggataacggcagaatggctgtggaaggagctggggaagaagaaaacaccaaggatgtgcacccgcgaggagtttaccaaaaaggtgcgtagcaatgctgcactcggggccatcttcacggacgagaacaagtggaaatctgcccgagaggctgtcggagacggccggttttgggaactggtggataaagagagaaatctccatctcgagggcaagtgtgagacttgtgtttacaatatgatgggtaaacgggagaagaagctgggcgagttcgggaaagcaaaggggagccgggccatctggtacatgtggctgggcgcccgctttctcgagttcgaggctctgggtttcttaaacgaggatcactggttctctcgggaaaacagcctcagcggcgtcgaaggggaaggactgcataagctagggtacatcctccgtgaggtgagtaagaaggagggcggcgctatgtacgccgacgacaccgccggatgggatacgcggatcacgatcgaggacctgaagaacgaggaaatgatcaccaatcacatggagggggagcataagaagctagcggaagccatcttccgcctcacctaccagaacaaggttgtgcgggtgcagcggcccacgccccgggggaccgtgatggatatcatcagccgccgcgatcagcggggatcgggccaggtgggcacatacgggctgaacacgttcacaaatatggaggcccaattaatccgccagatggagggggagggcgtattcaaaagcatccagcacttaaccgccgccgaggagatagcagtgcagaactggctggtccgggtcggtcgtgaacgactgtcccggatggccatcagcggggacgactgcgtcgtcaagcccctcgatgacagatttgcccgcgccctgacggccttaaacgacatgggcaaagtgcggaaggacatccaacaatgggaaccgtcccgcgggtggaacgattggactcaggttcctttttgcagccaccacttccatgagctcatcatgaaagacggacgcattttggttgttccctgtcgtaaccaggacgaactgattgggcgagccagaatttcccaaggcgcaggttggagcctgcgcgaaacggcctgtctaggcaaaagctatgcccagatgtggagcctaatgtatttccacagacgagatttgcgcctggccgcgaatgccatatgctccgcggtgccctcccactgggtcccaacctccaggaccacctggtcgatacatgcaagccatgagtggatgaccacggaggacatgctgacggtttggaaccgggtgtggatccaggaaaacccctggatggaggataagaccccggtcgaaagctgggaggagatcccttatctcggtaagcgagaagatcagtggtgtggctccctcatcggcctgacttcccgggccacctgggcgaagaacatacagaccgccataaaccaagtacgcagccttatcgggaacgaggagtacacggactatatgccgtctatgaagcggtttagacgggaagaggaggaagccggcgtgctgtggtga

SEQ ID NO: 25568 - RNA, 9876 nt, synthetic construct
  misc_feature 1..9876: note = derived and/or modified CDS sequence (opt11) from DENV-2__KF479233__SS-prME
  source 1..9876: mol_type = other RNA
accgccggtgtgattatcatgctgattcccacagcaatggcgttccatctcaccacccggaatggggaaccccatatgatcgtcagccggcaggagaagggcaagtctctgctgttcaagactgaggacggggtgaacatgtgcaccctgatggccatggacctgggcgagctgtgtgaagacaccatcacctacaattgtcccctccttcgccagaacgagcccgaagacatcgattgctggtgcaacagcacttccacttgggtgacctacgggacctgcaccgccacgggcgaacaccggagagagaagcggtccgtcgcattagttccccacgtgggcatggggctcgagacccgcaccgagacctggatgtccagcgagggtgcttggaagcacgcgcagcgtatcgagacgtggatactgcgccaccccgggtttacgatcatggctgccatcctggcctacaccatcggcaccacctacttccagcgggtcttgattttcatcctgctgacggcggtggcccccagcatgacgatgcgctgcatcgggatcagcaaccgtgacttcgtagagggggtctcaggcgggagctgggtggacatcgtgctcgagcacggctcctgcgtcacgaccatggctaagaacaagcccacgctggacttcgagctgatcaagaccgaagccaagcagcccgccaccctccgtaagtactgcattgaggctaaactgacgaatacgaccaccgctagccggtgcccaacgcagggggagccctctctgaacgaggagcaggacaagcgctttgtgtgcaagcatagcatggtggaccggggctggggcaatggctgcggcctcttcgggaagggagggatcgtcacgtgtgccatgtttacctgcaagaagaacatggagggcaaaatcgtgcagcccgagaacctggaatacaccattgtggtgacgccccacagcggtgaggagaacgccgttgggaacgacacgggaaagcacgggaaggagatcaaggtcacccctcagtcgtccatcacagaggccgagctgaccggctacgggaccgtcacgatggagtgtagcccgcggactggcctcgacttcaacgagatggtgctgctgcagatggagaacaaggcgtggctcgtgcaccggcaatggttcctggacctgccccttccctggctgccgggcgccgacacccaggggtccaattggatccagaaggagaccctggtcacgtttaagaacccccacgccaagaagcaggacgtggtcgtgctcggaagccaggagggggccatgcacaccgccctgactggcgcgaccgagatccagatgagctccggcaacctgctgtttaccggccacctgaagtgccgcctgcggatggacaagctccagctgaaagggatgagctactcgatgtgcaccgggaagttcaaggtggtcaaggagattgccgagacccagcacggcacgatcgtggtacgcgtccagtacgaaggagacggcagcccctgcaagatcccattcgagatcatggacctggagaagcggcacgtgctcggccgcctgataacggtgaatccgattgttaccgagaaggactcccctgtgaacatcgaggctgagccgcccttcggggatagctatatcataattggtgtagagccggggcagctgaagttatcctggttcaagaagggcagcagcatcggacagatgttcgagaccaccatgcgcggcgccaagcggatggcaatcctaggcgatacggcgtgggactttggtagcctgggcggggtcttcacctccatcggcaaggccctccaccaggtgttcggggccatctacggcgccgcatttagcggcgtgtcgtggaccatgaagattttgatcggggtcgtgatcacctggatcggcatgaacagccgctccacgagcctgtccgtgagcctagtccttgtgggggtggtcaccctgtacttgggcgtaatggtgcaagctgactctgggtgcgtggtgagctggaagaacaaggagctcaagtgcggcagcggcatcttcatcaccgacaacgtgcacacctggacggaacagtacaaatttcaacccgagtcccccagcaagctggcctccgccatccagaaggctcacgaagaggggatctgtggcatccggagcgtcacgagactggagaatctcatgtggaagcagattacccccgagctgaaccacatcctgtccgagaacgaggtgaagctgaccatcatgacaggcgacatcaagggcatcatgcaggcgggcaagcggagcctgcgcccgcagcccaccgagcttaagtactcctggaagacctggggtaaggccaagatgctcagcactgaaccccagaaccagactttcctgatcgacggcccggaaaccgcagagtgccccaacaccaaccgggcttggaactctctggaggtcgaggactacgggttcggcgtgttcaccacgaacatctggttaaagctgaaggagagacaggacgtgttctgcgacagcaaacttatgtccgccgcgatcaaggacaaccgggccgtgcacgccgacatggggtactggatcgaaagcgccttgaacgacacgtggaaaatagaaaaagccagtttcatcgaggtcaagagctgccactggcccaagtcccacaccctgtggagcaacggcgtgctggagtcagagatgatcatcccaaagaacttcgcgggccctgtgagccagcacaactaccgccccgggtaccacacgcagaccgccggcccctggcacctcgggaagctcgagatggacttcgacttctgcgagggcacgaccgtcgtagtgacagaggactgcgggaaccggggccccagcctgcgcaccacgacagccagtggcaagctcattaccgagtggtgctgccgctcttgcaccctgccgcccctgcgctacaagggggaagacggctgctggtacgggatggagatacggcccctaaaagagaaagaggaaaatctggtaaactccctggtgacggccggccacgggcaaatcgacaacttcagcctcggcgtcctgggcatggcgctgttcctcgaggaaatgctgcgcacccgggtcgggacgaagcacgccgttctgctcgtggccgtctcgtttatgaccctaattacgggcaacatgagcttcagggacttgggtcgggtaatggtgatggtcggtgccgcaatgaccgacgacatcggcatgggcgtaacttacttggcgctgctggcagcctttaaggtgcgccccaccttcgccgccggcctccttctgaggaagttgacgtccaaggagctgatgatgaccaccatcggtatcgtcctcctcagccagtccacaatcccggagacgattctggagctgacagacgcgctcgccctgggcatgatgatcctgaagatcgtgaggaacatggaaaaataccagctggccgtcaccatcatggcgatcctgtgtgtgcccaatgccgtgatcttacagaacgcgtggaaggtcagctgtaccatcctcgccgtggtgagtgtcagccccctgctgctcacgtcctcccagcagaaggctgactggatcccgctggccctgaccatcaagggactaaacccgaccgcgatcttcttgaccacgctgtcccgcaccaacaagaagcggagctggcccctgaacgaggccatcatggctgtgggcatggtgtccatcctagccagctccttgctgaagaacgacattccaatgaccggacccctggtcgccgggggcctgttaaccgtttgctacgtgctaacgggtagaagcgcggatctggagctagagcgggccgccgatgtccgctgggaggaccaggcggagatctcgggcagttcgcctatcctgagtatcaccatcagcgaggatggaagcatgagcattaagaatgaggaagaggagcagactttgaccatactcatccggacgggcctgctggtaatcagtggcctcttccccgtgagcatccccatcaccgccgcggcctggtacctgtgggaggtgaagaaacagcgcgccggggtgctctgggacgtaccctccccacctccagtcggaaaagccgagctggaggacggggcctaccggatcaagcagaagggcatcttagggtacagccagatcggcgctggcgtatataaagaagggactttccacacaatgtggcatgtcacccgcggcgccgtactaatgcacaaggggaagcggattgagccctcctgggcagatgttcgcaaggacctgatatcctacggcgggggttggaagctggagggcgagtggaaggaaggcgaagaagtgcaggttctggcactcgagcccggcaaaaacccccgggccgtacaaaccaagcccggtctgttcaaaaccaacaccggcaccatcggggcggtgagtcttgacttcagccctgggacttccggtagccccatcgtggacaagaaggggaaggtcgtgggcctctacgggaacggggtcgttactcgctccggaacctacgtctccgccatcgcccagaccgaaaagtccatcgaggacaatcccgaaatagaggacgacatcttccggaagaagcgcctgacgatcatggaccttcaccccggggccggcaagaccaaacgttacctgcctgctattgtgcgcgaggccatcaagcgggggctcagaaccctgattctagctcccacccgggtggtggccgccgagatggaggaggccctgcgcggcctccctatccgctaccagacacccgccatccgggccgagcacaccgggcgcgaaatcgtggacctgatgtgtcatgccaccttcacgatgcggttactcagcccggtgagggtgccaaattacaacctaatcataatggacgaggcccacttcacggatcccgcgagcatcgccgcccggggctacatctccacccgggttgagatgggcgaggccgcagggattttcatgaccgcgacgccgcccggcagccgggaccccttcccgcaatccaacgcccccatcatggatgaggagcgcgaaattcccgagcggagctggaactccgggcacgagtgggtgacggacttcaagggcaagaccgtgtggttcgtgcctagcatcaaggccgggaacgatatcgccgcgtgtctccgcaagaacggcaagaaggtgatccagctgtcccggaagacctttgacagcgagtacatcaagacccgcacgaatgactgggatttcgtggtcactacggatatatccgagatgggtgccaacttcaaggctgagcgggtgatcgatccccgccgctgcatgaagcccgtgattctgaccgatggggaggagagagtaatactcgccggccccatgcccgtgacacactcttccgccgcgcagcggcgcgggcggatcggccgcaacccaaagaatgagaacgaccaatacatctatatgggggagcctctggagaacgacgaggactgcgcgcactggaaagaggcaaagatgctgctcgacaatatcaacactccggagggcatcatcccttcgatgttcgagcccgagcgcgagaaggtggacgccatcgacggtgaataccggctgagaggggaggcccggaagacgttcgtagagctgatgcgcagaggcgacctcccggtgtggttggcgtacagggtagccgccgaaggcatcaactacgctgaccggcgttggtgcttcgacggcatcaagaacaaccagatactggaggaaaacgtggaagtggaaatctggaccaaggagggagagaagaagaagctcaagccccggtggctggacgcccgcatctactccgaccccctggcgctcaaggagtttaaggagttcgccgccggccgaaagtcactgacaatgaacctgatcaccgagatgggccgcctccctaccttcatgacccagaaggcccggaacgcgctggacaacctagcggtcctccatacggctgaggccgggggccgcgcctacaaccacgcgctgtccgagcttccggagaccctcgagacgctgctgctcctgaccctgctcgccacggtaaccggaggcatcttcttgtttctgatgagcggcaaagggataggcaagatgactctcgggatgtgctgcatcatcaccgcctccatcctgctctggtatgcccagatccagccccactggatcgcggcgagcatcatcctagagttcttcctgattgtgctgctgattcccgagcccgagaagcagcgcacacctcaggacaaccagttgacgtacgtcgtgatcgccatcttaaccgtggtcgcggccaccatggccaacgaaatgggcttcctcgagaagaccaagaaggactttgggctgggctccatagtgacgcagcagcccgagagcaacatcctggacatagacttaaggcccgccagcgcctggaccctgtacgcggtggccaccacctttatcacgcccatgcttaggcactccatagagaacagctccgtcaacgtgagcctcaccgccattgcaaaccaggcaaccgtgctgatgggcctggggaagggctggccgcttagtaagatggacatcggggtacccctgctggccatcgggtgctacagccaagtgaacccgattaccctcacggccgcgcttcttctcctggtcgcgcactacgccataatcgggcccggactgcaggccaaggccaccagagaggcgcagaagcgagccgcagccggcataatgaagaacccgacggtcgacgggatcaccgtcatcgacctcgaccccataccatacgaccccaagttcgaaaagcagctcggccaggtgatgctgctggtcctgtgcgttacccaggtgctaatgatgcgcaccacctgggccctctgcgaggcgttaaccctggctacggggccgatctcgaccctctgggagggcaaccccggccggttctggaataccacgattgccgtcagcatggccaacattttccgcggcagttacctggcgggcgcggggctcctgttcagcatcatgaagaacacggccaacacccgccggggcaccgggaataccggcgagacgctgggcgagaagtggaaaaaccgcctgaactcgctcgggaaaagcgagtttcagatttacaagcggtccggcattcaggaggttgaccgcactttggccaaggagggtatcaagagaggcgaaaccgaccaccacgccgtgagccgcgggtccgctaaactgcggtggttcgtcgagcgcaacctcgtgacccccgagggtaaggtgatggacctggggtgcggtcggggcgggtggagctactactgtggcgggcttaagaacgtccgcgaggtgaagggcctcacgaagggcgggcccggccacgaggaaccgatccccatgtccacgtacgggtggaacctggtgcggctccagagcggggtcgacgtgttcttcacgccgcccgagaagtgtgataccctcctgtgcgacattggggagtccagcccgaaccccacggtggaggccggccgcaccctaagggttctcaacctggtggagaattggctcaacaacaacacccaattctgcatcaaggtcctcaacccctacatgccgtcggtcatcgaaaagatggagaccctgcagcgcaagtacggcggggcactggtgcggaacccactgagccgaaacagcacccatgagatgtactgggtgtccaacgccagcggaaatatcgtctccagcgtgaatatgatatcccggatgttaatcaaccgcttcacgatgcggcacaagaaggccacctacgagcccgacgtcgatctggggtcaggcacccgcaacatcgggatcgagtccgaaatccctaatctagacatcataggcaagcgcatcgagaagataaagcaggagcacgaaaccagctggcactacgatcaagaccacccgtacaaaacgtgggcgtaccacggctcctacgagactaaacagaccgggagcgcctccagcatggtcaacggcgtggtgcggctccttaccaagccctgggacgtgatccccatggtgacccagatggccatgaccgacaccacaccctttgggcagcagcgcgtgttcaaagaaaaggtcgacacgcgtacgcaggagccgaaggaaggcaccaagaagttgatgaaaatcaccgccgagtggctctggaaggagttaggcaagaagaagacgccccgcatgtgcacgcgggaggagttcacccgcaaggtgcggtccaacgccgcgttaggggccatctttacggacgaaaataaatggaagtccgctcgcgaggcggtcgaggacagtcggttctgggagctcgtggataaggagcgcaacctccacctggagggcaagtgcgagacgtgcgtgtacaatatgatggggaagcgggagaagaaaatcggcgagttcggcaaggccaagggcagccgcgcgatctggtacatgtggctcggcgcccggtttctagagttcgaggccttagggttcctcaacgaagatcactggttcagccgcgagaacagcctgagcggcgtcgagggggagggcctgcacaagctcgggtacatcctgcgggaagtgtccaagaaggagggtggcgccatgtacgcggacgacaccgcggggtgggacacccgcattaccctggaggacctcaaaaacgaggagatggtgacgaaccacatggagggggagcacaagaagctggcagaggccatcttcaagctaacctaccagaataaggtcgtgcgggtgcagcgccccactccccgtgggaccgtcatggatatcatctcacgccgggaccaacgaggctccggccaggtgggcacgtacggcctcaacaccttcaccaacatgggggcccagctgatccgccaaatggagggcgaaggggtgtttaaaagcatccagcacctgactacgactgaggaggtcgcggtgcaagactggctcgcccgggttggccgcgagcgtctctcccgcatggccatcagcggcgacgactgcgtcgtgaagccgctggacgatcgattcgcctccgcactcaccgcgctgaacgatatggggaaggtccgcaaggatatccagcagtgggagcccagccggggctggaacgattggacacaggtccccttctgctcccaccattttcacgagcttatcatgaaagacggacgcgttctagtggtcccctgcagaaaccaggatgagctcatcggccgcgcccggatcagccagggggccggatggtccttacgcgagacggcctgcctaggtaagtcttacgcccagatgtggtccctgatgtacttccatcggcgcgacttgcgtctcgcggctaacgccatctgctccgccgtgccgtcacactgggttcccactagccgcaccacctggtccatccacgcacggcacgagtggatgaccactgaggacatgcttaccgtgtggaacagggtgtggatccaggagaacccctggatggaagacaagacccccgtggagagctgggaggaaattccgtacctcggaaagcgggaggaccagtggtgcggcagcctcattgggctcacctcccgagctacgtgggccaagaacatccagaccgccatcaaccaggtccgatccctgatcgggtccgaggagtacaccgattacatgccctctatgaagaggttcagacgagaggaggaggaggccggcgtgctttggtga

SEQ ID NO: 25569 - RNA, 9876 nt, synthetic construct
  misc_feature 1..9876: note = derived and/or modified CDS sequence (opt11) from DENV-2__KX372564__SS-prME
  source 1..9876: mol_type = other RNA
accgccgggattatcatcatgatgatccccaccgtgatggccttccaccttaccacccgcaacggagagccccacatgattgtgagcagacaggagaagggcaagagtctcttatttaagaccgagaacggtgtgaacatgtgcaccctgatggcgatggacctcggggagctgtgcgaggataccatcacctacaactgccccctgttgcgccagaacgagcccgaggacattgactgttggtgcaactcaacaagcacctgggtcacctatgggacctgcactgccaccggcgagcaccggcgcgaaaagcggagcgtcgctctggtgccccacgtgggaatggggctggagacccgcaccgagacctggatgtccagcgagggggcctggaaacacgcccagcggatcgagacctgggttcttaggcacccagggttcacgatcatggcggccatcctggcctacaccatcggcaccacctacttccagcgggttctgatcttcatcctcctcacggccgtggcgccatccatgacaatgcgttgtatcggcataagcaatcgggacttcgtcgagggcgtgtccggcgggagctgggtggacattgtcctggagcacggctcctgcgtaaccaccatggccaagaacaagcccacgttagacttcgagctaatcaagaccgaagctaaacaccccgccaccctccggaagtactgtatcgaggccaaactcaccaacacgacgaccgcatcacgatgcccgacccagggtgagccctccctgaatgaggagcaggacaagcgcttcgtctgcaaacatagcatggtcgaccggggttgggggaatgggtgtggtctattcgggaagggggggatcgtaacgtgcgccatgttcacgtgcaagaagaacatggagggcaagatcgtgcagcctgaaaacctcgagtacacgatcgtaataacgccccattcgggggaggagaacgccgttggaaacgacacgggcaagcatgggaaggagatcaaggtgaccccccagagctccattaccgaggccgagctgaccggctacgggaccgtcacgatggagtgcagcccccgcacaggcctggacttcaacgagatggtgttgttgcagatggaaaacaaggcctggctggtgcacagacagtggttcctcgacctgccgctgccctggctcccgggtgcggatacccaggggtccaactggatccagaaggagaccctggtaacgttcaagaacccccacgccaagaaacaggacgtagtcgtcctgggcagccaggagggcgcgatgcacaccgccctcaccggtgccaccgagatccagatgagctccgggaacctgctgttcacgggccacctcaagtgccgcctgcggatggacaagctgcagctgaaaggcatgtcttattccatgtgcaccggcaagttcaaggtggtaaaggaaatcgcggagacacagcacggcaccatcgtgatcagagttcaatacgaaggggacggcagcccctgcaagatccccttcgaaatcatggacctggagaagcggcacgtcctggggcgcctcatcacagtcaaccctatcgtgaccgagaaggactctcccgttaacatcgaggccgagccgcccttcggagacagctacatcatcattggcgtggagccggggcagctgaaactctcctggttcaagaagggcagctccatcgggcagatgttcgagaccacaatgcgcggcgccaagcggatggccatcctcggggacacggcctgggacttcgggagcctgggcggagtgttcacctcaatcggcaaggcactgcaccaggtcttcggagctatctacggcgccgccttcagcggtgtgtcctggaccatgaagatcctcatcggggttgtcatcacttggattggcatgaactcgcgctccacgagcctgtcggttagcctggtgctcgtgggggtagtgaccctctacttgggcgtcatggtgcaggctgactccgggtgcgtggttagctggaagaataaggaactgaagtgcggctctggtatcttcattacagataacgtgcacacttggactgagcagtacaagttccagcccgagagtcccagcaagctggcctccgccatccagaaggcccacgaggagggcatttgcggcataaggtcagtgacccggctggagaatctgatgtggaagcaaattacccccgagctgaaccacatcctgaccgagaacgaagtcaaactgacgataatgaccggggatatcaagggcatcatgcaggccgggaagcggtccctccgcccgcagcccaccgagctaaagtacagctggaaagcgtggggcaaggccaaggtgctgtcaaccgagctgcataaccacacgttcctgatcgacggcccagagaccgccgagtgcccgaacaccaaccgcgcctggaacagcctggaagtggaggattacgggttcggcgttttcaccacgaatatctggctcaagctgaaggagcgccaggacgtgtcctgcgacagcaagctgatgtccgccgcgatcaaggataaccgggccgtgcacgccgatatggggtactggatcgagagcgcgctcaatgacacctggaagatcgagaaggcctcctttatcgaggtcaaatcatgccactggcccaagtcccacaccctttggagcaacggcgtgctggaaagcgagatgataatccccaaaaactttgcgggccccgtgagccagcacaactaccgtccggggtaccacacacagaccgccggcccgtggcaccttgggcggctggaaatggacttcgatttctgcgagggcacgacggtcgtggtgaccgaggactgcgggaaccgcggtcctagccttcgcaccacgaccgcctccggcaagctcattaccgagtggtgttgccgcagctgcaccctgccgccgcttcggtacagaggagaagacggctgctggtacggtatggagatccggcccctcaaggagaaggaggagaacctggtcaactcattggtgacagccggccacggacagatcgacaactttagcttgggcgtgctgggcatggcgctgttcctcgaggagatgcttcgaacccgggtcgggacgaagcacgccatcttgctcgtcgccgtgtcctttgtcacactgatcacgggcaacatgagcttccgcgacctggggcgcgtgatggtgatggtcggagccaccatgaccgatgacatcgggatgggcgtgacctacctagccctgctggcggccttcaaggtgcggccaacatttgctgccggcctgctgctgcgcaagctcacatccaaggagctgatgatgacaaccatcgggatcgtgctactctctcagtccactatccccgagaccatcctggagctgaccgacgctctcgcgctgggcatgatggtactgaaaatcgtaagaaacatggagaagtaccagctcgctgtgaccataatggccatcctgtgcgtgccgaacgcagtcatcctacagaacgcctggaaggtgagctgtaccgcgctcgccgtggtatccgtgagccccctgctgctcacctcaagccagcagaaaaccgactggatccctctggccctgaccatcaaagggctcaaccccacggccatcttcttgactaccctatcccgcacctcaaagaagcggtcctggccgctcaacgaggcgatcatggccgtgggcatggtgagcatcctcgcttccagtttcctaaagaatgacatccccatgacgggccccctcgtggccgggggcctgctaaccgtgtgctacgtcctaaccgggcgtagcgccgacctggagctcgagcgggcggccgacatccgctgggaggagcaggcggagatctctggctcgtcgcccatcctctccatcaccatatccgaagacgggagcatgtccatcaagaacgaggaagaggagcagacgctgaccatcctgatccggaccggtctcctggtgatcagcggcctattcccggtgtcaatccccatcaccgccgcagcttggtacctctgggaggtcaagaagcagcgagccggggttctgtgggacgtacccagcccgccgcccgtcggtcgggcagaactggaagacggggcctaccgcatcaagcagaagggcatcctcgggtactctcagatcggcgcaggggtgtacaaggaagggacgttccacacgatgtggcacgttacccggggcgcggtcctgatgcacaaggggaaacgcatagagcccagctgggccgacgtgaaaaaagacctgatttcctacggcggggggtggaaactggagggcgagtggaaggagggggaggaggtgcaggtcctggcccttgagcccggcaagaacccccgtgccgtacagaccaagcccggtctgttcaagaccaacacaggtacaatcggggccgtaagcctggatttttcccctggcacgagcggcagccccattgtcgacaagaaggggaaggtggtgggcctgtacgggaacggcgtcgtgacccgcagcggcacgtacgtctccgcgatcgcccagacagagaagtccatcgaggacaacccggagatcgaagatgacatcttccggaaaaagcgcctgaccatcatggacctgcaccccggtgcaggcaagaccaagcggtacctacccgccatagtccgtgaagcgatcaagcgggggctgcgcacgctcatcctggccccgacacgcgttgtggccgcggagatggaggaggccctgcggggcctccctatccgctaccagacccccgcgattcgggccgaacacacgggccgcgagatcgtcgacctgatgtgccacgccacgttcaccatgcgactgctatcgcccatccgcgtgcccaattacaacctaatcattatggacgaggcccacttcaccgatcccgcttctatcgcggcccggggctacatcagcactcgcgtggagatgggcgaggccgctgggatctttatgacggccacgccgcccggcagccgggacccgttcccccagagcaacgcgcccatcatggacgaggagcgcgagatccccgaacgatcctggaatagcgggcatgagtgggtcaccgatttcaagggcaagaccgtgtggttcgtgccgtccatcaaggcggggaacgatattgccgcctgcctgcgcaagaacggcaagaaggtcatccagctcagccggaagacgttcgacagtgagtacatcaagactcgcaccaacgactgggacttcgtggtgaccacggacatcagcgaaatgggcgcgaacttcaaggccgagcgggtcatcgacccccgtcggtgcatgaagcccgtgatcttgaccgacggggaagaacgagtgatcctggccgggcccatgccagtcacccactcctctgcggcccagcggcgcgggcgcgtgggtcggaaccccaagaatgagaacgatcaatacatttacatgggggagccattggagaacgacgaggattgcgcgcactggaaggaggctaagatgctgctggacaacatcaataccccagagggcatcataccgagtatgtttgagcccgagcgcgaaaaggtcgacgccatagatggcgagtaccggttgcgcggagaggcaaggaaaacgttcgtcgatctgatgcggcggggcgatctacctgtgtggctagcctaccgcgttgccgccgaggggatcaactatgctgaccggcgctggtgcttcgacggagtaaagaacaaccagattctggaggaaaacgtggaggtcgagatttggaccaaggagggggagcggaagaagctgaagccgcgatggctagacgcacggatctacagcgatccactggccctgaaggagttcaaggagttcgccgccggacgcaagtcccttaccctgaatctgatcaccgagatgggccggctccctacgttcatgacacagaaggccaggaacgccctggataaccttgcggtgctccacaccgccgaggccggggggcgggcgtacaaccatgcccttagcgagctgccggagacgctcgagacgctgctactcctgacactgctcgcgaccgtgaccgggggcattttccttttcctgatgtccggcaaagggatcggcaaaatgacactcgggatgtgctgcatcgtcactgctagcatcctgctgtggtatgcccagatccaaccgcattggatcgccgccagcatcatcctcgagttcttcctgatagtgctgttgatccccgagcccgagaagcagcggacgccccaggacaaccaactgacatacgtggtaatcgcgatactgactgtggtagccgcaacgatggccaatgagatgggattcctcgagaagaccaagaaagacttcgggctgggtagcataaccacacagcagcccgagagcaacatcttggacatagatctccggcccgcatccgcgtggacgctgtacgccgtcgccaccacttttattacccccatgcttcgtcatagcatcgagaacagcagcgtgaacgtatccctcacagccatcgccaaccaggcgaccgtgctgatggggctggggaagggctggcccttaagcaagatggatattggggttccgctgctggctatcggttgctactcccaggtcaacccgatcaccctcaccgccgccctgctgctcctggtcgcgcattacgccatcatcgggcccggcctgcaggcgaaggccacgcgggaagcccagaagcgcgctgccgccggcatcatgaagaaccccaccgtagacggaatcaccgtgatcgacctcgacccgatcccctacgaccccaagtttgagaagcagctgggccaggtcatgctgctagtgctttgcgtgacccaggtcttaatgatgcgcaccacctgggccctctgcgaggcactaaccctggcgaccgggcccatcagcacgctctgggagggcaaccccgggcggttctggaacacaaccatcgccgtgtcgatggccaacatcttccgcggcagctacctggccggcgccgggctcctcttctccatcatgaaaaacaccgccaacacgcgtcgcggcaccggtaacaccggcgaaaccctgggagaaaagtggaaaaaccggctgaacgccctcggcaagagcgagttccaaatctacaagaaatccgggatccaggaggtggaccgcaccctggccaaggaggggatcaagaggggcgagaccgaccaccacgccgtctcgagaggctcggccaagctgcggtggtttgtggagcgcaatctcgtgaccccggagggcaaggttgtggacctgggctgcgggcggggaggatggagctactactgcggcgggctgaagaacgtgaaggaggtcaagggcttaaccaagggcggacccgggcacgaggagcctatcccgatgagtacgtacgggtggaacctggtgaggctgcagagcggcgtagacgtcttcttcacgccgccagagaagtgcgataccctgctgtgcgatatcggggagtccagccccaacccgaccgtggaggccggccggacccttcgcgtgctcaacctggtggagaactggctgaataacaacacgcagttctgcataaaagtgctcaacccctacatgcccagcgtgatcgagaagatggaggccctgcaacggcgctatggcggggccctggtccggaacccgctgagtcgcaactctacacacgagatgtactgggtgtccaacgccagcggcaacatcgtgtccagcgtaaacatgatatcccggatgctcatcaatcgctttaccatgcgccacaagaaggcgacctacgagcccgatgtggatctgggcagcggcacgcggaacatcgggatcgagtcggaggtgccaaacctggacatcatcggaaagcgtatcgagaagataaagcaggagcacgagaccagttggcactacgaccaggaccacccttacaaaacctgggcctaccacggcagctatgaaaccaagcaaacggggagcgcctccagtatggtcaatggcgtggtgcggctcctgaccaagccgtgggacgtcatccccatggtgacccagatggccatgaccgacacgacccccttcggacagcagcgcgtcttcaaggagaaggtggacacgcggacccaggagcccaaggaaggcacgaagaaactgatgaagatcaccgccgagtggctctggaaagagctgggcaaaaagaagaccccgcgcatgtgcacccgggaggagttcacacgcaaggttcgctccaatgccgctctgggggcgatctttaccgacgagaacaagtggaagtccgcccgcgaggcggtcgaggactcgggcttctgggagctcgtggataaggagcggaacctgcacctggaagggaagtgcgagacctgcgtctataacatgatgggcaagcgcgagaagaaactcggggaattcggcaaggcgaagggcagccgggccatttggtatatgtggctaggggcccgctttctggagttcgaagctctcggcttcctgaacgaggaccactggttctcccgggaaaacagcttgtctggcgtcgaaggggaggggctccataagctcggctacatcttgcgcgacgtgtccaagaaggagggcggggcgatgtatgcagacgacaccgccggctgggacacgagaatcaccttagaggacctgaaaaacgaggaaatggtcaccaatcacatggaaggggagcataagaagctggccgaggccatctttcgcctcacctaccagaataaggtcgtgcgggtgcagcgccccacgccccggggcaccgtcatggacatcatcagccgacgcgaccagagggggtccggccaggtggtcacctatggcctgaataccttcacgaacatggaggcgcagcttatccgccagatggagggggaaggcgtcttcaaaagcatccagcacctcaccgccaccgaggagatcgcggtgaagaactggctggtgcgagtcgggcgagagagactctcccgcatggccatcagcggcgacgattgcgtggtgaagcccttcgacgaccgctttgccaacgcgctcactgccctgaacgacatgggcaaggtccggaaagacatccaacagtgggagccgtcccgggggtggaacgactggacccaggtccccttctgcagccaccatttccacgagctgataatgaaggacggccgcgtgctcgtcgtgccctgtaggaaccaggacgagctgatcggacgtgcccggatcagtcaaggcgccgggtggagcctgcgcgaaaccgcctgcctagggaagtcgtacgctcagatgtggagcctgatgtatttccaccgccgcgacctgagactcgccgccaacgccatctgctccgccgtgccctcccactgggtcccgacatcgcgtaccacgtggagcatccacgcaacacacgagtggatgacaaccgaggacatgcttaccgtctggaaccgggtgtggatccaggagaacccctggatggaggacaagacgcccgtcgagtcctgggaggagatcccctacctgggcaagcgcgaggaccagtggtgcggttcactcatcggcttgaccagccgggccacctgggccaagaacatccagaccgccatcaaccaggttcggtccctgatcgggaacgaggagtacacagactacatgcccagcatgaagagattccggcgcgaggaggaggaagcgggtgtgctgtggtga

SEQ ID NO: 25570 - RNA, 9873 nt, synthetic construct
  misc_feature 1..9873: note = derived and/or modified CDS sequence (opt11) from DENV-2__KX274130__SS-prME
  source 1..9873: mol_type = other RNA
agcgcagccaccctgctgctgctggtgcccaccatcatggcctttcatttaaccacccggaatggcgaacctcacatgatcgtcgcacggcatgaaaaggggaagagtttgatcttcaagaccgaaaacggcgtgaacatgtgcaccctgatggccatggatctcggggagctgtgcgaggaaaccgtgacatacaaatgcccctacctgaagcaatccgagcccgaggacatcgactgctggtgcaacacaacctccacctgggtgacctacgggacctgctcgtccagcggcgagcaccgccgcgagaagcgctccgtggccttagcgccccacgtgggcatgggcctagaaacgcggacggagacctggatgagctcggagggggcctggaagcacgcccagcgcatcgagaactggatcctccggcaccctggctacactgtcatggccgccgccatcgccatggccatcggaactaataacttccaacgcgccctcattttcgttctgctgacagccgtggcacccagcatgaccatgaggtgcgtcggaatcgcgaacagggactttgtggagggtgtgtccggcggcagctgggtcgacatagtgctggagcacggctcctgcgttaccaccatggcaaagaataagcccacactggacttcgagctgaccaagaccgaggccaagctccccgccaccctgcgcaaatactgtatcgaggcgaagctgacgaatacgacgactgagtcacgctgtccgacgcagggtgaaccgagcctccccgaggagcaagacaagcggttcatctgtcgccatagcctggtcgatagggggtggggaaatggctgcgggctatttggcaagggagggatcgtgacctgcgcaatgttcacgtgtaagaaatacatggaggggaagatcgtgcagcccgaaaacttagagtacacagtcgccgtcacgccgcactccggggaggagcattctgtgggcaatgacactggcaaacatggccaagacgtaaaaatcacacctcaatcctcaatcaccgagacagcgctagagggttacggaagcatctccatggagtgcagcccccgcaccgggctggacttcaacgagatggtcctcctgcaaatggaggacaaggcctggctggtgcatcgccaatggttcctcgacctgcccctgccgtggctcccgggctccgatacccaggggagcaactgggtccagaaggagaccctggtgaccttcaagaacccccacgcgaagaagcaggacgtcgtggtcctgggatcccaggagggcgccatgcactcagccctcacgggcgccaccgagattcagatgacctccgggaacctgttatttacagggcacctcaagtgccggctgcggatggataagctggagctcaagggtatgtcttactcaatgtgtacgggcaagtttaaagttgttaaggagatcgctgaaacgcaacacggtaccatcgtgatacgggtccaatacgaaggcgaggggagcccatgcaagataccgttcgaaatcatggacctggagaagaaacacgtgttggggcggctcatcacggtaaaccccatcatcacggaaaaggacaaacccacaaacatagaggcggagcccccgttcggagactcgtacatcctgatcggggtcgagcccggccagctcaagatgaattggttcaagaagggcagctccataggtcagatgttcgaaaccaccatgcgcggggctaagcgcatggccattcttggcgacacggcgtgggactttggcagcctaggcggtgttttcaactccattgggaaggcactgcaccaggttttcggggccgtctacaatgccgcgttctcgggggtaagttggaccatgaaaatcctgatcggcgtgattatcacctggatcgggatgaactcacggtccacgagcatgtctataacgctcgtcatggtagggctggtgaccttatacctcggcgtcgtggtacaggccgactccgggtgcgttgtgagctggaagactaaggagctgaagtgcggctccggtatcttcgtgaccgacaacgtccacgtgtggaccgagcagtacaagttccagcccgagagccccgctaagctagccgccgccatcaagaaagcccatgaggaaggtgtgtgtggcatccgctccgtcacacggctcgagaacatcatgtggaagcaaataaccccagagctaaaccacatcctgacagaaaacgacgtgaaggtgacgataatgacaggggacatcaagggtatccttcaacagggccgtcgggccctgcgcccccagcccactgaactgaagtacagttggaagtcctggggcaagagcaaaatcgtcagcagcgaaacccacaatcagacgttcctcatcgacgggccagagaccacggagtgccccgacaccaaccgggcgtggaactccctggaggtggaggactacggctttggtctcttcagcacgaacatctggctccgcctgagggagaagcaagacactctttgcgatagcaagctcatgtcggccgccgtgaaagatgagcgagcgatccacgcggacatgggctactggatcgagagcaagttgaacggcagctggaagatagagaaagcctcctttctggaggtcaaatcctgcacctggccgcggagccataccttgtggtccaacggggtgctagagagcgagatgatcatccccaagaacctgggaggcccggtgtctcagcataactaccgcccggggtactacacgcagaccaccggcccgtggcatttagggaagctggaaatggatttcgactattgcgagggcaccaccgttattgtgacggaggaatgcaataatcgggggccgagcctccgaaccacgaccgcctccggcaagctcatcacagagtggtgctgccgttcatgtactatgccacccctgcgcttcaaaggcgaagacggttgctggtacggcatggagatccggcccctgaaggagaaggaggaaaaccttgtaaattccttagtcaccgctgggcacggacagatcgacaatttcagcctagggatactaggcatcgctctgttcctggaggaggtgatgaaatcgcgcatcggcatcaagcacacaatcgggatgacgatcatcacctttctcttactggtgaccggtaacgtcagctaccgggatcttggtagagtcatactgatggtgggctccaccatggcggacgagatgggcatgggcgtcacgtacctggcactcctagccacctttcgcatccggcccaccttcgcactggcgcttatgatccgcaagctgaccagcaaggagctgttgatggccacgatcggcatagtactgatcgcccagtgcgatgtgccggggaccatcctagagatcaccgacgcatgcgcacttggcctgatgctgctcaagatgactcgggaactggagcgctaccaactggccgttacgctcttatccctgacctgcattccaaacgctaccatcatgtggggcgcatggaaggtgacctgcacgattctcactctggtgagcatggccccactctttctcaccacttcccggcagaagacggattgggtccccgttgcactcagcatctacggcttgaaccctaccgcgatctacttcaccacattagccaaggccaagaaaatcaggtcctggcccctgaacgaggcagtaatggcggtgggcatggtgagtatcctggcaagcagtctcctgcggaatgacatccctatggctgggcccttagtagccggcgggctcctgacactctgctatgttctcacaggccgctcggccgacctggagctggagaagtccgcggacatcaaatggaacgacgatgccgagattagcggctccagcccgataataaacgtggccgtatccgaggatggtagcatgtccatcaaggacgaggaggaggaaaacaccctcaccattctgatccggaccggactgctcgctatctcgggtatgtaccccatggcaatccccgcaaccgccgccgtatggtacttttgggaggcccgtaagcagcgtgccggcgtgttgtgggacgtcccatccccgccgcccaccggaaaggcggagctggaagagggcgcctaccggatcaagcaacgggggatcttcggttacagccagatcggcgccggggtttacaaggagggcaccttccacaccatgtggcacgtgactcgtggctcggtattgatgtgcaagggaaagcggctggagccgtcctgggccgacgtgaagaaggacctcatctcatacggaggcggctggagactcgacggggagtggacagagggcgaagaggtgcaggttctggcgttagagcccggcaaaaatcctcgggctgtacagaccaagcccggcatgtttaagacagacacggggcggatcggcgccgtgtctctcgacttcgcaccgggcacttccgggagccccatcatagataagaaggggaaggtcatcgggctgtatggcaacggcgtagtgatgaaatccggggcctacgtgagcagcatcgcacagaccgagaaaagggaggatgagatccccgagatcgaggacgacatattccgcaagagacgcctgactatcatggatctccaccccggcgccggaaagaccaagcggtacctgccggccatcgtgcgggaggccattaaacgcggcctccgtacactgatcctcgcacccacccgtgtggtggcggcggagatggaagaggccctacggggcttgccgattcgttaccaaacccccgccatccgggccgagcacactggcagggaaatcgtggacctaatgtgccacgcgacctttacaatgcggctgctgagcccagtccgcgtcccgaactacaacctaataatcatggacgaggcccactttaccgaccctgcgtccatcgccgcgcggggatatatagcgacgcgtgtggaaatgggggaggccgccggtatcttcatgaccgccaccccacccgggtccaaggatcccttccctcagagcaacgcgccgatcatggacgaagaacgggaaatcccagagcgctcctggaacagcggccacgaatggataaccgacttcgagggaaagacggtgtggttcgtcccgtccattagagccggcaatgatatagcgacttgcctgcggaaaaacggcaagaaggtcatccagctcagtcggaagacttttgacaccgagtacatcaagacacgcaacaacgactgggactttgtggtcaccaccgacatttcagagatgggggcaaacttcaaggctgagcgggtgatcgatcctagacgctgcatgaagcccgtgatcctcaccgacggcgaggagcgggtcatccttgcgggcccgatgcccgtgacgcccagctccgcggcccaaagacggggccgcattggtcggaacccgaagaatgaaaacgatcagtacatctacatgggcgagccactggagaatgacgaggattgcgcccactggaaggaagccaagatgttgctggacaatatcaacacccccgaaggcatcatccccgcgatgttcgggccggaacgtgaaaagaccgacgccatcgacggcgagtaccggcttcgcggggaaagcaggaaaacttttgttgagttgatgcgaagaggggaccttcccgtctggctggcatacaaggtggcgtccgagggttatagttacgccgaccgccggtggtgcttcgagggcgtgaagaacaatcagattctcgaggagaacctcgaggtcgaaatatggacgaaggaaggcgagcgcaaaaagctgcggcccaagtggctcgacgcgcgcacttactccgacccccaggccctcaaggacttcaaggagttcgccgctgggcgcaagtcgaccaccctgaacctcatcgcggagctaggccgcctgccgacctacatgacccagaaaacgcgggacgcgctagacaacttggccgtcctgcacactgcagaggagggtggccgggcctaccagcacgcgatttccgagctccccgaaactcttgagaccctgctcctgttgtgcttgcttgcaaccgtgagcggcggggtcttcctgtttttaatgtcaggaaaggggatcggcaagatgagcatggggctgggctgcatcatcaccgcctccggcctgctctggtatgcccagatccagccccactggatcgccgcgtccattatcctggagttcttcctgatcgtgttactgatccccgagccggagaagcaacgaactccccaggacaaccagttaacatacgtggttattgccattctcaccctggtcgccgctaccatggccaatgagatgggatacctagagaagacaaagaaagacctaggcttcgggaacccctacgtcgcaagccacgaggccgccatactggacatcgaccttcaccccgcctccgcctggacgctctatgcggttgctaccaccctgatcaccccgatgttgcgccacagcatcgagaactcctccacgaacgtgtccctcaccgcaatcgccaaccaggcgaccgtcctgatgggcttagggaagggatggcccctctcgcgcatggacctgggcgtccccttactagcactcggttgctactcccaggtgaaccctttaacattgacagcaagcctgctgttactgatcggtcactatgccatcatcggaccgggcctccaggccaaggcgactcgggaggctcagaaacgtaccgcagcaggcataatgaagaaccccacagtagacggcatcaccgtcattgatatcgaacccatcccctacgaccctaagttcgagaagcagctcggacaagttatgctcctggttttatgtgtggcgcaagtgctgatgatgcggacgacctgggcaatgtgcgaggccctgaccatcgccacggggcccatctccaccctgtgggagggcaacccaggcaagttctggaacaccaccatcgcagtgtctatggccaacatcttccgcggttcctacctggcgggcgccgggctgttgttcagcatcatgaagaacactgtgaccggccggcgcgggacaggcgttgccggggagactctaggcgagaaatggaagattaagctgaacggcctcgggcgtactgattttcagacctacaagcgctccggcatcattgaagtcgaccggaccctggccaaagaagggatcaagcgcggcgagaccaatcatcatgctgtatccagagggtccgccaagctccgctggttcgtggagagaaatttggtcaaacccgagggcaaggttatcgacctcggctgcggtcgcggagggtggtcctactactgcggcgggctgaaaaacgtgacggaagtcaagggcctcaccaagggcgggccgggccatgaggagcccatccctatgtctacttacgggtggaacctggtgaggctgcagagcggggtggacgtcttcttcacgcccccggagaaatgcgatacgctactgtgcgacatcggggagtccagcccaaatccaaccatcgaggccggccgcacactgcgagtactgaatatggtggagaactggctcggcaacaatcagttttgtatcaaagtcctcaacccgtacatgcccagcgtgattgagaaaatggagaacctccagcgtaagttcgggggcacactggtccggaatccgctgtcccgcaacagcactcacgaaatgtactgggtctccaacgccagtggcaacatagtttccagcgttaacatgatctcacgcatgttaatcaaccggttcacgatgaagcacaagaagcccacgtatgagcaggacgtcgacctaggcagcggtacccgcaacgtcgggatagagaccgagaagccaaaccttgagattatcggcaaacggatcgagaagatcaaggacgagcacaagcaaacatggcattacgacctggaccacccttataagacatgggcctaccacggctcctacgagacgaaacagaccggaagtgcgtccagcatgatcaacggcgtggtaaagttgctgacgaagccctgggacgtgatcccgatggtgacccaaatggcaatgaccgacactacgccctttggccagcagcgtgttttcaaggagaaggtggacacccgaacccccgagccaaaagagggcacaaagaagttaatgaagctcacggccaagtggctgtgggccgagctggggaggcacaaggtgccccggatgtgcacgcgtgacgagttcactaacaaggtccggtccaacgccgcgatgggcgccgtttttacggaggaaaaccgctggtcttccgccaaagaggcggttgaagacgaggccttttgggacctggtggaccgggaacgcaagctgcatctccagggcaagtgcgagacttgcgtctacaacatgatgggcaaacgggagaagaagctcggcgagttcggtcgcgcgaagggaagccgcgctatctggtatatgtggctgggagccaggttcctggagttcgaagctctcggcttcctgaacgaggaccactggttctccagagagaacagcctgtcgggcgtggagggagaggggttgcacaaacttggctacatcttgcgcgagatcggcgcgaaggatgggggcatgatgtacgccgacgacacagccgggtgggacacccgtgtcacagaggaagacctcaagaacgaggaaatgattagcgagcagatgaaaggggagcatcgcacgctggccgaggctatcttcaaactgacctaccaaaacaaggtggtgcgggtgcagcgcccgacccccaagggcaccgtgatggacatcatctcccgccgggaccaaagggggtccggccaggttggcacgtacgggctgaacacatttaccaacatggaagcgcagctgatccggcagatggagggggagggtctgtttcgcgacatcagcaagttaaccatccaggaagagacggccatcctgacctggctaaaggagaagggcagagaccgtttgtcccggatggccataagcggggacgactgtgtcgttaagccagtcgatgatcgcttcgcccacgccttaaccgcgttgaacgacatgggcaaggtccggaaggacatacagcagtgggaggcctccaaaggttggaacgactggacccaagtccccttctgctctcaccacttccatgaaatcatcatgaaggacggccgcaagctcgtcgtcccatgccgcaatcaagatgagctcatcgggcgcgcgagaatctcccagggcgcaggctgggccctgaaagagacggcgtgccttgggaaggcctatgcccagatgtggagtctgatgtacttccacaggagagacctgcgcctcgccgccaacgcgatctgctccgccgtccccagccactgggtcccgacctcccggaccacctggtccatccacgcccaccatcaatggatgactacggaagacatgctggacgtgtggaacagggtatggatcctagagaacccctggatggacgataaaacctgcgtcaagtcctgggaggaggttccgtacctgggcaagagagaggaccagtggtgcggctcgctgataggcttgacctcacgcgccacctgggctaagaatatcaaagtggccatcgagcaggtacgcagcctcatcggcaaggaggagtacacagattacatgccatcaatgaaacggttcaagcaggagcagtctacagagggcgccctgtggtag

SEQ ID NO: 25571 - RNA, 9876 nt, synthetic construct
  misc_feature 1..9876: note = derived and/or modified CDS sequence (opt11) from DENV-2__GU289914__SS-prME
  source 1..9876: mol_type = other RNA
agcgcgggtatgattataatgctgatacccaccgtgatggccttccatctcaccacccgcaacggggagccccacatgatcgtgtcccgtcaagagaaaggcaaaagcttactgttcaagaccgaggatggagtgaacatgtgcaccctcatggcgatggacctgggagagctgtgcgaggataccatcacctacaattgtcctctcctgagacaaaacgaacccgaggacatcgactgctggtgtaactccaccagcacttgggtgacctatgggacctgtaccaccaccggcgagcaccgtcgtgagaagaggagcgtcgccttggtgccccatgtgggcatgggtctcgagactcgcaccgagacgtggatgagctcggagggcgcctggaagcacgcccagcggatcgagacctggatattgcgccacccggggttcacgatcatggcagcgattctggcctacaccatcggcaccacccatttccagcgggccctcatcttcatactgctgactgccgtcgcgcccagcatgaccatgcgctgcatcgggatctccaaccgagacttcgtggagggcgtgagcggcgggtcctgggtcgacatcgtgctagaacacggcagctgcgttaccactatggccaagaacaagcccacactcgacttcgagctgatcaaaaccgaggccaagcagcccgcaacgctccgcaaatactgcatcgaggcaaagctcactaatacgaccaccgaatcccggtgccccacccaaggggagcccagcctgaacgaggagcaggacaaacgctttgtctgcaagcactccatggtggacaggggctggggaaacggttgtgggcttttcgggaagggcgggatagtgacgtgcgcgatgtttacgtgcaagaagaacatggagggcaaggtcgtccagcccgaaaacctggaatacactatcgtggtcacaccccacagcggcgaggagcacgccgtgggcaacgacacgggcaagcacgggaaggagatcaaggtcacgccgcagtccagcatcaccgaggccgagctgacgggctacgggaccgtcacgatggaatgtagccctcgcactggcctcgatttcaacgagatggtattgctgcagatggaaaacaaggcgtggctcgtgcatcgtcagtggttcctggacctgcccttaccctggctgccgggcgcagacacgcagggaagcaactggatccagaaggagacactagtaacgtttaagaacccccacgcaaagaagcaagacgtggtcgttttgggtagccaagaaggggccatgcataccgccctaaccggcgccaccgagatccagatgtccagcgggaacctcctgttcacgggccacctgaagtgccgcctgcgcatggataagctccagctgaagggtatgtcctactcaatgtgtaccgggaagttcaaggtggtcaaggagattgccgagacccaacacggaaccatcgtgatccgggtgcagtacgagggcgacggcagcccctgcaagattcccttcgagatcatggacctggagaaacggcacgtcctcggccgcctgataacggtcaaccctatcgtgaccgaaaaggacagccctgtcaacatcgaggcggagccgcccttcggggactcctacatcatcatcggcgtggacccggggcagctaaagctcaactggttcaaaaagggctcttccatcgggcagatgttcgagaccactatgcgcggcgcgaagcgaatggccatcctgggcgacacagcctgggacttcgggagcctgggcggtgtgttcacctccatcggcaaggccctccaccaggtcttcggagcgatctacggcgccgccttcagcggcgtgtcctggacgatgaagatcctgatcggggtgatcatcacctggatcggcatgaactcaagatccacaagcctcagcgtcagtctggtgctcgttggaatcgtaacgctgtacctgggggtgatggtgcaggctgactccgggtgcgtcgtcagctggaagaacaaggagctcaagtgcggatctggtatcttcatcacagacaacgtccacacctggacggaacagtacaagtttcagcccgagtccccttcgaaactggcgtctgccatacagaaggcgcaggaagaggggatctgcggcatacggagcgtcacccgcctggaaaaccttatgtggaagcagatcacccctgagctgaaccacatcctggccgaaaacgaggtgaaactcacaatcatgacgggcgacatcaagggcatcatgcaagccgggaagcgttccctgcgcccgcaaccaaccgagctaaagtattcatggaagacctggggcaaggcgaagatgctctccaccgagagccacaaccagacgttcctgatcgacggccccgaaaccgccgaatgcccgaacacgaaccgggcctggaactccctggaagtagaggactacggtttcggcgtcttcaccacgaatatctggctaaagctgaaggagaagcaggacgccttctgcgactctaaactgatgtccgccgccatcaaggacaaccgcgccgtacacgccgacatggggtactggatcgagagcgcactcaatgacacctggaagatcgagaaggcctccttcatcgaagtgaagaactgccactggccaaagagccacaccctttggtccaacggtgtcctagagtctgagatgatcattcccaagaacttggctggccctgtgtcccagcacaattacaggccagggtatcacacccaaatcgccggaccctggcatttagggaagcttgagatggacttcgatttttgcgacgggaccacggtggtagtgaccgaggattgcgggaacagaggcccctcactcaggaccacgaccgccagcggcaagctgatcaccgaatggtgttgccgctcctgcacgctgcccccgttacggtaccggggggaggacggctgctggtacgggatggagatccggcccctgaaggagaaagaggagaacctggtgaattctctcgtgaccgccgggcacggccaggtcgataacttctccctgggcgtgttaggaatggctctgttcctggaggagatgctgcgcacgcgggtcggcaccaagcacgccatcctcttagtggccgtgagctttgtcactctgataaccggcaatatgtccttccgcgacctcgggcgggtggtggtaatggtgggggccacgatgaccgacgatatcgggatgggagtgacctacctggccctgctcgcggcctttaaagtccgacccaccttcgccgccggcctgctgctccgcaagttaacgagtaaagagttaatgatgaccacgatcgggatagtgctgctttcccagtctaccatccccgagacgatcttggagctcaccgacgccctggcgctgggcatgatggttttgaaaatggtccggaacatggagaagtaccagttggcggtcactataatggccatactgtgcgtcccgaacgccgtgatcctccaaaatgcctggaaagtgtcctgcaccatcctggctgttgtgtctgtgagccccctgctcctgacgagctcccagcagaagaccgactggatacccctggctctcactatcaagggtctgaaccccactgccatcttcctgacgactttgtcgcggacatccaagaagcggagctggcctctgaacgaggcgatcatggccgtcggcatggtgtccatcctcgccagcagcctcttgaagaacgacataccgatgacaggcccccttgtcgcgggcggactcctgacggtctgctacgtgctgaccgggcggagcgcggacctcgagctggagcgggctgcggatgtgaagtgggaggaccaagccgagatctccggctccagcccaatcctttccatcaccatcagcgaagatggttccatgagcatcaagaacgaagaggaggagcagacgctaacgatcctgatacgcaccggcctgctcgtcatatccggcctattcccggtgtccatacccatcaccgccgcagcctggtatctgtgggaggtaaagaagcaacgcgcgggggtcctatgggacgtacctagcccgccgcctatgggtaaggccgagctggaggacggagcgtaccgcatcaagcagaaaggcatactgggctactcccaaataggcgccggcgtgtacaaggaggggaccttccatacgatgtggcacgtcacgcggggcgctgtcctcatgcacaaggggaagcgcatcgagccgtcctgggcggacgttaagaaggacctgatcagctacggcgggggatggaagctagagggtgagtggaaggagggggaggaggtacaggtgctcgccctggagcccggcaagaacccccgggccgtgcagaccaagcccgggctgttccgcaccaacgccggcactatcggggcagtctccctcgactttagccccggcacttccggatcccccatcatcgacaagaaggggaaggtggtgggcctgtacgggaacggcgtcgtaacccgttccggcgcgtacgtgagcgcaatcgcccagacagaaaagtccatcgaggataaccctgagatcgaggacgacatcttccgcaaacggcgcctgaccatcatggacctgcatccaggggccggtaagacgaagcggtacctccccgcaatcgtccgcgaggccatcaagcgggggttacgcactttaattctcgccccgacccgggtggtggcagcggagatggaggaagcgctgcgcggccttcccatcaggtaccagacccccgccatccgggccgagcacacggggcgcgagatcgtagacctcatgtgtcacgccaccttcaccatgagactgctgagcccagtgagggtgccgaactataacctcatcatcatggacgaagctcacttcactgaccccgcgagcatcgccgcccggggctatatctcaacgcgcgttgagatgggcgaggccgccgggatcttcatgaccgcgacgccgcccggtagtcgggaccccttcccccagtccaacgcccccatcatcgacgaggaacgcgagatccccgagcggagctggaacagtgggcacgagtgggtgaccgacttcaagggtaagacggtgtggttcgtcccgagcataaaggccggaaacgacatcgctgcatgcctgcgcaagaacggcaagaaagttatccagctgtcccggaagaccttcgactccgagtatgtgaagaccaggaccaacgactgggacttcgtcgtgactaccgatatctccgagatgggtgccaacttcaaggcagaacgggtgatcgatccccggcggtgcatgaagcccgtaatactcacagacggggaggagcgggtgatcctagccggcccaatgccggtaactcacagcagtgccgcgcagagacgcgggcgaatcggccgcaaccccaagaacgagaacgaccagtacatctacatgggggaacccctggagaacgatgaggactgcgcccactggaaggaggccaagatgctccttgacaacataaacacacccgagggcatcatcccgagcatgtttgagcccgagcgcgagaaggtcgacgccatcgacggcgagtaccgtttgcgcggggaagcccggaagacattcgtcgaccttatgcgacggggcgacttacccgtgtggctggcttacaaggtcgccgccgaggggatcaactacgccgaccgccgctggtgcttcgacggcatcaagaacaatcagatcctcgaggagaacgtggaggtcgagatctggaccaaggagggggagcgcaaaaagttgaagccgcggtggctggacgcgcgcatttactccgaccccttggcgctgaaggagtttaaggaatttgccgccggccgcaagtccctgaccctcaacctgatcactgagatgggccgcctgcccaccttcatgacccagaaggcccgggacgcgctcgacaacttagccgtcctgcacaccgccgaggctgggggccgcgcgtataaccatgcgctatccgagctgcccgagacgctggagaccctccttctactcaccctgctggccaccgtgaccggcgggatcttcctcttcctgatgagtggtcgggggatcggaaagatgacactgggtatgtgctgcattatcaccgcctccatactcctgtggtacgcccagatccagccgcactggattgctgcgagcataatcctggagttcttcctcatagtcctgcttatccccgaacccgagaagcagcgcacgcctcaggacaaccagctcacctatgtggtgatcgccatcctgacagtcgtggccgccaccatggccaacgagatgggcttcctggagaagacaaagaaggaccttggcctgggttccatcgcgacccagcagccggagagcaacatcctcgacatcgacctccggcccgccagcgcgtggacgctgtacgccgtggccaccaccttcgtcacacctatgctgcgccactccatcgagaacagctccgtgaacgtgagcctcacggcaatcgctaaccaagccaccgtcctgatggggctggggaagggctggccgctctccaaaatggacattggggtccccctgctggcaatcggctgttacagccaggttaaccccataactctaaccgcggccctgctgctcctggtcgcccactacgcaatcatcgggcccggcttacaggcgaaggccaccagagaagcgcagaaacgtgccgccgccggcatcatgaagaaccccaccgtggacggcatcaccgttatcgacctcgacccgattccctacgaccccaaattcgagaaacagctgggccaggtcatgctgctcgtgctgtgtgtgacccaggtcttgatgatgcggacgacctgggcgctttgcgaggcgctgaccctggccaccgggcccatctccacgctttgggagggcaacccgggacgcttctggaacaccaccatcgcggtgagcatggccaacatattccgcggctcctacctggcgggcgccgggctcctcttcagcatcatgaagaacaccacgaacacccgaagaggcactgggaatatcggcgaaacactgggcgaaaagtggaagtcgcggttgaacgcgctcgggaagtcggagttccagatctacaaaaagtccggcatccaagaggtggacaggacgctggccaaggaagggattaagcggggcgagaccgaccaccacgcggtctcgagggggtctgccaagctgcgatggttcgtagagcgcaacatggtgaccccggagggcaaagtcgtggatctcggctgcgggaggggcgggtggagctactactgcggggggctgaagaacgtgcgagaggtgaagggcctgaccaagggagggcccggccacgaggagcccatcccgatgtcaacgtacggatggaatctcgtgaggctgcagagcggcgtggacgtcttcttcataccgcccgagaagtgcgacaccctcctctgtgatatcggagagtccagccccaacccgaccgtggaggctggtcgcacgctgcgggtgctgaacctcgtcgagaattggctgaacaacaatacgcagttctgcatcaaggtgctgaacccctacatgcccagcgtaatcgagaagatggagaccctccagcgcaagtacggcggggccctcgtccggaatccgctttcccgcaacagcacccacgagatgtactgggtgtccaacgcctcgggcaacatcgtgagcagcgtcaacatgatctcccggatgctgatcaaccgcttcaccatgcggcacaagaaggcgacctatgagcccgacgtggatctcgggtcgggcacgcggaacatcgggatagagtccgaaatccccaacttggatatcatcggcaagcgcatcgagaagattaaacaggagcacgagacgagctggcactacgaccaggatcacccatataaaacctgggcctaccatggctcatacgagaccaaacaaacggggagcgcctccagcatggtgaacggcgtcgttcggctgttaacgaagccgtgggacgtggtccccatggttacccagatggccatgaccgacaccacccccttcgggcagcaacgcgttttcaaggaaaaggtcgatacccggacccaggagcccaaggagggcacaaagaagctaatgaaaatcaccgctgagtggttgtggaaggagttgggcaagaagaagacccctcgcatgtgtacccgggaggagttcacgcgcaaggtgcgatccaacgcggccctgggagccatcttcaccgacgagaataagtggaagtccgcgcgcgaggccgtggaggactcccggttctgggagctagtggacaaggagcgtaacctccacctggagggcaagtgcgagacctgcgtgtacaacatgatgggtaagcgagagaaaaagctgggcgagttcgggaaggcgaagggcagccgcgccatctggtacatgtggcttggggcccggttcttagagttcgaggccctggggttcctcaatgaggaccactggttctcccgcgagaacagcctgagcggcgtcgagggggagggactgcacaagctggggtacatcctgagagacgtgtccaagaaggagggcggcgcgatgtacgccgacgacaccgccgggtgggatacgcgcatcaccctggaggacctcaagaacgaggagatggtaaccaaccacatggagggcgagcacaagaagctggccgaagctatcttcaaactgacctaccagaacaaggtggtgcgcgtgcagaggcccaccccccgggggaccgtcatggacatcatcagccgccgggaccagcgcggctccggccaagtgggcacgtatggcctcaacaccttcacgaacatggaggcgcagttaattcgccagatggaaggtgagggcgtgttcaagaatatccagcacctcacagtcaccgaggagatcgcagtgcagaactggctagcccgggttgggcgcgagcggctaagccgcatggccatctccggcgacgactgcgtcgtgaaacccctggatgaccggttcgccagcgcgctcaccgcccttaacgacatggggaagatccgaaaggacatccagcagtgggagccgtcccgggggtggaacgactggacgcaggtccccttttgcagccatcatttccacgaactgatcatgaaggacggccgggtcctagtggtcccctgtcggaaccaggacgagttgatcgggcgggcccggatctcccaaggggccggttggagcttgagagaaaccgcctgcctaggcaagtcctatgcgcagatgtggtcactgatgtatttccacagacgcgacctgcggctagcggccaatgccatctgctccgccgtccccagccactgggtgccgacctcccgcactacatggagcattcatgcgaagcacgaatggatgaccaccgaggacatgcttaccgtttggaaccgggtctggattcaggagaacccctggatggaggacaagacccccgtggaatcctgggaagagatcccttacctgggcaagcgcgaggaccagtggtgcggcagcctcataggcctgacgagccgggccacctgggccaaaaatatccaagccgccatcaaccaggtgcgctccttgatcgggaacgaagagtacaccgactacatgccgagcatgaagcggtttagacgcgaggaggaggaggctggcgtactctggtga

SEQ ID NO: 25572 - RNA, 9876 nt, synthetic construct
  misc_feature 1..9876: note = derived and/or modified CDS sequence (opt11) from DENV-2__AY858036__SS-prME
  source 1..9876: mol_type = other RNA
accgccggcattatcatcatgatgatccccacggtgatggccttccatctgaccacccggaacggggagccccacatgatcgtcagcagacaggagaaaggtaagagcctcctattcaagacggagaacggggtgaacatgtgcaccctgatggccatggacctcggcgagttgtgcgaggacactataacctacaattgtcccctgttacgccaaaatgagcccgaggacatcgattgttggtgtaacagcacctccacatgggtgacgtacgggacctgtaccgcaaccggtgagcacaggcgcgagaagcggagtgttgctctggtgccgcatgtgggcatgggactggaaacgcgcaccgagacctggatgtctagcgagggggcctggaagcacgcccagcggatcgagacctgggttctcagacaccccgggtttaccatcatggctgccattctggcgtacacaattggcaccacttacttccaacgggtcctgatcttcattctattgacggccgtggcgccatccatgaccatgcgctgcatcgggattagcaatcgggacttcgtcgaaggcgtttcggggggttcatgggtggacatcgtcctggagcacggctcctgcgttaccacaatggccaagaacaaacccacgttagacttcgagctgatcaagaccgaggccaagcaccccgccaccctgaggaagtactgcatcgaagccaagctcaccaacacgaccaccgcgtctcgttgtccgacccagggggagccctcccttaacgaggagcaggacaagcgcttcgtgtgcaagcactctatggtcgaccggggctggggcaacgggtgcggcctgttcgggaagggcggcatcgtcacgtgcgccatgttcacgtgcaagaagaacatggagggcaagatcgtgcagcccgagaatttggagtacacaatcgtcatcacgccccactccggcgaggagaacgccgttgggaacgacacgggcaagcacggtaaggagatcaaggtgaccccgcagagctccatcaccgaggccgagctgaccggttatgggaccgtcacgatggagtgctccccccgcaccggactggactttaatgaaatggtgttactgcagatggagaataaggcctggctcgtgcatcggcagtggttcctcgacctgcccctgccctggctcccaggcgcggacactcaggggtccaattggatccaaaaggagaccctggtaacattcaagaacccccacgccaaaaagcaggacgtggtcgttctggggagccaggagggcgccatgcacaccgccctcactggcgccaccgagatccagatgagcagtggaaacctgctctttacgggccacttgaagtgccgcctgcggatggacaagctgcagctcaagggcatgagctactccatgtgtaccgggaagttcaaggttgtcaaggagattgcggagacccaacacggcaccattgtgatcagagtgcagtatgagggtgacggcagcccctgcaagatccccttcgaaatcatggacctggaaaagcgtcacgtcctgggccgcctcatcacggttaacccgatagtcaccgagaaggactcacccgtcaatatcgaggccgagccgcccttcggggacagctatataataataggcgtggagccagggcagctgaagcttagttggttcaagaagggcagctccatcggccagatgttcgaaaccaccatgcggggcgccaagcggatggccattctcggcgacacagcgtgggatttcggttctctgggcggggtgtttacctccatcggtaaggcgctacatcaggtattcggtgccatctacggagccgccttcagtggcgtgtcctggaccatgaagattctcatcggggtggtgatcacctggatcggcatgaatagccgctccacgagcctgtccgtaagcctggtgctggtcggggtggtgaccctctacctgggcgtgatggtgcaggcggactccggttgcgtggtcagctggaagaacaaggaactgaaatgcggaagcggcatttttgtgaccgacaacgtgcacacctggacggaacagtacaagttccagcccgaatccccaagcaagctggcatccgcgattcagaaggcccatgaggaagggatctgtggcatccgaagcgtcacccgcctggagaacttgatgtggaagcaaataaccccggagctcaaccacatcttatctgagaacgaggtgaagttgactatcatgacgggggacatcaagggcatcatgcaggccggcaagcggagcctccggccgcagcccaccgagttgaagtattcctggaagacctggggaaaggcgaagatgctcagcaccgagttgcataaccacacgtttctgatcgacggccccgagaccgccgagtgcccgaacaccaaccgggcctggaactcccttgaggtggaggactacggattcggcgtcttcaccacaaacatctggttgaagctaaaggaaagacaagatgtgttctgcgactcgaagctgatgtccgccgcgatcaaggacaaccgggcggtgcacgccgacatggggtattggatagagagcgccctcaacgacacctggaagatcgagaaggcatcctttatcgaggtcaagagctgccactggcccaagtcgcacaccctgtggagcaacggcgttctggagtctgagatgatcatccccaaaaacttcgctggacccgtgtcgcagcacaactaccgcccggggtaccacacccagaccgctggcccgtggcacctggggcggttggagatggatttcgacttctgcgagggcacgaccgtcgtggtgaccgaggattgcgggaaccgtggcccttcgctccggaccacgaccgcctcaggcaagctcattaccgaatggtgttgccgcagctgtaccctgcccccgctgcggtaccgcggggaggacggctgctggtacgggatggagatacggcccctcaaggaaaaagaggagaaccttgtcaactccctggttacggccggccacgggcagattgacaacttctcactcggggtgctgggcatggccctgttcctagaggagatgctcaggacccgggtcggcaccaaacacgcgatcctgctcgtggccgtgtccttcgtgaccctgataacgggcaatatgagcttccgcgatctgggccgtgtgatggtgatggtcggcgctaccatgaccgatgacatcggaatgggggtgacctacctcgcccttctggccgcattcaaggtccggcccacgttcgcagccggcttactgctacgtaagctcacctcaaaggagttgatgatgaccacaatcgggatagtcctgctcagccagagcacgatccccgaaaccatcctggagctgactgacgccctcgccctgggcatgatggtcctgaagattgtgcggaacatggagaagtaccagctcgcagtgaccataatggccatcctgtgcgtgccgaatgcagttatcctgcagaacgcttggaaggtgagctgcacgacgctcgccgtggtctccgtgagccccctgctcctcacctcttcacagcagaaggcggactggatccccctagcactgaccataaaagggctcaaccccacggccatctttctcaccaccctggcccgcacctccaagaagagaagctggccgctcaacgaagccatcatggccgtgggcatggtctccatcctggccagttccctgttaaagaacgacatccccatgacgggcccgctggtagctgggggactcctcacagtgtgctatgttcttaccgggcgctcggccgatctagaactcgagcgggcggccgatgtgcgctgggaagagcaggccgagatctcaggctcaagcccgatcctgtctatcaccatcagcgaggacgggtcgatgagcatcaagaatgaggaagaggagcagacgctgaccattctaattcggaccggcctgctggtgatctccggcctcttccctgtcagcatacccatcaccgctgccgcctggtacttgtgggaggtgaagaagcaacgcgccggggtgctgtgggacgtcccctccccgccgcccgtgggcaaagcggagctcgaggatggcgcctatcggattaagcagaagggaattctggggtacagccagatcggcgccggcgtgtacaaggaaggtacttttcatacgatgtggcacgtcaccaggggcgcggtgcttatgcacaaggggaaacggatcgagccctcctgggccgacgtgaagaaggatctaatcagctacggcgggggatggaagctggagggcgagtggaaggagggggaggaggtccaggtgctggcgctagaacccggcaagaatccccgcgccgtgcagaccaagcccgggttgttcaaaaccaacacgggcaccatcggagccgtcagtctggacttcagccccggcacctccgggagccccatcgtggacaagaagggtaaggtggtcggcctctacgggaacggggtggtgactagatccggcacatacgtctctgcaatcgcccagaccgaaaagtccatcgaggataaccccgagatcgaagatgacatcttccgtaagaagcggttaaccataatggacctgcacccgggggccggcaaaaccaagcgctaccttcccgctatcgtgcgggaggcgatcaagcgcgggctccggacgctgatcctggccccgacccgcgtcgtagccgcagaaatggaggaagccctccgcggcctgcccatccgctaccagacccccgcgattcgcgccgagcacaccgggagagagatcgtcgacctgatgtgccacgcgacgttcaccatgcgcttgctgagcccaatccgggtgccgaactacaacctgatcattatggacgaggcccacttcaccgaccccgccagcatcgcggctcgaggctatatatccacccgggtcgagatgggcgaggcagcggggatcttcatgacggccacgccgccaggtagccgcgatccgttcccccagtccaacgctcccatcatggacgaggagagggaaatacccgagcgcagctggaattccgggcacgagtgggtgaccgacttcaagggcaagaccgtgtggttcgtcccaagtatcaaggccggaaacgacatcgccgcctgcttaagaaaaaacggtaagaaggtaatccaactgtcccgtaaaacatttgacagcgagtacatcaagacccggaccaatgactgggacttcgtggtcacgacggacatctccgagatgggggcgaacttcaaggctgagcgcgtaatcgatccccggcgctgtatgaagcccgtgatcctgaccgatggagaggagcgggttatcttagccggccccatgccggtgacccacagctccgccgcgcagcgtcgtggccgagtgggccgcaaccccaagaacgagaacgaccagtacatctacatgggggagcccctggagaatgacgaggactgcgcgcactggaaggaggccaagatgctcctcgataacatcaacaccccagaaggcatcatcccgtccatgttcgagcccgagcgagaaaaagtcgacgccatcgacggcgagtaccgtctgcgcggggaggcccggaaaacgttcgtggatctcatgcggcgcggagacctgcccgtctggctggcatatcgggtggctgccgaggggatcaactacgccgaccgccggtggtgtttcgacggcgtgaagaacaaccagatcctagaagagaacgtcgaggtggaaatctggaccaaagagggagagaggaagaagctcaagccgcggtggttggatgcccgcatctactccgaccccctggccctcaaggaattcaaggagttcgcggctggcaggaaaagcctcaccctgaacctcatcaccgagatgggccggctgcccacgttcatgacacagaaggcgcggaacgccctggacaacctggcggtcctgcacaccgccgagaccgggggacgcgcttacaaccacgccctatccgagctccccgaaacgctggagaccctattattgctgactctccttgccaccgtcaccggcggcattttcctgttcctcatgagcggcaagggtattggcaaaatgacgctgggtatgtgctgcatcatcaccgcctccatcctgctctggtatgcccagatccagccgcactggatcgccgcgagcatcattctggagttcttcctgatcgtgctcctgatccccgagcccgaaaagcagcggactccccaggacaatcagctgacctacgtggtcatcgccatcctcaccgttgtggccgccaccatggccaacgaaatgggcttcctggagaagactaagaaggacttcggactgggctccatcaccacgcagcagccagagagcaacatcctcgacatagacttacgccccgcaagcgcctggaccctgtacgcggtcgccaccaccttcataacgcccatgctgcggcactccatcgagaacagctccgtgaacgtgagcttgacggccatcgccaaccaagcaaccgttctgatgggcttgggcaagggctggcccttatccaagatggacataggggttcctctgcttgcgatcggttgctacagccaggtgaaccctatcaccctgacggcggccttgctcctgctcgttgcacactacgcgatcatcggacccggcctccaggcaaaggccacccgcgaggcccagaagcgggccgcggccggcatcatgaagaaccccaccgtcgacgggatcaccgtgatcgatctggacccgatcccctatgaccccaagttcgaaaaacaactgggccaggtcatgttactggtgctgtgcgtgacgcaggtgttgatgatgcgcaccacttgggccctgtgcgaggcccttacgctcgccacggggccgatctccaccctgtgggagggcaacccggggcgtttctggaacaccaccatcgcggtgagcatggccaacatcttcaggggctcctacctggccggcgccgggctcctgttcagcatcatgaagaacacggccaacacccgccggggcaccgggaacaccggcgagacgttaggtgagaagtggaaaaacagattgaacgcgctggggaagtccgaatttcagatctacaagaagtccggcatccaagaggttgaccggactctggctaaggaagggattaagcgcggtgagaccgaccaccatgccgtctcccggggctcagccaagctacgctggttcgttgagcggaacctggtgacgcccgagggcaaggtagtggatttgggctgcgggcgcggcgggtggtcctactactgcggggggctcaaaaacgtgaaggaggtgaagggcctgacgaagggtgggcccggccatgaggagcctatcccgatgagcacctacggatggaacctggtgaggctccagagcggcgtggacgtcttcttcacgccgcccgagaagtgcgacaccctgctgtgcgacatcggggagagctcccccaacccgaccgtggaggcgggacgcacgctccgggtgctgaacctggtggagaactggctcaataacaacacccagttctgcatcaaggtactgaacccctacatgcctagcgtgatcgagaaaatggaagccctgcagcgcaagtatggaggggccctggtccggaacccgctcagccgcaattcgacccatgaaatgtactgggtgagcaacgcctccggcaacatcgtcagctccgtcaatatgatcagccggatgctcatcaaccgcttcaccatgcggcacaagaaggccacgtatgaacccgacgtggacctggggtccggcacccgcaacatcgggatcgagagcgagacacccaacctcgacattatcggcaagcgcatcgaaaagatcaagcaggagcacgagacctcctggcactacgaccaggaccacccctataagacgtgggcgtatcacggcagctacgagaccaagcagactgggtccgccagctccatggtgaacggcgtcgtccggctgctgaccaagccgtgggatgttatacccatggtcacgcagatggccatgaccgacaccactccattcgggcagcagcgcgtgttcaaagagaaggtcgacacgcggacccaggaacccaaggagggcacaaagaagctcatgaagatcaccgccgagtggttatggaaggagttgggaaaaaaaaagacaccgcgtatgtgcacccgggaggagtttacccgaaaggtgcgaagcaacgccgcgctcggggcgatcttcactgacgagaataaatggaagtccgcccgcgaggccgtggaggactccgagttctgggagctggtcgacaaggagcggaacctgcacctcgagggcaagtgcgagacctgcgtgtacaacatgatggggaaacgcgagaagaagctaggcgagttcgggaaagccaagggctcccgggcgatctggtacatgtggctgggcgctcgcttcctcgagtttgaggcactggggttcctaaatgaggaccactggttcagccgggagaactccctcagcggagtggagggggagggcctgcacaagctagggtacatcctccgcgacgtctcgaagaaggaaggcggcgcaatgtacgcggacgacaccgccggctgggacacccggatcaccctggaggacctgaagaacgaggagatggtgacgaaccacatggagggcgagcacaagaaactggccgaggcaatctttagacttacctaccagaacaaagtggtccgggtgcaaaggcccacgccccggggaaccgtgatggacatcatcagtcgccgggaccagcgcggctcaggtcaggtcgtgacgtacggactaaacaccttcaccaatatggaggcccaactcatccgccaaatggagggcgaaggggtgttcaagtccatccaacacctgaccgtcacggaggagatcgcggtgaagaactggttggtacgggtcggccgcgagcgcctcagccgcatggcaatatccggcgacgactgcgtggtgaagcccctagacgacaggttcgcctcggccttaaccgccctcaatgacatggggaaggtccgcaaagacatacagcagtgggaaccgtcccggggttggaacgactggacccaggtccccttttgcagccaccacttccacgagctgatcatgaaagacgggcgcgtgctggtagtgccctgccgcaatcaggacgagctcatcgggcgcgcgcggatctcccagggggccggctggagcctgcgcgagaccgcctgcctcgggaagtcctacgcccaaatgtggtcactcatgtacttccaccggagagacctccggctggcggcgaatgccatctgcagcgctgtccccagccactgggttcccacctcacgcacgacctggagcatccacgccacccacgagtggatgaccaccgaggacatgctcaccgtgtggaaccgggtatggatccaggagaatccttggatggaagataagacccccgtcgagtcctgggaggagatcccctacctggggaaaagggaggaccagtggtgtggcagcctgatcgggctcaccagccgagccacgtgggcgaagaacatccagactgccatcaatcaggtgcgctccctgatcggaaacgaagagtataccgactacatgccttctatgaagcgcttccggcgcgaggaggaggaggcaggggtactgtggtag

SEQ ID NO: 25573 - RNA, 9876 nt, synthetic construct
  misc_feature 1..9876: note = derived and/or modified CDS sequence (opt11) from DENV-2__HQ332184__SS-prME
  source 1..9876: mol_type = other RNA
accgcgggtgtgatcatcatgctgatccccaccgccatggccttccacctcaccacccgcaacggtgagccccatatgatagtaggccggcaggagaaggggaagtccctgctgttcaagaccgaggacggtgtgaacatgtgcaccctcatggccatcgacctgggggagctgtgcgaagatacgatcacgtacaagtgccccttactgcgccagaacgagcccgaggacatcgattgctggtgcaactctaccagcacctgggtgacctacgggacctgcaccactactggcgagcaccggcgcgagaagcggtccgtcgccctggtgccacacgtggggatgggcctcgagactcgcaccgagacctggatgagctccgaaggggcttggaagcacgttcagcggattgagacctggatcttgcgccaccccggcttcaccatcatggccgcgattttagcctacaccatcgggaccacgcatttccagcgggcgctaatcttcatactactgacagccgttgcccccagcatgaccatgcgctgcatcggcatctccaatcgtgacttcgtggagggcgtcagcgggggctcctgggtggacatcgttttagagcacggtagctgcgtcaccactatggccaagaacaagcccacccttgattttgagctgatcaagactgaggccaagcagcccgccaccctccgtaagtactgtatcgaagccaaactgacgaataccaccaccgagtcccggtgtccgacacagggagagcccagcctgaacgaggagcaggacaagaggttcatctgcaagcactccatggtggaccgggggtgggggaacggctgcggcctgttcggaaagggcgggatcgtgacctgcgccatgtttacgtgcaagaagaacatggagggcaaggtcgttcaaccggagaatctggaatacaccatcgtgatcacgccgcacagcggagaggagcacgcggtcggcaacgatacggggaagcacggcaaggagatcaaaatcaccccgcagtccagcatcactgaagccgagttaactgggtatggcacagttaccatggagtgttccccccggactggcctcgacttcaacgaaatggtgctgctgcaaatggaggacaaggcctggctcgtccacaggcagtggtttctggaccttcctttgccctggctgccgggggccgacacccagggtagcaactggatacagaaggagacgctggtgacctttaagaacccccacgcgaagaagcaggacgtggtcgtgctcgggtcccaggagggcgcgatgcacaccgcccttactggcgccaccgagatccagatgagtagtggcaacttactattcaccggccacctgaagtgccgcctgcggatggacaagctgcaactgaaagggatgtcctatagcatgtgcaccggcaagttcaagatcgtgaaggagatcgccgaaacccagcacgggactatcgtgatccggatccagtacgagggcgacggctccccatgcaaaatacccttcgagataaccgacctggagaagcggcacgtattgggacgccttatcacggttaacccgatcgtgattgagaaggacagccccgtcaacatcgaagcggagcccccgttcggtgactcctacatcatcattggggtcgagccgggccaattgaagctcaactggttcaagaaggggagctccatcgggcagatgttcgagaccacgatgaggggtgccaagcggatggccatacttggggacaccggctgggatttcgggtccctgggcggggtgttcacctctatcggcaaagccctccaccaggtgttcggcgccatctacggggcggcgttcagcggcgtgtcctggacaatgaaaatcctcatcggtgtggtgatcacgtggatcggcatgaacagccgctccacatcgctgtccgtcagcctggtactggtgggggtggtgaccttgtacctgggcgccatggtccaagcagactccggctgcgtcgtgagctggaagaacaaggagttaaagtgcgggtcggggatcttcatcaccgacaacgtgcatacgtggaccgagcagtacaaattccagcctgagagccccagcaagctggcctccgccatccagaaagcccacgaggaggggatctgcggtatccggtcggttacccgcctagagaacctcatgtggaagcagatcacgcccgagctgaaccacatcctgtccgagaatgaggtgaagctcacgattatgaccggggacaccaaaggtatcatgcaagccggcaaacggagcctgcgcccgcagcccaccgagctgaagtactcctggaagacgtgggggaaggccaagatgctcagcactgagtcccacaaccagaccttcctgattgacggcccggagaccgcggagtgcccgaacacgaaccgggcctggaacagcctggaggtagaagactacgggtttggcgtattcactaccaacatctggctcaagctgcgcgagaagcaagacgtgttctgcgactccaagctgatgagcgccgcaatcaaggacaaccgggcagtacacgcggacatgggctattggatcgagtccgccctcaacgatacctggaaaatggagaaagccagcttcattgaagtcaagtcctgccactggcccaagagccacaccctgtggtccaacggggtgctggaatccgagatgatcattcccaagaacttcgccggccccgtaagccagcacaactaccgaccgggataccacacgcaaactgcgggtccctggcacttgggaaaactggagatggacttcgacttctgtgagggcactaccgtggtcgtgacggaggactgtggcaaccggggacccagcctgcgcacaaccaccgctagcggcaaactcataactgagtggtgctgtcggtcctgcaccctcccgccgcttcgctaccgcggggaggatggctgctggtatgggatggagattcgccccctcaaggaaaaggaggagaacttagtcaacagtttagtgaccgcgggccacgggcagatcgataacttctccctcggggtgctgggcatggccctgtttctcgaggagatgctgcggacacgggtcgggacgaagcacgccacacttctggtggcagccagcttcgtgacactgatcactggcaacatgtccttccgggacctggggcgtgtcatggtgatggtgggcgccacgatgaccgacgatatcggaatgggagtcacctacctcgcccttctggctgcgtttaaagtgcgacccaccttcgctgctggcctcctgctgcggaagctcacgagcaaggagctgatgatggccaccatcgggattaccctactatcccaaagtaccatccccgagacgatacttgagctgaccgacgcgctcgctctgggaatgatggtgctgaagatcgtccgcaacatggagaagtaccaactcgccgttaccatcatggccatctcttgcgtgcccaacgccgtaatcttacggaacgcctggaaggtgtcctgcactatcctggcggccgtatccgtcagccccctattgctgacttccagccagcagaaggccgactggatccccctcgccctgaccatcaagggcctgaaccccaccgcgattttcctcaccacgctttcccgcaccagcaagaagcgttcctggccgctgaacgaggccatcatggccgtggggatggtcagcatcctcgcctcctccctgctgaagaacgacatccccatgaccggccccctcgtggccgggggcctactgaccgtgtgctacgtcctcacggggcgcagcgcggacctggagctggagcgggccgccgacgtcaaatgggaggaccaagcagagatcagcggcagctcacccatcttgtccattaccatctccgaggacggaagcatgtcaatcaagaacgaggaggaggagcagacactgactatactgatccgcaccgggctcctggtgataagcggcgtcttcccggtgtccatccccatcacggctgcggcctggtacctatgggaagtgaagaagcagcgtgccggggtgctctgggacgtgcccagccctccccccgtgggcaaagctgagctggaggacggtgcctaccggatcaagcagcggggcatcctgggctattcccagatcggggcgggggtctacaaggaggggaccttccacaccatgtggcacgtgactcgcggggccgtgttaatgcatcgcgggaagcgcatcgagcccagctgggctgacgtcaagaaggacctgatctcctacggcggggggtggaagctggagggcgagtggaaggagggggaggaagtccaggtgctcgccctggagcccggcaagaatccgcgggcggtccagacgaagcccgggatcttcaagaccaacaccgggaccatcggcgcggtgagcttggatttcagccccgggacgagcggctccccaatcgtagacagaaaagggaaggtcgtgggcttatacggtaacggggtggttacccggagcggcgcctacgtgtcagccatcgcccagactgaaaagtccatagaggacaatcccgagatcgaggacgacatcttccgcaagaagcgtctgaccatcatggacctgcaccccggggctggcaaaacgaagcgctacctcccagccatcgtgcgggaggccataaagcgcggtctgcgaaccctgatcctagctccgacccgggtcgtagccgcggagatggaggaggcactccgcggtctccccatcagataccagacacccgcgatcaaggccgagcacacgggccgcgagatcgtagacctcatgtgtcacgccactttcaccatgcggctcctgagccccgtccgcgtgccgaactacaatctgatcatcatggacgaggcccacttcaccgaccccgcctccatcgccgcaagagggtatatcagcacgcgcgtggaaatgggcgaggcagccggtatatttatgaccgccacgccgcccggctcccgggacccgttcccccaaagcaacgcccccatcatggatgaggagcgagagatccccgagaggtcgtggaacagcgggcacgagtgggtcactgacttcaagggcaagacggtgtggttcgtgccgtccatcaaggccggcaacgatatcgcggcctgcctccgcaagaacgggaagaaggtcatacagctgagccggaagacctttgactccgagtacgtaaaaacccgcgccaacgactgggacttcgtggtcaccactgacataagcgaaatgggcgccaatttcaaggccgagcgggtcatcgacccccgccggtgcatgaagcccgtgatcctgaccgacggggaggagcgcgtcatcctcgccggccccatgccggtcactcactcctccgccgcccagcggcgcggccgcatcggcagaaaccctaagaatgagaacgaccagtacatctatatgggtgagcccctggagaatgatgaagactgcgcacactggaaggaggccaagatgttgctcgacaacatcaacacgcccgaggggatcatcccgtctatgttcgagcccgagcgcgagaaggtggatgccatcgacggcgagtaccggctccgcggggaggcccggaagactttcgtggacctgatgcgccgaggcgaccttcccgtctggcttgcgtataaggtggcggccgaggggatcaactacgcggaccgcaagtggtgcttcgacggcatcaagaacaaccagatcctggaagagaatgtagaggtggagatctggaccaaggagggcgagcggaagaagctcaagccgcgctggttagacgcccggatctacagcgatcccctggccctcaaagagtttaaggaatttgccgcggggaggaagagtcttacgctgaatctcatcacggagatgggacggctgcccacttttatgacccagaaggcccgcaacgccctggacaacctcgccgtgctgcacaccgctgaggccggcggtcgggcctataaccacgccctcagcgagctgccggagacccttgagacgctgctcctgctgaccctcctggccaccgtcaccggcgggatattcctatttctcatgtccgggaagggcatcggcaagatgactctggggatgtgctgcataataacggccagcgtactactctggtacgctcagatccagccgcattggatcgcggcgtccatcatcttggagttcttccttatcgtcctcctaatcccagagcccgagaaacagcgcaccccccaggataaccagctgacctatgtggtgatcgcaatcctcaccgtcgtggccgcgactatggccaacgagatgggctttctggagaagactaagaaggacctaggtctcgggagcatcaccacccaagagagcgagtcgaacatcctagacatcgacttacgaccggcaagcgcctggacgctctacgccgtggcgaccaccttcgtcacccccatgctgcgccactccatcgagaacagctcggtgaacgtgtcactgacggccatcgccaaccaggctaccgtcctcatgggcctggggaagggctggcccctgtccaagatggacatcggggtgcctctcttggcgatcggctgctactcacaggtgaacccgatcacattaaccgccgccttactgctgctcgtggcgcactacgccatcatcggcccggggctccaggcgaaggccacgagagaggcccagaagcgggccgccgcgggcatcatgaagaatcctaccgtggacgggatcaccgtaatagacctggagccaatcccgtacgaccccaagttcgaaaagcagctcggccaggtgatgctgctgatcctatgcgtgacccaagtgctgatgatgagaacgacttgggccctgtgcgaggccctcacactggccaccgggccgatttccacgctgtgggagggcaaccccggccgtttctggaacaccaccatcgccgtctccatggcgaacatattccgcggtagctacttggccggcgccgggttactgttcagcataatgaagaacacaacgaatacccgtcgcggcactggcaacatcggggagaccctcggcgagaaatggaaatcccggctgaacgccctcggcaagagcgagttccagatctacaagaagtcaggcatccaggaggtggaccgcacgctcgcaaaggaggggatcaagcggggtgagaccgaccatcacgcggtgagccgcggctccgccaagctgcggtggttcgtcgagcgcaacatggttacccccgaggggaaggtggtcgatctaggctgcgggcggggcgggtggagctactactgcggcggcttgaaaaacgtgcgcgaggtaaaggggctcaccaagggtgggcccggacacgaagagcccatccccatgtccacttacgggtggaacctggtaaggctccagagcggcgtggacgtgtttttcaccccgcccgagaaatgcgacaccctgctgtgcgacatcggcgagagctccccaaacccaaccatcgaggccgggcgcaccctccgggtcctgaatttggtcgaaaattggttgaataataacacgcagttctgcatcaaggtgctgaatccgtacatgcccagcgtcatagagaagatggagaccctgcagcgcaagtacggcggggccctcgtgcggaaccccctgtcccgcaattcgacccacgagatgtactgggtgtcaaacgccaccggtaacatcgtcagtagcgtgaacatgatcagccgtatgctgatcaaccgattcacgatgaagcacaagaaggccacctatgagccggacgtagatctggggtctggcacccggaatatcggtatcgagagcgagatacccaacctcgacatcatagggaagcgcatcgaaaagatcaagcaggagcatgagacctcctggcactacgaccaggaccacccttacaagacgtgggcgtatcacggcagctacgagaccaaacagaccggatccgcgtcttctatggtcaacggcgtagtgcggctgttgaccaagccctgggacgtagtaccgatggtgacgcaaatggccatgactgacactacacccttcggacagcagagagttttcaaggagaaggtggacacgcgcacccaagagcccaaggaggggacaaagaagctcatgcgaatcaccgcggagtggctgtggaaggagctgggcaagaagaagacgccccgcatgtgtactcgggaggagttcacccgcaaagtgcggagcaacgccgccctcggggcgatcttcaccgacgagaacaagtggaagtccgcccgcgaggcggtcgaggacggccggttctgggagctggtcgacaaggaacgcaacttgcacctcgagggcaaatgcgaaacttgtgtgtataacatgatgggcaagcgggagaagaagctgggcgagttcgggaaggccaagggcagccgcgccatctggtacatgtggctgggggcccggttcctcgaattcgaggcgctgggctttctgaacgaggaccactggttctcacgcgggaacagcctcagcggcgtcgagggggagggtctgcaccggctgggctacatactccgcgacgtaggcaagaaagagggcggggccatgtacgccgacgacaccgccggctgggacacccgaatcaccctggaggatctaaagaacgaggaaatggttactaaccacatgaagggcgagcacaaaaaactggccgaggcgatcttcaagctcacctaccaaaataaggtggtacgcgtccagcggccaacaccccgcggcaccgtgatggacataatctctcggcgcgaccaacgcgggagcggccaagtggggacgtacggcctgaataccttcaccaacatggaggcccagctcatccggcagatggaaggagagggcatctttaagtccatccagcacctaaccgccacggaggagatcgcagtgcagaactggcttgcccgggtggggcgggaacgcctcagccggatggcgatctctggggacgattgtgttgtgaagcccatagacgatcgcttcgccagcgccctgaccgccctgaacgacatggggaaggtccgaaaagacatacagcagtgggagccctcccgcggctggaacgactggacccaggttcccttctgcagccaccacttccacgagctcgtcatgaaagacggaagggtgctggtggtcccctgccgcaaccaggacgagttaatcgggcgggcccgcatttcccagggcgctggttggtcgctcaaggagactgcctgtctgggcaagtcgtatgcccagatgtggaccctgatgtacttccaccggagagacctccggctggccgccaatgcgatctgctctgccgtcccatcccactgggtccctacaagccgcaccacctggtccatccacgccaagcacgaatggatgacaacggaggacatgctggcggtctggaaccgggtgtggatccaggagaacccgtggatggaggacaagacccccgtggagagctgggaggaggttccctacctcggcaaacgcgaggaccagtggtgcgggtccctgatcggactaaccagccgggcgacatgggccaaaaacatacagacggccatcaaccaggtgcgcagcctcatcgggaatgaggagtacaccgactacatgcccagtatgaagaggtttcggcgcgaggaggaggaagccggcgtcctctggtga

SEQ ID NO: 25574 - RNA, 9876 nt, synthetic construct
  misc_feature 1..9876: note = derived and/or modified CDS sequence (opt11) from DENV-2__HQ332185__SS-prME
  source 1..9876: mol_type = other RNA
actgccggcgtgatcatcatgctgatcccaaccgccatggcgttccacctgaccacccggaatggggagccacacatgatcgtcggacggcaggagaaggggaagtccctgctgttcaagaccgaagacggcgtgaatatgtgcaccctcatggccatcgacctaggggagctgtgcgaggacaccatcacctataagtgccccctcctgcgtcagaacgagcccgaggacatcgactgctggtgtaacagcaccagcacctgggtgacttacgggacctgcaccaccacgggggagcacagacgggagaagagatccgtcgccttggtcccccacgtggggatgggcctcgagacccgcactgagacctggatgtcatccgagggggcctggaagcacgtacagcggatcgagacctggatcctgcgccacccgggcttcaccatcatggccgcaatcctggcatacaccataggcaccacgcacttccagcgggccctcatctttattctgctgaccgccgtcgcgccaagcatgaccatgaggtgcatcggcatcagcaaccgggacttcgtcgaaggcgtcagcgggggatcctgggtggacatcgtgctcgagcatgggtcgtgcgtcactacgatggccaagaataagcccacgctggactttgagttaatcaagaccgaggccaagcagcccgccactctccgcaagtactgcatcgaggccaagctgacgaacaccacgaccgaatcccggtgcccgacgcagggggaacccagcctcaacgaagagcaggacaaacgcttcatctgcaagcacagtatggtggatcggggctgggggaacggctgcgggctgtttggcaagggcgggatcgtgacctgcgcgatgttcacgtgcaaaaagaacatggagggcaaggttgtacagcccgagaatctggagtacaccatagtcatcacgccgcactcaggggaagaacatgccgtcggcaacgacaccgggaagcacggcaaggagatcaagatcaccccgcaatcgagtatcaccgaggctgagctgaccgggtatgggacggtgaccatggagtgcagcccgcggaccggcctcgacttcaacgagatggtcctgctacagatggaggacaaggcctggctagtgcaccggcagtggttccttgaccttcccctcccctggctcccgggggccgacacccagggaagcaattggattcagaaggagacgctggtcaccttcaagaacccccacgcgaagaagcaggacgtggtcgtgctcggatcccaggagggcgccatgcacaccgctctgaccggagccacggaaatccagatgagcagcggtaacctcctcttcaccggccacctgaagtgccggctgcggatggataagctgcagctcaagggcatgtcctacagcatgtgcaccggcaagttcaagatcgtcaaggaaatcgcggagacccagcacggtacgatcgtgatccggattcagtacgagggcgacggctccccctgcaagatccccttcgaaatcaccgacctagagaaacggcacgtgctcgggcgcttgatcaccgtcaacccgatcgtgatcgagaaggacagcccagtgaacatcgaggcggagccgccctttggggactcctatatcatcatcggggttgagccgggccagttgaagctcaactggttcaagaaaggtagctccatcggccagatgttcgagacgacgatgcgcggcgcaaagcggatggccatcttaggggacaccgcctgggacttcggctcgctcggcggggtgttcacctccatcgggaaggcgctccaccaggtattcggggcaatctatggcgccgccttcagcggtgtctcgtggaccatgaagatcctaatcggagtggtgatcacatggatcgggatgaactcccggtccaccagcctgtccgtcagcctggtgctcgtcggcgtcgtgaccctttacctaggggccatggtgcaggcggactccggatgcgtcgtaagctggaaaatcaaggagctcaagtgcggctccggcatcttcataaccgacaacgtccacacgtggaccgagcagtacaagtttcagccggaaagccccagcaagttagcctccgccatccagaaggcccacgaggagggcatatgcgggatccgttctgtcacccggctggagaacctcatgtggaagcagatcacccccgaactgaaccatatcctgtcggaaaacgaggtaaagctaacgatcatgacgggggacactaaggggatcatgcaggccgggaaacggtcactgcgcccgcagccgaccgagctgaaatactcgtggaagacctggggcaaagcgaagatgctcagcacagagtcccacaaccagaccttcctgatcgacggccccgagacggccgaatgcccgaacacgaaccgggcctggaacagccttgaggtggaggactacggtttcggggtcttcaccaccaacatctggctcaagctgcgcgagaagcaggacgtgttctgcgactccaagctgatgtccgccgccatcaagaacaatcgggcggtccacgccgacatgggatattggatcgagtctgccctcaacgacacctggaagatggaaaaggcctccttcattgaggtcaaatcctgccactggcccaagagtcacacactttggagtaacggcgtgctggagagcgagatgataatccccaagaacttcgccgggcccgtttcacaacataactaccgcccaggctaccacacgcagacggcgggaccctggcacctaggcaagttggagatggacttcgatttctgcgaagggaccaccgtcgtggtgaccgaggactgcggcaaccggggccccagcttgcgcaccaccaccgccagcgggaaactcatcacggagtggtgctgccgctcctgcaccctgcccccgctgcgataccggggcgaggatggatgttggtatgggatggagatccgccccctcaaggagaaggaggagaatctggtcaacagccttgtgaccgcaggtcacggtcagatcgacaacttctccttaggcgtgctggggatggccctgtttctcgaggaaatgctgcggacgcgcgtcggcacgaagcacgcgatactgctggtggccgtgagcttcgtcaccctgatcaccgggaacatgtccttccgcgacttaggccgcgtaatggtgatggtgggcgccaccatgacggacgacatcggtatgggcgtgacctacctcgcccttctggctgcgttcaaggtgcgccccaccttcgccgccgggctcctgctgcggaagctcaccagtaaggagctgatgatggccacgatcggcatcaccctcctttcacaaagcaccatccccgaaaccatcctggagcttacggacgccctcgcgttaggtatgatggtcctgaagattgtgcgcaatatggagaaataccagctcgctgtgaccatcatggccatttcctgcgtcccgaacgctgtcatcctgcggaacgcctggaaggtctcctgcaccatcctggcggccgtcagtgtcagccccctattactgacatcgagccagcagaaggccgactggatccccctcgccctgactatcaagggtctgaacccaacagcgatcttcctcacaacactgtcccgcacaagcaaaaagcggtcctggccgttgaacgaggccatcatggccgtgggcatggtgtccattctcgcctccagcctgctgaagaacgacatccccatgaccgggcccctcgtggccggcggtttactgaccgtgtgctacgtgctcacgggcaggagtgcggacctggagctggagcgggccgcagacgtcaagtgggaggatcaggcggagatctccggcagctcccctattctctcgatcaccatcagtgaggacggcagcatgtctatcaagaacgaggaggaggagcagacgcttaccatcctgatccgcaccggcctcctggtgatcagcggggtgttccccgtgtccatccccatcaccgcagcggcctggtacttatgggaagtgaagaagcagcgggccggcgtgctctgggacgtgcctagcccgccgcccgtcgggaaggcagagctggaggatggcgcatatcgcatcaaacagcggggaatcctgggctactcccaaattggcgcgggggtgtataaggagggcacgttccacaccatgtggcacgtgacccgcggggcagttttaatgcaccggggtaagcgcatcgagcccagctgggccgacgtgaaaaaggacctgatttcctacgggggcggctggaagctggagggggagtggaaggagggagaggaggtgcaagtactcgccctggaacccgggaaaaacccccgggccgttcagacaaaacccggaatcttcaaaacgaacacagggaccatcggcgcggtgagcttagacttctcccccggaaccagcgggtcccccatcgttgaccggaaaggtaaggttgtggggttatacggcaacggggtcgtgacgcggtcgggggcctacgtgtccgccatcgcccagacggagaaatccatcgaggacaaccccgagatcgaggacgacatcttccgcaagaaacggctgactatcatggacttacaccccggggcggggaagacgaaacgctacctccctgccatcgtccgagaggcgatcaagcgcggcctgcgcacgctgatcctggctccgactcgggtggtagcagcggagatggaggaggcccttcgcgggctgcccattcgctaccaaaccccggccatcaaggcagaacataccggccgggaaattgtcgacctgatgtgccacgccacgttcaccatgcgacttctgagccccgtgagggtgccgaactataacctgatcatcatggacgaggcgcatttcactgaccccgcgtccatcgccgcaaggggatacattagcacccgcgttgagatgggggaagccgcgggtatcttcatgactgccacgccgccggggtcccgggacccgttcccgcagtccaacgcccccattatggacgaggagcgcgagattcccgaaagatcttggaacagcggccacgagtgggtgaccgacttcaaggggaagaccgtgtggtttgtcccgtccatcaaagccggcaatgatatcgcggcatgcctcaggaaaaatgggaagaaagtgatccagctgagcagaaagacgttcgactccgaatacgttaagaccagagcaaacgactgggacttcgtagtgacaaccgatatctccgagatgggcgcaaacttcaaggccgagcgggtgattgacccccgccgctgtatgaagcccgtcatcctgacggacggcgaggagcgcgtgatcctcgcggggcccatgccggtgacccattccagcgccgcccagcggcgcggcaggatcgggcggaaccccaagaacgagaatgaccagtatatatacatgggcgaaccccttgagaacgatgaggactgcgcccactggaaggaggctaagatgctgctcgacaacatcaacacccccgagggcatcatcccgtcgatgttcgagcccgagcgcgagaaggtcgacgcgatcgacggggagtaccggttacgcggcgaagctcggaagaccttcgtggacctgatgcgccgcggagaccttcccgtttggctggcctacaaagtcgccgccgaggggatcaactacgctgaccgcaaatggtgcttcgacggaatcaagaataaccagatactggaggagaacgtggaggtggagatttggacgaaggaaggcgagcggaagaagctaaagccgcgctggctcgacgcccggatctacagcgatcccctggctctcaaggagttcaaggagtttgccgctggccgcaagtccctgaccctgaacctcatcaccgagatggggcggctgcccaccttcatgacgcagaaggcccgcaatgccctggacaacctcgccgtcctgcacactgcagaggcgggcgggcgggcctacaaccacgccctgagcgagctccccgagaccctggaaacccttctcctgctgacgctcctggccactgtaaccggaggcatcttcctgttcctcatgtccgggaagggaatcgggaagatgacgctgggcatgtgctgcattatcaccgccagcgtcctgctctggtacgcgcagatccagccgcactggatcgccgcctccatcatcctggagttttttctgatagtgctccttatccccgagccagaaaagcagagaacgccccaggacaaccagctgacctacgtcgtcatcgccatcctcaccgtggtggccgcgaccatggccaacgagatggggttcctggagaaaacgaagaaagacctgggcctcgggagcatcaccacccaggaaagcgagtccaacatattggacatcgacctgcggccggcgagcgcatggaccctctacgccgtcgcgacgacctttgtgacgcccatgctccgccacagcatcgaaaattcatccgtgaacgtaagcctgactgctatcgcgaaccaggccacggtgctgatgggtctggggaaggggtggcccctgtccaaaatggacatcggggtgcccctcctggcgatcgggtgctactctcaggtcaacccgatcactctgacggctgcactcctgctgctcgtggctcactatgccattataggtcccggcctgcaggcaaaggccacccgggaggcccagaagcgcgccgccgcgggcataatgaaaaatcccacggtggatggcatcaccgttattgacctggagcctatcccgtacgacccaaagttcgagaagcagctcggtcaggtcatgttactgatcctctgcgtgacgcaagtcctgatgatgcggacaacgtgggccctgtgtgaggccctcacactggccacaggtcccatttccactctgtgggagggcaaccccggacgcttctggaacacgaccattgccgtgagcatggcgaacattttccgcggctcctacctcgccggggctggcctgctgtttagcatcatgaagaacacgaccaacacgcggcgcgggaccgggaatatcggtgagaccttaggagagaagtggaagtctcggttaaacgccctgggcaagagtgagttccagatctacaagaagtcaggcatccaggaggtggaccgcaccttggcgaaggaaggcatcaagcgcggggagacggaccaccacgccgtgtcccgaggctccgccaagctgagatggtttgtggagcgcaacatggtgaccccggagggaaaagtcgtggacctgggatgcggccgcggcggttggagctactactgcggcgggctcaagaacgtccgcgaagtcaaagggctgaccaagggcggccctgggcacgaggagcctatccccatgtccacatacggctggaacctggtccggctccagagcggggtggacgtcttcttcacgccgcccgaaaagtgcgacaccctcctgtgcgacatcggcgagagctcccccaacccaacaatcgaggccggccgcacgctgcgggtgttgaatctggtggagaattggctcaacaataatacccagttctgcatcaaggtcctaaacccgtacatgcccagcgttatcgagaagatggagactctgcaacgcaagtacgggggagccctcgtgaggaaccccctgtcccgaaacagcacgcatgagatgtactgggtctccaacgctaccgggaacattgtgtcatctgtgaacatgattagccggatgctgataaatcgtttcaccatgaagcacaagaaggccacgtatgagccggacgtggacctgggctccgggacccgcaatattggaatcgaaagcgagattcccaacctcgacatcatcggcaagcgcatcgagaagatcaagcaggagcacgaaacctcttggcactacgaccaggaccacccctataagacctgggcttaccacgggagttacgagacgaagcagaccggctccgcctcttccatggtaaacggggtggtcaggctcctgaccaagccctgggacgtggtgcctatggtcacccagatggccatgacggacaccacaccctttggccagcagagggtgtttaaagagaaggtggacaccagaactcaggagcccaaggaaggcaccaagaagcttatgcggataaccgcagagtggctgtggaaggaactggggaagaagaagactccccggatgtgcacgcgggaggagttcacccgcaaggtccggtccaacgcggctctcggcgccatctttaccgacgagaacaagtggaagtccgcccgagaggctgtggaagacgggcgtttctgggagctggtggacaaggaacggaacctgcacttggagggcaagtgcgaaacctgcgtctacaatatgatggggaagcgggagaagaagcttggagaattcggcaaggccaaagggagccgcgccatctggtacatgtggctgggcgcccggttcctcgagtttgaggcgctcggattcctgaatgaagaccactggttctcccgcggcaacagcctcagcggtgtggaaggcgagggcctgcaccgcctcggttatatcctccgcgacgtaggcaagaaggagggcggcgccatgtacgccgacgatactgccgggtgggacacacggatcaccctggaggacctgaagaatgaggagatggtaacgaaccacatgaagggcgagcacaagaagctagcagaagcgatcttcaagctgacgtaccagaacaaggtggtccgtgtgcaacggccgacgccccgcggcaccgtcatggacatcatctcccggcgcgaccagcgagggtctggccaggtcggtacctacgggttaaacacgttcaccaacatggaggcccagctcatacggcagatggagggcgaggggatcttcaagtccatccagcatctaacagccacggaggagatcgccgtgcagaactggctggcacgcgtgggccgggagcgcctcagccggatggcgatctccggggacgactgcgtcgtgaaacctatcgacgaccgcttcgccagcgccctgacggccctaaacgatatgggcaaggtgcggaaagatatccagcagtgggagccctcccgcgggtggaacgactggactcaggttccgttctgttcacaccactttcatgagctcgtgatgaaggacggccgtgtcttagtcgtgccttgccgcaaccaggacgagctcatcggccgggcccgcatctcccagggggcgggctggagccttaaggagaccgcctgtctagggaagtcctacgcccagatgtggaccctgatgtacttccaccggcgcgatctcagactcgccgccaacgcgatttgcagcgccgtgcccagccactgggtccctaccagccgcactacatggtcgatacatgcaaaacacgaatggatgaccaccgaggacatgctggccgtgtggaaccgggtgtggatccaggaaaacccgtggatggaggacaagacgcccgttgagagctgggaagaggtgccatacctcggtaaacgcgaggaccagtggtgcgggtccttgataggcctgacctcccgcgcgacctgggccaaaaacatccagacagccatcaaccaagtgcgcagcctcatcggcaacgaggaatacacggactacatgccctccatgaagcgattccggcgcgaggaagaggaggccggggtcctgtggtga

SEQ ID NO: 25575 - RNA, 9876 nt, synthetic construct
  misc_feature 1..9876: note = derived and/or modified CDS sequence (opt11) from DENV-2__HQ332186__SS-prME
  source 1..9876: mol_type = other RNA
accgcaggcgtgattgtcatgctgatccccaccgccatggcgttccacctgaccacgcggaatggggagccccatatgatcgtgggccgccaggagaagggtaagtccctgctgttcaaaactgaggacggagtgaacatgtgtaccctcatggccatcgacctgggggagctgtgtgaagacaccatcacctacaagtgcccgctcctgcggcagaacgaacccgaggacatcgattgctggtgcaatagcaccagcacgtgggtcacctacgggacctgcaccaccacgggagagcacagacgggagaagaggagcgttgccctggtgccacacgtcgggatgggcctggagacccgcacagagacctggatgagcagcgagggcgcgtggaaacatgtgcagcggatcgagacctggatccttagacacccgggtttcaccataatggctgcgatcctggcctacaccatcgggaccacacacttccagagagccctcatcttcatcctgctgacggctgtggcgccctctatgactatgcgttgtatcgggataagcaaccgggacttcgttgagggcgtgagtgggggctcctgggttgacatcgtcttagagcacgggagctgcgtgaccacgatggccaagaacaagcccacgcttgacttcgagttgattaagaccgaggccaagcagcccgccaccctccgcaagtactgcatcgaggctaagctgacgaacacgaccaccgagagccggtgcccgactcaaggagagcccagcctgaatgaagagcaagacaagcgcttcatctgcaagcactccatggttgaccgggggtgggggaacggctgcggcctgttcggcaagggcgggatcgtgacctgcgcgatgttcacgtgtaagaagaacatggagggcaaggtggttcagccggagaacctggagtataccatcgtcatcacgccccatagtggagaagagcacgccgtgggaaacgacaccggcaagcatggcaaggagatcaagattaccccgcagtcctccataacagaggccgaactgaccgggtacgggaccgtgactatggagtgcagccctcggaccggcctcgacttcaacgagatggtcctgctccaaatggaggacaaggcttggctcgtgcaccgacagtggttcctggacctgcccctgccctggctcccgggggccgatacccagggcagcaactggatccagaaggagacgctcgtgacattcaagaacccccatgcgaagaagcaggatgtcgtggttctcgggtcccaggagggcgccatgcataccgcccttaccggggccacggagatccagatgagctcaggcaacctcctgttcaccggccacttgaagtgccgcttgcggatggacaaactccagctgaaggggatgtcctattccatgtgtaccggcaaattcaaaatcgtgaaggagatcgccgagactcagcacgggacaatcgtgatccgcgtccagtatgagggggacggcagtccctgcaagatccccttcgagatcaccgacctggaaaagagacacgtgctcgggcgcctgataaccgtcaacccgatcgtcatcgagaaagacagccccgttaacatcgaggcggagcctcccttcggcgactcctacatcatcatcggcgttgagccgggacagctgaagctcaactggttcaagaaaggaagctctataggccagatgttcgaaaccacgatgcgcggcgccaagcggatggccatcctgggggacaccgcctgggacttcggcagcttaggcggggtctttacgtccatcggaaaagcccttcaccaggtgttcggggcgatctacggagccgccttcagcggagtgtcctggaccatgaagatactgatcggggtcgtaatcacgtggatcgggatgaacagccggtccacctccctgtccgtgtctctggtcctcgtaggcgtggtcaccttatacctaggggccatggtgcaggcggactccggttgcgtggtgagctggaagaacaaggagcttaagtgcggctccgggatattcatcacagacaacgtgcatacgtggacagaacagtacaagttccaacccgaaagccccagcaagctggcctccgcaattcagaaggcccacgaggagggtatctgcggaatccgcagcgtgacccgcctggagaacctcatgtggaaacagatcacgcccgagctgaaccacatcctatccgagaacgaggtgaagctaacaatcatgaccggcgacaccaaggggatcatgcaggctggcaagcggagcctgcgccctcagcccaccgagctgaaatatagctggaagacgtggggcaaggcgaagatgttgagcaccgagagccataaccagaccttcctaatcgacgggccggagaccgccgagtgcccgaacacgaaccgtgcctggaacagtctggaggtagaggactacggcttcggggtgttcaccaccaacatctggcttaagctgcgcgagaaacaggacgtcttctgcgactccaagttaatgagcgccgccatcaaggacaaccgggcggtgcacgccgatatgggctactggatcgagtccgccctcaacgatacctggaagatggagaaagcgagcttcatcgaagtcaagtcctgccattggcccaagagccacactttctggtccaacggggtccttgagagcgagatgatcatccccaagaacttcgcaggtccagtgtcccagcataactaccgcccggggtaccacacccagatcgcggggccctggcaccttggcaagctcgagatggacttcgacttttgcgaggggaccaccgtggtcgtgaccgaggactgcggcaaccggggtccctcgctgcgcacgaccaccgcaagcgggaagctgatcaccgaatggtgctgccggtcatgcacgctcccgcccctgcgctaccggggcgaggacggttgctggtacggcatggagatccggcccctgaaggagaaggaggaaaatctcgtgaacagcctagtcaccgccggacacggccagatcgacaatttctcccttggcgtgctcggaatggccctgttcctggaagagatgttgagaacccgcgttggcaccaagcacgcgatcctgctggtggccgtgagcttcgtgactctcatcaccgggaacatgtccttccgggacctgggtcgcgtgatggtgatggttggggcaaccatgaccgacgatatcggcatgggtgtcacgtacctggccctcctggccgcgttcaaggtgcgcccaacctttgccgcggggctgttattgcggaagctgacgagcaaagagctcatgatggccactatcggcattacgctgctgtcccagagcacaatccccgagaccatcctggagctgaccgacgccctggcgttaggtatgatggtgctgaagatcgtccgaaacatggagaagtaccagctggcagtgacgatcatggcgatctcctgtgtgccgaatgccgtcattctccggaacgcctggaaagtgagctgcaccatcctggcggccgtctcagttagccccttactgctgacctccagccaacagaaagcggattggatacccctcgccctcacaatcaagggcctgaatcccacggccatcttcctgacgacgctctcccgcacaagcaagaagcggtcctggccgctgaacgaggccataatggccgtgggcatggtctcgatcttggcctccagcctcctgaagaacgacatcccgatgacagggcctctagtggctggcgggcttctgaccgtgtgctacgtcttaacgggccgcagcgcggatcttgagctggagcgggccgcggacgtgaagtgggaggaccaggccgagatctccggctcgtcccccatcctgagcattaccatctcggaggacggctcgatgtccatcaagaacgaggaggaagaacagacgctcacgatcttaatccgcaccggccttctcgtaattagcggggtcttcccggtgtccatccccatcaccgccgcggcatggtacctgtgggaagtgaagaagcaacgagccggagtcctgtgggacgtgccctccccgccgcccgtggggaaggcggagctcgaggacggtgcttaccgcatcaagcagcgggggatcctggggtattcccagatcggcgcgggggtctacaaggagggcaccttccatacgatgtggcacgtcacccgcggggccgtactgatgcaccgaggcaagcgcatagagcccagctgggcggacgtcaagaaggacctcatctcctacggtgggggctggaaactggagggggaatggaaggagggggaagaggtccaggttctggcactcgagccaggaaagaaccctcgggcggtgcagaccaagcccggtatttttaagaccaatactgggaccatcggcgcggtgagcctggacttctcccccggcacctcggggtccccgatcgtggaccgcaagggcaaggtagtgggactctacggcaacggcgtggttacccggagcggtgcttacgtgtccgcaatcgcccaaacggagaagtccatcgaggacaatcccgagatcgaggatgacatcttccgcaagaagcggttaaccatcatggacctacaccccggcgcggggaagactaagcgctacctgccggccatagtgagggaagccataaagcgcggcttacgtactctgatcctggccccgacacgagtcgtagccgcagagatggaagaggccctgcgcgggctccccatacggtaccagacgcccgccataaaggccgagcacacgggccgcgagatcgtggacctgatgtgccacgccacctttacgatgcgactgctcagccctgtgcgagtgcccaactacaaccttataattatggacgaggcacacttcaccgaccccgcctcaatcgcagcaagaggctacatcagcacacgcgtggaaatgggggaagcagcgggcatcttcatgaccgccactccgcccgggtcccgggatccgttcccccagagcaacgcccccatcatggacgaggaacgcgagatccccgagagatcctggaatagcggccacgagtgggttactgactttaaggggaagaccgtatggtttgtgccgtccattaaggccggtaacgacatcgcggcctgcctgcgcaagaacggcaaaaaagtcatccagctatctcggaagaccttcgactccgagtacgtaaagacccgcgccaacgattgggacttcgtcgtcaccaccgacatcagcgagatgggggccaactttaaggccgagagagtgatcgaccccagacggtgcatgaaacccgtgatcctgaccgacggcgaggagcgcgtcatcctggcggggcccatgccggtgactcactcgagcgccgcccagcggcgcggccgcatcgggcgtaatcctaagaacgagaacgaccagtacatctatatgggcgagcccctcgagaacgacgaggactgcgcccactggaaggaggcaaagatgctgctggacaacatcaacacccccgagggtataatcccgtcgatgttcgagcccgagcgcgagaaagtagacgcgatcgacggcgagtaccggctccgcggcgaggcccggaagaccttcgtcgacctaatgcgccgcggggacctgcccgtgtggctcgcctacaaggtggccgctgaaggcatcaactacgcggatcgcaaatggtgcttcgacgggatcaagaacaaccaaatcctggaggagaacgttgaggtggagatctggaccaaggagggtgagcggaagaagctgaagccgcgctggcttgatgcccggatctacagcgatcccctggcactgaaagagttcaaagaattcgcagcgggccgcaagtccctgacgctgaacctcatcacagagatggggcggctccccaccttcatgacccagaaggcccgcaacgccctggacaacctggccgtcttgcacacggccgaggcgggtgggcgggcctacaatcacgccctgagcgagttacccgagaccctcgagaccctactgctcctgaccctgctcgccacagtgaccggcggcatcttcctgttcctgatgtccgggaaaggcatcgggaagatgaccctcggcatgtgttgtataatcactgccagcgtattgctgtggtatgcgcagatccaaccgcattggatcgccgcatccatcatcctcgagttctttcttatcgtcttactcataccggaacccgagaagcagcgcacgccccaagacaaccaactgacgtatgtggtgatagccatcctgactgtcgtagccgcgaccatggccaacgagatggggttcctggaaaagactaagaaggacctgggcctcggcagcatcacgacccaggagccggagagcaacatcctcgacatagacctgcggcccgcctccgcatggaccttgtacgctgtagcgaccacttttgtcacccccatgctccgccattcaatcgaaaactccagcgtgaacgtatccttgaccgccatcgccaaccaggctacggtcctgatgggtctcggtaaggggtggccattaagcaaaatggacatcggagtgccgctgctcgctatcgggtgctactcccaggttaaccccatcacgctgaccgccgccctgttgctgctcgtcgcccactatgccatcatcggccccggcctccaggcaaaggccacccgggaggcccagaagcgcgctgcggcggggatcatgaagaatcccaccgtggacggcatcacggtgatcgacctcgagccgatcccttatgaccccaagtttgagaagcagttagggcaggtcatgctcctgatcctgtgcgtgacgcaagtgctcatgatgcggactacttgggccctatgcgaggccctgacactcgcaaccggcccaataagcactctttgggaggggaacccgggtcgcttctggaacacgacaatcgccgtgtccatggcaaatatcttccgcggctcttacctggccggggccggtctgctgttttcgatcatgaagaataccacaaacacccggcgggggacgggcaacatcggcgagaccctgggggagaaatggaagtccaggctcaatgccctgggcaagtccgagttccagatctacaagaagtcagggattcaagaggtggaccgcaccctggcgaaagagggcatcaagagaggtgagaccgaccatcacgcggtgtcccggggcagcgccaagctgcggtggttcgtagaacgcaacatggtgacgcccgagggcaaggtggtcgacctggggtgcggccgcggcgggtggagctactactgcggcgggctgaagaacgtacgcgaggtgaagggtctcacaaagggcggtcccgggcacgaggagcccataccgatgtccacctacggctggaaccttgtccggctgcagtccggggtggatgtgtttttcacaccgcccgaaaagtgcgatacactcctgtgtgacatcggagagagctcacccaacccgaccatcgaggcgggccgcaccctgcgagtcctcaacctggtggagaactggctgaacaataacacccagttctgcatcaaagtgctcaatccctacatgccctccgtcatcgagaagatggagactctgcagcgcaagtatgggggcgccctcgttcggaacccgttgtcacgtaactccacccacgagatgtactgggtcagcaacgccaccggtaacatcgtgtccagcgtgaacatgatctcccggatgctgatcaaccgcttcaccatgaagcacaagaaggccacctacgaacccgacgtagaccttggctcggggactcggaacatcggcatcgagtccgagatccccaacctggacataatcggaaaacgcatcgagaagatcaagcaggagcacgagacgagctggcactacgaccaggaccacacctacaagacctgggcctaccacggatcctacgagacgaagcagaccggcagtgcctccagcatggtcaacggggtggtccgcttattgaccaagccctgggacgtcgtgccgatggtgacccagatggccatgaccgacaccactcccttcggccagcagcgggtcttcaaggagaaggtcgacacccgcacgcaggagcccaaagaaggcaccaagaagctgatgcggatcaccgcggagtggctgtggaaggagctcgggaagaagaagacgccccggatgtgcacgcgggaggagttcacccgcaaggtgagatccaatgccgccctaggcgccatcttcaccgacgaaaacaagtggaagtccgcgcgcgaggcggtcgaggacgggaggttctgggagctcgtggaccgcgagcggaacctgcacctggagggcaagtgcgagacttgcgtctacaacatgatggggaagcgcgagaagaagctcggagagttcggcaaggctaagggatcgcgggccatctggtacatgtggctgggcgcccgcttcttggagtttgaagcgctcgggttcctcaacgaggaccactggttcagccggggcaactccctaagcggagtggagggcgagggcctccatcgcctggggtacatcctgagggacgtgggcaagaaggagggcggcgcaatgtacgccgacgacacggccgggtgggacacccgcatcaccctcgaggacctgaaaaacgaggagatggtcaccaaccacatgaagggcgagcacaagaagctggccgaggcgatcttcaagctcacgtaccaaaataaagtggtgcgggtccagcgcccgacgcccagaggcaccgtgatggacatcatcagcaggcgagaccagcgggggtccggccaggtggggacctacggcctcaacaccttcacaaacatggaggcacagctgatccgccagatggagggcgaaggcatcttcaagagcatccagcacctgaccgtcaccgaggagatagcagtgcagaactggctggcccgtgtcggccgcgagcggctttcccgcatggccatcagcggggacgactgcgtcgtgaagccgatagacgaccggttcgcttccgccctcaccgccctgaacgacatgggcaaggtgcgcaaggacatccagcagtgggagccctcgagggggtggaacgactggacacaggtcccgttctgctcccaccacttccacgagctggtgatgaaggacggccgcgtgctcgtagtgccctgccggaaccaggacgagctgatcggccgagcccggatctcccagggagcgggctggtccctgaaagagaccgcgtgcttaggaaagagctatgcccagatgtggactctgatgtatttccaccggcgggacctcagattagccgctaacgcaatctgctccgcggtcccctcacactgggtccctacatcccggacgacctggagcatacacgccaagcacgagtggatgaccaccgaggacatgctggccgtgtggaatcgtgtgtggatacaggagaacccatggatggaggacaagacgcccgtcgagtcctgggaggaagtgccctatctgggcaagcgagaggaccagtggtgcgggagcttgatcggactgacctcgcgcgcaacctgggcgaagaacatacagaccgcaatcaaccaggtcagaagcctgatcggcaatgaggagtacacagattatatgccctcgatgaagcggtttcgccgagaggaggaggaggccggggtcttatggtaa

SEQ ID NO: 25576 - RNA, 9876 nt, synthetic construct
  misc_feature 1..9876: note = derived and/or modified CDS sequence (opt11) from DENV-2__HQ332187__SS-prME
  source 1..9876: mol_type = other RNA
accgcaggcgtgatcatcatgcttatcccgaccgccatggccttccacctaactacccggaacggggagccacatatgatcgtgggccggcaagaaaaggggaaatccctgctgttcaagacagaggacggcgtgaacatgtgcaccctcatggcgatcgaccttggggagttatgcgaggatacgatcacctataagtgccccctactgcgccagaatgagccagaggacatcgattgttggtgtaactcgacctcaacctgggtgacatacggaacctgcaccaccacgggggagcaccggcgcgagaagcgatcagtggcccttgtcccacacgtggggatgggtctcgagactcgaaccgagacctggatgagctccgaaggggcctggaagcatgtccagcggatcgagacctggatcttgcgtcacccgggcttcaccatcatggctgcgatcctggcctacacaatcgggaccactcactttcaacgggccctcatcttcatcctattaaccgccgtggcgcccagcatgacaatgcgttgcatcggtatttccaatagagactttgtagagggcgtcagcggcggctcgtgggtggacatcgtactcgagcacgggagctgcgtcacgacgatggccaagaacaagccaacactggacttcgagctaatcaagaccgaagccaagcagccggccacacttcgcaaatactgcatcgaggccaagctcacgaacacaaccaccgaatcgcgttgccccacacagggcgagcccagcctgaatgaggagcaagacaagcgcttcatttgcaagcactccatggttgacaggggctggggaaatggctgcgggttattcggcaagggcgggatcgttacctgcgcgatgttcacgtgcaagaaaaatatggagggtaaagtggtgcagccggagaacttggagtacacaatcgtgatcacgccccacagcggggaagagcatgccgtcggcaacgacaccgggaagcacggaaaagagatcaagatcaccccgcaatcgtcaatcacagaggccgagttaaccgggtacggcacggttaccatggagtgtagcccccggacaggcctcgatttcaacgaaatggtgctgctgcagatggaagacaaggcctggctcgtccaccggcagtggttcctggatcttccccttccctggctgccgggtgccgacacccaaggcagcaattggatccagaaggagacgctggtgaccttcaagaacccccacgcgaagaagcaggacgtggtcgtgctcgggtcccaggagggggccatgcacaccgccctaaccggggcaacggagatacaaatgagctctggcaacctcctctttaccggccacctgaaatgcaggttacggatggataagctgcagctgaaggggatgtcctacagcatgtgcacgggaaagttcaagatcgtcaaggagatcgccgagacccagcacgggacgatagtgatccgaatccagtacgaaggcgacgggtccccttgcaagatacccttcgaaatcacagatctggagaaacgacacgtgctcgggcgcctgatcaccgtcaaccctattgtgatcgagaaggatagccccgtgaacatcgaggctgagccgccctttggcgactcctacatcatcatcggggtagaaccaggccaactgaagctcaactggttcaagaaggggagcagcatcggtcagatgttcgagaccacgatgcggggcgcgaagcggatggctatcctgggggataccgcatgggacttcggtagtctcggcggggttttcacctccatcggcaaagccctccatcaggtgttcggggcgatatatggcgctgcctttagcggtgtttcctggacaatgaagatcctgattggcgtcgtgattacgtggattgggatgaatagcagatccaccagcctgtccgtcagcttggtgctcgtcggtgtggtgaccctgtacctaggggcaatggtgcaggcggactcaggatgcgtcgtgtcatggaagaataaggagctgaaatgcggttccgggatcttcatcaccgacaacgtgcacacgtggacggaacagtataagttccagcccgagagcccctcaaagctggcctccgccatccaaaaggcccatgaagaaggtatctgtggtattaggagcgtcacgaggctggaaaacctcatgtggaagcagatcaccccagagctgaaccatatactgtccgaaaacgaagtgaagttgacaatcatgaccggtgataccaagggaataatgcaggctggcaagcggagcctacgtccgcaacccacggagctgaagtactcctggaagacgtggggtaaagcgaagatgctcagcaccgaatcgcacaaccagaccttcctgatcgacggacccgagaccgctgagtgcccgaacacgaaccgggcatggaacagcctagaggtggaagactacggatttggggtcttcaccaccaacatttggctaaagctgcgggagaagcaggacgtgttctgcgattccaagctcatgtctgcggctattaaggacaaccgggcggtgcacgccgacatgggctactggatagagtccgcgctcaacgacacgtggaaaatggagaaggcgagcttcatcgaggtcaagagttgtcactggcctaagtctcacacactgtggtccaacggcgtgctcgagagcgagatgattatccccaaaaacttcgctgggcccgttagccagcacaactaccgcccgggctaccacacccagactgctgggccctggcacctgggcaagctagagatggactttgatttctgcgaggggaccactgtcgtggtgactgaggactgcggcaacagaggccccagcctgagaaccaccaccgccagcggaaagctaatcacggaatggtgctgtcgatcctgcactctgcccccgctgcgttaccggggcgaggatgggtgctggtacggcatggagatccgtcccctcaaggagaaggaggaaaaccttgtaaactctctcgtcaccgccggacacggccagatagacaacttctccctaggggttctggggatggccctcttcttggaggagatgctgcggacccgcgttggcacgaagcacgcgatcctgctagtcgccgtgagcttcgttaccctcatcacgggtaacatgtcctttcgggacctcggcagggtgatggtgatggtcggggcaacaatgacggacgatataggcatgggggtgacctatcttgccctactggccgcgttcaaggtgcgccccaccttcgccgccgggctcctgttgcgtaaattgacgagcaaggaactgatgatggccaccattggcataaccctgctctctcagtccaccatccccgagaccatccttgaactaacggacgctctggctttaggtatgatgatcctgaaaattgtccggaatatggaaaagtaccaactcgccgtgaccatcatggccatctcctgcgtgccgaacgctgtcatcctcagaaacgcctggaaggtgtcatgcacaatcctggcggctgtgtccgtgagccccttactgctgacctcctctcagcagaaggccgactggataccgctcgccctgacgatcaagggcctgaaccccaccgcgatatttctcaccaccctgtcccgcacaagcaagaagcggtcctggccgctgaatgaggccatcatggccgtggggatggtaagcatcctggcttccagcctgctgaagaacgacattcccatgacagggcccctagtggccggcgggttgctgaccgtgtgttacgttctcacaggccgaagcgccgatctggagctggaacgggcagccgacgtcaagtgggaggatcaagcagagatctctggaagctccccaatactctccatcacgatcagcgaggacggcagcatgtccatcaagaacgaggaggaagagcagaccctgaccatcctgatcaggaccggcctcctggtgatatcgggggtattcccggtatcaatcccgatcacggccgcagcgtggtacctttgggaggtcaagaaacaacgggctggcgtcctctgggacgtgcccagcccgccgcccgtcgggaaagccgagctggaagacggcgcctaccgcatcaagcagagggggattctaggatactctcaaattggcgcgggcgtctataaggaagggacgttccataccatgtggcacgtgacccgcggggctgtgctcatgcaccgaggcaagcgcatcgaacccagctgggccgacgtcaagaaggacctgataagttacgggggaggctggaagctcgagggggagtggaaggaaggcgaggaggtccaagtcctcgccctcgagcccgggaagaaccctcgtgccgtccaaaccaagccaggcatctttaagacgaacacaggtaccattggcgcggtatcactggatttcagtcccgggactagcgggtcgcctatcgtggatcgcaagggcaaggtcgtgggactctacggaaacggcgttgtcacgcggagcggggcctacgtgagcgccatcgcgcagaccgagaagtccattgaagacaaccccgagatagaggacgatatcttccgcaagaagcggttgaccatcatggacctgcaccccggggcgggtaagaccaaacgctatctccccgttatcgtccgggaggcaatcaagcgcggcctgcgtacgttaatactcgcccccaccagggtggtggccgccgagatggaggaagctctccgcgggctgcccatacggtaccagacacccgccatcaaggccgagcacaccgggcgggagatcgtcgacctgatgtgccacgcaaccttcacaatgcgactcctgtctcccgtccgagtgccgaactataatctgatcattatggacgaagcgcatttcaccgaccccgcctccatcgcagccaggggatacatcagtacgcgcgtcgagatgggcgaggcagctgggatctttatgacggctacgccgcccggttcacgggatccgtttccccagagcaacgcacctatcatggacgaggaacgcgagatacctgagcgcagttggaacagcggccacgagtgggtaacggacttcaaagggaagacagtgtggttcgtcccctccatcaaggccgggaacgacatcgccgcgtgcttgcgaaagaacggcaaaaaggtcattcagttgagccggaagacgttcgattcggagtacgttaagacccgcgccaatgactgggacttcgtcgtgaccaccgatatcagtgagatgggggccaacttcaaggccgagcgggtgatcgacccccgccggtgcatgaagccagtaatattgactgatggggaggaaagggtcatactagcagggcccatgccggtcacacatagtagcgcggcccagcggcggggacgcattgggcggaatcccaagaacgagaacgaccagtacatatacatgggcgaacccctggaaaatgacgaggactgcgcccactggaaggaggccaagatgctgctagacaatataaacaccccagagggcataatcccgtcaatgtttgaacccgagcgcgagaaggtcgatgcaatcgacggggagtaccggctccgaggcgaggcgcgtaaaaccttcgttgacctgatgcggaggggcgacctccccgtgtggctggcgtataaggtcgcggccgagggcatcaactacgccgaccgcaagtggtgcttcgacgggatcaagaacaaccagatcctggaggagaacgtggaggtggagatctggacgaaagagggcgagcggaagaagctcaagccgcgctggttagacgcacggatctatagcgacccacttgccctcaaggagttcaaggagttcgccgccggccgcaagtccttgaccctgaatctcataactgagatgggaagactgcccacctttatgacgcagaaagctcggaacgccctggacaacttagccgtcctgcacaccgccgaagcaggcgggcgagcgtataatcacgccttatcagagctcccagaaaccctggagaccctgctcctgctgacgctcttggccacagtgaccggcggcatcttcttgtttttgatgagtggcaagggcatcgggaagatgactctaggtatgtgctgcatcataactgcctcagtccttttgtggtacgcgcagatccagccgcattggatcgcggcctccatcattctggagttctttctgatcgtgctcctgatcccggagcccgagaagcagcgcacgccccaggataaccagctgacctacgtggttatcgccatcttgaccgtcgtggctgcaactatggccaacgaaatggggtttctggagaaaacgaagaaagacctgggactcgggtctataacgacccaggagagcgagtccaacatcttggacatcgatctgaggccagcaagtgcctggaccctctacgccgtcgccacaactttcgtgacccccatgcttcggcactccatcgagaatagctcagtgaacgtatcactgaccgcgattgcgaaccaggcaaccgtgctcatggggctggggaaggggtggcctctatccaagatggatattggtgtccccctactggccatagggtgctactcacaggtcaacccgataaccctgaccgcggctctgctgttactcgtggctcactacgcaataatcggccccggtctgcaagccaaggcgacacgggaggcgcagaagagggccgcggccgggatcatgaagaatcctacggtggacggcatcaccgtcatcgaccttgagcccatcccgtacgaccccaagttcgaaaagcagttgggacaagtaatgctgctgatcctctgcgtgacccaggtcctgatgatgcggacaacgtgggcgctgtgcgaagccttgacactggccacgggccccatctccaccctttgggaagggaacccgggcagattctggaatacgaccatcgcagtctcaatggccaacatctttcgcggctcttaccttgcgggggccggcctgctgtttagcatcatgaagaataccaccaacacgcggcgcggtaccggtaacattggcgagacacttggggaaaagtggaagtcaaggctgaacgccctgggcaagagcgaattccagatctataagaagagcgggatccaagaggtggacaggacgctcgccaaagagggaatcaagcgcggagagacagatcaccacgcagtcagccgcggctccgccaaattacggtggtttgtggagcgaaacatggtgaccccggagggcaaggtggtggacctggggtgcggccgcgggggatggtcgtactactgcgggggcctcaaaaacgtgcgcgaggttaagggcctaaccaagggcggtcccgggcacgaagaacctatccccatgtccacatacggctggaacctagtccggctccagagcggggtcgatgtcttctttacaccgcccgagaagtgcgacacgctactgtgcgacatcggcgagagttcccccaaccccaccattgaagcgggccgtaccctccgggtgctgaacctggtagagaattggttgaacaataacacgcagttctgtatcaaggtgctaaacccgtacatgccaagcgtgatcgagaagatggaaacgctgcaacggaagtacggaggcgcgcttgtgcggaaccctttgtcccgcaatagcacccacgaaatgtactgggtcagcaacgcgacagggaacatcgtgagcagcgtgaacatgatcagccggatgctgatcaaccgctttactatgaaacataagaaggccacgtacgagcctgacgttgatttgggctccggaacgcgaaacataggcatagagagcgagatccccaatctagacatcatcggtaagcgcatagagaagatcaaacaggagcacgagacctcctggcactacgaccaggatcacccctacaagacctgggcttatcacgggagctacgaaacgaagcagaccggctctgccagctccatggtaaacggggtggtccgcctgttaacaaagccatgggacgttgtgccaatggtcacacaaatggcaatgactgacaccaccccattcggccagcagcgggtcttcaaggagaaggtggacacccggacgcaggaacccaaagagggtactaagaagctaatgcggattactgccgagtggctttggaaggagctgggaaagaagaaaacgccccggatgtgcacgcgggaggaattcacccgcaaggtacggtccaacgcggcacttggcgccatattcacggacgagaacaagtggaagtcggcgcgcgaggccgtggaggacggccggttcggcgagcttgtagacaaggagaggaatctgcacctcgaggggaagtgcgagacttgcgtgtacaacatgatgggaaagcgtgagaagaagctgggcgagttcgggaaggcgaaaggctcacgggcgatatggtatatgtggctgggggcacggttcctcgaattcgaagccctgggcttcctcaacgaagatcattggttctctcgaggcaatagtttaagcggcgtggagggcgaggggctgcatcgcctggggtatatcctccgcgatgtcggtaagaaggaggggggggcgatgtacgccgacgatacggccggttgggacacccgtatcaccctggaggacctgaagaacgaagagatggtaaccaaccacatgaagggcgagcacaagaagctcgccgaggcaatcttcaagctgacgtaccagaacaaagtggtcagagtgcaaaggccgacgccgcgcgggaccgtgatggacatcatctcccggcgcgaccagcgcggaagcgggcaggtgggcacctatggacttaatacgttcaccaatatggaggcgcagctcatccggcagatggaaggagagggaatcttcaagtccatacagcacctgactgcgactgaggaaatcgcggtgcagaactggctggcccgggtaggccgggaacgcctcagccggatggcgataagcggcgacgactgcgtagtgaagcccattgatgacaggttcgcgagtgccctgactgcacttaacgacatggggaaggttcggaaggatatccaacagtgggagccctcccgcggctggaatgactggacccaagtcccgttttgctcgcatcacttccatgagctagtcatgaaggacggcagggtgctggttgtcccctgccgcaatcaggacgaactgatcgggcgggcccgcatctcccaaggcgccgggtggagcctcaaagaaaccgcctgtctcggcaaatcctacgcccagatgtggaccctgatgtacttccaccggcgagacttacggctagcggcaaatgctatctgctccgctgtgccgagtcactgggtacctacaagccgcacgacctggtcaatccacgccaagcacgagtggatgaccaccgaggatatgctcgctgtttggaatcgggtatggattcaggagaacccatggatggaggataagacgccggtcgagagctgggaggaggttccctacctggggaaacgcgaggaccaatggtgtggctccctgatcggccttactagccgggccacctgggctaagaacatacagaccgccatcaatcaagtaagatcgctcatcggaaacgaggagtacacggattacatgccatccatgaagcgcttccggcgcgaggaagaggaagccggagtcctgtggtga

SEQ ID NO: 25577 - RNA, 9876 nt, synthetic construct
  misc_feature 1..9876: note = derived and/or modified CDS sequence (opt11) from DENV-2__HQ332188__SS-prME
  source 1..9876: mol_type = other RNA
acagccggcgtgatagtcatgctaatacccaccgcgatggcgttccacctcaccacacggaacggggaaccccacatgatcgtgggccggcaggagaaggggaagagtctgctgttcaagaccgaggacggggttaacatgtgcaccctcatggccatagatcttggggagctatgtgaggacaccattacctacaaatgccccctcctgcggcagaacgagcccgaggacatcgactgctggtgcaactccaccagcacctgggtaacctacgggacctgcaccacaacgggagaacaccggcgtgagaagcggtcggtggcgctggtgccccacgttgggatgggcctcgagacccggacggagacctggatgagctctgagggagcgtggaagcacgtgcaacgaatcgagacgtggatcctgcgccatccaggctttaccatcatggccgcgatcctggcatacaccatcgggaccacgcacttccagcgggccctcatattcatacttctgaccgccgtagcgccaagcatgaccatgagatgcataggcatcagcaatcgggacttcgtagagggcgtcagcgggggaagctgggtggacatcgttctcgaacacgggagctgtgtgaccacgatggccaaaaataagcccaccctggacttcgaactgatcaagacagaggccaaacagcccgccacccttcgcaagtactgcatcgaagccaagctgacgaacaccacaaccgagtcccggtgcccgacgcagggcgaaccaagcctaaacgaggagcaggataagcgcttcatctgtaagcactccatggtggaccgcggatggggcaacggctgcgggctgttcgggaagggggggatcgtgacctgcgcgatgttcacgtgcaagaagaatatggagggcaaggtggtgcagcccgagaatctggaatacacgatagtcatcacgccccatagcggcgaggagcacgctgtgggcaacgacacggggaagcacggcaaggagatcaaaattaccccgcaatccagcatcaccgaggccgagctcactgggtatgggaccgtgaccatggaatgctcaccccggaccggcttggacttcaacgagatggtcctgctgcagatggaggacaaagcttggttggtgcaccgacagtggttcctggatctgcccctcccctggctaccgggggccgacacccaggggagcaactggattcaaaaggagaccttggtcaccttcaaaaacccccacgcgaagaagcaggacgtcgtggttctcggttcccaggagggggcgatgcacaccgccctaaccggagccacggagatccaaatgagcagcggcaacctcctgttcaccggccacctgaagtgcaggctacggatggacaagctccaactgaagggaatgtcctactccatgtgcaccggcaaattcaagattgtgaaggagatagcagagacacagcatgggacgatagtcatccgcgtccagtacgagggcgacggcagtccctgcaagatcccttttgagattacggacctggagaagcggcacgtgctcgggcgcctgataacagtgaacccgattgtcatcgaaaaggatagcccggtaaacatcgaagcggagccgccgttcggggattcctacatcatcatcggggtggagccgggccagctaaagttaaattggtttaagaagggtagttcaatcggtcagatgttcgagacaacgatgcgcggcgccaaacgcatggccatcctgggggacaccgcctgggacttcggcagtctcggcggagtcttcacctccattggaaaggccttgcaccaggtgttcggtgcgatctacggcgctgctttcagcggggtgtcctggacgatgaagatcttgataggggtcgttatcacgtggatcggtatgaacagccggagtaccagcctgtctgtcagcctggttctcgtgggggtggtcaccctgtacctaggggccatggtacaggcggacagcggctgcgtggtgagctggaagaacaaagagcttaagtgcggttccggtatcttcattaccgacaatgttcacacatggaccgagcagtacaagttccagcccgagagccccagcaagctggcctccgcaatccagaaagcccacgaggagggcatctgcgggatacggtcagtgacccgcctggaaaatctcatgtggaagcaaatcacccccgaactgaaccacatcctgtcggagaacgaggtcaaactcaccataatgacaggagacaccaagggggtgatgcaggccggcaagcggagcttgcgcccgcaacccaccgaattgaagtacagttggaagacgtgggggaaggcaaagatgctcagcaccgagtcacataaccagaccttcctgatcgacgggcccgaaaccacggagtgtccgaacacaaacagagcctggaacagtctggaagtggaggactacggcttcggtgtctttaccaccaacatctggctcaagctcagagagaagcaggacgtgttctgcgactcaaagctgatgagtgccgccatcaaggacaaccgggccgtacacgccgacatgggctattggattgagtccgctctaaatgacacctggaagatggaaaaggccagctttatcgaggttaaaagctgtcactggcctaagagccatacgctgtggtccaacggcgtgctggagagcgagatgatcattcccaagaacttcgccggccccgtgtcccaacataactatcgaccgggctaccacacacaaatcgccggtccctggcacctcggcaaactggagatggacttcgacttctgcgaggggaccacagtcgtagtgactgaggactgcggcaaccggggccccagcctgagaaccacaaccgcgtctgggaaactaattacggagtggtgctgccggtcctgcaccttgcccccgctgcggtaccggggggaggacgggtgctggtatggcatggagatccgcccactcaaggagaaggaggagaatctggtcaattcccttgtgacggccgggcacggccagatcgacaacttctccttgggggtgctagggatggccctgttcctcgaagaaatgctgaggacccgagtcggcactaagcacgccatcttactcgtggcggtgagcttcgtcaccctgattaccgggaacatgtcatttcgggacctgggccgcgtaatggtgatggtgggggcgaccatgactgacgacattggcatgggcgcgacatacctcgcactactggccgcgttcaaggtgcgccctacctttgccgccgggcttctactgcgtaagctcaccagcaaggagctaatgatggccacaattggcatcaccctgctctcccaaagcaccatccccgagaccattctggagctgacggatgccctcgcgcttgggatgatggtgcttaagatcgtcaggaacatggaaaagtaccagctcgctgtgaccatcatggccatatcctgcgtgccgaacgcggtcatcctgcggaacgcctggaaggtgagctgcaccatacttgcggcagtatccgtgtcccccctcctgctgacatcctcacagcagaaggccgactggatccccctcgccctgacgattaagggtctaaaccccactgcgatctttttgacaacactgtcccgcacaagcaagaaacggtcctggcctctgaacgaagccatcatggctgtgggcatggttagcatactcgcctccagcttactcaagaacgacatccccatgactgggccgctcgtggcgggcgggctgctgaccgtgtgctacgtactaaccggccgcagcgctgacttagagttagaaagggcggccgacgtgaaatgggaagaccaggccgagatcagcgggagctcccccatcctcagtatcacgatctccgaggacggttccatgagtatcaaaaacgaggaggaggaacagaccctgaccatcctgatccgcaccggcctcctggtgataagcggggtcttcccggtgtccatcccgattaccgccgcggcctggtacctgtgggaagttaagaagcagcgtgctggcgtcctatgggacgttcccagcccgccgcccgtggggaaggcagagctggaggatggcgcctatcgcatcaagcagcgcgggatcctgggctattcccagattggcgcgggggtctacaaggaaggtactttccacaccatgtggcatgtgacccgcggggccgttctcatgcaccgtggcaaacgcatcgagccctcgtgggcagacgtcaagaaggacttaatctcctacgggggcggctggaaactggagggggagtggaaggagggcgaggagattcaagtgttggccctggaacctggcaaaaaccccagggctgttcagactaagcccggcatctttaaaacgaacacagggaccattggcgcggtctccctggacttctcccccgggaccagcggctcccctatagtggacagaaagggcaaggtagtaggcctctatggcaacggcgtagtcacgcggagcggggcctacgtctcggcaatcgcccagaccgagaagtcgatcgaggacaaccccgagatcgaggacgacatattccgcaaaaaacgtctgaccatcatggacttgcaccctggcgccgggaagacgaagcgctacttaccggccatcgtacgggaggccatcaaacgtggcttgcgcacgctcatactggccccgacccgtgtggtcgccgcggaaatggaggaggccctccgcggcctgcccattcggtaccagacccccgccatcaaggctgagcacaccgggcgagagattgtggacctgatgtgccacgccacgttcaccatgcggcttctgagccccgtgcgcgtccctaactacaacctgatcataatggacgaggcgcactttacagaccccgcttccatcgctgcccgtggctacatcagcacgcgcgtggagatgggggaagccgcgggtatattcatgacggccacgccgccagggtcgcgcgacccgttcccccaaagcaacgccccaatcatggacgaggagcgcgagatccccgagcggtcctggaacagcggccacgagtgggtgacagatttcaaggggaagaccgtctggttcgtaccctccataaaggccggcaacgatattgcggcgtgccttcgcaagaatggcaaaaaggttatccagctgagccggaagacgtttgacagtgagtacgtcaagacacgcgccaacgattgggattttgtggtgaccacggacatcagcgagatgggcgcaaacttcaaagccgagcgggtcatcgacccccgccggtgcatgaagcccgtgatactgacggacggcgaagaacgcgtgatcctcgcggggccaatgccggtcacccactccagcgccgcccagcggcgcggtcgcattggacggaaccctaaaaacgagaatgaccagtacatctacatgggcgagccgctggaaaatgacgaagattgcgcccactggaaggaggccaagatgctgctcgacaacatcaacacccccgaggggataatcccgagcatgttcgagcccgagcgcgagaaggtggacgcgatcgacggagagtaccggctgcgcggcgaagcccggaaaaccttcgtggacttgatgcgccgcggggacctccccgtctggctcgcctacaaggtcgccgcagaggggatcaactacgcggataggaaatggtgtttcgacggaatcaagaacaaccagatacttgaggagaacgtggaggtggaaatatggacgaaggagggcgaacggaagaagctcaagccgcgctggctagacgcgcgtatttactcggaccccctggccttgaaggaattcaaggaattcgccgcgggcaggaaaagtctgaccttaaacctcatcaccgagatggggcggctaccgaccttcatgacgcagaaggctcgcaacgccctcgataacctcgccgtcctgcacaccgcagaggcaggcgggcgggcctacaaccacgccctgagcgagctgcccgagaccctggagaccctgctcctgctgacactcctggccaccgtgacgggcggcatattcctgttcctcatgtcggggaagggcatcgggaagatgaccctgggcatgtgctgcatcatcaccgccagcgtgctactctggtacgctcagatccagccgcactggatcgcggcctccatcattttggagttcttcctgatagtcctcctgatccccgagcccgagaagcagagaacaccacaggataaccagctaacttacgtcgtgatcgccatactcaccgtggtcgccgcgacgatggcaaacgagatggggttcctggagaagacgaagaaggacctgggtctcgggtccatcaccactcaggagcccgaatccaacattctggacatcgacctccggcctgcctccgcctggaccctctatgccgtggcgacgaccttcgtcaccccaatgctgcgccactctatcgagaactccagcgttaacgtgtccttaactgctatcgccaaccaagctacggtgctcatgggactggggaaggggtggcccctgtcaaagatggatatcggggttccgctcctggctatcgggtgctactcccaagtaaaccccatcaccctaaccgccgccctcctgctgctcgtggcccactacgcgatcatcggacccgggctacaggctaaagccaccagggaggcgcagaagcgcgccgccgcgggcatcatgaagaaccccacggtcgatggcatcaccgtcatagacctggagcccatcccctatgaccccaagttcgagaagcagctcgggcaggtcatgctgctcatcttatgcgtcactcaggtccttatgatgcggaccacatgggccctgtgcgaggccctgaccttggccaccggccccatttctaccctgtgggaggggaacccggggcgcttctggaacacgaccatcgcagtatccatggcgaatatcttcaggggctcttacttggctggcgcgggcctgctgttctccatcatgaagaacactaccaacactcggcgagggaccggcaatattggcgagaccctgggggagaaatggaagtcgcggctgaacgccctggggaagtccgagttccagatctacaagaagtctgggattcaggaggttgaccgaaccctcgcgaaggagggcatcaagcgtggggagacggaccaccacgctgtgtcccgcggcagcgccaaactgcggtggttcgtggaacgcaacatggtcactccggagggcaaggtggtggacctggggtgtggccgcggggggtggtcctactactgcggcgggctcaagaatgtccgcgaggtgaagggactgaccaaagggggccccgggcacgaagagccgatcccgatgagcacttacggctggaacctggtgagattacagtccggggtcgacgtgttcttcacgccgccggaaaagtgcgacaccctgctgtgcgacatcggagaaagcagccctaacccgaccatagaggccgggcgcaccttacgagtgctgaacttggtagaaaattggctcaacaacaacacccagttctgcatcaaggtactgaatccctacatgccctccgtgatagaaaagatggagacgctgcagagaaagtacgggggagcccttgttcggaacccgctcagccgcaattccacccatgagatgtactgggtaagcaacgcaaccgggaatatcgtgagcagcgtcaacatgatctcgagaatgcttatcaaccggttcacgatgaaacacaagaaagccacgtacgaacccgacgtcgatctgggcagcgggactcgcaatatcggcatcgaatccgagatccccaacttagacatcattggcaagcgcattgagaagatcaagcaggaacacgagaccagctggcactacgaccaggaccacccctacaagacctgggcctaccatgggtcctatgagacgaagcaaaccggcagcgcctcttcaatggtgaacggggtcgtgcgactgctgaccaagccgtgggacgtggtccccatggtgactcaaatggccatgacggatacgacccccttcggccagcagcgtgtgtttaaggagaaagttgacacccgtacgcaggagcccaaggaagggaccaagaagttgatgcggatcacagcggagtggctgtggaaggagttggggaagaagaagacgccgcgcatgtgcacgcgtgaagagtttactcggaaggtgcgatccaacgcggctctcggcgccatattcaccgacgagaacaagtggaagtcagcccgcgaggcggtggaggacggccgattctgggagttagtagatcgcgaacggaatctgcacctcgagggaaagtgcgagacctgcgtgtacaacatgatgggtaagcgcgagaagaaactgggtgagttcggaaaggccaaagggtcgcgggctatctggtacatgtggctgggagcccgcttcctcgaatttgaggcgctggggttccttaacgaggaccattggttttcgcgaggcaactccttgtctggggtagaaggcgagggcctgcaccgcctgggttacatccttcgggacgtaggcaagaaggaggggggcgccatgtacgcggacgacacggccgggtgggatacccgcataacgctagaggacctgaagaatgaggagatggtgaccaaccacatgaagggcgagcacaagaagctcgccgaagcgatctttaagctgacttatcagaacaaggtcgtgcgtgttcagcgccccacgcctaggggcaccgtcatggacataatcagccgccgcgaccagcgggggtctggccaggtggggacctatggcctgaacacgttcaccaacatggaggcccagctcatccgccagatggaaggcgaagggatcttcaagagcatccagcacctgacagtcaccgaagagatagccgtccagaactggctggcgcgggtgggccgcgagcggctctcccgaatggccattagcggggacgactgcgtggtaaagcccattgacgacaggttcgcgtccgccttaacggccttaaacgacatggggaaggtcaggaaagacatccagcagtgggagccgagtcgggggtggaatgactggacccaagtgcccttctgctcccaccacttccatgagctcgtaatgaaggacggccgcgtcctggttgttccctgccggaatcaggatgagctcataggccgcgcacggatctcgcaaggggcgggatggtcactcaaggagaccgcgtgcctgggtaagagctacgcccagatgtggacccttatgtacttccaccgccgggacctcaggttagctgccaatgcaatctgctccgcggtgcccagccactgggtgccgacgagccggacgacttggtcaatccatgccaagcacgagtggatgaccactgaggacatgctcgccgtctggaaccgcgtctggatccaggagaacccctggatggaggacaagacgcctgtcgagagttgggaggaggtcccatacctcggtaagcgggaggaccaatggtgtgggtccctgatcggtcttacctcacgcgccacatgggcaaagaatatccagaccgccatcaaccaggtgcgcagcctcattggcaacgaagaatacacggactacatgcccagcatgaagagattccgccgggaggaagaggaagctggagtgctctggtga

SEQ ID NO: 25578 - RNA, 9876 nt, synthetic construct
  misc_feature 1..9876: note = derived and/or modified CDS sequence (opt11) from DENV-2__HQ332189__SS-prME
  source 1..9876: mol_type = other RNA
accgccggggttattgtcatgctaatccctacagccatggcgttccatttaaccactcgcaacggggagcctcacatgatagtgggcaggcaggagaagggtaagtccttgcttttcaagaccgaggacggcgtgaacatgtgcacgctcatggccatcgacctgggggagctgtgcgaggacactatcacctacaagtgccctctcctgcggcaaaacgagcccgaggacattgactgctggtgtaacagcaccagcacctgggtaacctacgggacctgcaccaccacgggcgagcaccggagagaaaagcggtcagtggcactagttccccacgtcggcatgggtctcgagacccgcaccgagacgtggatgtcatccgagggagcctggaagcacgtgcagcggatcgagaactggatcctgcgccacccgggcttcaccatcatggcagcaatcctggcctacactatcgggaccacccatttccagcgggccctcatcttcatcctgctgacggccgtggcgcccagcatgaccatgcgctgcatcggaatctccaatcgggacttcgtcgagggcgtaagcgggggctcctgggtggacatcgttctcgaacatggcagctgcgtaaccacgatggccaagaataaacccacgctagacttcgagctgatcaagaccgaggccaagcagcccgccaccctcagaaagtactgcatcgaggccaaattgaccaacacgaccaccgagtcccggtgcccgacccagggcgagccttccctgaacgaggagcaagacaagcggttcatctgtaagcactcaatggtggatcggggctgggggaacggctgcgggctgttcggcaagggcggaatcgtcacgtgcgcgatgttcacttgcaaaaagaacatggagggcaaagtggtgcagcccgaaaacctagagtacacgatagtaattacgccccacagtggggaggagcacgcggtgggcaacgacacgggaaagcacggcaaggagatcaagatcaccccgcagtccagcataaccgaggcggaactgaccgggtacggtacagtgacgatggaatgctccccccggaccggtctcgacttcaacgagatggtcctgttgcagatggaggacaaggcctggttggttcaccggcagtggtttctagacctgcccctcccctggctaccgggggctgacacccagggaagcaactggatccagaaggagaccctggtgacgttcaagaatccccacgcgaagaagcaggacgtcgtggtcctcgggtcgcaggagggcgccatgcacaccgccttgactggggccactgagatccagatgtcgagcggcaacctcctttttactgggcacttgaagtgccgcctgcggatggacaagctccagctgaaggggatgtcctacagcatgtgcaccggcaagttcaagatcgtgaaggagattgccgaaacacagcacggtaccatcgtgattcgcgtacagtatgagggcgacggcagcccctgcaagatcccctttgagataacagacctcgagaagcgccatgtgttggggcgcttaatcaccgtgaacccgatcgttatcgaaaaggacagccccgttaatatcgaggcggaaccgccctttggcgactcctacgtgatcattggagttgagccgggccagctaaagctcaattggttcaagaagggatcatccatcggacaaatgtttgagacgacaatgcgcggcgccaagcggatggccatcctgggggacacggcctgggactttggcagcctcggcggggtgttcacctccatcgggaaggctcttcaccaagtgttcggggcgatctacggcgcagccttcagcggggtttcctggaccatgaagatactgatcggcgtggtcattacgtggatcgggatgaacagccgctctaccagcctgtccgtcagcctggtgctcgtgggcgtcgtgactctgtacctgggtgccatggtgcaggcggactccggctgtgtcgtgtcctggaagaacaaggagctgaaatgcggttccgggattttcataaccgataatgtgcacacctggacggaacaatacaaattccagccagagagccccagcaagctggcgtctgcaatccagaaagcccacgaggaaggcatctgcgggatccggagcgtaacgcgccttgaaaacctcatgtggaagcagatcacgcccgagctgaaccacatcctgtcagagaacgaggtgaagctcaccatcatgacgggcgacacgaaggggatcatgcaagctggcaagcggagcctgcgcccgcagcccaccgagctgaagtactcctggaagacctggggcaaggccaaaatgctatcgaccgagtcccacaatcagaccttcctaatagacggacccgagaccgccgagtgcccgaataccaaccgggcatggaactccctcgaagtggaggactacggcttcggggtattcacgaccaacatctggttgaagctgcgcgagaagcaggacgtgttctgcgattccaaactcatgagcgccgccattaaggataaccgggctgtgcacgccgatatgggctactggatcgaatccgccctcaacgatacgtggaagatggagaaggccagcttcatagaggtcaaatcctgccactggccaaagtcacacaccctgtggtctaacggcgtgctggaaagtgagatgatcatccccaagaatttcgctgggcccgtgtcccagcacaactatcgccccggctaccatacccagacggcggggccctggcacctcggcaagctggagatggacttcgacttctgcgaggggaccactgtggtggtgaccgaggactgcggaaaccggggccccagcctgaggacgaccacggcgtctgggaagctcataaccgagtggtgctgccggtcctgcacgctgcccccgctgcgctaccggggagaggacgggtgctggtacggaatggaaatacgccccctcaaggagaaggaggagaacctggtcaacagcctagtgaccgccgggcacggtcagatagacaacttcagcctcggtgtgctagggatggccctattcctcgaggagatgctgcggacccgcgtcgggaccaagcacgcaatcctcctagtggccgtgagcttcgtcacgctgatcaccggaaacatgtccttcagagacctgggccgcgtgatggtcatggtaggggccacaatgaccgatgacataggcatgggcgttacgtacctcgcactgctggccgcgttcaaggtccgcccgacattcgccgccgggctgctgctgcggaaactgaccagcaaggaactgatgatggccaccatcggcattaccctgttatcccagagcacaatacccgagacgattctggagctcaccgacgccttggcgctcgggatgatggtcctgaaaattgtgcgcaacatggagaagtaccagctcgctgtgacgatcatggctatatcctgcgtcccgaatgccgtgatcctgcggaacgcctggaaggtaagctgcacgattctggcggcagtgtccgtgagccccctcctgctgacctccagtcagcagaaggccgactggatccccctcgccctgaccataaagggcctgaatcccacggcgatcttcctcaccaccctctcccgcaccagcaagaagcggtcctggccgctgaatgaggccatcatggccgtcggcatggtttccatcttggcctcctcgttgctcaagaacgacatccccatgacgggacccctcgtagccggcgggctgttaacagtctgctacgtgctcaccggtcgctcggcggatctggaactggagcgggccgccgacgtgaaatgggaggaccaggccgagatttccgggagcagccctattctcagcatcaccatcagcgaggacgggagcatgtccattaagaacgaggaggaggagcagacgcttaccatcctaatccgcaccggcttgctagtcatcagtggagtgttcccggtgtcaatccccatcaccgccgccgcctggtacttgtgggaggtgaagaagcagcgcgccggcgtgctctgggacgtgcccagcccgccacccgtcggcaaggccgagcttgaggacggcgcctaccgcatcaagcagagagggatcctgggctactcccagatcggcgcgggggtgtataaagagggtacctttcacactatgtggcacgtaacccgcggagccgtcctgatgcaccgaggcaagcgcatcgagccctcatgggcagacgttaagaaggatttgatctcctacggcggcggctggaagctggaaggggagtggaaggaaggtgaggaggtacaggtcttggccctggagcccgggaaaaacccccgggctgtacaaaccaagcccggcattttcaaaaccaacacgggaacgatcggcgccgtgagtctggacttcagtcccggaaccagcgggtctcccatagtcgaccgtaagggcaaggtggtgggtctctacggcaacggcgtcgtgacccgcagcggggcctacgtgtccgccatcgcccagacggagaagtccatagaggacaacccagaaatcgaggacgatatctttcgcaaaaagcggctgaccatcatggatctgcaccccggcgcgggcaagaccaagagatatctccccgccatcgtccgggaggccatcaaacgcggcctgcgcaccctgatcctcgccccgacgcgggttgtggccgcggaaatggaggaggcactccgcggtctgcccatccggtaccagacccccgcgatcaaagccgagcataccgggcgcgaaatcgtagacctgatgtgccacgccacattcacgatgcggctccttagccccgtacgcgtgccgaactacaacctgatcatcatggacgaggcgcacttcaccgatcccgccagtatcgccgcccggggctacatcagcacccgcgtggagatgggggaggccgcgggcattttcatgacagccacgccgcccgggtcacgggacccgttcccccagtctaacgcccctatcatggatgaagagagagagatccccgaacggtcctggaatagcggccacgagtgggtcaccgacttcaaggggaagacagtgtggtttgtgccttccataaaggcgggcaacgacatcgcggcatgcctcagaaagaacggcaagaaagtgatacagctcagccggaaaactttcgactccgagtacgtgaagacgcgcgctaacgactgggacttcgtcgtgaccaccgacatcagcgagatgggggctaacttcaaggcagagcgagtgatcgacccccgcagatgcatgaaacctgtcatcctgactgacggcgaggagcgcgtgatattagctgggcctatgcccgtgacgcactccagcgccgcccagcggagagggcgcatagggcggaaccccaagaacgagaacgaccaatacatatacatgggtgagcccctagagaacgacgaggactgcgcacactggaaggaggccaagatgctgctcgataacataaacacgccggagggcattatcccgtccatgtttgagcccgagcgcgagaaggtcgacgcgatcgacggggagtaccggctgcgcggcgaggcgcgtaaaaccttcgtcgacctgatgcgccgtggggacctccccgtgtggctggcgtacaaggttgctgccgagggcattaactatgcggacaggaagtggtgcttcgatgggataaaaaacaatcaaatcctcgaggagaacgtggaggtcgagatctggactaaggagggcgaacggaagaaactcaagcctaggtggctggacgcccggatctatagcgatcccctggcactcaaggagttcaaggagttcgcagcgggccgcaagtccctgacgctgaatctaatcaccgagatggggcggcttcccactttcatgacccagaaggccaggaacgccctggataaccttgcggtactgcacacggccgaggctggcggccgggcttacaaccacgccctgagcgagctccctgaaaccctggagaccttactcctgttaacactcctggccacggttacgggcggcatcttcctgttccttatgtccggaaagggcatcggtaaaatgactctgggcatgtgctgcatcatcacggcctccgtcttgctgtggtacgcgcagatccaaccccactggatcgcagcatccattatcctcgagttcttcctgatcgtactcttaatcccagagcccgagaagcaacgcacaccccaggacaaccagctgacatacgtggtaatcgccatcctaaccgtcgtcgccgccaccatggcgaacgagatggggttcctggagaagaccaaaaaggacctgggcctcggcagcatcactacacaggagtcggaatccaacatcctcgacattgatttacggccggccagcgcctggacactatacgcagttgcgacaacctttgtgacccccatgctgcgccattctatcgaaaacagctccgtgaacgtctcactgaccgccatcgccaaccaggccaccgtgctcatggggttgggtaaaggctggcccctgtccaagatggacatcggtgtgcctctcctggcaatcgggtgctacagccaagtcaaccctataacgctgaccgccgccctcctgctgctcgtggctcactatgccatcatcgggcctggcctgcaagcgaaggccacccgagaggcccagaagcgcgccgccgcagggatcatgaagaacccaactgtagacggtatcacggtgatcgacctggaacccatcccgtacgaccccaagttcgagaagcaactcggccaagtgatgttacttattctctgcgtgacccaggtcctgatgatgcggacaacatgggctctgtgcgaggcactcactttggccacgggtcccatcagtactctgtgggagggtaaccctggccgtttctggaacacaacgattgccgttagcatggctaacatcttcagaggatcctacctcgccggggccggcctgcttttcagcatcatgaagaacaccaccaacacccgtcgcgggacgggaaacatcggcgagaccctcggtgagaagtggaaatcccggttgaacgccctcggcaagagcgagttccagatctacaaaaagtccggaatccaggaggtggaccgcaccctcgctaaggagggtattaagcgcggggaaaccgaccaccacgcagtcagccgcggctccgccaagctgcggtggttcgtggagcgcaatatggtgacgccagaggggaaagtcgtggacctcggctgcggtcggggcgggtggagttattactgcggcggcctaaagaatgtgcgcgaagtcaaggggctgaccaagggcgggcctgggcacgaggagcccatccccatgtccacctatggatggaacttggtgcggctccagtcgggggttgatgtcttcttcaccccgcccgaaaagtgcgatacgcttctgtgcgacataggcgagagctcccccagccccacgatcgaggccggccgcaccctccgggtgctaaacctagtggaggactggcttaacaataacacccaattctgcatcaaggttctgaacccgtatatgccctcggtgattgagaagatggagaccctgcaacgcaagtacggaggggcactggtgcggaatccactgagccgcaatagtacgcacgagatgtactgggtcagcaatgcgaccgggaacattgtaagttctgtgaacatgatctcccggatgctgatcaaccgcttcaccatgaagcacaagaaggccacctacgaaccggacgtcgacttgggtagcgggacccggaatattggcatagagtccgagatccccaacctcgacatcatcggcaagcgcatcgaaaagatcaagcaggaacacgaaaccagctggcactacgaccaggaccacacctacaaaacctgggcctaccacggatcgtacgagacgaagcagaccggcagcgcaagtagcatggtcaacggagtcgtacgcctgctgaccaagccgtgggacgtcgtgcctatggttacccaaatggccatgacggacaccactccgttcggccagcagcgggtgtttaaagagaaggtggacaccaggacgcaggagcccaaggagggcaccaagaagctaatgaggatcaccgcggaatggctgtggaaggagctggggaagaagaaaacgcctcggatgtgcacgcgtgaggagtttacccgcaaagtccgatccaacgccgcgctcggcgccattttcaccgacgagaacaaatggaaatcagccagggaggcggtagaggacgggcggttctgggagctcgtcgaccgtgagcggaatctgcacctcgagggcaagtgcgagacctgcgtgtataacatgatgggtaagcgcgagaagaagctgggcgagtttggcaaggccaagggctcgcgcgcaatctggtacatgtggctgggtgcccgctttctcgagttcgaggcgctgggattcctgaacgaggaccactggttcagccggggcaacagcctctccggggtggaaggcgaggggttgcaccgcctggggtatatcctacgcgacgtaggcaagaaagagggcggcgccatgtacgccgacgacacggccgggtgggacacccggattaccctggaagacctgaagaacgaggagatggtcaccaaccacatgaagggcgagcacaagaaacttgccgaggcgatcttcaaactgacgtaccagaacaaggttgtccgtgtgcagcgccccaccccgcgggggactgtgatggacatcatctcccgccgcgaccaacgggggtctggccaggtcgggacgtacggcctaaacaccttcaccaatatggaggcccaactcatccgccaaatggagggcgaagggatattcaagtctattcagcacctgaccgctaccgaggagatcgcggtgcagaactggctggcccgggtgggccgcgagaggctttcccgcatggcaatcagtggggacgactgcgtcgtaaagccaatcgacgatcggttcgcctccgccctgacggccctgaacgatatgggtaaggtgcgcaaggacatccagcagtgggagccctcacggggctggaatgactggactcaggtgcctttctgttctcaccatttccacgaactcgtgatgaaggacggccgtgtcctggttgtcccttgccggaaccaagacgagctgatagggagagcccggataagccagggggcgggctggtccttgaaggaaaccgcttgcctgggtaagtcatacgcccaaatgtggaccctaatgtacttccacagacgagacctccgcctcgccgccaatgcgatatgctccgccgtgccgagccactgggtcccgacctcccggacgacttggtcgattcatgccaaacacgagtggatgacgactgaggacatgctggccgtgtggaaccgcgtttggatccaagaaaacccctggatggaggacaagactccggtagagtcctgggaggaggtgccctacctcggcaagcgcgaggaccagtggtgtgggtcattgatcggccttactagtcgtgctacttgggccaagaacatccaaaccgccatcaaccaagtgcggtccctcataggcaacgaggagtatacggactacatgccctccatgaaacggttccgccgtgaagaggaggaagcaggagtcctgtggtga

SEQ ID NO: 25579 - RNA, 9876 nt, synthetic construct
  misc_feature 1..9876: note = derived and/or modified CDS sequence (opt11) from DENV-2__JN368476__SS-prME
  source 1..9876: mol_type = other RNA
agcgccggcatgatcataatgctgatccccaccgtgatggccttccacctcactacacgcaacggagaaccccatatgattgtaggcatccaggagaagggtaagagcctgttgtttaagaccgaggacggagtgaacatgtgtaccctcatggccatggacttgggggaactctgcgaggacaccataacctacaagtgccccctcctgagacaaaacgagcccgaggatatcgactgctggtgcaacagcaccagcacctgggtgacctacggaacctgtaccacaaccggcgagcaccggcgggagaagcggagcgtagccttagtgcctcacgtggggatgggacttgagacccggacagaaacctggatgtcttcggagggggcctggaagcacgcacaacgtatagaaacctggatcttgcggcatcccggcttcactataatggccgcgatcttagcctacaccatcgggactacccacttccagagggcactgatcttcatcctgttaacagccgtcgcgccctcaatgaccatgcggtgcatcggaatctcaaacagggacttcgtggaaggggtgtccggtggcagctgggtagacatcgtactcgagcacggctcctgcgtgaccacaatggccaagaacaagcccaccttggacttcgagttaattaagacggaggccaagcaaccagccacactccgtaagtactgtatcgaggccaaacttaccaacactaccaccgaaagtcgctgccccacccagggtgagccctccctgaaggaggaacaggacaagcggttcgtctgcaagcacagcatggtagaccggggctgggggaatggctgtggcctctttggaaagggcgggatcgtgacatgcgccatgttcacgtgcaagaagaacatggagggtaagattgtccagcccgagaacctggaatacaccatcgtggtgacgccccattcaggcgaggagcacgcggtcggcaacgacacgggaaagcacggcaaggaaatcaaagtgactccccaaagctccatcaccgaagctgagctgaccgggtacgggaccgtgactatggagtgtagcccgcgaaccggcttagacttcaacgagatggtactgctgcagatggagtctaaggcctggctcgtgcataggcaatggttcttggacctgcccttgccctggctgccgggagccgacaagcaaggcagtaactggatccagaaggaaacgctggtgaccttcaagaatccccacgcgaaaaagcaggacgtcgtggtcctcgggagccaagaaggggctatgcatacggccctgaccggggcaaccgagatccagatgtccagcggcaatctcctgtttaccggccacctgaagtgccggctgcgcatggacaaactccaactgaaggggatgagctacagcatgtgcacgggtaagtttaaggtggtgaaggaaatcgccgagacccagcacgggaccattgtcatcagagtgcaatatgagggagatggctcaccctgtaagatccccttcgagatcatggacctggaaaagcgctacgtcctcggtcggctgatcaccgtgaacccgatagtgacggagaaggacagcccagtgaatatcgaggcggagcctccgttcggcgattcctacatcattataggggtggagccgggccagttgaagctcaactggttcaaaaagggaagctcgataggacagatgtttgagacaaccatgcgcggtgccaagcgtatggccatcctgggagacacagcatgggactttggcagcctcggcggggttttcacgtcaatagggaaagcactccaccaggtgttcggcgcgatttacggagcagccttttcgggagtctcctggaccatgaaaatcctgattggagtgataataacctggatcgggatgaatagccggtcaaccagcctgtctgtttcgctggtccttgttggcatagtgactctgtacctgggggtcatggttcaagccgacagcggctgcgtggtctcgtggaaaaacaaagagctcaagtgtggctctgggatcttcatcactgacaacgtgcatacctggaccgaacagtataagtttcagcccgagtcccccagcaagctggcctccgcgatccagaaggcccaggaagagggcatttgtgggatccggtcggtgacgcgcctggagaacctcatgtggaagcagatcacacccgagttgaaccacatccttgctgaaaacgaagtcaagctcaccatcatgaccggcgacataaaggggatcatgcaggccggcaagcgctccttacggccgcagcccaccgagttaaaatacagctggaagacctgggggaaagcgaagatgctatccaccgagagccacaaccagaccttcttgatcgatggaccagagaccgcggaatgcccgaataccaatagagcctggaactccctggaggtggaggactacggcttcggggtcttcaccacaaacatttggcttaaacttaaagagaagcaggacgccttttgcgacagtaagttgatgtcggccgcgatcaaagacaatcgcgccgtccacgccgacatgggctactggatcgagagcgccttgaatgatacgtggaagatcgagaaggcctccttcattgaagtgaagaactgtcattggcccaaatctcacactctatggtccaatggagtgttagaatcagagatgattatccctaagaacctcgcggggcccgtttcgcagcataactacagaccggggtaccatactcagaccgccggcccttggcacctgggcaagttggaaatggacttcgacttttgtgacggcaccacagtgatcgtcaccgaggactgcggcaatcggggacccagtctccgcaccactacggccagcggcaagttaataaccgagtggtgttgcagatcctgcaccctgcccccgctccgctatagaggggaagacggctgctggtatggcatggaaatccgccccctgaaggaaaaagaagagaacctagtaaactctttggtgaccgccggacacggccaggtggacaacttctccctaggcgttctggggatggcgctgtttctggaggagatgctgcggacccgcgtcggaaccaagcacgccatactcctggtggcagtcagcttcgtgaccctgatcactgggaatatgagcttcaaggatctcggccgggtggtggtgatggtggggacgaccatgaccgatgacatcggcatgggcgtcacgtacctcgcactcctagccgcattcaaggtgcgccccacgttcgcagcagggcttctactcagaaagttaacaagcaaggagctgatgatgacgaccatcggaatagtactcctgagccaatcaacgatccccgagactatcttagagttaaccgacgccctggccctagggatgatggtcctcaagatagtacgagatatggagaagtatcagctggcagtgactatcatggcaatcctgtgtgtcccgaatgccgtgatcctccaaaacgcctggaaagtctcttgtacgatcctggccgtcgtttcggtgagccctctgctcttaaccagctcccagcagaagaccgattggattcccctggcactcaccatcaaaggcctgaacccgacggccatattcctgaccaccttgagccgcactaacaagaagcggtcttggccgctcaacgaggccatcatggccgttggcatggtgagcatcctggcgtcatccttgctgaagaacgatatcccgatgacggggcccctggtcgcgggtgggctcctgacagtgtgctacgtgctgacaggccgctccgctgaccttgagttagaacgagccaccgacgtcaagtgggaagaccaggccgaaatcagcgggagctccccaattctatctatcacaatctcggaggacggcagcatgtcaatcaagaacgaggaggaggagcagaccctcactatactgatccgcaccgggctgctcgtaatcagcgggttattcccggtaagcatccccataacagcagctgcctggtatctgtgggaggtcaagaagcagagagcgggcgtactctgggacgtgccctccccgccgcccatggggaaggctgagctggaagatggagcgtaccgcattaaacaaaaggggatcctcggttactcccagataggcgccggtgtctacaaggagggcacgtttcataccatgtggcatgtgacgcgcggagcggtcctcatgcacaagggcaagcgcatcgagccaagctgggccgacgtcaagaaggacctgatctcctacggtggcggctggaagttggagggagagtggaaggagggcgaagaggtccaagtgctcgccctcgagcccggtaagaacccccgggcggtccagaccaagcccggactgttcaaaacgaacacgggcaccatcggcgccgtgagcctcgacttcagtcccggaacctcggggtctccaatcatcgacaagaagggaaaggtggtcggtctgtacggcaatggagttgttacgcgtagcggggcctacgtttccgccattgcacagaccgaaaagtccatagaagacaaccccgagatcgaggacgacatcttccgcaaaaggcggctgaccatcatggacctccaccccggcgcggggaagaccaagcgttacctccccgccatcgtgcgagaagccataaagcgcggccttagaacgctgattctcgcgccgacccgcgtggtcgcggccgagatggaggaggccctgcgggggctgcccatccgataccagacccccgcaatacgggccgagcacaccggccgtgagatcgtggatctcatgtgtcacgcgaccttcaccatgcgcctgctgtcccccgtgcgtgtcccgaactacaaccttatcataatggacgaggcccacttcacagaccccgctagtatagccgctcgcggctacatcagcacccgtgtggagatgggggaggcagccgggatcttcatgactgcaacgccgcccgggtcccgagacccgtttccacaatccaacgcccccattattgacgaggagcgcgagatccccgaacgctcctggaacaccggccacgagtgggtgacagacttcaagggtaagacggtgtggttcgtgccaagcatcaaggccggcaacgacatcgcggcctgcctgaggaagaatggcaagaaggttatacagctctcccggaagaccttcgacagtgagtacgtcaaaacccgaaccaacgactgggacttcgtcgtgacaaccgatatctccgagatgggggccaacttcaaagccgagcgcgtgatcgacccgcgacgctgcatgaagccggtgatactcacagacggcgaggaacgggtgatcttagcggggcccatgccggtcacccatagctccgccgcccagcgaagaggccgcatcggacgcaatcccaagaacgagaacgaccagtacatctacatgggcgaaccactggaaaacgacgaggactgcgcacactggaaggaggccaagatgcttctggataatataaacactccagagggcatcatcccatcaatgttcgagcccgagcgcgagaaggtcgacgcgatagacggcgagtatcggctgcgcggcgaagcccgcaagaccttcgtagacttgatgaggcgcggagatctgccagtatggttggcttacaaggtggcggccgaaggcatcaattacgcggaccggcgctggtgttttgacgggatcaagaataaccagatcctcgaggagaacgtagaggtcgagatctggaccaaggagggcgagcggaagaagttaaagccccgctggctggacgcccggatctactccgaccccctcgccctgaaggagttcaaggagttcgccgccggccgcaagagcctgaccctcaaccttatcacagagatggggcggctgcccacctttatgacacagaagacgcgcgatgcgctcgacaatcttgcagtgctgcacacagcggaggccggcgggcgggcatacaaccacgcgctctccgaactgcccgagaccctggagactctccttctgctcaccctgctggcaaccgtcacgggcgggatcttcttgttcttgatgtcagggcgcggcatcgggaagatgaccctcggcatgtgctgcatcatcaccgctagcgtgcttctttggtatgcccagatccagccgcactggatcgcggctagcataatattggagttctttctcatcgttctcctgatacccgagcccgagaagcagagaacgccccaagacaaccagctcacgtacgtggtaatcgccatcctgaccgttgtcgccgccaccatggcaaacgagatgggatttctggagaagaccaaaaaggacctcggcctggggtccatcgcgacgcagcagcccgagtcaaacatcctggacatcgatttacgccccgcctcggcctggaccctttacgccgtggcgacaaccttcgtgacacctatgttacgacacagcatcgagaacagttctgtcaacgtcagcttaaccgccatcgctaaccaggccacagtgctgatggggctgggcaaggggtggcccctctccaagatggacatcggcgtcccgctgctggccatcggttgctacagccaggtgaaccccatcaccctaacggcggccctgctgctcctggtggcccactacgccatcattggcccaggcctccaggcgaaggccacccgcgaggcccagaagcgggcagccgcggggatcatgaagaaccccacagtcgatggaatcaccgtcatcgacctcgacccgattccctacgaccctaagttcgagaagcagctgggccaggtgatgctgctcatcctgtgcgtgacccaggtgctgatgatgcgcaccacctgggccctctgtgaagcccttaccttagccacgggaccgatctccaccctctgggagggaaacccgggacgcttctggaatacgactatagccgtgtctatggcgaacatcttccgcggctcatacttagccggcgccggcctactcttcagcatcatgaagaacacgaccaacacacgacgcggtacgggcaacatcggcgaaactttgggggagaaatggaagagtcgcctgaacgccctcggcaagagcgagttccagacctataagaaaagcgggatccaggaggtggaccgaactcttgccaaagagggcattaagcgaggggaaacggatcaccacgcggtgtcccggggctccgccaaacttcgctggtttgtggagagaaacatggtcacgcccgagggaaaagtggtggacctagggtgcggcagaggcggttggtcctactactgcgggggcctgaagaacgtccgggaggtgaagggcctgactaagggcgggcccgggcacgaagaacccataccgatgagcacctacggctggaacttagtacgcctgcagagcggtgtcgacgtgttcttcatcccacccgagaagtgcgacacgctgctatgtgacatcggtgagtccagccccaacccgaccgtggaggccggccggacgctccgcgtactgaacttagtggagaattggctgaacaacaacacgcagttctgcatcaaagtgctgaacccctatatgccctccgtcatcgagaagatggaggccctgcagcggaagtacggtggcgcgctcgttcggaacccgctgagccggaactcgacccacgagatgtactgggtatccaacgccagcggaaacatcgtgtcgtccgtcaacatgatctcccgcatgctgatcaatcgcttcaccatgaggcacaaaaaggccacatatgagcccgatgtcgaccttggctcggggacccggaatatcgggatcgagtccgagatccccaacctggacattatcggaaagcgaatcgagaaaatcaaagaggagcacgagacctcgtggcactacgaccaggatcacccttacaagacgtgggcctaccacgggagctacgaaacgaagcagaccgggagtgcctcctccatggtcaacggggtggtgagactcctcaccaagccgtgggacgtcctccccacggtcacgcagatggcgatgaccgacaccaccccgttcggacagcagcgcgtctttaaggaaaaggtcgacacccggactcaggaacccaaggagggcaccaagaaactgatgaagattaccgccgagtggctctggaaggagctgggtaagaagaagactccgcggatgtgcacccgcgaggagttcacccggaaggtgcggtccaacgccgccctgggcgcaatcttcacggacgagaacaagtggaaaagcgcgcgcgaggctgtggaagactcccgcttttgggaactcgtggacaaggagcggaacctacacttggagggcaagtgtgaaacttgcgtgtataacatgatgggcaaacgcgagaagaagttgggggagtttggcaaggcaaagggcagccgggccatctggtatatgtggctgggtgcacgcttccttgaatttgaggcgctgggtttcttgaacgaggaccactggtttagtcgggaaaatagtctgagtggggtcgagggcgaggggctccacaagctgggctatatcctgagggacgtctccaagaaggagggcggggctatgtacgcagacgacaccgcaggctgggacacacggatcacattagaggacttaaagaacgaggaaatggtgacgaatcacatggagggcgaacataagaagttggcggaggctatcttcaagctcacataccagaataaagtcgttagggttcaacggcccacgcctcggggaacagttatggacatcattagcagacgcgaccagcgggggtccggccaagtgggcacgtatgggctgaacaccttcacaaatatggaggcccagctgatcagacagatggaaggagagggggtgttcaagaacatccaacacctcaccgtcacggaagaggccgccgttcaaaactggctggcccgggtgggccgagaacgtctgagcagaatggccatctccggagatgactgcgttgtcaagccactggacgataggttcgccaacgccctgactgcgctgaacgatatggggaagatccggaaggatatccagcaatgggaaccgagcaaaggctggaacgattggacgcaagtccccttctgctcccatcacttccacgagctaatcatgaaggacgggcgcgtcctcgtggttccctgcagaaatcaggacgagctgataggccgcgcgcgcatcagccaaggggccggctggtccctccgcgagaccgcctgccttggcaagagctacgcacaaatgtggtccttgatgtacttccaccggcgcgacctcaggctggctgcgaacgctatctgtagcgccgtcccgtcccactgggttccgacgagccgcaccacctggagtattcatgccaagcacgagtggatgaccacggaggacatgctgaccgtgtggaaccgggtatggatcagggaaaacccttggatggaggacaaaacacccgttgaatcttgggaggagattccctacttgggtaaacgggaggaccagtggtgtggcagcctgatcgggctgaccagccgcgctacctgggctaagaacatccaggcggccatcaaccaagtgcggtcccttatcggcaacgaggagtacacagactatatgccatccatgaagcgcttccggcgagaggaggaggaggccggggtcctgtggtga

SEQ ID NO: 25580 - RNA, 9876 nt, synthetic construct
  misc_feature 1..9876: note = derived and/or modified CDS sequence (opt11) from DENV-2__JF260983__SS-prME
  source 1..9876: mol_type = other RNA
accgccgggttcctgataatggtgatccccacggtcatggccttccacttaaccacccggaacggggaaccgcacatgatcgtgtctaagaatgaaaaagggaagggtcttctctttaaaaccgaaaacggcatcaacatgtgcaccctcatggcaatggacctcggtgaattatgcgaggataccgttacatacaagtgccccttcctcaagcagaacgagcccgaggacattgattgctggtgcaacagcacgtccacgtgggtcacctacggcacatgcagctccaccggtgagcatcggcgggagaagcggtccgtggccttagtgccccacgtagggatgggcctggaaacccggaccgagacctggatgagctccgagggggcctggaagcaggcgcaacggatcgaaacctggattctccgtcaccctggtttcaccttgatggctgcggtgctggcctacacgatcggtaccacccacttccaacgggccctcatcttcatcctgctgaccgccgtggcaccctccatgactatgcgctgtattggcatttcaaatcgggacttcgtggagggcgtgagcggaggctcatgggtggacatagtactcgaacacgggtcctgcgtcacaaccatggctaagaataaaccgacgctggactttgagctgataaaaaccgaggcaaaacagcccgccacacttaggaagttctgcattgaggccaagctaaccaacaccactacagaaagtcgatgcccgacccagggcgaacccagcctagtcgaagaacaggacaagcggttcgtgtgccggcacagtatggttgacaggggatggggaaacggctgcgggttgttcggcaagggcgggatcgtgacttgcgcgatgttcacgtgcctcaagaagatggagggcaaggtcgtacagcccgaaaacttagagtacacgatcgtaatcacaccccactctggcgaagaacacgccgtgggcaatgacacgggtaagcatggcaaggaagtgaagatcaccccgcagtcctcaatctcagagactgaactaaccgactacggcactattacgatggagtgtagcccgcggactgggttagactttaacgaaatggtgcttctccagatggaatcaaaggcttggctggtccaccgccaatggttcctggacctccccttgccctggctcccgggcgctgatacccaggggtctaactggattcagaaggagatgttagtgacctttaagaatccccatgccaagcggcaggacgtcgtggtactgggaagccaggaaggggcgatgcataccgccctgacgggagctactgagatccagatgtcgctcggaaatattctattcatgggccacctcaagtgccgactacgaatggacaagctgcagctgaagggcatgagctatagcatgtgcactgggaagttcaaggttgtgaaggagattgccgaaacgcagcatgggacgatcgtcatacgcgtgcaatacgagggggacgacagcccgtgtaaaatcccatttgagatcatggacctcgagaagaaacacgttctggggcggctgataactgtgaatccgatcgtaacagaaaaggactcccccatcaacatcgaagccgagccgccgttcggcgatagttacatcgtcataggcgtggagccgggacagctcaaactgaactggttcaagaaaggatcctcgatcgggcaaatgttcgagacaacgatgcgcggggcgaaacgaatggctatcctaggcgacaccgcctgggacttcgggtccatcggtggggtctttacgagcgtggggaaggcccttcatcaggtgttcggcgccatctacggggcagcgttcagtggtgttagctggacgatgaagatcctgatcggcgtagttataacgtggatcgggatgaactcccggagcacctcactatcagtcacccttgttctagtgggaatcgtcaccctttacctgggcgtgatggtgcaggcggactccggttgtgtggtaagctggaaaaacaaagaactgaagtgcgggtcaggcatatttgtgacagataacgtgcacacctggaccgagcagtacaagttccagcccgattcccccagcaagttggcctcagcgatccaaaaagcccacgaggaaggtatttgcgggattcgcagcgtcacgcggctggaaaacctcatgtggaagcagatcacgcccgagctaaaccacatactgtctgagaacgaggtgaagttgacgatcatgaccggggaaattaaggggataatgcaggccggccgccggtcgctaaagccccaacccaccgaattacgctattcctggaaaacgtggggcaaggccaaggttctcagtactgagctgcagaatcagaccttcctgatcgacggccctgagacgacggagtgtccgaactctaaccgggcctggaatagcctcgaggtagaggactacggctttgggatcttcacgacgaacatctggctgaaactgagggagaagcaggacatgatctgcgactcaaagctcatgagcgcggccgtgaaagacgatagagccgtgcacgccgatatgggatattggatagaatcccgtctgaacgatacctggaaaatggagaaagctagcttcatagaagtaaagtcctgctactggcccagaagccatacgctgtggtcgaatggtgtgctcgagagcgaaatgataatacccaagaacctggcgggccccgtcagccagcacaattaccgtccgggctattatactcagactgccgggccctggcatctgggcaagctcgaaatggacttcgagttttgtgaggggaccacggtggtggtcacggaggactgcgggaacagggggccatccctgcgaacaaccaccgcttcaggcaaactgatcacggagtggtgctgccgctcctgcacccttccacccctgcgctatcggggtgaggatgggtgctggtacggcatggagatcagacccctgaaggagcgggaggagaacctcgtaaacagcttagtgacagccggtcatggacagatagacaacttctctctggggatcctcggtatggctctcctgctggaagaaatgctgcgtacccgggtcggcacgaagcacgcgctgctcctggtggccatcagctttgtgacgctgatcacaggaaacatgtccttcaaagaccttgggcgggttatcatcatggtcggggccgcaatgaccgacgagatgggcatgggcgtgacgtatttagcgctattagctgcattcagagtccggcccacgttcgcagtcggcctgctgctacgcaagttgaccagcaaggagttgcttatggccactatcggtgttgtcctgttgagtcaaagtaacatccctgggacagtgctcgagttaacagacgctatcgccctgggaatcatggtccttaagataatgaggagtatggaaaaataccagcttgccgtgaccgtaatggcgatgctgtgcattccaaacgtcatgatcctccaacacgcttggaaagtggggtgcaccatactcgcggcggtcagcgtcagccccctgcttctgacgtcatcccagcagaagaccgactggatcccccttgccctaaccataaagggtctgaacccaaccgccatatttttgacgacgctcagccggccatctaagataaggagctggcctctaaacgaggccatcatggcagtgggcatggtcagcattctggccagctctctcctgaaaaacgacatccctatgacagggcccttggtcgcagggggcctactaactgtgtgctacgtgttaacgggccgctccgccgatctagagctggaaaaagccgcggaagtcaagtgggaggaccaggccgagatatcggggtccagcccaattctttcgatcaccatcagcgaggatggctccatgtccatcaagaacgaggaggaggagcagacgctcaccatcttaatccggacgggtctcctcgtgatttccgggttgttccccgtatcaatccctatcactgccgccgcctggtacttatgggagaccaaaaagcaaagagcaggcgtcctctgggacgttccgagtcccccgcccatgggaaaggccgagctggaggacggcgcctaccggatcaagcaacgcggtatcttcggctatagccaaataggagcaggcgtctataaggagggcacattccacacaatgtggcacgtaacccgaggagcggtactggtgcacaaggggaaacgcctcgaaccgagctgggccgacgtcaagaaggaccttataagctatggcgggggctggaagctggagggggagtggaaggatggcgaagaggtccaagttttggccctggaacccgggaagaacccccgggccgtccagaccaagccgggccttttcaagaccaatacagggacaatcggggccgtttccctagacttcagcccggggacctccggttctcccatcatcgaccgaaagggcaaggtggtcgggctctacggcaacggcgtggtgacgcgctcggggacctacgtcagcagcattgctcaaaccgagaagtccgttgaggacaatcccgagatcgaggacgacatatttcgcaagaaacgtctgaccataatggacctgcaccccggcgccgggaaaacgaaacgatacttaccggccatcgtgcgagaggcaattcgtcgcggcctgcgtacccttattctcgccccaacacgtgtcgtcgcagccgaaatggaggaggccctccgggggttaccaatcagataccaaaccccggcgatcaaagcggagcacaccgggcgtgaaatcgtagacctcatgtgccatgctactttcacgatgcgtttactatcgccaatcagggtacccaactataatctcataataatggacgaagcccatttcacggaccccgcgagtatcgccgcgaggggttacatctcaacgcgggtcgaaatgggggaagctgctggtatcttcatgactgcaacgccacccggttcacgagacccgttcccccagtccaacgcacctatcatggatgaggagcgtgaaatcccggagcgctcctggaactctgggcacgaatggatcaccaactttaaagggaaaactgtgtggttcgttcccagtattagggcgggcaacgacatcgcggcttgcctaaggaagaatggaaagagagtgatccagcttagccgcaagaccttcgacacggagtatacgaagacacggaccaatgactgggacttcgttgtaacaacggacatctccgagatgggagcgaattttaaggctgagcgcgtgatagaccccaggcgctgtatgaagccagtgatcctcacggacggcgaggaacgggtagtgttagcgggtccgatgccggtgacccacagctcggcagcccaacgtcgcggccggatcggacgaaatcccaagaacgagaatgaccagtacatttacatgggcgagcccctggagaacgacgaggattgcgctcactggaaggaagcgaagatgttattggacaacatcaacacgccggaaggtatcattccctctatgttcgagcccgagagagagaaagtcgacgcaatcgacggcgagtatcgtctgcgcggcgaagccagaaagacattcgtagacctcatgaaacgcggggatttaccggtatggttggcctacaaggtcgcctcggagggcatcaactatgcagaccgcaagtggtgcttcgacggtataagaaataatcaaatcctcgaggagaacatcgaggtggaggtttggactaaagaaggcgagcgcaagaaattaaagcccagatggcttgacgcccgtacctactccgatcccctcgccctgaaggagttcaaggagttcgctgccggccgtaagagtctcactctcagcctgatcaccgaaatggggcgcctgcctacgttcatgacccagaagacgcgtgacgcgctcgacaacctagccgttctgcactccgcagagatgggagggcgcgcctacaaccatgctctctccgagcttccggagaccctagagacgctcctgttgctgggacttctggcgactgtgacagggggaatcttcctattcctgatgagtggcaggggtgtgggcaaaatgacgctcgggatgtgttgtataatcacagcctcaggactcctgtggtatgctcaaattcagcctcactggatcgccgcttctatcatactcgagttctttttgatagtacttctgatccctgagcccgagaaacagcgcacaccccaggataatcagctcacctacgtggtcatcgccattctcacgttggtggccgctaccatggccaacgaaatgggcttcctcgagaagaccaaaaaggacctggggctcggcggcttcacgatgcagcagcctgagataaacatattagacatcgacctgaggcccgcgtcagcgtggacgctttacgctgtggccacaaccttcgttaccccgatgctacgccacagcattgagaacagcagcgtgaacgtaagccttacggccattgcgaatcaggccaccgtcctaatgggtctcgggaagggctggccacttagcaagatggatatcggcgtaccgctgctggccataggctgctactcccaggtgaaccccatcaccttaacggccgccctattgctactcgtagcacactacgcgatcatcgggccaggcctccaggccaaggcgaccagggaggcacagaagcgggcggcggcaggcatcatgaagaacccgaccgtagacggcataaccgtgatcgacctggagccaattccgtacgatccaaagttcgagaagcagctcggccaggtaatgctcctggttctatgcgtgacacaggtgctcatgatgcgcacgacctgggctctttgcgaagcgttgacgctcgccaccgggccaattagcacgttatgggagggtaaccccggcaagttctggaataccaccatcgccgtgtccatggccaacatcttcagagggtcctacttagccggcgcgggtctccttttctccatcatgcgcaacacgacgagcgcccgacgaggtactggtaccataggtgaaacactgggagagaaatggaaaagccgtctcaacgcactgggcaggagcgagttccagatctataagaagtccggcatccaagaggtggatcggacactggccaaagagggcatcaagcgcggcgaaaccgaccaccatgcagtcagccggggtagcgcaaagctcagatggttcgtcgaacgaaacatggtggcgcccgaagggaaggtcgttgacctaggctgcggcagaggcggctggagttactactgcggcggcctgaaaaatgtgcgggaggtcaaggggctcactaagggtgggcccggccacgaagaaccgatccccatgtccacctacggttggaacttggtacggctgcagagcggggtggatgtctttttcactccacccgagcggtgcgacacgcttctatgtgatatcggtgaaagctcaccgaatcctacagtagaagccggtcgtaccctgcgggtgttgaatctcgttgaaaactggctcggtagcaacactcagttctgcattaaggtcctcaatccttacatgccgtccgtaatcgagcgcatggagacactccagcgcaaatttggtggcgcccttgtacgtaaccctctaagcagaaattccacccacgagatgtactgggtcagcaacgcctcaggtaacatcgtgtcatccgtcaacatgataagccggatgctcataaacaggttcacaatgcgtcacaaaaaggcgacctacgaacccgacgtagacctgggttccggcacgcgaaacatcggtatcgaatgcgaaaccccgaacatggacatcataggcaaacggatagaaaagatcaaacaggagcatgaggccagctggcactacgaccaagaccatccctacaaaacctgggcttatcacggatcctacgagacgaagcaaacggggagcgcctcctccatggtgaatggtgttgttagactgctcactaagccctgggacgtgattccaatggtgacccaaatggcaatgaccgacacgacccccttcgggcaacagcgggtgttcaaggagaaggtggacaccaggacccaggagccgaaggagggtaccaagaaactcatgcgaatcacggccgagtggttgtggggcgagttaggcaggagaaagaagccccgcatctgtactcgggcggagttctgtaacaaggtcagatccaatgccgctctgggagcggtgtttaccgacgaaaacaagtggaagtccgcaagggaggccgtcgaggacgagcgcttctgggagctggtggaaaaagagaggaacctgcacctggatgggaagtgtgagacgtgcgtctacaacatgatgggcaagcgcgagaagaaactaggagagttcggcaaggcaaaggggagccgggccatatggtacatgtggctcggcgccagatttttagagttcgaggcccttggctttctcaatgaagatcattggttctccagagagaacagcttgagcggggtcgagggtgaggggcttcacaaactcggttacatactacgcgatataagccggaaggccgggggtgcgatgtatgcagacgacacagcgggctgggacaccaggattacgtctgaagatctgaaaaacgaggagatgatcacggaccagatggagggtcgccataagaaacttgcggaggcgatcttccggcttacctaccaaaacaaagtagtacgcgtacaacgtcccacgccacgcggaaccgtgatggacatcatcagccggagggaccaacgggggtccggccaggtgggtacctacgggctcaatacgtttacaaatatggaggcacagcttatccgccagatggagggcgaggggctgttcaaaagcatcttacatctaacgccgcaggaagaaacagctgtacacgcctggctggtccgtgaggggcgtgagcggctggcgaggatggccatctcaggggacgattgcgtggtcaagcccctcgacgaccggttcgcacgcgcgctaactgcccttaacgacatgggaaaagtacgcaaggacatacagcagtgggagcccagcaagggttggtccgactggacccaggtgcctttttgttcgcatcacttccacgagctcatcatgaaggatgggcgcaagctggtagttccgtgccgaaaccaagacgagctgattgggcgggcccgcatcagtcaaggggcaggatggagcttgcgggagactgcctgtctggggaagtcctacgcccagatgtggtccctgatgtacttccaccgccgggacctccgacttgcagcaaacgctatatgctctgccgtgccgagccactgggttcccacgtcccggacaacctggtctatccacgcctctcatgaatggatgaccactgaagacatgctggcagtgtggaacagggtgtggatacaagacaacccctggatggaggacaagacaccggtcgagtcctgggaggacataccctatctcggcaagcgggaggaccagtggtgcggcagcctgatcgggttgaccagccgggccacctgggccaagaacatccagaccgccatcaaccaagtgcgtgccctcataggcgaagaggagtatatggactacatgccgagcatgaaaagatttagatccgaagaggaagagagtggggttctctggtag

SEQ ID NO: 25581 - RNA, 9876 nt, synthetic construct
  misc_feature 1..9876: note = derived and/or modified CDS sequence (opt11) from DENV-2__AF119661__SS-prME
  source 1..9876: mol_type = other RNA
accgtgggcgtcatcataatgcttatccccactgccatggccttccacttgaccacccggaatggggaaccccacatgatcgtgggccggcaggagaaggggaagtcgctgttattcaagaccgaggacggcgtcaatatgtgcaccctcatggcgatcgatctgggtgaactgtgcgaggataccatcacctacaagtgccccctcctccgccaaaacgagcccgaggacatcgactgctggtgtaacagcaccagcacctgggtcacctacggaacctgcaccaccacgggcgagcaccggagggagaaacggtccgtggccctggtcccacacgtcgggatggggctcgagactcgcaccgaaacctggatgtcatccgagggggcctggaaacacgcgcagcggatcgaaacatggatcctgcgtcaccccgggttcatcataatggcggcgatcttagcttataccatcggtactacccacttccagcgggcgctcatattcatactgcttactgccgtagctcccagcatgaccatgcgctgtatcggggtttccaatagagacttcgtcgagggcgtgagtggagggtcttgggtagacatagtcctggagcatgggtcatgcgtgaccaccatggccaaaaacaaaccgactctggacttcgagttaatcaagacggaggccaagcagcccgtgacgctccgcaagtactgcatcaaagccaagctgaccaacacgaccaccgaatcccggtgcccgacccagggtgaacctagcctgaacgaggagcaagacaagcgcttcgtctgcaagcacagtatggtggaccgggggtggggaaacggctgcgggttgttcggcaaaggcgggatagtgacctgcgccaccttcacgtgcaagaagaacatggagggcaagatcgtgcagccagagaacctggagtacacgattgtcatcacgccccactccggggaggagcacgcggtgggcaatgataccgggaagcacgggaaggaaatcaaaatcactccacagtcctctatcactgaggccgagctgaccgggtacggcacggtcaccatggaatgctctcccaggacgggcctcgatttcaacgagatggtgctgctacagatggaggacaaagcctggctcgtgcaccggcagtggttcctggacctgcccttgccctggctgcctggggctgatacccaaggctccaactggatccaaaaggagactctggtcaccttcaaaaacccccacgccaagaaacaggatgtggtcgttctcggttctcaagagggcgcgatgcacaccgcactgactggcgcgacggaaatacagatgagcagcggcaacctcctgttcaccggccatctgaagtgtcgcctgcggatggacaagctccaactgaaagggatgagttatagcatgtgcaccggcaaattcaagatcgtcaaagaaatcgccgaaacccagcacgggacgatcgtgatccgggtccaatacgaaggcgacggctccccttgtaagattcccttcgagatcatggaccttgagaagcgacacgtgctggggcgcttaataaccgtcaaccctatcgtaacagagaaggacagccccgtgaacatcgaggcggaaccgcctttcggcgactcttacatcatcataggggtcgagccgggtcagctgaagctcaattgggtgaagaaggggtcttccatcggccaaatgttcgaaacgaccatgaggggcgcgaagcgaatggccatcctgggggataccgcttgggactttgggtccctcggcggggtgttcacgtccatcgggaaggccctacatcaggtctttggggcaatctacggggcggcctttagcggggtgtcctggaccatgaagatcctaatcggcgtgatcatcacgtggatcgggatgaacagccggtctaccagcctgtccgtcagcctggtcctcgtgggcgtcatcaccctataccttggggcaatggtgcaggcggactccggctgcgtggtctcgtggaaaaacaaggaactcaagtgcggctctgggatctttatcaccgacaacgtgcacacgtggaccgagcaatacaagttccaaccagaaagccccagcaaactagcatcggctatccagaaggcccacgaggagggtatttgtgggattcggagcgtgactcgcttagagaacctcatgtggaaacagataacccccgagctgaatcacatcctgtccgagaacgaggtaaaacttacgatcatgacaggggacataaaggggatcatgcaggccggaaagcgatcgctgcgcccgcagcccaccgaactgaagtactcctggaagacctggggcaaggccaagatgctaagcactgaatcccacaaccagaccttccttatagacgggcctgagacagcagaatgcccgaacactaaccgggcctggaacagtctggaggtggaggattacggtttcggtgtattcacgacaaacatctggctcaagttgcgcgaaaagcaggacgttttctgcgactccaaacttatgagcgctgccatcaaggacaacagggccgtgcacgcagacatgggttactggatcgagtccgcactcaacgacacctggaagatggagaaggccagcttcatcgaggtcaagtcctgtcactggcccaagagccacactctgtggtcaaacggcgttctagaaagcgagatgattatccccaagtccttcgccggaccagtgagccagcacaattaccgtccgggctactacacccagacagcagggccctggcatcttggcaaactggagatggacttcgacttttgcgaggggaccactgtggtcgtgaccgaggactgcggaaaccggggaccaagccttcgcacgacgaccgcgtccgggaagctcatcaccgagtggtgctgtcggagctgcacgctgcccccactgcgctaccggggcgaagacgggtgctggtatggcatggagatccgcccgctaaaggagaaggaggagagtctggtagacagcctggtcaccgcggggcacggccagatcgacaatttctccttaggcgtgctggggatggctttattcctcgaggagatgctccgcactcgcgtgggcaccaagcacgccatcctgttggtcgcagtgagcttcgtgacgctgattaccgggaatatgtccctgagggacctcggtcgcgtcatggtgatggtgggggcgaccatgaccgacgacattggaatgggcgttacgtatctagccctgttggccgcctttaaagtgcggcccacattcgcggcgggtctgctgttacggaagctgactagcaaggaactgatgatggccaccatcggcatagccctcctatcccaaagcacaatccccgagacgatcctggagctgaccgacgccctggcgctggggatgatggtactcaagatcgtacgcaacatggagaaataccagctcgccgtgaccatcatggcgatctcttgcgtgcccaacgcagttatcttacagaacgcatggaaggtgagctgcacaatattggcggcggtctccgtgagcccactgctgctcaccagtagccagcagaaggccgactggatcccattggctctaaccatcaagggtttgaaccccaccgcgatcttcctgacgactctagcccggaccagcaagaaacgcagctggcccctaaacgaagccatcatggccgtgggcatggtctccattctggccagcagcctgctcaagaatgacatccccatgacggggccgctggtagcaggagggctgctgacagtgtgctacgtcttgactggtcggtccgccgacctggaactcgaacgtgctaccgacgtgaagtgggaggaccaagccgagataagcgggtcctcacccattctgagcatcaccatcagcgaggacggctccatgagcatcaagaacgaagaggaggagcagactctaaccatcttgatccggaccggcctactggtgatctccggactcttccctgtctcaatacccatcacggccgcggcctggtacttatgggaggtgaagaaacagcgcgcaggcgtgctgtgggacgtgcccagcccaccgcccgtggagaaggctgagttagaggatggggcatatcggatcaaacaaaaagggatactggggtatagccaaatcggcaccggcgtgtacaaggaaggcacgttccatacaatgtggcacgtcacgcgcggtgcggtgctgatgcaccgggggaaacgcatcgaaccctcctgggccgatgtgaagaaggacctcatctcctatggcggcggctggaagctggaaggcgaatggaaagagggggaggaggtacaggtgttagccctcgagcccggcaaaaacccccgggccgtccagacgaagcccgggctgttcaagacgaacaccggcactatcggggctgtctccctggacttcagccccggcacgagcggcagccctatagtggaccgcaaggggaaggtagtcggcctctacgggaatggggtggtgacgcggagcggcgcctacgtcagcgccatcgcccagaccgagaagtccatagaagacaaccccgagatcgaagacgacatcttccgcaagaaacggttgaccattatggacctgcaccccggtgctgggaagaccaagagatatctgcccgcgatcgttcgggaggcaatcaaacggggactcaggacgctgatcctcgcccctacccgcgtggttgccgcggagatggaggaagcgctacgcggcctgccaatccggtaccagacccccgccatccgcgcagagcacaccggcagagagatcgtggacctgatgtgccacgccacgttcaccatgcgcctcttgtctcccgtacgggtcccgaactacaacctgatcatcatggacgaggcccattttaccgaccccgcgaatatcgctgcccgcggctacatctcgaccagagtggagatgggcgaggccgccgggatcttcatgactgcgacgccacccggatccagagacccgttcccccaatccaacgcccccatcatggacgaggagcgggaaatccccgagagatcctggaacagcggccacgaatgggtgactgacttcaagggcaaaacagtctggtttgtgcccagtataaaggctggaaatgacatcgccgcgtgcctcaggaagaacggcaagaaggtaatccagctgtcgcgcaagacgttcgattccgagtacgtcaagacccggaccaacgactgggacttcgtggtgaccacggacatcagcgaaatgggcgccaacttcaaggcggagagagtcattgacccccgacgttgtatgaagcccgttatcctgacggatggggaggaacgagtgattctggccgggcctatgccggttacacattccagcgccgcgcagcgcagagggcgtatcggtcgcaaccccaagaatgagaatgaccagtatatatatatgggggagccactggagaacgacgaggactgcgcccactggaaggaggccaagatgctgctcgacaatatcaacacccccgagggcatcattccctccatgttcgaacccgagcgggagaaggtggacgccattgacggcgagtaccgcctgcgtggggaagcccgcaaaacgttcgtggacttgatgcgccgcggagacctccccgtttggttggcctaccgcgtcgccgccgaggggatcaattacgctgaccgccggtggtgcttcgacggcgtgaagaacaaccagatcctggaggagaatgtagaggtggaaatctggaccaaggagggggagcgcaagaagttgaagccgcgctggcttgacgcccgaatctattctgaccccttagcgctcaaagagttcaaggagttcgccgccggccggaagtccttgactctgaatctcataacggaaatgggtcgcctgcccacgttcatgacacaaaaggcccgcgacgccttagacaatttggccgttctgcacaccgccgaggccggtggccgcgcctataaccatgcactatctgagctccccgagaccctggagacgctgctccttctgactctactggccacagtaacaggaggcatcttcctgttcctcatgtctggcaagggcgtgggcaaaatgaccctggggatgtgctgcatcatcacggcctcgattctgctatggtatgcccagatccagccgcactggatcgcagcttccatcatcctggagttcttcctgatggtcttgttaatccctgagccggagaaacagcgcacgccgcaggacaaccagctgacttacgtagttatagccatcctcaccgttgtagccgccacgatggccaatgagatgggattccttgaaaagaccaagaaggacctggggctcggaagcatagcgacccaggagccagagagcaacatcctggacatcgacctacgccccgcctctgcatggaccttgtacgccgtggccacgaccttcgttacccccatgctgcggcactccattgaaaattccagcgtgaacgtgtccctgaccgcgattgccaaccaggccacggtcctcatgggcctgggtaagggctggcctctgagcaagatggacataggggtgccgctcctggccatcggctgctactcgcaggttaatcccatcaccctgacggcggctctcctgctcctagtcgcccactacgctatcatagggcccggcttgcaggccaaggcgacccgcgaggcccagaagcgggccgccgccggtatcatgaagaatcccacggtggacggcatcaccgtgatcgacctggacccgattccttatgaccccaagttcgagaagcagctcggccaggtgatgttgctgattctatgcgtgacccaggtcctgatgatgcgcaccacttgggcgctgtgcgaggccctcacactggccaccgggcccatctcaaccctatgggaggggaacccggggcgattctggaacaccaccatcgccgtctccatggccaacatcttccggggcagctacctcgcgggcgccgggctgttgttcttcataatgaagaatactactaacacgcgcagaggtaccgggaacatcggggagacgctgggcgaaaagtggaagtcccgcctcaatgccttaggtaagtcggagttccagatctacaagaagtccgggatccaagaggtggaccggaccctcgctaaggaggggatcaagcgcggcgaaacagatcaccacgctgtgagccgcggctccgcgaaattgcgctggtttgtcgagcgtaatatggtgacccctgagggcaaagttgtcgacctgggctgcgggcgcggcggatggagctactactgcggcgggctcaagaacgtgcgggaggtgaaaggccttacaaagggtgggccaggccacgaggagcccatccctatgtccacttacgggtggaacctggtccgcctccagagtggcgtggatgtgttcttcacgccaccggagaagtgcgacaccttactctgcgacatcggggagagcagccccaacccgaccattgaggccggcaggacgctccgcgtcctgagcttggtggaaaactggttgaacaatgacacccagttctgcattaaggttttgaacccttacatgcccagcgtaatcgagaagatggagacactccagcggaagtacggtggggctcttgtgcgcaaccccctctctcggaactccacccacgagatgtattgggtcagcaacgccaccggtaacatcgtctccagtgtgaacatgatttcccgcatgctaatcaatcggttcaccatgaaacacaagaaagcgacgtacgaacccgatgtggatctggggagcgggactcgcaacatcgggatcgaatccgagatccccaacctcgatataatcggcaaacgaatcgagaagatcaagcaggagcacgagaccagctggcactacgatcaggaccacccgtacaagacctgggcctaccacggctcctacgaaactaagcagaccgggtccgcttccagtatggtcaatggagtagtgcggctgttgaccaagccgtgggacgtagtgcccatggtgacacagatggcgatgacggacaccacacccttcgggcagcagcgcgtcttcaaggagaaggtggacacccggacgcaggagcccaaggagggaaccaaaaagctcatgaagatcaccgctgagtggctgtggaaggagctgggcaagaagaagaccccgcgcatgtgcacgcgggaggagttcacccgaaaggttcggtccaacgcagccctcggggccatcttcacggatgagaacaagtggaaatcggcccgcgaggccgtcgaggacaaccgtttttgggagctggtagataaggagcgaaacctgcatctagagggcaagtgcgagacctgcgtctataatatgatggggaaaagggaaaagaagttaggagagttcgggaaggctaagggatcacgcgccatctggtacatgtggctgggagccaggttcctcgagttcgaagccctggggttcctgaacgaggaccactggttcagtcgcgagaactccctcagcggcgtggagggtgagggcctgcataagctggggtacatcctacgggacgtctcgaaaaaggaaggcggcgcgatgtacgccgacgacacagccgggtgggacacgcgcatcacgctggaagacctgaaaaacgaggagatggtcacgaatcacatggagggcgagcacaagaaactcgccgaggcgatctttaagttgacgtaccagaataaggcggttcgtgtgcagcgcccaacgccgcggggtaccgttatggatatcatctcccgccgggaccagcgcggcagcggccaagtggggacctacggcctgaatacgttcaccaacatggaagctcagctgatcaggcagatggagggggagggcatcttcaaatccatccagcacctgaccgtgaccgaggaaatagccgtgcagaactggctagcccgggtggggcgcgagcggctcagtcgtatggcaatctccggcgacgactgcgttgtcaaacccctggacgaccgcttcgcgagcgccctgactgccctcaacgacatgggtaaggtgcgcaaggacatccaacagtgggagccgtcacgggggtggaacgactggacccaggtgcccttctgtagccaccacttccacgagctgatcatgaaggacggccgcgttctggttgtgccctgccgaaaccaggacgagctcatcggtcgtgctcgaatctcccaaggcgctgggtggagcctcaaggagaccgcgtgcctgggcaagtcctacgcccaaatgtggagcctcatgtactttcaccgccgggacctgcgcctggccgccaacgccatctgttccgcggtccccagccactgggtgccgacctctcggaccacgtggagtatccacgccaaacacgagtggatgacaaccgaggatatgttgaccgtgtggaaccgcgtctggatccaggagaatccctggatggaggacaaaacgcccgtggagtcttgggaggaggtcccgtacctgggcaagcgggaggaccagtggtgcgggtccttgatcggcctaaccagccgagcaacgtgggccaagaacatccagacagcgatcaaccaggtgcggtctttgattgggaacgaggagtacacggactacatgcccagcatgaagcgattccgccgggaagaggaggaggccggtgtgctatggtga

SEQ ID NO: 25582 - RNA, 9876 nt, synthetic construct
  misc_feature 1..9876: note = derived and/or modified CDS sequence (opt11) from DENV-2__EU056810__SS-prME
  source 1..9876: mol_type = other RNA
actgccggcatcatcatcatgctgatccccaccgtgatggccttccacctcaccacccgcaatggggaaccccacatgatcgtctcccggcaggagaaaggtaaatccctgctgttcaagaccgaggacggggtcaatatgtgcaccctgatggctatggatctgggcgaactgtgcgaggacaccatcacctacaactgccccttactgcggcagaacgagcccgaagacatcgactgctggtgcaactctacctccacctgggtgacctatgggacctgcaccgccaccggcgagcaccggcgggagaagcggtccgtagcccttgtgccccatgtgggtatggggctcgagacgcgcaccgagacgtggatgtccagcgagggcgcatggaagcatgcccagcggattgagacgtggatcctgcggcaccccgggttcactatcatggcagccatcctggcctacaccataggcaccacatacttccagagggtactcatattcatcctgttgacggctgttgcgccctccatgacaatgcgttgcatcgggatcagtaaccgtgactttgttgagggcgtctccggcgggtcatgggtggacattgtgctcgagcatggctcctgcgtcactactatggccaagaacaaacccacgctggacttcgagctgataaaaaccgaggctaagcagcctgccactcttcgcaagtactgcatcgaggcaaagctgaccaacacgacaacggcgtcccggtgcccgacccagggggagccatccctgaacgaggagcaggacaagcgcttcgtgtgcaagcactcgatggtggaccggggctggggcaacggttgtggactcttcgggaaaggcggaatcgtcacgtgcgccatgttcacgtgcaagaagaatatggagggcaaggtggtgcagcctgaaaatctggagtatactatcgtcatcacgccacactccggcgaggagaacgccgtggggaacgatacgggtaaacatggcaaagaaatcaagatcaccccgcagagctccatcaccgaggccgagctgaccggatacggcaccgtgacgatggaatgcagcccccgcacgggcctggacttcaatgagatggtcctgctgcagatggagaacaaggcctggctcgtgcaccggcagtggttcctggacctgcccctcccctggttgccgggcgcggatacccaggggtccaactggatccagaaggagaccctggtgacgttcaagaatccccatgccaagaagcaggacgtcgtcgtcctcggcagccaggagggggccatgcacacagccctgaccggcgcgacagagatccaaatgagcagtgggaacctcctcttcacgggccacctaaagtgccggctgcggatggacaagctacagctgaagggcatgagctactccatgtgcaccgggaaattcaaggtggtgaaggagatagcggaaacccagcacggcaccatcgtcgtgcgcgttcaatacgagggtgacggcagcccctgcaagatcccattcgagatcatggacctcgagaaacggcacgtcctcggaaggcttatcacagttaacccgatcgtgaccgagaaggactcacccgtcaatatcgaggcggagccgcccttcggtgactcttacattatcatcggcgtcgaacccggacagctgaagctcaactggttcaagaagggctccagcatcgggcagatgttcgaaacaaccatgcgcggcgctaagcggatggccatcctgggcgacacggcctgggacttcgggtcgttgggcggtgtgttcactagcatcggcaaagctctccaccaagtcttcggggccatatacggcgctgccttctccggcgtaagctggaccatgaagatcctcatcggggtggtcataacctggattggcatgaactcccgaagcacctccctgagcgtgagcctcgtgctcgtgggggtggtaaccctgtacttgggtgttatggtgcaagcggacagcgggtgcgtggtctcctggaagaacaaggagctcaagtgcggcagcggaatcttcgtgaccgacaacgtgcacacctggacggagcagtacaagttccagcccgaaagcccctcaaagctcgccagtgccatccagaaggctcacgaagaggggatttgcggcatacggtccgtgacccgactggagaacctcatgtggaagcagatcacacccgagctgaaccacatactgagcgagaacgaggtgaagctcaccatcatgacgggggacatcaagggcatcatgcaggccgggaagcggtccctacgcccgcagcccaccgagctgaagtacagctggaagacttggggtaaagcgaagatgctctctaccgaactgcacaaccagacgtttctgatcgacggccccgagaccgcagagtgccctaataccaatcgggcctggaacagcctcgaggtggaagactacgggttcggcgtcttcactacgaacatctggctgaaactgaaggagcgccaggacgtgttttgcgactccaagctcatgagcgccgccatcaaagacaaccgggccgtacatgccgacatggggtactggatcgagtcggccctgaacgacacgtggaagatcgagaaggctagcttcatcgaggtgaagtcctgccattggcctaagagccacaccctgtggtccaacggcgtgctcgagagcgagatgatcatccctaagaacttcgccgggcccgtgtcccagcacaactatcgcccgggttaccatacccagaccgcgggtccttggcacctggggaaacttgaggtcgacttcaacttctgcgaaggcacgaccgtggtggttacaggtgattgcggcaatcggggcccctcgctccgcaccacaaccgccagcgggaagctgatcaccgagtggtgctgccggtcctgcaccctgcccccgctccgttaccggggcgaggacgggtgctggtatggcatggagatccgccccctgaaagagaaggaggaaaatctggtgaactcgctggtgacggccgggcacggccagatcgacaacttttcactgggcgtcctggggatggccctcttcctggaagagatgctgcggacacgcgtgggcaccaaacacgcgatcctcctggtggccgtcagcttcgtgacccttataacggggaacatgtccttccgggacctcggcagggtgatggttatggtgggggccaccatgacggacgacattggcatgggcgtgacttacctggcgttgctggccgcgttcaaggtccgtcccacctttgccgccggtctgctgctccgcaaactcaccagcaaggagctgatgatgaccaccatcggcatcgtgctcttgtcccaaagcacgatccccgagaccgtcctggagctcaccgacgccctggccctgggaatgatggtgctcaagattgtacgtaacatggagaagtaccagctggcggtcaccatcatggccatcctgtgtgtgccgaatgcggtgatcctacaaaacgcctggaaggtctcctgcactatcctagccgtggtgagcgtcagccccctgctcctgaccagctcacagcagaaggcggactggattcccctagccctcaccatcaagggcctgaaccccaccgccatcttcttaaccacgctaagccggacctccaagaaacgctcctggcctctgaacgaggctatcatggcggtgggcatggtgtctatcctggccagttccctcctgaagaacgacatccccatgaccgggcctctggtcgccggcgggctcttaacggtgtgctacgtgctgacgggccggagcgccgacctcgagctggagcgcgccgcggacgtccggtgggaggaccaagccgagatcagcgggtccagccccatcctgtccatcaccatctcagaggacggctccatgagcataaagaatgaggaggaggagcagacactcacgatcctgatcaggaccgggctactcgtcatctctgggctgttcccggttagcatccccatcaccgcagccgcttggtacctgtgggaggtcaagaagcagcgggcgggcgtgttatgggacgtgcccagtcccccgcccgtcgggaaagccgagctggaggacggcgcctaccgcattaagcagaaggggattctgggctacagccaaatcggtgctggggtttataaggagggaaccttccataccatgtggcacgtgacgagaggggccgtcctgatgcacaagggtaagcgcatcgaaccctcctgggcggacgtaaagaaagacctgatcagctacggagggggctggaaactggaaggggaatggaaagagggcgaggaggtacaggtcctcgccttggagcccggcaagaacccacgggctgtgcagaccaagcccgggttattcaagaccaataccggaacgatcggcgccgtgtccctcgacttcagccccgggacctcggggtcccccatcgttgataagaagggcaaggtggtggggctgtacggcaacggcgttgtgacccgctccgggacctacgtgagcgccatcgcgcagacggagaagtccatcgaagataaccctgagatcgaggatgacatattccggaagaaacgcctgaccatcatggacttacaccccggcgctggaaagaccaagcggtacctccccgccatcgtccgcgaggccatcaagcggggacttcgcaccctgatactcgcgccgacgcgggtggtggctgccgagatggaggaggccctgcgcgggttgcccatccgctaccagacacccgccatccgggcggagcacaccggccgtgagatagtcgacctaatgtgccacgccaccttcacgatgcggctgctgagccccgtgagggtgccgaactacaatctcattatcatggacgaggcccacttcacagaccccgccagcatcgccgcacggggctatatctccacccgcgttgaaatgggggaggcagctgggatctttatgaccgccacgccgcccggtagccgagacccgttcccccagtccaacgcccccatcatggatgaggagcgcgagatccctgagcggagctggaactccggtcacgaatgggtgacagacttcaaaggcaagaccgtgtggttcgtcccgagcatcaaggcgggcaacgacatcgccgcctgcctgcgcaagaacggcaagaaagtgatccagctgtccagaaagactttcgacagcgagtacatcaagacgaggactaatgactgggatttcgttgtcaccaccgacatctccgaaatgggtgccaacttcaaggcggagcgggtgatcgaccctcgccggtgcatgaagccagtcatactcacggacggcgaggaaagggttatcctggcggggcccatgcccgtcacccacagctccgccgctcagcggcgcggccgaatcgggaggaacccaaagaacgagaacgaccagtacatctacatgggcgagcccctggagaacgacgaggattgcgcacactggaaggaggcgaagatgctcttggacaacatcaacacccccgagggcatcatcccgagcatgttcgagcccgagcgcgagaaggttgacgccatcgatggggagtaccggctacgcggcgaggcccgtaaaaccttcgttgacctcatgcgcagaggggacctacccgtgtggctggcctatcgcgtcgccgcggagggcatcaactacgcggaccggcgctggtgcttcgacgggatcaagaacaaccagatactcgaagagaacgtagaagtcgaaatctggacgaaggagggcgagcggaagaagctgaagccgcgctggctggacgcccgtatctactccgaccccctcgctctgaaagagttcaaggaatttgcagctggccgcaagagcctaaccctcaatctgattaccgagatggggcggctgcccacatttatgacgcagaaagcccgcaacgccctcgataacctggccgtcttacacaccgcggaagctggcgggcgggcctacaaccacgccctctccgaactgcccgagaccctggagaccctcctgctgctcacgttgctggccacggtgaccggcgggatcttcttgttcctgatgagcgggaagggcatcgggaaaatgaccctggggatgtgctgcatcataaccgcgtccatcctcctctggtacgctcagattcagccgcactggatagccgccagcatcatactggagtttttcttaatcgtgctgttaatccctgagccagagaagcaaaggacacctcaggacaaccagttgacttacgtcgtgatcgcaatcctgacggttgtcgcggccaccatggccaacgaaatgggattcctggagaagacaaagaaggacttcggcctcggctccatcgccacccagcaaccggagagcaatatcctggacatcgatctgcggcccgcctcggcttggaccctttacgccgtggccaccacgtttatcacacccatgctgcgccactccatcgagaacagctccgttaacgtgagcctgactgccattgccaaccaggcaacggtgttgatggggctgggcaaggggtggcccctctccaagatggacatcggcgtgccgctcctggcaattgggtgctacagccaggtcaacccgatcacgctgacagcagccctcctgctgctggtggcgcattacgccatcatcggcccaggcctgcaagccaaggccacccgggaagcccagaagcgcgcggctgccgggataatgaagaaccccacagtggacggcatcacggtcatagacctggacccgatcccctacgaccccaagttcgaaaagcagctcggccaggtgatgctgctggttctctgtgtcacccaggtgctgatgatgcggaccacctgggccttatgcgaggcccttacgctggcgaccggccccatctccaccctgtgggaaggtaacccgggccgcttctggaacacaacgatcgccgtgagcatggccaacatcttcaggggctcctacctcgcgggcgccggtctgctgttcagcatcatgaagaacaccgcgaatacccggcgcgggaccggaaatacgggcgagaccctgggcgaaaagtggaagaatcgcctaaacgctctgggcaagtccgagttccagatctacaaaaagtccgggatccaagaagtcgaccggaccctcgccaaagagggcatcaagcgcggcgagaccgaccaccatgccgtgtcccgcggcagtgccaagctgcgttggttcgtagagcgcaacctggtcacgcccgaaggcaaggtggtggacctcgggtgcggccgcggcggatggtcctactattgcggcgggctgaagaatgtgcgggaggtgaagggtctgaccaagggcgggcccgggcacgaggagcccatcccgatgagcacttacggctggaaccttgtgcgactgcagtctggggtcgacgtgtttttcacgccgcccgagaagtgcgacacgctgctctgcgacatcggcgagagttcccccaacccgactattgaggccggccgcaccctgcgggtgctgaacctcgtcgagaattggctgaacaataacacacagttttgcatcaaggtgctgaacccctacatgcccagcgtgatcgagaagatggaggccctgcagcgcaagtacgggggcgccctcgtccgaaacccgctgagccgcaactccacacacgagatgtattgggtaagcaatgccagtgggaatatcgtcagctctgtcaacatgatcagccggatgctgatcaatcgcttcacgatgcggcataagaaggcgacctacgaacccgacgtggacctcggctctggtaccaggaacatcgggattgagtcggagacccccaacctggacattatcgggaagcgcatcgagaagatcaagcaggagcacgagacgtcctggcattatgaccaggaccacccctataagacctgggcctaccacgggagctacgagaccaagcagaccggctctgccagctccatggttaacggggtagttcggctgctcactaagccgtgggatgtgatccccacggtgacacagatggccatgaccgacactacccccttcggccagcagcgggtgttcaaggagaaggtggacacccggactcaggagcccaaggagggcacgaagaagctgatgaaaatcacagccgagtggctgtggaaggagttaggaaagaagaagaccccgcgtatgtgtaccagggaggagttcacgagaaaggtgcggtctaatgcggccctgggcgccatcttcaccgacgagaacaagtggaagtccgcccgcgaggccgtggaggactcgcggttctgggagctggtcgacaaggagcgcaacctacacttggaggggaagtgcgaaacctgtgtgtacaacatgatgggcaagcgtgagaagaagttgggggagttcggcaaggcaaagggctcccgtgccatctggtacatgtggctgggggcccggttcctggagttcgaagcactgggcttcctcaacgaggaccactggtttagtagagagaactcactgagcggggttgagggggaggggctgcataagctaggctacatactccgggacgtgagcaaaaaggagggcggcgcgatgtacgccgacgacaccgctggctgggacacgcgcataacactggaggacctcaagaacgaggagatggtgaccaaccacatggagggggagcataagaaactggccgaggccattttcaagctcacctaccaaaacaaggtggtccgggttcagcgccccacaccccgtggcaccgtgatggacatcatctcacgccgggaccagcgcgggagcggccaggtcggcacctacggactcaacacattcacgaacatggaggcgcagctgatccgccagatggaaggcgagggggtattcaagtccatccaacacctaaccgtgaccgaggagatcaccgtcaagaactggctcgcccgggtgggacgcgagcggttatcccgcatggccatcagcggcgacgactgcgtggtcaaacccttggacgaccggttcgccagcgcgctcacggcgctgaatgacatgggtaaggtgcgcaaggatatccaacagtgggaaccgagtaggggctggaacgactggacccaggtacccttttgctcacatcacttccacgagctgatcatgaaggacgggcgcgtcctcgttgtcccgtgccggaaccaggacgaactgatcggccgcgccagaatctcgcagggggccggctggagcttgcgcgagaccgcctgcctcgggaagtcctacgcccagatgtggagcctgatgtatttccaccggcgtgacctgcgcttagcagccaacgctatctgctcagccgtccccagccactgggtgccgaccagccgcacaacgtggtcaatccacgcccggcacgagtggatgaccacggaggacatgctaaccgtatggaaccgtgtctggatccaggagaacccctggatggaggataaaacacccgtggagtcctgggaggagatcccatacctggggaaacgggaggaccagtggtgtggcagcctcatcgggctgaccagccgcgcgacctgggctaagaacatacagacagccatcaatcaggtgcgctccctgatcggcaacgaggagtacacggattacatgccgagcatgaagcggttccgccgggaggaagaagaggccggggtcctctggtag

SEQ ID NO: 25583 - RNA, 9876 nt, synthetic construct
  misc_feature 1..9876: note = derived and/or modified CDS sequence (opt11) from DENV-2__EU056811__SS-prME
  source 1..9876: mol_type = other RNA
acagcgggcatgatcatcatgctgatccccacggtgatggctttccacttgacgacccgcaacggggagccccacatgatcgtcagccggcaggaaaagggcaagtcactgctttttaaaaccaaggacgggaccaacatgtgtactcttatggcgatggacctaggcgagctgtgtgaggacaccatcacatacaagtgccccttcttgaagcagaacgagcccgaggacatcgactgctggtgcaacagcaccagcacctgggtgacctatgggacttgcaccacgaccggcgagcatcgccgggagaagcgcagcgtggcactggtcccccacgtgggcatggggctggagacccggaccgagacgtggatgtccagcgagggcgcgtggaagcacgcccagcgcatcgagacctggatcctccggcatcccgggttcaccatcatggccgcgattctggcctacaccatcggcacgacccactttcagcgcgtgctgatcttcatccttctgaccgccatcgccccctccatgaccatgcggtgcatcgggatcagcaaccgtgacttcgtcgagggcgtgtccggcgggagctgggtggacattgtcctggagcatggctcctgcgtgacgactatggctaagaataagcctaccctcgacttcgagctaatcaagacagaggccaagcagcccgccacgctgcggaagtactgcattgaagccaagctcaccaacacaacaacggacagccgctgccctacccagggggaacccaccctgaacgaggagcaggacaagcggttcgtgtgcaagcactctatggtcgaccgcggctggggcaacggatgcggcctgtttggcaagggcgggatcgtgacctgcgccatgttcacgtgcaagaagaacatggagggcaagattgtgcagccggagaacttagagtacaccgtcgtgattactccccattctggcgaggagcacgcggtggggaacgacacaggtaaacacgggaaggaggtaaagatcacgccgcagtccagcatcacggaggccgagctgacgggctacgggaccgtcacgatggagtgtagcccccggacgggcctggacttcaatgagatggttctcctgcagatggaggacaaggcatggttggtccaccggcagtggttcctcgacctacccctgccctggctcccgggagccgacacccagggcagtaactggatccagaaggagaccctggtgaccttcaagaatccccacgccaagaagcaggacgtggtcgtgctgggctcccaagagggggcgatgcacacggcactcaccggcgccaccgagatccagatgagtagcgggaacttactgttcaccggccacctcaaatgccggctgcgcatggacaagctacagctcaaagggatgtcctacagcatgtgcacagggaagttcaagatcgtcaaggagatagccgagactcaacacggaacgatcgttatacgggtccaatacgagggtgacggctccccctgcaagatccccttcgagatcatggacctggagaagcgccacgttctcggccggctcatcaccgtgaacccgatcgtgacggagaaggatagccccgtcaacatcgaggccgagccgcccttcggggactcctacatcatcatcggcgtggagccggggcagctgaagctggactggttcaagaaaggtagctccatcgggcagatgttcgaaaccactatgcgcggcgcgaagcggatggccattctcggcgacaccgcctgggacttcgggagcctgggcggagtgttcacgtccatcgggaaggccctacaccaggtcttcggggcaatctacggcgcggctttcagcggggtgtcatggaccatgaagatcctcatcggggtgataatcacctggatcggcatgaacagccggtccacgagcctctccgtcagcctggtgctggtggggatcgtaacgttatatctgggcgtcatggtgcaggccgattctgggtgcgtcgtgagctggaagaacaaggagcttaagtgcggctccggaatctttgtcaccgacaatgtccacacctggaccgagcagtacaagtttcagcccgagagccccagcaagctcgcctccgcgatccagaaggcccacgaagaggggatctgcggcatccgcagtgtgacgcggctcgagaacctgatgtggaagcagatcacctccgagcttaaccacatcttaagcgagaacgaggtaaagctgactatcatgaccggagatatcaagggaatcatgcaggtagggaagcgctccctccgaccccaaccgacggagctgcgctacagctggaagacctggggcaaggccaagatgctgtccaccgagctccacaaccagacattcctgattgacggccccgagacggccgagtgccccaacaccaaccgggcttggaacagcctggaggtggaggactacggcttcggcgtgtttaccaccaacatctggctccgcctgcgagagaagcaggacgcgttctgcgactccaagctgatgagcgccgctatcaaggacaaccgcgccgtccacgccgacatggggtactggatcgagtctgcgctcaacgacacatggaaaatcgagaaggccagcttcatcgaggtgaaatcctgccattggcccaagagccacacgctgtggtccaacggcgttctggagagcgagatggtcatccccaagaatatcgccggccccgtgtcccagcataacaaccggccagggtaccacactcagaccgctggcccgtggcacctcgggaagctggaaatggacttcgacttctgcgagggcaccacggtggtggtgaccgaggagtgcgggaaccgcggccccagcctgcggaccacaacggccagcggcaagttgatcaccgagtggtgttgccgatcctgcaccctgccgccgctgaggtaccgcggggaggacggctgttggtacgggatggagatcagaccgctaaaggagaaggaggaaaatctcgtgagctccctagtcaccgcgggccacgggcagatcgacaacttcagcttgggcatcctgggcatggccttattcctcgaggagatgctgcgcacgcgggtgggtaccaagcacgccatactgctcgtggctgtctcctttctgactctgatcaccggcaacatgtcatttagggacctcggacgcgtgatggtgatggtcggcgcgacgatgaccgacgacatcgggatgggcgtgacctacctggccctgctggccgcctttaaggtgaggcccaccttcgccgcgggcctgctgctccgcaagctgacgtccaaggagctgatgatgaccacaatcgggatcgtcctcctgtcacagagctccatcccagagaccatcttggagctcacggacgccctggccctggggatgatggtactcaagatggtgcggaacatggagaaataccaactggccgtcaccatcatggcaatactgtgcgtgcccaacgcggtgatcctccagaacgcttggaaggttagttgcaccactcttgccgttgtctcagtgtccccgctgctcctgacgagcagtcagcagaaggcagactggatccccctggccttaacgatcaagggactgaaccccaccgcgatcttcctaactacgctcacccgcacctccaagaagcggtcctggccactgaatgaggcaatcatggccgtcggcatggttagcatactggcctccagcctcctgaagaacgacatcccgatgactggccccctggtggctggcgggctcctgacggtgtgctatgtcctgaccggacgcagcgccgacctcgagctggagcgggccactgacgtgaagtgggatgaccaggccgagatctcaggtagctcccccatcctgagcatcaccatctccgaagacgggagcatgtccatcaagaacgaggaggaggagcaaaccctcacaattctgatacgtaccggcctgctagtgatcagcggcctgttccccgtttccatcccgatcaccgccgcggcctggtacctgtgggaggtgaagaagcagcgggccggggtgctctgggacgtcccctccccgccgccggtgggccgcgccgagctagaggacggggcctaccggatcaagcagaagggcatcctggggtactcgcagatcggcgcaggcgtgtacaaggaggggaccttccacacgatgtggcacgtcacccgcggcgccgtgctcatgcataaggggaagcgaatagagcccagctgggccgacgtaaagaaggacttgatctcctacggcgggggctggaagctggagggcgagtggaaggagggggaggaggtccaggtgctcgccctggagcccggcaaaaacccccgcgccgtgcagaccaagccagggctgttccggacaaacacaggcaccatcggggccgtcagcttagacttctcccccggcaccagcggctctcccatcgtagacaagaaggggaaggtggtggggctgtacgggaacggcgtcgtgacccgcggcggcgcctacgtcagcgccatcgcccagacggagaagggcatcgaggacaacccggagatcgaggacgacatcttccggaagcggcggctgaccatcatggacctgcaccctggggccggcaagaccaagcgctacctccccgcgatcgtaagagaggccatcaaacgcgggctgcgcacccttattctcgcccccacgcgcgtggtcgccgcggagatggaggaggccctgcgcgggctgccgatacggtaccagacccccgccatccgcgcagagcacaccggccgggagatcgtggacctcatgtgccacgccaccttcacgatgcgcctgctgtcccccatccgggtgccgaactacaacctcatcatcatggacgaggcgcacttcaccgatcccgccagcatcgccgcccgcgggtacatcagcacccgggtcgagatgggcgaggccgcgggtatcttcatgaccgccacaccgcccgggagccgcgaccccttcccgcagagcaacgccccaataatggacgaggagcgggagatccccgagcgctcctggaacagcgggcacgagtgggttaccgacttcaagggcaaaacggtgtggttcgtaccctccatcaagactggcaacgacattgccgcctgcctgcggaagaacgggaagcgcgtaatccagctgagccggaagacgttcgactcggagtacgtgaagactcgcactaacgactgggacttcgtcgttaccacggatatcagcgagatgggcgcgaactttaaggccgagcgggtcatcgacccgcgccggtgtatgaagccagtgatcctcaccgacggggaggagcgcgttattctggccggccccatgcccgtgacccactccagcgccgcgcaacgccgcggtcgcatcggccggaacccgcgaaacgagaacgaccagtacatctacatgggcgagcccctggagaacgacgaagactgcgcccactggaaggaggcaaagatgctcctggacaacatcaacacccccgaagggatcatcccctcaatgttcgagccggagcgggagaaggtcgacgccatcgatggcgagtaccgcctccgcggggaggcacgcaaaacgttcgtggacttaatgcggagaggcgacctgcccgtgtggctggcttacaaggtggccgccgaggggataaattacgccgaccgccgctggtgcttcgacgggacccggaacaatcagatcctcgaggagaacgtggaggtggagatttggaccaaggagggcgagcgcaagaagctgaagccccggtggctagacgcccgcatctacagcgacccgctcgcgctgaaagagttcaaggagtttgccgccgggcggaagtccctgactctcaacctgatcacggagatggggcgcctgcccaccttcatgacccagaaggcccgagacgccctagacaacctggcggtcctgcacaccgcagaggccgggggcaaggcctacaaccacgcgctcagcgagctgcccgagaccctggagacgctcctgctgcttaccctcctggcgaccgtgaccggcgggatcttcctctttctgatgtcgggcagagggatcggcaagatgacgctggggatgtgctgcatcatcaccgccagcatccttctgtggtacgcccagatccagccccactggatcgcggcgtccataatccttgagttctttctcattgtcctgctgatcccggagcccgagaagcagcggacgccccaggacaaccagctaacctacgtgatcatcgcaattctgacggtggtcgccgcgaccatggccaacgagatgggctttttagagaagaccaagaaggacctcgggctggggcacatcgccacgcagcagccggagagcaacatcctggacatcgacctccgcccggcctccgcctggacgctgtacgccgtcgccaccacattcatcaccccaatgctgcgccacagcatcgagaacagctccgtgaatgtcagcctcacggcgattgccaaccaggccaccgtcctaatgggcctggggaagggatggccactctccaagatggacatcggggtacccctgctggccatcggctgctactcccaggtcaacccgatcaccctcaccgccgcgctgctgatgctcgtggctcactacgccattatcggccccgggctccaggccaaggcgacgcgggaggcccagaagcgcgctgccgcgggcatcatgaagaaccccaccgtggacgggatcaccgtaatcgatctggaccccatcccgtatgaccccaagttcgagaaacagctcggccaggtaatgctgctggtcctgtgcgtcacgcaggtgctgatgatgcgaacgacctgggctctgtgtgaggccctcacgttggccaccgggcccgtttccacgctgtgggagggcaaccccggccgcttctggaacaccacgatagccgtttccatggccaatatcttccgggggtcatacttagcgggcgccgggctgcttttctcaatcatgaagaacaccacgtccacccgccggggcaccggcaacatgggggaaaccctcggcgagaagtggaagaaccgcttaaatgccctgggtaagagcgagttccagatctacaagaagtccggcatccaggaggtggatcggacgctcgcaaaggaggggattaagcgcggcgagacggaccaccacgccgtgagccgggggtcggctaagctgcgctggttcgtcgagcggaacctggtgacgccggaggggaaggtggtagacctcggctgcgggcgcggtgggtggagctactactgcggcggcctgaagaacgtgcgagaggtgaaggggctgaccaagggtgggcccggacatgaggagcccatccccatgtccacctacgggtggaacctcgtccgcctgcagagcggcgtggacgtgttcttcgtcccgcccgaaaagtgcgacaccctgctctgcgacataggcgagtccagccccaaccccaccgtggaggccgggcgcacgctgcgggtgctgaacctcgtcgagaactggttaaacaacaacacccagttctgcgtgaaggtgctgaacccttacatgccctccgtcatagagcggatggagaccctgcagcgcaaatacggcggggccctcgtgcgcaatcccctgagccgaaacagcacacacgagatgtactgggtgtccaacgccagcggcaacatcgtatccagtgtgaacatgatatcccgcatgctgatcaaccggttcacgatgcgccacaagaaggccacctacgagccggacgtggacctggggtcgggaacgcggaacatcggcatcgagtcggagacccccaacctggacatcatcgggaagcgcatcgagaagattaagcaagaacacgagaccagctggcactacgaccaggaccacccatacaagacctgggcctatcacggctcctatgagaccaagcagactggctctgcgtccagcatggtcaacggcgtggtgcggcttctgaccaagccctgggacgtcatcccgatggtgactcaaatggccatgacggatactactcccttcgggcagcagcgcgtattcaaagagaaggtcgacacccgaacgcaggagcccaaggaggggacgaagaaactgatgaaaatcaccgccgagtggctgtggaaggagctcggcaagaagaagacgccccgcatgtgcacacgggaggagtttaccaagaaggtgagatccaacgcggcccttggcgccatcttcactgacgagaacaagtggaagtccgcccgggaggccgtggaggacaaccgcttctgggagctggtcgacaaggagaggaacctccacctggagggcaaatgcgagacctgcgtgtacaacatgatggggaagcgcgagaagaaactgggcgaattcggcaaggcaaaggggtcacgggccatctggtacatgtggctcggcgcccgcttcctggagttcgaggccctcggtttcctcaacgaggaccactggttcagccgggagaactccctcagcggggtcgagggcgagggtctgcacaagctcggctacatcctgagggaggtgtcaaagaaggagggcggggccatgtacgccgacgacacggccgggtgggacacccgtatcaccatcgaggacctgaagaacgaggaaatgataaccaaccacatggccggcgagcacaagaagctcgccgaggcgatcttcaagttgacgtatcagaacaaggtcgtacgcgtgcagaggccgacgccccggggaaccgtgatggacatcataagtcgccgggaccagcgcggcagcggccaggtcgtgacctacgggctcaacaccttcacaaatatggaggcccagttgatacgtcagatggagggcgagggggtgtttaagagtatccagcatctgaccgccagcgaagagatagccgtacaggactggctggtgcgcgtgggccgggagcgcttatcccggatggccataagcggcgacgactgcgtagtgaagcccttagacgatcgctttgcgaaggccctgaccgccctaaacgacatggggaaggtgcggaaagacatccagcagtgggagccctcccgtggctggaacgactggacccaggtccctttctgtagccaccacttccacgagctgatcatgaaggacgggcggacgctggtggtgccctgccgcaaccaggacgagcttattggacgggcccgtatctcgcagggggccggctggagcttacgggaaaccgcgtgcttgggaaagtcctacgcacagatgtggtctctcatgtacttccaccgccgggacctgagactggccgccaacgccatctgttcggcggtccccagccactgggtgcccacctcccgcaccacgtggagcatccacgcaagccacgagtggatgaccaccgaagatatgctcaccgtgtggaaccgggtttggattttggagaacccctggatggaagataagacgcctgtggagagctgggaagaaatcccctacttggggaagcgagaggaccagtggtgtggttccctcatcgggctgaccagccgagccacctgggccaaaaacatccagaccgcaatcaaccaggtgcgcagcctgataggcaacgaggagtacacggactatatgccctctatgaagcgcttccgccgggaggaggaggaagcgggggtcctttggtga

SEQ ID NO: 25584 - RNA, 9876 nt, synthetic construct
  misc_feature 1..9876: note = derived and/or modified CDS sequence (opt11) from DENV-2__DQ645545__SS-prME
  source 1..9876: mol_type = other RNA
accgcaggcgtgatcattatgatgatccccaccgtggtggcctttcacctgaccacccggaatggggaaccccatatgatcgtgtctcggcaggaaaagggcaagtcactgctattcaagaccgagaatggcgtaaatatgtgcacgctgatggccatggacctaggcgagctttgcgaggacaccatcacctataactgccccctgttacggcagaacgagcccgaggatattgattgttggtgcaacagtacctccacgtgggtgacctacgggacctgcaccgcgaccggcgagcatcggcgtgagaagagaagcgtggcgctggtgccccacgtggggatgggcctggagacccgtacggaaacctggatgagctcccagggcgcgtggaaacatgctcagcggatcgaaacttgggtgttacgccacccggggtttaccattatggcggcaatactggcctacaccatcggcacaacctacttccagcgggtcctgatcttcatcctattgaccgccgttgcgccttccatgaccatgcgttgcatcgggatatcgaaccgcgatttcgtggaaggggtatccggcgggagctgggtcgacatcgtgctggaacatggcagctgcgtcactacaatggccaagaacaagcctacgttggacttcgaactcatcaagaccgaggctaagcaccccgccaccctgcgaaagtactgtatcgaggccaagctcacaaacacaaccaccgcgagccgctgcccgacacagggggagccctctttaaacgaggagcaggataaacgcttcgtttgtaagcatagcatggttgaccggggttggggcaacggttgcgggcttttcgggaaaggagggatcgttacctgcgcgatgttcacatgcaagaaaaacatggagggcaaggtagtgcagcccgagaatcttgaatacacgatagtcatcactcctcattccggcgaagagaacgcagtcgggaacgacacgggcaagcacggtaaggagatcaaggtgacgccgcagtcttccatcaccgaggccgagctgaccggctatgggaccgtaactatggagtgtagcccccgcacaggcctggatttcaatgaaatggtgctcttgcagatggaagacaaggcttggctggtacaccggcagtggtttttggacctgcccctgccctggctccccggcgcggacactcaggggagtaactggatccagaaggagactctggtgacgtttaagaatccccacgcgaagaagcaagacgtggtcgtgctcggcagccaggagggggccatgcataccgctcttaccggagcgacagagatacagatgagctctggaaacctcttatttacgggccatctcaaatgtcgcctgaggatggacaaactgcaattaaagggtatgtcctactcgatgtgcaccgggaagttcaaagtagtgaaggagatcgccgaaacccaacatggcactatcgtgatcagagtgcagtacgagggcgacggctcgccctgcaagattcctttcgaaatcatggacctggaaaagcgccacgttcttggccgcctcatcacggtgaacccaatcgtcacgggcaaagactcccccgtaaacattgaggccgagccccctttcggcgacagctacattatcatcggagtggaaccggggcagcttaagctgtcctggttcaagaagggaagtagtatagggcagatgttcgagaccaccatgcgcggagccaagcgaatggcgattctcggagacacagcctgggacttcgggagcctagggggcgtcttcactagcatcgggaaagcgctgcaccaggtcttcggcgctatttacggtgcggccttcagcggtgtttcatggaccatgaagattctcatcggcgtggtcattacctggattggaatgaactcacggagtacgtctctcagcgtaagcctggtgctggtcggagtggtgacactctacctgggtgtgatggtgcaggccgacagtgggtgtgtagttagctggaaaaataaggagctaaaatgtggcagcgggatctttataactgacaacgtgcacacctggacggagcagtacaagtttcagcccgagtcccccagtaagctcgcctccgccatccagaaggcccatgaggaggggatctgtggaatacggtcagtcacccgccttgagaacctgatgtggaaacagattacgcctgagttgaaccacatcctgtccgaaaacgaggtcaagctgaccataatgacaggcgacatcaagggaatcatgcaagcaggaaagcgctccctcaggccgcaacccaccgaactgaaatactcctggaaggcatggggcaaggcgaagatgctgtccacggagctccataaccatacattcctaatcgacgggccagaaaccgcggagtgcccaaataccaaccgggcatggaacagtttagaggtcgaggattatgggttcggggtgttcacaaccaacatctggcttaagttaaaggagcgccaggacgtattctgcgactcgaagctaatgtccgcagcaattaaggataaccgcgcagtccatgccgacatgggctactggatcgaatcggccctcaacgatacgtggaagatcgagaaagcatccttcattgaggtcaagagctgtcactggcctaagagtcacaccctttggagtaacggtgttttggagtccgagatgatcataccaaagaacttcgcggggcccgtttcccaacacaactatcgaccaggataccacacccagaccgcagggccatggcacttaggcaagctggaaatggatttcgacttctgcgaggggacgacagttgtcgtgacggaggactgcggtaaccgaggtcccagcctgcgaactaccactgccagcgggaagttgatcacggagtggtgctgtcggagctgtaccctgccacccctgcgttaccgcggcgaggatgggtgttggtacggcatggagatccgccccctgaaggagaaagaggaaaatctggttaactctcttgtgacggcagggcacggccaaatagacaatttcagcctcggggtgcttgggatggcgctgttccttgaagagatgttgagaacacgcgtgggtacgaagcatgctatactgttagtcgccgtgtccttcgttacgctgataacgggtaacatgagcttccgagacttgggccgcgtcatggtcatggtaggcgctacgatgaccgatgacatcggaatgggcgtaacttacctcgccctgctggcggcgtttaaggtccggccaacattcgccgccgggctcctgttacggaagctcacgtccaaggagctcatgatgaccaccatcgggattgtccttctcagccagtctaccataccggagaccatcctggagctgacggacgccctcgccctgggaatgatggtactgaagatagtacgcaacatggagaagtatcaactcgcagttactatcatggccatcctgtgcgtgccaaacgccgtcatcctgcaaaacgcgtggaaggtttcttgcaccatcctcgcggtcgtatcagtaagccccctactactcacgtcctcccagcagaaagccgactggatccctttagccttaaccatcaagggtctcaatcctactgctatcttcctgacgaccctgtcccggacctcaaagaaaaggtcttggcccttgaacgaagctatcatggcggtgggcatggtgagcatccttgcctccagcctgctcaagaatgatatcccgatgactggaccgttggtcgccggtggtctactcacagtgtgctacgtgctgacggggcggtcggctgacctggagctcgaacgagcggccgacgttcggtgggaggagcaggctgagatctcgggaagctcccctatcttaagtatcaccattagcgaagacggcagcatgtcaatcaagaacgaggaggaggagcagacccttaccatcctcatcagaacgggcctgctggtcataagcgggctgtttccggtttcgatccccatcaccgccgccgcttggtatctttgggaggtgaagaagcagcgggcgggcgtactgtgggacgtgcccagcccgccacccgtgggaaaggccgaactcgaggacggcgcgtaccgcattaagcagaaggggatcctgggatactcgcagatcggcgccggcgtgtacaaggagggcaccttccacaccatgtggcatgtgacccgaggagcagtcctgatgcacaagggtaagcgcatagagcccagctgggcggacgtaaagaaagacctaatctcctacggcggcggctggaagctggagggggagtggaaggagggagaagaggtgcaagtcctggccctcgagcccggtaagaacccccgggcagtgcagacgaagcccggactgttcaaaactaacaccggtaccatcggcgctgttagcctggacttctcgccaggcacatcagggtcccccatcgtggacaagaaggggaaggtggtgggtctttacggcaacggcgtcgtaacccgatctgggacctacgtctccgccatcgcccagacagaaaagagtatcgaggacaaccccgagatagaagacgacatattccggaagaaacgactcacgatcatggatctgcatcctggcgctgggaagacaaagcggtatctgccagcaatcgtccgcgaggctatcaagcggggtttgcgtaccctgatccttgccccgacccgcgtggtggctgcagagatggaagaggcgttacgcgggttacccattcgctatcagacccccgcaatccgagctgagcatacaggcagagaaatcgtagacctgatgtgccatgccacgtttaccatgagactcctgagccccatccgcgtgccgaattacaacctgatcattatggacgaggcccacttcactgaccccgcttccatcgcggctcggggctacatctctacccgcgtggaaatgggggaggccgccggcatctttatgaccgccacgccccctggatctcgagatccgttcccccagtccaacgcaccgattatggacgaggagcgcgagatccccgagcggagctggaatagcggccacgaatgggtcactgacttcaagggcaaaacggtatggttcgtcccatccataaaggccggtaacgacatcgcggcgtgtctccgcaagaacggcaagaaggtaatccagctgagccggaagaccttcgattctgagtacgtgaaaactcgcacgaacgactgggatttcgtggtcaccaccgacataagtgagatgggggcgaacttcaaagccgagcgagtcatcgaccctcgtcgttgcatgaagccggtgatcctgaccgacggtgaagaacgtgttatcctcgcgggtcccatgcccgtgacgcacagcagtgctgcccaacggaggggccgggtcggtcgcaatccgaaaaatgaaaacgatcaatatatctacatgggtgagccgctcgagaacgacgaagactgcgcacattggaaagaggcaaaaatgctgctagataacattaatacaccggaaggcatcatcccctcgatgttcgaaccagagagggaaaaggttgacgccattgacggggagtaccggctacgaggcgaagcacgaaagacttttgtcgacctgatgcgcagaggggatctccccgtctggctggcttaccgcgtggcagcggagggaatcaattacgccgaccgccgctggtgcttcgacggtgtcaaaaacaaccagatcctggaggagaacgtcgaggttgagatatggaccaaggagggcgaacgtaaaaagttgaagccgcgctggctggacgccaggatatactcggaccccctggctctcaaggagttcaaggagtttgcggccggccgcaaatctttaaccctgaacttgattacagaaatgggcagactgcccacctttatgactcagaaggcacgcaacgccctggacaacttagccgtactccacacggccgaggccggcggacgcgcctataaccacgcgctgagtgagctcccagagacccttgagaccctactgttgctgaccctgctggcgacggtgaccggcggcatctttctgttcctcatgtccggaaaaggcatcgggaagatgactttagggatgtgctgcatcatcaccgccagcgtgctgctctggtacgcccaaatacaaccgcactggatcgccgcctcaatcattctggagtttttccttatcgtacttttaattcccgaacctgagaagcaaaggacgccccaggataaccaactgacgtatgtcgtgatcgcgatcctaacggtagtggccgccaccatggcgaacgagatggggttcctggagaagacgaagaaggacttcggtcttggagggatcgccacgcaacaaccggaaagtaatatcttggacatcgatctccggcccgcctctgcctggaccctgtacgcggtggccaccaccttcatcacgcccatgctccgacactccatcgagaacagctccgtgaacgtcagcctcacagcgatagcaaaccaagccacggtgctaatgggcctcggcaagggctggcccctgtcaaagatggacataggagttccgctgctggccatcggatgttacagccaagtcaaccccatcacactgacagcagcgctgttgctgctagtggcccactatgccattatcggccccgggctccaagccaaggctacccgggaggcgcagaagcgcgccgccgccggcattatgaaaaatcccaccgtagacggtatcacagtaattgacttggaccctattccctacgaccccaagttcgagaagcaacttggacaggttatgctcttagtgctctgcgtcacgcaggtcctcatgatgcggacaacctgggccctctgtgaggccctgacactagcaacggggcctatcagcaccctgtgggagggcaatccgggcagattctggaacaccacaatcgctgtctcgatggcaaacatcttccgtgggtcgtatttggccggtgcggggttgctgtttagcatcatgaagaacacggccaacacccgacgcggcaccggcaatacgggagagactctgggagagaagtggaagaaccgtctgaacgcgttggggaagtcggagtttcagatatacaagaaatccggcatccaggaagtcgatagaacccttgcaaaagagggcataaagagaggcgaaacagaccatcacgcggtctcgcgcggctctgccaagctccgatggttcgtggagaggaacctagtcacccctgaaggaaaggtgatggacctgggttgcgggcggggaggctggagctactattgcggcggtctcaagaacgtgaaagaggtaaagggcctgaccaaaggagggccagggcacgaggagcccataccgatgtcgacctacgggtggaacctggtgcgacttcagtccggcgtggacgtatttttcaccccgcccgagaagtgcgacacgcttctttgcgacatcggagagagctcccccaaccccacagtggaagccgggcgaacgctccgcgtgctgaatctggtagaaaactggcttaacaataatacccaattctgcataaaggtcctcaacccatacatgccaagcgtgatagaaaagatggaggcgctgcagagaaagtacggcggcgcattagtaaggaatccactcagcaggaactccacccacgagatgtattgggtgagcaacgcatctggcaacatagtgagctctgtaaatatgatctcccggatgctcataaaccggttcaccatgcgccacaagaaggcaacttacgagcctgacgtggatctggggtcgggcacccgcaacataggcatcgaatcagaaacaccaaatctcgacatcatcggtaagcgtatcgagaagatcaaacaggagcacgagacatcatggcactacgaccaggaccatccgtacaaaacttgggcctaccatggtagctatgagaccaagcagactgggtccgccagctccatggtcaacggcgtggtgagactcctgaccaagccgtgggatgtcatccccatggtaacccagatggccatgaccgataccacccctttcggccagcagcgggtgttcaaagagaaagtggacacgcgcacccaagagcccaaggagggaacaaagaagctaatgaagatcaccgccgaatggctgtggaaagaactgggcaaaaagaaaacgccgcgtatgtgtacccgcgaggagttcacccgtaaggttcgttctaacgcagcattgggggccatcttcaccgacgaaaacaagtggaaaagcgcccgggaagcggtggaggacagcggattctgggagttagtcgataaagagcgtaacttgcacctggaggggaagtgtgagacttgtgtatacaacatgatgggcaagcgggagaagaagctgggcgagtttgggaaggccaaaggctcccgcgccatctggtatatgtggcttggggcacgtttcctcgaatttgaggcactgggcttcctgaacgaggatcattggtttagccgcgagaactctctcagtggggttgagggcgaaggactgcacaaattaggctacatactgagagacgtcagcaagaaagagggaggggccatgtacgcagacgataccgcgggctgggacacccggataaccctggaggacctgaagaacgaggaaatggtgacgaaccacatggagggggaacacaagaaactcgccgaggcgattttcaaacttacctatcaaaacaaggttgttcgggtgcaaagacctacgccccggggaaccgtgatggatatcatctcccgtcgcgaccagcgcggctccgggcaggtcgtcacgtatggcctgaacacatttaccaacatggaagcccaactcatccggcagatggagggggagggcgtgtttaagtccatccagcaactaactgccacggaagagattgccgtcaagaattggctggcacgcgtaggccgtgagcgtctctctcgcatggcgatttcaggagacgactgcgtggttaagcctctggatgaccggttcgcgagcgcccttaccgccctcaacgacatggggaaagtgaggaaggacatccagcagtgggagccatcccgggggtggaacgactggacccaggtgcccttctgttcacaccacttccacgagctgatcatgaaggacgggagagtgctggtggtaccatgccgtaaccaggacgagcttatcgggcgggcccgtatcagccagggggccggctggagcctgcgcgagaccgcctgcctaggcaagtcctatgcccagatgtggtcgctcatgtacttccaccggcgcgatttacgcttggccgccaacgcaatctgctccgccgtgccctcccactgggtcccgacatcccgcaccacctggagcatccacgcaacccacgaatggatgacgaccgaggacatgctcaccgtttggaacagggtttggatacaagagaatccctggatcgaggacaaaacccccgtggaatcctgggaggagatcccctacttgggcaagcgcgaggaccaatggtgcggaagtctgatcgggttgacctcgagagctacgtgggcgaagaacatccagacagccatcaaccaagtgcgctccctgataggaaatgaagagtacaccgactatatgccgtccatgaagcgattccgtcgcgaggaggaggaggccggcgtcctgtggtga

SEQ ID NO: 25585 - RNA, 9876 nt, synthetic construct
  misc_feature 1..9876: note = derived and/or modified CDS sequence (opt11) from DENV-2__DQ645546__SS-prME
  source 1..9876: mol_type = other RNA
accgctggcgtgatcatcatgatgatccccacagtcgtggcattccacctgacaacccggaacggggagccccacatgatcgtgagccgacaggagaagggtaagagcctcctattcaaaactgagaacggggtcaacatgtgtaccctgatggcgatggacctcggcgaactttgcgaggacacaatcacctataactgccccctgctacggcaaaatgagcccgaggatattgactgctggtgcaactcgacgtccacctgggtcacctacggtacctgcaccgccacgggcgagcaccggcgcgaaaagcggagcgtggccctggttcctcacgtgggcatgggtctggaaactcggaccgagacctggatgtccagcgagggcgcctggaagcacgcccagcgaattgagacatgggtgctccgccacccggggttcacaatcatggccgccatcctggcctacacgatcggcacgacctacttccagagggtcctgatattcatcctcctaacggccgtcgcccccagcatgaccatgcgatgcatcggaatcagcaaccgggacttcgtggagggtgtctccggcgggagctgggtggacatcgtgctggagcatggctcttgcgtcaccaccatggccaagaacaagcccacgctcgacttcgagctgatcaagaccgaggctaagcatcccgccacactccgcaaatactgtatcgaggcgaagctcacaaacacgaccaccgcgagccggtgcccgacccagggggagccctccctgaacgaggagcaggataagcgcttcgtgtgtaagcactcgatggtggaccgaggctggggtaacgggtgcggcctgtttgggaaaggcggtattgtcacgtgcgctatgttcacttgcaagaaaaacatggagggcaaggtggtgcagcccgaaaacctagagtacacaatcgtaatcacgccccattccggcgaggagaatgccgttggcaacgacacaggcaagcatggaaaggagattaaggttaccccacaatcgtccatcaccgaggctgagttgacaggctacgggacggtcacaatggagtgcagcccccgcaccggcctggactttaacgaaatggtgctcttacagatggaggacaaggcctggctggtgcaccgccagtggttcctcgacctgcccctgccctggcttccgggcgcggacacccaaggatcgaactggatccagaaggagaccctagtgacgttcaagaacccgcacgcaaagaagcaggacgtggtcgtgctgggcagccaggagggggccatgcacaccgcactcactggcgccaccgagatacagatgagctccgggaatctactattcacgggccatctcaagtgccgcctgcggatggataaactgcagctcaagggcatgagctactcgatgtgcaccgggaaattcaaggtggttaaggagatcgcggagactcagcatggcaccatcgtcatccgcgtgcaatacgaaggggacgggtctccctgcaagatccccttcgagatcatggacctggagaagaggcacgtccttggccgcctcatcactgtgaaccccatcgtcaccgagaaggactcccccgtcaacatcgaggccgagccacccttcggggacagctacatcataatcggcgtggagccggggcagctgaagctgtcctggtttaagaagggctcgtccatcggtcagatgttcgagacaacaatgcggggagccaaacgaatggccatcctcggcgatactgcctgggactttgggagcctgggcggggtgttcacctccataggcaaagcgttgcaccaggtgttcggggcaatttacggcgccgccttcagcggcgtgtcctggacgatgaaaatcctcatcggggtggtcatcacctggattggcatgaactcacgctctacgagcctgtccgttagtctggtgctggttggggttgtgaccctctacctgggcgtcatggtgcaggcggactccggctgcgtggtcagctggaagaacaaggagctgaagtgcgggagcggcatcttcatcacagacaacgtacacacgtggaccgaacagtacaagttccagcccgaatcccccagcaagttagcctccgcgatccagaaggcgcacgaggaggggatctgcggcatccgaagcgtgacccgcctggagaatttgatgtggaagcagatcacccccgagctcaaccacatcctgtccgaaaacgaagtcaagctgaccattatgacgggtgacatcaagggcatcatgcaggccggaaagaggagcctccgtccgcagcccaccgagctgaagtactcctggaaggcgtggggcaaggccaaaatgctctcgaccgaactccacaaccacacctttctaatcgacggccccgagacggccgaatgcccgaacaccaaccgggcctggaattccctggaggttgaggactacggcttcggcgtgttcaccaccaacatttggctcaaactgaaggaacgccaagacgtcttctgcgacagcaagctgatgagcgctgcgatcaaggacaaccgggccgtgcacgctgacatggggtactggatcgagagcgccctaaatgacacgtggaaaattgagaaggcctccttcatcgaggtcaaaagctgccactggcccaagtcccacaccctgtggagcaacggcgtgctagagagcgagatgatcatccctaagaacttcgcgggccccgtgagccagcacaattaccgcccgggataccacacccagaccgccggaccctggcacctcggcaagctggagatggacttcgacttctgtgagggcacaacggtggtcgtgaccgaggactgtgggaacaggggccccagcctgcgcaccaccacagccagcggcaagctcattaccgaatggtgctgccgtagctgcaccctgcccccgctgcgctaccgcggggaagacggctgttggtacgggatggagatccgcccccttaaggagaaggaagagaacctggtgaactccctggttaccgccggccacgggcagatagacaacttcagcctcggcgtgctggggatggcgctgttcctcgaggagatgctgcggacgcgcgtgggcaccaagcacgccatcctgctcgtcgctgtgtccttcgtgaccctgatcacgggcaacatgagcttccgggatcttgggcgcgtcatggtgatggtgggcgccacgatgaccgacgacatcgggatgggcgtcacctacctcgccctgctggcggcgtttaaggtccggcccacattcgccgccggcctcttgctgcggaagctcacgtccaaggagctgatgatgaccaccatcgggatcgtcttactcagccagtccacgatccccgagacgatcctggagctgaccgacgccctcgcgctgggcatgatggtgctgaagatcgtgcgcaacatggagaaataccagttagctgtcaccatcatggccatcctgtgcgtgcccaacgccgtgatactgcaaaatgcctggaaggtcagctgcaccatcctcgcggtggtctccgttagccccctgctgctcacaagcagccagcagaaggcggactggatcccactggcgctgacgatcaaggggctcaaccccactgctatcttcctgaccacgctgtcacgcacctccaagaagcgctcttggcccctcaacgaggcaatcatggctgtgggaatggtgagcatcctggcttccagccttcttaagaacgacatccccatgaccggccccctggtcgctgggggcctgctcactgtgtgctacgtgctgacggggcggagcgccgacctggagctcgaacgcgcggccgacgtccggtgggaggagcaggccgagatctcaggcagctcccccatcctgagcatcaccatcagtgaggacgggagcatgtccatcaagaacgaggaggaggagcagaccctgacaatcctcatccgcacgggcctgctggtcatcagcggcctctttccggtgtcaatccccatcaccgccgccgcgtggtatctgtgggaggtcaagaagcagcgggccggggtgctgtgggatgtgcccagcccgccgcccgtcggcaaggccgagctcgaagacggggcctaccggatcaagcagaagggaatcctggggtactcccagatcggcgccggcgtgtacaaggaggggaccttccacactatgtggcacgtgacacggggcgcggtcctgatgcacaaggggaaacgcatcgagccctcctgggccgacgtgaagaaggacctcatctcctacggagggggctggaagctggaaggcgagtggaaggaaggggaggaggtgcaggttctggctttagagcctggtaagaacccccgggccgtgcagacgaaaccagggctgttcaagaccaacacaggcactatcggagcagtgagcctggacttttctcccggcacgagcggttccccgatcgttgacaagaaggggaaagtggtgggcctctacgggaacggcgtcgttacccgtagtggcacctacgtgtccgccatagcccagaccgagaaatcgatcgaagataacccggagatcgaggacgacatcttccgcaagaaacgcttgactatcatggacctgcacccaggagccggcaagaccaagcggtacctgccagccatcgtccgcgaggcgatcaagcgggggctccgcaccctgatcctggccccgacacgggttgtggcagcagagatggaggaggctctccgcggcctgcccatccgataccagacgcccgcgatccgggccgagcacaccgggcgcgaaatcgtcgaccttatgtgccacgctaccttcaccatgcggctactatcccccattcgcgtcccgaactacaatctcatcatcatggacgaggcacacttcacggaccccgcctccatagcggcccggggctatatatccacccgcgtcgagatgggcgaagcggccgggatcttcatgaccgccacgccgccaggtagtcgggatcccttccctcagagtaacgccccgatcatggatgaggagcgcgagatccccgagcgctcctggaacagcggacacgagtgggtcactgacttcaagggcaaaacagtatggttcgtaccgtcgataaaggccggcaacgacattgccgcctgcctccgcaagaacggcaagaaggtcatccagctgagcaggaagaccttcgactccgagtacgtgaagacccgtacgaacgactgggacttcgtggtaaccaccgacatcagcgaaatgggagcgaacttcaaggccgagagagtgatcgacccacgccggtgcatgaagcccgtgatcctgacggacggggaggagcgcgtcatcctcgccggccctatgccggtgacgcactccagcgccgcccagcggcgggggcgggtcgggcggaaccccaagaacgagaacgaccagtacatctacatgggggagcccctggagaacgacgaggactgcgcgcactggaaggaagctaagatgctgctcgataacatcaacacacccgagggcatcattccgtccatgttcgagccagagcgcgagaaggtggacgcgatcgacggcgagtaccggctgcgcggggaggcccggaaaaccttcgtggacctgatgcgccggggcgacctcccggtctggctggcctatcgcgtggcggccgaggggatcaactacgccgaccggcgatggtgcttcgacggagtgaagaacaaccagatactggaggagaacgtggaggttgaaatctggaccaaggagggcgagcggaagaaactcaagccgcgttggctcgacgcaaggatctacagcgaccccttagccctgaaggagttcaaggagttcgcggccggacgcaagtccctgactcttaacctaattacagagatggggcgtctgcccacctttatgacccaaaaggcccgcaacgccctggacaacctagcggtcttacacacagccgaggccggcggccgcgcctacaaccacgccctgtccgaactccccgagacccttgaaaccttgttgttattaaccttactggcgacggtcaccgggggaatattcctgttcctcatgtccggcaaggggatcggcaagatgaccctggggatgtgctgcatcatcaccgcaagcgtgctcttgtggtacgcccaaatccagccgcattggatagccgcttccatcatactggagttcttcctgatagtgcttctgataccagagcccgagaagcagcgcacgccccaggataaccagctgacgtacgtcgtgatcgcaatcctcaccgtagtagccgccaccatggccaacgagatgggcttcctggagaaaaccaagaaggacttcgggctgggcggcatcgccacgcagcaaccggagagcaacatcctcgacatcgatttgcggcccgcgagcgcctggaccctttacgccgtagcgaccaccttcatcacgccgatgctccgccacagtatagagaactcttcggttaacgtaagcctgacggccatcgcgaaccaggcgactgtgctgatggggctcggcaaggggtggcccctgtccaagatggacattggggtgccgctactcgccattgggtgctatagccaggtcaaccccatcaccctgacggccgcgctgctccttctggtggcacactacgccatcatcggccccggcctccaggccaaggccacccgggaggcgcagaagcgcgccgccgcagggatcatgaagaaccccacagtggacggcatcaccgtcatagacctggacccgatcccctatgacccaaagttcgagaagcagctgggccaggtgatgctcctggtcctgtgcgtcacacaggtgctcatgatgcggaccacctgggccttatgcgaggcgctgaccctcgccacgggccccatctccaccctttgggaggggaacccaggccgcttctggaataccaccatcgccgtgagcatggcaaatatctttcgcggctcctacctagccggggcaggcctcctgttcagcataatgaagaacacggccaacacccgccgcgggaccggcaacacaggcgagacgctgggcgagaaatggaaaaaccggctaaacgccctgggcaaatcagagttccagatctacaagaagtccgggatccaggaggtcgaccgcaccctagccaaggaaggtatcaagcgcggggagaccgatcaccacgctgtgtcccgcggctcagccaaactccggtggttcgtggagcgcaacctggtcacaccagaagggaaggtgatggacctgggatgcggacgcgggggctggtcctactactgcggcgggctcaagaacgtgaaggaggtcaaggggctgacgaagggggggccgggtcacgaggaacccatcccgatgagcacctacggttggaacctggtgcgcctccagtccggggtggacgtctttttcacgccgcccgagaagtgcgacaccctgctgtgcgacataggcgagagctcccccaacccgacggtggaggcgggccggaccctccgcgtgctgaacctggtcgagaattggctcaacaacaacacacagttctgcatcaaagtactgaacccatatatgccctctgtgatcgagaagatggaagccctgcagcggaagtatgggggcgccctggtccgcaacccgcttagccggaattccacccacgagatgtactgggtgtctaacgcctcaggcaatatcgtgagctccgtcaacatgatcagccgcatgctaattaaccgttttacaatgcgccacaaaaaggccacgtatgaacccgacgtggacctcggctcagggacccgaaacatcggcatcgagtctgagacccccaacctcgacattatcggcaaacgtatcgagaagatcaagcaggagcacgagaccagctggcactacgaccaggaccacccttacaagacgtgggcatatcacgggagctacgagaccaaacaaaccgggtccgccagctccatggtgaacggggtcgtgcgcctactgaccaagccgtgggacgtcatccccatggtgacgcaaatggccatgaccgacaccaccccgtttggccagcagcgggtcttcaaggagaaggtcgatacacgtacgcaggagcccaaagagggcaccaagaagctcatgaagataaccgcggagtggctgtggaaagagctgggaaagaagaagacgccacgcatgtgcacccgcgaggagttcactcgaaaggtccgcagcaacgcggccctcggcgccatcttcaccgacgagaataagtggaagtccgcccgggaggctgtggaggacagtggcttctgggagctggtcgataaggagagaaacctgcacctagagggcaagtgcgagacgtgcgtgtacaacatgatggggaagcgggagaagaagctgggtgagttcggcaaagccaaggggtcacgcgccatctggtacatgtggctgggcgcccggttcctcgagttcgaggcgctggggttcttgaacgaggaccactggttctctcgcgagaactcccttagcggagtggagggggagggccttcataagctgggatacatcctccgggacgtcagcaagaaagaaggcggggccatgtacgccgatgacaccgccgggtgggacacccgcataactctggaggacctcaagaacgaggagatggtgacgaatcacatggagggcgagcacaagaagctcgctgaggcgatcttcaagcttacctatcagaacaaggtggttcgcgtgcagcgcccgacgccacgggggaccgtgatggacataatctcccgccgggaccagaggggcagcggccaggtcgtgacgtacgggctaaacacgttcacgaacatggaggcgcagctcatccggcagatggagggcgagggcgtgttcaagtccatccagcagctgaccgctacggaggagatcgccgtcaagaactggctagcccgcgtaggacgcgagcggctcagccgcatggcgatctccggcgacgactgcgtggtcaagcctctagatgaccgctttgctagcgcgttaaccgccttaaacgacatggggaaggtgcgcaaggacatccaacagtgggagccttcccgggggtggaacgattggacccaggtgccgttttgcagtcaccacttccacgagctcatcatgaaggacgggcgcgtcctggtggtaccctgtaggaatcaggacgaactcatagggcgcgcccggatctcgcagggggcgggatggtccttgcgcgagaccgcctgcctgggtaagtcctatgcccagatgtggagcctcatgtacttccaccggcgcgacctgcggttagccgccaacgcgatctgcagcgcagtcccctcccactgggtgcctacgtccaggaccacatggagcatccacgccacccatgagtggatgaccacggaggacatgcttaccgtgtggaaccgggtctggatccaggagaacccctggatcgaggacaagacgcccgtggagagctgggaggagatcccttacctggggaaacgcgaggatcagtggtgcggcagcctgatcggtctcaccagccgggccacgtgggcgaagaacatccaaaccgccattaaccaggtgcgctccctgatcggcaatgaggagtacaccgactatatgccgagcatgaagcggttccgccgcgaggaggaggaggccggggtcctgtggtga

SEQ ID NO: 25586 - RNA, 9876 nt, synthetic construct
  misc_feature 1..9876: note = derived and/or modified CDS sequence (opt11) from DENV-2__DQ645547__SS-prME
  source 1..9876: mol_type = other RNA
actgccggcgtgatcataatgatgattccgaccgtcgtggccttccacctgacaacgcggaacggggagcctcatatgatcgtgagccgccaagagaagggcaaatcgcttttatttaagaccgagaacggggtcaacatgtgcaccctaatggcgatggacctcggcgagctgtgcgaggataccatcacctacaactgtcccctgctcagacagaacgaacccgaggacatcgactgctggtgcaatagcaccagcacttgggtgacctacggaacctgtaccgccacaggcgaacaccgtcgcgagaagcggtcggtggccctggtaccgcatgtaggtatggggcttgagacccggaccgagacctggatgtccagcgagggtgcttggaagcacgcccagcggatcgagacttgggtgctacgccaccccgggttcactatcatggcggccatcctggcctacaccatcggcaccacatacttccagagagtcctcatcttcatactccttacggctgtggcgccctccatgaccatgcggtgcataggcatctcgaaccgggacttcgtggagggcgtgtcgggcgggagctgggtggacatcgttctggagcacgggtcctgcgtcaccaccatggccaagaacaaaccgacgttagattttgaactaattaagaccgaggcaaagcaccccgcgaccctgcgcaaatactgcatcgaggccaagctcaccaacacgaccaccgcgagccgttgcccgacccagggggagccctccctgaacgaggagcaggacaagcggttcgtctgcaagcactcgatggtggatcgggggtgggggaacgggtgcgggctgttcgggaagggaggaatcgtcacgtgcgccatgttcacgtgcaagaagaacatggagggcaaggtggtgcaacccgagaatcttgagtacaccatcgtcatcacgccacactccggtgaggagaatgccgttgggaacgacacgggcaaacacggaaaagagatcaaggtgacgccgcagagctctattacggaggccgagctgacaggctacgggaccgtcacgatggagtgcagcccaaggaccggcctcgacttcaacgaaatggtgctcttgcagatggaggataaggcctggcttgtccaccggcagtggtttctcgacctgcccctgccatggctcccgggcgctgacacccaggggtccaactggatccagaaggagaccctggtgacgttcaaaaacccccacgccaagaagcaggacgtggtcgtgctgggcagccaggagggggctatgcacaccgccctcacaggcgccaccgagatccagatgagctccggaaacctgctgttcacgggccacctaaagtgtcgcctgcggatggacaagctgcaactcaagggaatgagctactccatgtgtactgggaagttcaaggtggtcaaggagatcgcggagacccagcacgggaccatcgtgatccgcgtgcagtatgagggggacggaagcccctgcaagatccccttcgagatcatggacctggagaagcggcacgtcctgggtcgccttatcacggtgaacccgatcgtgaccgaaaaggattcgcccgtgaacatcgaagccgagccccccttcggagacagctacatcataatcggcgttgagccgggccagttaaagctgagttggtttaagaagggaagttcaataggacagatgttcgaaactactatgagaggcgccaagcggatggctatcctcggagacactgcgtgggatttcgggagcctgggaggggtgttcacctcgatcggtaaggctctccaccaggtcttcggggcaatatacggcgcagcgttctcaggagtgtcctggaccatgaagatcctcataggggtggtcatcacctggatcggcatgaactctcgctctacgagcctgtctgtgtctttggtgttggtcggagtggtgaccctctatctgggcgtcatggtgcaagcggactcgggctgcgtggtcagctggaagaacaaggagttgaaatgcgggagcggcatctttatcaccgataacgtccacacatggacggagcagtacaaatttcagcctgagagccccagtaagttagcaagtgccatccaaaaagcccacgaagaggggatctgcggcatccggagcgtgacccgcctggagaacctgatgtggaagcagatcacccctgaactaaaccatatcctatccgagaacgaggtcaagctgactatcatgacgggggacataaagggtatcatgcaggcagggaagcggtcgctccgcccacagccaaccgagctgaagtactcgtggaaggcatggggtaaggccaaaatgctgagcaccgagttacacaatcacaccttcctgatcgacggtcccgagacggctgagtgtccgaataccaatcgggcgtggaactccctggaggttgaggactacgggtttggtgtgttcaccacaaacatctggctcaaactgaaggagcgacaggatgtcttctgtgattcaaaactgatgtccgcggccataaaggataacagggcagtgcacgccgacatggggtactggatcgagtcagcactcaatgacacgtggaaaatcgagaaggcctccttcattgaggttaaaagttgccattggcccaagtcacacaccctgtggtctaacggcgtgctggagtccgaaatgatcatccccaagaatttcgcaggccccgtgagccaacacaactaccgcccggggtaccacactcagaccgcaggcccctggcacctcgggaaactcgagatggacttcgatttctgcgagggaaccacggtagttgttaccgaggattgcgggaaccggggcccgagcctgcgtaccaccacggcctccggcaagcttataacagagtggtgctgccggagctgtacgctgccaccgctacgctaccgcggggaggacggctgctggtatgggatggagatacgtcccctcaaggagaaggaggaaaaccttgtgaactctctggtcaccgccgggcacgggcaaatcgacaattttagcctcggagtgctgggcatggcgctgttcctggaggagatgttgcggacgcgcgtgggtaccaaatacgccatcctgctcgtcgccgtgtccttcgtcaccttgatcaccgggaatatgagcttccgggacctgggtcgcgtcatggtgatggtgggggccactatgaccgatgacatcgggatgggcgtcacctacctcgccctactcgcggcgttcaaggtgcgccccactttcgcggccggcttgctgctgagaaagctcacgtcaaaggagctgatgatgaccactatcggaattgtcctcctctcccagtcaaccatccccgagacgatcttagaactgaccgatgccttagcgctgggaatgatggtgctgaagatcgtgcgaaacatggagaagtaccagttagccgtcaccattatggcgatcctgtgcgtgccaaacgctgtgatcctccagaatgcctggaaggtcagctgtaccatcctcgcggtggtgtccgtaagtccgctgttactcacgtcctctcaacagaaggccgactggataccccttgcattaactatcaaggggctcaaccccactgccatctttctgaccacactgtccagaactagcaagaagcgcagctggccgttgaacgaggcgatcatggctgtggggatggtgagcatcctggcctccagcctactcaagaacgacatccccatgaccgggccccttgtagccgggggcctgcttaccgtgtgctacgtgctaacgggacggagcgcagacctggaattagaacgtgcggcagacgtccggtgggaggagcaggccgagatttccggcagctcgcccatcctgagcatcactatctcagaggacgggagcatgagcatcaagaacgaagaagaggagcagacattaaccatcctaatccgcacgggcctgttggtcatcagcggcctattcccggtctccatccctatcacggcggcagcgtggtacctgtgggaggtcaagaaacagcgggcaggggtgctgtgggacgtccccagcccgccgcccgtcggcaaggccgagctcgaggatggggcttaccgcattaagcagaagggcatcctggggtactcccagatcggcgccggtgtgtataaggagggcaccttccacaccatgtggcacgtgacccggggcgcggtcctgatgcataagggtaagaggatcgagcccagctgggccgacgttaaaaaggacctgatctcatacggcgggggctggaagctggagggcgagtggaaggagggcgaggaggtgcaggtcctggcactcgagcccggcaagaatcctcgggccgttcaaaccaagcccgggctgttcaagactaacaccgggaccattggggccgtctcactggactttagccccggcacgagcggctcccccatcgtagacaaaaaggggaaggtggtgggactctatggtaacggcgtcgtgacccgttctgggacctacgtgtctgcgatcgcccagaccgagaagtccatcgaagacaaccccgagatcgaggacgacatcttccggaagaagcgcctgacgataatggacctgcacccgggggccgggaagaccaagcgttacctacccgcaatcgtccgcgaggcgatcaagcgggggctccgcaccttgatcctggccccgacccgggtagtggccgccgagatggaggaggcgttacgcggcctacccatacgctaccaaacgcccgcgatccgagccgagcacaccgggcgtgagatcgtcgacctcatgtgccatgccacattcacaatgcgacttctgagtcctataagagtgcctaactacaacctgatcataatggacgaggcgcacttcacagaccccgcctccatcgcggcccgcggatatatcagcacccgcgtggagatgggggaggccgcaggcatcttcatgaccgcgacgccgcccggctcgcgggacccgttcccccagagcaacgcgcccatcatggacgaggaacgggaaatcccagagcggtcttggaactcggggcatgagtgggtcacggacttcaagggcaagaccgtgtggttcgtgccgtccatcaaggccgggaatgatatcgccgcctgccttcgcaagaacggcaagaaggtcatccagctgagccggaaaacgttcgattctgagtacgtgaagacacgcacaaacgactgggacttcgtggtcaccaccgacatcagcgagatgggcgcgaacttcaaggccgagcgggtgatagatccacgccggtgcatgaagcccgtgatcctgaccgacggggaggagagggtcatcctcgccggcccaatgccggtgacccactccagtgccgcccaacgccgcgggcgggtcggccgcaaccccaagaacgagaacgaccaatatatctacatgggggagcccctggagaacgacgaagactgcgcgcactggaaagaggccaagatgttgctcgacaacatcaatacccctgagggcatcatcccgtccatgttcgagcccgagagggaaaaggtggacgccattgacggcgagtaccggctgcggggggaggcccggaagactttcgtggatttgatgcgccggggcgatctcccagtatggttagcttaccgcgtggcggccgaggggatcaattacgccgaccggcgctggtgttttgacggggtgaagaataaccagatcctggaagagaatgtagaggtagagatctggaccaaggagggggaacggaagaagctcaagccccgctggctggacgctcggatctatagcgacccgctggccctcaaggagttcaaggagtttgcggcgggccgcaagagcttaacgctcaacttgatcaccgaaatgggccggctgcccactttcatgacccagaaggcccgcaacgccctagataacttggcggtgctgcatacggccgaggccgggggccgagcctacaaccacgctctgagtgagctccccgaaaccttagagaccctgctccttctgaccctcctggcgactgtcaccggaggcatcttcctgttcctcatgagcggcaagggaatcggcaagatgaccctggggatgtgctgcatcatcaccgctagcgttctgctttggtacgctcagatacagccgcactggatcgccgcctccatcatcctggagtttttcttgatcgtgttgctgatccccgagccggagaaacagaggaccccgcaggacaaccagttaacgtacgtcgtgatcgctatcctcaccgtcgtcgccgccaccatggccaacgaaatgggtttcttggagaagaccaagaaggatttcgggctaggcggcatcgccacgcagcagccggagagcaatatcctcgacatcgacttacgccctgcgtcagcgtggaccctgtacgccgtggcaacaacgttcatcacgcccatgctccgccattccatagagaatagctcagtgaacgtcagcctaaccgccatcgccaaccaagccaccgtgctgatggggctaggcaaggggtggcccttgtcgaagatggacatcggcgtgcccctgctcgccatcgggtgctattcccaggtcaaccccatcaccttaacggccgcgctgctcctgctggtcgcacactacgccatcatcggccccgggctccaggccaaagccacccgagaggcacagaaacgcgccgcggccggcatcatgaaaaaccctaccgtggacgggatcacggtgattgacttggatccaatcccctacgatcccaagtttgagaagcagctgggtcaagtgatgctcctggtgctgtgcgtcacgcaggtactcatgatgcggacaacatgggccctgtgcgaggcgctcaccctggccacggggcccatctccacactgtgggaaggaaaccccggcaggttttggaacactacgatcgccgtgagcatggccaatatcttccgcggctcctacctagccggggcgggcctgctgttcagcatcatgaagaacacggcgaacacccggcgcggcactggcaataccggcgagacgctgggggagaagtggaagaaccggctaaacgccttagggaagtccgagttccagatctataagaagtcagggatccaggaggtcgaccgcacactggccaaggagggcatcaagcgcggggagaccgaccatcatgcagtgtcccgcggctctgccaagctacggtggttcgtagagcgcaacctggtcacccccgagggcaaggtcatggacctggggtgcggccgcggagggtggtcctactactgcggcgggctcaaaaacgtgaaggaagtgaaggggctgacgaagggcggcccggggcacgaagaacccatcccgatgagcacctacggctggaacctggtgcgcctccagtccggggtggacgtcttctttacgccgcccgagaagtgcgacaccctgctgtgcgacatcggcgagagctcccctaacccgacggtggaggccggccggactttacgcgtgctgaacctggtagaaaactggctcaacaacaacacccagttctgcatcaaggtgcttaacccctacatgcccagtgtgatagagaagatggaggccctacagcggaagtatgggggagcccttgtccgcaatccgctgtcacggaactccacccacgagatgtactgggtgagcaacgcgtctgggaacatcgtgagctccgtcaacatgatcagtcgcatgctaatcaaccgattcacaatgcgccacaagaaggcaacgtacgagcccgatgttgatctgggctcaggcacccggaatatcggcatcgagagcgagactcccaacctcgatatcatcggcaagcgcatagagaagatcaagcaggagcacgaaacctcctggcactacgaccaggaccacccgtacaagacgtgggcctaccacgggagctatgagaccaagcagaccggatcagccagctccatggtgaacggggtcgtgcgcctgctgaccaagccgtgggacgtcatcccaatggtgactcagatggccatgaccgatacaacccccttcggacagcagagggtgtttaaggagaaggttgacacgaggacccaggaaccgaaggagggaacaaagaagctgatgaagattacggcggagtggctgtggaaggagcttggaaagaagaagaccccgcggatgtgtactagagaggagttcacacggaaggtgaggagcaatgcggccttaggagccatcttcaccgacgagaacaagtggaagtccgcccgggaggcggtggaggacagtggattttgggagctggtcgataaggaacgtaacttgcaccttgaaggcaagtgcgagacctgcgtgtacaacatgatggggaaacgggaaaagaaactgggcgagtttggcaaggccaagggttcccgagccatctggtacatgtggctgggagcccggttcctcgagtttgaggcgctcgggttcctgaacgaagaccactggttctctcgtgagaactctcttagcggcgtggagggggagggcctccacaaactaggctacattctccgggacgtcagcaagaaagagggcggagctatgtacgccgacgacaccgccgggtgggacacaagaatcaccctggaagacctgaagaacgaggagatggtgacgaaccatatggagggcgagcacaagaagctcgctgaggcgatcttcaagctgacctaccaaaacaaagtggtccgagtgcaacgcccgacgccccgggggaccgtgatggacataatttcgcgccgtgaccagcgaggcagcggccaggttgtgacgtatggactgaacaccttcaccaacatggaggcgcagctcatccggcagatggaaggagagggggtgttcaagtccatccagcagctaaccgcaacggaggagatagccgtcaagaactggttagcacgcgtgggtcgcgaacggctcagccgcatggcgatctccggggacgactgcgtggtgaagccgctggacgaccggtttgccagcgcacttaccgccctcaacgacatgggcaaggttcgtaaggatatccagcaatgggaaccgtcccggggctggaacgactggacccaggtgccgttttgcagccaccactttcacgagcttataatgaaagacgggcgcgtcctagtggtgccctgccgcaaccaagacgagctaatcggccgcgcccggatatcccagggggcgggctggagcctgcgcgagaccgcgtgcctggggaagtcctatgcccagatgtggtccctcatgtactttcaccggcgagatctgcgtttagccgctaatgcgatttgcagtgccgtacccagccattgggttccgacttcccggacgacctggagcatccatgccacccacgagtggatgaccacggaggacatgctcaccgtgtggaaccgggtctggatccaggagaacccctggatcgaggacaagaccccggtggagtcctgggaggagattccctatctgggcaagcgcgaggaccaatggtgcggcagcctgatcggcctcaccagtcgggccacgtgggcaaagaacatccagaccgccatcaaccaagtgcgctccctgatcggtaacgaggagtacactgattacatgccgagcatgaagcggttccgccgcgaggaagaggaggccggggtgctgtggtga

SEQ ID NO: 25587 - RNA, 9876 nt, synthetic construct
  misc_feature 1..9876: note = derived and/or modified CDS sequence (opt11) from DENV-2__DQ645549__SS-prME
  source 1..9876: mol_type = other RNA
acagcgggggtcattatcatgatgatccccacagtagtagctttccacctaaccacacgtaacggcgaaccccacatgattgtgtcacgtcaggagaagggcaaaagcctactattcaaaacggaaaacggggtcaacatgtgtactctgatggctatggacctcggagagctatgcgaggacacgatcacgtacaactgcccgctactaagacagaacgaacctgaagatatagactgctggtgcaactctacaagtacgtgggtcacatacggaacctgtacagccaccggtgaacatagacgagaaaagcggtcagtggcgttggtaccccacgtcgggatgggactagagacgcgcacagaaacgtggatgtcaagtgaaggtgcctggaagcacgcacaaagaatagagacatgggtcctacgccacccaggcttcacgatcatggccgcaatcctggcatacactatcggcactacatacttccaacgagtactaatatttatactactaaccgcggttgcacccagcatgacaatgagatgcatcggcataagcaatcgagatttcgtcgagggcgtcagcggcggttcgtgggttgacatagtactagaacacggctcctgcgtgacaaccatggcgaaaaacaagcccacactagactttgaactaataaaaaccgaggccaagcacccggcgaccctccgcaaatactgcatcgaggcaaaattaaccaataccaccacagcatcccggtgcccaactcagggcgagccttcgctgaatgaagaacaagacaaacgttttgtatgtaagcacagtatggtcgatcgaggctggggcaatggatgcgggctattcggaaaggggggtatcgtaacatgtgccatgttcacttgcaaaaaaaacatggaaggaaaggtggttcagccagaaaacctagagtacacaatcgttataacccctcatagcggggaagaaaatgccgtcgggaatgacacgggaaaacacggaaaggagatcaaagtcaccccgcaatcatcgataactgaggcagagctaacaggttatggaactgttacaatggagtgtagcccccgtacaggcctagacttcaacgagatggtgctcctacagatggaagacaaggcgtggttggttcaccgacaatggttccttgatctgccgctgccctggctgcccggggccgacacccaggggtcaaactggattcagaaggaaaccctcgtaacgttcaaaaacccacacgctaagaaacaggacgtggtagtcttaggaagtcaggaaggggctatgcacacggcgctcaccggggccacggagatacagatgtcaagtggaaatctcctattcacaggccacctgaaatgccgtctacgaatggacaaactccaactcaaaggaatgtcgtatagcatgtgcacaggcaagttcaaagttgtgaaagaaatcgcagaaacccaacacggtaccatcgtgatccgggtacaatacgagggagatggctccccatgtaaaattccattcgagatcatggaccttgaaaagagacatgtcctaggccggctgatcacagtgaatcccatagtcactgaaaaagacagtcccgtaaacatcgaggcagaaccacccttcggtgactcgtacatcatcataggagtagaacccggccaactaaaattatcgtggttcaaaaagggctcctccataggacagatgtttgaaacaaccatgcggggagcaaagagaatggcgatactaggggacaccgcctgggatttcgggtcactgggcggcgttttcacttccatcggtaaggcgcttcaccaggtcttcggagcgatatacggagccgcgttttcgggagtaagctggactatgaagatactaataggagtagtcataacgtggatagggatgaacagtaggagcacgtcactcagcgtaagtctagtattagtgggagtggttacgctatacctaggggtaatggtccaagcagactcagggtgcgtggtatcctggaagaacaaagaactcaagtgcggctcaggcatattcattactgacaacgtacacacatggaccgaacaatataaattccaaccagagagccccagcaaactagccagcgctatccaaaaagcacacgaagaaggcatttgcggcatccgtagtgtcaccagactcgagaacctcatgtggaagcaaataacaccagagttaaaccacatcctgtcagaaaatgaagttaagctgacaatcatgacaggagatatcaagggtattatgcaagcggggaaacgcagtctccgaccgcagcccacagaactcaagtattcatggaaagcctggggtaaagccaagatgctaagcaccgaactgcacaaccacacattcctgatcgacggcccggaaactgcggagtgtcctaacaccaacagagcatggaacagcctcgaagttgaagactacggcttcggggtatttacgacgaatatctggcttaagctcaaagagcgacaggacgtcttctgcgacagcaagctaatgagtgccgcaatcaaagacaaccgcgcggtacacgcggacatggggtattggatcgagtccgcactcaacgatacctggaagatcgaaaaagcatcgttcatcgaagtaaaatcatgccactggccgaaaagccacacactgtggtccaacggggtgctcgaatcagaaatgataattcctaaaaacttcgcggggccagtatcacagcataactaccgccccggatatcacacacagactgccgggccgtggcatctaggaaagcttgagatggacttcgatttctgcgaaggcacaacagttgtcgttacagaagattgtggaaacaggggaccgagcctcagaaccacgaccgccagcgggaagctcataacagaatggtgctgccgatcttgcacactaccaccgttacggtatcgcggagaagatggctgttggtatggaatggaaatcagaccactaaaggagaaagaagaaaatctagtcaacagcctcgtgacggccggtcacggccaaatagacaacttctcgttgggagtcctgggaatggcattatttctagaagaaatgctacggacccgagtggggactaaacacgcgatccttctagtagcagtgtctttcgtaaccctaataacgggaaatatgtcgtttcgggacctcggcagagtaatggtgatggtgggagccacaatgaccgacgatatcggcatgggtgttacctacctggctcttttagccgcatttaaagtcagacccacattcgccgccgggcttctactccggaaacttacctcaaaagaactcatgatgacgacaatcggaatagtgctcctatcccaaagcaccatccctgaaacaattctggagctaacagacgccttagcccttggcatgatggtattaaaaatcgtccgaaatatggagaagtatcaactggcggttacaatcatggcaatcctttgcgtccccaacgcggtaatcctccagaatgcgtggaaggtatcgtgcactatcctcgccgtagtgagcgtaagccccctccttctgacttcaagccaacaaaaggccgactggatacccctagcgctcacaataaaggggctgaaccccacagccatattcctcacaacactgagccgcacatcaaaaaaaagatcatggccactgaacgaagccataatggctgtagggatggtgtccatcttagcgagttcactgctaaagaacgacatcccaatgacggggcccctggttgcaggcgggctcctaacagtctgctacgtactcacgggaagatcggcagacctcgaactcgagagggccgcggacgtacgctgggaggaacaagcggaaatcagcggttcgtcaccgattctgtctatcacaatatcagaagatggatcaatgtcgataaaaaatgaggaggaggagcaaactctaactatattgattcgtaccggtctcttagtcataagcggtttattccccgtttcaatcccaataacggcggcggcctggtatctgtgggaagtcaagaagcaacgggccggtgtactctgggatgttccaagcccaccccctgttggcaaagcagaactagaggatggcgcataccgaataaaacaaaaaggcatactagggtacagtcagattggggcaggcgtttacaaagaaggaacctttcacacgatgtggcatgttaccaggggagctgtactcatgcacaagggtaaaagaatagaaccctcgtgggcggacgtaaaaaaagacctaatatcctacgggggggggtggaagctcgagggcgagtggaaagaaggagaggaggtacaggtactagcacttgaaccaggaaagaacccgcgtgcggtccagactaagccgggcctgttcaagactaacacgggaacaataggagccgtttccctagatttttcgccgggcacatcaggtagtccgatagtagataaaaagggaaaagtcgtcggactctatggcaacggcgtagtaacacgaagtggcacatacgtgtcggcgattgcacaaacggagaagtccatagaagacaaccctgaaatcgaggacgacatattccggaagaaacgccttactatcatggacctccatccgggcgcaggcaaaacaaagcggtaccttcccgccattgtgagagaagcaataaagaggggtcttcgcaccttgattctagccccaacgagagtggttgcggctgaaatggaagaggcgttaagaggcctgcccatccgttaccaaacgccggcgatacgcgcggaacacaccggacgagagatagtggatctcatgtgtcatgcgactttcactatgcggctgctctcaccgattcgcgtaccaaattacaacctaataattatggacgaggcccatttcacagacccggcgagcatagcagcccgcggatatataagcacaagggtagaaatgggcgaggccgctgggatctttatgacagcgacgcccccgggaagtagagacccgttccctcagagtaacgccccaatcatggacgaagaacgcgagatccccgaaagatcttggaactcagggcacgaatgggtcacagacttcaaaggaaaaacagtttggttcgtaccgagcatcaaagcggggaacgatatcgctgcatgcctacgcaagaacggaaagaaagtgatacagctcagccggaaaacgttcgactcagaatatgttaagacccggaccaatgactgggacttcgttgtgaccactgacatatccgaaatgggcgcaaacttcaaggcagaaagggtgatcgacccacgcagatgtatgaagccagtaatactaaccgacggcgaagagcgcgtcatcctagcggggccaatgccggtgactcatagtagcgcagcgcaaaggcggggaagggtcggaagaaaccccaagaacgagaatgaccagtatatttatatgggagaaccattagagaatgacgaggactgcgcccactggaaagaagcaaagatgcttcttgataatataaacaccccagagggaatcattcccagtatgtttgaacccgaaagagaaaaagtcgacgccatcgacggagaataccggctgagaggagaagctcgtaaaacgttcgtcgacctcatgagacggggggatctaccagtatggctcgcataccgcgtagctgcagaagggataaactacgcggacagacgctggtgcttcgacggtgtgaaaaacaaccaaatactcgaggagaatgtggaagtagagatctggacgaaagaaggagaaaggaagaaactgaaacctaggtggctcgacgcgcggatatacagcgaccctctcgcacttaaggaattcaaggagtttgccgcgggcaggaaatctctaaccctaaacctaatcacagaaatgggacgcctcccaacattcatgacacaaaaggcacgcaacgccctggacaacctagctgtgctacacacggctgaagcaggaggacgggcttataaccacgcgctaagcgaactacctgagacactagaaactctactattactcacactgctcgccactgtgaccggagggatcttcctctttctaatgtccggcaagggaataggaaaaatgacgctcggtatgtgttgcataattactgcaagtgtacttttatggtacgcgcaaatacagccccactggattgccgcgagcatcatactcgaattcttcctgatcgtcctcctaatccccgaacccgagaagcaaaggactcctcaagacaaccaactgacgtacgtggtaatcgcgatcctgaccgttgttgcagcaactatggcaaacgagatgggtttcctagaaaagacaaagaaggactttgggttgggaggaatagcaacacaacagccagagagcaacatcctcgatatagacctgcgacccgcgtcggcatggactctttacgcggtagcaacaacctttatcaccccgatgctccgacactcgatcgagaacagcagcgttaatgtcagcctgacagcaatagccaaccaagccacggtattgatgggactgggcaagggctggcccctgagtaaaatggatataggagtcccgcttctggccataggctgttactcccaagtaaacccaatcaccctgaccgcggccctcttactgctagtggctcactatgccataataggccctggcctgcaggccaaagccacacgggaagcccaaaaaagggctgcagctggcatcatgaaaaacccaaccgtcgacggaatcacagtcatcgatctcgaccccattccctacgacccaaaattcgaaaaacagctaggccaagtaatgttactagtgctatgcgtgacgcaggtcttaatgatgaggaccacttgggcgctgtgtgaagcgctcacgctcgcaacgggcccaatctctacactgtgggagggtaatccaggccggttctggaatacgacgatagcggtaagcatggcaaacattttccggggctcgtacctcgccggggccgggctgctatttagtattatgaaaaatacggcaaacaccagacgcggaacagggaatacaggtgaaacactgggcgagaagtggaagaatcgtttgaacgcattgggaaagtcagaattccagatatataaaaaaagtggcatccaagaagtagacaggacgctagccaaggaaggcataaaaagaggggaaaccgaccatcacgcggtcagccgaggctcagccaaactgcgctggtttgtagaacggaacctcgtaacgccagaaggcaaggttatggacctcgggtgcgggcgaggtgggtggagctactattgcggcggactgaaaaatgtaaaggaagtaaaggggttaaccaaaggagggcccggacacgaagagccaatccctatgtccacctacggctggaacctggtgagattgcaatccggagttgatgtcttcttcacccctcccgaaaaatgcgacaccctcctatgcgacatcggagagagctccccaaatcccacggtggaggctggacgcacgctgagggtactaaacctagtcgagaactggctaaacaacaacacacaattctgtatcaaagtactaaacccgtacatgccatcggtaattgagaagatggaggcgctccaaagaaagtacggtggcgcgctagtccggaaccccctgagccgtaacagcacccacgaaatgtattgggtttccaatgcgtccggaaacattgtaagttcagtgaatatgataagccggatgctcataaataggttcacaatgcggcacaaaaaggccacctacgaacccgacgttgacctggggagcgggacacgaaatatcggaatagagtccgaaacccctaacttggatataataggcaaacgaatagagaagatcaaacaagaacacgagacctcctggcactacgatcaggaccacccctacaaaacctgggcatatcacggatcatacgagactaaacagaccggaagcgcgtcctccatggtaaacggagtggtccgattgctcactaagccctgggacgtaattccaatggtcacacaaatggccatgacagatacgacaccatttggacaacaacgcgtgttcaaagtgaaggttgacacacgaacccaggaacccaaagaggggacgaaaaagctgatgaaaattacagcagaatggttgtggaaagagcttggaaagaaaaaaactccgcgcatgtgcacgagggaggaattcacgcggaaggtgagaagcaacgcggcgttaggcgccatcttcacagacgagaacaaatggaaatccgcgcgcgaagcagttgaggattcgggcttctgggaactggtagataaggagcgcaacctccacctagaaggaaaatgcgaaacatgtgtgtacaacatgatggggaagagagaaaaaaaactaggcgaattcggtaaagcaaaaggatcacgggcgatctggtatatgtggctgggggctaggttcttagaatttgaagcgctcggcttcctcaacgaggaccattggttctctagagagaactctttgtcaggggttgagggcgaaggactacacaaactgggctacatcctaagagacgtgtccaagaaagagggaggagcgatgtacgcggacgacaccgctggctgggatacaagaattaccctggaagacctcaagaacgaagaaatggtaacgaaccatatggagggggagcacaaaaaactcgcagaagcaatattcaaactgacataccagaacaaagtggtgagagtacaacggcccaccccacgcggcactgtaatggacataatttcgcgcagagaccaaagggggagcggccaggtcgtaacttacggcctcaacactttcaccaacatggaagctcaacttatccgccaaatggaaggggaaggggttttcaaatctatacagcagttgacagcaaccgaagaaatcgcggtaaagaactggctagcgagagtaggccgcgagaggttgtccagaatggcaatcagtggagatgattgcgtggtgaaacccttggacgaccggttcgcgagtgcactaacggccctcaacgacatgggcaaagtgagaaaagacatacaacagtgggagcccagccgaggttggaacgactggacacaagtaccattttgcagccaccacttccacgaattaattatgaaggacggaagggtactcgttgttccatgccgtaatcaagacgaactgataggccgagcaagaatctcacagggtgccggctggagcctccgggaaacggcatgcctagggaaatcctacgctcaaatgtggagcctgatgtacttccacagaagagacctccgcttagccgcaaacgccatctgctcagctgtaccgtcgcattgggtacctacctcgcgaacaacttggtcgatacacgccacacacgaatggatgaccacggaggacatgctaacggtttggaatagagtatggattcaggagaatccgtggattgaggacaagacacccgtcgaaagctgggaagagatcccctacctcggcaaaagagaagaccagtggtgtggctccctaataggattaacatcaagagcgacctgggcaaaaaatatacagacggcaatcaaccaagtcaggagtctgataggaaatgaggaatacaccgactacatgccttccatgaaaaggttccgtcgagaggaagaggaggccggagtcctctggtga

SEQ ID NO: 25588 - RNA, 9876 nt, synthetic construct
  misc_feature 1..9876: note = derived and/or modified CDS sequence (opt11) from DENV-2__DQ645550__SS-prME
  source 1..9876: mol_type = other RNA
acggccggggtgataatcatgatgatccccaccgtggtcgccttccacctgactacccgtaacggtgagccgcacatgattgtgagccggcaggagaagggcaagagcctccttttcaagaccgaaaacggggtcaatatgtgcacattaatggcgatggacctcggcgagctttgcgaggacaccattacctacaattgccccctgctccggcagaacgagcccgaagacattgattgctggtgtaacagcaccagcacctgggtgacctacgggacctgcaccgccaccggagagcatcgacgcgagaagcggagcgtggcgctggtcccccacgtaggcatggggctcgagacccggaccgaaacctggatgtcctcagagggcgcctggaagcacgcgcaacgcatcgagacctgggtactccgccaccccgggttcaccatcatggccgccatactggcctacacaatcggcaccacctatttccagcgggtactcatcttcatcttactcaccgccgtggcgccttctatgaccatgcgctgcattgggatcagcaatcgggactttgtggaaggcgtcagcggcgggagctgggtggacatcgtcctcgaacacggctcctgcgtcacgaccatggccaagaacaagcccacgctggacttcgagctgatcaagacggaagccaagcatcctgccacgctgcgcaaatactgcatagaagccaagctcaccaacacgaccaccgcgagccggtgcccgacgcagggtgagccctccctgaatgaggagcaagataaacggttcgtgtgcaagcacagcatggtggaccggggctggggcaacggctgcggcctgtttgggaaaggagggatagtcacgtgcgctatgttcacgtgcaagaagaacatggaggggaaggtggtgcagcccgagaacctcgagtacaccatcgtcattacgccccactccggcgaagagaacgccgtggggaacgacaccggcaagcatggaaaggagatcaaagttaccccacagagctctataaccgaagccgagctgacgggttacgggactgtcacgatggagtgcagcccacggaccgggctggactttaacgagatggtgctcctacagatggaggacaaagcctggctggtccaccggcagtggttcctcgacctcccactgccctggttgccgggcgcggatacccaggggtccaattggatccagaaggagacactggtgacatttaagaacccccacgccaaaaagcaggacgtggtagtgctgggctctcaggagggggccatgcacaccgccttgaccggcgccacagagatccagatgtcgtccggaaacctgctgtttacgggtcacttaaagtgtcgattgcggatggacaaactgcagctcaaggggatgtcatactccatgtgcaccgggaagttcaaggtggtaaaggagatagccgagactcaacacggaaccatagtgatacgcgttcagtacgagggggatgggagcccgtgcaagatccccttcgagatcatggacctggagaagcgacacgtcttgggccgcctcatcacggtcaatccaatcgtgaccgagaaagactctcccgtcaacatagaggccgagccgcccttcggtgacagctacatcatcatcggcgttgaaccagggcagttgaagctctcctggttcaaaaagggcagctccataggacaaatgttcgagaccaccatgcgcggcgccaagcggatggccatactcggcgacacggcctgggacttcggcagcctaggaggggtgttcacctcaatcggcaaggcgctgcaccaggtcttcggtgccatctatggcgccgccttcagcggcgtatcctggacaatgaaaatcctgatcggggtggtaataacctggatcggcatgaactcccgctccacgagtttgtcggtgagcctggtgctagtcggagtggtgaccttgtacctcggggtcatggtgcaggcggactccgggtgtgtggtcagctggaagaacaaagagctgaagtgtggtagcggcatcttcattaccgacaatgtacacacgtggactgaacagtacaagttccagccggagtcccccagcaagctggcctccgcaatacaaaaggcccacgaggaggggatctgcggcatccggtccgttacccgcctcgagaacctgatgtggaaacagatcacccccgagctcaaccacatcttgtccgagaacgaggttaaactgaccatcatgaccggggacattaagggtatcatgcaggccgggaagcggtcgctccggccgcagcccaccgagttaaagtactcgtggaaggcttgggggaaggcgaagatgctgtctaccgagctccacaatcacacatttctgattgacggccccgagacagctgagtgccccaatacaaacagagcctggaactcccttgaagtagaggactatgggttcggcgtgttcaccaccaacatatggctcaagctgaaggagcgccaggacgtcttctgcgacagtaagctgatgtccgccgcgatcaaagataaccgggccgtgcacgccgacatgggttactggatcgagagcgccctaaacgacacgtggaagatcgaaaaggccagctttattgaggtcaagagctgccattggcccaagtcccacaccctgtggtctaacggcgtcctggagtccgagatgataatccccaagaactttgcgggccccgtcagccagcacaactatcgcccggggtaccacacccagaccgctgggccctggcacctcgggaagctggagatggacttcgatttctgcgagggcaccacggtggtcgtgaccgaagactgcgggaaccggggtcctagcctgcgtaccaccactgccagcggcaagctaatcacagagtggtgctgccggagctgtaccctgcccccgctccgctacagaggggaagacggctgctggtacgggatggagatccgccccctcaaagagaaggaggagaatctggtgaacagtctggtcaccgccgggcacgggcagatagacaacttcagcctaggtgtgctcggcatggccctgttcctcgaagagatgctgcgaacgcgcgttgggacgaagcatgccatcctgctcgtagccgtgtccttcgtgaccctgataaccggcaatatgagcttccgggacctggggcgtgtcatggttatggtgggcgccacgatgaccgacgacatcggcatgggcgtcacctacttagcccttcttgccgccttcaaggtgcgtcctaccttcgccgctggcttactgctgcggaaacttacatcaaaggagttaatgatgacgaccatcgggatcgttctgctcagccagtccaccatacccgagacgatcctggagctgaccgatgccctcgcgttgggcatgatggtcctcaagatcgtgcgcaacatggagaagtaccagctcgcggttacaatcatggccatcctgtgtgtgcctaacgccgtgatccttcagaacgcctggaaggtcagctgcaccattctcgcggtggtgtccgtcagccccttactattaacatcctctcagcagaaagccgactggatacccctggccttgactatcaagggtctcaaccccaccgccatattcctgaccacgctgtcccggaccagcaagaagcgctcctggccgttaaacgaggcgataatggcggtgggcatggtgagcatcctggcctccagcctgctcaagaacgacatccccatgaccgggccccttgtcgcagggggcctactaaccgtgtgctatgtgctgacgggacggagcgccgacctcgagcttgagcgagcggccgacgtcaggtgggaggagcaggccgagatatccggtagctcccccatcttgagcatcaccataagcgaagacgggagcatgtccatcaagaacgaggaagaggaacagacactgaccatcctcattcgcacgggcttgctggtgatcagcggcctctttccggtttcgataccgatcaccgccgctgcgtggtacctgtgggaggtcaagaagcagcgggccggggtgctgtgggacgtcccctcaccgccgcccgttggcaaggccgagctcgaggacggggcataccgcatcaagcaaaagggcatactggggtactcccaaatcggtgccggcgtttacaaagaagggactttccacaccatgtggcacgtaacacggggagcggtcctgatgcacaaggggaagcgcatcgagccatcatgggccgacgtaaagaaggacctcatatcctacggcgggggctggaaactggagggcgagtggaaggagggcgaggaggttcaggtactggccctcgagcccggcaaaaacccccgggccgtgcaaacgaagcctgggctgttcaagaccaatactggcaccatcggggccgtgagcctggacttttcgcccggcacgtccggctcccccatcgtcgataaaaaggggaaggtggttggcctctacggaaacggcgttgtgacccgcagcggcacctacgtttccgctattgcccagaccgagaagagtatagaagacaaccccgagatagaggatgacatcttccggaagaagcgcctgacgatcatggacctgcacccgggggcggggaagacgaagcggtacttgcccgccatcgtccgcgaggccataaagcgcgggctccgcacactgatcttggccccgaccagagtcgtggccgccgagatggaggaggcccttcgcggccttcccattagataccagacgccagctattcgggccgagcacactgggcgcgagatcgtcgacctgatgtgccatgccaccttcaccatgagacttctgagccccatcagggtgccgaactacaacctcattattatggacgaggcacacttcacggacccggcgagcatcgcggcccggggctacatcagcacccgcgtggagatgggcgaagccgccggaatttttatgaccgcaacgccgccaggctcccgggacccattcccccagagcaacgcgcccatcatggacgaggagcgagagattcccgagcggtcgtggaactcaggccacgaatgggttacggacttcaagggcaagactgtttggttcgtaccttccatcaaggccgggaacgacatcgctgcctgcctccgcaagaacggcaagaaggtcatacagctaagccggaagaccttcgactccgaatacgtgaaaacccgcaccaacgactgggacttcgtggtcaccaccgatatcagcgagatgggagccaacttcaaggccgagcgcgtgatcgaccccaggcgatgcatgaagcctgttattctaactgacggggaggaacgagtaatcctggccgggccgatgccagtgacgcattcgagcgccgcccagcggcgcgggcgcgtcggccgcaatcccaaaaacgagaacgaccagtatatctatatgggggagcccctggagaacgatgaagactgtgctcactggaaagaagccaagatgctgcttgataacatcaacacccccgagggaattatcccgtcaatgttcgaaccagagcgcgagaaggtggacgccatagacggtgagtaccggctgagaggagaggcgaggaagacgttcgtcgacctgatgcgccgtggtgacctgcccgtctggctggcctacagagtggcggcggaggggataaattacgccgaccgacgctggtgcttcgacggcgtgaagaacaatcaaatcctggaggagaacgttgaagtggaaatctggaccaaggagggggagcgtaagaaactcaaaccgcgctggttagacgcccgtatctacagcgaccccctggcgctcaaagagtttaaggagttcgcagccggccggaagtcccttacgttaaatctaatcaccgaaatggggcggctgcccacattcatgacccagaaggcgcgcaatgccctggacaacttagcggtgttacacacggccgaggccgggggccgggcctacaatcacgccttatcggagctacccgagacgttggagacgctgttgctgctaacgctgctggcgacggtcacagggggcatcttcctttttctcatgtccggcaaggggatcggcaagatgaccctggggatgtgctgcatcatcaccgcaagcgtgctgctctggtacgcccagatccagccgcattggatagccgcctccatcatcctggagttcttcctgatcgtcctcctgatccccgagcccgagaaacagaggacgccgcaggataaccagcttacgtacgtcgttatagcaattctgaccgtggtcgcagccaccatggccaacgagatgggattcctggagaagaccaagaaagactttggtctgggcggaatcgcgactcagcagccggaaagcaacatcctcgacatcgatctgcgacctgcgagcgcctggaccctgtacgctgtggccaccaccttcatcacgcccatgcttcgccattccatcgagaacagcagtgtgaacgttagcctgaccgccatagcaaaccaggcgaccgtgctgatggggttaggcaaggggtggcccctgtccaagatggatatcggcgtgccgctgctagccatcggatgctacagccaggtcaaccccatcaccctgacggccgcgctgctcctgctggtggcccactacgccataattggccccggccttcaggccaaagccacacgggaagcgcaaaagcgcgccgctgctggaatcatgaagaaccctaccgtggacggcatcaccgttatagatctggacccgatcccctacgaccccaagttcgagaagcagctgggccaggtgatgttactggtactatgcgtcacccaggtattaatgatgaggaccacttgggccctgtgtgaagcgttaaccctcgccacgggccctatctccaccttgtgggaagggaacccgggccgcctgtggaacaccacgatcgcggtgtcaatggccaacatcttccgcggctcctacctcgcaggggcgggcctgctgttctctatcatgaagaatactgccaacacgaggcgcgggaccggcaacaccggcgagactttaggggaaaagtggaagaaccggctgaacgccctgggcaagtccgagttccaaatctacaagaagagtgggatccaggaggttgatcgaactctcgctaaggagggtatcaaacgcggggagaccgaccatcatgcagtgtccaggggcagcgccaaattgcggtggttcgtggaacgcaacctcgtcacccccgagggcaaagtgatggacctcgggtgcggccggggcggatggtcgtattactgcggcgggctgaagaatgtgaaggaggtcaaggggctcacgaaaggcggacccgggcacgaggaacccatcccgatgagcacgtacggctggaacctcgttcgcctgcagtccggagtggatgttttcttcacgccgcccgagaagtgtgacaccctgttgtgcgatatcggcgagagctccccgaacccgacggtggaggccggccggaccctgcgcgtcctgaacctggtcgaaaactggctgaacaacaatacccaattctgcatcaaggtcctgaacccctatatgcccagcgtaatagagaagatggaggcactccagcgtaagtacggaggggccctcgtgcgcaacccgctgagccggaactccacccacgaaatgtactgggtgagcaacgcgagtgggaatatcgtatcctcggtaaacatgatcagccgtatgctgataaaccggttcaccatgcgccacaagaaggccacgtatgagccggatgtggacctcggctccgggactcggaacatcggcatcgagtcggagaccccgaacctggacatcatcggcaagcgcatcgagaagatcaagcaggagcacgagacctcctggcactacgaccaggaccatccctacaagacgtgggcataccatggtagctacgaaaccaagcagacggggtctgcgagctccatggtaaacggggttgttcgcctgctcaccaagccgtgggacgtcatcccgatggtgacgcaaatggccatgaccgacaccacccccttcggccagcagcgggtgtttaaggtcaaggtagatacgcgcacccaggagcccaaggaaggcactaagaaactgatgaagattaccgcggagtggctgtggaaggagctcggcaagaagaagacgcctcggatgtgtacccgcgaggagttcacccggaaggtgcgcagcaacgctgcgctgggcgcaatcttcaccgacgagaacaagtggaaaagtgcgagagaagcggtcgaagactcagggttttgggagttagtggacaaggagcgtaacctccacctggagggtaagtgcgagacttgtgtttataatatgatgggaaagcgggagaagaaacttggggaatttggcaaagccaaagggtccagagccatctggtacatgtggcttggcgcccggttccttgagttcgaggcactggggttcctaaacgaggaccactggttcagccgcgagaactccctgagcggtgtcgagggggagggcctgcacaagttgggatacatcctgcgcgacgtaagcaagaaagaaggcggggccatgtacgccgacgataccgccgggtgggacacccgtataaccctggaggacctcaagaacgaggagatggtcacgaaccatatggagggggagcacaagaagctggccgaggcgatcttcaagctgacctaccagaacaaggtcgtacgggtgcaacgccccacgccccggggaaccgtcatggacatcatctcccgccgggatcagcgcggcagcggtcaggtggttacatacgggttaaacactttcaccaacatggaggcgcaacttatacggcaaatggagggggagggggtctttaagtccattcagcagttaaccgccacggaagagatagccgtgaagaattggctcgcccgcgtgggccgcgagcgccttagccgcatggcgatctccggagacgactgcgttgtgaagcccctggacgaccggtttgccagcgcactcacagctctgaacgatatggggaaagtgcgcaaggatattcagcagtgggagccgtcgagaggttggaacgactggacgcaggttccgttctgcagccaccactttcacgaacttatcatgaaggacgggcgtgtgctcgtggtcccctgtcggaaccaggatgaactgatcggccgcgcccggatctcccagggcgcgggctggtctctgcgcgaaaccgcctgtctcggcaagtcctacgctcagatgtggagcctgatgtacttccaccgacgtgacctgcggctcgccgccaacgcgatatgctccgccgtgcccagccactgggtcccaacgtcccgcaccacgtggtctatccacgcaacccacgagtggatgaccacggaggacatgctgacagtttggaatcgggtgtggatccaggaaaacccctggatagaggacaagacccccgtggagtcctgggaggagatcccttacctggggaagcgcgaggaccagtggtgcggctccctcatcggtctgacaagccgggccacctgggctaagaacatccagaccgcgataaaccaggtcaggtccctgataggtaacgaggagtacaccgattatatgccgagcatgaagcggttccgcagagaagaggaggaggccggtgtgctttggtga

SEQ ID NO: 25589 - RNA, 9876 nt, synthetic construct
  misc_feature 1..9876: note = derived and/or modified CDS sequence (opt11) from DENV-2__DQ645551__SS-prME
  source 1..9876: mol_type = other RNA
accgcgggtgtgatcatcatgatgatcccaactgtggtggccttccacctgacgacccgaaatggggagccccatatgatcgtgagccggcaggagaagggcaagagcctcttattcaagaccgagaacggggtcaatatgtgcacgctgatggcaatggacctcggcgagctgtgcgaggacacaatcacatacaactgccccttgctacgccagaacgagcccgaagatatcgattgctggtgcaacagcacctcaacttgggtgacttatgggacctgtactgcgacaggtgagcaccggcgcgagaagcggagcgtggccctggtcccacacgtgggcatggggcttgagacccgaaccgaaacctggatgtccagcgagggcgcttggaagcacgctcagcgtatcgagacctgggtgctgcgccaccccgggtttactataatggcagccatattggcctacaccatcgggaccacgtacttccaacgggtactgatttttatactccttactgccgtcgctccaagtatgacaatgcgttgcataggcatcagcaacagggattttgtagagggcgtctccggcgggagctgggtggatatcgtgctggagcacggttcctgtgtcaccaccatggccaagaacaagcccacactcgacttcgagctgataaagactgaggccaagcaccccgccaccctacgcaagtactgcattgaggctaagctcaccaacacgaccaccgcttcgcggtgcccaacccagggcgaaccatcgctgaacgaggagcaggacaaacggttcgtgtgcaaacactccatggtagaccgaggctggggcaacgggtgcggccttttcggaaaaggcgggatcgtcacgtgcgccatgtttacgtgcaagaagaacatggagggcaaggtggtgcagccagagaacttggagtataccatcgtcataacgccccattccggcgaggagaacgccgtagggaacgacacgggcaagcatgggaaggagatcaaggtgactccgcagagctccatcaccgaggctgaactaacgggctacggaaccgtcacgatggagtgtagccccagaaccggcttggacttcaacgagatggtgcttctgcagatggaggacaaagcatggctggtccaccggcagtggtttctcgacctgccccttccctggctcccgggcgcggacacccaggggtctaactggatccagaaagaaacgctggtgacgttcaaaaaccctcacgccaaaaagcaggacgttgtcgtgctgggcagccaggagggggccatgcacacagccctcactggcgccactgaaatacaaatgagcagcgggaacctgctgttcaccggccaccttaagtgccgcctgcggatggacaaactgcagttaaagggcatgtcatactctatgtgcaccgggaagttcaaggtggtcaaagaaatagcagagacccagcacggcaccatcgtgattcgcgtgcagtacgaaggcgacggctcaccctgcaagatcccctttgagatcatggatttggagaagaggcacgtcctgggcagactcattacggtaaatcctatcgtgaccgagaaggatagtcccgttaacatcgaggcggagccacccttcggggacagctacatcattattggagtggagccggggcagctgaagctgtcctggttcaagaaaggaagctccatcgggcagatgttcgagacgacaatgaggggcgccaagcggatggccatcctaggcgacacggcctgggacttcgggagcctaggcggagtgttcaccagcatcggcaaggcgctgcaccaggtcttcggggctatctacggcgccgccttttcaggcgtttcctggaccatgaagatcctcatcggggtggtcatcacttggatcgggatgaacagccgatccactagcctttccgtgagcctcgtgttggtgggggtagtgaccctctacctgggcgtcatggtccaggcggattccgggtgcgtggtcagctggaagaacaaggagcttaagtgcggcagcggcatttttatcaccgataacgtgcacacgtggactgagcaatataagttccaaccggagtcccccagcaagctcgcctctgccatccagaaagcccacgaagagggcatttgtggtatccggtcggtgactcgcctggaaaacctgatgtggaagcagataactcccgagctcaaccacatcttatccgagaacgaagtcaagctgaccatcatgacgggggatatcaaggggattatgcaggccgggaagaggagcctccgcccgcagccaaccgagctcaaatactcatggaaggcttggggtaaggcaaagatgctgagcaccgagctgcacaaccacacgttcttaatagacggacccgaaacggccgagtgcccaaacaccaaccgggcctggaacagtctggaggtggaggactacgggttcggagtgttcaccaccaacatctggctcaagttaaaggagcgccaggacgttttctgcgacagcaaactgatgtccgccgccatcaaggacaaccgggccgtacacgcggacatggggtattggattgagagcgctttgaacgacacgtggaagatcgaaaaggcctcttttatcgaagtcaagtcctgccactggcccaagtcccacaccctgtggagcaatggagtgctggagtcagaaatgatcatccccaagaacttcgcgggcccggtaagccagcacaactaccgcccggggtatcatacccagacggccggcccctggcacttagggaagcttgagatggacttcgacttctgcgagggcacgacagtggtcgtgaccgaggactgcgggaataggggtcccagcctccgcaccaccacagcctccggcaagctaataaccgagtggtgttgccggagctgcaccctgccccccctacgctaccgcggggaagacggctgctggtatgggatggagatccgccccctcaaggagaaggaagaaaacctggtaaacagtctggtcaccgcaggccacgggcagattgacaacttctcattaggagtactggggatggcgctgttcctcgaggagatgttgcggacccgcgtggggaccaagcacgccatcctattagtcgccgtctcctttgtgaccctgatcaccgggaacatgagctttcgggacctcgggagagtcatggtgatggtgggcgccacgatgaccgacgacatagggatgggtgttacctacttagccctgcttgcggccttcaaggtgcgccccactttcgcagccggcctcctgttacggaagctcacaagcaaggagctgatgatgaccaccatcggtattgtcctgctatcacaatccaccattcccgagacgatattggagctgaccgacgccctcgcactgggcatgatggtgctgaagatcgtgcgaaacatggagaagtaccagttagctgtcaccatcatggccatcttgtgtgtaccaaacgccgtgatcctgcagaacgcttggaaggtcagctgtacgattcttgcggtagtgtccgtcagtcccctgctgctcacgtccagccagcagaaggccgactggatccccttagccctgaccatcaaggggctcaatcccaccgccatattcctaacaacgctttcccggacgagcaagaagcgcagctggccgctcaacgaggcgatcatggctgtgggcatggttagcatcctggcctccagccttctgaagaacgatatcccaatgaccgggcccctggtcgccgggggactgctgaccgtctgctacgtcctgacggggcgtagcgcggacctggagctcgagcgggctgccgacgtccggtgggaggagcaagccgagatttcaggtagctccccaatcctcagcatcacaatctctgaggacgggtcgatgtcgatcaagaacgaggaggaggagcagaccctgaccattctcatcaggacgggcctgcttgtgatctcagggctcttcccggtgtccatccccatcaccgccgccgcgtggtacctgtgggaggtcaagaagcagcgggccggggtgctgtgggacgttcccagccccccgccagtcggcaaggcggagctcgaggatggggcgtaccgcataaaacagaaaggaatcctggggtattcccagatcggcgccggagtgtacaaggaggggaccttccacaccatgtggcacgttacccggggtgcggtcttgatgcataaggggaaacgcatcgagccctcgtgggccgacgtgaaaaaggacctcatctcctacggcgggggttggaaactggagggcgagtggaaggagggcgaggaggtgcaggtcctggccctcgagcccgggaagaacccccgtgccgtccagaccaaacctgggctgtttaagactaacaccggcaccattggggcagtgagccttgacttctcgcccggcaccagcggcagtcccatcgtcgataaaaaagggaaggtggtaggcctctacggtaatggcgtcgtaacccgctctggcacctacgtgtccgcgatcgcccaaaccgaaaagtcgatcgaggacaacccggagatcgaggacgacatcttccggaagaagcgtttgacgattatggacctgcaccccggtgccggcaaaaccaagaggtatttgccggccatcgtccgcgaggcgatcaagcgcgggctccgcaccttgatcctggcccctacccgggtggtggccgcggaaatggaggaggccctccgtggcctccccatccgataccaaacccctgcgatccgggcggagcacaccggacgtgagatcgtcgacctgatgtgccacgccaccttcaccatgaggctcctgagccccattcgcgtgccgaattacaaccttatcatcatggacgaggcccacttcaccgaccccgcctccattgcggccaggggctacatcagtacacgcgttgagatgggcgaggccgccggtatattcatgacggcaactccgcccggctcccgcgacccgttcccacagagcaacgcgcccatcatggacgaggagcgcgagatccccgagcggtcctggaacagcgggcatgagtgggtcacggacttcaagggcaagaccgtgtggttcgtgccgagcatcaaagccggtaacgacatagccgcgtgcctcaggaagaacggaaagaaggtcatccagctgagcagaaagacgttcgactccgaatacgtgaagactcgcacgaacgactgggattttgtggttacgacggacatcagcgaaatgggggcgaacttcaaggcagagcgggtgatcgaccctagacgttgcatgaagccagtcatcttgaccgacggtgaggagcgcgtcatcttagccgggcccatgcccgtgacgcacagcagcgccgcccagcggcgcgggcgggtaggcagaaaccccaagaacgagaacgatcagtacatttatatgggtgagccgctggagaatgatgaggactgtgcgcactggaaggaggcgaagatgttactcgataacatcaacacccccgagggaatcataccgtccatgttcgaacccgagcgcgagaaggtggacgccatcgacggcgagtaccgactgcgcggggaagcccggaagacttttgtggacctcatgcgccggggcgatctcccagtctggctggcataccgcgtggcggcagagggcatcaactatacagaccggcgatggtgcttcgacggcgtgaagaacaaccagatcctggaggagaacgtcgaggtggagatctggaccaaagagggtgagcggaagaaactcaagccccgctggctggacgcccgaatctattccgatcccctggctctcaaggagttcaaagagttcgccgccggccgcaaatccctaaccctgaacctcatcacagaaatgggccggttgcccactttcatgacgcagaaggcgcgcaatgcattggataaccttgcagtgctgcacaccgcggaagcagggggcagagcctataaccatgcactgagcgagctcccggagacgctagagaccctgctccttctgacgctcttggcaaccgtcaccgggggcatcttcctgttcctcatgtcgggcaagggcatcggcaagatgactctggggatgtgttgcataattaccgcgagcgttctgctttggtacgctcagatccagccgcattggatcgcagcgagtataatcttagagttcttcctgatagtgctcctgatccccgagcccgagaagcagagaacgccccaagataatcagttaacgtatgtcgtaatcgccatactaaccgtggtcgcggccaccatggccaacgagatgggcttcctagagaagacgaaaaaggacttcgggctgggcgggatcgccactcagcagccggagagcaacatcctcgacattgacctgagacccgcgagtgcatggacgctgtacgccgtggccaccaccttcatcacccccatgcttcgccactccatcgagaacagctcagtaaacgtgagcctgacggccatcgcgaatcaagcgacagtgctgatgggtcttggcaagggttggcccctgtcaaaaatggatataggtgtgccgctgctagccatcgggtgctacagccaggtcaatcccattacgttaaccgccgcactgctcttactggtggcgcactatgccatcatcggccccggcttacaggctaaggccacccgggaagcccagaaacgcgcagccgccggtatcatgaagaacccgaccgtggacggcatcactgtcatcgacctggatccgatcccttacgacccgaaattcgagaaacagctgggccaggtaatgctcctcgtgttgtgcgtcacccaggttctcatgatgcggaccacttgggcactgtgcgaggccctgacgctcgcgaccgggccaatctccaccctgtgggaggggaatccgggccgcttctggaacactaccatcgccgtgtccatggccaacatctttcgcggctcctacttagcaggtgccggcctcctgttctctatcatgaaaaatacagcaaacacccggcgcggtacgggcaacacaggagagaccctgggggagaagtggaaaaatcggctcaacgccttaggcaagtccgagttccagatctacaagaagtctgggatccaggaggtcgaccgcaccctggccaaggagggcattaaacgtggggagaccgaccaccacgccgtgtcccgcggcagcgcgaagctccggtggttcgtcgagagaaacctggtcacgcccgagggcaaggtgatggacttagggtgcggacgcggcgggtggtcctactactgtggggggctcaagaacgtaaaagaggtcaaggggttaaccaagggcgggcctggccacgaggagcccatcccgatgagcacttacgggtggaacctggtgcgcctccagtccggtgtggatgtgttcttcacgccgcccgaaaagtgcgacaccctgctgtgcgacatcggcgagagctcccccaacccgaccgtggaggccggtcggaccctccgcgtgctaaacctggtagagaactggttgaacaacaacacccaattctgcatcaaggtgctgaatccctacatgccctctgtgatcgagaagatggaggccctgcagagaaagtacgggggcgcattggtccgcaacccgctctcgcggaactccactcacgagatgtactgggtaagcaacgccagtgggaatatcgtcagttccgtcaacatgatcagccgcatgctgatcaacaggttcacgatgcgccacaagaaagcgacctatgaacctgacgtggacctggggtccgggactcggaacatcggcatcgagtccgagacccccaacctcgacatcatcggcaagagaatcgagaagatcaagcaggagcacgagacctcctggcactacgaccaggaccacccctacaaaacctgggcctaccacggcagttacgagaccaagcaaactggctcagccagcagtatggtaaacggagtcgtgcgcctgttaacgaagccatgggacgtgatacccatggtgacccagatggcaatgaccgacacgacacccttcggtcagcagcgggtattcaaggagaaggtagacacccgcacccaggagcccaaagagggtaccaagaagctcatgaaaataacggcggagtggctgtggaaggagctggggaagaagaaaacgccgcggatgtgcacccgagaggaattcaccagaaaggtacgaagcaacgcggctctcggcgcgatctttacggacgagaacaaatggaagtccgcccgggaggccgtcgaggacagcgggttttgggagctggtcgacaaagaacgaaacctgcatctcgagggcaagtgcgaaacctgcgtttacaacatgatggggaagcgggagaagaaactgggcgaattcggcaaggccaaggggtcccgcgccatctggtacatgtggctgggtgcccggttcctcgaattcgaagccctcgggttcctgaacgaggatcactggttcagccgtgagaactctttaagcggcgtggagggggaaggcctgcacaagctaggctacatcctccgcgacgttagcaagaaggagggtggtgcgatgtatgccgacgacacagcagggtgggacacccgcataacgttggaggacctgaagaacgaggagatggtcacgaaccatatggagggcgagcacaagaagctcgcggaggccatcttcaagctgacctaccagaacaaggtagtccgggttcagcgccccacgccccgagggacggtgatggacataatctcccgccgtgatcagcgcggtagtggccaagtcgtcacctacgggctgaacacctttaccaacatggaagcgcagttaatccgacagatggagggcgagggggtgttcaagtccatacagcaactgacggccaccgaggagatcgcggtcaagaactggctggcccgcgtgggtcgcgagcgtctctcacgcatggcgatctccggggacgattgtgtggttaagcccctcgatgaccggttcgcaagcgccctgaccgccctcaacgacatggggaaggtgaggaaggacatacaacagtgggaaccctcccggggctggaacgactggacccaggtgcccttttgctcccaccacttccacgagctgattatgaaggacggccgcgtgctggtagtgccctgtcgaaaccaagacgaactcatcggccgcgcccggatctcacagggggccggctggagcctgcgagagacggcgtgcctggggaaatcctatgctcaaatgtggagcctcatgtacttccacagacgagatctccggctggccgccaacgccatctgcagcgcggtgccctctcactgggtgccgaccagtcgtacaacctggagcattcatgcgacccacgagtggatgacgaccgaagacatgctcaccgtgtggaaccgggtctggatccaggaaaacccctggatcgaggacaagaccccagtggagtcctgggaggagatcccctacctcgggaaacgcgaggaccagtggtgtggtagtctcatagggctaacgtcacgagcgacctgggccaaaaatatccaaaccgcgatcaaccaggtgcgctccctaatcggcaacgaggagtacaccgactacatgccttccatgaaacggttccgccgcgaggaggaggaggccggagtcctgtggtga

SEQ ID NO: 25590 - RNA, 9876 nt, synthetic construct
  misc_feature 1..9876: note = derived and/or modified CDS sequence (opt11) from DENV-2__DQ645552__SS-prME
  source 1..9876: mol_type = other RNA
acggccggggtgatcatcatgatgatacccaccgttgttgccttccacctgaccacccggaacggggaaccccatatgatcgtgagccggcaggagaagggcaaatcgctcttatttaagaccgagaatggggtcaacatgtgcactctgatggcgatggatctcggcgagctgtgcgaggacaccatcacctacaactgtcctctgttacggcagaacgagccggaagacatcgactgctggtgcaactctaccagcacctgggtgacctacgggacctgcaccgcaaccggagagcaccggcgcgagaagcggagcgtggctctcgtcccccacgtgggcatggggctggaaacccgtaccgagacctggatgtcctcagagggggcatggaagcacgcccagaggattgagacttgggtgctccgccaccccgggttcacgataatggccgccattctggcttacactatcggaaccacgtactttcagcgggtcttaatcttcatactcttgacggccgtggctccctccatgaccatgcgctgcatcgggatttccaaccgggatttcgttgagggcgtctccggcgggagctgggtggacatcgtgctggagcatggctcctgcgtcacgaccatggctaagaataagccaacgctcgacttcgagctgatcaagaccgaggccaagcacccagccacccttcgcaagtactgcatcgaggccaagctcacgaacacgaccaccgcttcacggtgcccgacccaaggggagcccagtctgaatgaggagcaggacaagcgctttgtgtgcaaacatagcatggtggaccggggctggggcaacgggtgcggcctgttcgggaaaggcggcatcgtcacgtgcgccatgttcacgtgcaagaagaacatggaggggaaagttgtgcagcccgagaacctcgagtacaccatcgtcatcacgccccactccggcgaggagaacgccgtgggaaacgacacgggcaagcatgggaaggagatcaaggtgactccgcagagcagcatcaccgaggccgagctgacgggctacggaaccgtcacgatggaatgctcacctcgcaccggcctggacttcaacgagatggtgctcctgcagatggaggacaaggcctggctggtccaccggcagtggttcctcgacctgccactgccctggcttcctggcgcggacacccaggggtctaactggattcagaaggagactctggtgacgttcaagaacccccacgccaagaaacaggacgtggtcgtgttagggagccaggagggggccatgcacaccgccttaaccggcgccacggagatccagatgagctccggtaacctgctatttacgggccacctcaagtgccgcctgcggatggacaagctgcaacttaagggcatgagctacagcatgtgcaccgggaagtttaaggtggtcaaggagatcgcggagacccagcacgggaccattgtgatcagggtgcagtacgaaggggacggcagcccctgcaagatccccttcgagattatggacttggagaagcgtcacgttttaggccgcctcatcacggtgaacccgatcgtgaccgagaaggattcccccgttaatatcgaggccgagcctcccttcggggacagctatatcataatcggcgtggagccagggcagctgaagctgtcctggttcaagaagggctcctccatcggccaaatgttcgaaaccacgatgcgcggcgccaagcggatggccatcctcggcgacacggcctgggacttcggatccctgggcggggtgttcaccagcatcggcaaggcgcttcaccaggtctttggggctatatacggcgccgcgttctctggcgtttcctggaccatgaaaatcctcatcggggtcgtcattacctggataggaatgaactcccgctccacgagcctgtccgtgagcctggtgcttgtgggggtggtgaccctctatttgggcgtcatggtgcaagcggattccgggtgcgtggtcagctggaagaacaaggaactgaagtgcggtagcggcatcttcatcaccgataacgtgcacacctggacggagcagtacaagttccagcccgagagtcccagcaagctcgcctccgcaattcagaaggcccacgaggaagggatctgcggcattcggagcgtgacacgcctggagaacctgatgtggaagcagataaccccggagctcaaccatatcctgtcggagaacgaggttaagctgaccataatgacgggtgacatcaagggcatcatgcaggccgggaagcggagcctccgcccgcaacctaccgagctgaagtacagttggaaggcctggggcaaggccaaaatgctgagcaccgagttacataatcacaccttcctgatcgacggccccgagacggccgagtgccctaacacgaaccgggcctggaactctctggaggtggaagactacggctttggcgtgttcaccaccaacatatggctcaagctgaaggagcgtcaagatgtcttctgcgattccaagctcatgtcagccgcgattaaggacaaccgggccgtgcacgccgacatgggttactggatagagtctgccctgaacgatacgtggaagatagagaaggcctccttcatcgaggtcaagagctgccactggcccaagtcccacactctgtggagcaatggcgtcctggagtccgagatgatcatccccaaaaacttcgcaggccccgtgtcccaacacaactatcgcccggggtaccacacccaaactgccggcccctggcacctggggaagctggagatggacttcgatttttgcgaggggacaacggtggtcgtgaccgaagactgcgggaaccggggccccagcttacgcactaccacagccagcggaaagctgatcaccgagtggtgctgccgcagctgcaccctgcccccgctgcgctaccgcggggaggacggctgctggtacgggatggagatccgcccactcaaggagaaagaggaaaatctggtaaattcgctggtcaccgccggccatgggcagatcgacaacttcagcctaggcgtgctgggcatggcgctgttcctcgaggagatgcttcggacccgcgttgggaccaagcacgccatcctgctcgtcgccgtgtcattcgtgaccctgataaccggcaacatgtctttccgggacttggggcgcgtcatggtcatggtgggtgccacgatgaccgacgacatcgggatgggcgtcacgtaccttgccctgctcgctgccttcaaggtgcgccccacctttgccgcgggcttactgctgcggaagctcacgtccaaggagctgatgatgacaaccatcgggattgtactgctcagccagtccacaatcccagagaccattctggagttgaccgatgccctagcgctgggcatgatggtgctgaagatcgttcgcaacatggagaagtaccagctggccgtcaccatcatggccattctgtgcgtgccgaacgccgtgatcctgcagaacgcatggaaggtcagctgcacaatcctagcggtggtgtccgtctcgccgctgcttctcacgtccagccagcagaaggccgactggatccccctagccctcaccattaagggactcaacccgaccgccatattcctgaccacgctgtcccggaccagcaagaaacgatcctggccgctcaacgaggcgatcatggccgtgggcatggtttcaatcctggcctccagcctgcttaagaacgacatccccatgaccggccccctggttgcgggaggtctgttaactgtgtgttacgttctgacagggcggagcgccgacctggaactagaacgtgcggccgacgtccggtgggaggagcaggccgagatctccgggagctcccccatcctgagtattaccatatccgaggacgggtcgatgtccataaagaacgaggaggaggagcagactctaaccatcctcatccgtacgggcctgttggtgatatcgggcctcttcccagtaagcatacccataaccgccgccgcgtggtacctgtgggaagtcaagaagcagagagccggggtgctgtgggacgtgccgagcccgccgcccgtcggcaaggctgagctcgaggacggtgcttaccgcataaagcaaaagggcatactggggtactcccaaatcggcgcgggtgtgtacaaagagggtacctttcacaccatgtggcacgtgacccggggtgctgtccttatgcacaaggggaagaggatcgagccctcgtgggccgacgtgaagaaggacctcatttcctacggcgggggctggaagctggagggcgaatggaaggagggagaagaggtacaggtgctggcccttgagcccggcaagaacccccgagccgtgcagacgaagcccggactgtttaagaccaataccggcaccatcggggccgttagcctggacttcagtcccggcacttctggctcccccatcgtcgacaagaaagggaaggtggtgggcctctacggtaacggcgtcgtgacccgcagcggcacatacgtgtccgcaatcgcccagaccgagaaatccatcgaagacaacccggaaatcgaggacgacatcttccggaagaaaaggctgacgattatggacctgcatcccggggctggtaagaccaaacggtacctccccgccatcgttcgcgaggcgatcaagcgtgggctccggaccctgatcctggcgccgactagggtggtcgccgccgagatggaggaggccctccgcggcctgcccatccgctaccagacgcccgcgatccgggccgagcacaccggtcgcgagatcgtcgacctgatgtgccacgccaccttcaccatgaggctcctgagcccgatccgcgtgccgaactacaacctgataatcatggacgaggcccacttcacggaccccgcctcaattgccgctcggggctacatcagcacccgcgtggagatgggagaagccgccgggatctttatgaccgccacgccgcccggctccagagaccctttcccccagagcaacgcgccgatcatggacgaggagcgcgagatacccgagcggtcctggaacagtgggcacgagtgggtcacggacttcaagggtaagaccgtgtggttcgtgccctccatcaaggctggcaacgacatagccgcctgcctccgtaagaacggcaagaaggtcatacaactgagtaggaagaccttcgactccgagtacgtgaagacccgcacgaatgactgggacttcgtggtcaccaccgatataagcgagatgggagcgaacttcaaggccgagcgtgtgatcgacccccgcagatgcatgaagccagtaatcctgacggacggggaagaacgcgtcatcctcgccggccccatgccggtgacgcactccagcgccgcccagcggcgcggccgggtgggccgcaaccccaagaatgagaacgatcagtacatctacatgggggagcccctcgagaacgacgaagactgcgcgcattggaaggaggccaagatgctactcgacaatattaacacccccgagggcatcatcccgtccatgttcgagcccgagcgcgagaaagtggacgccatagacggcgagtaccggctacgcggagaggcccggaaaacattcgtggacctgatgcgccggggcgatctcccagtctggctagcctacagagtagcggccgagggaataaactacgccgaccggcgctggtgcttcgacggcgtgaagaacaaccagatcctggaggagaacgtcgaagtggagatctggacgaaggagggggagcggaagaagctcaagccgcgctggctggacgcccgaatctactcggatcccctcgccctaaaggagttcaaggagttcgcggccggccgcaaatcccttacgctgaaccttatcaccgagatgggtcggctacccaccttcatgactcaaaaagcccgcaacgctctggacaacctcgcggtgctgcacacggccgaggcaggcggccgggcctacaaccacgccctgtccgagctccccgagaccctggagaccctgctcctgcttaccctcctggccacggttaccggtggcatctttctgttcctcatgagcggcaagggtatcggcaagatgaccctcgggatgtgctgtatcatcaccgcaagcgtgctgctttggtatgcccagatccagccgcactggatcgctgcctccatcattttagagttcttcctgatcgttctccttatacccgagcccgagaaacagcgcactccgcaggacaatcagctgacgtacgtcgtgatcgcgatcctcacggtggtggccgccaccatggccaacgagatgggattcctcgagaagaccaagaaggacttcgggctgggcggcatcgctacgcagcagccggagagcaacatcctcgatatcgacctgcggcccgcgtccgcctggaccctgtacgccgtggccaccaccttcatcacccccatgttgcgccactccatcgagaactcgtccgtgaacgttagcctgacagctatcgcgaaccaggctaccgtgctgatggggctcggcaaggggtggcccctgtccaagatggacataggcgtgccgctgctcgccatcggctgctacagccaggtcaatcctatcaccctgacggccgcgttgctcctgctggtggcccactacgcaatcatcggccccggcctccaggccaaggcaacccgggaggcgcagaagcgcgctgcagccgggataatgaagaacccgacggtggacggcatcaccgtaatcgacttggacccgatcccctacgacccaaagtttgagaagcagcttggccaagtgatgctcctggtactgtgcgtcactcaggttctcatgatgcggacaacttgggccctgtgcgaggcactgaccttagccacaggccccatctccaccctgtgggaggggaatccgggccgcttctggaacactaccatcgccgtgagcatggccaacatctttcgaggctcctacttggccggggctggcctactgttcagcattatgaaaaacacggccaacacaagacgcggcaccggcaacaccggcgagacgctgggggagaagtggaagaaccggctcaacgccctaggcaagtccgagttccagatctacaagaagtccgggatccaggaggttgaccgcaccctcgccaaggagggcatcaagagaggggaaaccgaccatcacgcggtttcccgcggcagcgccaagctccgctggtttgtggaacgcaacctggtaacccccgagggcaaggtcatggacctggggtgcggccgcggcgggtggtcctactactgcggcgggctcaagaacgtgaaagaggtcaagggtctgacgaaaggagggcccggtcacgaggaacccatcccgatgtctacctacgggtggaatctggtcagactgcagtccggcgtggacgtcttcttcacgccacccgagaagtgcgacaccctgttatgcgacatcggcgaaagctcccccaacccaacggtggaggccggacggaccttgcgcgtcctaaacctggtcgagaactggctcaacaacaacacccagttttgcatcaaggtgctgaacccctacatgcccagcgtgatcgagaagatggaggccttacagcggaagtacgggggcgccttggtccggaaccccctcagccgaaattccacccacgagatgtactgggtcagcaacgcgtctggcaacatcgtgagctccgtcaacatgatctctcgcatgctgatcaaccggttcaccatgaggcataagaaggccacgtacgagcctgacgtggacctgggctccgggacgcggaatatagggatcgagagcgagacccccaacctcgacatcatcggcaagcgtatcgagaagatcaagcaagagcacgagacctcgtggcactacgaccaggaccatccctacaagacgtgggcctaccatgggtcctacgaaaccaaacagaccgggtccgcaagctcgatggtgaacggggtcgtgagactgctgacgaagccgtgggacgtcatccctatggttacgcagatggccatgaccgacaccacccccttcggccagcagcgagtgttcaaagagaaggttgacacgcgcacccaggaacccaaggagggcaccaagaaacttatgaaaatcaccgcggagtggctgtggaaggagctggggaagaagaagacgccccgcatgtgcactcgcgaggagttcacccggaaggtgcgctccaacgctgccctcggcgcaatcttcaccgacgagaacaagtggaagtccgcccgtgaggccgtggaggactctgggttctgggagctggtcgacaaggagcgcaatctgcacctcgaggggaagtgcgaaacgtgcgtttacaacatgatggggaaaagagagaagaagctgggcgagttcggcaaagccaaggggtcccgcgcaatctggtacatgtggctgggcgcccggttcctcgagttcgaggcgctcgggtttctgaacgaggaccactggttcagtcgcgaaaactcactgagcggagtggagggggagggcctacacaagctgggctacatcctccgcgatgtcagcaagaaggaaggcggggctatgtacgccgacgacacagccgggtgggacacccgcatcaccctggaggacctgaagaacgaggagatggtgacgaaccacatggagggcgaacacaagaagctcgcggaggcgatcttcaagctgacctaccagaacaaggtcgtgcgggtacaacgccccacctcccgggggaccgtgatggacatcatcagcaggcgggaccagcggggctccggccaggtcgttacttacgggctgaacaccttcaccaacatggaggcccaactaatacgacagatggagggagagggcgtattcaagagcatccaacagctcacggccaccgaagagatcgcagtcaagaactggctggcccgcgtgggccgcgagcggctcagccgcatggctatcagcggcgatgactgtgtggtaaagccactggacgatcggtttgcctccgcgctgacagcactcaatgacatggggaaagtgaggaaggacatccagcagtgggaacctagcagaggctggaacgactggacacaggtgccattctgctcccaccacttccacgaattaatcatgaaggacgggagggtcctggtggtgccctgccggaaccaggacgagctcatcggtcgcgcccggatcagccagggggcgggctggtctctgcgcgagaccgcttgtctaggcaagtcctatgcgcagatgtggtcgcttatgtacttccatcggcgtgacctgcgcctcgccgccaacgcgatatgcagcgccgtcccctcacactgggtgcccactagcagaaccacatggagtatccacgccacccatgagtggatgaccacggaggacatgctcacggtttggaaccgggtctggatccaggagaacccctggatcgaggacaagaccccagtcgagagttgggaggaaatcccctacctaggaaagcgcgaggaccaatggtgtggcagcctgatcgggctcacctctcgggccacgtgggctaagaacatccaaactgccatcaaccaagtgagaagcctgatcggaaacgaggagtacaccgattacatgccctccatgaagcgtttccgccgcgaggaggaggaggccggggtcctgtggtga

SEQ ID NO: 25591 - RNA, 9876 nt, synthetic construct
  misc_feature 1..9876: note = derived and/or modified CDS sequence (opt11) from DENV-2__DQ645553__SS-prME
  source 1..9876: mol_type = other RNA
accgccggcgtgatcatcatgatgatccccaccgtcgtggcattccaccttaccaccaggaacggggaaccccatatgatcgtttcgcggcaagaaaaaggcaagtccctcctgttcaagaccgagaacggggtcaacatgtgtaccctcatggcgatggatctcggcgagctgtgcgaggacaccatcacctacaactgccccctgctacggcagaacgagccggaggacatagactgctggtgcaacagcaccagcacttgggtgacatacgggacctgcaccgccaccggcgagcacagacgagagaagaggagcgtggccctggtgccccacgtgggcatggggctggagacccggaccgagacctggatgtccagcgagggagcctggaagcacgcacagagaatagagacctgggtgttgcgccaccccgggtttacaataatggcggccatcctggcctacaccataggtaccacatacttccagagggtacttatcttcatcctcttgacggccgtagcgcctagtatgactatgcgctgtattggtataagcaatcgcgacttcgtggagggcgtgtcaggcggaagctgggtcgacatcgtgctggagcacggctcctgcgtcaccaccatggccaagaacaagccaacgctcgacttcgagctgatcaagactgaggctaaacacccggccaccctgaggaagtactgcatcgaggccaaactgacaaatacgaccacagcaagccggtgcccgacccagggggagccgagtctgaacgaggagcaggacaagaggtttgtgtgcaagcacagtatggtggacaggggttggggcaacgggtgtggcctgttcggtaagggcgggatcgtcacgtgtgcgatgttcacgtgcaagaagaacatggagggcaaagtagtgcagccagagaacctcgagtacaccatagtcatcacgccccacagcggcgaagagaacgccgtggggaatgacaccgggaagcatgggaaggagatcaaggtgaccccccagtcgtccattaccgaggccgagctgaccggctatgggaccgtaacgatggagtgctcaccacgcaccggcctggactttaacgagatggtgctcctgcagatggaggacaaagcctggctagtgcatcgccagtggttcctcgacctgcccctgccctggctgccgggcgctgacacccaggggtccaactggatacagaaggagacccttgttacattcaaaaacccacacgccaaaaagcaggacgtagtcgtgttaggctcacaggaaggtgccatgcacaccgcactcaccggtgccaccgagatccagatgagcagcgggaacctgctgttcacgggacatctcaagtgccgcctacggatggataaacttcagctgaaaggcatgagctactccatgtgcactgggaaattcaaggtggttaaggagatcgcggaaacccaacacggaaccatagtaatccgcgtgcagtatgagggggacggcagcccatgcaagattcccttcgagatcatggacctggaaaagcgccacgtcctgggtcgcctcataaccgtgaacccgatagtgaccgagaaggactcccccgtcaacattgaggccgagccacccttcggggacagctacatcatcataggcgtggagccggggcagctaaagttgtcgtggtttaagaaaggctcgtcaatcggtcagatgtttgaaacaaccatgcgcggagccaaaaggatggcaatcctcggcgacacggcctgggacttcgggtcgcccggcggggtgttcacctctattggcaaggcactgcaccaggtcttcggggccatctacggcgccgcattcagcggcgtgtcctggaccatgaagatcctgatcggggtggtgatcacctggatcggcatgaactcacgctccaccagcctctccgtaagcctggtgttagtcggtgtggtgacattgtacctgggagtcatggtccaagcggactccgggtgcgtcgtaagctggaaaaacaaggagctgaagtgcggctccggaatcttcattaccgataacgtgcacacatggacggagcaatacaagtttcagcccgagtccccctccaagcttgcctccgcgatacagaaggctcacgaggaggggatctgcgggatccggagtgtgacccgcctcgaaaatctgatgtggaagcagatcactcctgagctgaaccacattctctccgaaaacgaagtcaagcttacgattatgactggggacatcaagggcatcatgcaagccgggaagcgaagcctgcgcccacagcccaccgaactgaagtactcctggaaagcttggggcaaggccaagatgttaagcaccgagttacacaaccacacatttctcatcgacggcccggaaacggccgaatgccccaatacgaaccgggcctggaacagcctggaggtggaagactacgggttcggcgttttcaccaccaacatctggttaaagctcaaggagcgccaggacgtcttttgcgatagcaagcttatgtccgccgcgattaaagacaaccgggctgtgcacgccgacatggggtattggattgagtctgccctgaacgatacatggaagatcgagaaggccagtttcatagaggtaaagtcgtgccattggcctaagtcccacacactttggagcaacggcgtgctcgagtctgagatgattattcccaagaacttcgcgggccctgtcagccagcacaactaccgacccgggtaccacacgcagacagccggcccctggcacttggggaagctcgagatggacttcgatttctgcgagggtaccacagtggtcgtcactgaggactgcgggaatcgagggcccagcctgcgtacgaccacggcctccgggaagctgatcaccgagtggtgctgccgtagttgtaccctcccgcccctgcgctatcgcggagaagatggctgctggtacgggatggagatccggcccctcaaggaaaaggaggagaatcttgtgaatagcctggtgaccgccggccacgggcagatagacaacttcagcctgggtgtgctagggatggcgcttttcctggaggagatgctcagaacgcgcgttgggacaaagcacgccatcctactggtcgccgtctcattcgtgaccctgatcaccggcaacatgtcgttccgggacctagggcgagtaatggtgatggtgggcgccacaatgactgacgatatcggcatgggcgtaacctacttggccttattggcagcattcaaggtgcgccccacgttcgccgctggcctgctgttgagaaagctgacgtccaaggagctcatgatgacaaccatagggatcgtcctgcttagccagtccactatccccgagacaatcttggagctgaccgacgccctggccctcggaatgatggtactgaaaatcgtgcgcaacatggagaaataccagcttgccgtcaccattatggccatcctctgcgtgcccaacgccgtcatcctccagaacgcctggaaggtcagctgcaccatcctggcggtggtgtccgtcagccccctcctgctaacgagctcgcagcagaaagctgactggataccgttggcactgaccatcaaggggctgaatcctaccgcaatattcttaaccactctatcccggaccagcaagaagcgctcctggcccctaaatgaagcgatcatggcggtgggcatggtaagcattctcgcctccagcctgctaaagaatgacatccccatgacagggcccttagtcgccggcgggctgctgaccgtgtgctatgtgctcaccgggaggagcgctgatcttgagctggagcgcgcggccgacgtccggtgggaggagcaggccgagatttcgggcagctccccgatcttaagcatcaccatctccgaggacggtagcatgtctatcaaaaacgaagaggaggagcaaactttaacaatcctgatccgcacgggcctgctagtgatcagcgggctgttccccgtttccatccccatcactgccgcagcgtggtatctctgggaggtcaagaagcagagggccggggtactgtgggacgtgcccagtcctccgccggtcggcaaggccgagctggaggacggggcctaccgtatcaagcagaagggtatcctcgggtattcccagataggagccggcgtgtataaggaggggaccttccataccatgtggcacgtcacgcggggggcggtcttgatgcacaaggggaagcgcattgaaccgtcatgggccgatgtcaagaaagatctgatatcctacggcggtggttggaaacttgagggtgagtggaaagaaggtgaggaggtgcaggtccttgcactggagcccggcaaaaatccccgggctgtgcagaccaagccaggcctattcaagaccaacacaggcaccataggggccgtgagcctggacttctcccccggcacgagtgggtcccccatcgtcgacaagaaaggcaaggtggtgggcctctatggaaacggcgtcgtgacccgcagcgggacatacgtgagtgcgattgcccaaaccgagaagtccatcgaggataaccccgaaatcgaggacgatatcttccggaagaaacgcctcacgattatggacctccaccccggggcgggaaagaccaagcggtacctgccggctatcgtccgggaggcgatcaagcgggggctacgaaccctcatactggcccccacccgcgtggtggccgccgagatggaggaggccctgcgcggcctccccatacgctatcagacgcccgcgatccgggccgagcacaccgggagggagatcgtcgatctgatgtgtcacgccacattcaccatgagactcctcagccccatcagagtgcccaactataacctgataatcatggacgaagcccatttcacggaccccgcttccatagcagcccggggctacatcagtacccgcgtggagatgggggaggctgccgggatcttcatgaccgccacgccacccggctctagggatccctttccccagagcaatgcacccatcatggacgaggagagggagatacccgagcgatcttggaattctgggcacgagtgggtcactgactttaagggcaaaaccgtatggttcgtgcccagtatcaaagccgggaacgacatcgcggcctgcctgcgcaagaacggcaagaaggtcatccagctctcccggaagaccttcgactccgagtacgtgaaaacccgcactaatgactgggacttcgttgtaaccacggacatcagcgagatgggcgccaacttcaaagccgagcgagtcatcgacccccgccggtgcatgaagcccgtgatactgactgacggagaggagcgagtgatcctggctggcccaatgcccgtgacgcactccagcgccgcgcaacgaagggggcgggtcggccgcaacccaaagaacgagaacgaccagtacatctacatgggggagcccctcgagaatgacgaggactgcgcgcactggaaggaagcaaagatgctgctcgacaatatcaacacgccggaaggaattatcccctccatgttcgagccggagagagagaaggtggacgccatcgacggcgagtaccggcttcgcggggaggcccggaaaaccttcgtagacctgatgagacggggggaccttccggtctggctcgcataccgcgttgcggctgaagggatcaactacgcagatcggcgctggtgttttgacggcgtgaagaacaaccagatattagaggagaacgtcgaagtggagatatggaccaaggagggggagcgcaagaagctgaagccccgctggcttgacgcccggatctatagcgaccccctggccctaaaggagttcaaagaattcgcggcggggagaaaatccctcacgctgaacctgatcacggagatgggtcggctccccaccttcatgacccagaaggccagaaacgcactggacaacctggcggtactccacacggccgaggccgggggccgggcttataaccacgcccttagcgagctgcctgaaaccctggagaccctgctgctcttaacccttctcgcgacggtcaccgggggcatcttcctgttcctgatgtcgggcaaggggatcggcaagatgaccctcgggatgtgctgcattatcaccgcctcggtgctgctgtggtatgcccaaatccagcctcactggatcgccgcatccatcatcttggaatttttcttgatcgtgttgctgatcccagagccggagaaacagcgcaccccgcaagacaaccagcttacgtacgtggtaattgcgattctcaccgtggtagccgccaccatggccaatgagatgggctttctcgagaagactaagaaggactttggcctaggcgggattgctacgcagcagcctgagagtaatatcctggacatagacctccggccagcgtctgcctggaccctctatgcggtggcgactacctttattactcccatgctgcgccatagcatagagaacagctccgtgaacgtcagtctcacggcaatcgcgaatcaagccactgtgctgatggggttaggcaaggggtggccgctatccaagatggacataggcgtgcccctgttagccataggatgttattcacaggtcaaccccatcaccctaacggccgcgctgttgctcctggtggctcattacgccatcatcggccccggcctgcaggccaaagcgacccgcgaggcccagaaacgcgccgccgccgggattatgaagaacccgaccgtggacggcatcacagtcatagacctcgatcccatcccgtacgaccccaagttcgagaagcaattggggcaggtgatgctgctcgtgctgtgcgtcacccaggtgctaatgatgcggaccacgtgggccctctgcgaggcgctgactctagccacaggaccgatcagcacattgtgggaggggaaccccggccgtttctggaataccaccatcgcagttagcatggctaacattttcaggggctcctaccttgcgggggcgggcttactcttcagtatcatgaagaacacggccaacacccggcgcgggacgggcaacaccggtgaaaccctgggggagaagtggaaaaatcgcctaaacgccctcggcaagagcgaattccaaatctataaaaagagcgggattcaggaggtggaccgcaccctggccaaggagggcatcaagcgcggggaaaccgatcaccacgcggtcagtaggggaagcgcaaaactgcggtggttcgtagagcggaaccttgtcacccccgagggcaaggtgatggacctggggtgcggccgcggcgggtggtcctactactgcggcgggctgaaaaacgtgaaggaagtcaagggactcacgaagggcgggcccgggcacgaagagccgatcccgatgtctacatacggctggaacctggtgcgcctacagtccggggtggacgtcttcttcacgccgcccgagaaatgcgacacactactttgcgacatcggcgagagctccccgaacccaacggtcgaggccggtcggaccctgcgcgtgctcaatctggttgagaactggctaaacaacaacacccagttctgcattaaggtgctcaacccctacatgccgagcgttatagagaagatggaggcgctgcagaggaagtacgggggcgccctggtgcgtaaccccttatcccggaatagtacccatgagatgtactgggtgagcaatgctagcgggaacatcgtgagctccgtcaatatgataagccgcatgctcatcaaccggttcaccatgcgccacaaaaaggcaacgtacgagcccgacgtggacctcggctccgggacccgaaatataggtatcgagtccgagactcccaacttagacatcattggcaagcgaatagaaaagatcaagcaggagcacgagacgtcctggcactacgaccaggaccacccgtacaaaacgtgggcatatcacggcagctacgagaccaagcagaccggctccgccagctcgatggttaacggggtcgtgcgtcttcttaccaagccctgggacgtcatccccatggtgacccagatggccatgaccgacacaacgccattcgggcagcagcgagtattcaaggagaaggtggatacgcgcacacaggagccgaaggagggcacaaagaagttgatgaaaatcaccgcggagtggctctggaaggaactggggaagaaaaaaacgccccgtatgtgtacccgcgaggagttcacccggaaggtgcgctctaatgctgccctgggcgccatcttcaccgacgagaacaagtggaagtctgcacgggaagcggtcgaggacagcgggttttgggaactcgtcgacaaggagcgaaacctacacctggagggcaagtgcgagacgtgcgtgtacaatatgatggggaaaagggagaaaaagctcggcgagttcggcaaggccaaagggtcccgcgctatttggtacatgtggctgggtgcgcggttcctggagttcgaggccctcggctttctgaatgaggaccattggttcagtcgggaaaactccctcagcggcgtggagggtgaaggcctccacaagctgggctacatcctgcgcgacgtcagcaagaaggagggcggggccatgtacgcagacgacaccgccgggtgggacacgcgcatcacactcgaggatctgaagaacgaggagatggtgacgaaccatatggagggcgagcacaagaagctagccgaagcgatctttaagctcacctaccagaacaaggtggtgcgggtccagaggcccactcccagagggaccgtgatggacatcatctccaggcgggaccaacgtggtagcgggcaggtcgtgacctacggactgaacacctttacaaacatggaggcccagctgatccggcagatggagggtgagggggtgtttaaaagcattcagcagttaacagccacggaggagatagccgtcaagaactggctggccagggtggggcgcgagagactgagcagaatggcgatatccggcgacgactgtgtcgtcaagccattggacgaccggttcgccagcgccctcacggcattgaacgacatggggaaggttagaaaagatatccaacagtgggaaccctcccgggggtggaacgattggacgcaggtgccattctgctcccaccacttccacgagctcataatgaaggacgggcgcgtcttggtggtgccctgtcggaaccaagacgagctgatcgggcgcgctcggatctcacagggggcgggctggagcttgcgcgaaacagcctgcctgggcaagtcctatgcccagatgtggtccctgatgtatttccaccggcgagatctcagactagccgccaacgcgatctgttccgccgttccgagtcactgggtgcccacgtcccgcacaacctggtctatccacgccacgcacgagtggatgactacggaggacatgttggccgtctggaaccgggtgtggatccaggagaacccatggattgaggataaaacgcccgtggagtcatgggaggagatcccgtacctcgggaagcgcgaggaccaatggtgtggcagcctgatcgggcttacctctcgggcgacctgggcaaagaacatccaaaccgccatcaaccaggttcgcagtctcatcggaaacgaagagtacaccgactacatgcccagtatgaagcggttccgccgcgaggaagaagaggcaggggtcttgtggtga

SEQ ID NO: 25592 - RNA, 9876 nt, synthetic construct
  misc_feature 1..9876: note = derived and/or modified CDS sequence (opt11) from DENV-2__DQ645554__SS-prME
  source 1..9876: mol_type = other RNA
accgccggcgtaataatcatgatgatccctaccgtggtcgccttccacttgactacacgcaacggagagcctcacatgattgtgagccgtcaggaaaagggcaagagcctcctgttcaagaccgagaatggcgtaaatatgtgcacccttatggcgatggacctcggcgagctgtgcgaggataccatcacatacaactgcccacttctccggcagaacgagcccgaggacatcgactgctggtgcaacagcacctcgacctgggtcacctatgggacgtgcactgccaccggcgaacaccggcgcgagaagcggagcgtggccctggtgccccacgtgggtatggggttagagacccggaccgagacctggatgtccagcgagggcgcctggaagcacgcccagcggattgagacctgggtgctccgccatcctggcttcaccatcatggccgccatcctggcctacactatcggaaccacctatttccagcgggtccttatctttatcttactgacggccgtggcgccctctatgaccatgagatgcatagggatcagcaatcgggacttcgttgaaggagtctccggcgggagctgggtggacattgtgctcgagcacggaagctgcgtgacaaccatggctaagaataagccgacgctcgacttcgaactgatcaagaccgaagccaagcaccctgccaccctgcgcaagtactgcatagaggcgaaactaaccaatacaaccaccgcgagccggtgcccgacccagggggaaccctccctgaacgaggagcaggataaacggtttgtatgcaaacacagcatggtggaccggggctggggcaacgggtgcggcctcttcgggaagggcggcatcgtaacttgcgccatgttcacgtgtaaaaagaacatggagggcaaggtggtgcaacccgagaacctcgagtatactatcgtcatcacgcctcactccggtgaagagaacgccgtgggaaacgacacgggcaagcatggcaaggagataaaggtgaccccgcagagctccatcaccgaggcggagctgaccggctacgggacagtcacgatggagtgcagcccccgcacaggcctggatttcaacgaaatggtgctgctgcagatggaggacaaggcctggctggtccatcggcagtggttcctcgacctgccgctgccttggctccccggcgcggatacccaaggttccaattggatccaaaaggaaacactggtcacgttcaagaatccccacgccaaaaagcaagacgtggttgttctgggcagccaggagggtgccatgcacacggcactcacaggagcgaccgagatacaaatgagttccggaaacctgctgttcacaggacacctcaagtgccgcctgcgtatggacaagctgcagctcaagggaatgagctattctatgtgcaccggtaagttcaaggtggtcaaggagattgcggaaacccagcacggcaccatcgtgattagagttcagtacgagggggacggcagcccctgcaaaatccccttcgagataatggaccttgaaaagcgtcacgtgctggggcgcctaatcacggtgaacccgatagtgacggagaaggacagccccgtcaacatcgaggccgagccgcccttcggggactcatacatcattattggcgtggagccgggccagctgaagctgtcctggttcaagaaggggagctccatcgggcagatgttcgagaccaccatgcggggcgcaaagcgtatggcaatactcggggacaccgcctgggacttcgggagcctaggcggagttttcacgtccatcggcaaggcgctacaccaagtattcggggccatttacggcgcggcattctcgggcgtgtcctggactatgaagatcctcatcggggtcgtcatcacctggatcggcatgaacagccgttccacgtctctatccgttagcctcgtgctggtcggggtcgtgactctgtacctgggcgtcatggtgcaggcggattccgggtgcgtggtcagttggaagaacaaggagctgaagtgcggctccggaatcttcattacggacaacgtacacacctggacggagcagtataagtttcagcccgagtcgcccagcaaactcgcctccgccatccagaaagcccatgaggaggggatctgcggcatccggagcgtgacccgtttggagaaccttatgtggaagcaaataacgcctgagcttaaccatatcctgtccgagaacgaggtcaagctgacaatcatgacgggggacatcaaggggattatgcaggccgggaagcgaagcctccgcccgcaacccaccgagctgaagtattcctggaaggcgtggggaaaggccaagatgctgagcaccgagctccataaccataccttcctgatcgatggtcctgagacggccgagtgtccgaacaccaatagagcatggaactcgctagaggtcgaagattacggatttggtgtctttaccactaacatctggctcaagctaaaggagaggcaggacgtcttctgcgatagcaagctgatgagcgcagcgatcaaggacaaccgggccgttcatgccgacatgggatactggatcgaaagcgccctaaacgatacgtggaagatcgagaaagcctccttcatagaagttaagtcgtgccactggcccaagtcacacaccctgtggagcaacggcgtgcttgagagcgagatgatcatacccaagaacttcgcgggccccgtgtcgcagcataactatcgcccggggtaccacacccagaccgcaggcccctggcacctaggaaagctggagatggacttcgacttctgtgagggaacgacggtggtcgtgaccgaggactgcgggaaccgtggccccagcctcagaaccactactgcctccggtaaactgatcaccgagtggtgctgccggagctgcaccctgccccctttaaggtaccgcggggaggacggctgctggtatgggatggagatccgccccctcaaggaaaaggaggagaatcttgtgaactccctggtcaccgcaggccatgggcagatcgacaacttcagcctcggcgttctgggcatggcgttgttcttagaagagatgttgcggacaagggtgggtactaagcacgccatcctactcgtagccgtaagtttcgtaacactgatcaccggcaacatgtcttttcgggacttggggagagtgatggttatggtaggcgcgacgatgaccgacgatatcgggatgggtgttacctatcttgctctgcttgcggccttcaaggtccgccccaccttcgcggctggcctcctgctgaggaagctcacgtccaaggagctgatgatgaccaccattgggatcgtcctgctctcacagtccacgatccctgagacgattctggagctaacggatgctctcgcgctaggcatgatggtgctgaagatagtgcgtaacatggagaagtatcagctggccgtcaccatcatggctatactctgcgtgccgaacgccgtgatactgcagaacgcctggaaggtgagctgcacgatactggcggtcgtgtcggtgagcccactgctgctcacgtccagccagcagaaggcagactggatcccccttgccctcacgatcaagggtctcaatccaactgccatcttcctgaccactctctcccgaaccagcaagaagcgctcttggccgctaaacgaagcgatcatggccgtgggcatggtgagcatactggcgtcctcgctgctcaagaacgacatccccatgactggcccccttgtcgccgggggcctgctcacagtgtgctatgtcctgacggggcgctccgccgacctggagctagagcgcgcggccgacgtcagatgggaggagcaggccgagatatccggctcttcccctatcctgagcataaccatctccgaagacgggagcatgagcataaagaatgaggaggaggagcagaccctgaccattcttatccgcacgggtcttctggtgatctcaggcctcttccccgtgtccatccccatcactgctgccgcatggtacctgtgggaggtcaagaagcagcgagcaggggtgttgtgggacgtgccctccccgccgcccgtcgggaaggccgagctcgaggacggggcctaccgcatcaaacagaagggtatcctagggtactcccagatcggggccggcgtgtacaaagaaggcactttccataccatgtggcacgtgacccggggcgctgtcctcatgcacaaggggaaaaggatcgagcccagctgggccgacgtgaaaaaggacctaatctcctacggaggcggctggaagctcgagggcgagtggaaggagggggaagaggttcaggtgttggccttagagcccggcaaaaacccccgggctgtccagaccaagcccgggctgttcaaaactaacaccggcacaatcggggctgtgagcctggacttttcccctgggacgagcggctcccccatcgtagacaagaaggggaaagtagttggcctctacggtaacggcgtcgtgacacgaagcggcacctacgtttccgcgatcgctcagaccgagaagtcaatcgaggacaacccggagatagaggacgacatctttcggaagaaacgcctgacgatcatggacctgcaccccggggcaggcaagaccaagcggtacctcccagcgattgtccgtgaagctataaaacgcgggctccgcaccctgatcctagccccgacccgggttgttgccgccgagatggaggaagccctcagaggcctgcccatacgctatcaaacacctgcgatcagagccgaacacaccgggcgcgagatcgtcgaccttatgtgtcacgccaccttcaccatgcggctcctgagccccatccgagtgccgaactataacctgatcatcatggatgaagctcacttcacggaccccgccagcatcgcagcacggggttatattagcactcgcgtagagatgggcgaggccgccgggatattcatgacggccacgccgccgggcagccgggacccctttccccaaagcaacgcgcccatcatggacgaggagcgagagatccccgagcgttcgtggaactccggtcacgagtgggtaacggatttcaaagggaagacggtgtggttcgtaccgagcataaaggctggcaacgacatcgccgcgtgcctccgtaagaacggcaagaaggtcatccagctcagccggaagaccttcgactccgagtacgtgaagactcgcacgaacgactgggacttcgtggtcacgaccgatatcagcgaaatgggcgcgaatttcaaggccgaacgtgtgatcgatccccgtaggtgcatgaagcccgttatcctgactgacggcgaggaacgcgtgatcctcgccggcccgatgccggtgacacactcctcggccgcccagcggcgcgggcgggtcggcagaaatcctaaaaacgagaacgaccaatacatctacatgggggaaccattggagaacgacgaggactgcgcgcattggaaggaggccaaaatgctgctcgacaacatcaatacgcctgagggcattatcccgtccatgtttgagcccgagcgggagaaggttgacgcgatcgacggtgagtaccgactgcggggagaggcacgtaagacgttcgtcgatcttatgcgcaggggagacttacctgtctggctggcctacagggtggcggccgagggaatcaactacgcagatcggcggtggtgcttcgatggcgtgaaaaacaaccagatcctggaggagaacgtagaggtagagatatggaccaaggagggggagcggaagaagctcaagccgcgatggctagacgcccggatctacagcgaccccctggccctcaaggagttcaaggagttcgcggccggccgcaagtccctgacgttaaaccttatcaccgagatgggcaggctaccaacgttcatgacgcagaaagctcgcaacgccctggacaacctcgccgttctacacacggccgaggctgggggacgggcctacaaccatgccctgagcgagctccctgagaccctagagaccctgctcctgctaacgctcctggcgactgtcaccggaggcatcttcctatttttgatgtccggcaaggggatcggcaagatgaccttggggatgtgctgcataatcaccgccagcgttctactctggtatgcccagattcagccccactggatcgccgcctctatcatcctggagttcttcttgatcgtgttgctgatccccgaaccggagaagcagcggacgccccaggacaaccagctgacatatgtcgtcattgcgatccttacggttgtcgccgctacgatggccaacgagatgggcttcctggagaagaccaagaaggacttcgggctaggtggcatcgcaacgcaacaaccagagagcaacatactcgacatcgacctgcggcccgcaagcgcctggacactatatgccgtggcaaccacctttatcacgccaatgctcaggcattctatcgaaaactcgagtgttaatgtcagcctgaccgccatcgcaaaccaagccaccgtgctgatggggctcgggaaaggctggccgctgagtaagatggacataggcgtgccgctgctcgcgatcgggtgctattcacaggtcaaccccatcactctgacggccgcgctgctcctgctcgtggcgcactatgccatcatcggccccggcctccaggccaaggccacgcgggaggcacaaaagcgggccgccgctgggatcatgaagaaccccacagtagatggcatcaccgtcattgacctggaccccattccatatgatcccaagttcgagaagcaactgggacaggttatgcttctggtgctgtgcgtcacccaggtgctgatgatgcgcactacctgggccctgtgtgaagccctgactctcgccaccggacccatttccaccctgtgggagggaaacccgggccgattctggaacaccaccattgcagtgagcatggccaacatcttccgcggcagctatctggccggggcgggcctcctgttctctattatgaaaaatacggccaataccaggcgcgggacgggcaacaccggcgagacgctgggggagaagtggaaaaacaggctcaacgccctgggcaaatccgagttccaaatctacaagaaatccgggatccaggaggtcgacaggaccctcgccaaggaggggataaagcgcggtgagaccgaccatcacgcggtgagtcgcggctccgccaagctccgatggttcgtcgagcgaaacctagtcacccccgagggcaaggtgatggacctggggtgcggcagaggcgggtggtcgtactactgtggcgggctcaagaacgtgaaggaagtcaaagggctgacaaagggcgggcccgggcacgaggagcccatccctatgagcacatacggctggaacctagtacgtctccagagcggcgttgatgtttttttcacaccgccagagaagtgtgacaccctactgtgtgatatcggcgagagctcccctaacccgaccgtggaggctggcagaaccctccgcgtgctgaatctggtcgagaactggctcaacaacaatacccagttttgcatcaaggtgctgaacccatatatgccttcagtgatcgagaaaatggaggccctgcagcggaaatatgggggcgccctggttagaaacccactcagccgtaattcgacccacgagatgtattgggttagcaacgcatccggcaacattgtctcatccgttaatatgatctcgcgcatgctgatcaatcggttcaccatgagacacaagaaagccacgtacgagcccgacgtggatctcggctccgggacccgcaatataggcatcgagagcgagacccccaacctcgacataatcggaaagcgaattgaaaagatcaagcaggagcacgagactagttggcactacgaccaggaccacccctacaagacgtgggcttaccacgggagctacgagaccaagcagaccggctctgcctcgtccatggtgaatggggtcgtgcggttactaacaaagccgtgggacgttatcccaatggtgacgcaaatggcaatgacagacacaacacccttcggccagcagcgggtgtttaaagagaaggtcgatacgcgcacacaggagcccaaggaaggcaccaagaagctcatgaagatcactgcggagtggttatggaaagagcttgggaagaaaaagactcctagaatgtgcacccgtgaggaattcacacggaaggtgcgatcaaacgctgctctcggcgccatctttacagacgagaacaagtggaagtccgccagggaggcagtcgaggacagcgggttctgggagctcgtcgataaggagcgcaacctacaccttgagggaaagtgtgagacctgtgtatacaatatgatgggcaagcgggagaagaagctgggcgagtttggcaaggctaaaggatcccgcgcaatttggtatatgtggctgggtgccaggttcctcgaatttgaagcgctgggcttcctgaacgaggaccactggttcagccgcgagaactccctcagcggcgtggagggggagggcctgcataagctgggctacatcctccgggacgtcagtaagaaggagggcggggccatgtacgccgacgacacagcggggtgggacacccgcatcacccttgaggacctgaaaaacgaggagatggtgacgaaccacatggagggtgagcacaagaagttggctgaggctatctttaagctaacataccagaacaaggtggtacgggttcagcgccccactccacgggggacggtgatggacatcatctcccgacgggaccagcgcggcagcggccaggtcgttacatacgggctgaatacctttacgaatatggaagcccagctcatccggcaaatggagggagaaggggtattcaagtccatacagcaactgactgccacggaggagatcgccgtcaaaaactggctggcgcgagtgggccgggaacggttaagccgcatggcgatctccggcgacgactgcgtggttaagcccctcgacgaccggttcgccagcgcactgaccgctctcaacgatatggggaaaatccgcaaggacatccagcagtgggagccaagccggggctggaacgattggacacaagtgccattctgcagccaccatttccacgagcttatcatgaaggatgggcgcgtactggtcgtaccctgccggaaccaggatgagctcatcggccgggcgcggatatcccagggggcaggctggagcctacgcgagaccgcctgcctgggtaagtcctatgctcagatgtggagcctgatgtatttccaccggcgcgatctgcggctagccgcaaacgctatttgctccgccgtgccgtcccactgggtcccgacttccagaaccacctggagcatccacgccacccacgaatggatgaccacggaggacatgctcactgtgtggaaccgggtctggatccaggagaatccctggatcgaggataagacccccgtcgagtcctgggaagagatcccctacttagggaagcgcgaggaccagtggtgcggcagcctaatagggctcactagccgggctacctgggcgaaaaacatacagacagcgatcaatcaagtgcgttccttaatcggcaatgaggagtacaccgactacatgccgagcatgaagcggtttcgccgtgaagaggaggaggcgggggtgctgtggtaa

SEQ ID NO: 25593 - RNA, 9876 nt, synthetic construct
  misc_feature 1..9876: note = derived and/or modified CDS sequence (opt11) from DENV-2__DQ645555__SS-prME
  source 1..9876: mol_type = other RNA
acagccggggtgatcatcatgatgatccctaccgtggtggccttccacttaacgacccggaacggggagcctcacatgatcgtgagtcggcaagagaagggcaagagcctcctgttcaagaccgagaacggggtcaacatgtgtaccctgatggcgatggatctcggggagttgtgcgaggacaccatcacgtacaactgccccctgctccgccagaacgaacccgaggacatcgactgctggtgtaactctacctctacatgggtgacctacgggacctgcaccgccaccggcgagcacaggcgcgagaagcgaagcgtggccctcgtcccacacgtaggtatgggtctggagacccggacagagacctggatgtccagccagggagcctggaaacacgcccagcggatcgagacctgggtactcaggcatcccggtttcacgatcatggcggcgatcctcgcttacaccatcgggaccacctatttccagcgggttttaatcttcatcctcctgacggccgtggcgccatccatgaccatgcggtgtattgggatcagcaaccgggactttgtcgaaggagtctccggtgggtcatgggttgacatcgtgttggagcatgggtcttgcgtaaccacgatggccaagaacaagccgacgctggatttcgagctgatcaagaccgaagccaaacaccccgccaccctgcgtaagtattgcatcgaagccaagctcactaacaccacaactgcaagccggtgcccaacccaaggggaaccctccctgaatgaggagcaggacaagcgcttcgtgtgcaagcacagcatggtggaccggggctggggaaacgggtgtggcctgttcgggaagggcgggatcgtcacgtgcgccatgttcacatgcaagaagaatatggaaggtaaggtggtgcagccggagaacctagagtacacgattgtcatcacgccgcactccggcgaggagaacgcggttgggaacgacactggaaagcacgggaaggagataaaggtaacaccgcaaagttccatcaccgaggccgagcttaccggctacgggaccgtcacgatggagtgtagccctcgcaccggcctggacttcaatgagatggtcctacttcagatggaggacaaagcatggttggttcaccggcagtggttcctggacttgccgcttccatggttacccggcgcagacacccagggatcgaattggatacagaaggagaccctggtcacgttcaagaatccgcacgccaaaaagcaggacgtggttgtgcttggcagccaggagggagcgatgcacaccgccctcaccggcgccaccgagatccagatgtcgtccgggaacctgctgttcacgggacacctgaagtgccgccttcggatggacaagctgcagctaaagggaatgagctacagcatgtgcacgggcaagttcaaagtggtaaaggaaatcgcggagactcagcacggcaccatcgttatccgcgtacaatacgagggggacgggagcccctgcaaaattccattcgagatcatggacctggagaagcggcatgtcctaggccgcctcatcacggtcaacccgatcgtgaccgagaaggactcccccgtgaacatcgaggccgaaccgcccttcggggattcctacatcatcatcggagttgagccggggcagctcaaactgtcttggttcaagaagggcagctccatcgggcagatgttcgaaaccaccatgcgcggggcaaaacggatggcgatactcggcgatactgcctgggacttcggtagcctgggcggggttttcacctccatcggaaaagctctgcaccaggtcttcggcgcgatctacggcgccgccttctccggcgtgagctggaccatgaagatcttaataggggtggttatcacctggatcggcatgaacagccgctccaccagcttatccgtcagcctggtactggtcggggtggtgaccctctacctgggcgtcatggtgcaggccgactccgggtgcgtggtctcctggaagaacaaggagctgaaatgcggcagtggaatctttatcaccgacaacgtgcacacctggacggagcagtacaagttccagcccgagtcccccagcaaattggcctccgccatccagaaggcccacgaggaaggcatctgcggcatcaggagcgtgacacgactcgagaacctcatgtggaagcagattacccccgagcttaaccacatcctgagtgagaatgaggtcaagctgaccatcatgacaggcgacataaagggaatcatgcaggccgggaagcggtccctccgcccgcagcccaccgagctgaagtactcatggaaggcgtggggcaaagccaagatgctgagtaccgagctccacaaccacaccttcctgatagacggccccgaaacggccgagtgcccgaacaccaaccgggcctggaatagtctcgaagtggaggactacggcttcggcgtgttcaccaccaatatatggctcaagttaaaagaacgccaggatgtattttgtgacagcaaacttatgtctgccgctataaaggacaaccgggccgtacacgccgacatgggctattggatcgagagcgccctaaacgacacgtggaagatcgagaaagcctccttcatcgaggtaaagagctgtcattggcctaaatcccataccctgtggagcaatggcgtactcgagtccgagatgatcattcccaagaatttcgcggggcccgtttctcagcacaattaccgcccggggtaccatacccaaaccgccggcccctggcacttgggtaagctggaaatggacttcgacttttgcgagggcaccacggtggtcgtgacagaggattgcgggaaccgcggccccagcctgcgcacgaccactgcttccggcaagctcattaccgagtggtgctgtcggagctgtacactacccccgctgcgttaccgcggagaggacggttgttggtacgggatggagatccgacccctcaaagagaaagaagagaatctggtgaactcccttgtcaccgcaggccacgggcaaatcgacaacttttcattgggcgtcttgggcatggccctgttcttggaggagatgctgcggacacgcgtgggcaccaagcacgccatcttgctcgtcgccgtgtccttcgtgactctgatcaccggcaatatgtccttcagggatctggggagggtcatggtgatggtcggcgccacgatgaccgacgacatcgggatgggcgtcacctacctcgccctgctggcggccttcaaggttcgccccacctttgccgccggcctcctgctgcggaagttaacgtccaaggaactgatgatgactactatcgggatcgtcctcctcagccaatctaccatccccgagaccattctggagctgacggacgcactggctctgggcatgatggtacttaaaatcgtgcgcaacatggagaagtatcagctcgcggtcacaatcatggcgatcctgtgcgtcccgaacgccgtgatcctgcagaacgcctggaaagtcagttgcaccatcctcgccgtcgtttccgtcagccccctgctgctcacgtcaagccagcagaaggccgactggatcccgctggccctgaccatcaaggggttaaaccccaccgccatcttcttgacgacgctgtcccgtacctcgaaaaagcgctcctggccgctcaacgaggcgatcatggccgtgggcatggtgagcatactggcatcaagcctccttaagaacgacatacccatgaccggccctctggtcgcagggggcctgctaaccgtgtgttacgtgctgacggggcgaagcgcggacctggaactggagcgcgcggcagatgttcgctgggaagaacaggccgagatctccggcagctcccctatacttagcataaccatctccgaagatgggagcatgtcaatcaaaaacgaggaagaggagcaaaccctgacgatcctcatcaggaccggtttgctggtgatcagcggccttttcccggtgtccatacccatcactgccgccgcgtggtatctctgggaggtcaagaagcagcgggctggggtgctgtgggacgtgcccagcccgccgcccgtcggtaaggccgaacttgaggacggggcctaccgcatcaaacagaagggcatactgggatactcccaaatcggagccggagtgtacaaggaagggaccttccacaccatgtggcacgtcacacgcggtgcggtgctgatgcacaaggggaagcgtattgagcccagctgggccgatgtcaaaaaggacctcatctcatacggagggggctggaagctggagggcgagtggaaggagggggaggaggtgcaggtcctggccctagagcccggcaagaatccccgggccgtgcagacgaagcccgggcttttcaaaaccaacacgggcaccattggggctgtgtctctggacttttcccccggtacgagcgggtcccccatcgtcgataagaaggggaaagtggtgggcttatacgggaacggcgttgtgacgcgcagcgggacttacgtgtccgcgatcgcccagaccgaaaagtccattgaggataaccctgagatcgaggacgacatattccggaagaaacgcttaacgatcatggacctgcaccctggggccggcaagaccaagaggtaccttccggccatcgttcgtgaagccatcaagagagggctccgaaccctgatcttggccccgacgcgggtagtagccgcggagatggaagaggccctccgcgggcttcccatccgctaccaaacgcccgcaatccgggcagagcacacggggcgcgagatagtcgacctgatgtgccatgccacattcaccatgcggctattaagccctatccgcgtgccgaactacaacctaatcattatggatgaagctcacttcaccgaccccgcctccatagccgcgaggggctacatcagcacccgcgtggagatgggcgaggcggcggggatctttatgaccgccacccctcccgggtcccgggacccgttcccacagagcaatgcgcccattatggacgaggagcgcgagatccccgagcggagctggaacagcgggcacgagtgggtcaccgacttcaaaggcaagaccgtatggttcgtgccgtccatcaaggccggtaacgatatcgccgcctgcttacgcaagaacggcaagaaagtcatccagctgagccggaagacctttgactccgagtacgtcaaaaccaggaccaacgattgggacttcgtcgtcaccaccgacatttctgagatgggcgcgaatttcaaagccgagcgggtgattgaccccagaaggtgcatgaagcccgtgatcctgaccgatggggaggagcgggtcattctcgcgggtcccatgccggtgacccactccagcgccgcgcaaaggcgcgggcgggtcggtcgcaaccccaaaaacgagaacgaccagtacatatacatgggggagccactggagaacgatgaggattgcgcccactggaaggaggctaagatgcttctcgacaacatcaacacccccgagggaataatcccgagtatgttcgaacccgagcgcgaaaaggtggacgccatcgacggggagtacagactgcgcggggaggccaggaagacctttgtggatctgatgcgcagaggggacctcccagtctggctggcctaccgcgtggcagcagagggcatcaattatgccgaccggcgctggtgcttcgacggcgttaagaataaccagatcctggaggagaacgtcgaggtggagatctggaccaaggaaggagagcgtaagaagctcaagccgcgctggctggacgcccggatctacagcgaccccctggcgctcaaggagttcaaagagttcgcggccgggcggaagtccctaacgctgaacttgatcaccgagatgggcagactgcccacctttatgacgcagaaggcccgcaatgccctagacaacctcgcggttctgcacacggcggaagctggagggcgggcctacaaccacgccttatctgagctccccgagacactggagacccttctcctgctgaccctcttagcaaccgtgaccgggggcatctttctattcctaatgtccgggaaggggatcggcaagatgaccctggggatgtgctgtatcatcaccgcgagcgtactgctctggtacgcccagatccagccgcactggatcgcggcttccatcatcctagagtttttcttgatcgtgctcctgatcccggagccggaaaagcagcgcacaccccaggacaaccaactgacgtacgtcgtcatcgcgatcttgaccgtagttgcagccaccatggccaacgaaatgggattcctcgagaaaaccaagaaggacttcggactgggcggcatcgctacgcagcaacctgagagcaacatcttggatattgacctgcgccccgcgtcagcatggaccctgtacgccgtggccaccacctttatcacgcccatgttacgacacagtatcgagaatagttcggtgaacgttagccttacggccatcgcgaaccaggctaccgtactgatggggctcggtaaagggtggcccctgagcaagatggacatcggcgtaccgctgctcgccatcgggtgctacagccaggttaacccaattacgctgacggcagcgctacttctgctggttgcccattatgcaatcatcggccccggcctacaggcaaaggccacccgggaggcgcagaagcgagccgccgccggtatcatgaaaaacccgacagtggacgggatcactgtcatagatctggacccgatcccatacgatcccaagttcgagaagcagctgggccaagtgatgctcctggtgctgtgcgtcacccaggtgctcatgatgaggaccacctgggccctgtgcgaggcgttgaccctcgccacgggaccgatctccactctgtgggagggtaaccctggcaggttctggaataccaccatcgctgtcagcatggcgaatattttccgcggcagctacttagccggagccgggctcctgttcagcatcatgaagaatacggccaatacccggagggggaccggcaacaccggggaaacgctgggggagaagtggaaaaaccgcctcaacgcactcggcaaatccgagtttcagatttacaagaagtcagggatacaggaggttgaccggaccctggccaaggagggaatcaagcgcggagagacagaccaccacgcggtaagccgcggcagtgccaagctccggtggttcgtggagagaaacttggtcacccccgagggcaaggtgatggatctagggtgtggccgcggcgggtggtcctattactgcggcgggctaaagaacgtcaaggaggtaaaggggctgacgaagggcggccccgggcatgaggagcccatccctatgtccacgtacggttggaacctggtgcggttgcagtccggggtggacgtcttcttcactccgcccgagaagtgcgacaccctgctgtgcgacatcggggagtcatcccccaacccgacggtggaagccggtcgtacccttagggtcctcaacctcgtcgaaaactggctcaacaataacacccagttctgcataaaggtcctgaacccctacatgccctctgtgatagagaagatggaggcacttcagcggaaatacgggggcgcgctggtccgcaacccgctcagccgtaattccacgcatgagatgtactgggtgagcaatgcgtccgggaacatcgtgagcagcgtgaacatgatcagccgcatgctgatcaaccgtttcaccatgcgccacaagaaagccacgtacgagcccgatgtggacctgggaagcggtacccggaacatcggcatcgagtctgaaactcccaacctcgatatcattggtaaacgaatcgagaagatcaagcaggagcacgagacctcgtggcactacgatcaggaccacccctacaaaacgtgggcctaccacgggagttacgagacaaagcagaccggcagcgccagctctatggtgaacggggttgttcgcctgctaactaagccgtgggacgtgatccctatggtgacccagatggcgatgaccgacaccacccccttcggccagcagcgagtcttcaaggagaaagtcgacacacgcacccaggaacccaaggaggggaccaaaaagctaatgaagatcaccgccgagtggctgtggaaagaacttggtaagaagaagacgcccagaatgtgcacacgcgaggagttcaccagaaaggtgcgctcgaatgccgctttgggagccatcttcacggacgagaacaagtggaagtcggcccgggaagcggtggaggacagcgggttctgggagctagtcgacaaagagagaaacctgcacctcgaagggaagtgcgagacgtgcgtgtacaacatgatggggaagcgggagaagaagttgggagagttcggtaaggcaaaagggtcccgcgccatctggtacatgtggctgggcgcccgctttctcgagttcgaggccctggggttcctgaacgaggaccactggtttagccgggagaactctctcagcggtgtggagggggagggtctgcataagctgggctatatcctacgagatgtcagtaagaaagagggcggggccatgtacgcggatgacacagccgggtgggatacccgcatcaccttggaggacctgaagaacgaggaaatggtgacaaatcatatggagggagagcacaagaaacttgctgaggctatattcaaattgacctaccagaacaaggtggtccgggtacaacggcccactcccagaggcacggtgatggacatcatctccagacgcgaccagcgcggcagtggccaggtcgttacgtacgggctgaacactttcaccaatatggaggcccagttgatccggcagatggagggcgaaggtgtgttcaagtccatccagcagctgaccgcgactgaggaaatcgccgttaagaactggcttgcgcgagttggccgcgaacgtctgagcagaatggcgatttccggcgacgattgcgtagtaaaacccctggacgatcgattcgcgagcgccctgaccgcccttaatgatatgggtaaggtgagaaaggacatccagcagtgggagccgtcaagaggttggaacgactggacccaggtgcccttctgtagccatcacttccacgagttaataatgaaggatggccgcgtcctggttgtcccctgcagaaaccaggacgagttaataggtcgggcccggatctcccaaggggcgggatggagcctgcgcgagaccgcctgcctgggcaagtcctacgcccaaatgtggagtctcatgtacttccaccgccgcgacttgaggctggcggccaacgcgatatgctccgccgtcccatcgcactgggttccgacgtcccgcaccacgtggagcatccacgccacccacgagtggatgacaacggaagacatgttgaccgtgtggaaccgtgtgtggattcaagaaaatccctggatcgaagacaagacccccgtggagtcctgggaagaaatcccgtacctaggtaaacgcgaggaccaatggtgcggttcgctaattgggctcacctcacgggccacatgggcgaagaacatccagaccgccatcaaccaggtgcgctctctaatcggcaacgaagagtacaccgactacatgcctagcatgaagaggttccgccgcgaggaggaggaggcaggggtcctttggtag

SEQ ID NO: 25594 - RNA, 9876 nt, synthetic construct
  misc_feature 1..9876: note = derived and/or modified CDS sequence (opt11) from DENV-2__DQ645556__SS-prME
  source 1..9876: mol_type = other RNA
accgcgggcgtgatcatcatgatgatccccaccgtcgtggctttccacctgaccaccaggaatggggagccccacatgatcgtgagccggcaggagaaggggaagagcctcctgttcaagaccgagaatggagtcaacatgtgcaccctgatggcgatggatctcggcgagctctgcgaggacacaataacctacaactgcccactgctgcggcagaacgagcctgaggacatcgactgctggtgcaacagtacctctacttgggtgacctacggcacgtgcaccgccaccggcgagcacagaagggagaagcggagcgtggcattggtcccccacgtaggcatggggctggagacccggaccgagacgtggatgtccagcgaaggcgcctggaagcacgcccagcggattgagacctgggtgctacgccacccggggtttaccataatggcggccatcctggcctacaccatcggaacgacctacttccagcgggttctgattttcatcctactgacggccgtggcgccctccatgaccatgcgctgtatagggataagcaacagggactttgtggagggcgtgtccggcgggagctgggtggacatcgtgctggagcacggctcctgcgtcaccaccatggccaagaacaagccgacgctcgacttcgagctgatcaagactgaggccaaacaccccgccaccctgcgcaagtactgcatcgaagccaagctcaccaatacgactacggcgtctcggtgcccaacccagggggaaccctccctgaacgaagagcaggacaagcgctttgtgtgcaagcatagcatggtagaccgcggctggggcaacgggtgcggcctttttggaaagggcggaatcgtcacgtgtgccatgttcacgtgcaagaagaacatggagggcaaggtggttcagcccgagaatctcgagtacaccatcgtcatcacgccccactccggcgaggagaatgccgtggggaacgacacgggcaaacacggcaaggagataaaggtaaccccgcagagctctatcacagaggctgagctgaccggatacgggactgtcacgatggagtgcagccctcgcaccggcctcgacttcaacgagatggtactcctgcagatggaggacaaggcctggctggtccaccggcaatggttcttggacctgcccctgccctggctcccgggcgcggacacacaggggtccaactggatccagaaggagacgctagttacgttcaaaaaccctcacgccaagaagcaggacgtggtcgttctcggcagccaggagggagccatgcacacggctctcactggagccaccgagatccaaatgtcgtctgggaacctgctgttcacgggccacttgaagtgccgacttcggatggacaagttacaactcaagggcatgagctactctatgtgcaccgggaagttcaaagtagtcaaggagatcgcagagacgcaacacggcaccatcgtcatccgcgttcagtacgagggggacgggagcccctgcaagattcccttcgaaatcatggacctggagaagcggcacgtactgggcagactcatcacggtaaaccccatagtgacagagaaggactcccccgtcaacatagaggccgagccacccttcggggacagctacatcataatcggcgtggagccggggcagctgaagctctcctggttcaaaaagggctcatccatagggcagatgttcgagaccaccatgcgcggcgcaaagcggatggccatactcggcgacacggcctgggatttcggatctctggggggggtgttcacctccatcggcaaagctctgcaccaggtcttcggggccatctacggcgccgccttcagcggcgtgagttggaccatgaaaatcctcattggggtggtcataacgtggatcggtatgaacagccgctccacgagcctgtccgtgagcctggtgctggtcggggtggtgaccctctacctgggcgtcatggtgcaagctgactccgggtgtgtggtgtcctggaaaaacaaggagctgaagtgcggcagcggcatcttcatcaccgacaatgtgcacacctggaccgagcagtacaagttccagcccgaatccccaagcaagctcgcctccgccatccagaaggcccacgaggagggtatctgcggcattcggagcgtgacccgcctcgagaacctgatgtggaagcaaatcacccctgagctcaaccatatcctgtccgagaacgaggtcaaactgaccatcatgacgggcgacatcaagggcataatgcaggccgggaagcggagcctccgcccgcagcccaccgagctgaagtactcctggaaggcttggggcaaggccaaaatgttgagcaccgagttgcacaaccacaccttcctgatcgatggccccgagacggccgaatgtcctaacaccaaccgggcctggaactccctggaggtggaggactacggattcggggtatttacgaccaacatatggttgaaactgaaggagcgccaggatgttttctgtgatagcaagctgatgtccgccgcgatcaaggataaccgggccgtgcatgccgatatgggctactggatcgagagcgcgttaaacgacacgtggaagatcgagaaggcctccttcatcgaggtcaagagctgccactggccgaaatcccataccctctggagtaacggcgtgttggagtccgaaatgattatccccaagaactttgcgggccccgtgtctcagcacaattaccgcccggggtatcacacccaaaccgccggcccctggcacctcggaaagctggaaatggacttcgacttctgtgagggcactacggttgtcgtgaccgaggactgcgggaaccggggccccagcctgcgtaccaccactgcctccggcaagctcattaccgagtggtgctgcaggagctgtacactgcccccgctgcgctaccgcggcgaggacggctgctggtacgggatggagatcagacccctcaaggagaaggaggagaacttagtgaactcactggtcaccgcaggccacgggcagatcgacaacttcagtctcggcgtgctgggcatggcgctattcctcgaggagatgctgcggacgcgcgtaggcaccaagcacgccatcctgctcgtcgccgtgtccttcgtgaccctgatcacaggcaatatgagcttccgggacctggggagggtcatggtgatggtgggtgccacaatgaccgacgacatagggatgggcgtcacatatctggccctgctggcggccttcaaggtgcgccccaccttcgctgccggcctgctgctgcggaagctcacgagcaaggagctgatgatgaccaccatcgggatcgtcctgctttcacagtccactatccctgagactatcctggagctgaccgacgccctcgcgctgggtatgatggttctgaagattgtgcgaaacatggagaaataccagctcgccgtcaccatcatggccatactgtgtgtgccgaatgcggtgatcctgcagaatgcttggaaggttagctgcaccatcctcgcagtggtttccgtctctcccctgctgctcacatcgtcacaacagaaggccgactggatacccttagccctgaccatcaaggggttgaaccccaccgccatcttcctgaccacgctgtcccggacctccaagaagcgcagctggcccctcaatgaggcgattatggcagtgggcatggtgtcaattttagcctccagcctgctcaagaacgacatccccatgaccggccccctggtggccgggggcctgctcaccgtgtgctatgtgctgacgggaagaagcgccgacctggagctcgagcgcgcggccgacgtgcggtgggaggagcaagccgagatctccggcagctcccctatcctgagcattaccatctccgaagacgggagcatgtctatcaaaaacgaggaggaggaacagaccctgaccatcctcatcagaacaggcctgctggtgattagcggtcttttcccggtgtccatccccatcaccgccgccgcgtggtacctatgggaggtcaagaagcagcgtgccggcgtgctgtgggacgtccccagcccgccgcctgtcggcaaggcagaactcgaggacggggcctaccgcatcaagcagaagggaatcctggggtactcccagatcggcgccggggtgtacaaggaggggaccttccataccatgtggcacgtgacaaggggtgcggtgctcatgcacaaggggaagcgcatcgagcccagctgggccgacgtgaagaaggacttgatctcctacggaggcggctggaagcttgagggcgagtggaaggagggggaagaggtgcaggtcctagccctcgagcctggaaagaatccccgggccgtgcagacgaagcccgggctgttcaagacaaacaccggaaccatcggggccgtgagcctggacttctcacctggcacgagtggctctcccatcgtcgataagaaggggaaggtggtgggactctacgggaacggagttgtgaccagaagcggcacctacgtgtccgcgatcgcccagaccgagaagtcgatcgaggataaccccgagatagaggacgacatcttccgcaagaaaagactgacgatcatggacctgcaccccggggccggcaagacgaagcggtacctgcccgccatcgtccgcgaggcgatcaagcgggggctccgtacactgatcctggcgccaacccgggtagtcgccgccgagatggaggaggcactccgcggccttcccatccgctatcagacgcccgcgatccgggcggagcacaccgggcgggaaatagtcgacctgatgtgccacgccaccttcaccatgcggctcctgtcccccatccgcgtgcctaactataatctgatcatcatggacgaggcccacttcacggaccccgccagcatcgctgcccggggctacatcagcacccgtgtggaaatgggcgaggctgccgggatattcatgaccgccacaccgcccggctcccgggacccgttcccccagagcaacgcgcccatcatggacgaagaacgcgagatacccgagcggtcctggaactcggggcacgagtgggttacggacttcaaaggcaagaccgtgtggttcgtgccgtccatcaaggccgggaacgacatcgccgcctgcctccgcaagaacggcaaaaaggtgatccagctgagccggaaaaccttcgactccgagtatgtgaagacccgcacgaacgactgggactttgtggtgaccaccgacatcagcgagatgggcgctaacttcaaggccgaacgggtcatagacccacgccggtgtatgaagcccgttattctgaccgacggggaggagcgcgttatactcgcaggtcccatgcctgtgacgcactctagcgccgcccagcggcgcgggcgggtgggccgcaaccccaagaacgagaacgaccaatatatctacatgggggagcccctagagaacgacgaggattgcgcgcactggaaggaggccaagatgctgcttgacaacatcaacaccccggagggcataatcccgtccatgttcgagcccgagcgcgagaaggtagatgccatcgacggggagtatcggctgcgaggggaggcccggaagaccttcgtggacctgatgcgccggggcgacctacccgtatggctggcctaccgcgtggccgccgaggggatcaactatgccgaccggcgttggtgtttcgacggcgtgaagaacaaccagatcctggaagagaacgtcgaggtggaaatatggaccaaggagggggagcggaagaagttaaagccgcgctggttggacgcccggatctacagcgaccccctggcccttaaagaattcaaggagttcgcggcaggccgaaagtccctgacgctaaatctcatcacggagatgggccgtctgcccaccttcatgacccagaaggctcgaaatgccctggacaacttggctgtgctgcacacggccgaggccgggggacgggcctacaaccacgccctgagcgagctccctgaaactctggaaaccctgctgctgctgaccttgctggccacagtcaccgggggcatcttcctattcctcatgtccggcaaggggatcggcaagatgaccctggggatgtgctgcatcatcaccgcctcagtgctgctctggtacgcccagatccagccgcactggatcgcggcctccatcattctggagttcttcctgatagtcttgctgatacccgagccagagaagcaacgcacgccccaagacaaccaactgacgtacgtcgtgatcgcgatcctcactgtggtcgccgccaccatggccaacgaaatgggcttcctcgagaagaccaagaaggactttgggcttggcggcatagccactcagcagccggagagcaacattctcgacatcgacctgaggcccgcgagcgcttggactctgtacgccgtggcgaccaccttcatcacgcccatgctccgccattccatcgaaaacagctccgtgaacgtcagcctgaccgcgatagcgaaccaggccaccgtcctgatgggcctcgggaaggggtggcccctgtccaagatggacatcggcgtgccgctgctagccatcgggtgctacagccaagtgaaccccatcaccctgacagcggcgctgctcctgttagtggctcactacgccatcatcggccccgggctacaagccaaggcgacgcgggaagcgcagaagcgtgccgcagccgggatcatgaagaaccccaccgtggacggaatcaccgtaatcgacctggacccgatcccctatgacccgaaattcgagaagcagctgggacaggtgatgctcctggttctatgcgttacccaggtactaatgatgagaaccacctgggctctgtgcgaggcgctcacactcgctacggggccgatctccaccttatgggagggtaacccgggccgcttctggaacacgaccatcgccgtgagcatggccaacatcttccgcggctcctacctggccggggccggcctcctgttcagcatcatgaaaaatacggccaatacacggcgcggaaccggcaacaccggcgagacgctgggggaaaagtggaaaaaccggttgaacgccctgggcaagtccgagttccagatctacaagaagtccgggatacaggaggtcgacagaacgctggcaaaagaggggatcaagcggggagagaccgaccaccacgcagtatccaggggcagcgccaagctccggtggttcgtagagcgaaacctggtcacccctgagggtaaggtgatggacctgggttgcggccgcggggggtggtcctactactgcggaggactcaagaacgtgaaggaggtcaaggggctgacgaagggcgggcccgggcacgaggagcctatcccgatgagcacttacgggtggaacctggtgcgactccagagcggggtggacgtgttcttcacgccccccgagaagtgcgacaccctgctgtgcgatatcggcgaatcctcccccaatccgacggtcgaggccggtcggacgctccgcgtgctgaacctagtcgagaactggctcaacaacaacacccaattctgtatcaaggtgctgaacccttacatgcccagcgtgattgagaagatggaggccctgcagcggaagtacggcggggccctggtccgtaacccgctcagccggaattccactcacgagatgtattgggtttccaacgcatccgggaacatcgtgtcttccgtcaatatgatcagccgcatgcttatcaaccgcttcaccatgaggcacaagaaggccacgtacgaacctgatgtcgacctcggcagcggaacgcggaacatcggcatcgagtccgagaccccaaacctcgatatcatcggcaaacgtatcgagaagatcaagcaggagcacgaaacctcatggcactacgaccaggaccacccctacaagacgtgggcctaccacgggagctacgagaccaagcaaaccgggagtgccagctccatggtgaacggggtcgtgcgcctgctgaccaagccctgggacgtcatccccatggtgacgcagatggcgatgaccgacaccacccccttcggccaacagcgggtgttcaaggaaaaggtcgacacgcgcacccaggagcccaaggagggcaccaagaagctcatgaagataaccgcggagtggctttggaaggagttagggaagaagaagaccccgcggatgtgcaccagagaagagttcacccgcaaggtgcgcagcaacgccgccctcggggccatcttcaccgacgaaaacaagtggaagtcggcccgggaggcggtggaggatagcggcttctgggagctggtggacaaggagagaaacttgcacctagagggcaagtgtgagacgtgcgtatacaacatgatggggaagcgagaaaagaagctgggggaattcggtaaggccaagggctcccgcgccatctggtacatgtggctaggcgcccggttcctcgagttcgaggcgctgggcttcctgaacgaggatcattggttcagccgcgagaattccctcagcggagtggagggcgagggactgcacaagcttggctacatcctccgggatgttagcaagaaggaaggcggggctatgtacgcagatgacaccgccgggtgggacacccgcataaccctggaggacttgaagaacgaggaaatggtgactaaccacatggagggcgagcacaagaagctcgccgaggcgatcttcaagctaacgtaccagaacaaggtggtccgggtgcagcgacccaccccccgtgggaccgtgatggacataatctcccgaagagaccagcgcggcagtggccaggtagtgacctacgggctaaacaccttcaccaacatggaggctcagctaatccggcagatggagggcgagggggttttcaagaacatccagcagctgaccgccaccgaggagatcgctgtcaagaattggctggcccgcgtgggacgagagcggctctcccgaatggcgataagcggcgatgactgcgtggtcaagccactcgacgaccggttcgccagtgccctgaccgcgctcaacgacatggggaaggtgcgtaaggacgtacagcagtgggagccaagccgaggatggaacgactggacccaggtccccttctgctcccaccacttccatgagttaatcatgaaggacgggagggtgctggtggtcccctgccggaaccaggacgagctcataggccgcgcccgtatcagccagggggctgggtggtccctacgcgagaccgcctgtctgggaaaaagctatgcccagatgtggtccctcatgtacttccaccggcgggacctgcggctggccgcaaacgcaatttgcagcgccgtgccctcccactgggtgccgacgagccgcacaacatggtcaatccacgccacgcacgagtggatgaccacggaggacatgctcaccgtatggaacagggtgtggatccaggagaacccctggatcgaggacaagacgcctgtggagagctgggaggagatcccctacctagggaagagagaagaccagtggtgcggctccctgatcgggcttactagccgggctacgtgggccaaaaacatccagaccgccatcaaccaagtccgctcattgattggcaatgaagagtacaccgactacatgccctccatgaagcggttccgccgcgaggaggaggaggccggggtgctgtggtag

SEQ ID NO: 25595 - RNA, 9876 nt, synthetic construct
  misc_feature 1..9876: note = derived and/or modified CDS sequence (opt11) from DENV-2__AF204178__SS-prME
  source 1..9876: mol_type = other RNA
acggcgggcatgatcattatgttgatccccaccgtgatggctttccatctcaccacccggaacggagagccccacatgatcgtcagccggcaggagaagggcaagagcctattgttcaaaacaggggacggagtaaacatgtgtacccttatggcgatggaccccggggagctgtgcgaagacaccatcacctacaagtgccccctgttaaagcagaatgagcccgaggacatcgactggtggtgcaacagcacctccacctgggtgacctacgggacctgtaccaccaccggcgaacacaggcgggagaagcgctcggtcgccctggtgccgcacgtaggcatgggcctggagacacgcaccgagacctggatgtccagcgagggggcttggaagcacgcccagcggatagagacgtggatcctacggcaccccggctttaccatgatggctgcgattctggcctataccatcgggaccacgcacttccaacgagccttaatctttatcctcctgaccgccgtggcgccctcgatgaccatgagatgcatcggcatctctaaccgagacttcgtggagggcgtgtccgggggcagctgggtcgacatcgtgctggagcatgggtcctgcgtgaccacgatggccaagaataagccaaccctggatttcgagctcatcaagaccgaggcgaagcagccggccacactgcggaagtactgcatcgaggccaagctcactaacaccaccaccgacagccgctgccccacgcagggagagccttccctgaacgaggaacaagacaagcggttcgtctgcaagcactctatggtggaccgcggctgggggaacggctgcgggctgttcggcaagggcgggatcgtcacctttgcgatgttcacgtgcaagaagaacatgaaggggaaagtcgtgcagcccgagaatctggagtacactatcgtcatcacgcctcacagcggagaggagcacgcagtcggcaacgacaccgggaagcacggcaaagagatcaagatcacgccacaaagctccatcaccgaggccgagctgaccggctacggcactgtgacgatgaagtgcagcccccggaccggcctggacttcaacgagatggtgctcctgcaaatggagaacaaggcctggctagtccaccgccagtggttcctcgatttgccgctgccgtggctccccggggccgacacccagggctccaactggatccagaaggagaccctggtgaccttcaagaatccccacgcgaagaagcaggacgtggtcgtgcttggtagccaagagggcgccatgcacaccgccctcaccggggcaacggagatccaaatgtcctccggcaacctgctgttcaccggccatctcaaatgcagactgcgcatggacaagctgcagttaaaggggatgagctactccatgtgcactggcaagtttaaggtcgtgaaggagatagccgaaacccaacacgggacaatcgtaatccgggtccaatacgagggcgacggcagcccctgcaagataccgtttgagatcatggacctcgaaaagcgccacgtcctagggcggctcatcaccgttaatcccatcgtcactgagaaagattccccggtgaatatcgaggcggagcccccgttcggtgatagctacataattatcggggtggagcccggacagctgaaacttaactggttcaagaaggggtccagcattggtcagatgttcgagaccacgatgcgcggcgccaaacgcatggccatcctcggggacacggcctgggatttcggctccctcggtggggtcttcacctcaatcgggaaggccctgcaccaagtattcggcgcgatctacggcgcagcgttctccggggtaagctggaccatgaagatcctcatcggcgtcataattacttggattgggatgaactcacgcagcacctccctgagcgtgtccctggtgctggtgggcgttgtgacattgtacctaggggtgatggtgcaagccgacagcggctgcgtcgtctcatggaagaataaggagctgaagtgtggtagcgggatcttcatcaccgacgacgtgcacacgtggaccgaacaatacaagttccagcccgagagcccttccaagctcgcgtctgccatccagaaggcccatgaagagggaatctgcgggatccgctccgtcacacgactggagaacctgatgtggaagcagatcaccccggagttgaaccacatactaagcgagaacgaggtcaagctgacgatcatgaccggcgacatcaaggggatcatgcaggcgggcaagcgttcgctccgcccccagcctaccgagctcaagtacagctggaagacttggggcaaggccaagatgctgtccacggagagccacaaccagaccttcctcatcgacgggccggaaaccgcggaatgccccaacaccaaccgcgcgtggaactccctggaggttgaggactacggcttcggggtgttcacgaccaacatctggctgaagctgcgggagaagcaggacgttttctgcgactccaagcttatgtccgcagtgatcaaggacaaccgcgccgcccacgcggacatgggctattggatcgagagcgccctgaacgacacctggaagatagaaaaggcctccttcatcgaagtcaaaagctgccactggcccaagtctcacaccctctggagcaacggcgtgctggagtccgaaatgatcatccccaagaattttgccggcccggtgagccagcacaactaccggcccggctaccacacacagacggccggcccctggcacctgggcaagctcgagatggattttgacttctgtgaggggaccaccgtggtcgtgaccgaggactgcggcaaccgcggccccagcctgcggacgactaccgcctctgggaagctgatcaccgaatggtgctgccgcagctgcacactcccacccctgcggtaccggggagaggacgggtgctggtatggcatggagatccggccactgaaagagaaagaggagaacctcgtaaactccctggtcaccgcagggcacggccagatcgacaacttcagcctgggcgtgctcggcatggccctgttcctggaggagatgttacgcacccgtgtgggcactaagcacgccatcctgctggtcgccgtgagtttcgtgacgctcatcaccgggaatatgagcttccgcgacctgggccgggtcatggtgatggttggggccaccatgaccgacgacatcggtatgggcgttacgtatctggcgctccttgccgcctttaaggtgcgccccaccttcgcggccgggctgctcctgcgcaagctgaccagcaaggagcttatgatgaccaccatcggaatcgttttgctttcgcagtccaccatcccggagaccatcctcgagttaaccgacgccctggccctcgggatgatggtcctgaaaatggtgcggaagatggagaaataccaactggccgtgacgatcatggcgatcctatgcgtccccaacgccgtgatcctccagaacgcctggaaggtgagctgcaccatcctggccgtggtgtccgtctcacccctcttcatcacgtcctcgcaacagaaagcggactggatacccctcgcgctgaccattaagggcctcaaccccacggctatcttcttgaccaccctgtcccgcacgaacaagaagcgaagctggcccctcaacgaggccatcatggccgtaggtatggtgtccattctggcgagctccctactgaagaacgacatccccatgacgggacccctggtcgccggcgggctgctcaccgtgtgttacgtgttaaccggccgctccgccgacctggagctcgagcgggctgccgacgtcaagtgggaggaccaggcggaaatcagcggcagtagccccatcctgtccattaccatcagcgaagacggctccatgagcatcaagaacgaggaggaagagcagatcctgacgatcctcatccgcaccggcctgttggtcatttcgggtctgtttcccgtgagcatccctataaccgccgcagcctggtacttgtgggaggtcaagaagcagcgggccggcgtactgtgggacgtgccctcaccgccgcccgtagggaaagcggagcttgaagacggcgcctaccgcatcaagcaaaagggaatcctgggctactcccaaatcggcgccggggtgtacaaagagggtaccttccacaccatgtggcacgtgacgcgaggggccgtcctgatgcacaagggcaagcgcatcgagccgagctgggccgacgtgaagaaggacttgatcagctacggtggcggctggaagctggagggggagtggaaggagggcgaagaggtgcaggtcctggcgctcgagcctgggaagaacccacgcgccgtccagaccaaacccggcctgttcaagaccaatgccgggacgatcggcgccgtgtccttggactttagcccgggcacatccgggagccctatcatcgacaagaagggcaaggtcgtggggctctacggcaacggcgtggtcacacgcagtggggcgtacgtgtctgcgatcgcccagacggagaagtccatagaggacaatcccgagatcgaggatgacatcttccggaagcgcaaacttaccattatggacctgcatcccggcgccgggaagaccaagaggtacctcccggccatcgttcgcgaggcgatcaagcggggcctgcgaacactaatcctggcccccacccgggtcgttgccgcggagatggaagaagcattacgcgggctgcccattcggtaccagacccccgcgatccgcgccgaacacacaggccgcgaaatcgtggacctgatgtgccacgccaccttcaccatgcggctactgagcccggtccgcgtgcccaactacaacctgatcatcatggacgaggcccacttcacagaccccgcaagcatagcggcccggggctacatctccactcgcgtggagatgggcgaggccgccggcatattcatgaccgcgacaccgcccggcagccgggaccccttcccccagtcgaatgcgcccatcatggatgaggagcgcgagatccccgagcggtcgtggtcctctggccacgaatgggtaactgacttcaaagggaaaacggtgtggttcgtgccctccattaaggcaggcaacgacatcgccgcctgcctccgcaagaacggcaagaaagtcatccagttgtcccgcaagaccttcgactccgaatacgtgaagacccggaccaacgactgggacttcgttgtcacgaccgacatcagcgaaatgggggcgaatttcaaggctgagcgggtaatcgaccctcgccggtgcatgaaacccgtgatcctaaccgacggcgaggagcgcgtcatcctcgccgggcctatgcctgtgacccactccagcgccgcccagcggcgcggtcgtatcgggcgcaaccccaaaaacgagaatgaccagtacatctacatgggcgagccccttgagaacgacgaggactgcgcgcattggaaggaagccaagatgctgcttgacaacatcaatactccggaaggcatcatcccctccatgttcgagcccgagcgggagaaagtggacgccatcgatggggagtaccgcctgcgcggcgaggcccggaagactttcgtcgacctgatgcgcagaggggacctcccagtgtggctggcctaccgagtggcggcagagggcatcaactacgccgacaggcgctggtgctttgacgggatcaaaaacaaccagatcctagaggagaacgtggaggttgagatctggaccaaggagggcgaacggaagaagttaaaaccccgctggctggatgccaagatatacagcgaccccctagccctcaaggagttcaaggagttcgcagctggccggaagagcctgacccttaacctcatcacagagatggggcgcctgcccaccttcatgacccagaaggcccgcgacgccttagacaacctcgcggtcctgcacacagcggaggccggcgggcgggcttacaatcacgcactgtctgagctcccggagacgctggagaccctgctactgctcaccctcctggcgaccgtgacgggcggaatcttcctgttcctcatgtccgggcggggaatcgggaagatgaccctgggcatgtgctgcatcatcaccgccagcatcctgctctggtacgcccagattcagccccactggatagccgcctccatcatcctggagttcttcctgatcgtgctactgatccccgagcccgagaagcagcgtacgccccaggacaaccagctgacctacgtcgtgatcgcgatcctcaccgtggtcgccgcaaccatggctaacgagatggggttcctggagaagaccaagaaggacctgggcctcggcagcatcaccacgcaacagcccgagagcaacatcctggacatagatcttagacccgcctccgcgtggaccctttatgccgttgctaccactttcgtgacgccaatgctgaggcactctattgagaattcaagcgtaaatgtgagccttaccgccatcgcgaaccaggcgaccgtgttgatggggctgggtaaaggttggccgctgagcaagatggacatcggtgtccccttactggccatcgggtgctattcccaggtgaaccccatcaccttgacggcggcgctcttcctgctggtggcgcactacgccatcatcggacccggcttacaggccaaggcgacccgggaggcgcagaaacgagcggccgccggcatcatgaagaacccgaccgtcgacggcatcacagtgatcgaccttgaccccatcccctacgaccccaagttcgagaagcagctgggccaggtgatgctcctggtactgtgcgtgacccaggtcctcatgatgcggacaacctgggccctgtgcgaggcccttacgctcgcgacgggcccgatctccaccctgtgggaggggaaccccggccgcttctggaatacaaccatcgccgtatccatggccaacatcttccggggcagctatctggccggggccggcttgctgttctccataatgaagaacacaaccaacactcgccgcgggaccggcaacatcggcgaaacgctgggggagaagtggaagatcaggcttaacgcgctgggcaagagcgagttccagatctacaagaagtccgggatccaggaggtcgaccgcaccctggcaaaagagggcatcaagcgcggagagaccgaccaccacgccgtgagccgggggtccgccaagcttcggtggttcgtggagcgcaacatggttacccctgagggcaaggtggtcgatcttggctgtggccgtggcgggtggagctattactgcggagggctaaagaatgtgcgcgaggtcaaggggctcacgaagggaggccccgggcacgaggagccgatccctatgtccacctacggctggaacctggtcagactgcagagcggggtcgacgtgttcttcaccccccccgagaagtgcgacaccctcctatgcgatatcggagagtcctcaccgaacccaacggtggaggctgggcgcaccctgcgggtgttgaacctggtggagaactggctaaacaacaatacccaattctgcatcaaggttttaaatccctacatgccgagcgtgatcgagaagatggagaccctgcagcgcaagtatggcggcgccctggtggggaaccccctatcccggaactcgacccacgagatgtactgggtctccaacgccagcggcaacatcgtgtccagcgtaaacatgatatcccgcatgttaatcaatcgcttcacgatgcgccacaagaaggccacctacgagcccgacgtcgacctggggagtggcacgcgtaacatcggcatcgagtccgagatccccaatctggacatcattgggaagcgcatcgagaaaatcaagcaggaacacgaaaccagctggcactacgaccaggaccatccgtacaagacgtgggcctatcacggctcctacgagaccaagcagaccgggagcgcttccagcatggtgaacggcgtggtcagactcctgaccaagccttgggatgtggtgccgatggtcacgcagatggccatgaccgataccactcccttcggccagcagcgcgtgttcaaggagaaggtcgacacgcgcacccaagagccgaaagaaggaactaagaagcttatgaaaatcaccgcagagtggctctggaaagagctgggcaagaagaagacgccccggatgtgcacccgcgaggagttcacgcggaaggtacgctccaatgccgccctcggtgcgatcttcaccgacgagaataagtggaagtccgccagggaagccgtggaggactctcgcttctgggaattggtcgacaaggagcggaacctgcatctggaaggcaaatgcgagacgtgtgtctacaatatgatggggaagcgcgaaaagaagctcggcgaattcggcaaggccaagggaagccgggccatatggtacatgtggctgggcgcgcgcttcctggagttcgaggccctcggattcctgaacgaagaccattggttttctcgggagaatagcctgagcggcgtggagggggaaggtctctacaagctgggctacatactgcgtgatgtgtccaagaaggaaggcggcgcaatgtacgccgacgacaccgcggggtgggatacccggatcaccctggaggacctgaaaaacgaggagatggtgacgaatcatatggagggcgagcataagaagctggccgaggccatcttcaagctcacctatcagaacaaggtggtccgcgtgcagcggcccacgccccgggggaccgtgatggacatcatcagccggcgcgatcagagaggaagtggtcaggtcgggacgtacggcctgaacaccttcactaacatggaggcccagctgatccgccagatggaaggggaaggcgtgttcaaaagcatccagcacctcactgtgacggaggagatcgccgtccagaactggctggcgcgggtgcgccgcgagcggttatccagaatggctatcagcggcgatgattgcgtggtcaagccgctcgacgaccggttcgcttccgccctgaccgcccttaatgacatggggaaggtgcggaaggacattcaacagtgggagcccagccggggctggaacgactggacccaggtgcccttctgctcccaccacttccacgagctcattatgaaggacggtcgcgtcctcgtggtcccctgccggaatcaggacgaactcatcggccgcgcgcggatcagccagggcgccggttggtcccttagagagaccgcctgcttaggcaagagctacgcccagatgtggtccctgatgtactttcaccgtcgcgacctccgcctggccgcgaacgccatctgttccgcggtcccgtcccactgggtgcccactagccgcaccacctggtcgatccacgccaagcacgagtggatgaccacagaggatatgctgacggtctggaaccgggtctggatccaagagaacccctggatggaggacaagacccccgtggagagctgggaggagatcccgtacctcgggaagcgtgaagaccagtggtgcggcagcctaatcggcctgacctcccgggccacctgggccaaaaacatccagacggcaatcaaccaagtgcgcagcctgatcggtaacgaagagtataccgactacatgccctccatgaagcggttccgccgcgaggaggaagaggccggcgtcctgtggtag

SEQ ID NO: 25596 - RNA, 9876 nt, synthetic construct
  misc_feature 1..9876: note = derived and/or modified CDS sequence (opt11) from DENV-2__AF204177__SS-prME
  source 1..9876: mol_type = other RNA
accgccggcatgatcataatgctcatccccaccgtgatggcgttccacttaaccacccggaacggggagcctcacatgatcgtcagcaggcaagagaaagggaagtcactgctattcaagacgggagatggtgtgaacatgtgcacgctcatggcgatggacctgggggaactgtgcgaggacacaattacctacaaatgtcccctcctgcgccagaacgagcccgaggacatcgactgttggtgtaacagcaccagcacctgggtgacctatggtacttgcaccaccaccggcgagcacaggcgcgagaagaggagcgtcgccctggtgccacacgtgggtatgggcttggaaacccgcacagagacctggatgtccagcgagggggcatggaagcacgcccagcggatcgagacgtggatactacgccaccccggctttacaataatggccgcgatattagcctacaccatagggaccacgcacttccagcgggccctcatctttatcttgcttactgccgtagcgccctccatgacgatgcgctgcatcggcattagtaaccgggacttcgtggagggcgtgtctgggggctcttgggtcgatatcgtgctcgaacacgggagctgcgtgaccactatggcgaagaacaagcccactctggacctggaactcatcaagaccgaggctaagcagagcgccacgctgcgcaaatactgcatcgaggccaagctgactaacactaccactgagtccaggtgcccgacgcagggcgagccttcgctaaacgaggagcaggacaagagattcgtctgcaagcattccatggtggatcgcggctggggcaatggctgtgggctgttcggcaagggcgggatagtgacctgcgctatgtttacttgtaagaagaacatgaaaggtaaggtcgtgcagcccgagaacctggaatacaccatcgtaatcactccacacagcggagaggagcacgcggtcggcaacgataccggcaagcacggtaaagagattaagatcacgccgcagagtagcattacggaggcggagctcacagggtacggcacggtgaccatggagtgctcgcctaggactggactagacttcaacgagatggttctgctccagatggagaacaaggcgtggcttgtccaccggcagtggttcctagatctgcccctaccctggcttcccggggccgacacccagggcagcaactggatccagaaggaaacgttggtcacgttcaaaaacccccacgcgaaaaagcaggacgtggtcgtgctggggtcccaggaaggagctatgcacaccgccctgaccggggcaacggagatccagatgagtagtggcaacttgctgtttaccggccacctgaagtgcagactccggatggacaagctgcagttaaaagggatgagttacagcatgtgcaccggcaagttcaaggtcgtgaaggaaatcgcagagacccagcatgggacgatcgtgattcgtgtccagtacgagggcgacggatccccctgcaagatccccttcgagatcatggacctagagaagcggcacgtactggggcgacttatcacagtgaatccaatcgttaccgagaaggatagcccggtcaacatcgaggctgagccgcccttcggagactcctacatcataatcggggtagagcccggccagctcaagctgaactggttcaagaaagggagttccatcggacaaatgttcgagacaacgatgcgcggcgccaagcggatggctatcctgggggacactgcctgggacttcggctcactcggtggcgtcttcacttccatcggaaaggccctgcatcaggtgttcggcgcgatctacggcgcagcattcagcggggtgtcctggaccatgaagatcctgataggcgtcatcatcacttggatcgggatgaactcacgctcgacctccctgtccgtaagcctcgtgctggtgggcgtcgtcacgctgtacttgggggtcatggtgcaggccgactcgggttgtgtggttagctggaagaacaaagagctgaagtgcggcagcgggatcttcatcaccgacaatgtgcacacgtggaccgagcaatataagttccaaccggaatctccgagcaaactggcgtccgccatccagaaggcccacgaggaggggatctgcgggatccggagcgtgaccagactggaaaacttgatgtggaaacagataacccccgagctgaaccatattttgtccgagaacgaagttaagctgactatcatgacaggtgacatcaaagggatcatgcaggccggcaagcggtctctgcgcccacagcccaccgagctcaagtacagctggaagacctggggcaaagccaagatgctgagcacggagtcccacaaccagaccttcctgatagatggtcccgagacagctgaatgccccaacaccaacagagcatggaatagcttagaggtggaggactatggcttcggcgtgtttactaccaacatctggctaaagctgcgcgaaaagcaggatgtgttctgcgactccaagctgatgagcgcggccataaaggataaccgggcagtgcacgccgacatgggctactggatcgaatctgcgctgaacgacacctggaaaattgagaaggccagcttcatcgaagtcaagtcctgccactggcccaaaagccataccttgtggtccaacgaagttctcgagagtgagatgatcatcccgaagaatttcgccggccccgtgagccagcacaactaccgccccggataccacacccagaccgcgggcccgtggcacttagggaagctggagatggatttcgatttctgcgagggcaccacagtcgtcgtgaccgaggactgtggtaaccgtgggccctccctcagaacgacgaccgcatcggggaagttaatcaccgagtgctgttgccggtcctgcacgctgccgccactccgttaccgcggggaggacggctgctggtacggaatggagattcgcccgctgaaggagaaggaggaaaacttggtcaacagcctcgtgacggcaggccatggccagatcgacaacttctcactgggcgtgctgggcatggccctcttcctcgaggagatgctacggacccgcgtagggaccaagcatgccatcctcctggtcgcggtaagcttcgtgacgttaatcaccggcaacatgtccttcagggacttggggcgcgtcatggtgatggtgggcgccaccatgaccgacgacataggaatgggcgtcacgtacctggctctgcttgccgccttcaaggtgaggccgaccttcgctgccggtctgctcctcagaaagctgacaagcaaggagctgatgatgaccacgattggtatcgtgctgctgtcgcaaagcaccatccccgaaaccatcctggagctgactgacgccctggccctgggtatgatggtcctcaagatggtgcgcaagatggagaagtaccagctggccgttactataatggcgatactgtgtgtccccaatgcggtgatcctccagaatgcttggaaggttagttgcaccatactagccgtggtaagcgtctcccctttgtttctcaccagcagtcagcagaaagctgactggatccccctggcgcttaccatcaaagggctcaaccccacggccatcttcctgaccacgctgtcaaagacgaacaaaaagcgctcctggccgctcaacgaggccatcatggccgtgggcatggtgagcatcctggcgtcctccctgctcaagaatgacataccgatgacggggcccctggtggccgggggccttctgacggtgtgctacgtcctgactgggcgcagcgccgacttagagctcgagcgggccgccgacgtcaagtgggaggaccaggcggaaatctccggtagctcgcccatcctgagcatcaccatatcagaggacgggagcatgtccattaagaacgaggaggaggagcagattcttacgatcctaatccggaccggactcttagtgatctccggcctcttccccgtatccatcccgattaccgccgccgcctggtacctgtgggaagtaaagaagcagagagcaggggtcctatgggacgtgccgagcccgccgccagtaggcaaggcggagctcgaggacggagcctatcgcatcaagcaaaagggcatcctggggtactcccaaatcggcgcaggagtgtacaaggaggggacctttcacaccatgtggcacgtaacgcggggggcagtcctgatgcacaaggggaaacgcattgagccctcttgggccgatgtaaagaaagacctcatctcctacgcgggtgggtggaaattggaaggcgagtggaaggagggcgaggaagtgcaggtcctggcgttagaacccgggaagaacccgagagcggttcagaccaagcccggcctgttcaagaccaacgccggaaccatcggcgccgtgagcctggacttctcccccggcacgtccggctcccctatcatcgacaaaaagggcaaagtcgtggggttgtacgggaatggggtggtcacccgctccggcgcctacgtttccgccatcgctcagaccgagaagtccatcgaggacaacccggagatcgaggacgacatctttcggaagcgcaagctgaccatcatggatctgcatcccggcgccgggaagacgaagcggtacctgccggccatcgttcgcgaagccatcaaacggggcctcaggaccctgatcctggccccgacccgggtcgtggccgccgagatggaggaggcgctccgcgggctccctatccggtaccagacgcccgccatccgcgccgagcacacgggccgtgagatcgtggacttgatgtgccacgctacgttcaccatgcggttgctgagccccgtcagggtgcccaactacaacttaataatcatggacgaagcccatttcaccgacccggcctccatagccgccagggggtacatctcgacccgcgtggaaatgggcgaagccgccggcatcttcatgaccgcaacgccgcccgggtcccgggacccattcccgcagtcaaacgcacccatcatggacgaggagcgcgaaattcctgagcggagttggtcctccggccacgagtgggtgactgactttaaggggaagacggtgtggttcgtccccagcatcaaggcgggcaatgacattgccgcgtgcctccgcaaaaatggcaagaaggtaatccaactgtcccggaagaccttcgatagcgagtacgttaagaccagaaccaatgactgggacttcgtggtcacgaccgacatctccgagatgggcgccaacttcaaggccgagcgggtgatcgacccccgccggtgcatgaaaccggtgatcctgaccgacggcgaggagcgcgtgatcctagccggtcccatgcctgtgacacacagctccgcagcccagcggcgcggccggatcgggcgcaacccaaagaatgagaacgaccaatatatctatatgggcgagcccctggagaatgacgaggactgtgcgcactggaaagaggcaaagatgctcctcgacaatattaatacaccggagggtatcatccctagcatgttcgagccggagcgggaaaaggtggacgccatcgacggcgaataccgcctgcgaggcgaggcccggaagaccttcgtcgacctgatgcgccgcggtgatctcccagtatggctggcgtaccgcgtggccgccgagggcatcaactacgcggaccggcgctggtgcttcgatggtatcaagaacaaccaaatcctggaggagaatgtcgaggtggaaatctggaccaaggagggcgaacggaagaaactaaaacctcgctggttggacgctcggatctactcagaccccctggcgctcaaggagttcaaggagttcgccgctgggcgcaagagtctgaccttgaacttgattaccgagatggggcggctgcccaccttcatgacgcagaaggcgagggacgcgctggacaacctcgccgtcctgcacaccgccgaggcgggcggtcgagcgtataaccacgcgctcagcgaacttccggaaacgctggagaccctgctgctgctgaccttgctggcaacggtgaccggaggcatctttctgttcctcatgagcggtcgcgggatcgggaagatgacgctgggaatgtgctgcatcattaccgctagcattcttctctggtacgcccagatacagcctcattggatcgccgcgagcatcatcctggagtttttcctgatagtgctccttataccggagcccgagaaacagcggacgccccaagacaaccagctgacctacgtcgtgatcgccattctcacggtggtcgccgccaccatggcgaacgagatggggttcctggagaaaaccaagaaggacctaggcctcgggagcatcaccacgcagcagcctgagtccaatatcctggacatcgacctgcgtcctgcgtccgcttggactctctacgccgtggccaccaccttcgtgacgcctatgttgcggcattcgattgaaaatagctccgtcaacgtgagcttaacggccatcgcgaaccaggctaccgtgctaatgggattgggcaaggggtggcccttaagtaagatggacatcggagtccccctcctcgccatcgggtgttactctcaggtgaacccgatcactctgactgccgccctcttcctgctggtggcacactacgcgataatcggccccggcttgcaggccaaggccaccagggaggcgcagaaacgggccgccgccggtatcatgaagaaccccaccgtcgacggcataacagtcatcgacctggaccccataccgtatgacccgaagttcgaaaaacaacttggacaggttatgctcctggtactttgcgtgacccaggtgctcatgatgcgcaccacttgggcactgtgcgaggcgttaaccctcgccacgggacctatcagcacgctgtgggaggggaaccccggcaggttttggaacacaacaatcgccgtcagcatggccaatatattccgcgggtcatacctcgccggtgcgggactcttatttagcatcatgaagaatacgaccaacacccgccgggggaccggtaacatcggagagacgctcggcgagaagtggaagtcccgactcaacgccctcggcaagagcgagttccagatctacaagaagtccgggatccaggaggttgaccgcactcttgccaaagagggcatcaagaggggagaaaccgaccaccacgcggtgagccggggcagtgcgaaactgcgttggtttgtcgagcgaaacatggtaaccccggaggggaaggtggtcgatctgggctgcggccgcgggggctggagctattactgcggcggcctcaagaacgtgcgggaggtgaaggggctaacgaagcgcggacctggccacgaggaacctatccccatgtcaacctacgggtggaacctagtcaggctgcaaagtggcgtggacgtattcttcacaccgcccgagaaatgcgacaccctcctgtgtgacataggggagtcgtcaccgaaccccacggtcgaggccggccgcaccctgcgggtactcaacctggttgaaaactggctgaacaacaacacccagttctgcatcaaggtcctcaacccgtacatgcccagcgtgatcgagaagatggaggccctgcaacgcaagtacggcggcgccttagtgcggaaccctctgtcccgcaacagcacccacgagatgtactgggtctccaacgccagcggcaacatcgtatccagcgtgaatatgatctcacggatgttaatcaaccgctttaccatgcggcataagaaagcgacatacgagcccgacgtcgacctggggagcgggacccgcaacatcgggatcgaatccgaaatccccaacctggacataatcggaaagcgaatcgagaagatcaagcaggagcacgagactttatggcactacgaccaggaccatccttacaagacctgggcctaccacgggagctacgagaccaaacagaccggctccgcctcctccatggtgaatggcgtggtccggctgctgaccaagccctgggacgtagtgccgatggtcacgcagatggccatgacggacaccacccccttcgggcagcaacgcgtgttcaaggagaaagtggacacccggacgcaggagccgaaggagggcacaaagaaattaatgaagattacggctgaatggctctggaaggagctggggaagaagaagacgccacggatgtgcacgcgggaagaattcacccgcaaggtccgcagcaacgcggccctcggggccatcttcacggacgagaacaaacgcaagtccgcccgtgaggccgtggaggactcacgcttctgggagctcgtcgacaaagaacggaacctgcacctcgaaggcaaatgtgagacctgcgtgtacaatatgatgggtaagcgcgaaaagaagctgggagagttcggcaaggcgaagggctcccgggccatttggtacatgtggctgggcgcccgcttcctcgagttcgaggccctagggtttctgaacgaggaccactggttttcccgggagaacagcctgtccggagtggagggggaaggtctgcacaagttggggtacatactccgcgacgtgagtaagaaggagggcggggcgatgtacgcggacgacacggcgggctgggataccagaattaccctggaggatcttaagaacgaagagatggttaccaaccacatggaaggtgagcacaagaagcttgccgaggccatcttcaagctgacgtaccaaaacaaagtggtccgcgtgcagcggccgacgccccgcgggactgtgatggacatcatctcccggcgcgaccagcgaggcagcgggcaagtcggcacctacggtctgaacaccttcacgaacatggaggcgcagctcatacggcagatggagggcgagggcgtgttcaagtccatccagcaccttaccgtgacggaggagatcgccgtccagaattggctggcgcgcgtggggagagagcgcctcagccggatggccatatccggcgacgactgcgtagtcaagcccttggacgaccgcttcgccagcgcgttgacggccttaaacgacatggggaaggtgcggaaagacatccagcagtgggagcccagccggggctggaacgactggacccaggtgccgttctgcagccaccacttccacgagctgatcatgaaggacggccgagttctggtggtcccctgccgcaaccaaaacgagctcatcgggcgggcccgcatctctcagggcgccgggtggagcctccgtgaaaccgcctgtctgggaaaaagttatgcacagatgtggtcgctcatgtacttccatcgccgtgaccttcgcctggccgccaacgccatctgctcagccgtcccctcgcactgggtgccgacttcccggacgacctggagcatccatgcgaagcacgaatggatgacgaccgaggacatgctcaccgtatggaaccgcgtctggatccaggaaaatccttggatggaagataagacgagcgtggagagttgggaggagataccctacctggggaagagggaggaccagtggtgcggcagccttatcggcctcaccagccgcgccacgtgggccaagaacatccagacagccatcaaccaggtgcgcagccttatcgggaacgaagagtatactgactacatgccctccatgaagcggttccgccgggaagaggaggaggcgggcgtcctgtggtga

SEQ ID NO: 25597 - RNA, 9876 nt, synthetic construct
  misc_feature 1..9876: note = derived and/or modified CDS sequence (opt11) from DENV-2__DQ645540__SS-prME
  source 1..9876: mol_type = other RNA
accgccggagtgatcatcatgatgatacccacggtcgtggccttccacctgaccacgcggaacggagagccccacatgatcgttagcaggcaggagaaaggcaagagcctcctgttcaaaaccgagaacggggtcaatatgtgcacccttatggcaatggacctcggcgaactgtgcgaagacaccatcacctacaactgccccttactccggcagaacgaacccgaggatatcgactgctggtgcaacagcacaagcacatgggtaacatatgggacctgcactgccaccggtgagcatagacgagagaagaggagcgtcgccctggtaccccacgtgggtatggggctggaaactaggactgagacctggatgtccagcgagggcgcctggaagcatgcccagcggatcgagacctgggtgctccgccatcctgggttcacgatcatggcggccatccttgcctacactatcggaacgacctactttcagcgggtcctgatctttatcctcctgacggccgttgcgccctcaatgaccatgcgctgcattggcatcagcaaccgggacttcgtggagggcgtctcgggcgggtcatgggtggacatcgtgctagagcacgggtcctgcgtcaccactatggccaagaacaagccgacgctggacttcgaacttactaaaaccgaggccaagcaccccgccaccctgcggaagtactgcattgaggccaaattaacgaacaccacaaccgcgagcaggtgcccgacgcagggggagccctccttaaatgaagagcaggacaagcgctttgtgtgcaagcacagcatggtggatcgcggttggggaaacgggtgtggtctgttcggaaaagggggaatcgtgacctgcgccatgttcacgtgcaaaaagaacatggagggcaaggtggtgcagcccgagaacctcgagtacaccatcgtcatcacgccccactcaggcgaggagaacgccgtggggaacgacaccggcaagcacgggaaggagataaaggtgaccccgcagagctccattactgaggccgagctgaccggctacggaacggtaacgatggagtgctcaccccgcacgggacttgatttcaacgaaatggttctcctccagatggaagacaaggcctggctggtgcatcggcagtggtttctcgatctgcccctgccctggctgcctggtgcggacacccaggggtccaactggatccagaaggagacgctggtaaccttcaaaaacccacacgctaaaaagcaggacgtggtcgtgctcggcagccaagagggtgccatgcacacggcgctcactggagccacggagattcagatgagcagcgggaacctcctgttcacagggcacctcaagtgccgcctgcggatggataagctgcagttaaaggggatgagctacagcatgtgcaccgggaagttcaaggtcgttaaggagatagcggagacccaacacggtacgatagtgatccgcgtgcagtacgaaggcgacggcagtccctgcaagataccctttgagatcatggacctggagaagcgtcacgtcctcggccgcttaatcaccgtgaatccgatcgtaacggagaaggactcgccagtcaatatcgaagcggagcccccctttggcgactcatacatcataattggcgtggagcctgggcaactgaagctgtcctggttcaagaaggggagctccatcgggcagatgttcgagaccaccatgcgcggcgccaaacggatggccatcttgggtgacacggcctgggatttcggcagcctgggcggggtcttcacctccattggcaaagctctgcatcaggttttcggtgcaatttacggcgccgccttcagcggagtgtcatggaccatgaaaatcctcatcggggtggtcatcacatggatcggcatgaattcaagatccacgagtctgtccgtgtctctggtgctagtcggggttgtgacactgtacctgggggtcatggtgcaagcggactccgggtgcgtggtctcgtggaagaacaaggaactgaaatgtggctctggtatctttatcacggacaacgtacatacgtggacagagcagtacaagttccagccggagtccccatccaagctagcaagcgccatccagaaagcccacgaggagggaatctgcggcatcagaagcgtgacgcgcctggagaacctgatgtggaagcagatcacccctgagctcaaccacatcctgagtgagaacgaggtgaaactaacgatcatgaccggagacatcaagggtataatgcaagccgggaaacgatccctccgaccccagcccaccgagctgaagtactcctggaaggcgtggggcaaagccaaaatgttatcgacggagctgcacaaccatacattcctgatcgacggtcccgaaacggcggagtgtcccaacacaaaccgggcctggaactccttggaggtggaggattacggtttcggggtgttcaccacaaacatctggctcaagctcaaagaacgccaagacgtcttctgcgactctaagctgatgtccgccgcgatcaaggataaccgggccgtccacgccgacatgggatactggatcgagagcgccctcaacgacacgtggaagatcgagaaggcatcctttatcgaggtaaagagctgccactggcccaagagtcacacgttgtggagcaacggcgtgctggagtccgagatgatcatccccaagaatttcgcaggacccgtgtctcagcacaactacaggccgggataccatacccagaccgctggtccctggcacctcgggaagctggaaatggactttgacttctgcgagggcacgaccgtggtcgttaccgaggactgtggcaacagaggccccagcctccgcaccacgaccgcctccggcaagctcataaccgaatggtgctgcagaagttgcaccctgcctccgctgcgttaccgcggagaggacggctgctggtacggcatggagatccgcccgttaaaggagaaggaggagaacctggtgaactccctggtgacggcgggccacgggcagatcgataattttagcctcggggtgctaggcatggcgctgttcttggaagagatgctgcgtacgcgtgtggggaccaagcatgccatattactcgtcgccgtttcctttgtgactctgataacgggtaatatgagcttccgggacctgggccgtgtcatggttatggttggggcgaccatgaccgacgacatcgggatgggcgtcacctatctcgccttactagcggcattcaaggtgcgcccaacattcgccgccggcctcctgctgcggaagctaacctccaaggagttaatgatgaccaccattggcatcgtcctgttgagccagtcgacgattcccgagaccatactcgagctgacagacgcgctcgcgctgggcatgatggtcctgaaaattgtgcgcaacatggagaagtaccagctggccgtcacaatcatggccatcctgtgcgtgccgaacgccgttattctgcagaacgcctggaaggtcagctgcacgatcttagctgtggtaagcgtcagccccctgctgctcacctcaagccagcagaaggccgattggatccctctggccttgaccatcaaaggattaaaccctactgccatattcctcacgaccctgtcccggaccagtaagaagcgctcctggccgcttaacgaggccatcatggccgtgggcatggtaagcatcctggcttccagcctgctcaagaacgacatccccatgaccggccccctggtcgccgggggcctacttacggtgtgctacgtgctgactggccgcagcgccgatctggagctcgaaagggcggccgacgtcagatgggaggagcaggccgaaatttccggctcaagccctatcctgagcatcaccatctcggaggacgggtcgatgtcaataaagaatgaggaggaggagcagaccctcacgatcctcatccgcactgggctgctggtgatctccggtttattcccggtgtccatccctataaccgctgccgcatggtacctgtgggaggtaaagaagcagcgggctggggtgctgtgggacgtgcccagccccccgcctgtcggtaaggccgaactcgaagatggggcgtacaggataaagcagaagggaatccttgggtatagccagattggagccggcgtttacaaagagggcaccttccacacgatgtggcatgttacgcggggcgccgtcctgatgcacaaggggaaacgcatcgaacccagctgggcggacgtaaagaaagatttgatcagctacggtgggggctggaaactggagggcgagtggaaagaaggagaggaggtgcaagttttggccttagagcccggaaagaatccccgggccgtgcaaaccaagcctgggctattcaagacgaatactggtacgataggggccgtgagcctagacttctcccccggcacctcgggcagccccatcgtcgacaagaaggggaaggtcgtaggcctctacggtaacggcgtcgtgaccaggtcgggcacgtacgtgtccgcaattgcccagactgagaagtctatcgaagataaccccgagatcgaggacgacatcttccgaaagaagcgcctgacgatcatggacctgcatcccggggctggcaaaaccaaacggtacctccccgccatcgtcagagaagcgattaaacgggggctccgcaccctgattctggcccctacgagggtggtggccgcagaaatggaggaggccttacgaggactacccatccgataccaaacccctgcgatccgggccgagcataccgggcgtgagatcgtcgacttaatgtgccatgccacctttacgatgagattgctgagccccatccgcgttcccaactacaacctgatcataatggacgaggcacacttcaccgacccggccagtatcgcggcacggggctacatctctaccagggtggagatgggcgaggccgcggggatcttcatgactgccacgccgccaggctcacgggacccgtttccccagagcaacgcacccattatggacgaggagcgcgaaatccccgagcgctcctggaattctggccatgagtgggtcaccgactttaagggcaagactgtgtggttcgttccttccatcaaggcggggaacgacatcgcggcctgtctccgcaagaacggcaagaaggtcatccagctgtcacgtaagacctttgactccgagtatgtgaagacgagaactaacgactgggattttgtagttaccaccgatatttcggagatgggcgccaatttcaaagctgagcgtgtcatagatcctcgccgttgcatgaaacccgtgatactgacagacggggaggagcgcgtcatcctcgccgggcccatgccggtgacccactccagcgcagcacagcggcgcgggcgggtaggaaggaaccccaagaacgaaaatgaccagtatatctatatgggggagccccttgagaacgacgaggactgtgcgcactggaaagaggccaagatgctgctcgacaatatcaacacacctgagggcatcattccgtccatgttcgagccggagcgagagaaggtggacgcaatcgacggggagtacaggttgcgcggggaggctcggaagaccttcgtggacctgatgcgacggggcgacctccccgtctggttggcctaccgcgtggctgccgaaggcatcaactacgcagaccgccgctggtgtttcgacggcgtgaagaataaccaaatcctggaagagaatgtcgaggtggagatttggacgaaggagggcgagcggaaaaagctcaaaccgcgttggctggacgcacggatttacagcgaccccctggctctcaaggagttcaaagagttcgcggccggtcgcaagtccctgacccttaacctcatcaccgagatgggccggcttcccacatttatgacgcagaaagcccgcaacgccctggacaacctcgcggtactgcacaccgccgaggccggaggccgggcctacaaccacgccctgtcggagttgcccgagaccctggaaacccttctcttgttaaccctccttgcaactgtaaccgggggtatcttcctcttcctcatgagcggtaaggggatcggcaagatgaccctggggatgtgctgcatcatcaccgcaagcgtcctgctctggtatgcccagattcagccgcactggattgccgcttcaatcattttagagtttttcctgatcgtgctcctgatccccgagcccgagaagcagcgcaccccccaggacaaccaactgacttacgttgtgatcgcgatcctcaccgtcgtggccgcgaccatggccaacgagatgggcttccttgagaaaacaaaaaaagatttcggtctgggcggtatcgccacccagcagccggagtccaacatactagacattgatctgaggccggcgagcgcctggactctgtacgcggtggccactacattcatcacacccatgctccgccacagtatcgagaacagctccgtcaacgtctcgctgactgccatcgcgaaccaggccactgtgctgatgggactcggcaaggggtggcctctctccaagatggacatcggcgtcccgctgctcgctatagggtgctacagccaggtcaaccccatcacgctgaccgctgcgctgctcctccttgtggcacactacgccatcatcggccccggcttgcaggccaaggccacccgggaggcgcagaagcgcgcagccgcggggatcatgaagaaccccacggttgatggcatcacggtgatcgatctggacccaatcccgtacgaccccaagttcgagaagcagctcgggcaggttatgctcctggtgctgtgtgtcacccaagtgctcatgatgcggaccacctgggccctgtgcgaggcgctgacgctcgccacgggcccaatatccaccctgtgggaggggaaccctgggcggttttggaacaccacgatcgcggttagcatggcaaatatattccgcggttcctacctggccggcgcgggcctccttttcagcatcatgaagaacaccgccaacacccgccgcgggaccggcaacactggtgagaccctgggggagaaatggaagaaccgactcaacgccctgggcaagtctgagttccagatctacaagaaatcggggattcaggaggttgatcgcacactggccaaggagggcatcaaacgcggggaaacggatcaccacgcggtctcccgcgggagcgccaagttgcgatggttcgtagagaggaatctggtcacgcccgagggtaaggttatggacctggggtgcggccgcggtggatggagctactattgcggagggctcaagaacgtgaaagaggtcaaagggctaaccaagggagggcccgggcatgaggaacccatcccgatgtcgacctacggctggaacctggtaagattgcagtccggcgtggatgtattcttcacgccccccgagaagtgtgatacgctgttatgcgacatcggcgagtcgtcccccaatcccaccgtggaggcgggccgtaccttgcgcgtgctgaatctcgtcgagaactggctcaataataatacgcagttctgtatcaaggtattaaacccctacatgcccagtgtgatcgaaaagatggaggcccttcaacggaagtacgggggcgccctggtccgcaacccactctctcgcaactccacccacgagatgtactgggtgagcaatgcaagcggcaacatcgtgagttccgtcaacatgataagccgcatgctgatcaatcggtttacgatgcgccataagaaggccacctacgaaccagatgtcgatctgggcagtgggacccggaatattggcatcgaaagcgagatccccaatctcgacatcatcggcaagcgaatcgagaagattaagcaggagcacgaaacctcctggcactacgaccaggatcacccctacaagacgtgggcctaccatgggagctatgagaccaaacagactggctccgctagctccatggtgaacggggtcgtgcggctgctaaccaagccgtgggacgtcatccccatggtgacccagatggctatgaccgacaccacccctttcggccaacagagagtgttcaaggtcaaggttgatacacggacgcaggagccgaaggagggaaccaagaagctaatgaagatcacagcggagtggctgtggaaagagctgggtaagaagaagacgccgcggatgtgtaccagagaggagttcacacggaaggtccgctcgaatgccgccctcggcgccatcttcacagacgaaaataagtggaagtccgctcgggaggctgtcgaggactcaggattctgggagctggtggataaggaacgaaacctgcacctcgagggcaaatgcgaaacgtgcgtgtacaacatgatggggaagcgggagaagaagctgggcgagttcggtaaagctaaagggagtcgcgcaatctggtatatgtggctgggcgcccgcttcctggagtttgaggcgctggggttcttgaacgaggaccactggttcagccgcgagaactccctctcaggcgtcgagggtgaaggtctgcacaagctggggtacatcctccgggacgtaagcaaaaaggaggggggcgccatgtatgccgatgacacagcggggtgggacacccgcatcaccctggaagacctgaagaacgaggaaatggtgacgaaccatatggaaggcgagcataagaagctcgccgaggccatctttaaactcacctaccagaacaaggtcgtgcgggtgcagcgcccaacacccagaggcaccgtcatggacatcatatccagacgggaccaacgcggctctggccaagtagtaacgtacggcctgaacacatttacgaatatggaagcccaactcatccggcagatggaaggcgaaggtgtcttcaaatccatccagcagctcaccgccaccgaggagattgcggtaaagaactggcttgcccgcgtcggccgcgaacgactctcccggatggcgatctcaggcgacgactgcgtagtaaagcccctggacgaccgtttcgcctcggccctgaccgccctcaacgacatggggaaggttcgcaaggatatccagcagtgggagccgtcccggggatggaatgactggacccaagtccccttctgcagtcaccacttccacgaactgatcatgaaggatggccgcgtgctggtggtgccatgtcgtaaccaagacgaactcatcggtcgcgcccggatctctcagggcgcgggctggtccctgcgcgagacggcatgcctggggaagtcttacgcccagatgtggtcgctaatgtactttcaccgccgagacctgcgtttagccgccaacgcgatttgctcggcggtccccagtcactgggtgcccacgtcccgcaccacatggagcatccacgccacccacgaatggatgaccacggaggacatgctcaccgtctggaaccgggtgtggatccaagaaaacccatggatcgaagacaagacccctgtcgagtcctgggaggagatcccctaccttggaaagcgggaggaccagtggtgcggcagcctgatcggtctcaccagtcgagcgacgtgggcgaaaaacatacagaccgccataaaccaagtgcgctccctgatcggcaatgaggagtacaccgactacatgccgagcatgaagcggttccgccgcgaggaggaggaggcaggggtgctctggtga

SEQ ID NO: 25598 - RNA, 9876 nt, synthetic construct
  misc_feature 1..9876: note = derived and/or modified CDS sequence (opt11) from DENV-2__DQ645541__SS-prME
  source 1..9876: mol_type = other RNA
acagccggagtaatcatcatgatgatcccgaccgtcgtggcgttccacctgaccacccggaatggggagccccacatgatcgtgagccggcaggagaagggcaagagcctccttttcaagaccgagaacggggtcaacatgtgcaccctgatggcaatggacctcggcgagctgtgcgaggacacgatcacctacaactgccccctgctccggcagaatgaacccgaggacatcgactgctggtgcaacagcaccagcacctgggtgacctacgggacctgcaccgccaccggcgagcatcggcgcgagaaacggagcgtggcactagtcccccacgtgggaatggggctggagacgcggacagagacctggatgtccagcgagggcgcctggaagcacgcccaacggatcgagacctgggtgctccgccacccagggttcacgatcatggcggccatactggcttacaccatcggcaccacctacttccagcgcgtcctgatcttcatcctcctgacagcagtcgcgccctcaatgaccatgagatgtatcgggatcagcaatcgggacttcgtggagggcgtctctggcgggagctgggtggacatcgtgctagagcacggctcctgcgtcaccaccatggccaagaacaagcccacgctcgattttgagttaaccaagaccgaggccaagcaccctgccaccctgcgcaagtactgcatcgaagccaaactaacgaacaccaccacggcgagcagatgcccgacgcagggggaaccctccctgaacgaggagcaggacaagcgcttcgtgtgcaagcacagcatggtggaccggggctggggaaacggatgtggcctgttcgggaagggcgggatcgtgacgtgcgctatgttcacgtgcaagaagaacatggagggcaaggtggtgcagcccgagaacctcgagtacacaattgtcatcacgccccactccggcgaggagaatgccgtggggaacgataccggcaagcacgggaaagagatcaaggtgaccccccagagctccatcacagaagccgagctgaccggctacgggactgtaaccatggagtgcagcccccgcaccggcctggacttcaacgagatggtgctcctgcagatggaggacaaagcctggctcgtccaccggcagtggttcttggacctgcccctgccttggctcccgggggcggacacccaggggtccaactggatccagaaggagacgctggtgaccttcaagaacccccacgccaaaaagcaggatgtggtcgtgctgggcagccaggaaggcgccatgcacaccgccctcaccggcgccacggagattcagatgagctccgggaacctgctgtttaccggccacctcaagtgccgcctgcggatggacaagctgcaactcaagggcatgagctactccatgtgcacggggaagttcaaggtggtcaaggaaatcgcggagacccagcacggcacgatcgtgatccgagtgcagtacgagggcgacggtagcccttgcaaaatccccttcgaaattatggacctggagaaacggcacgtcctgggccgcctcataaccgtgaatccgatcgtgaccgagaaggactcacccgtcaacatcgaggccgagccgcccttcggagactcgtacatcatcatcggcgtggagccgggacaactgaagctgtcctggttcaagaagggctcatccatcgggcagatgttcgagactacgatgcgaggggccaagcgaatggctatcctcggcgacaccgcctgggacttcgggagcctggggggtgtgttcacctccatcggcaaggcgctgcaccaggtctttggggccatctatggcgccgccttcagcggcgtgtcctggaccatgaaaatcctcatcggcgtcgtcatcacgtggatcggcatgaacagccgcagtaccagcctgtccgtgagcctggtgctggtcggggtagtgaccctctacctcggggtcatggtgcaggctgattccgggtgcgtggtctcatggaagaacaaggagctgaaatgcggcagcggcatcttcatcaccgacaacgtgcatacatggaccgagcagtacaagttccagcccgagagtcccagcaagctcgcctcggccatccagaaggcccacgaggaggggatctgcggcatccggtccgtgacccgcctggagaacctgatgtggaagcagattacccccgagctcaaccacatcctgtccgagaacgaggttaaactgacgatcatgaccggagacatcaagggcataatgcaagccgggaagcggtcactccgccctcagccaacagaactaaaatactcctggaaggcgtgggggaaggccaagatgctgagcaccgagctccacaatcacacgttcctcatcgacggccccgagaccgccgagtgccctaacaccaaccgggcgtggaactccctggaggtggaggactacgggttcggagtgttcactactaacatctggctcaagctgaaggaacgccaggacgtcttctgcgacagcaagctgatgtccgctgcgatcaaggacaatcgggccgtgcacgccgacatggggtactggatcgagagcgccctcaacgacacctggaagatcgagaaggcgtccttcatcgaagtcaagagctgccactggcccaagtcccacaccctgtggagcaacggagtgctggagtccgagatgatcatccccaagaacttcgctggacctgtgagccagcacaattaccgcccggggtaccacacccagactgccggcccctggcaccttggaaaactggagatggacttcgacttctgcgagggcacgaccgtggtagtgaccgaggactgtgggaaccggggccccagcttacgcaccacgaccgcttccggcaagctcattaccgagtggtgctgtcggagctgcaccctgcccccgctgagataccgcggggaggacgggtgctggtacgggatggagatccgccccctcaaggagaaggaggagaacctggtaaacagtctggtcacggccggccatggtcagatcgacaacttcagcctcggcgtgctgggcatggcgctgttcctcgaggagatgctgcggacccgcgtgggtaccaagcacgccatcctgctcgtcgcagtgtccttcgtgaccctgatcacggggaacatgagctttagagacctggggcgcgtcatggtgatggtgggcgccaccatgactgacgacatcgggatgggcgtgacctacctcgcgctgctggcggccttcaaggtgcgacccacgttcgccgccgggctcctgctgcgaaagttgacctccaaggagctgatgatgacaaccatagggatcgtcttactcagccaatcgacgatccccgagaccatcctggaattgaccgacgccctcgcgttaggcatgatggtgctgaagatcgtgcgcaacatggagaagtaccagctcgccgtcaccatcatggccatcctgtgcgtgccgaacgccgtgatcctgcagaacgcctggaaagtcagctgcacgatcctggcggtggtgtccgttagccccctgctgctcacgtcaagtcagcagaaggcagactggatccccctggccctcaccatcaaggggctcaatcccaccgccatcttcttaacgaccctgtcccggaccagcaagaagcgttcctggccgctcaatgaggcgatcatggccgtgggcatggtgtcaatcttggccagtagcctgctcaagaacgacatcccgatgaccggcccacttgtcgccgggggcctgctcacggtgtgctacgtgctgaccgggcggtcggcagacctggaactcgagcgcgcggcagacgtccggtgggaggagcaggccgagatctccggcagctcccccattttgtcgatcacaatcagtgaagacgggagcatgtccatcaaaaacgaggaggaggagcagaccctgacgattctcatccgcaccggcctgctggtgatcagcggcctcttcccggtatccatccccatcaccgccgccgcgtggtacttatgggaggtgaagaaacagcgggccggggttctgtgggacgtgcctagcccgccgcccgtcggcaaggctgagctcgaggacggggcctacagaatcaaacagaagggcatcctggggtactcccagatcggcgccggggtgtacaaggaggggactttccacaccatgtggcacgtgacgcggggcgcggtcctgatgcacaagggaaagcgcatcgagcccagctgggccgacgtgaagaaagatctcatctcctacggcgggggatggaagctggagggcgagtggaaggagggggaggaggtgcaggtcctggccctcgagcccggcaagaacccccgggctgtgcagaccaagcccgggctgttcaagaccaacaccgggacgatcggggccgtgagcctggacttcagccccggcactagcggctcccccatagttgacaagaaggggaaggtggtgggcctctacggtaacggcgtcgtgacccgcagcggcacatacgtatccgcgatcgcccagacggaaaagtccatagaggacaaccccgagatcgaggacgacatattccggaagaagcgcctgaccatcatggacctgcaccccggggccggcaaaaccaaacggtacttaccagccatcgtccgcgaagcgatcaagcggggactccgcaccctgatcctggcaccgacgcgggtggtggcggcagagatggaggaggccctccgcggcctgccaatccgctaccagacccccgcgatccgggccgaacataccggtagggagatcgtcgatctgatgtgccacgccaccttcacgatgcggctccttagcccaatccgcgtgccgaactacaacctgataatcatggacgaggcccatttcaccgaccccgcctccattgcggcccggggctatatcagcacccgcgtggagatgggggaggccgccgggatctttatgaccgccacgccgcccggctcccgggacccgttcccccagagcaacgcacccatcatggacgaggagcgcgagatccccgagcggtcctggaacagcgggcacgagtgggtcactgatttcaagggcaagacagtgtggtttgtgccgtccatcaaagccgggaacgacatcgccgcttgcctccgcaagaacggcaagaaggtcatccagctgagccggaaaaccttcgactccgagtacgtgaagacgcgcaccaacgactgggacttcgtggttaccaccgacatcagcgagatgggcgcaaactttaaggccgagcgcgtgatagacccccgccggtgcatgaagcccgtgatcctgacggacggggaggagcgcgtcatcttagcgggccccatgccggtgacccactcctcagcagcccaacggcgcggtcgggtcggccgcaaccccaagaatgagaatgaccagtacatctacatgggggagcccctggagaacgatgaggattgcgcgcactggaaggaggcaaagatgctgctcgacaacatcaacaccccggagggcataatcccgtccatgttcgagcccgagcgcgagaaagtagacgccatcgacggcgagtaccggctgcgcggggaggcacggaagaccttcgtggacctgatgcgccgcggggatctccccgtctggctggcttacagagtggcggccgaagggatcaactacgccgaccggcgctggtgcttcgacggcgtgaaaaacaaccagattctggaagagaacgtcgaggtggagatatggacgaaggaaggggaacgaaaaaaactcaagccgcgctggctcgacgcccggatatacagcgaccctttagctctcaaggaatttaaggagttcgccgccggccgcaagtccctgaccctgaacctcatcacggagatgggccggctgcccaccttcatgacgcagaaggcccgcaacgctctggacaacctcgcggtgctgcataccgccgaggccgggggccgggcatacaaccacgcgctgagtgagctccccgagaccctggagacccttctcctgctgaccctcctggcgaccgtcaccgggggtatattcctgttcctaatgtccggcaaggggattggcaagatgaccctgggtatgtgctgcatcatcaccgcaagcgtgctcctgtggtacgcacagatccaaccgcactggatcgccgcctccatcatcttggagttcttcctgattgtgctactgatccccgagcccgaaaagcagcgcacgccccaagacaaccagttaacgtacgttgttatcgcgatcttgaccgtagtcgctgccacgatggctaacgagatgggcttcctggagaagacgaagaaggacttcggcctgggcggtatcgccacgcaacagccggaaagcaatatcctcgacatcgacctgcggcccgctagcgcttggacgctgtacgccgtggccaccacgttcatcactccaatgctccgccactccatcgagaacagctccgtgaacgtcagcctgactgccattgcgaaccaggctaccgtgctgatggggcttggaaaggggtggcccctgtctaagatggacataggagtgccgctgctcgccatcgggtgctacagccaggttaaccccatcacactgaccgccgcgctgctcttactggtggcccactacgccatcatcgggcccggcctccaggccaaggccacccgggaggcgcagaagcgcgccgccgccggaatcatgaagaaccccaccgtggacggcatcacggtcatcgatctggacccgatcccgtacgaccccaagttcgagaagcagctagggcaggtcatgctcctggtgttatgcgtcacccaagtgctcatgatgcggacgacctgggccctgtgcgaggccctgactctggccaccggccccatctccaccctatgggaggggaacccgggtcgcttctggaacacgacgatcgctgttagcatggccaacatcttccgcggctcctatcttgccggggcgggtctcctgttcagcatcatgaagaacaccgctaacacacggcgtggcaccggcaacacgggcgagacgctgggggagaagtggaagaaccgtctcaacgcgctggggaagtctgagttccagatttacaagaagtccgggattcaggaggtcgaccgtaccctggccaaggagggcatcaagcgcggggaaaccgaccaccacgccgtgtcccgcggcagcgccaagcttcgttggttcgtggaacgcaatctggttacgcccgagggcaaggtgatggacctggggtgcggccgcggcgggtggtcctattactgcggcgggctcaaaaacgttaaggaggttaaagggctgacaaagggcgggcccgggcacgaggagcctatcccgatgagcacctacggctggaacctggtgcgcctccagtcgggggtggacgtcttttttacgccgcccgagaagtgcgacacgctgctgtgcgacatcggggagagctcccccaacccgaccgtggaggccggccggaccctccgcgtgctcaacctggtcgagaactggctcaacaacaacacccagttttgtatcaaggtgctgaacccctacatgcccagcgtcatcgagaagatggaggccttacagcggaagtacgggggcgccttggtacgcaacccgctcagccggaactccacccacgaaatgtactgggtgagcaacgcgtccggaaacatcgtgagctccgtcaatatgatatctcggatgctgatcaaccggttcacgatgcggcacaagaaggccacctatgagcccgacgtagacctgggctccgggacccggaatatcggaattgagagcgagacccccaacctcgacatcatcggcaagcgtatcgagaagatcaagcaggagcacgaaacgtcctggcactacgaccaggaccacccctacaagacctgggcctaccatgggagctacgaaaccaagcagactggctccgccagctccatggtgaacggggtcgtgcgcctgctgacgaagccatgggacgtcatacccatggtgacccagatggccatgaccgacactacgcccttcggccagcagcgggtttttaaggagaaggtagacacccgcacccaggagccaaaagagggcaccaagaaacttatgaagatcacggcggagtggctgtggaaggagctggggaagaagaaaaccccgcggatgtgcacccgcgaggagttcacccggaaggtgcgcagcaatgctgccctcggcgctatatttacggacgagaacaagtggaagtccgcccgagaagcggtggaggacagcggcttctgggagctggtagacaaggaaagaaacctgcacctcgagggcaagtgcgagacctgcgtgtacaacatgatggggaagcgggagaagaagctgggcgagttcggtaaggccaaggggtctcgcgccatctggtacatgtggctgggcgcccggttcctcgagttcgaggcgctgggattcctaaacgaggaccactggttcagccgcgaaaacagcctcagtggcgtggagggcgagggcctgcacaagctgggctacatcctccgagacgtcagcaagaaggagggcggcgccatgtatgccgacgacacggctgggtgggatacccgcataacgctggaggatctgaagaacgaggagatggtgaccaaccacatggagggcgagcataagaagctcgccgaggccatcttcaagctgacctaccagaacaaggtggtccgggtgcagcgccccacacccagggggacggtgatggatatcatatcccgccgggaccagcgcggcagcggccaggtcgttacttacgggctgaacacctttaccaatatggaagcccagctcattcggcagatggagggcgagggggtgtttaagtcaatccagcagctgacagccactgaagagatcgccgtgaagaactggctagcccgcgtgggccgcgagcggctcagccgcatggcgatatccggcgacgactgcgtggtcaagccccttgatgaccggttcgccagcgccctgaccgccctcaacgatatgggcaaggtccgaaaggacatccagcagtgggagccttccaggggctggaatgactggacccaagtgcccttctgcagccaccatttccatgagctgatcatgaaggacgggcgcgttctggtggtgccatgccggaaccaggacgagctcatcggccgcgcgcggatctcccagggggcgggctggagcctgcgcgaaacggcctgccttggcaaaagttacgcccagatgtggagcctcatgtacttccaccggcgcgacctgcgtctagcagccaacgcgatctgctccgccgtccccagccactgggtgccaacctcccgcaccacctggtctatccatgccacccacgagtggatgactaccgaagacatgctcaccgtgtggaacagagtttggatccaggagaacccctggatcgaagacaaaacccctgtggagtcgtgggaggaaatcccatacctcgggaagcgcgaggaccagtggtgcggcagtctgatcgggcttacgagccgggccacttgggcaaagaacatacagaccgccatcaaccaggtgcgctcactgatcggcaacgaggagtacaccgactacatgccgagcatgaagcggtttcgccgcgaggaggaggaggccggggtcctgtggtga

SEQ ID NO: 25599 - RNA, 9876 nt, synthetic construct
  misc_feature 1..9876: note = derived and/or modified CDS sequence (opt11) from DENV-2__DQ645542__SS-prME
  source 1..9876: mol_type = other RNA
accgccggcgtgatcattatgatgatccccaccgtggtggccttccacctaaccacgcggaacggagaaccccacatgatcgtgagccggcaggagaaggggaaatcattattgttcaagaccgagaacggggtgaacatgtgcaccctgatggcgatggacctcggcgagctgtgcgaggacaccattacctacaactgccccttgcttcggcagaacgagcccgaagacatcgactgctggtgtaatagcaccagcacgtgggtgacatacggaacgtgcaccgccaccggcgagcaccggcgcgagaagcggagcgtggccctggtaccccacgtgggcatggggctagagacgcggaccgaaacctggatgtccagcgaaggcgcctggaagcatgcccagcggattgagacctgggtgctccgccaccccgggttcacgatcatggcggcaatcttagcatacaccattggcacaacctacttccagcgggtcctgatcttcatcctcctgacggctgtagcgccgtccatgaccatgcgctgcatcgggatcagcaaccgggacttcgtggaaggtgtctccggcggaagctgggtcgacattgtgctggagcacggctcctgcgtcaccaccatggccaagaacaagcccacgctcgacttcgaactgacgaagaccgaggcaaagcaccccgccacgctgcgcaaatattgcattgaggcaaagctcacgaacactaccaccgcgagccggtgccctacgcagggtgagccctccttaaacgaggagcaagacaagcgcttcgtgtgcaagcatagcatggtggaccggggctggggcaacggctgcggcctgttcgggaagggcggtatcgtgacctgtgccatgttcacgtgcaagaaaaacatggaaggcaaggtggtgcagcccgagaaccttgagtacaccatcgtcattacgccccactccggcgaggagaatgcagtgggaaacgacaccggcaagcacgggaaggagattaaggtgacccctcagagctccatcaccgaggctgagctgacaggctacgggacggtcaccatggagtgcagcccccgcacgggactggatttcaacgagatggtgctcctgcagatggaagacaaggcgtggctggtccaccgacagtggttcctcgacctgccgctgccatggctcccgggcgcggacactcaggggtccaactggatccagaaggagactctggtcacattcaagaacccccacgccaagaaacaggacgtggtcgtactggggagccaggaaggggcgatgcacaccgcccttaccggggcgacggagatacagatgagctccgggaacctcctgttcacgggccacctcaagtgccgactgcggatggacaagctgcagctcaaagggatgagctattccatgtgcaccgggaagttcaaggtggtcaaggagatcgcggagacgcagcacgggactatcgtgatccgcgttcagtacgagggggacggttcgccctgcaagatccctttcgagatcatggacctggaaaagcgtcacgtgctgggacgcctcatcaccgttaacccgatcgtcaccgagaaggactcccctgtcaacattgaggccgagccgcccttcggggacagctacatcatcatcggcgtggagccgggccagctgaagctgtcctggttcaagaagggcagctccatcggtcaaatgttcgaaaccactatgcggggcgccaagcggatggcgattctcggcgacaccgcttgggacttcgggagccttgggggggtgttcacctcgataggcaaggcgttacaccaggtattcggcgcgatctatggcgccgccttcagcggcgtctcctggacaatgaagattctgatcggggtggtcatcacgtggatcggcatgaactcacgttccactagcttgagtgtgtcgctggtgctggtcggcgtggttaccctataccttggcgtaatggtgcaagccgactccggctgcgtggtctcttggaagaacaaggagctgaagtgcggcagcggaatcttcatcacggacaacgtgcacacttggaccgagcagtacaagttccagcccgagtcccccagcaagctcgcctccgccattcagaaggcccacgaggaggggatctgcggcatccgtagcgtaacccgcctggagaaccttatgtggaagcagatcacccccgagctcaaccacatcctgtccgagaacgaagtcaagttaacgatcatgaccggggacatcaagggcatcatgcaggcggggaagcggagcctcagaccgcaacccaccgagcttaagtactcctggaaggcgtggggcaaagccaaaatgctgagcaccgagctccacaaccatacgttccttattgacggccccgagaccgccgagtgcccgaacaccaaccgggcctggaactcacttgaggtggaagactacggttttggcgttttcaccacgaatatctggctcaagttaaaggagcgccaggatgttttctgcgattctaagctgatgtcggccgcgatcaaagacaaccgggccgtgcacgccgacatggggtattggatcgagagcgctctcaacgatacctggaagattgagaaggcgtccttcatcgaggtcaagtcctgccactggcccaagtcgcataccctgtggagcaacggcgtattagagtccgagatgatcatccccaagaacttcgcgggccccgtgagccagcacaactaccgcccggggtaccacacacagaccgccggcccctggcacctagggaagctggagatggacttcgacttctgcgagggcacgaccgtggtcgtgaccgaggactgcgggaacagaggccccagcctgcgcaccacgaccgcctctggcaagctcataaccgagtggtgctgtcgcagctgcaccctgcccccactacggtaccgcggagaagacggctgttggtacgggatggagatccgcccactcaaggagaaggaagagaatttagtgaactccctcgtcacggccgggcatgggcagatcgacaacttcagcctcggcgtgctgggcatggcgctgttcctcgaggagatgctgcggacgcgcgtgggaaccaaacacgcaatcctgctcgtggccgtgtctttcgtgaccctgatcaccgggaacatgagcttccgggacttgggccgcgtcatggtgatggtgggggcaaccatgaccgacgatatcgggatgggagtcacctacctcgccctgctggcagccttcaaggtgcgccccacgttcgccgccggcctcctactgcggaaactcacgagcaaggaattgatgatgaccaccatcggcatcgtcctgcttagccagagtaccatcccggagaccatactggagctgaccgatgcccttgcgctgggcatgatggtgctgaagatcgtgcgcaacatggagaaataccagctcgccgtcaccatcatggccatcctgtgcgtaccaaacgccgtgatcctgcagaacgcctggaaggtgagctgcacgatcctcgcggtcgtctccgtcagcccccttctgctcacttccagccagcagaaggcggactggatccccctggccctgaccatcaaggggctcaaccctaccgccatcttcctgacgaccctgtcccggaccagcaagaaaagatcttggccgctcaacgaggcgataatggccgtgggtatggtgagcatcctggcttccagcctgctcaagaacgacatccccatgaccggccccctggtcgccgggggcttgctcacggtatgctatgtgttaacaggacggagcgccgacctggagttagaacgtgcggccgatgtccggtgggaggagcaggccgagatctccgggagctcccccatcctctcaatcaccatctccgaggacgggagcatgtccatcaaaaacgaggaggaggagcagaccctgacgatcctcatccgcaccggcctgctggtgatcagcggcctgttcccggtgagtatccccataacagccgcggcgtggtacctttgggaagtcaagaagcagcgggccggggtgctttgggacgtacccagcccgccgcctgtcggcaaggccgagctcgaggacggcgcctatcgcatcaagcagaagggtatcctggggtactcccagataggcgccggcgtgtacaaggaggggactttccacacaatgtggcacgttacgcggggcgcagtcctcatgcacaaggggaagcgcatcgagccctcctgggctgacgtgaagaaggatctcatctcatacggcgggggctggaagctcgagggcgagtggaaggagggggaggaggtgcaggtcctggccctcgagcccggtaagaacccccgagccgtgcaaacgaagcccgggcttttcaagaccaacaccggcaccatcggagccgtgagcctggacttctcccccggtactagcggctcgcctatcgtcgacaagaaggggaaggtggtgggcctctacgggaacggcgtcgttacccggagcggtacatatgtatccgcgatcgcccagacggagaagtcaatcgaggacaaccccgagatcgaggatgacatcttccggaaaaaacgccttaccataatggacctgcaccccggggccggtaagaccaagcggtatctgcccgccatcgtccgcgaggcgatcaagcgagggctcagaactctgatcctggccccgacgcgggtcgtggccgctgagatggaggaagccctccgcggcttacccattcgttaccaaacccccgcgatccgggccgagcacaccgggcgcgagatcgtggacttaatgtgtcacgcgacctttacgatgcgactcctgtcccccatccgcgtgcctaactataacctgatcattatggacgaggcacacttcaccgaccctgcctccatcgcggctaggggctacatctccacccgcgtggagatgggcgaggccgccgggattttcatgaccgccacaccgcccgggtcccgggacccgtttccccagagcaacgcgcccattatggacgaggagcgcgagatccccgagcgctcgtggaacagcgggcacgagtgggtcaccgattttaagggcaagactgtctggtttgttccgtcgatcaaagcagggaacgacatcgccgcctgcctccgcaagaatggcaagaaggtcatccagttgtcacggaagaccttcgattccgagtatgtgaagacgcgcaccaatgactgggacttcgtcgtcaccacggacattagcgagatgggcgcaaacttcaaggccgagcgtgtgatagacccgcgccggtgcatgaagcccgttatcctgacggacggggaggagcgcgtcatcctcgccggaccaatgccggtcacccactccagcgccgcccagaggcgcgggcgggtcggtcgcaatcccaagaacgaaaacgaccagtacatctacatgggggaaccactagaaaacgacgaggattgcgcgcactggaaggaggccaagatgctgctcgacaacatcaacaccccggaaggtatcatcccgtccatgttcgagcctgagcgcgagaaggtggacgccatcgacggcgagtaccggctgcgcggggaggcccggaagaccttcgtggacctgatgcgccgaggcgacctccctgtctggctggcctacagggtggcggccgaggggatcaactacgccgaccggcgttggtgtttcgatggcgttaagaacaaccaaatcctggaggagaacgtcgaggttgaaatctggacgaaggagggagagaggaagaagctgaagccgcgctggctggacgcccggatctacagcgaccccttggccctcaaggagttcaaggagttcgcggccggccgcaagtccctgaccctgaacttgatcaccgagatgggccggctgccaaccttcatgacgcagaaggcccgcaacgccctggataacctagcggtgctgcacactgccgaggccggggggcgggcctataaccacgccctgagcgagctcccagagaccctggagacgttattactgctgactctcctcgcgaccgtcaccgggggcatcttcctgttcctcatgtccgggaagggtatcggtaagatgaccctggggatgtgctgcatcattaccgccagcgtgctgctctggtatgcccagatccagcctcactggatcgccgcctcaatcatcctggagtttttcctgatcgtgctcctgattcccgagcccgagaagcaacgcactccccaggacaaccaacttacatacgtagtgatcgcaatcctcaccgtagtcgccgccactatggccaacgagatgggcttcctggagaagacgaagaaggacttcggcctaggcggcatcgccacccagcagccggagtctaacatccttgacatcgatctgcggcccgcgtcagcctggaccctgtatgccgtggccaccacgttcatcacccccatgctccgccactccatcgagaacagctccgtaaacgtgtccctgaccgccatcgcgaatcaggccaccgtgctgatggggctcgggaaggggtggcccctgagcaagatggacatcggcgtaccactgctcgccatcggctgctattcgcaggtcaaccctatcacgctgaccgccgcgctgctcctgctggtggcccactacgccatcatcggccccggcctacaggccaaggcgaccagggaagcgcagaagcgcgccgctgcggggatcatgaagaaccccaccgtggacggcatcactgtcatcgacttggacccgattccctacgaccccaaattcgagaagcaactgggacaggtcatgctactggtgctgtgcgtcacccaagtgttgatgatgcggaccacctgggctctgtgtgaggcgctgacgctcgcgactggtcccatctccaccctgtgggaggggaacccgggccgcttctggaacaccactatcgctgtgagcatggccaacatcttcagaggctcctacctggctggggcggggctcttgttcagcataatgaagaacaccgccaacactcggcgcgggaccggcaacacgggtgagaccctgggggaaaagtggaagaaccggctcaacgcactgggcaaatccgagttccagatctacaagaagtccgggatccaagaggtcgatcgcaccctggcgaaagagggaattaagcgcggggagaccgaccaccacgcagtgtcacgcggcagcgccaagctcagatggtttgtggagcgcaatctcgtaacacccgagggcaaggtgatggacctgggatgtggccgaggcgggtggagttactactgtggcgggctcaaaaacgtgaaagaggtaaaggggctgaccaagggcggtcccgggcacgaggagcccatcccgatgagcacatacggttggaaccttgtgcgcctccagagtggggtggacgtcttcttcacgccgcccgagaagtgcgacacgctgctttgcgacataggcgagtcttcaccaaacccaaccgtggaggcaggcagaaccttgcgcgtgttgaacctggtcgagaactggctcaacaacaacacgcagttctgcatcaaggtgctcaatccctacatgccctcggtgatcgagaaaatggaggccctgcagcgaaaatacggcggcgccctggtcagaaatccgctcagccgaaactccacacacgagatgtattgggtgagcaacgcgtcaggtaacatcgtgagctccgttaacatgatcagccgcatgctaatcaaccggttcacgatgcgccacaaaaaggcgacctacgagcccgacgtggacttgggttccgggaccaggaacattggtatcgagagcgagatccccaacttggacatcattggcaagcgcatcgagaagatcaagcaggagcacgagacctcctggcactacgatcaggaccacccctacaagacgtgggcctaccatggcagctacgagaccaagcagaccggctcggccagctccatggtgaacggcgtcgtgcgcctgctgacgaaaccctgggacgtcatccccatggtgactcagatggccatgaccgacaccaccccttttggccaacagagagtgtttaaggagaaagttgatactcggacccaggaacccaaagagggcactaagaagctcatgaagatcacagcggagtggctatggaaggagctggggaagaagaagactccgcggatgtgcacccgcgaggagttcacccggaaggtgcgcagcaacgctgccctcggcgccatcttcaccgacgagaataagtggaagtccgctagggaggcggttgaggactcagggttctgggagctggtcgacaaggagcgcaacctgcacctcgagggaaagtgcgagacttgcgtgtacaacatgatggggaagcgggaaaagaagctgggggagttcggcaaagccaaggggtcccgcgcaatctggtacatgtggctgggcgcccggttcctggagtttgaagcgctggggttcctgaacgaggaccactggttcagccgcgagaactccctcagcggcgttgagggggagggccttcacaagctgggctacatcttaagagacgttagcaagaaggaaggcggcgccatgtacgcggatgataccgctgggtgggacacccgcatcacccttgaagacctgaagaatgaggagatggtgacgaaccatatggagggcgagcacaagaagttggccgaggcgatttttaagctgacgtaccagaacaaggtggttcgggtgcagaggccgacgccccgggggaccgtgatggacattatcagtcgcagggatcagaggggcagcggccaggtcgtgacttacggcctgaacactttcaccaacatggaggcccagctcatccgccagatggagggcgagggggttttcaagtcaatccagcagttaacggccacggaggagatcgccgtcaagaactggctggcccgcgttggccgcgagcgtctctcacgcatggcgatctcaggcgacgactgcgtggtcaagcctctggacgaccgtttcgcttcggccctcaccgccctcaacgacatgggaaaggtgcgcaaggacatccaacagtgggagccgtcacggggctggaatgactggacccaggtccccttctgcagccaccacttccacgagctgatcatgaaggacgggcgcgtcctggtggtgccctgccggaaccaagacgagctaatcggacgcgcccggatctcgcagggggctggatggagcctgcgcgagacagcctgcttaggcaaatcctacgcccagatgtggagcctaatgtacttccaccggcgcgacctgcgactggcggcaaacgcgatctgctccgccgtccccagccactgggtcccgacgagtcgcaccacgtggtccatccacgcaacccatgagtggatgacaaccgaggacatgcttaccgtgtggaaccgggtatggatccaagagaacccctggatcgaggacaaaacccccgtcgaaagctgggaagagatcccctacctggggaagcgggaggaccaatggtgcggctcgctgatcgggttgacatcgcgagccacttgggcgaagaatatccagaccgccattaaccaagtgcgctccctgatcgggaacgaggagtataccgactacatgccgagcatgaaacggttccgccgggaggaggaggaggccggggtcctatggtag

SEQ ID NO: 25600 - RNA, 9876 nt, synthetic construct
  misc_feature 1..9876: note = derived and/or modified CDS sequence (opt11) from DENV-2__AY702036__SS-prME
  source 1..9876: mol_type = other RNA
acggccggagtgatagtcatgctaatcccaacagccatggctttccatctaacgacacgtaacggggaaccacatatgattgtcggacgacaagaaaaaggcaaatccctgctattcaaaaccgaagacggtgtaaacatgtgtacgctcatggcaatcgacctgggcgaactttgcgaagacaccattacgtataagtgcccgctgctaagacagaacgagccggaggacatagattgctggtgtaactcgacatcgacttgggtcacctacggcacgtgcacaaccacaggagagcaccgacgagagaagcggagcgtagcactggtgccacacgtaggtatggggctggagacacggactgagacctggatgtcatcggaaggcgcatggaagcacgtgcagaggatagaaacctggatcctacggcatccgggcttcaccatcatggcggcaatcctggcctacacgatagggacgacacatttccaacgtgcgctcatcttcatcctgctcacggccgtcgcgccctcgatgaccatgcgttgcataggcataagcaaccgcgactttgtggaaggagtgtccggtggatcatgggtagacattgttctagaacacggaagctgcgtcacaaccatggctaaaaataaaccgaccctggatttcgagctaatcaaaaccgaggccaaacaacccgccaccctgcggaagtactgcatcgaagccaaactcacaaacacaacaacagaaagccgctgcccaacgcagggcgagccgagcttgaacgaagaacaagataagaggtttatatgtaaacacagtatggtagatagaggatggggaaatgggtgcgggctgtttggaaaagggggcatcgtaacctgtgcaatgttcacgtgcaagaagaacatggagggcaaggtagtgcaaccagaaaatctcgagtacaccatcgtaatcacaccacattcgggcgaggaacacgcagtagggaacgatacaggcaaacatggcaaagaaataaaaataaccccacaatcaagtattactgaggcggagcttacgggctacggaacggtaaccatggagtgcagccctcgcacgggccttgacttcaacgaaatggtgctactacagatggaggacaaggcttggctcgtccaccgccagtggttcctagatctgccgctcccatggctaccgggagcagacacgcaaggctccaattggatacaaaaagaaaccctagtaacattcaaaaacccgcatgcgaaaaagcaggacgtagtagtattgggctcccaagagggcgcaatgcacaccgcgcttaccggagcaacagaaatacagatgtccagcggaaatctactcttcaccggacatctcaagtgccgcctccgcatggataaattgcaactcaaagggatgtcgtactcgatgtgcaccggaaagttcaagatcgtgaaagaaatagccgagacgcagcatgggacgatagtgatacgtgtacaatacgaaggagacgggtcgccctgcaaaatcccatttgagattaccgatctagagaaacgacacgtactgggtagactcataactgtcaatccaatcgtcacggaaaaagacagcccagtaaatatcgaggcagagcctccattcggcgactcctacattataatcggagttgaaccgggacaattaaaactaaactggttcaagaagggtagctctatcggccagatgtttgaaacaactatgcgcggcgccaaacgaatggcgatattgggggacaccgcctgggactttggatcgctgggaggcgtgtttacatctatcgggaaagcactccaccaggtattcggcgccatatacggggccgcattcagcggagtcagctggacgatgaaaattctcataggagtcatcatcacctggataggcatgaactcaagatccacatcccttagcgtatcactcgtcttagtgggggtcgtgacactatatctgggcgccatggtacaggccgacagtggttgtgtcgtatcgtggaaaaacaaggaacttaaatgtggaagcggcattttcattacggacaacgtgcacacctggaccgaacagtataagtttcaaccagaatcccccagtaaactcgcatcagcaatccaaaaagcgcatgaagaaggaatctgcggcatccggagcgtgacgagactcgaaaatctcatgtggaagcaaatcaccccagagttaaaccacattctgagcgaaaacgaagtcaaactcaccataatgaccggtgacataaaaggaatcatgcaagcgggaaagcgtagccttaggccccaaccgactgagttaaaatacagctggaagacctggggcaaggcaaaaatgcttagcaccgagtctcacaaccaaacctttctaatagatggtccagaaactgcagaatgccccaacacgaaccgcgcttggaatagtctagaggtagaagattacggattcggagtattttcaaccaacatctggctcaaacttagagagaaacaagatgtattttgcgacagtaaactcatgagtgcagccataaaagacaacagggcagtgcacgcggatatgggatactggatcgagtcggcgctcaatgacacatggaaaatggaaaaggcttcgtttatagaagtgaagtcatgccattggccgaagagtcacacgctgtggtcgaacggggtgctcgaatccgagatgataattccaaagaacttcgccggcccggttagccaacacaactacagaccaggctaccatacgcaaaccgccggaccgtggcaccttgggaagctcgagatggactttgacttctgcgagggcactaccgtcgtcgtcacggaggactgtgggaacagaggcccatcgttaaggacgacgacggcctcggggaagttgattacggaatggtgctgcagaagttgcaccctacccccactacgctacagaggggaagacgggtgctggtacgggatggagatacggccactaaaagaaaaagaagagaatctcgtaaacagcctagtaaccgcgggccacggacaaatcgataacttctcactaggcgtacttgggatggcacttttcctggaggaaatgctccgaactagggttggcaccaagcacgccattctgctagtagcggtatccttcgtaaccctaataacgggaaacatgagctttcgggatctagggagagtcatggtgatggtaggtgcgacgatgaccgacgacatcggaatgggtgtcacgtatctggcactgctggcagcgtttaaagtgagaccaaccttcgctgccggtctcctccttcggaaactcacgtccaaggaattaatgatggcaactatcggcatagcactcctgagtcagagcactatgccagagacaattctagaacttactgacgcgctcgctctagggatgatggttttaaaaatagttcgaaacatggaaaaataccagcttgccgtaacaatcatggccatatcctgcgtccccaacgcggtcatactacagaatgcgtggaaggtaagttgcaccatcctagccgctgtttcagtttcccctctattgctaacaagttcacaacagaaggcggactggatcccactagccctaaccatcaagggactaaaccccacggccatattcctcacaaccctgagccgaacaagcaagaaacgatcatggccactgaacgaagctattatggccgtcggcatggtgtccatcctagcgagtagcttactcaaaaatgatatacccatgaccggcccgctagtggcgggaggcctactgaccgtctgctacgtacttaccgggcgaagtgcggacttagagctcgaacgagcagccgacgtgaaatgggaggatcaagcagaaatatccggatcatcccccatactgagtatcactataagcgaggacggcagcatgtcgatcaaaaatgaagaagaagaacaaacactgaccatactcatacggactgggctgcttgtaatatccggcgtgttcccggtctctatacccatcacagcagcggcttggtacctgtgggaagtaaagaaacagagagcaggggtactttgggacgttccctcaccccctcctgtcggaaaagctgagctggaggatggggcataccgcattaaacagaggggaatactggggtactctcaaataggcgcaggagtatacaaagaaggaacgttccatacaatgtggcacgtcacgaggggtgcagtgctcatgcatcgagggaaacgcatagaaccaagctgggcagatgttaagaaagatctcatctcatacggagggggttggaagctcgaaggggaatggaaggagggggaggaagtgcaggtactcgccctcgaaccgggtaaaaacccacgcgcggtccagacgaagccagggatattcaagacaaatacaggcacgatcggcgcagtcagtctagatttctctccaggaaccagcggatcccctatcgtggacagaaaaggtaaagtagtcggtctctatggcaacggggtagtaacaagatccggagcatacgtctcagccatagcacaaaccgaaaagtcaatcgaggacaacccggagattgaagacgacatttttcggaagaagagattaacgattatggacttacatcccggggcgggaaagactaagagatacctgcctgctatcgtgagggaagccataaatcgcgggctcaggacgctgatacttgccccgacacgagttgtggcggccgagatggaagaagctctcaggggactaccgatccggtatcagacccccgcaatcagggcggaacacacgggccgagaaatcgtggacctaatgtgccatgctacgttcaccatgcgtttgttaagtcccgtgcgagtccccaactataacctgattatcatggatgaagcgcactttactgaccccgcctcgatagcagcgagaggatatatctcgacccgtgttgagatgggcgaagcagcgggaatctttatgacggcgacacctccgggctcccgggacccgttcccacagagcaacgcaccgataatggacgaagaacgagaaattcccgagagaagctggaacagtggccacgaatgggtcacagacttcaaaggtaaaaccgtatggttcgtcccgtcaataaaagcaggaaatgacatcgccgcctgcctcaggaagaacggcaagaaagtcattcaactatcccggaagacgttcgacagtgagtacgttaaaacccgagccaacgattgggattttgtcgttacaacagatatctcggagatgggggcgaacttcaaagcagaaagagtaatagatcctagaagatgcatgaaaccagtcatactaaccgacggcgaagaacgagtcatactagccggtcccatgcctgttacgcacagcagcgccgctcaacgccgagggcgcattggccgcaaccccaaaaatgagaatgaccaatacatctacatgggcgagcctctagagaatgacgaagactgcgcccactggaaagaagcaaagatgctgctcgacaacatcaacacacctgaagggataatcccgtcgatgttcgaaccggaacgagaaaaagtagacgcaattgacggagaataccgattacgcggtgaggcccgcaagaccttcgtagatttaatgaggcgaggggatctccctgtatggctggcctacaaggtcgcagccgaaggaatcaactatgcagaccgcaaatggtgcttcgacggcatcaagaacaaccagatcctcgaagaaaacgtcgaagtcgaaatatggaccaaagaaggggaaagaaagaaactgaaaccccgctggctcgacgcaaggatatattctgacccattagcactaaaagagtttaaagagttcgctgccggcagaaagagcctcaccctcaacttaatcacagagatgggccgtctaccaaccttcatgacgcaaaaggcaagaaacgctttagacaacctagctgtactgcatacagccgaagccgggggccgagcatacaatcacgcgctgagcgagttaccagaaacactggagaccttgctactgctaaccctgctcgccacagtcactggaggtatcttcttattcctaatgtccggaaagggcataggcaaaatgactctaggaatgtgctgcataattacagctagttctttactctggtacgcccagatccaaccccactggatcgcagcgtcaattatactcgagttcttcctaatcgttctgttaataccagaaccagaaaaacaaagaacgccccaagataaccaattaacttacgtggtcatcgcaattctcacggtggtcgcagccacgatggcaaacgaaatgggctttctcgagaagacaaagaaagacctaggactaggttccataaccacgcaggaatcagagtcgaacatcctagatattgatcttcgacccgctagcgcatggacactatacgcggtcgcaaccaccttcgttacccctatgcttcggcactccatagagaactcctcggtgaacgtgtcgctgaccgcgatcgcgaaccaggcgacagtactaatgggcctcgggaaaggctggccgctgtccaagatggacattggcgtgccactactagcaatagggtgctactcccaagttaacccgataactctgacagcggcactactcctactcgtggcccactacgcaataatcggccccgggctccaagcaaaggcaacacgggaggcgcaaaaacgtgccgcagccggcatcatgaaaaacccaacagttgacgggataaccgtgatcgacctcgaaccaataccatacgacccaaagttcgaaaaacaacttgggcaagtaatgctactgatcctctgcgtaacacaagtgctcatgatgcgcacaacttgggcactgtgcgaggccttgactctagccaccgggccaatctcgacactgtgggagggcaatcccggtcggttctggaatacaactatcgcggtgagcatggcaaatatattccgaggatcatacctggcaggggctggcctcttattctcgataatgaagaacacaaccaacactaggcgcggtacaggcaacataggagagacgctaggagagaaatggaaatcgcgtctcaacgcattaggtaaatccgaatttcaaatctacaaaaagtcaggcatacaagaggtagaccgcacgctcgccaaagaaggcataaaacgaggagagacagatcaccatgccgttagccgcggctcggcaaaactccgatggttcgtcgagcgaaacatggtaacaccagaaggtaaagtagttgatctgggctgcggacgagggggttggagctactattgcggaggcctcaaaaacgttagagaggtcaagggccttaccaaaggtggccccgggcacgaagaaccaatacccatgtctacatatggttggaaccttgtacgcctccaatccggagtcgatgtattcttcacgcccccagagaaatgtgacactctcctctgcgacatcggagagtccagcccaaaccccacaatcgaggcggggagaactcttcgcgtgctgaacctcgtagagaactggctgaacaataacacgcaattctgtataaaggttctaaacccctacatgccctcggtgatcgagaaaatggaaacattacaacggaagtacggaggcgccttggtaaggaaccccctcagcagaaactcaacccacgagatgtactgggtaagcaacgcaacaggcaacatcgtatccagcgtaaacatgatctcaaggatgctcatcaacagattcacgatgaaacataagaaagccacatacgaaccggacgtcgacctcggtagcgggacgcgcaacatcgggattgagagcgagataccaaacttagatatcatcggcaaaaggatcgagaaaattaagcaagaacacgaaacgagctggcactacgaccaggaccacccctacaaaacctgggcataccacggatcctatgagacgaagcagacgggaagcgcgagctcaatggtaaacggcgtcgtacgtctcctgactaaaccatgggacgtggtcccgatggtaacccagatggcgatgacggacacaacaccgttcggacagcagagagtattcaaagaaaaagtcgacacccgcactcaggaaccaaaggagggaaccaaaaagctaatgaaaattaccgcggagtggctatggaaagaactcggcaaaaagaaaaccccgaggatgtgcacacgggaagagttcacgcgcaaggtccgaagcaatgctgccttaggggctatcttcacagatgagaacaaatggaaaagtgcacgagaagcagtcgaagacggcaggttctgggaactcgtcgacagggaacgcaacctacacctggaaggcaaatgcgaaacgtgcgtatacaacatgatgggaaaacgagagaagaaactgggggagttcggtaaagccaaaggatcgcgggcaatatggtacatgtggctaggcgcacggttcctagagttcgaagccctagggtttctgaacgaagaccattggttcagcagggggaacagtttgagcggcgtcgaaggggaaggactacaccgactcggatacattctacgagaagtgggcaagaaagaagggggagcgatgtacgcagacgacacagcaggctgggatacccgtattacactagaagacctcaaaaacgaggaaatggtcactaatcatatgaagggtgaacataaaaagctagctgaagcaattttcaagttgacgtaccaaaacaaagtagtgcgagtccaacgacctacgccaagaggaactgtcatggatatcatatccaggcgagatcagcggggatccgggcaggtcgggacatatgggttaaacacgttcaccaatatggaagctcagcttataagacaaatggagggggaggggatttttaaatcgatccaacatctcacggcaacggaggagatcgcggtacaaaattggctagcacgggtcgggcgcgaaaggcttagcagaatggccatatcaggagacgactgtgtcgtcaagccgattgacgacagattcgcaagcgcactgacagcgctaaacgatatgggtaaagtacgaaaagacatacaacaatgggaaccgtcccgaggatggaacgactggacgcaggtaccattttgtagtcaccacttccacgaactggtgatgaaggatggaagagtgttagtggtaccttgccggaaccaagacgagctcatagggcgcgctagaatcagccagggagccggctggagtctgaaagaaaccgcgtgtctaggaaagtcatacgcccaaatgtggacgctaatgtatttccaccggcgtgacctacgcttggcggcgaatgctatttgcagcgccgtcccgtcgcactgggttcccacatccaggacaacctggagtatccatgcgaaacatgagtggatgaccacggaagacatgctcgcagtctggaacagagtatggatacaggagaacccctggatggaggacaaaacaccagtggaaagctgggaagaagtcccctacctgggcaaacgagaagatcaatggtgtggctccttaatagggctgacctccagagccacatgggcgaagaatatacaaacggctataaaccaggtaaggtcgcttatcggaaacgaggaatataccgattatatgccgtctatgaaaaggttcagacgagaggaggaagaggctggagtactatggtaa

SEQ ID NO: 25601 - RNA, 9876 nt, synthetic construct
  misc_feature 1..9876: note = derived and/or modified CDS sequence (opt11) from DENV-2__AY702034__SS-prME
  source 1..9876: mol_type = other RNA
accgcgggcgtgatcgtcatgttaatccctactgccatggcgttccacctcacgacccgtaatggggagccccatatgatcgtgggccggcaggagaaggggaagtcgctgctgttcaagaccgaggacggcgtgaatatgtgcacactcatggccatcgatctaggggagctgtgcgaggatacaatcacatacaaatgcccgctcctgcggcagaacgagcccgaggatatcgactgctggtgcaactcgaccagcacctgggtaacctatgggacttgcaccaccaccggcgagcaccggcgcgagaagcggtccgttgccctggtgccccacgttggcatgggcctcgagacccggaccgagacttggatgagcagcgagggggcttggaagcacgtgcagaggattgaaacgtggatcctgaggcacccaggctttaccatcatggccgcgatcttagcctatacgatagggaccacgcactttcagagagccctgatcttcatcctgctgaccgccgttgcgcccagcatgacgatgaggtgcatagggatctccaaccgggacttcgtggaaggcgtgagcgggggcagctgggtggacattgtgctcgagcacgggagctgcgttaccactatggccaagaacaagcccaccctggacttcgagcttattaagaccgaggccaaacagcccgccaccttacgcaagtactgcatcgaggctaaactgacgaacaccaccaccgaatcccggtgtccgacccagggcgagcccagcctgaacgaggagcaggacaagcgcttcatctgcaagcattccatggtggaccgggggtgggggaacggctgcggtttattcggcaaggggggcatcgtgacttgcgcgatgttcacttgcaagaagaacatggaggggaaggtggtgcagcccgagaatctggagtacaccatcgtcatcacgccacatagcggggaggagcatgccgtgggtaacgacaccgggaaacatggcaaggagatcaagatcactcctcaatcgagcatcaccgaggccgagctgacggggtatggtacggtaaccatggagtgctcccccagaaccggccttgatttcaacgaaatggtactgttgcagatggaggataaggcctggctcgtacaccgacagtggttcctcgacctgcccctcccctggttgccgggggcagacacccagggcagcaactggattcagaaggagacgttagtgaccttcaagaaccctcatgcgaagaagcaggacgttgtggttctcggttcacaggagggcgccatgcacactgccctgaccggcgccacggagattcagatgagcagcggcaacctcctgttcaccggccacttaaagtgccgcctgcggatggacaagttacagcttaaagggatgtcctacagcatgtgtaccggcaagttcaaaatagtgaaagagatcgccgagacccagcacgggacgatcgtgatccgcgtccaatacgagggggacggctccccctgcaagatcccgttcgagatcacagacctggagaagcggcacgtgctcgggcgccttatcaccgttaacccgatcgtgactgaaaaggacagccccgtcaacatcgaggccgagccgccctttggcgactcctatatcatcatcggggtggagccgggccagctgaagctcaactggttcaaaaagggaagctccatcggacaaatgtttgagacgaccatgcgcggggccaaacggatggccatcctgggggataccgcctgggacttcgggagcctcggcggggtattcacctccataggaaaggccctccaccaggtgttcggggcgatctacggagctgcattcagcggggtgtcctggactatgaagatcctgatcggcgtcatcataacctggatcgggatgaactcgcgttccaccagcctgtccgtaagcctggtgctcgtcggcgtggtgaccctgtacctgggggctatggtccaggcggactccggctgtgtggttagctggaagaacaaggagctcaagtgcggctccggcattttcattacggacaacgtccacacctggaccgaacagtacaagttccagcccgagagcccgagcaagctggcgtccgccatacagaaggcccacgaggagggcatatgcgggatccggagcgtgacccgcctggagaatctcatgtggaagcagatcacgcccgagctgaaccacatcctatccgagaacgaagtgaaactcacaatcatgaccggcgacatcaaggggatcatgcaggccggtaaacgcagcctgcgcccgcagcccactgagctgaagtactcctggaaaacgtggggcaaggccaagatgctctcgacggagtcccacaaccaaaccttcctaatcgacgggcccgagaccgccgagtgcccaaacacgaaccgggcctggaacagcctggaggtcgaggactacggctttggggtgttcaccaccaacatctggttaaagctgcgcgaaaagcaggacgtgttctgtgacagcaagctaatgtctgccgccatcaaggacaaccgggctgtccacgcagacatgggctactggattgagtctgcacttaacgatacctggaaaatggagaaggccagcttcatagaggtgaagtcctgccactggcccaaaagccacactctgtggtccaacggcgtgctagagagcgagatgataatacccaagaatttcgccgggcccgtctcccagcacaactaccgcccgggctaccacacgcagaccgctgggccctggcaccttggcaaactggagatggatttcgacttctgtgaggggaccaccgtggtggtcacagaggactgcggaaatcgaggccccagcctacgcaccaccaccgccagcgggaagctcatcacggagtggtgctgccggtcctgcaccctgcccccgctgcggtaccgtggtgaggatgggtgctggtacggaatggagatccgccccctcaaggaaaaggaggagaacctggttaacagcctggtgaccgccgggcacggtcaaattgataatttctccctcggcgttttagggatggccctcttcctggaggagatgttgcggacccgcgtgggtacgaagcacgcgatactgctcgtggccgtcagcttcgttaccctgataactgggaacatgtccttccgggacctaggccgcgtgatggtcatggtgggggccaccatgactgacgatatcggcatgggcgtgacctacctcgccctgctggccgcgttcaaggtgcgccccacctttgccgcgggtctcctgctgcggaagttgacctcgaaggagctgatgatggccacaatcggtatcgccctcctctcacagagcacgatgcccgagaccatactggagctgactgacgcgctcgcactggggatgatggtgctgaagattgtgagaaacatggagaagtaccagctcgccgtcacgatcatggccatctcctgtgtgcccaacgccgtgatcctgcagaatgcgtggaaggtaagttgcaccatcctggccgcggtttccgtcagccccctactgttaacctcctctcaacagaaggccgactggatccccctcgcgctgaccatcaagggcctaaatcccacggcgattttcctcaccaccctgtcccgtaccagcaagaagcgctcctggcccctgaatgaggccataatggcggtgggcatggtgagcatcctagcctccagcttactgaaaaatgacatccccatgacggggcccctcgtcgcgggcgggttactgaccgtgtgctatgtgctcaccggccggtcagccgacctggagctcgaacgcgccgccgacgtcaagtgggaagaccaagcggagatatccgggagctcccccattctatccatcactatctccgaagacggctcgatgtccatcaagaacgaggaggaagagcagacgctgaccatcctgatcagaaccggactcctggtaataagcggcgtgttcccggtctccatccccatcaccgccgccgcatggtacctgtgggaggtgaagaagcaacgcgccggcgtgctctgggacgtccccagcccgccgcccgtggggaaggccgagctggaggatggggcgtaccgtatcaagcagcgcgggatactgggctactcccagatcggcgccggggtgtacaaggagggcaccttccacacgatgtggcacgtcacacgcggcgccgtgctcatgcacaggggcaagcggatcgagccctcatgggccgacgtgaagaaggatctgatcagctacgggggcggctggaagctagagggggagtggaaggagggcgaggaggtccaggtcctcgccctggagcccgggaagaatccccgcgctgtgcaaacgaagcccggcatcttcaagaccaacacggggaccatcggggccgtcagcctagacttttcccccggcactagcgggtcacccatcgtggaccggaaaggcaaggtggtcgggctctatggcaacggcgtggtgacccgctccggggcctacgtctccgccatcgcgcagacagaaaagtccatcgaggacaaccccgagatcgaagacgacatcttccggaagaagcgcctgaccatcatggacctgcaccccggagccggaaagaccaagcgttacttaccagccatcgtgcgcgaagccatcaaccgggggctgcgcacccttatactcgctccgacgcgcgtggtggctgccgaaatggaggaggccctccgagggctgcctatccgataccagacccctgccatacgggccgagcacaccggccgcgagatcgtggacctgatgtgtcacgcgacattcacgatgcgactcctaagccccgtgcgcgtcccgaactacaacttgatcatcatggacgaggcccacttcaccgaccccgcgagcatcgccgcgcggggctacatcagtacccgagttgaaatgggggaggccgccggcatattcatgaccgcgacgccgccaggttcccgggacccgttcccccagtcaaacgctcccattatggacgaggaacgcgagatcccggagcggtcctggaacagcggccacgagtgggtgaccgacttcaaggggaagaccgtctggttcgttccgtccatcaaggcgggcaacgatatcgcagcctgcctccgcaagaacggcaagaaggttatccagctgagcaggaagaccttcgactccgagtacgtcaagacgcgcgcaaacgactgggatttcgttgtgaccaccgacatcagcgagatgggcgccaacttcaaggcggagagggtcatcgacccccgccggtgcatgaagcccgtaatccttaccgacggcgaagagcgcgtcattctcgcagggcccatgccggtcactcactccagcgccgctcagaggcgcggccgtatcggtcggaacccgaagaacgagaacgaccagtacatatacatgggcgagccgttggagaacgacgaggattgtgcgcactggaaggaggcaaagatgctgctggacaatatcaacacccccgagggcatcatcccatccatgttcgagcccgagcgcgagaaggtggacgcgatcgacggggagtaccggctgcgcggcgaggcccggaagaccttcgtggacctgatgcgccgcggggacctcccggtctggctggcctacaaggtggccgcggaggggattaattacgccgaccggaaatggtgcttcgacgggataaagaataaccagatcctggaggagaacgtggaggtagagatctggacaaaggagggcgagcggaagaaactcaagcctcgctggctggacgcccggatctacagcgaccccctggccctcaaggagttcaaagagttcgcggccggtcgcaaaagtctgacgctgaatctcattactgagatggggcggctgcccacctttatgacccaaaaagcccgaaacgcccttgacaaccttgccgtgctgcacactgcggaagccggcgggcgggcctacaaccacgccctgagcgagttacccgaaactctggagacgctgctcctcttaaccctcctggccacggtgaccggcgggatcttcctgtttctcatgagtgggaaaggcatcgggaagatgaccctgggcatgtgttgcatcatcactgcgtcttccctgctctggtacgcgcagatccagccccattggatcgccgcgagcatcatcttggagttcttccttatcgtgctactgatacccgagccggagaaacagcggacaccccaggacaaccagctgacgtacgtcgtcatagccatattaaccgtggtggcggctaccatggccaacgaaatggggttcctggaaaagacgaagaaggaccttggcctcgggagcatcacaacccaggagtccgaaagtaacatactggacatcgacctgcggccggcctccgcctggacgctctacgcggtcgccaccacgtttgtgacccccatgctgcgccacagcatcgagaactccagtgtgaacgtctccctgaccgctattgccaaccaggcgaccgtactaatgggtctgggcaagggttggcccctgagcaagatggacataggcgtgcccctccttgccatagggtgctactcccaagtcaatcccatcacgctgaccgccgccctcctgctgcttgtggcccactacgcgatcatcggccccggcctgcaggctaaagccaccagggaggcccagaaacgggccgccgcaggtatcatgaagaaccccactgtagatgggattacggtcattgacctggagcccatcccgtacgaccctaagttcgagaaacagctcgggcaagtcatgctgctgatactctgcgtcacgcaggtcctgatgatgaggaccacctgggccctgtgcgaagctctcacgctggccaccggccccatcagcaccctctgggaggggaaccccggccgcttctggaacaccacgatcgcggtgtccatggcgaacatctttcgcgggtcttacctagccggggccggcttattgttttccatcatgaagaacactaccaacactcggagagggacaggtaacatcggcgagaccctcggcgagaagtggaagtctcggctgaacgcgctggggaagtccgagttccagatatacaagaaaagcgggattcaggaggtagatcgcaccctcgccaaggagggcatcaagcggggagaaacggaccaccacgccgtctcccgcggctctgccaagctgcgatggttcgttgaacgcaatatggtaaccccggagggcaaggtcgtagacttaggctgcgggcgcggcgggtggtcctactactgcggggggctcaagaatgtgcgagaggtcaaggggctaaccaaaggcggccccgggcacgaggagcccatccccatgagcacctatggctggaacttggttcggctccagtctggggtggacgttttcttcaccccgcccgagaagtgcgacacgttactgtgcgatatcggcgagtcaagccccaaccccaccatcgaggcgggcagaacactacgcgttctgaacttagttgaaaactggctcaacaacaacacgcagttctgcatcaaggtgctaaacccgtacatgccgtcagtgatcgaaaagatggagaccctgcagcgcaagtacgggggggccctcgtgcggaaccccctgtcacggaactccacgcacgagatgtactgggttagcaatgccaccggtaacatcgtttccagcgtgaacatgattagtagaatgctgatcaaccgcttcacgatgaaacacaagaaggccacgtacgagcctgacgtcgacctgggcagcggtacgcggaacatcggcatcgagtccgagatacccaacctcgacatcatcggtaagcgcatcgaaaaaatcaagcaagagcacgagaccagctggcattatgaccaggaccacccctacaagacttgggcctaccacgggtcatacgaaaccaagcagacgggctcggcctcgagtatggttaacggcgtggtccgcctgctgaccaagccctgggatgtggtcccgatggtcacccagatggcgatgactgacacgacccccttcggtcagcagcgggtcttcaaggagaaggtggacacccgcacccaagagccaaaagagggcactaagaagctcatgaagatcaccgccgagtggctgtggaaggagctggggaagaagaagacgcctcggatgtgcacccgcgaggagttcacgcggaaagtccgttccaacgcagccctcggcgccatcttcaccgacgagaacaagtggaagtccgcgcgcgaggctgtcgaggacgggaggttctgggaactggtggaccgggagcgcaacctgcacctcgagggcaagtgcgagacctgcgtctacaatatgatggggaagcgggagaagaagctcggcgaatttggcaaggccaaggggagtcgcgccatatggtacatgtggctgggcgcccggttcctcgagttcgaggccctggggttcctgaacgaggaccattggttcagccgcggcaacagcttgtccggggtggaaggcgagggccttcaccggttggggtacatcctccgcgaagtcggcaagaaagagggcggcgccatgtacgccgacgacaccgccgggtgggacacgcggatcaccctggaggaccttaagaacgaggagatggtgaccaaccacatgaagggcgagcacaagaaactcgcggaggcaatattcaagctgacctaccagaacaaagtggtccgcgtccaacggccaacaccccgcggcaccgtgatggacatcatcagccggcgcgaccaacgcgggtccggccaggtcgggacctacggcctcaacaccttcacgaacatggaggcacagctcatccggcagatggagggcgaagggatcttcaagagcatccagcacctgaccgccaccgaggagatcgctgtgcagaactggctggcgcgcgtcggccgggagcgcttatcccggatggccatttcaggggacgactgtgtcgtgaagccgatcgacgaccgctttgcctcggcccttaccgccctgaacgacatgggcaaggtccggaaggacatccaacagtgggagcccagccgcgggtggaatgactggacgcaggtcccgttctgctcccatcacttccatgagcttgtgatgaaggacggccgggtactggtggtgccctgccgcaaccaggacgagctgatcggccgggcgcgcatcagccagggagccggctggtcgctcaaggagaccgcctgtctgggcaagagctatgcccagatgtggaccctgatgtacttccatcggcgcgacctccggctagccgccaacgccatctgttccgccgtgcccagccactgggtccctaccagccgcaccacgtggagcatccacgccaagcacgagtggatgaccaccgaggacatgctagcagtttggaacagagtgtggatccaggagaatccatggatggaagataaaacccccgtcgagtcctgggaggaagtgccgtacctcggcaagcgcgaggaccaatggtgcggtagcctgatcggcctcaccagccgggccacctgggccaagaacatccagaccgcaatcaaccaggtgcgttccctcatcggcaacgaggaatacacggactacatgccctccatgaaacgattccggcgcgaggaggaggaggccggggtcctgtggtga

SEQ ID NO: 25602 - RNA, 9876 nt, synthetic construct
  misc_feature 1..9876: note = derived and/or modified CDS sequence (opt11) from DENV-2__AF208496__SS-prME
  source 1..9876: mol_type = other RNA
acggccggggtgatagtcatgctgattcccaccgccatggctttccacctcaccacgcggaatggggaaccgcatatgatcgtagggcggcaggaaaaggggaagtccctgctgttcaagaccgaggacggcgtaaatatgtgcactctcatggctatcgatctgggggagctgtgcgaggataccataacctacaagtgcccttttctccggcagaacgagcccgaggatatcgactgctggtgcaacttcacctccacctgggtcacctatgggacttgcaccaccacgggcgaacaccggcgcgaaaaacggagcgtggccctggtccctcacgttgggatgggcctggagacccggaccgaaacctggatgtccagcgagggggcttggaagcatgtgcagcggatcgagacgtggatcctgcgacacccgggctttaccatcatggccgctatcctggcctacaccatcgggaccacgcactttcagcgggcgctgatttttatcctactgaccgcggtggcgcccagcatgaccatgcggtgtatcggcataagtaatcgggacttcgtggagggcgtgtccggcgggagttgggtggacatcgtcctggagcatgggtcctgtgtgaccacgatggctaagaacaagcccactttggacttcgaactgatcaagacggaagcaaagcaacccgccacgctgcgcaagtactgtatcgaggccaagctcacaaacaccaccactgagagccggtgcccgactcaaggggagcccagtctaaacgaggagcaagacaagcgatttatttgcaagcacagcatggtcgaccggggctggggcaacggctgcgggctgttcggtaagggcggcatcgtgacctgtgcgatgttcacgtgcaagaagaacatggagggtaaagtggtgcagcccgaaaacttagagtacaccatcgtaattacgccccactccggcgaagaacacgccgtcggcaacgacaccggaaagcacggcaaggagatcaagatcaccccacagtcttccatcaccgaggccgagctcaccggatatggcacggtgaccatggagtgcagcccccgcaccggtcttgacttcaacgagatggtcttactgcaaatggaggacaaggcctggcttgtgcatcggcagtggttcctcgatctgcccctaccctggttaccgggggccgacacccagggcagcaattggatccagaaggagacccttgtgacatttaagaacccccacgcgaagaagcaggacgtcgtggtcctggggagccaggagggagccatgcacaccgccctcaccggagcaacggagatccagatgtcgagcggcaacctgctgttcaccggccatctcaagtgccgtctgcgtatggacaagctgcagctcaaggggatgagttactccatgtgcacgggcaagttcaagatcgtgaaggagatcgccgagacccagcacgggactatcgtaatacgcgtccagtacgagggagacggtagcccttgcaagataccattcgaaatcacggacctggagaagcgacacgtgctggggcgcttgatcaccgtgaacccgattgtgaccgagaaggactcaccggtgaatatcgaagctgagccgcccttcggagacagctacatcattattggggtggagccgggacagctgaagctgaactggttcaaaaagggttccagcatcgggcagatgttcgagacgaccatgcgaggtgccaagcggatggccattctcggggataccgcgtgggacttcggctccctcggtggcgtcttcaccagtatcgggaaggccctgcatcaggtgttcggggcgatctacggcgccgcctttagcggggtgagctggactatgaaaatactaatcggcgttatcatcacctggatcggtatgaactcccggagcaccagtctgagcgtctcccttgttctcgtcggcgtggtaaccctctatctgggagccatggtccaggcggacagcgggtgcgtggtgtcatggaagaataaggaactgaagtgtggcagcgggatcttcataacagacaacgtccacacttggaccgagcagtacaagtttcaacccgagtcccctagcaagttagccagcgccattcagaaagcccatgaggagggaatctgcggaatccggtccgtcacccgcctggagaatctgatgtggaagcagatcacgcccgagctcaatcacatcttaagcgaaaatgaggtaaagctgacaatcatgaccggcgacatcaaaggaatcatgcaggcaggtaagcggtccctgcgcccgcagcctaccgaactgaagtacagctggaagacgtggggcaaggcgaagatgctgtcaaccgagagccataaccagaccttcctcatcgacgggcccgagaccgccgagtgccctaacacgaaccgggcatggaactccctggaggtcgaggattacggcttcggggtatttaccaccaacatctggctgaaactcagggagaagcaggacgtgttctgcgatagcaaactgatgagcgccgctatcaaggataatcgggccgtccacgctgatatgggctactggatcgagagcgccctgaatgacacctggaagatggaaaaggccagtttcatcgaggtcaagagctgccactggcccaaatcccacaccctctggagcaacggcgtgctagagtccgaaatgatcatccccaagaattttgcagggcccgtgagccaacataactacagaccgggctaccacacgcagaccgcggggccatggcaccttggcaagctcgagatggacttcgatttctgcgagggcaccaccgtggtggtcactgaggactgcggcaataggggcccgtcgctgcggaccaccacggccagcggcaagctgatcacggagtggtgttgccggagttgcacgctgccgcccctgcgctaccggggcgaggacgggtgctggtacggcatggaaatccgccccctaaaggaaaaggaggagaatttggtaaactccctggttaccgcagggcacggccagattgacaacttctctctgggcgtcctcgggatggcccttttcctggaggagatgttacggacccgggtgggcacgaagcacgcgatcctgttagtggccgtatcctttgtgaccctcatcaccgggaatatgagcttccgggacctgggcagggtaatggtaatggtgggagccaccatgacggacgacatcggcatgggcgtgacctacctcgcccttctggctgcgttcaaggtcaggcccaccttcgccgccgggctgctcttgaggaagctgacgtctaaagagctcatgatggccacgatcggtatcgccctgcttagccagtccaccatgcccgagaccatcctcgagctaacagacgcgctggccctcgggatgatggtgctgaagatcgttcgcaacatggagaagtaccagttagccgtcacaatcatggcaatcagctgcgttccaaacgccgtcatcctccagaacgcctggaaagtctcctgtacaatcctggccgccgtaagcgtcagtccactactactgaccagctcgcagcagaaggccgactggattccgctcgcactcaccatcaaaggcctaaaccccacagccatcttcttaaccacactctcaaggacttccaagaagcgtagttggccgctgaatgaggctatcatggccgtcggcatggtgagtatcctggcgagctccctcctcaagaacgatatccccatgacggggcccctggtcgcgggcggacttctaaccgtgtgctacgtgctgaccggcagaagcgcggacttggagctggaacgcgccgccgacgttaaatgggaggaccaggcggaaatcagcgggtcctctcccatcctgtccatcacaattagcgaggacggctccatgagcatcaagaatgaggaggaggagcagacgctcaccattctgataaggaccggcctgctcgtgatctccggggtgtttccagtcagcatccccatcactgctgccgcttggtacctgtgggaggttaagaagcaaagagccggggtgttatgggacgtgcccagcccgccgccagtggggaaggcagagttagaggacggtgcgtaccggatcaagcagcgtgggatactgggctacagtcagatcggcgccggggtgtataaagagggcacctttcacacaatgtggcacgtcacgcgcggggctgtcctgatgcaccgcggtaaacggatcgagccctcatgggccgacgtgaagaaggacctcatttcctacgggggcggctggaaacttgaaggcgagtggaaggagggcgaggaggtccaggtcctggctttggaacccgggaagaatccacgcgcggtgcagaccaagcccggcatatttaagaccaacacggggaccataggcgccgtctccctggacttctcacccggcacttccgggtcccccatcgtggaccggaagggcaaggtggttggtctgtacggcaatggcgtagtcacccgctccggtgcgtacgtctcggccatcgcgcaaaccgagaagtccatcgaggacaatcccgagatcgaggacgacattttcaggaagaagcgcctcaccatcatggatctacaccccggcgccgggaagaccaagcgatacctgcccgccatcgtcagagaggccatcaagcggggcctccgcaccctgatcctggcaccgactcgcgttgtcgcggctgagatggaggaggcactgcgggggcttcccattcgctatcagacccctgccatccgggccgaacacaccggccgcgagatcgtagacctgatgtgccacgcgaccttcaccatgcggcttctcagccccgtgcgcgtcccaaactacaacctgatcatcatggacgaggcgcactttacggaccccgcctccatcgccgcccggggttacatctccacccgcgtggagatgggagaggcggccggcatcttcatgactgcgactccgcccgggagccgtgacccgttcccccaatcaaacgcccctatcatggacgaggagcgagagatcccagagcggagctggaactcaggccacgagtgggtgaccgatttcaaagggaagaccgtctggttcgtgccgagcataaaggccggcaacgacattgccgcctgtctacgcaaaaatggcaagaaggtgatccaattatcccggaagaccttcgatagcgagtatgtgaagacacgcgccaacgactgggacttcgtggtgaccacggatatttccgagatgggcgccaactttaaggccgagcgggtcatcgatccacgcagatgcatgaaacccgtgatccttaccgacggtgaggagagagtgatcctggccggacccatgccggtcacccatagctccgccgcccagcggagaggacgaatcgggcggaacccgaaaaatgaaaacgatcagtacatctacatgggcgagcccctagaaaatgacgaggactgcgcgcactggaaagaggcgaagatgctgttagacaacatcaacacccccgagggcatcattccgagcatgttcgagcccgagcgcgagaaggtggacgccatcgatggggagtaccggctacgaggcgaagcccggaaaaccttcgtagacctgatgcgccgcggggatctgcccgtatggctcgcctacaaggtggccgcggaaggcatcaactacgccgaccgcaaatggtgcttcgacggcatcaaaaacaaccaaatactggaggaaaacgtggaggtagagatctggaccaaagaaggcgagcgaaagaagctaaagccacgctggctcgatgcccggatctactccgaccccttagccctgaaggagtttaaggagttcgcggccgggcgaaaaagcctgacgctgaacctgatcaccgagatggggcggttgcccaccttcatgacccagaaggctcgtaacgccttagacaatctggccgtccttcacacggcggaagccggcgggcgggcctacaaccacgccctgtccgagcttcccgagaccctcgagactctgctgctcctgacactgctggccacggtcacaggcggcatcttcttatttctgatgagcgggaagggtatcgggaagatgacattgggcatgtgctgcatcatcaccgcgtccagcctactgtggtacgctcaaatccaaccgcactggatagccgcctccatcatcctcgagttcttcctgatagtgctactaatccccgagccagaaaaacaacgaacaccccaagacaaccagctgacgtacgtagtcatcgcgatactgactgtggtggctgccaccatggccaatgagatggggttcctcgagaagaccaaaaaggacctgggactgggcagcatcgccacgcaggagtccgagtccaatatcctggacattgacctgcggcctgctagcgcgtggaccctgtacgccgttgccaccactttcgttacgcccatgctcaggcatagcattgagaactcatctgtgaacgtctctctgaccgcaatcgcgaaccaggccacagtgcttatggggctcggcaaggggtggcccctttcaaagatggatatcggcgtgccgctgctcgccatcgggtgctacagccaagttaacccgatcaccctgacagccgccctgttactgctggtagctcactacgccataataggtcccggtttacaggccaaggctacgagagaggcccagaagagagcggctgcagggatcatgaagaaccccaccgttgacggcattaccgtaatcgatctggagcccatcccgtacgacccaaagtttgagaaacagctcggacaggtgatgctcctgatcctctgcgtaacccaagtactcatgatgcggaccacatgggccctgtgcgaggccctgaccttagccacgggccccatctccacactgtgggaggggaaccccggccgcttctggaacacaaccatcgccgtaagcatggccaatatcttcaggggctcatacctggccggtgccggcctccttttcagcataatgaagaacaccactaatacccggcgggggaccggcaacatcggggagaccctgggggagaagtggaagtcccgactcaacgccttaggcaagagcgagttccagatttacaaaaagagcgggatccaagaggtcgaccgcaccctggcgaaggaaggcattaagcgcggggagaccgaccaccacgccgtcagccggggctccgcaaagctaaggtggttcgtggagcgcaacatggtgacccctgaaggcaaggtcgtggacctggggtgcggcagaggagggtggtcttactattgcggagggctgaagaacgttcgcgaagtcaagggtctcacgaagggcggcccggggcacgaagaacccatccctatgagtacttacggctggaacttagtgaggttgcaaagcggtgtggatgtcttcttcaccccgcccgagaagtgcgacaccctcctgtgcgacatcggcgagagctcccccaaccccacgatcgaggcaggccgcacactgagagtgctcaatctcgtggagaattggctgaataacaacacccagttctgcatcaaggtactcaacccgtacatgcccagcgtgatcgagaagatggagacccttcagcgcaaatatggaggggccctggtgcggaaccccctctctcgtaacagcacacacgaaatgtactgggtatccaacgccacggggaatattgtcagctccgtgaacatgatctctcggatgctgataaatcgcttcacaatgaagcacaaaaaggccacctacgaacctgacgtcgacctgggctccgggacccggaacatcggcatcgaaagcgagatccccaacctggacatcatcggcaaacgcatcgagaagattaaacaggagcacgaaacgtcctggcactatgaccaggaccacccctacaagacctgggcgtaccatgggtcatacgaaaccaaacagaccggctccgcgagctccatggtcaacggggtggtgcgcctcctgacgaaaccctgggacgtggtaccgatggtcacccagatggcaatgaccgacacaacgcccttcggccagcagagggtattcaaggagaaggtggataccaggacccaggagcccaaggaggggaccaagaagctgatgaagatcacggctgaatggctctggaaggagctggggaagaagaagacgcctcgaatgtgcacccgtgaggagttcacccggaaggtacgctcgaatgccgccctcggcgcgatcttcacggacgaaaacaagtggaagtccgcccgggaggccgtggaggacgggagattctgggagctcgttgaccgggagcgcaacttacaccttgaaggcaagtgcgagacctgcgtctacaatatgatgggaaagcgggagaagaagctcggcgagttcggcaaagccaaagggagccgggcgatctggtacatgtggctgggggcccggttcctggagttcgaggccctcgggttcctgaacgaggaccattggttctcccgaggcaatagcttatcaggggtggagggcgagggcctccaccggctggggtacatactgcgcgaggtaggcaagaaagaaggcggagccatgtacgccgatgacacagccgggtgggacacccggatcacactcgaggatctgaagaacgaggagatggtgaccaaccatatgaagggcgagcacaagaagttggctgaggccatcttcaagttgacctaccagaataaggtggtccgggtacagcggccgacgccacgcggcaccgtgatggacatcatttcccgccgcgaccagcgcgggagcggccaggtgggaacatatggcctgaacaccttcactaatatggaggcgcagctgatccgccaaatggagggcgaggggattttcaagtccatccagcacctcacggcgaccgaggagattgcggtgcagaactggctagcccgcgtgggccgcgaacgcctcagccggatggccatctccggggatgactgcgtcgtgaagcccatagacgaccggttcgctagtgcccttaccgcgctaaatgacatgggcaaggtgcggaaagatattcagcagtgggagccctccagagggtggaacgactggactcaggtcccgttctgcagccaccatttccatgagctggtgatgaaggacggtcgggtattggtcgtgccctgccgtaaccaggacgagctgattggcagggccaggatcagccagggcgccggttggtccctaaaggagacggcctgcctcggcaagtcgtatgctcagatgtggacacttatgtactttcacaagagagacctgcgcctcgcggccaacgccatatgcagcgctgtgccctcccactgggtccccactagcagaaccacctggagcatccacgctaagcacgaatggatgacgacagaggatatgctggcggtgtggaacagagtgtggatccaggaaaacccatggatggaggacaagacccccgttgaaagctgggaggaggtgccctacctgggcaaacgggaagaccagtggtgcgggtctctcatcggattaacctcgcgggcaacgtgggctaagaacatccagaccgccatcaaccaggtgcgatctctgatcggcaacgaggagtacacagattatatgccctccatgaagcggttccggcgggaggaggaggaagcgggggtcctctggtga

SEQ ID NO: 25603 - RNA, 9876 nt, synthetic construct
  misc_feature 1..9876: note = derived and/or modified CDS sequence (opt11) from DENV-2__AY702040__SS-prME
  source 1..9876: mol_type = other RNA
accgcgggaatgatcatcatgctcatccccaccgtgatggcattccacttgaccacgcgaaacggggagccacacatgatcgtgagccggcaggagaagggcaagagcctgctgtttaagactaaggatgggaccaatatgtgcaccctcatggcgatggacctgggcgagctgtgcgaagacaccataacctataagtgccccttcctcaagcaaaacgagcccgaagacatcgactgctggtgcaacagcacgtccacgtgggtgacctacgggacctgcaccacgaccggcgagcaccgccgggagaaaagatccgtagccctcgtcccgcacgtgggcatggggctggaaacccggaccgaaacatggatgtccagcgagggcgcctggaagcacgcccagagaatcgagacctggatcctccggcatcccgggttcaccatcatggccgcaatattagcctacaccatcggcacgacccatttccagcgcgtgctgatattcatcctcctgactgccatcgccccctcgatgaccatgcggtgcatcggaatttcaaaccgggacttcgtcgaaggcgtctctggcgggagctgggtggacatagtcctggagcacggctcctgcgtcacgaccatggcgaaaaataagcccaccttggacttcgagctgatcaagaccgaagcaaagcagcccgccactctacggaagtactgcatcgaggccaagcttactaacaccaccacggacagccgctgcccgacacagggggagcccacattaaacgaggagcaagacaagcggttcgtgtgtaagcactccatggtcgaccgcggctgggggaacgggtgcggcctgttcgggaagggcgggatagtgacctgcgccatgttcacgtgcaagaagaacatggagggcaaaatcgtgcagcccgagaacctcgagtacaccgtcgtaatcacgccccacagcggcgaggagcacgctgtggggaacgacaccggcaaacacgggaaagaggtcaagatcacgccgcagtccagtatcacggaggccgagcttaccgggtacgggacggtgaccatggagtgcagcccccggacgggcctggacttcaacgagatggtgctcctgcagatggaggacaaggcctggctggtccaccgccagtggtttctcgacctgcccctgccctggctaccgggcgccgacacccagggaagcaactggatccaaaaggagacactagtaaccttcaaaaacccccacgccaagaagcaggacgtcgtagtgctggggtcccaggagggggcgatgcatacggcgctgaccggcgccaccgagatccagatgagcagcgggaacctgctgttcaccggccacctcaagtgccggctgcgcatggataagctgcagctcaaaggtatgtcgtacagcatgtgcacggggaagttcaagatcgtcaaggagattgccgagacccagcacggcaccattgtgatccgggtgcagtacgagggggatggctccccctgcaagattcccttcgaaatcatggatcttgagaagcgacacgtcctgggccggctcattaccgtgaacccaatcgtgacggaaaaggacagcccagttaacatcgaagccgagccgcccttcggggactcatacatcatcatcggcgtggagccggggcagctgaagctggactggtttaagaaaggcagctccattgggcagatgtttgagaccaccatgcggggcgcgaagcgcatggccatcctcggcgacaccgcctgggacttcgggagcctgggtggggtctttacgagcatcggcaaggccttacaccaggtcttcggggccatctacggcgcggcattcagcggggtgtcctggaccatgaagatcctcatcggggtgatcatcacttggatcggcatgaactctcgctccaccagcctgagtgtaagcctggtgctggtggggatcgtcacgctctacctgggcgtgatggtgcaggccgactccgggtgcgtcgtgtcgtggaagaacaaggagctgaagtgcggctccgggatcttcgtgaccgacaacgtacacacctggaccgagcagtacaaattccaaccggagagccccagtaagctcgcctccgcgatccaaaaggcccacgaggaggggatctgcggcattcgcagcgtgacgcggctggagaatctgatgtggaagcagatcaccagcgagctcaaccacatcctgagcgagaatgaggtgaagctgaccataatgaccggggacatcaaaggcatcatgcaagtcgggaagcgctccctccggcctcaaccgacggagctgcggtacagctggaagacctgggggaaggccaagatgctctccactgaactccacaaccagaccttcctgattgacggccccgagacagccgagtgcccaaacaccaaccgggcctggaactccttggaggtggaggactacgggttcggcgtgttcaccaccaacatctggctccgcctgcgggagaagcaggacgcgttctgcgatccgaagctgatgtccgccgccatcaaggacaaccgcgccgtccacgccgacatggggtactggatcgagagcgcgctcaacgacacctggaagatcgagaaggccagtttcatcgaggtgaagtcctgccactggcccaagtcccacacgctgtggagcaacggggtgctggagtccgagatggtcatcccgaagaacttcgccggccccgtctcccaacacaacaacagaccggggtaccacacccagaccgccggcccctggcacctcgggaagctggagatggacttcgacttctgcgaaggaaccacggtggtcgtgaccgaggagtgcgggaaccgcgggccctccctgcggacaactacggcaagcggcaagctcatcaccgagtggtgctgccgcagctgcaccctgcccccgctgagataccgcggggaggacggctgctggtacgggatggagatccgacccctaaaggagaaagaggagaacctcgtctctagcctggtcaccgcgggtcacgggcaaatcgacaacttctccctcggcatcctgggcatggcactgttcctcgaggagatgctgcgcacgcgggtggggaccaagcacgccatccttctcgtggccgtgtcattcgtgaccctgatcaccgggaacatgtccttccgcgacctgggccgcgtgatggtcatggtgggcgcgacgatgaccgacgacatcggtatgggcgtgacctacctcgccctgttggcggccttcaaggtccggccaaccttcgccgcgggcctcctgttgcgcaagctaacgagcaaggagctgatgatgacgaccatcgggatcgtgctgctttcccaaagctccatccccgagaccatcctggagctgacggacgccctggccctgggcatgatggtgctgaagatggtccggaatatggagaagtaccagctcgccgtgaccatcatggccatcctgtgcgtgccgaacgcggtcatcctgcagaacgcctggaaggtaagctgcaccatcctcgccgttgtgtccgtgagccccctgttgctcacctcctctcaacagaaagccgactggatccccctggcgctgacgatcaagggattgaacccaaccgcgatcttcctgacaaccctgtcccgcacgagcaagaagcggtcctggccgttaaatgaggccatcatggccgttggcatggtaagcatcttagcctccagcctattaaaaaacgatatacccatgaccggccccctggtggccggcgggctgctcaccgtctgctacgtgctgacagggcgcagcgccgacttggagctcgagcgggccacggacgtgaagtgggacgaccaggccgaaatttccgggagctcccccatcctgagcatcatcatctccgaggacggtagcatgtccataaagaatgaggaggaggaacagaccctgaccatactcatccggaccggtctgctggtcatctcaggactctttccagtctccatacccatcaccgctgcggcctggtacctgtgggaggtcaagaagcagcgagccggggtcctgtgggacgtgccctcgccaccgcctgtaggccgcgccgagctcgaggacggggcctatcggatcaagcagaagggcatccttgggtactcccagattggcgcgggcgtgtacaaggaggggacgttccatactatgtggcacgtgacccgcggcgccgtgctgatgcacaagggtaagcggatcgaaccctcctgggccgacgtcaagaaggacctcatctcctacggcgggggatggaagctggagggcgagtggaaggagggggaggaggtccaggtgctggccctcgagcccgggaaaaacccccgcgccgtccagaccaagcccggccttttccgcacaaacaccggcaccatcggggcggtgagcctggacttctcccccggcaccagcggctcccccatcgtggacaagaaggggaaagtcgtaggcctttacgggaacggcgtggtcactcgcggcggggcctacgtgagcgccatcgcccagaccgagaagtccatcgaggacaaccccgagatagaggacgacatcttccggaagcgtcggctgaccatcatggacctgcaccccggtgccgggaagaccaagcgctacctgcctgcgattgtacgggaggccattaaacgcgggcttcgcacgctgatcctggcgccgacccgggttgtggccgcggagatggaggaggccctccgcggcctgcctatccgataccagacacccgccatccgcgccgagcacacgggccgggagatcgtggacctcatgtgtcacgccacgttcacgatgcgcttgctaagtcccatccgagtcccgaactacaacctaatcatcatggacgaggcgcacttcaccgaccccgccagcatcgccgcccgtggctacatctccacccgggtggagatgggggaggccgcgggcatcttcatgacagccacgccgcccgggagccgcgacccgttcccccagtccaacgcgcccatcatggacgaggagagggaaatccccgagcgcagctggaactctggccacgagtgggtgacagacttcaagggcaagaccgtctggtttgtcccgagcataaagacgggcaacgacatcgccgcttgcctacggaagaatggcaagcgcgtcatccagctgtccagaaagaccttcgacagcgagtacgtcaagaccaggaccaacgactgggatttcgtggtgacgaccgacatttccgagatgggggcgaattttaaggccgagagagttatcgaccccagacggtgtatgaagcctgtgatactgaccgacggagaggagcgcgtcatactcgccgggcccatgccggtcacccactcatccgccgcgcagaggcggggccgcatcggtcggaacccccgcaacgagaacgaccagtacatttacatgggcgagcccctggagaacgacgaggactgtgcccactggaaggaagccaagatgctgctcgacaacatcaacacgcccgagggtatcatcccgagcatgttcgagcccgagcgggagaaggtggacgccattgacggggagtacagactgcggggcgaggcccgcaagaccttcgtggatctgatgcggcgcggcgacctgcccgtctggctggcgtataaggtggccgccgagggaattaactacgccgacagacgctggtgcttcgacgggacccggaacaaccaaatcctggaggagaatgtggaggttgagatctggaccaaggaaggcgagcgcaagaagctcaagcctcggtggctggacgcccgcatctactccgacccactggcgcttaaggagttcaaggagtttgccgcgggccgcaagtcactgacgctgaacctcatcaccgagatggggcgcctgcccaccttcatgacccagaaggcgagggatgccctggacaacctcgcggtgctgcatacggccgaagccggtgggaaggcctacaaccacgcgctgtcggagctacccgagaccctggagaccctgctactgctgaccctcctggccaccgtcacgggcggcatcttcttgttcttaatgagcgggcgcggcatcggaaagatgaccctgggcatgtgctgcatcatcaccgcctccatcctgctctggtacgcccaaatccaaccgcactggatcgccgcgagcataatcctcgagttctttctgatcgtgctcctaatcccggagcccgagaagcagcgcacgccccaggacaaccagctgacgtacgtgatcatcgccatcctcaccgtcgtggccgccaccatggccaatgagatgggattcctggagaagaccaagaaggacttcggcctgggccacattgcaacgcagcagccggagtccaacatcttggacatcgacctgcgccccgccagcgcctggaccctgtacgccgtggctaccaccttcatcacgcccatgctccgccacagcatcgagaactcgagcgtcaacgtgtccctgaccgcgatcgccaatcaggccaccgtgctgatggggctcggcaaagggtggccgctgagcaaaatggacatcggcgtcccgctgctcgccattggatgctactcccaggtgaaccccataaccctcacggccgcgctgctactgctggtggcccactacgcgatcatcggcccgggtcttcaggccaaggcgacccgggaggcccaaaagcgcgctgccgccggtatcatgaagaacccgaccgtcgacggcatcaccgttatcgacctggatccgatcccctacgaccccaagttcgaaaaacagcttggccaagtgatgctcctggtcctgtgcgtgacacaggtgctcatgatgcggaccacctgggcgctgtgtgaggccctgaccctcgccacgggccctgtcagcaccttgtgggaggggaacccgggccgcttctggaacaccaccatcgccgtttccatggccaacatattccggggcagctacctggcgggggccggccttctgttctccatcatgaagaacacaaccagcgcccggcgagggaccggcaacatgggggaaaccctgggggagaagtggaagtcgcgcctcaacgccctgggcaaaagtgagttccagatctacaaaaagtccgggatccaagaggtggatcggacgctggccaaagagggcatcaagcgcggggagaccgaccaccacgcggtcagccggggctccgcgaagctccgctggttcgtggagcggaacctggtcacccccgaggggaaagtagtggacctgggatgcggccgcggtggctggtcctactactgcggaggcttgaagaacgtgcgggaggtcaagggcctgaccaaaggcgggcccgggcacgaagagcccatcccgatgtccacgtatggctggaacctggtgcggctccagagcggggtggacgtcttctttgtgccgcccgaaaagtgtgacaccctgctgtgtgacatcggcgaatccagccccaacccgaccgtggaagccggccgaaccctccgcgtcctgaacttagtggagaactggctcaacaacaacacccagttctgcgtgaaggtcctgaacccctacatgcccagcgtgatcgagcggatggagacgctccagcgcaagtacgggggcgcactggtgcgcaacccgctctccaggaacagcacccacgagatgtactgggtctccaacgcgtcgggcaacatcgtgtccagcgtgaatatgatctcccgcatgttaatcaaccggttcacgatgcggcacaagaaggccacctacgagccagatgtggacctgggcagcgggacacggaatatcggcatcgagtccgagacacccaacctcgacatcatcggcaagcgcatcgagaagatcaagcaggagcacgagacctcgtggcactacgaccaggaccacccctacaagacctgggcgtaccacgggagctacgagacgaagcagaccggaagcgcctccagcatggtgaacggtgtggtccggctgctgaccaagccgtgggacgttatccccatggtgacccagatggcaatgacggacaccacccccttcggccagcagcgcgtcttcaaggagaaggtggacacccggacgcaggagcccaaagagggcaccaagaaactaatgaagatcacagcggagtggctgtggaaagaactggggaagaagaagaccccgaggatgtgcacgcgggaggagttcaccaagaaggtgcgctccaacgccgccctcggcgcaatcttcaccgacgagaacaagtggaaatcagcccgggaggcggtcgaggacaaccgcttctgggagctggtggacaaggagcggaacctgcacctcgaggggaagtgcgagacctgcgtctacaacatgatgggcaagcgcgaaaagaagttaggggagttcggcaaggccaagggctcccgggccatctggtacatgtggctgggggcccgcttcctcgagttcgaggccctgggcttcctgaatgaggaccactggttcagccgggagaactctttaagcggggtggagggcgaggggctgcacaagctgggctacatcttacgcgaggtgagcaagaaggagggcggggcgatgtacgcagacgacacggccggctgggatacacggatcacaatagaggacctgaagaatgaagagatgatcaccaaccacatggcgggggagcacaagaagctggcggaggccatcttcaagctcacgtatcagaacaaggtcgtgcgcgtacagcgccccacgccccggggcacagttatggatatcatcagccgcaaggaccagcgtgggagcggccaggtgggaacctacgggctgaacacgttcaccaacatggaggcccagctgatccgccagatggagggcgaggggatcttcaagtccatccagcacctcaccgcttccgaggagatagccgtgcaggactggctggtccgggtgggccgcgagagactgtcccgcatggcgatcagcggcgacgactgtgtagtcaagcccttagacgatcggttcgccaaagccttgaccgccctgaacgacatggggaaagtgcgcaaggacatccagcagtgggagccctctcggggctggaacgactggacccaggtgcctttctgcagccaccacttccacgagctcatcatgaaggacgggcgcaccctggtcgttccctgccggaaccaagacgagctgatcggccgcgccagaatctcccagggagcagggtggagcctccgcgagaccgcctgcctgggcaagtcctatgcccagatgtggtcgctaatgtacttccaccggcgcgacctccggcttgccgccaacgcgatctgttccgccgtgcccagccactgggtcccgacctcccgcactacgtggtctatccatgccagccacgagtggatgaccaccgaggacatgctgaccgtgtggaaccgcgtgtggatcctcgagaacccctggatggaggacaagactcccgtcgagagctgggaggagatcccctacctgggtaagcgggaggaccagtggtgtggctcgctgatcggtctcacctcccgcgccacctgggccaagaacatccagaccgcgatcaaccaggtgcggagccttatcggcaacgaggagtacacggactacatgccgtcgatgaaacgcttccggcgcgaggaggaggaagctggggttctgtggtga

SEQ ID NO: 25604 - RNA, 9876 nt, synthetic construct
  misc_feature 1..9876: note = derived and/or modified CDS sequence (opt11) from DENV-2__AY037116__SS-prME
  source 1..9876: mol_type = other RNA
acagcgggtatcatcatcatgatgatacccaccgtgatggccttccacctgaccacccgcaacggggaaccccacatgatcgtctcgcggcaagaaaaaggcaagagcctcctgttcaaaacagagaacggggtgaacatgtgcaccctgatggcgatggacctcggcgagctatgcgaggacacgatcacctacaactgccccctactccgccagaacgaacccgaggacatcgactgcgggtgccactcaaccagcacttgggtgacctacgggacctgtaccgctaccggggagcatcggcgcgaaaaacggagcgtcgccctagtcccccacgtggggatggggctggaaacccgcactgagacctggatgtccagcgaaggggcgtggaagcacgcccaacggattgagacctgggtcctccgacaccccggcttcacgataatggcggcgatactggcctacaccatcgggacgacctacttccagcgggtgctgatctttatcttgctgactgccgtgaccccctccatgaccatgcgctgcatcggcatatctaaccgagatttcgtcgagggcgtgtccggcgggagctgggtggacatcgttctagagcacgggtcctgcgtgaccacgatggcgaagaacaagcccaccttggacttcgagttagtgaagaccgaggccaagcacccggccaccctgcgcaagtactgtatcgaggcgaagctcacgaacaccaccaccgccagccggtgtccaacgcagggagagccgtccctgaacgaggagcaggacaagcgattcgtgtgcaagcacagcatggtggaccggggttgggggaacggctgtgggctattcggaaagggcggcatcgtaacctgcgcgatgtttacatgcaagaagaatatggagggcaaggtcgtgcagcccgagaacctagagtacaccatcgtgatcacgccgcactccggagaggagaatgctgtcggaaacgacaccgggaagcacggcaaggagatcaaggtgaccccgcagagctccatcaccgaggccgagctaaccgggtacgggacagttaccatggagtgcagcccccgcaccggcctggacttcaacgagatggtcctcctgcagatggaaaacaaggcgtggctggtgcatcggcagtggttccttgacctgcccctgccctggctcccgggggccgacacccagggctccaactggatccagaaggagacgctggtaaccttcaagaacccccatgcgaagaagcaggacgtggtggtcctggggagccaggagggtgccatgcacaccgcgctcaccggcgccacggagatccagatgagctctggcaacctgctgttcaccggacacttgaagtgccgcctgcggatggacaaattacagctcaagggcatgagctactccatgtgcaccggcaagttcaaggtggtgaaggagatcgccgagacccagcacgggacgatcgtaatcagggtgcagtacgagggcgacggcagcccctgtaagatcccgttcgagatcatggacctggagaagcggcacgtgttggggcgcctcattaccgttaacccgatcgtaaccgagaaggactcccccgtgaacatagaggcagagccgcccttcggagactcatacataatcatcggggttgagccgggccagctgaagttgtcctggtttaagaaggggagctccatcggccaaatgttcgaaaccaccatgcgcggtgccaagagaatggccatcctcggggacaccgcatgggacttcggcagcctcggaggggtgttcacctccattgggaaagccctgcaccaggtgttcggggcaatctacggcgccgccttctcgggggtctcctggaccatgaagatcctcatcggcgttgtcatcacgtggattgggatgaacagccgctccaccagcctgtccgtcagcctggttttagttggcgtggtgaccctctacctgggggtgatggtccaggctgattccggatgcgtggtgtcatggaagaacaaggagctgaagtgcggcagcggaatcttcatcaccgataacgtccacacctggaccgagcaatacaagttccagcccgagtccccaagcaagctagcgtccgccattcaaaaggcccacgaggagggcatctgtgggatccggtctgtgacacgcctggagaacctgatgtggaagcaaatcacgcccgagctcaaccacatcctatccgagaacgaggtcaagctgacgatcatgactggcgacatcaaggggatcatgcaggccggtaagcggagcctccggcctcagcccacagagctgaagtactcctggaaggcctggggcaaggcgaagatgctgagcacagagctgcacaaccacacctttcttatcgacgggcccgagaccgccgagtgcccgaacaccaaccgggcctggaactcactggaagttgaggactacggcttcggggtgttcaccacgaacatctggctcaagctgaaggagcgccaggacgtgttctgcgacagcaagctgatgtccgctgccataaaggacaaccgcgcggtccacgccgacatgggctactggattgagagcgccctcaacgacacctggaagatcgagaaggcctccttcatcgaagtcaagagctgccactggccaaagtcccacaccctgtggagcaatggcgtgctggagagcgagatgatcatccccaagaacttcgcaggacccgtctcacagcacaattaccgcccgggctaccacacccagactgctgggccctggcacctcggccggctggagatggacttcgacttttgcgaggggacaaccgtggtggtcaccgaggattgcggcaacagaggccccagcctgcgaacgacgactgcctccggcaagctcatcaccgagtggtgctgccgcagttgcaccctcccaccgctgagatatcgcggcgaggacgggtgctggtacggcatggagatacggcccctcaaggagaaggaggagaacctcgtgaactccctggtgacggccgggcacgggcagatagacaacttctcactcggggtcttagggatggccctgttcctcgaagagatgttgcgcacacgtgtgggcaccaagcacgcaatcctgctcgtggccgtttccttcgttaccctcatcacggggaacatgagtttccgcgacctgggccgcgtgatggtcatggtgggggccaccatgaccgacgacatcggcatgggcgttacctacctcgctctgttagccgcgttcaaggttcggccgacgttcgccgccgggctcctgttacgcaaattgacttccaaggagctgatgatgaccaccatcggcatcgtgctgctcagccagtccacgatacccgagaccatactggagctgaccgacgcctgggcccttggtatgatggtcctgaagatcgttaggaacatggagaagtatcagctagcggtgaccatcatggccatcctgtgcgtcccgaatgcggtgatcctgcagaacgcctggaaggtgagctgcacaacgctggccgtcgtctccgtgagcccgctcctgctgacctccagccagcagaaagcggactggatcccgttggccctgaccatcaagggcttaaaccccacggccatcttcctcaccaccctttcccgcaccagcaagaagcggtcctggccactgaacgaggccatcatggcggtcggcatggtaagcatactcgcctccagcctgctgaagaacgacatccccatgacggggccactcgtggccggagggctgctgaccgtctgctatgtgctcaccggccgcagcgctgacctggagctggagcgggccgcggacgtgcgctgggaggagcaagccgagatttccggttcctcacccatcctctctattaccatttcggaggacggctcgatgtctattaagaatgaggaagaggagcagactctgaccatcctgatccgcaccgggctcctggttatttctgggctgttcccggccagcatacctatcaccgcagcagcgtggtacctctgggaggtcaagaagcagcgcgccggtgtgctgtgggacgtccccagcccgcctcccgtggggaaggccgagttggaagacggggcctaccggatcaagcagaaggggatactcggctactcccagatcggcgctggggtctataaggagggcacgttccacacgatgtggcacgtgacccgcggggcggtgctcatgcacaagggcaagcggatcgagccatcttgggccgacgtcaagaaggacctgatctcctacgggggtggctggaagctcgagggggagtggaaggaaggggaggaggttcaggtgctggccctggagcccgggaagaacccccgcgccgtgcagaccaagcccggactcttcaagaccaacacgggtaccatcggcgcggtaagcctggacttcagccccggaaccagcgggagccccatcgtggacaagaagggcaaggtggtcgggttatacggtaatggagtggtaacccgtagcggtgcgtacgtctccgccatcgcccagacggagaagtccatcgaggacaaccccgagatcgaggacgatatcttcagaaagaaacggctcacgataatggaccttcacccgggtgccgggaaaaccaagcgctacctgccagccatcgtacgggaggctataaagcgcggcctgcggaccctcatactggccccgacgcgcgtcgtcgcggccgagatggaggaggccctgcgcggactccccatccggtaccagaccccggccatccgcgccgagcacaccggccgggaaatcgtcgacttaatgtgccatgcaaccttcactatgcgcttactcagccccatccgggtgccgaactacaacctgatcatcatggacgaagcccacttcactgaccccgcgtctatagccgcccgcggctacatatctacccgggtcgagatgggggaggccgccggcatctttatgaccgcgacgcctcccgggtctcgcgacccgttcccccaaagcaacgccccaatcatggatgaggagcgggagattcccgaacgctcctggaactcaggccacgagtgggtgactgacttcaaggggaaaaccgtgtggttcgtcccgtccataaaggccggaaacgacatcgccgcgtgccttcgaaagaacggcaaaaaggtgatccagctcagccgcaaaaccttcgactccgagtatatcaaaacgcggaccaacgattgggacttcgtggtcaccaccgacatcagcgagatgggcgccaacttcaaagccgagcgcgtgatagacccccggcgctgcatgaagccagtgatcctgacggacggcgaggagcgggtcatcctggccggcccaatgccggtaacccacagtagcgccgcgcagcgtcggggccgcgttgggagaaaccccaagaatgagaacgaccagtacatctacatgggcgagcccctcgagaacgacgaggactgcgctcattggaaggaggcgaagatgctgctggacaacatcaacacccccgagggcataatcccgtccatgttcgagccagagagagagaaagtcgacgccatcgacggggagtatcggcttcggggcgaggctcgcaagactttcgtggacctgatgagacgcggggatctgcccgtctggctcgcctatcgggtggccgcggaggggatcaactatgccgaccgtcggtggtgcttcgacggggtgaaaaacaaccagatccttgaggagaacgtggaggtcgagatatggacgaaagagggcgagcgcaagaagctgaagccgagatggctcgatgcccggatatactctgacccccttgcgctgaaggagttcaaggagttcgccgcgggacggaagtccctcaccctgaacttaatcaccgagatggggcgcctacccacattcatgacgcagaaggcgcggaacgcgttggacaacttagccgtgctccacaccgccgaggcgggcgggcgcgcctacaaccacgcgctgagcgagctgcccgagaccctcgaaacgttactgcttctaacgctgctcgccaccgtcaccggcggcattttcctctttctgatgtcgggcaagggtatcgggaagatgaccctgggcatgtgttgcataatcacagcaagcattctactgtggtacgcccaaatccaaccgcactggatcgccgcatccataatcctcgagtttttcctgatcgtactgctcattcccgaacccgagaagcagcggacgccgcaggacaaccagctcacctacgttgtcatcgcgatcctgaccgtggtggccgcaaccatggccaacgagatggggttcctcgagaagactaagaaggactttggcctgggcagcatcgcgactcagcagcccgagagcaacatcctggacattgacctccgtccggcctccgcctggaccctgtacgctgtagccaccacgttcatcacccccatgctgcggcacagcatcgagaactccagcgtgaatgtgtcgctcaccgcgatcgcgaaccaagcgaccgtcctgatggggctgggcaaggggtggccactctcgaagatggacatcggtgtgccgctcctggcaatagggtgctactcccaggtgaaccccatcaccctcaccgcggccctgctgttgttggttgcccactacgccatcataggccccggccttcaggccaaagccacccgcgaggctcagaaaagggcggccgcaggtatcatgaagaacccgactgttgacggcatcacggtgatcgaccttgacccaatcccctacgaccccaagttcgagaagcagcttggacaggtcatgctgctcgttctgtgcgtcacacaggtcctgatgatgcgcaccacttgggcgctttgcgaggccctgacgctggccaccggcccaatatcgacgctctgggaggggaacccgggccgattctggaacaccacgatcgccgtgagtatggccaacatcttccggggctcttacctggccggtgccggcctgctgttctccatcatgaaaaacacagcgaacacccgccggggaaccggcaacacgggcgaaaccctcggggagaagtggaaaaatcgcctgaacgccctcggcaagagcgagttccagatctacaagaaatccgggatccaggaggtggaccggaccttggctaaagaaggcatcaagcgcggagagaccgatcaccacgccgtcagccggggctccgccaaactgcgctggttcgtggaacgcaacctcgttacgcccgaaggcaaggtcgtggaccttggctgtggccgcgggggttggagctattactgcggaggactgaagaacgtgaaggaagtcaagggcctcaccaagggcggtcccgggcacgaggagcccatccctatgtccacctacggctggaacctggtgcggctgcagagcggggtggacgtcttcttcacgccgcccgagaagtgtgacacgctcctgtgcgacatcggggagtcatcgcccaacccaaccgtggaggccggccgcacactgagggtgttgaacctggtcgagaattggctgaacaataatacccaattctgcatcaaggtcctcaacccctacatgcccagcgtcatcgagaagatggaggccttacagcgtaagtacgggggcgcgctggtacgcaacccgctctcccgcaactccacacacgagatgtactgggtgtccaacgccagcgggaacatcgtgtccagcgtgaacatgatctcccgcatgctcatcaatcgcttcacgatgcggcacaagaaagcgacctacgagcccgacgtcgacctgggctccgggaccaggaacatcggtatcgagtccgagacgccgaacctggacataatcggaaagcgcatcgagaagataaagcaggaacatgagacgagctggcactatgaccaggatcacccctataagacctgggcgtaccacgggagttacgagaccaagcagaccggctcagcctcctcgatggtgaacggggtcgtacggctcctgacgaagccgtgggacatcatccccatggtgacccagatggcaatgactgacactacgcccttcggccagcagcgagtcttcaaggagaaggtagacacccgaacccaggagcccaaggagggaaccaagaagctgatgaaaatcacggcagagtggctctggaaggagctggggaagaagaagaccccgcgcatgtgcaccagagaggagtttacccggaaggtccggagcaacgccgccctgggtgcaatctttacggacgagaacaagtggaaatccgcgcgcgaagccgtggaggactccgggttctgggagctcgtggataaggagcggaacctccatctggagggcaagtgcgagacctgcgtctacaacatgatggggaagcgcgaaaagaagctcggcgagttcggcaaggccaaggggagccgggccatctggtacatgtggctgggcgcgcgcttcttagagttcgaagctctcgggttcctgaacgaggaccactggttttcccgggagaacagcttgagcggcgtagagggggaaggccttcacaagctggggtacatcctgcgtgatgtatcgaagaaagagggcggagccatgtatgcggacgacaccgccggttgggacacccggattacgctcgaggaccttaagaacgaggagatggtcaccaaccatatggagggcgagcacaagaagctggcggaagcgatattcaaactcacctaccagaacaaggtggtgcgagtccaacggcccacgccgcgtgggacggtgatggatatcatcagccggcgcgatcagcggggctccggccaggttgtcacctacgggctgaacaccttcaccaatatggaagcccagctgatccgccagatggagggtgagggggtgttcaagagcatccagcacctcacggtgaccgaggagatcgccgtcaagaactggctggtgcgcgtgggccgggagcgcctatcccggatggccatcagcggcgatgactgcgtcgtgaaacctctcgatgatcgcttcgcgtccgccctgactgccctgaacgacatggggaaggtgcggaaagacatccagcagtgggaaccgagccgcggatggaacgactggacccaagtccccttctgctcccatcacttccatgagctcattatgaaggacgggcgggtgctcgtggtcccctgccgcaatcaggacgagctgatcggccgggcacgcatcagccagggggccggctggtccctacgggagacggcgtgcctgggcaagagttacgcccaaatgtggtccctgatgtacttccacaggcgggacctccgcctggccgccaacgccatctgcagcgcggtgccctcccactgggtgccgaccagccggaccacatggtccatacacgccacacacgagtggatgacgacggaggacatgctgaccgtctggaaccgcgtatggatccaggagaatccatggatggaggataagacccccgtggagagctgggaggagattccctacctagggaagcgtgaggaccagtggtgcgggagcttaattgggctgacgtcccgagccacctgggctaagaacatccaaaccgcgatcaaccaggtccggagcctcatcggcaacgaggagtacaccgactacatgccatccatgaagcgcttccgcagggaggaggaagaggccggggttctgtggtaa

SEQ ID NO: 25605 - RNA, 9876 nt, synthetic construct
  misc_feature 1..9876: note = derived and/or modified CDS sequence (opt11) from DENV-2__AF169678__SS-prME
  source 1..9876: mol_type = other RNA
agtgcgggcatgataatcatgctgatccccaccgtgatggcgttccatctcaccacgcggaacggggagccccatatgatcgtatcgatccaggaaaaggggaaaagccttctgttcaagaccgaggatggggtcaacatgtgtacgttgatggctatggacctgggcgagctctgcgaagataccatcacctacaagtgccccctccttcggcagaatgagccagaagacatagactgctggtgtaatagcaccagcacctgggtcacctacggtacctgcaccaccaccggcgagcaccgccgggagaagcgctccgtcgccctggtgccacacgtgggcatgggcctagagacccggaccgagacgtggatgagctcggagggcgcctggaagcacgcccagcgcatagaaacgtggatcctccgccaccccggttttaccatcatggccgcgatcctggcctacactatcggcactacccacttccaacgcgctctcatattcattctgctgacggccgtcgctcccagcatgaccatgcggtgcatcgggattagtaaccgtgacttcgtggagggcgttagcggcgggtcctgggtagacatcgtgttggaacatgggagctgcgtgaccaccatggccaaaaacaagcccacgctggactttgagctgatcaagacggaggccaagcagcccgccacccttcggaaatactgcatcgaggccaaacttaccaacacgaccaccgagtcccgctgtccgactcaaggggagcccagcttaaaggaggaacaggacaaacggtttgtctgcaaacactctatggtcgaccgaggctggggcaacgggtgcgggctgtttgggaaaggcgggattgtgacttgcgcgatgttcacatgcaagaagaatatggaaggtaaaatcgtccagcccgaaaatctggagtatacgattgttgtgacaccccacagcggcgaggaacacgccgtcggtaacgatacgggtaagcatggtaaggagattaaggtgacccctcagtcgagcatcacagaagcagagctgacgggatatggaaccgtgacgatggaatgctctccgcggactggcctggacttcaacgagatggtcctgctgcaaatggaaaacaaagcatggcttgtccaccgtcagtggttcctagacctgcccctcccatggctgccgggcgcagatactcaggggagcaactggatccagaaggagaccctagtgacgttcaagaatccacacgccaagaagcaggacgtcgtggtcctcggtagccaggaaggtgctatgcacaccgcgctaaccggcgccaccgagatccagatgtccagcggaaacctcttgttcacgggccacctgaagtgccggctacgcatggacaagctccagctaaagggcatgtcctacagcatgtgcaccgggaagttcaaggtggttaaggagatagccgagactcagcatggtaccatagtgatccgggtgcagtacgagggggacgggtccccctgcaaaatccccttcgagattatggacttagagaagcgctacgtactaggccggctgatcaccgtcaaccctatcgtgacggaaaaagactcgcccgttaacatcgaagccgagccgccgtttggcgacagttatatcatcatcggggtcgagcctggtcaactgaagctgaactggttcaagaagggcagctccatcgggcagatgttcgaaaccacgatgcgcggtgccaagcgaatggccatcctgggagacacggcctgggacttcggcagtcttggcggggtgttcacttctataggcaaggcactccatcaggtgtttggggcgatctacggtgcagccttctcgggcgtctcgtggaccatgaagatcctgatcggggtgatcattacctggataggcatgaacagccggtccacgagcttgtcagtaagcctggtcttagtggggatcgtcaccctgtacctgggcgtgatggtgcaggccgacagtgggtgcgttgtttcgtggaagaataaggagctcaagtgcggcagcggcatcttcatcaccgacaacgttcacacttggacggagcagtataagttccagcccgagtctccatccaaactggcatccgccatccagaaggcccaggaggaaggaatctgcggcatccgtagcgtgacacggctggagaatctcatgtggaagcagatcacacctgaattaaaccacatcctggcggagaacgaggtcaagctcaccatcatgacgggcgacatcaagggcatcatgcaggccgggaagcgcagcctgaggccccagccgaccgagttgaaatatagctggaaaacctggggcaaggcgaaaatgctctccaccgaatcacacaatcagacgttcctgatagacggaccagagacggccgagtgtcccaataccaaccgcgcttggaactccctggaggtagaggactacgggtttggtgtgttcaccacgaacatctggctaaagctgaaagagaagcaggacgccttctgcgactcaaagctgatgtccgcggcgatcaaggataaccgggcagtccacgctgacatggggtactggatcgagagcgctctcaacgacacctggaagatcgaaaaggcctccttcatcgaggtaaagaactgccactggcccaagagccataccctgtggtcaaacggcgtgctggagagcgagatgatcatccccaaaaacctcgcgggccccgtaagccagcacaactaccgcccgggataccacacccagattgcagggccgtggcacctggggaagctggagatggactttgacttctgcgacggcaccacggtggtggtcacagaagactgcggcaaccgtgggcccagcctcaggacaaccacggccagcggcaaacttatcaccgagtggtgctgccggtcctgcaccctgcccccactccggtacagaggggaagacggatgttggtacgggatggagatccgcccgctgaaggagaaggaggagaacctggtgaatagcttggtgaccgcaggccacgggcaggtcgacaacttctccctgggtgtgctgggcatggcgctttttctggaggaaatgctgcggacgcgcgtgggcacgaagcacgccatcctcctggtcgccgtgagcttcgtaacgcttatcaccggcaacatgtcgttcaaggacctcggcagggtcgtggtgatggtcggtgccacgatgaccgacgatatcggcatgggagtgacctacttagcgctcctcgctgccttcaaggtgcgccccaccttcgccgccgggctgctgctccgcaagctgacgagcaaggagctgatgatgaccaccatcgggatcgtgctactatcccagtctaccatccccgaaactatactggagctcaccgatgccttagcgctaggaatgatggtgctcaaaatcgtgcgcaatatggagaagtaccagctggccgtgacgataatggcaatcctatgtgtgccgaacgcagtcattctccaaaacgcctggaaggtgagctgcaccatattagctgtggtcagtgtatcgcccttgatcctcaccagctcccagcagaaaaccgactggatccccttggccctgaccatcaaagggctcaaccccaccgccatcttcttgacgacactatctcgcaccaacaagaagcggtcctggccgcttaacgaggccattatggccgtgggcatggtcagcatccttgcctcctcccttctgaagaacgacattccgatgaccggacccctggtggccgggggcttactaacggtgtgttacgtactgaccgggcgctctgccgacctcgagctcgagcgtgcggctgatgtaaagtgggaggaccaggccgagatctccgggagctctcccatcctatccatcaccatctccgaagacgggagcatgagcatcaagaacgaagaagaggagcagaccttgacgatcctcatacgcacaggactactggtgatcagcggcctttttccagtctccatccctatcacagccgcggcctggtacctgtgggaggtgaagaagcagcgggcgggggtgctgtgggacgtcccctccccgccgcccatgggcaaggctgagctcgaggacggggcctacaggatcaagcaaaaaggcatccttgggtacagtcaaatcggagccggagtctataaggaggggaccttccataccatgtggcatgtgacgaggggcgcggtactaatgcacaaaggcaaacgaatcgagccgtcatgggccgacgtgaagaaggacctcatctcatacggcggaggctggaagctggagggcgagtggaaggagggggaggaggtacaggtcctggccttggagcccggcaagaatccccgcgccgttcagacgaagcccgggttgttcaaaaccaacacaggcacgatcggggccgtaagcctggacttttcccccggtacctctggctcccccatcatagacaagaaggggaaggtggttggcctttacgggaatggggtggtcacccgtagcggcgcctatgtgagtgcgatagcccagaccgagaagtccattgaagacaacccagagatcgaggacgacatctttcggaagaagcgtctgacgatcatggaccttcatccaggcgccggcaagaccaagcgctacctgcccgccatagtgcgcgaagcgatcaagcggggcctccgcacgctaattttagcccctacccgcgttgttgcggccgagatggaagaagccctccgaggcctgcccatccgctaccagacgcccgcgatccgcgccgagcacacagggcgcgagatcgtggacctgatgtgccacgccaccttcaccatgcgcctcttatctccagtccgcgtaccgaactataacctgatcataatggacgaggcccacttcacggatccagccagcatcgcggcccgcggctacatcagcacccgcgtggagatgggtgaggccgcggggatcttcatgacggcaacgccgcccggatcccgggacccgttcccccagtccaacgcccccataatcgacgaggaacgcgaaatccccgagcgatcatggaacagcggtcacgagtgggtcactgatttcaaagggaagaccgtgtggtttgtgccatccatcaaggccgggaacgacatcgccgcctgcctacgcaagaacggcaagaaagtcatccagctgagccggaaaacctttgatagcgagtacgtcaagactcgcacgaatgactgggacttcgtggttactactgatatcagcgagatgggggctaattttaaggcggagcgagtgatcgacccccgccggtgcatgaagcccgttatcctgaccgatggggaggaacgcgtcatactcgccggccccatgcccgtaacgcattcaagcgccgcccaacggcgtgggcggatcgggcgcaaccccaaaaacgaaaacgaccagtacatctacatgggggagccgctggagaacgacgaggactgtgcgcactggaaagaggcgaagatgctcctcgacaacatcaacaccccagaggggatcatcccgtctatgttcgaacccgagcgggaaaaggtggacgccatcgacggcgaataccgcttacgcggggaggcccgcaaaacctttgtagatctgatgcgccggggcgacctccccgtgtggctagcatataaagtggcggcagagggcatcaactatgccgacagaaggtggtgcttcgacgggatccagaacaaccagatactggaggaaaacgtcgaggtcgagatatggaccaaggagggggagcgcaagaagttgaagccccgctggctggacgcccgaatctacagcgatcccctcgccttaaaggagttcaaggagttcgcggctggcagaaagtcactgaccctgaacctcatcactgagatgggccgcctgcccacgtttatgacccaaaaggctcgggacgctctggacaacctcgcggtcctgcacacagccgaggcagggggccgcgcatacaaccatgcccttagcgagttgcccgagaccctggagacgctgctcctgctgaccctcttagcgaccgtgactgggggcatcttccttttcctcatgtccggtcgaggaatcgggaaaatgaccttagggatgtgctgcatcatcacggcaagcatcctgctatggtacgctcagattcagccgcattggatagccgcgagcatcattctcgagttctttctgatcgtgctcctcatccccgagcccgagaagcagcgcacgccccaggacaaccagctaacgtacgtagtgatcgctatcctaaccgtggtcgctgccaccatggctaatgaaatgggtttcctcgagaagaccaagaaagacctgggattcgggtccattgccacacagcagccggagtccaacatcctagacatcgacctgcgtcccgcgagcgcctggaccctatacgctgtggccaccaccttcgtcacgcccatgctccgccacagcatcgaaaattccagcgtcaacgtgtccctgaccgccatcgccaaccaggccacggtgctgatgggcttaggaaagggctggccgctctcgaagatggatatcggagtaccgctgttagccatcggctgttacagtcaggtgaaccccataaccttaacggctgcgttgctcctgcttgtggcacattacgccataatcgggcccggcttacaagctaaagccacccgggaggcgcagaagcgcgccgctgccggcatcatgaagaaccccaccgtggacgggatcacagttattgaccttgaccctatcccctacgaccccaagttcgagaagcaactgggccaggtgatgctcctggtactgtgcgtgacacaggtgctcatgatgcggaccacgtgggccctgtgtgaggccctaaccctagcaaccgggccaataagcaccctctgggagggcaacccggggcgtttctggaataccaccatcgctgtctccatggccaacatcttccgtggaagctacctagctggtgcggggctcctgttctcaatcatgaagaacacaaccaacactcgtcgtggcactgggaacataggcgagacgctgggcgagaagtggaaaagccgcctcaacgctctggggaaatcagagttccagatttacaaaaagtccggcatccaggaggtagatcgcaccttagccaaggagggtatcaagcggggtgagaccgaccatcacgccgtgtcccgcgggagcgcgaagctaaggtggttcgtcgagcgcaacatgattaccccggagggaaaggtggtggacctgggctgcgggcgcggcggctggagttactattgcggagggctgaagaacgttcgcgaggttaaggggctaacgaaaggcgggcccggacacgaggaacctatcccgatgagcacctacgggtggaaccttgtgcggctgcaatccggcgtagatgtatttttcacgcctcctgagaagtgcgacacgcttctttgcgacatcggagagtcatcccccaaccctacggtggaggcgggccgcaccttgcgggtcctcaacctggtggagaattggttgaacaacaatactcaattttgtataaaggtgttaaacccctacatgccgagcgtcatagagaaaatggaagccctccagcgcaaatacggcggggccctggtgcgcaacccgctgtctcgtaactccacccatgaaatgtactgggtcagcaatgcatccggcaacatcgtcagctccgtgaacatgatcagcagaatgctcataaatcgcttcaccatgaaacacaagaaggcgacgtatgagcctgacgttgacctggggtccggcactcggaacatcgggatcgagagtgaggtccccaacttggacataatcggcaaacgcatagagaagattaagcaagagcacgaaacatcctggcactatgatcaagaccacccttataagacgtgggcgtaccacggcagctatgagacgaaacagaccgggtccgccagttccatggtgaatggcgtggtcagactcctgaccaagccgtgggacgtgctgccgaccgtgacacagatggccatgaccgacaccaccccgtttggccagcagcgcgtcttcaaggagaaagtagacacgcggacacaggagccaaaggagggcaccaagaagttgatgaaaatcactgccgaatggctgtggaaagagctcggtaagaagaagacgccgcgcatgtgcacccgcgaggagttcactcggaaggtgcgcagcaacgcggccctcggggccatctttacggacgaaaacaaatggaagtccgcacgggaggccgtcgaggacagtcgcttttgggagctggtggacaaagaaaggaatctacatctcgagggcaagtgcgagacgtgcgtctacaacatgatggggaaacgcgaaaagaaacttggcgagttcggaaaggcaaagggctcccgggccatctggtacatgtggctaggagcgcgcttcctcgagttcgaggccctgggtttcctaaacgaggaccactggtttagccgggaaaattcccttagcggcgtggagggggaaggcctgcacaagctcgggtacatactccgcgacgtgtctaagaaggaaggcggcgcaatgtacgccgatgacacggccgggtgggacacccggatcaccctggaggacttgaagaatgaggaaatggtcacgaaccatatggagggcgagcacaagaagctcgcagaggcgatcttcaagctgacctaccagaacaaggtggtgagggtccagcggcccacgccccgaggtacagtgatggacatcatctcccggagggatcaacggggcagcggccaggtcgggacgtatggccttaacacgtttacaaatatggaggcacaattaatccgccagatggagggggagggcgtttttaagaatatccagcacctgacagctactgaggagatcgctgtccagaactggctggcccgggtggggagggagcgtctcagccgaatggctatctcgggggacgactgcgttgtgaagccattagacgaccgcttcgcgtccgctctgaccgccttaaacgacatgggtaaggtgcggaaggacatccagcaatgggagcctagccgtggatggaacgactggacccaggtgcccttctgctcccaccacttccacgagctgataatgaaggacggcagagtgctagtggtaccctgcagaaaccaggatgaactcatagggcgcgcacgcatcagccagggcgcggggtggtcgttgcgggaaaccgcgtgccttggcaagagttacgctcagatgtggagcttaatgtatttccaccgccgcgacctgcgcctggctgccaacgccatctgtagcgcggtgccgtcccactgggtgccgacgagccggaccacctggagtatacatgctaagcacgaatggatgaccaccgaggatatgctcacggtctggaaccgcgtgtggatccaggagaacccgtggatggaggataagacccccgtggagagttgggaagagatcccctatcttggcaagcgggaggaccagtggtgcggttccctgattggactcactagcagagccacatgggccaaaaacatccaagcggctatcaaccaggtccggagcctgatcgggaacgaggagtacacggattacatgccgagtatgaaacgcttccggagggaggaagaggaagccggcgtactgtggtga

SEQ ID NO: 25606 - RNA, 9876 nt, synthetic construct
  misc_feature 1..9876: note = derived and/or modified CDS sequence (opt11) from DENV-2__AF169679__SS-prME
  source 1..9876: mol_type = other RNA
tcagccggcatgattatcatgctgatccccaccgtgatggccttccacctcacgaccagaaacggggagccccacatgatagtcagcatccaagagaaaggcaagagcctgctgttcaagaccgaggatggggtgaacatgtgcaccctcatggcgatggacctgggtgagctttgcgaggacaccatcacctacaagtgtcccctcctgcggcagaacgagcccgaggacatcgactgctggtgcaacagcaccagcacctgggtgacctacgggacctgcaccaccaccggcgaacacaggcgggagaagcgctccgtcgccctggtgccccacgtcggaatggggctagagaccaggaccgaaacctggatgagcagcgagggcgcctggaagcacgcccagcgcatcgagacctggatcctgcggcacccggggttcaccataatggctgcgatcctcgcttacactatcggcaccacccacttccaacgcgccctgatcttcatcctgctgacggccgtcgcgcccagtatgaccatgcgttgcatcgggatctccaaccgcgacttcgtggagggcgtgtcgggcgggtcctgggtcgacatcgtgttggagcacggcagctgcgtgaccaccatggcaaagaacaagccaacgctggacttcgagctgatcaagaccgaggccaagcagcctgctaccctccggaagtactgcatcgaggcgaagctgaccaacacaaccaccgagagccgctgtcccacccaaggggagcccagcctaaaggaggagcaggacaagcggttcgtctgcaaacactccatggtcgaccggggctgggggaacgggtgtggactcttcgggaagggtggaatcgtaacttgtgcgatgttcacgtgtaagaagaacatggaaggcaaaatcgtccagcctgagaacctggaatacacaatcgtggtgacgccgcacagcggagaggaacacgcagtcgggaatgacacggggaagcacgggaaagagatcaaggtgacgccgcaatcctctatcaccgaggccgagctgaccggctacgggaccgtgacgatggaatgcagccccaggacaggccttgatttcaacgagatggttcttctgcagatggagaacaaggcttggctcgtgcatcgccagtggttcctggacttacccctcccgtggctaccgggagccgacacccaggggagcaactggatccagaaagaaaccctcgtgacgtttaagaatccccatgccaagaaacaggacgtggtagtcctcggctcccaagagggtgccatgcacacggccctcaccggagccaccgagatccagatgtccagtgggaatctcctgtttacgggccatctgaagtgccggctgcgcatggataagctccagctcaagggcatgtcctacagcatgtgtaccgggaagttcaaggtggtgaaggagatcgctgagacccaacatggcacaatagtgattagagtacaatatgagggggacggctccccctgcaaaatccccttcgagataatggatctggagaaacgctatgtgctcggccggttgatcacggtcaacccgatcgtgaccgagaaggacagcccagtcaacatcgaggccgagccccccttcggagactcctacatcatcatcggcgtcgagccggggcagctgaagctcaactggttcaagaagggcagctccatcggacagatgttcgagacgaccatgcgcggcgcaaagcgtatggccatactgggtgatacggcctgggacttcgggagcctgggcggagtgttcaccagtatcgggaaggctctccaccaggtgttcggggcgatctacggggcggccttcagtggggtctcctggaccatgaagatcctgatcggggtaatcataacctggatcggcatgaacagccgttccacgagcctgtccgtgagcctggtcctcgttgggatcgtaaccctgtatctgggcgtcatggtgcaggccgactccggatgtgtggtcagctggaagaacaaggaattaaaatgcggctccggcatcttcatcaccgacaacgtgcacacctggacggaacaatacaagtttcagcccgagtcccccagcaagctggcgtccgcaatccagaaggcccaggaggaggggatctgcggcattcgcagcgtgacccggctcgaaaacctaatgtggaagcagatcacgcccgagcttaatcacatcctagccgagaatgaagtcaagctcaccatcatgaccggggacatcaagggcatcatgcaagcgggcaagcgcagtctgcggcctcagcccacggaactgaagtacagttggaagacctggggcaaggccaaaatgctcagcacggagagccacaatcagacgttcctcatcgacgggccaaagaccgccgagtgcccgaacaccaaccgcgcgtggaactccctggaggtggaggactacgggttcggcgtgttcaccacgaatatctggctcaagctgaaggagaagcaggatgccttttgcgacagcaagctgatgtccgccgcgatcaaggacaatcgggccgtccacgccgacatgggttactggatcgagagcgcacttaacgacacctggaagatcgagaaagcctccttcatcgaggttaaaaactgccattggcccaagagccatacactttggtccaacggggtgctggaaagcgagatgatcatccccaagaacctcgcgggtcccgtgtcgcagcacaactaccgcccggggtaccacacccagatcgccggtccctggcacctggggaagctcgaaatggacttcgacttctgcgacggcaccacggtggttgtgaccgaagactgcggaaacaggggccccagcctccgcacgacgaccgcctcaggcaaactgatcaccgagtggtgttgtcgttcctgcaccctgccccctctcaggtaccggggagaggacggctgctggtacggcatggagatccgcccgctgaaggaaaaggaggagaacttggttaacagcctcgtgaccgcaggccacgggcaggtcgataacttcagcttaggtgtcctgggaatggccttatttctggaggagatgctgcgaacgcgcgtcgggaccaagcatgccatcctcttagtagccgtgagtttcgtgactctgatcactggcaacatgtcattcaaggacctcgggcgagtcgtggtgatggtgggcgccacaatgacagatgacatcgggatgggcgtgacctacttggccctgcttgcggcattcaaggttcgccccaccttcgccgccggactgctgctccgcaagctaacgagtaaggagctgatgatgaccaccatcgggattgtcttgctgtcacaatctactatccctgagacgattttagagctcaccgacgccctggcgcttggcatgatggtattaaagatcgtacgcaatatggagaagtaccaacttgcagtcacaatcatggccattctgtgcgtccctaacgccgtcatcctccagaacgcctggaaggtgtcctgcaccatcctggctgtggtaagcgtgagccccctgatcttaactagttcccaacagaagacagactggatacccctggctctgaccatcaagggactcaaccccaccgcgatcttcttgacgacgctgagcagaaccaacaaaaagcggagctggccgctcaacgaggccataatggcggttggaatggtcagcatccttgcctccagcctgctcaagaacgacatccccatgaccggcccgctggtggcgggtggcttgcttactgtctgttacgttctgaccggtcgcagcgccgacctggagctcgagcgggccgcggacgtgaaatgggaagaccaagccgagattagcgggagctcccccattttgagcatcactatttctgaagacgggtctatgtccatcaagaacgaagaggaggagcagactctgacaatccttatccgcacgggactgctagtgataagcggccttttcccagtctccattcccatcacagcggccgcctggtacctttgggaggtgaagaaacagcgggcgggggtgctgtgggatgtcccctcacctccaccaatgggcaaggccgagctcgaggacggagcctatcgtatcaaacagaaaggcatcttagggtacagtcagataggcgccggtgtgtacaaggaggggacatttcacacaatgtggcacgtgacgcggggcgcagtcctgatgcacaaaggtaagcgcatcgagccctcctgggcggacgtgaagaaggacttgatctcctacggcggaggttggaaattagagggcgagtggaaggagggagaggaggttcaggtcctggccctcgagcctggcaagaatccccgggccgtgcagaccaagcccgggctattcaaaaccaacaccggcacgatcggggcggtgagcctggacttctcccccggaacctccggctcccccatcatcgacaagaaagggaaggtagtggggctctatgggaatggcgtggttacccgctcgggcgcctatgtgtccgcaatcgcccagaccgagaaatctatagaggacaaccccgagatcgaagacgatattttccggaaaagacggctgacgattatggacctgcacccaggtgctggcaagaccaagcgctacctgccggcgatcgtgcgtgaggccatcaagcgcgggctccggaccctgatcctggcgccgacccgcgtcgtggccgccgagatggaggaggccttacggggcctgccgattcgctatcagacccctgcgatacgcgccgagcacacggggcgggaaatcgtggaccttatgtgccacgccaccttcaccatgcgtctcctgtcccccgtcagagtaccgaactacaacctgatcatcatggatgaggcccacttcaccgacccggccagcatcgcggcccgcggctacatcagcaccagagtggagatgggggaagccgccgggatctttatgacggccacgccgcccggctcccgcgacccgttcccgcagagtaacgcccccatcatggacgaagagcgggagatccccgaaagatcatggaacagcgggcacgagtgggtgacggacttcaagggcaagacagtgtggtttgtaccgtccatcaaggccgggaacgatatagcagcttgcttgcgcaagaacggcaagaaagtcatccagctgagccgtaagacctttgactccgagtacgtgaagactcggacgaacgactgggacttcgtagtcacaaccgacatcagcgagatgggcgccaacttcaaggccgagcgcgtgatagacccccggcgctgcatgaagcccgtgatcctgacagacggggaggagcgagttatcctcgctgggcccatgccggtgacgcactccagcgccgcacagcgccggggacggatcggaaggaaccccaagaacgagaatgaccagtacatctacatgggggagcctctggagaatgatgaggactgcgcgcactggaaggaagcgaaaatgctgcttgataacatcaacaccccagagggcatcatcccgtctatgttcgagccagagcgcgagaaagtggacgccatagacggcgagtatcggctgcgcggggaggcacgcaagaccttcgtggacctgatgcggcgcggcgacctacccgtgtggctggcctacaaggtggcggccgaggggatcaactacgccgaccggcgctggtgttttgacggcatacggaataatcaaattcttgaggagaacgtcgaggtcgagatctggaccaaggaaggggagcgcaaaaagctaaagccgcgttggctggatgcccgcatctacagcgaccccctagcactcaaggaattcaaggagttcgcggccggccgtaagtcgttgacgctgaacctcatcaccgagatgggccgcctgcccaccttcatgacccagaaggcgagagacgccctggacaatctcgcggttctgcacacggcggaggcagggggccgagcctataaccacgcactcagcgagctccccgaaaccctggaaaccttgctcctgctgacactcctggcgacggtgacggggggtatcttcctgttcctcatgtctggccgggggatcggaaagatgaccctagggatgtgctgcataatcaccgccagcatcctgctctggtacgcccagatccagccgcactggatcgccgcatccatcatcctagagttttttctcattgtgctcctgattcccgagcctgagaagcaacgcacaccccaggacaaccaactgacgtatgtcgtgattgcgatcttgaccgtggtagccgccaccatggccaacgagatgggcttcctggagaagaccaagaaagacctggggttcggcagcatcgccacgcaacaaccggagtccaacatcctcgacatcgacttgcggcccgctagcgcatggacactgtacgccgtggctaccacctttgtcacgcccatgctccgccacagcatcgagaactccagcgtcaacgtgtccctgaccgctattgcgaaccaggccactgtgcttatgggcctcgggaaaggctggcccctgagcaagatggacataggtgtcccactactcgcgattggctgctactcccaggtaaatcccataaccctgaccgccgcgctgctcctcctggtggcgcactatgcaatcatcgggcccggcctccaggccaaggccacccgtgaggcgcagaaacgagccgccgctggcatcatgaaaaaccccacagtcgacgggatcactgtgatcgacctggacccgatcccctacgacccaaagtttgagaaacagctaggccaggtgatgctcctggtcctgtgcgtgacccaggtccttatgatgagaaccacgtgggccctgtgtgaggctctgaccttagccacggggccgatcagcaccctgtgggaaggcaacccggggcgtttctggaacaccaccatcgccgtaagtatggccaacatcttcaggggaagctacctggccggggcgggtcttctgttctccattatgaagaacactactaacactcgtcgcggcaccgggaacatcggcgagacgcttggcgagaagtggaagagtcggctcaacgcgctgggcaagagtgagttccagatctacaagaagtccggcattcaggaagtggaccgcaccttggcaaaggaggggatcaagaggggcgagaccgaccatcacgccgtgtctcgcgggtcagcgaagctacggtggttcgtcgagaggaacatgataacccccgagggcaaggtggtggacctgggctgcgggcggggcgggtggagctactactgcggcgggctgaagaacgtacgcgaggtcaagggcctcacaaagggcgggcccggccacgaggaacccattccgatgagcacttacgggtggaacctggtaaggctgcagtccggcgtcgatgtgttcttcaccccgccggagaagtgtgataccttactgtgtgacattggggagtcatcgcccaacccgacggtagaggcaggcaggaccctgcgggtactcaacctggtagagaattggttgaacaacaatacccagttctgcatcaaggtgctcaacccctacatgcccagcgtaatagaaaagatggaggccctgcagcgcaagtacggcggggccttagtgcggaatccgctaagccgtaacagcacgcacgagatgtactgggtgagcaacgcctctggcaacatcgtcagctctgtgaacatgatcagccggatgctcatcaacagatttaccatgaagcacaagaaggcgacctacgagcccgacgtagacctggggtccggcacccggaacatcgggatcgaaagcgaggtgcccaacctggacatcattggcaagcgcatcgagaagatcaaacaggagcacgagacatcctggcattacgaccaggaccacccctataagacctgggcctaccacggctcctacgagacgaaacagactgggtccgcctcctccatggtgaacggagtggttcggctcctgaccaagccttgggacgttctacctaccgtcacgcagatggccatgacggacaccacccccttcggacagcagcgagttttcaaggagaaggtggacacgcgcacccaggagcccaaggagggaaccaagaagcttatgaagattaccgccgagtggctgtggaaggaactgggcaagaagaagacgccgcggatgtgcacccgcgaagagttcacccggaaagtgaggagcaatgcagcactcggggctattttcaccgatgagaacaaatggaaatcagccagggaggccgtcgaggacagccgcttctgggagctagtggacaaagagaggaacctgcacctcgagggtaagtgcgagacctgtgtctacaacatgatgggcaaacgcgagaagaaactgggcgagtttggcaaggcgaagggctcccgggccatctggtacatgtggctgggagccaggttcctcgagttcgaggctctggggttccttaacgaagaccactggttctcgagggagaactccctcagcggggtggagggggaggggctgcataaactggggtatatcctccgcgacgtgagcaaaaaggaggggggcgcgatgtacgccgacgacaccgccgggtgggatacccgaatcacgctggaggacttgaagaatgaagagatggtcacaaaccatatggagggcgagcacaaaaagctagccgaggccattttcaaactgacttatcagaataaggtggtgcgcgtacagcggccaacgccccgtgggaccgtgatggatatcatctcgcgacgcgaccagcgggggagcggccaggtggggacgtacggcctgaacaccttcacgaacatggaggcccaactcatccgccagatggagggagagggcgtcttcaaaaacatccaacacctgaccgccacggaagaaatcgccgtccagaactggctcgcgcgggtggggcgcgagcgcctatcccgcatggccatcagcggcgacgactgcgtcgtgaagcccctggatgataggtttgcgagtgccctgaccgccctcaatgacatgggcaaggtgagaaaagacatccagcagtgggagccgtctcgcgggtggaacgactggacccaggtcccattttgctcccaccactttcacgagctgatcatgaaggacggccgggtgctggtggtcccctgccgcaaccaggacgagctcatcggacgggcgcgcatctctcagggcgccggctggtccctacgggagactgcgtgcctgggtaagagctacgcacagatgtggtctttaatgtacttccaccgccgggatttgcgcttggcagccaatgccatttgcagcgcggtcccctcccactgggtaccgacgtctcgaaccacctggtccatccacgccaaacatgagtggatgaccacggaggatatgctcacggtctggaaccgcgtgtggatccaggagaacccctggatggaggacaagacccccgtggaaagctgggaagagatcccctatctgggcaagcgggaagaccaatggtgcgggtcccttatcggattaaccagccgcgccacctgggccaagaacatccaagcggcgatcaatcaagtccggagcttgatcgggaatgaggagtacacggactacatgccgtccatgaaacgcttccggcgcgaggaggaagaggctggcgtgctgtggtga

SEQ ID NO: 25607 - RNA, 9876 nt, synthetic construct
  misc_feature 1..9876: note = derived and/or modified CDS sequence (opt11) from DENV-2__AF169680__SS-prME
  source 1..9876: mol_type = other RNA
tctgcggggatgatcatcatgctgatcccgaccgtcatggcgttccatctcaccacccgcaacggggagccacacatgatcgtcagcatccaggagaaaggcaaaagcctgctgttcaaaacggaggatggcgtaaacatgtgcaccctcatggctatggacctgggggaactgtgtgaggacaccatcacatacaagtgccctttactacggcagaatgagcccgaagatatcgattgctggtgcaactccaccagcacctgggtgacttacgggacctgcaccactacaggcgagcaccgcagggagaagagatccgtcgccttggtaccccacgtgggtatggggctggagacaagaacggagacatggatgagtagtgagggcgcctggaagcatgcccagcgcatcgaaacttggatcttgcggcaccccggattcaccatcatggccgcgatcctggcgtataccatcggcactacccatttccagcgggccctcatattcatcttgcttacagccgttgcgccgagcatgacgatgaggtgcattgggatttccaaccgcgactttgtcgaaggcgtgtccggcgggtcctgggtcgacatcgtgttagagcacggctcatgcgttaccaccatggccaaaaacaagcccacgctggatttcgaacttatcaagacggaggccaagcagcccgctactctccggaaatactgcatcgaggcaaagctgaccaacactaccaccgaatcgcgctgtccaacccaaggggaaccctcccttaaggaggagcaggacaaaagattcgtctgcaagcactcgatggtggatcgcgggtgggggaacgggtgcgggctcttcgggaagggcgggatcgtaacgtgcgcgatgtttacgtgtaagaagaacatggaaggaaagatcgtccagcccgagaacctggagtacaccatcgtggtgacgcctcacagtggcgaggaacacgcggtcgggaacgatacgggaaagcacgggaaggagatcaaggtaaccccgcagagctcaattaccgaagccgaactgaccgggtatggaaccgtgacgatggagtgtagtcctcgtaccgggctcgatttcaacgagatggtgctgctgcagatggagaacaaagcatggctagtgcaccgccaatggttcctagatctgcccctcccgtggctgccgggcgcggatacccaggggtcgaactggatccagaaggagactttggtgacgttcaaaaacccccacgcgaagaagcaagacgtcgtggtcctcggctcgcaggagggtgcgatgcacaccgctctgaccggcgccacagagatccagatgtctagcggtaacctcctgttcacaggtcacctaaagtgcagactgcgtatggataagttgcagttaaagggcatgtcctactcgatgtgcaccgggaagttcaaagttgtcaaggaaatcgccgagactcagcacggcaccatcgtcatacgggtgcagtacgagggggatggctccccttgtatcatccccttcgagatcatggatctggaaaagcgctatgtactggggcggctgatcacggtcaacccgatagtgactgagaaagacagccccgtgaacatcgaggcggagccgcccttcggcgacagctacattatcattggtgtcgagccggggcagctgaagcttaactggttcaagaagggcagctctatcgggcagatgttcgaaaccactatgcgcggcgccaagcgcatggccatcctgggcgacaccgcctgggattttgggagcctggggggtgtcttcacttccatcggcaaggccttacatcaagttttcggggctatctatggtgccgcattcagcggcgtctcctggactatgaagatcttgatcggggtgatcatcacctggattggcatgaacagtcggtcgacgagcctgtccgtaagcctggtcctcgtgggcatcgtgaccctgtacctgggggtcatggtgcaggcggattccgggtgcgtggtctcttggaagaacaaggagttaaaatgtggcagcggcatatttatcaccgacaatgtccatacctggacggagcagtacaaattccagcccgagagcccatccaagctcgcgagtgccatccagaaggcccaggaggaggggatctgcgggatccgctcggtgaccaggttagagaacctgatgtggaagcagatcactccggagctgaaccacatactggctgagaacgaggtcaagctgaccattatgacgggggacatcaagggaatcatgcaagccgggaagcgctcgctgcggccgcagccaacggaactcaagtacagctggaagacatggggcaaggcgaagatgctctccaccgaatcccacaaccagaacttcctgatagacggccccgaaacagccgagtgcccgaacaccaaccgcgcctggaactcccttgaagtggaggactacggattcggcgtgtttactaccaatgtttggttaaagctgaaggagaagcaggacgctttctgcgacagcaagctgatgtccgccgctatcaaggacaaccgtgccgttcacgccgacatgggttattggatcgagagcgccctgaacgacacctggaagatcgagaaagcctccttcatcgaggtgaagaattgccactggcccaaaagccacaccctctggtccaacggcgtcctggagagcgagatgatcatacccaagaacctcgcgggccccgtttcccagcacaactaccgcccgggttaccacacgcagatcgcaggcccctggcacttagggaagttggagatggacttcgacttctgcgacggcaccacggtggtggtgacggaggactgtggaaaccggggaccatcactccgcaccacaacagccagcggcaaactgatcactgaatggtgctgccgatcttgcactctgcccccgctgcggtaccgcggtgaagacggttgctggtacggaatggagatccgcccgctcaaggagaaggaggagaacctggtgaacagcctcgtcaccgccggccacggccaggtggataacttttcactgggagtcctgggcatggcgctattcctggaggagatgctgcggacccgcgtcggaaccaagcatgcaattctcctggtagccgtcagcttcgtcaccctgattaccggaaacatgtcctttaaagatctcgggcgggtagtggtaatggtgggcgccacaatgactgacgatatagggatgggcgtgacgtacttggccctgttggcggccttcaaagtccgcccgaccttcgcagcaggcctgctgctccggaagctgaccagcaaagagctgatgatgacgaccattggcatcgtgctcctctctcaatcaaccatccccgagaccatcctggagctcacggacgccctggcgctgggcatgatggtgctcaagatcgtccgcaatatggagaagtatcagctagccgttaccatcatggccatcctgtgtgtcccgaacgccgtgattttacagaacgcctggaaggtgtcctgcacgatactggcggtcgtgagcgtcagccccctaatcctcacctcttcccaacaaaagacggactggataccactggcccttaccattaaggggctcaaccccaccgcgattttcctgactacactgtcccggaccaataagaaaaggtcctggccgctcaacgaggccatcatggcggtcggcatggtgtccattctagcctccagccttcttaagaatgatataccgatgacgggccctctggtggccgggggtttattgaccgtctgttacgtgctgacggggcgctccgcagatcttgagctcgagcgtgccaccgacgtgaagtgggagcgccaagcggagatctcgggcagcagccccatactgagcataaccatcagtgaggacgggtcgatgtccattaaaaatgaggaggaggagcaaaccctgactatattaatacggaccggcctgctggtcatcagcggtctctttccggtttccatccctatcaccgctgccgcctggtacctatgggaggtgaagaagcagcgcgccggggtcctgtgggacgtgccgtccccgccgcccatgggcaaggcggaactcgaggacggggcctaccggatcaagcagaagggcatcctggggtactcacagataggcgccggcgtatataaagaagggacatttcacacgatgtggcacgtaacgcgcggcgctgtgctgatgcacaaggggaagcggatcgagccaagctgggccgacgtgaagaaagacctcatatcctatgggggcggctggaaactggagggcgagtggaaggaaggggaggaggtccaagtgttggccctcgagcccggcaagaatccacgggccgtgcaaactaagcctgggctgttcaagaccaacaccggcacgatcggcgccgtctccctggacttctcccccggcaccagcggctcccctatcatcgataagaaggggaaggtggtgggactatatggcaacggtgttgtaacccgttccggcgcctacgtgtccgccatcgcacagactgagaaaagtatcgaggacaaccccgaaatagaggatgacatattccgaaagcggaagatgacgataatggatttacacccgggcgccggcaagaccaagcgctacctgcccgcgatcgtccgggaggccatcaaaagagggctgcggactctcatcctggcgccgacccgagtggtggccgccgagatggaggaggccctccgcggccttcccatccgctaccagacgccggccatccgggccgagcatactggacgcgagattgtagacctgatgtgccacgccaccttcaccatgcgcctactttcacccgttcgggtgccaaactataacctcattatcatggacgaggcccattttaccgaccctgcctcgatcgccgcgagaggctatatctcaacccgggtcgagatgggcgaggccgccgggatcttcatgacggccacgccccccggctcacgcgacccgtttccccagagcaacgcacctatcatcgacgaggagcgggagatccccgagcgcagctggaacagcggccatgagtgggtaacggactttaagggcaagaccgtgtggtttgtcccgagcataaaggcggggaatgatatcgctgcctgcttgcggaagaatggaaaaaaggtcatccagctcagcagaaagaccttcgacagcgagtatgtgaaaacccgtacgaacgactgggatttcgttgtgacgaccgacatcagcgagatgggagccaactttaaggcagagagagtgatcgatcctcggcgctgcatgaagcccgtcatcctgactgacggagaggagcgcgtaatactagccggaccaatgccagttactcactctagcgcggcccagagacgggggcgcattggacgaaaccccaaaaacgaaaacgaccagtacatctacatgggggagcctctcgagaacgacgaggattgcgcccactggaaggaggcgaagatgctgttagacaatatcaacaccccggagggcatcatcccctccatgtttgaaccggaaagggagaaggtcgatgctattgacggcgagtatcggctccgcggggaggcccgcaagaccttcgtggatcttatgcggcgcggagacctacccgtgtggctcgcatataaggtcgccgcggaaggaatcaactatgccgaccggcgctggtgcttcgacggcatccgcaacaaccagattctcgaggagaacgtggaggttgagatatggaccaaggaaggggaacggaagaaactgaagccacggtggctcgatgccagaatctactcagaccccctggccctgaaggagttcaaggaattcgcggcgggacggaaatccttgacgctgaatctgatcaccgagatgggaaggctccccaccttcatgacccagaaggcccgggacgccctggacaacctggccgtactccacaccgcggaggctggtggccgggcctacaaccacgcgctgagcgagctgcccgagaccctcgagactctgctgctcctcacgctactcgccacagtgaccgggggcatcttcttgttcctgatgagcggccgggggatcgggaagatgactctcggtatgtgctgcatcatcacggctagcatcctgctgtggtacgcccaaatccagccgcactggatcgccgccagcatcatcctcgagttctttctaatcgtcctactgatccctgagccagagaagcagcgtacgccccaagacaaccagctcacgtatgttgtaatcgccatcttaacggtcgtggcagccaccatggccaatgagatggggttcttggagaagacgaaaaaagaccttgggttcggatctatcgcaacgcagcagccggagtcaaacattctggacatcgaccttcggcccgccagcgcgtggacactatacgctgttgcgaccaccttcgtcactccgatgctgcgccacagcattgagaactccagcgtgaatgtgtctctcaccgccatcgccaaccaggcgaccgtcctgatgggcctggggaagggctggcccctttccaagatggatatcggggtgccgctgctggcgattggctgctactctcaggtgaaccccatcaccctcacggccgccctgctgctcctggtagcacattacgccataatcggccccggcctccaggccaaggccacccgggaggcccagaagcgcgcggccgccggtatcatgaagaacccaagtgtggacgggatcaccgtgatcgacctggacccgatcccctatgacccaaagttcgagaagcagctgggtcaggtgatgctcctcgtattgtgcgtgacgcaagtcctgatgatgcggacgacgtgggccctctgcgaggccctgaccctggctacggggccaatctccacgctctgggagggcaaccccggccgcttctggaatacgactatcgccgtgagcatggccaacatatttcggggctcctacctggccggcgctgggctcttgtttagcatcatgaagaacacaacgaacacccgccgcggtacaggcaacatcggcgaaacgctgggggagaagtggaagtcacgtcttaatgcgctcggcaagtctgagttccagatctacaagaagtccggcattcaagaggtggaccgcactctggccaaggaggggatcaagaggggcgagaccgaccatcataccgtcagccgcgggtccgcgaagctgcggtggtttgttgaacgcaacatgattacccccgagggcaaggtgttagaccttggctgcgggagaggcgggtggagctattactgtggcggactgaagaacgtccgcgaggtgaaaggcctcacaaagggcgggccgggccacgaagagccaatcccaatgtccacatacgggtggaacctggtgcggctgcagagcggcgtcgacgtgttcttcactccgcccgagaagtgcgacaccctcctgtgtgacataggcgagtccagcccaaacccgacggtggaagcgggccgcaccttacgggtgttaaacttggtggagaactggttgaacaacaacacccaattctgcatcaaagtactcaacccctacatgccctcggtcatcgaaaagatggaagcgcttcaacgcaaatacgggggcgccctggtgcgcaacccgctatcccgcaacagcacgcacgagatgtactgggtgtccaacgccagtggcaacatcgtctccagcgtgaacatgatttccagaatgttgatcaatcggttcacgatgaagcacaagaaggccacttatgagcccgacgtggacctggggagcggtaccaggaacatagggatcgagagtgaagtccccaacctcgacataatcggtaagagaattgagaagatcaagcaagagcacgagaccagctggcactacgaccaggaccacccctacaagacgtgggcatatcacggctcatacgagacaaaacagacaggcagcgcgtccagcatggtcaatggcgtggtccggctcttaaccaagccgtgggacgtgttgccaaccgtgacgcagatggccatgaccgatactacccccttcgggcagcagcgcgtcttcaaggagaaggtggacacgcgcacccaggaacccaaggaaggtaccaagaagctcatgaagataacggccgagtggctgtggaaagaactgggtaagaagaagactccgcggatgtgcacccgcgaggagttcacccggaaagtacgctccaacgccgctctcggtgcaatattcaccgacgaaaacaagtggaagtccgcccgggaggccgtagaagactcacgcttctgggagctggtggacaaggaacggaacctgcacctcgagggcaagtgcgaaacttgcgtctacaacatgatgggtaagcgagagaagaagctgggcgagttcgggaaggccaagggctcccgcgcgatatggtacatgtggttaggtgcgcgcttcctggagttcgaggccctgggattcttgaacgaggaccattggttctccagggaaaacagcctctctggcgtcgagggggagggccttcacaagctcgggtatatcctccgcgacgtatccaagaaagaagggggcgccatgtacgccgacgacacagcaggttgggacacccggattaccctggaagatttaaagaacgaggagatggttactaaccacatggagggcgaacataagaagctcgccgaggcgatctttaagctgacctaccagaacaaggtggtgcgcgtccagcggcccacgccccggggaaccgtgatggacatcattagccggcgcgaccagcgaggatccgggcaggttgggacgtacgggctaaatacattcacaaacatggaggcccagctcatccgccagatggagggggagggtgtctttaagaacatccagcacctgaccgcgacggaggagatcgctgtgcagaactggctggcccgggttgggagggagcgcctcagccggatggccatctctggcgacgactgcgtcgtcaagcccctggacgaccgcttcgccagcgcactgacggccttgaatgacatggggaaagttcggaaggacattcagcagtgggagccatcccgagggtggaacgactggacgcaggtccccttttgcagccaccacttccacgaactgatcatgaaggacgggagagtgctggtggtcccctgtcgcaaccaagacgagctgatcgggcgggcccgcatctcccagggcgcagggtggagcctgcgggaaaccgcctgcttgggcaagtcctatgcccagatgtggtcgctgatgtactttcataggagagacttgcgcctagcggcaaacgccatctgctccgccgtccccagccattgggtgccgacttcccggaccacctggtccatccacgccaagcacgagtggatgaccacggaggatatgctcaccgtatggaaccgggtgtggatccaagagaacccctggatggaggacaagacccccgtggaatcttgggaagaaatcccctacctgggcaagcgagaggaccagtggtgcgggagcctaatcggcttaacctccagagcgacctgggccaaaaacatccaagccgccatcaaccaggtccggtccctgatcgggaacgaggagtacacggactacatgccgtctatgaagagattcagacgcgaagaggaggaggcgggcgttctgtggtga

SEQ ID NO: 25608 - RNA, 9876 nt, synthetic construct
  misc_feature 1..9876: note = derived and/or modified CDS sequence (opt11) from DENV-2__AF169682__SS-prME
  source 1..9876: mol_type = other RNA
agtgcgggaatgataataatgcttatcccgacggtaatggcttttcacctaaccacgcgcaacggggaaccacacatgatagtatcgatccaagaaaaaggcaaatcattactattcaaaaccgaagacggggttaatatgtgcacactaatggcgatggacctaggcgaactgtgcgaggacacgatcacttacaaatgtccgctattacgacagaacgagcccgaggacatagactgttggtgtaactcgaccagcacctgggttacatacggaacatgcacaaccaccggagaacatcgaagagaaaaacgaagcgtggcgctcgtcccccacgtaggaatggggttggaaacgagaaccgaaacatggatgtcgtccgaaggagcatggaaacacgcacaacgaatagagacttggatcctgcggcaccccggctttaccataatggcagccattttagcatacaccatcggaaccacacatttccaaagggcattaatctttatcttgctgaccgcagtagccccctctatgactatgaggtgcatcggaatcagcaaccgagacttcgtggagggagtatcaggcgggagctgggtagatatagtactagagcacggctcgtgcgtgacgaccatggccaaaaacaaaccaaccctggatttcgaactaataaaaactgaagcgaaacaaccggcaacgctacgcaaatactgcatagaagctaaactaaccaacaccaccacggagagcagatgccctacacagggggaaccctcgttgaaagaggagcaggacaaacgcttcgtttgcaaacacagcatggtggatcgaggttgggggaacggctgcggactcttcggaaaaggagggatagtaacatgtgcaatgttcacgtgcaagaaaaacatggaaggcaaaatagtgcaaccagagaacctcgaatacacgatcgtggtaacacctcacagtggtgaggaacacgcggttggaaatgacactggaaaacacggaaaagaaatcaaagttactccgcagagttctatcactgaagccgaactgacgggatacgggactgtcaccatggagtgctccccgcggacaggcctcgacttcaatgagatggttctcttacaaatggagaacaaggcttggttagtacacagacagtggttcctggacctccctctaccatggctgcccggggcagacacgcaaggatccaactggatccaaaaagagacattagtaaccttcaaaaacccacatgccaagaaacaggatgtggtagtattgggctcacaagagggagcaatgcacaccgcgctaaccggcgcgaccgaaatacagatgtccagtggtaacctgctttttaccgggcacttgaaatgcagactaaggatggacaaactacagctgaaagggatgagctactcgatgtgtacgggaaaatttaaagtagtcaaagaaatagctgaaacccaacatgggacgattgttataagggtacaatacgagggtgacggatcaccatgtcgcattcccttcgaaatcatggatttagagaagcggtacgtgctaggaagactgatcacggtaaacccaatagtaacagaaaaagactctcctgtcaacatagaagctgaaccgcccttcggcgacagctacataatcataggcgtggagcctggtcaattgaagctgaattggttcaaaaagggctcctctatcggccagatgttcgaaaccaccatgaggggcgccaaacgaatggccatcctaggggacaccgcatgggacttcggctctctagggggagtatttacatcaatcgggaaggctttacaccaagtattcggagcaatctatggggccgcattttctggcgtatcgtggaccatgaagattctcatcggggtgataatcacttggatcgggatgaactcccggtcgactagcctttcggtatcattagtgcttgttggaatagtcactctttaccttggagtcatggtacaagcagactcgggatgtgtagtaagctggaaaaataaagagctgaaatgcgggtcaggcatatttatcaccgataacgtccatacctggacagaacagtacaagtttcagccggagtcgcccagcaagctcgcaagtgccatccaaaaagcacaggaggaagggatatgtggaatcagatccgtgactagactagagaatctcatgtggaagcaaataacaccagaactaaaccacatactcgcagaaaacgaggtaaaactcacaatcatgaccggtgacatcaagggaattatgcaggcaggcaaaagaagtcttcgtccacagccgacagagctgaaatacagttggaaaacctggggaaaagcaaagatgctctcaacagaatcacataaccaaacctttctcatagatggcccggaaactgctgagtgcccaaacacaaaccgcgcttggaacagcttagaggtggaagactacgggttcggtgtctttacaaccaatatttggttaaaacttaaggagaaacaggacgccttttgtgacagcaagctgatgtccgcggccatcaaagacaaccgcgctgtgcacgcagatatgggctactggattgaatcagctttaaatgacacctggaaaattgaaaaagcatcgtttatagaggtcaaaaattgccattggccgaagtcacacacattatggtccaacggggtcctagagtcagagatgattatccccaaaaacctagctggaccagtgagccagcacaactaccgtcccggataccacacacagatcgccgggccctggcacctagggaagctcgagatggacttcgatttctgcgacggaaccacagtcgtggtcaccgaggattgcggtaatcgcgggccatcgctccgaacgacaactgcctcggggaagctaattaccgagtggtgctgtcgctcatgcactcttcctcccctccgatacagaggcgaggacggctgctggtacggaatggaaatccgtccccttaaggagaaagaggagaatctggtaaatagcttggtaacagcgggccacggccaggtcgacaacttttcactcggggtattgggaatggcccttttcttggaggaaatgctcagaacaagagtcggaactaaacatgcgatcctgctggttgccgtcagcttcgttaccctaataacggggaatatgagcttcaaggacctcggcagagtagtagtcatggtcggcgcgacaatgactgatgatataggcatgggcgtaacgtatctggccctactggccgcatttaaggtgaggccaacctttgccgcaggattgctcctaaggaaattgacgagcaaagaactcatgatgacaacaatcggcatcgtactcctctcacaaagcactattcccgagacaatactcgagctgacagatgccctcgccctgggcatgatggtactgaagatcgtaagaaacatggagaaataccagctcgcggtcacgataatggctatcctgtgcgtcccaaacgccgttatactgcagaatgcttggaaggtaagctgcaccatactagccgtcgtcagcgttagtccactaatcctgaccagcagtcaacagaaaaccgactggatcccactggccctaacaatcaagggcctgaatcccaccgcaatatttctgaccaccttatcgcgcaccaacaagaaacggtcatggccattgaatgaggcaatcatggctgtgggaatggtcagcatcctagcctccagcctactcaagaacgacataccaatgaccggcccactggtcgcagggggtctactaacggtgtgttacgtgctcaccggccgatcagccgaccttgaactggagagagccacggacgtgaagtgggaagatcaagcagaaatatcggggtcctctccaagtctgagcataacaatctctgaggacggaagcatgagcatcaaaaacgaagaagaagaacaaacattaacgatactgataagaacggggctgctagtcatcagcggcctgttcccagtaagcataccaatcacggcagcggcgtggtacctatgggaggtaaagaaacaacgcgctggggtgttatgggatgtaccctcaccaccaccgatgggcaaagcagagctggaggacggcgcataccggatcaaacaaaagggcatcctcggttatagtcagatcggcgccggcgtatacaaggagggaacattccatacgatgtggcacgtgacgcgtggggccgtcttaatgcacaaaggaaagagaatagaaccaagttgggcggacgtgaagaaagacctgatcagctacggtggaggatggaaactggagggggagtggaaagagggtgaggaagtgcaagtcctggcgctagaacctggcaaaaacccacgagcggttcagaccaaacccggactgttcaagacaaacaccggaacgataggcgcggtgtccctggacttttctccgggcacgtcaggaagccccattatagacaaaaagggcaaagttgtgggactatacggaaatggagtagtaaccagaagcggggcttacgtctcggccatagcccaaacggaaaaatccatagaggacaacccagaaatcgaggacgacatctttcgcaagagacgtctaacaataatggacctacacccgggggccggcaaaacaaagagatacctacccgccatcgtgagggaagcgatcaagcggggcctacgaaccctaatactagcaccgactcgcgtcgtagccgccgaaatggaagaggcgctaagaggtctcccgatacggtaccaaaccccagcgatacgagcagaacacactggacgcgaaatcgtcgacttgatgtgccacgccacgttcaccatgcgcttactatctccagttagagtacctaactacaacctaataataatggacgaagcgcacttcacggatcccgcatcgatagcagcaaggggctacataagcactagggtagaaatgggcgaggccgcaggtatattcatgaccgcgacacctccaggctctagggatcccttcccacagagcaacgccccaatcatcgatgaggagagagaaataccagaacggagctggaactcaggccacgaatgggtcacagacttcaagggaaaaacagtgtggtttgtaccaagcataaaagccggcaatgacatagccgcatgccttaggaagaacggaaagaaagtcattcagttaagcagaaaaacattcgacagtgaatacgtaaaaaccagaaccaacgactgggacttcgtggtgactacagatatatcagaaatgggggcgaatttcaaagctgaacgagtaatcgacccgcgacgttgcatgaagcctgtgatcctcacagatggggaagaacgagtcatccttgccggtcctatgccagtgacgcatagctccgcagcccaacgtagaggtagaatcggacggaatcccaaaaatgagaatgaccaatatatatacatgggagaaccattagaaaacgatgaggactgcgcccattggaaagaggcgaagatgctgctagacaatatcaacacaccagaaggaatcatcccatcgatgttcgaaccggaacgagagaaagtcgacgccatcgacggagagtatcgcctgcggggagaggcaaggaaaaccttcgtagacctcatgcgaaggggtgacctgcctgtctggcttgcgtataaggtcgcagcggaaggcataaactatgcagacaggcgatggtgctttgacggcattaaaaacaaccagatactcgaggaaaacgtagaggtcgaaatatggaccaaggaaggggagcgtaaaaagttaaaaccgaggtggcttgacgcaaggatctatagcgacccgctggcgctcaaagagttcaaggagttcgcggcagggcgaaagagcttagccttaaacctcatcaccgagatggggaggctgccaacctttatgactcagaagacgagggacgcgttagacaacctcgcagtcctacacactgcggaagcgggcggcagagcatacaaccacgcgctctcggaattgcccgaaaccctcgagacactcctactgttaaccctgctagcgacagtgacaggaggcatcttcctcttcctcatgtcagggaggggcataggtaagatgacactcggcatgtgctgcattataaccgccagcattctattgtggtacgcacaaatacaaccacactggatcgcagctagcatcatcctggtgtttttcctaatagtgctactgatccccgaaccagagaaacagcgcacgccacaggacaaccaattgacctatgtagtaattgcgattctgaccgtagtggccgcaacaatggcaaacgagatgggattcctcgagaaaaccaagaaagacctagggttcggttcaatcgcaacccaacagcccgaatcgaacatcctagacatagacctgagacccgcgagcgcctggaccctctacgcagtagcaacaacgttcgtaacaccgatgctccgacatagcatcgaaaattccagcgtcaacgtatctctcaccgccatagcgaaccaagccacagtcctaatgggtcttgggaaagggtggccactatccaaaatggacataggagtaccattactagcaatagggtgctacagccaagtaaatccgataacgctcacagcggccctactacttttagtggcccactacgccattattggaccgggactacaagcgaaagccaccagagaagcacaaaagcgggccgccgctggcatcatgaaaaaccccacagtcgatggtatcaccgtaatcgacctcgacccgatcccatacgatccgaaattcgagaaacaattaggacaagtgatgttgctagtattgtgtgtcacacaagtactcatgatgcgcactacctgggccctctgcgaagcgttaaccctagcaacagggcccataagcacgctatgggaaggcaacccgggtcggttttggaacacgaccatagcagtctcaatggctaatatctttcgcggaagctatctagccggcgcaggtctactgttcagcataatgaaaaacaccacaaacactcggaggggaacgggaaatataggagaaacgctgggggagaagtggaagtcccgactaaacgcactcggaaaatccgagttccaaatttacaaaaagagtgggatacaagaagtcgaccgaacattggcaaaggagggtattaaacggggtgaaaccgatcaccacgccgtatcaagagggtcagctaagctcaggtggttcgtggaacgaaacatggtcaccccggaaggcaaagttgttgacctcggttgcggaaggggcgggtggagctactactgtggtggcttgaagaacgtccgggaggtaaaaggactcaccaagggaggtcccggacacgaggaaccgattcccatgtcgacatacggatggaacctcgtacgcctccaatcaggggtggacgtatttttcacaccacccgaaaaatgcgataccctactctgcgacataggcgagagctcaccgaacccgacggtcgaagctggcagaacactcagagtccttaacctagtcgaaaactggctcaacaacaacactcaattctgcatcaaggtcctaaatccgtatatgccatcggtgatagagaaaatggaagcactacagaggaaatacggcggagcactggtacggaatccactctccagaaactccacgcacgagatgtactgggtaagtaatgcatccgggaatatagtctccagcgtgaacatgatctccaggatgctaataaaccggttcacgatgaagcacaagaaagccacatacgaaccggatgtggacctgggatccgggacgcggaacattgggatcgaaagtgaagtaccgaacttagacataattgggaaacgcatcgaaaagatcaaacaagagcacgaaaccagttggcactacgaccaagaccacccctataagacctgggcgtaccacggcagctatgaaactaaacaaacagggtcagcgagcagtatggtgaacggagtagtacgcctgctgacgaaaccatgggacgtgctaccgaccgtgacacaaatggccatgactgacacgactcccttcggccaacaacgcgtcttcaaggagaaggtggacaccagaacacaagagccgaaagagggcaccaagaagctaatgaaaatcacggccgagtggctatggaaagaactaggcaagaagaaaacaccccgcatgtgtacacgagaggagttcacacgaaaggtgcgctcaaacgcagccctgggtgcaatattcaccgacgaaaacaagtggaaatcagcacgagaagcagtagaggatagccgtttctgggaactcgtggacaaagagcgcaacctacacctggagggcaagtgtgaaacatgcgtatacaacatgatggggaaaagggagaagaagctgggggagttcggaaaggcaaaaggctcccgagcgatatggtacatgtggctcggagctcgattcctagagtttgaggcactgggattcctaaacgaagaccattggtttagccgtgagaatagcttaagcggcgtggaaggtgaaggactacacaagctgggttacatactccgggacgtcagcaagaaagaaggaggagcaatgtacgccgacgacacagccgggtgggacacacgtatcacgttagaagacctcaaaaacgaggagatggttacaaaccacatggaaggggagcacaagaaactcgcagaagcaatatttaagctaacctaccaaaacaaagtagttagggtccaaaggccgacgccgcgtggaacagtcatggacataatttcccgcagagatcaacgaggctctggacaagtagggacatatggactgaacacattcaccaacatggaggcccagctaatcagacagatggagggagaaggcgttttcaagaatatacagcaccttaccgccaccgaggaaatcgcggtacaaaattgcttagcccggctaggaagggaacgactatcgaggatggcaatatccggagacgattgcgtggtaaaacctctagacgacaggttcgcgtcggccttgactgctctcaatgacatgggcaagataagaaaggatatacaacagtgggagcccagcaggggatggaacgactggacacaagtacccttctgctcccaccacttccacgagctcatcatgaaagacggtagggtccttgtggtaccgtgcagaaaccaagacgagcttatcggcagggcaagaatcagccagggggccgggtggagtctccgcgagacagcatgtttaggtaaatcctatgcacagatgtggtccctcatgtacttccaccggagagatctacgcctcgcagccaatgcgatctgctcagccgtccctagccattgggtaccaacaagtagaacaacctggtccatccacgctaaacatgagtggatgaccacagaggacatgctcacagtctggaaccgagtctggatacaggagaacccgtggatggaggacaaaacaccagtggagagctgggaagagatcccgtatctaggtaagcgtgaagaccagtggtgtggcagcctaatcgggctaacctcccgagctacgtgggctaagaacatccaagcggcaattaaccaagttcgctcccttataggaaatgaagaatacaccgactacatgccctcaatgaaacgattccgccgggaagaagaggaagcaggagtcttatggtga

SEQ ID NO: 25609 - RNA, 9876 nt, synthetic construct
  misc_feature 1..9876: note = derived and/or modified CDS sequence (opt11) from DENV-2__AF169681__SS-prME
  source 1..9876: mol_type = other RNA
agcgcaggcatgatcatcatgctcatccccaccgttatggccttccatctcaccacccgtaacggggagccccacatgatcgtatccatccaggagaaagggaagtcgctccttttcaagaccgaggacggcgtgaacatgtgtaccttaatggctatggacctgggcgagttgtgtgaggacacaattacctacaagtgtcccctcctgagacaaaacgagcccgaggacatcgactgctggtgtaacagcacaagcacgtgggtgacctacgggacatgcactaccaccggcgagcaccgccgggagaagcgctcggtagccctagtgccgcacgtgggtatggggctcgaaacgcggaccgagacctggatgagctccgaaggcgcctggaagcacgcccagcgcatcgagacctggatcctgcgtcaccccgggttcacgatcatggccgcgatcctggcctacaccatcggaaccacccacttccagcgcgccctcatattcatcctactgacagcagtcgcgccaagcatgacgatgcggtgcatcggtatctcaaacagagacttcgtggagggcgtgagcggcggaagctgggtcgacatagtgctagagcacggcagctgtgtgaccacaatggccaaaaacaagcccacgctggatttcgagctgatcaagaccgaggcaaagcagcccgccaccttgcgaaagtactgcattgaggccaaactgaccaacacgaccaccgagtctcggtgcccgactcagggcgagcctagcctgaaggaggagcaggacaagcggttcgtctgcaagcactccatggtggacagaggctggggcaatggttgcggcttattcgggaagggtgggatcgttacgtgcgcgatgtttacatgcaaaaagaacatggaggggaaaatcgtccagcccgagaacctggagtacaccatcgtggtgacgccccacagcggtgaggagcacgcagtcgggaacgacaccgggaagcacggtaaggagatcaaggtgaccccgcagtccagcataaccgaggccgaacttacaggatacgggaccgtgacgatggagtgcagccctcgtaccggtctcgatttcaacgagatggtcctgctgcagatggagaataaggcctggctcgtgcaccgccagtggttcctggacctgcccctcccttggctgccgggcgccgacacccaggggagcaactggatccagaaggagactctggtgacgttcaagaatccccacgcgaaaaagcaggacgtcgtggtcctcggcagccaggagggggccatgcacaccgccttgaccggagccaccgagatccagatgtccagcgggaacctcctgttcacgggccacctgaagtgccgcctgcgcatggacaagctccagttaaagggcatgtcctacagcatgtgcaccgggaagttcaaggtggtgaaggagatcgccgagacacagcacggtactatcgtcatccgggtgcagtatgagggtgacggctccccctgccgaatccccttcgagatcatggacctggaaaagcggtacgtgctcggccgcctgatcacggtcaatccgatcgtgaccgaaaaagacagccccgtgaatatcgaggcggaaccgcccttcggggactcgtacataatcatcggcgtcgagccaggtcagctcaaattgaactggttcaagaagggcagctcaatcgggcaaatgttcgagaccaccatgcgcggcgccaagcggatggccatcctaggcgatacggcttgggacttcgggagcctggggggggtgtttacctccataggcaaggccctccaccaggtgttcggggccatctacggggccgccttcagcggcgtctcctggacgatgaagatcttaatcggggtgattatcacttggatcggtatgaacagccgctccacgagcctgtccgtgagcttggtgctcgttgggatcgtgaccctgtacctcggcgtaatggtgcaggccgactccgggtgtgtggtcagttggaagaacaaggagctcaagtgtggcagtggcatctttatcaccgacaacgtgcacacctggacagagcaatacaaattccagcctgaatcccccagcaagttggcgtccgccatccagaaagcgcaagaggaggggatctgcggcatccggagcgtgacacgcctggagaacctgatgtggaaacagatcacgcctgaactgaatcacattctagccgagaacgaggttaagttgaccatcatgacgggggacatcaaaggtatcatgcaggccgggaagcgttccctgaggccacagcccacagagctcaaatacagctggaagacctggggcaaggcgaagatgctctccaccgagagccacaaccagacgttcctgatcgacggccccaaaaccgccgaatgcccgaacaccaaccgcgcatggaactccctggaggtggaagactatgggttcggcgttttcacgactaacatctggttaaaactgaaggagaagcaggacgccctgtgcgacagcaagctgatgtccgccgcgatcaaagacaaccgcgctgttcacgccgacatggggtactggatcgagagcgccctgaacgacacctggaagatcgagaaggcctccttcatcgaggtgaagaactgccactggcccaagtcgcacaccttgtggagcaatggcgtgctcgagagcgaaatgatcatccctaagaacctggcgggccccgtctcccagcacaactatcggccggggtaccacacccagatcgccggcccctggcacctggggaagctcgagatggacttcgacttctgcgacggcactacggtggttgtcaccgaagactgtggtaaccgcggccccagcctgcggaccaccacggccagcggcaaattaatcacggagtggtgctgtcgctcctgcaccctcccgccactgcgataccgtggggaggacggctgctggtacgggatggagatacgacccctgaaggagaaggaagagaatctggtgaatagtcttgtgaccgcggggcacgggcaggtcgacaacttttccctgggcgtgctcggcatggccctgtttctggaggaaatgctcaggacgagagtggggactaaacacgccatcctgctcgtcgccgtcagcttcgtgactttgataaccggcaacatgtcctttaaggacctggggcgcgtcgtcgtgatggtcggggccactatgaccgacgatatcggcatgggcgtgacctacctggcgctcctagcggcgtttaaggtgaggcccaccttcgcggccggcctgttgctgcgcaagctgacgagcaaggaactcatgatgaccactatcgggatcgtcctgctctcccagagcaccatcccggagaccatcctcgagctgaccgacgcccttgcgttaggcatgatggtcctgaagatcgtgcgcaacatggagaagtaccagctggctgtcaccatcatggccatcctctgcgtgccaaacgccgtcatcctgcagaacgcatggaaagtgtcgtgcaccatcctggccgttgtcagcgtgagccccctcatactgacgtcgagccagcaaaagaccgactggatccccctggccctcaccatcaaagggctgaatcctaccgccatctttctgacgaccttatctcgcactaacaagaagcgctcctggccgctgaacgaggctataatggcggtgggtatggtttcgatcctggcctcgagcctcctgaagaacgacatccccatgaccggtcccctcgtagccggcggtttgcttacggtgtgctacgtcctgactgggcggtccgccgacctcgagctcgagcgcgccaccgacgtgaagtgggagaaccaggccgagatcagcggcagctccccgatcttgagcatcaccatatccgaggacgggtcgatgagtatcaaaaacgaggaggaggagcaaacgctcaccatcctgattcggacaggcctgttggtgatcagcggcctgttcccggtctccattcccataaccgccgccgcctggtacctgtgggaggtgaagaagcagcgcgcgggggtcctctgggatgtaccctccccgccgcccatggggaaggcggagctggaggacggggcctatcggatcaagcagaaaggcatcctgggctactcccagatcggcgccggcgtgtataaggaggggaccttccacacgatgtggcatgtgacccggggcgccgtcctcatgcacaaggggaaacgtattgagcccagctgggccgacgtgaagaaggacctgatctcctacggcgggggctggaaactggagggcgaatggaaggagggggaggaggtgcaggtcctcgccctggagcccggcaagaacccccgcgccgttcagaccaagcccggactgttcaagaccaatacgggcaccataggggctgttagcttggacttttcacccggcaccagcggctcacctataattgacaaaaaggggaaggtcgtgggcctctacgggaatggcgtggtcacaaggagcggcgcctacgtgtccgccattgcgcagactgagaaatccatcgaggacaatccggagattgaggacgacatcttccgcaaacggcgcctaacaatcatggacctgcaccccggggccggcaagactaaacggtacctccccgcgatcgtgagagaggctatcaagcgggggttgcgcaccttgattctagcgccaacgagggtcgtagccgccgagatggaggaggcacttcgaggcctgcccatccggtaccagacacccgccatccgcgcggagcacaccgggcgcgagatcgtggacttaatgtgccatgccaccttcacgatgcggctactgtccccagtccgcgtgccgaactacaacctcatcatcatggacgaggcccacttcaccgaccccgctagcatagccgcccggggctacatcagcacccgcgtggaaatgggtgaggccgccgggatcttcatgaccgctacgcctcccggctcccgggacccattcccacaaagcaacgcccccatcatcgacgaggagcgcgagatccctgagcgttcttggaacagcgggcacgagtgggtcaccgacttcaagggcaaaaccgtgtggttcgtgccgtctataaaggctgggaacgacatcgccgcctgcctgcgtaaaaacggcaagaaggtaatccaactgagccggaagacattcgactccgagtacgtgaagacgcgcaccaacgattgggacttcgtggtgacgaccgatataagcgagatgggtgccaactttaaggcggaacgggtgatcgatccccgcagatgcatgaagcccgtgatactcaccgacggggaggagcgcgtcatcctggcaggccccatgccggtcacccactccagcgccgcgcagcggagggggcggatcggccgcaaccccaagaacgagaatgaccaatacatctacatgggggagcccctggagaacgatgaagactgcgcccattggaaggaagcgaagatgctcttagacaatatcaacactcccgagggcattatcccgtccatgttcgagcccgagcgggagaaggtagacgccatcgacggcgagtatcgcctgcgcggggaggcccggaagacctttgtcgacttaatgcgtcggggcgacctgcccgtgtggctggcctacaaggtggccgcggaggggatcaactacgctgatcgccggtggtgcttcgacggcatcaagaacaatcagatactcgaggagaatgtcgaggtggagatctggacgaaggagggggagcgtaagaagctgaaaccgcggtggctggacgcccgcatctatagcgaccccctcgccctgaaggaattcaaggagttcgccgcgggccgtaagtctctggccctcaacctgatcaccgagatgggccgcctaccgaccttcatgacccagaagacgcgggacgccctcgacaatctagcagtcctgcacactgcggaggccggcggacgggcctacaaccacgccctcagcgagttaccagagaccctggagaccctccttttgctcacgctgctagccaccgtgacagggggtatcttcctcttcctgatgtccgggagagggatcggcaaaatgaccctggggatgtgctgtatcatcaccgcgtcaatcctcctgtggtacgcacagatacagcctcactggatcgccgcctccatcattctggtgttcttcttgatcgttctgctgattcccgagcccgagaagcagagaacgccacaagacaaccaactcacctacgtggtgatcgccatcctgaccgtggttgcggcaactatggccaacgagatgggcttcctggagaagaccaagaaggatctcggcttcggcagcattgccactcagcagcccgagtcgaacatcctggacattgacctgcgtccggcctctgcgtggaccctctacgccgtggccaccacgttcgtcacccccatgctgcgccactcgatcgagaactccagcgtgaacgtgtcccttaccgccatcgccaaccaggcgaccgtcctcatgggcctgggtaagggctggcccttaagcaagatggacatcggtgtgccgctcctggcgatcggctgctacagccaggtgaaccccatcacgttgacagccgccctactgttgctcgtcgcgcactacgccatcatcgggcccggcctgcaggccaaggccacccgtgaggctcagaagcgcgcggcggccggtatcatgaagaaccctaccgtggacgggatcacggtgattgacttagatccgatcccctatgacccaaagttcgaaaagcagcttggccaagtcatgctgctggtgctctgcgtgacccaagtcttaatgatgcggacaacctgggccctgtgcgaagcgttgacgctggcaaccgggcccataagtaccctgtgggagggtaacccggggcgcttctggaacaccacgatcgccgtgtccatggccaacatcttccggggaagctacctcgccggcgccgggctgctgttttccatcatgaagaacaccaccaacacgcgccgcgggacggggaacatcggcgagaccctcggcgagaagtggaagtccaggctgaacgcattggggaaatccgagttccagatctataagaaaagtggcatccaggaggtggatagaaccctagccaaggaagggatcaagagaggcgagacggaccaccacgcggtctcccgcgggagtgcgaaactgcgatggtttgtggagcgcaacatggtcacgcccgagggtaaggttgtggacctgggctgcgggcggggcgggtggtcttactactgcggggggttgaagaacgtgcgtgaggtcaagggactaacaaagggtggccccggccacgaggagcccattccgatgagcacatacgggtggaacctggtgcggttacagtccggggtggatgtctttttcatcccgcccgagaaatgcgatacactgctgtgcgacattggggagagctctcccaacccgacagtggaggcgggccgcaccctacgggtgcttaacctggtggagaactggctcaacaacaacacgcagttctgtatcaaggtgctaaatccctacatgcccagcgtgatcgagaagatggaggccctgcagcgcaagtacggcggggccctggtccggaaccctcttagcaggaactccacccacgagatgtactgggtgtctaatgccagtggcaacatcgttagctccgtcaatatgatctcgcggatgctgatcaatcgctttaccatgaggcacaagaaggccacgtacgagcccgacgttgacctgggctccggcacccgcaacatcgggatcgaaagcgagatccccaacctcgacatcattggcaagcggatagaaaagatcaagcaggagcacgagacttcctggcactacgaccaggaccatccatacaagacatgggcgtaccatggcagctacgagaccaagcagaccgggtcagctagctccatggtgaacggcgtcgtgaggctgctgaccaagccgtgggatgtgctgcccaccgtcacacagatggctatgaccgacaccaccccgttcgggcagcagcgcgtcttcaaggagaaggtggacacccgaacccaggagccgaaggagggcaccaagaagctgatgaagatcaccgccgagtggctgtggaaggaactcggcaagaagaagacgccgcgcatgtgcacccgggaagagtttacacgcaaggtccgtagcaacgccgcattgggggccatcttcaccgacgagaacaaatggaagtccgcgcgcgaggccgtggaggacagccggttctgggagctggtcgacaaggagaggaacctgcacctggaagggaagtgcgagacgtgtgtgtacaacatgatgggaaagcgggagaagaagctgggcgagttcgggaaggcaaagggctcccgcgctatatggtacatgtggctgggcgcccggttcctggagttcgaggccctggggtttctcaacgaggaccactggtttagcagagagaactcccttagcggcgtagagggggagggcctgcacaagctgcggtatatcctgagggacgtcagcaagaaggagggaggggccatgtacgcggacgacacggccggctgggacactcgaattaccctggaggatctcaagaacgaggagatggtaaccaaccacatggaaggcgagcacaaaaaactggccgaagccatcttcaagctgacctaccagaacaaagtcgtccgtgtgcagcgccccaccccccgcggcaccgtgatggacatcatatcccggagggaccagcggggaagcggccaggttgggacctacgggctcaacaccttcaccaacatggaggcccagctgatcaggcaaatggagggcgagggtgtgttcaagaacatccagcacctgacagcaacagaggagatcgcggtgcagaactggctcgcccgcgtcggccgcgagcgcctgagtcgcatggccatcagcggggacgactgcgtggtgaagcctctcgacgaccgcttcgcctccgcgctcactgccctgaacgacatgggcaagatccggaaggacatccagcagtgggagccgagccgcggctggaacgactggacccaggttccattctgttcccaccatttccacgagctgatcatgaaggacgggcgggtgctcgtcgtcccctgtcgcaaccaggacgagctgataggccgagcccggattagccagggggccggctggtccttacgggagaccgcctgcctcggcaagagctacgcgcagatgtggtcactgatgtacttccaccgccgggacctgcgactcgctgctaacgccatctgctctgctgtgccctctcattgggtgcccacgagccggacgacctggagtatccacgcaaagcacgagtggatgaccacagaggacatgctgacggtctggaacagagtgtggatccaggagaacccatggatggaggacaagacccccgtggaaagctgggaggagatcccctaccttggcaagcgggaggaccagtggtgcggctccttgatcgggctgaccagccgcgctacctgggccaagaacatccaagctgcgatcaaccaggtccgaagcctgatcggtaacgaggagtacacggactatatgccgtccatgaagcgcttccgccgggaggaggaggaggccggggtcttatggtga

SEQ ID NO: 25610 - RNA, 9876 nt, synthetic construct
  misc_feature 1..9876: note = derived and/or modified CDS sequence (opt11) from DENV-2__AF169683__SS-prME
  source 1..9876: mol_type = other RNA
agcgcaggcatgatcatcatgctgatccccactgtgatggcattccacctcaccacccggaacggggaaccgcacatgatagtcagcatccaggagaagggtaagtcactactgttcaaaaccgaagacggggtcaatatgtgcaccctcatggctatggaccttggcgaactgtgcgaggacacgataacatacaagtgcccgctgctgcggcagaacgaaccagaggatatcgactgttggtgcaacagtacctcaacctgggtgacctacggaacctgcaccacaaccggcgagcaccgccgggagaagcgatccgtcgccctggttccccacgttggcatgggcttagagactcggactgagacctggatgagcagcgagggcgcgtggaagcacgcccagcgtatagagacctggatcctgagacatcctgggttcacgatcatggcggcgattctggcctacaccataggaaccacccactttcagcgcgccctcattttcattttgctgacggccgtcgccccctccatgaccatgcgctgtattgggatctccaaccgcgactttgtggaaggcgtgagcggcgggtcctgggtggacatcgtgctcgagcacggcagctgcgttactaccatggccaaaaacaaacctactcttgacttcgagctgattaagaccgaggccaagcagccagccaccttgcgcaagtactgcattgaggccaagctgacaaacactacaacagaatcccgttgccccacccagggggagccctccctcaaggaggagcaggacaagaggttcgtgtgcaagcactccatggtggaccgcggctggggcaacgggtgcggcctcttcgggaagggcgggatcgtgacgtgcgcgatgtttacgtgtaaaaagaacatggaggggaaaatcgtgcaacctgaaaacttagagtatactatcgtggtcacgccccactccggcgaggaacacgccgtcggaaacgacacgggcaaacacggtaaggagatcaaggtgaccccgcagtccagcataacagaggccgagctgactggctacgggacagtcacaatggagtgcagtccccggaccgggctcgacttcaatgaaatggtcctgctgcagatggaaaacaaggcctggctcgtgcaccgccagtggttcctagacctacccctcccctggttgccgggggccgatactcaagggtccaactggatacagaaggaaaccctggtgacattcaagaacccccacgccaagaagcaggacgtcgtcgtcctcggcagccaggagggggccatgcacaccgccctgactggagcaaccgagattcagatgtcaagcggaaacttactgttcacgggtcacctgaagtgccgactgcgcatggacaaactccagctgaagggtatgtcctacagcatgtgtaccgggaagtttaaggtggtgaaagagatcgccgagactcaacacggcaccatcgtcatccgggtgcagtatgaaggtgacggttccccgtgccgcatccccttcgagatcatggatctggaaaagcggtacgtgttaggccgcctaatcacggtcaacccaatagtgaccgaaaaagacagccccgtgaacatcgaggccgagccgcccttcggagactcgtacatcatcataggtgtcgaaccggggcagctgaagctcaactggttcaaaaagggcagctccatcgggcagatgtttgagaccaccatgcgaggcgctaagcggatggccatactcggtgacacagcctgggacttcgggtcattgggaggggtcttcaccagcatcggcaaagccctccaccaggtgttcggggcgatatacggcgccgccttcagcggtgtatcctggaccatgaagatcctcatcggggtgataattacatggattggaatgaacagccgttccacgagcctgtccgtgagtctggtcctcgttgggatcgtgaccctgtacctgggggtcatggtgcaagccgactccggatgcgtggtcagctggaagaacaaggaactcaagtgcgggagcggcatcttcatcaccgacaatgtccacacctggacggagcagtacaagttccaacccgagtcccccagcaaacttgcgtcagcaatccagaaggcccaggaggagggtatatgcggtatccgtagcgtgacccgtctggaaaatctcatgtggaagcagattacccccgaactcaaccatatactggccgaaaacgaggttaagctcaccatcatgaccggggacatcaagggcatcatgcacgccgggaagaggtccctgcgcccgcaacccaccgaactgaaatacagctggaagacctggggcaaagcgaagatgctctccaccgagagccacaaccaaactttcctgatcgacggccccgagacggccgaatgcccgaacaccaaccgggcctggaactccttggaggtggaggactacggattcggcgtgtttaccacgaacatttggctaaaactgaaggaaaagcaggacgccttctgcgacagcaaactgatgtccgccgcaataaaggacaaccgcgccgtccacgccgatatgggttactggatcgaaagcgccctcaacgacacctggaagatcgagaaggcctccttcatagaggtgaaaaactgtcactggccaaagagccacaccctgtggtccaacggcgtcctggagagcgagatgatcatccccaagaatcttgcgggccccgttagtcagcacaactacaggccaggctaccacacccagatcgccggcccgtggcacctggggaagctggagatggacttcgatttttgcgacggcaccacggtggttgtaacggaggactgcggtaaccgcggcccctcattacggactaccacggccagcggcaagctgattaccgagtggtgttgccgctcctgcacccttccgccactccggtaccgtggtgaggacggctgctggtatggcatggagatccggccgctaaaggagaaagaagagaacctggtaaattcactcgtgaccgcaggccacggccaggtcgataacttttccctgggtgtgcttggcatggccctctttctggaggagatgctgcgcacgcgggtgggcacgaagcacgctatcctgttggtcgcagttagcttcgtcacgctaatcactggaaatatgtccttcaaggacctcggtcgggtcgtggtgatggtcggcgccaccatgactgacgacatagggatgggcgtgacctacctggcccttctcgctgccttcaaggtgcggcccactttcgccgccggtttgctgcttcgcaagctgacgtctaaggagctgatgatgaccaccatcgggatcgtgctcctttcccagagcaccatcccagagacgatcctggagctcaccgatgctctggcgctgggaatgatggtgctgaaaatcgtgcggaacatggagaagtaccagttagccgtcaccatcatggccattctgtgcgtacccaacgccgtcatcttacagaatgcctggaaggtgtcctgcaccattctggcggtggtcagcgtgagcccgcttatcctcacgtcttcccaacagaagaccgattggatcccactggccctgaccatcaaggggcttaaccccaccgcaatctttctaacaaccctgtcgcggaccaataagaaaagatcctggccgttaaacgaagccatcatggcggttggaatggtaagcatactggcctcctcactgctaaagaacgacatccctatgactggccccctggtggctgggggcctgctaacggtgtgctacgtcttgaccgggaggtccgcggatttagaactcgagcgcgcgaccgacgtgaagtgggaggaccaggcggagatcagcgggagcagtccgatcctcagcataaccatcagcgaggacgggagtatgagtatcaagaatgaggaggaggaacagactctgaccatcctgatccggaccggcctgctggtaattagcggcctcttcccggtatccatcccaattacggctgccgcctggtacctgtgggaggtaaagaagcagcgcgctggggtactgtgggacgtaccatccccaccgcccatgggaaaggcggaactggaggacggggcctacaggattaagcagaagggcatcctggggtactcccagatcggcgccggcgtgtacaaggaggggaccttccacactatgtggcacgtcacgagaggagccgtcctgatgcacaagggaaagagaatcgagccaagctgggccgacgtgaaaaaggaccttatctcctacggcgggggttggaagttggagggtgagtggaaggaaggggaggaggtgcaggtcctcgcgttagagcccggcaaaaacccccgcgccgtgcagaccaagcccggcctgtttaaaaccaacactggtaccattggagcagtatcacttgacttctcgccaggcactagcggctcccccatcatcgacaaaaaggggaaggtcgtggggctctacgggaacggtgttgtcacccggagcggagcctatgtgtccgccatcgcgcaaactgagaagtccatcgaggataaccccgagatcgaggacgacatattccgcaaacggcggcttaccataatggatctacacccaggggcaggcaagaccaagcgctacttaccggcgatcgtacgcgaggccataaagcgagggctcagaactctgatcctggcaccgacgcgggtcgtggctgccgagatggaagaggccctccgaggcttgcccatccgataccagacacccgccatccgcgctgagcataccgggcgcgagatcgtggacctgatgtgccacgccaccttcacgatgcggctcctctccccggttcgcgtaccgaactacaacctaatcatcatggatgaggcgcactttaccgaccccgctagcatagccgcgcgggggtatatatccacccgtgtggaaatgggcgaggccgctgggatcttcatgaccgcaacgcctccaggctcccgggacccgtttccccagagcaatgcccccattatcgacgaggagcgcgagatcccggagcggtcctggaacagcgggcacgagtgggttacggacttcaagggaaagaccgtgtggttcgtgccatccatcaaagctgggaacgacatagccgcctgcctccgcaaaaacggcaagaaggtaatccaactgagccgtaagacctttgattccgagtacgtgaagacgcgtaccaatgactgggacttcgtggtcaccaccgacatttcggagatgggtgccaacttcaaggcggaacgggtgatcgacccccgcagatgcatgaagccggtgatcctgacggacggggaggagcgtgttatcctcgccggccccatgccagtgacccacttctccgctgcccagcggcgggggcggatcggccgcaaccctaaaaacgaaaacgaccaatacatctacatgggtgaacccttagagaacgacgaagactgcgcccactggaaggaggcaaagatgctgctcgacaacatcaacacccccgaaggtatcataccgagcatgttcgaacccgagcgggagaaggtggacgccatcgacggggagtaccgcctgcgcggggaggcacgaaagaccttcgtcgatctcatgcgccgaggcgacctcccagtgtggctagcctacaaggttgctgcggagggtattaattacgcggatcgtcggtggtgctttgacggtattaagaacaatcaaatcctggaagagaacgtcgaggtggagatctggacgaaggagggcgagcgcaagaaattgaagccgcgatggctcgacgcccgcatatactccgaccccctggcactaaaggagttcaaggagttcgccgcgggtcgtaagagcctggccctgaatctcattaccgagatgggccgactgcccactttcatgacccagaaaacgcgggacgccctggacaacctcgccgtgttgcacaccgcagaggccgggggacgcgcgtacaaccacgccctgtcagaactacccgagacactggagaccctgctccttctgacactcctggcaaccgtaaccggcggcatctttctgttcctcatgagcggccgggggataggcaagatgaccctgggaatgtgttgcatcattaccgcgtctatcctgctgtggtatgcccagatccagcctcactggatcgcagccagcatcatcctagtcttcttcctgatcgtcctccttatccccgagcccgaaaagcagcgcactccccaggataaccagctgacctatgtggtgatcgccattctcaccgtcgtggcggccaccatggccaacgagatgggcttcctggagaaaacgaagaaggacctggggtttggctcgatcgcgacccagcaacctgaaagcaacatattagacattgaccttcggcctgccagtgcatggaccttatacgccgtcgccaccacgttcgtcacgcccatgttgcgccattcaattgagaatagttccgtgaacgtaagcctaacagccatagcgaaccaagccaccgtcctgatggggctcgggaagggttggcccctgtccaagatggacatcggggtgccgcttctcgccatcgggtgctacagccaagtaaaccccatcacgctgaccgccgctctgctcctcctggtcgcccactacgccatcatcgggcccggccttcaagccaaggccacgcgagaggcccaaaagcgcgcagccgccggcataatgaagaaccccactgtggacgggatcacggttatcgacttagaccctatcccctacgaccccaaattcgagaagcagctgggccaagtgatgctcctggtgttgtgcgtgacccaggtcttaatgatgaggactacttgggccctgtgtgaggccctgacgctcgcgaccgggcccatatccacgctgtgggagggcaacccagggcgcttctggaacaccaccatcgccgtttcaatggccaatattttccggggctcctacctggccggcgcggggctcctgttctcgatcatgaagaacaccaccaacacccgacgcggcacggggaacatcggtgagactctgggcgagaagtggaaatcccggctcaacgcgctgggcaagtctgaatcgcagatttacaagaaatcagggatccaagaggttgatcgtaccttagcgaaggagggtatcaaacgtggcgagaccgaccaccacgccgtctccagggggagcgccaaacttcggtggttcgtggagagaaacatggtcacgcccgaggggaaggtcgtggacctgggttgcggccggggcgggtggtcctactactgcggcgggataaagaacgtccgcgaagtaaaggggcttactaagggtgggcccggtcacgaggagccaataccgatgtctacgtatgggtggaacctagtgaggctgcagtccggcgtggatgtctttttcattccgccagagaagtgcgataccctgttgtgcgatatcggggagtctagccccaacccgaccgtggaagcgggacgcaccctgcgggttctgaaccttgtcgaaaactggctgaataacaatacgcaattctgcattaaggtgctgaacccctacatgcctagcgtgatcgagaaaatggaggccctccagagaaaatatggtggagcgctggttcggaacccactgtcccgcaactccactcacgagatgtattgggtgagcaacgcctccggaaacatcgtgagcagcgtcaacatgatctctcggatgctcatcaacaggtttaccatgcgtcacaagaaggccacgtacgagccggacgtggatctcgggtcggggacacgcaatattggaatcgaatctgagatacctaacctggatatcatcggcaagcggatcgagaagatcaaacaggagcacgagacctcttggcactacgaccaagaccacccctacaaaacctgggcgtaccacggaagctacgagacaaagcagaccggatccgccagctctatggtgaacggcgtcgtgcgcctgctcacaaagccgtgggatgtgttgcccaccgtcacccagatggcgatgaccgatactaccccattcgggcagcagcgtgtgttcaaggagaaggtagacacgcgtacccaagagcccaaagagggcactaagaagctgatgaagattacagccgagtggctctggaaggagctgggcaagaagaagactccgcgcatgtgcacgcgggaggagttcacgagaaaggtgcgtagcaacgccgcgctgggggccatctttaccgacgagaataagtggaagtccgctcgcgaggccgttgaagactcccggttctgggagcttgtcgacaaggagcgaaacctgcaccttgagggcaagtgcgagacgtgcgtgtataacatgatggggaagcgcgagaaaaagctcggcgagttcgggaaggcgaagggctcacgcgctatctggtacatgtggctaggcgcccggtttctggagttcgaggcgctcggtttccttaacgaggatcactggttttcacgcgaaaattccttgagcgggttggagggggaaggcctgcacaagctgggctacatcctccgtgacgtcagcaagaaggagggcggcgccatgtacgccgacgataccgctggatgggacactcgcatcaccctggaggatctgaagaatgaggagatggtcacgaaccacatggagggggaacacaaaaagctcgccgaggccatcttcaagttgacctaccaaaacaaagtggtgcgggtccagcgtcccacaccccgggggaccgtgatggatatcattagccgccgagatcaaagaggcagcggccaggtgggtacgtacggcctgaacacctttacgaacatggaggcccaactcatccggcaaatggagggggagggcgtcttcaaaaacatacagcacctgactgcgaccgaggagatcgctgtgcaaaactggctggctcgcgtgggtcgcgagcgtctgtcccgcatggccatcagcggcgacgactgcgtcgttaagccccttgacgaccgcttcgcatccgcgctaaccgccctcaacgacatgggcaagatccgcaaggacatccagcagtgggagccaagccgggggtggaacgattggacccaagttccgttttgttcccaccacttccacgagctgatcatgaaagacggtcgcgtcctggttgtgccatgtcggaatcaggatgagctcatcgggagggcccggattagccagggagctggatggtccctgcgcgaaaccgcttgcttaggcaaaagttacgcacagatgtggtccctcatgtacttccaccggcgcgatctgcggctggccgccaacgcaatctgcagcgctgttccttcccactgggtcccgacaagccgaaccacctggtcgatacacgcgaaacacgagtggatgacgacggaggacatgctcacggtgtggaaccgggtctggatccaggagaacccctggatggaggataagacccccgtggagagctgggaggagatcccctacctgggcaagagagaagaccaatggtgcggttccctcatcggcctcactagccgggccacctgggccaagaacatccaggccgcaataaatcaggtgaggagcttgatcgggaacgaagagtacacggactacatgccatccatgaagcggttccgccgcgaagaagaggaagccggcgtcctgtggtga

SEQ ID NO: 25611 - RNA, 9876 nt, synthetic construct
  misc_feature 1..9876: note = derived and/or modified CDS sequence (opt11) from DENV-2__AF169684__SS-prME
  source 1..9876: mol_type = other RNA
tctgctggcatgataatcatgttaatccccacagtgatggccttccacctcaccacccggaacggggagccccatatgatcgtgagcattcaggagaagggcaagagtctgctgttcaaaaccgaggatggcgttaacatgtgcacgctaatggcgatggacctaggcgagctctgcgaggacaccataacatacaaatgccccctcttgcgccagaacgagcccgaggatatcgactgctggtgcaactcaacatcgacgtgggtcacatatgggacctgcactacaacaggcgagcatcggcgcgagaagcggtccgtcgcgctggtgccgcacgtaggtatggggctagagacgcggaccgagacctggatgagctccgagggcgcgtggaaacacgcccagcgcatcgaaacctggatcctgcggcacccgggcttcacgatcatggccgcgattctggcttacacaatcggcaccacccacttccagcgggccctcatcttcatcctgctgacggccgtcgcgccctctatgaccatgcggtgtataggaatctccaacagagacttcgtggagggcgtctctggaggttcctgggtcgacattgtattagagcatggcagctgtgtgacgaccatggccaagaacaagccgacgctggacttcgagttaatcaaaaccgaggctaagcagcctgctaccctgcgtaagtactgcatagaggccaagcttaccaacacgacaaccgagtcccgatgcccaacgcagggggaacccagcctgaaggaggagcaagacaagcggtttgtgtgcaagcactccatggtggaccgcgggtgggggaacgggtgcgggctcttcgggaagggggggatcgtgacgtgcgccatgttcacgtgtaaaaagaacatggagggcaaaatcgtccaaccagagaacctggagtatacgatcgtggtgactccccactcaggagaggaacacgcagtggggaatgatacgggcaaacacgggaaagagatcaaagtcaccccgcaatccagcatcacagaagccgagcttaccgggtatgggaccgtgacgatggagtgcagcccccggactggactcgatttcaacgagatggtcctgcttcagatggagaacaaggcctggctcgtgcaccgccaatggttcctggacctgcccctaccctggctgccgggcgccgacacgcagggtagcaactggattcagaaggagaccctggtaacgttcaagaacccccacgcgaagaagcaggacgtcgttgtcctcggctctcaggagggcgctatgcacacagcgcttaccggcgcaactgaaatccagatgtccagtggcaacctcctgttcacgggccacctcaaatgtcggttgaggatggacaagctgcagctgaaaggcatgtcctacagcatgtgtaccggcaagttcaaagtggtgaaggagatcgccgagacccagcatggcaccatcgtcatccgggttcagtacgaaggagacgggtccccctgtcgcatcccattcgaaatcatggacctggaaaagcggtacgtgttgggccgcctgattacggtcaacccgatcgtcacagaaaaggacagccccgtcaacatagaggccgagccacccttcggggacagctacatcatcatcggcgtcgagccggggcagctgaaactcaactggtttaagaaaggcagctccattgggcagatgttcgaaaccaccatgcgcggcgccaagagaatggctatccttggcgatactgcctgggacttcgggagcttgggcggggtgttcacgtccataggcaaagccctccaccaggtgttcggggcgatctacggggccgcatttagcggcgtctcctggacaatgaaaatactgattggggtcatcattacctggatcggcatgaacagccgctccacgagcctgtccgtcagcttggtccttgttgggattgtgacactgtacttaggcgtcatggtgcaggccgactccgggtgtgttgtctcctggaagaacaaagagctgaagtgcggctcggggatctttatcaccgataacgtgcacacgtggaccgaacagtataaattccagcccgaatcacccagcaagctagcatccgcgatccagaaggcacaggaggaggggatctgcgggatcagaagcgtgactcgcttggagaacctaatgtggaagcaaatcaccccggagctgaaccatatcctagccgagaacgaggttaagctcaccatcatgacgggggacatcaaaggcatcatgcaggccgggaagcgttccttgaggccacaaccaaccgagctaaagtacagctggaagacgtggggcaaagcgaagatgctttccacggagagccacaatcagacgttccttatcgacgggccggaaacagccgagtgcccaaacaccaaccgggcttggaatagcctggaagttgaggactacgggtttggcgtgttcacgacgaacatttggctcaagctcaaggagaaacaagacgcgttttgcgactcaaagctgatgagcgccgctattaaggacaaccgcgccgtccatgccgatatgggatactggattgagagcgcactcaacgatacttggaagatagagaaggcctccttcatcgaagtcaaaaactgccattggccaaagagccacactttatggtccaatggcgtgctggagagcgagatgataattcccaagaacctcgcgggccccgtctcccagcataactaccggccgggctaccacacccagatcgcgggcccctggcacctggggaaactggagatggacttcgacttctgcgacggcaccactgtggttgtcactgaggattgcgggaatagagggcctagcctccggaccactacggcttctggtaagctgatcaccgagtggtgctgccgctcctgcaccctacccccgctcaggtaccgcggggaggacggttgctggtacgggatggagatccgtccacttaaggagaaggaggagaatctggtgaacagcctcgtgaccgccggccacggccaggtcgacaatttctcgctaggcgtgctgggtatggccctctttttggaggagatgctgcgcacgcgggtgggaaccaagcacgccatacttctggtggccgtttccttcgttacgctgatcaccggtaatatgtccttcaaggatctcgggagggtcgtggtaatggtaggcgccaccatgaccgatgacattgggatgggcgtgacctacctggccctgctggcggcctttaaagtgcgtcccaccttcgccgccggcctgctgttacggaagctgacgtccaaggagctgatgatgaccacgatcgggatcgttctgcttagtcagtctacaataccggagacgatcctggagctcaccgatgcgctagccctgggcatgatggtgctcaagatcgtgcgcaacatggagaaataccagctggccgtcacgatcatggccatcctgtgcgtgccgaacgccgttatactccaaaacgcctggaaggtgtcctgcacaatcctcgcagtggtctctgtgagccccctaatcctgacgtcgtcccagcagaagaccgactggatccccctggccctcaccatcaaggggcttaaccccacagcgatttttctgacgacgctgtcgcggacaaacaagaagcgctcctggccgctcaacgaggccatcatggcggtgggaatggttagcatactggcatccagtctgctcaagaatgacatccccatgacaggccccctggtggccggcggcctgttgacggtgtgctacgttctgactgggcgatccgcagaccttgagctagagagagccaccgacgtgaaatgggaggaccaggctgaaatttctcggtcatcccccatcttaagcataaccatctccgaggacggcagcatgagtatcaagaacgaggaggaggagcaaacgctgaccatcttaatcagaacagggctgctggtgatctcaggtctctttccggtcagcatcccgataacagctgccgcctggtacctgtgggaggttaagaagcaacgggcaggcgtgttgtgggatgtcccctccccgccgccgatggggaaggcggagttggaggacggcgcctaccgcataaagcagaaggggatcctgggttattcccaaataggggccggagtgtacaaggagggtaccttccacacaatgtggcacgtcactcgcggggcggtcctgatgcacaagggcaagaggatcgagcccagctgggcggacgtaaagaaggacctcatctcgtacggcggcgggtggaagttagagggcgagtggaaagagggggaggaagtccaggtcctggcgcttgagcccggtaagaaccctcgagcagtgcaaacgaagcccggcctgttcaagaccaacacggggacaatcggcgcggtgagcctcgacttctcccctgggaccagcggctctccaatcatcgataagaagggcaaagtcgtgggtctgtacggcaacggtgtggttactcgctccggcgcctacgtgtcggccatcgcgcagacggagaagtccatagaggacaaccccgagatcgaggatgacatttttcggaagcgccggttgaccatcatggacttacacccgggcgccggtaaaaccaagaagtacctgcccgccatcgtgcgggaggctatcaagagagggttacgaaccctgatcctcgcgccgacgcgggtcgtggccgccgaaatggaggaggccctccgcggcctacctatcagataccagacccccgccatccgcgcggaacacaccggccgcgagatcgtggacctgatgtgtcacgccaccttcactatgcgcctcctgagtccggtccgcgtaccgaactataatctgataataatggatgaagcccacttcaccgaccccgcaagcatagcagcgcgagggtacatcagtacccgcgtggagatgggggaggccgccggcatcttcatgaccgccacgccgcctgggtcccgggacccgttcccccagagcaatgctcccattatcgatgaggagagggaaatccccgagcggtcctggaactccggccacgagtgggtgaccgatttcaaaggaaagaccgtgtggttcgtaccttccataaaagcgggaaacgatatcgccgcctgccttcgcaagaacggaaagaaggtgatacagctatcccggaaaacattcgattccgagtacgtgaaaacgaggaccaacgactgggacttcgtagtcaccaccgacatctctgagatgggtgcaaactttaaagctgagcgggtaatagatccccgccggtgtatgaagcccgttatcctgacggacggggaggaacgcgtcatcctcgccggtccaatgcctgtgacgcatttctccgccgcccagcgccgaggcaggatcgggcgcaatcccaagaacgagaatgaccagtacatctacatgggggagcccctcgagaatgacgaagactgtgcccactggaaggaggctaagatgctgctcgacaacatcaacaccccggagggaattatcccttcaatgttcgaacccgagcgggagaaggtagacgccatcgacggcgagtatcgcctgcgaggtgaggctcggaagacttttgtcgatctgatgcggcgtggggacctgcccgtgtggctggcctacaaggtggccgcagagggcatcaactacgctgaccgtcgttggtgcttcgatgggattaagaacaatcagatactggaggagaacgtcgaggtggagatctggaccaaggagggagagcgcaaaaagctcaagccgcggtggttagacgccaggatctactccgatcccctggccttgaaggagtttaaggagttcgccgcagggcgcaaatcactggccctgaatctaataaccgagatgggccgactgcccaccttcatgacccagaagacgagagacgcgctggacaacctcgccgtcctgcacactgcggaggcgggcgggcgagcctacaaccatgccctgtccgagcttcccgagaccctggaaaccctcctcctcctgacgctcctggccacagtgacaggcgggatcttcctttttttgatgtccggccgggggatcgggaaaatgaccctaggcatgtgctgcatcataacagcctctatcctactctggtacgctcaaatccaaccgcactggatagccgccagcattatcctggagttcttcctgatcttccttcttatcccggagcctgagaaacagagaacgccgcaagataatcagctgacctacgtcgtaatcgccatcttaaccgtcgtcgcggcgacaatggccaacgagatgggcttcctggagaagacaaagaaggatttgggattcgggtccatcgccacgcagcagccggagagcaacatcctcgacattgatctacggccggcctccgcgtggactttgtacgccgtcgccaccacgttcgtcacccccatgctccgccacagcatcgaaaactctagcgtgaacgtctcactgaccgccatcgccaatcaggcaactgttctgatgggcctcgggaagggttggcccctgtccaagatggacatcggcgtgccgctgctcgcgatcgggtgttacagccaggtaaaccctatcacgctgactgcagccctcctcctactggtagcacactacgctatcataggtcccggcttacaagctaaggcgacccgcgaagcccagaagagggcggccgccggcatcatgaagaaccccaccgtggacggcatcacggtaatcgaccttgaccccatcccctatgatcccaaattcgaaaagcagctgggtcaggtcatgttgctagtgctgtgcgtgacccaagtgctcatgatgcggaccacatgggcattatgcgaggccttgacactggcgaccggccccatatccaccctgtgggaggggaacccgggccgcttctggaataccacgattgccgtttctatggccaacatcttccgggggtcctatctggccggcgccggcctcctgttttcaatcatgaagaacaccactaacactcgacgcgggacgggcaacattggggaaacattaggcgagaagtggaaatcccggctaaacgcgctgggcaagagcgagttccagatctacaagaagagtgggatccaagaagtcgaccgcaccctcgccaaggagggcataaaacgcggggagaccgatcaccatgctgtgagccgcggttccgccaaattacgatggtttgtggagcgcaatatggtcacccccgaggggaaggtggtggacctgggctgtggaaggggcgggtggagttactattgcggcgggctgaagaacgtaagagaagtgaagggattaaccaagggaggacccggtcacgaggagcccatccccatgtctacctatggctggaatctggtaagacttcagtcgggggtcgacgtgttcttcatcccgccggagaagtgtgacacccttttatgcgacattggcgagtccagccccaacccgaccgtagaggcgggcagaacactgagggtcttaaacctggtggagaattggctgaacaacaacacgcagttctgcatcaaagttctcaacccctacatgccctcggtcatcgagaagatggaggccctacaacgccggtacggcggcgcgctggtgagaaacccgcttagccggaacagcacacatgagatgtactgggtgagcaacgcctccgggaatatcgtctcgagcgtcaacatgatctcgcgcatgctcattaaccggtttactatgaaacacaaaaaagccacgtacgagccggacgtggacctgggctctgggaccaggaacatcggtatcgagtcggaagtgccgaacctggacatcatcggtaagcggatcgaaaagataaagcaggagcacgagaccagctggcattacgaccaggaccacccctacaagacttgggcttatcacggcagctacgagaccaagcagactggaagcgcatctagcatggtgaacggtgtagttaggttactgaccaagccttgggacgtgctgcccaccgttactcagatggccatgacagacaccaccccattcggccagcagcgcgtcttcaaggagaaggtggacacgcggacccaggagcccaaggaagggaccaagaagctcatgaaaatcactgccgagtggctgtggaaggaactgggaaaaaagaagacaccgcgcatgtgcaccagggaagagttcacccgcaaggtgcggtccaatgcggcgctcggcgccatcttcaccgacgagaacaagtggaagtccgcccgcgaagctgtcgaggactctcggttctgggagttggttgacaaggagcgcaatctgcacctcgaggggaagtgcgagacttgcgtctacaacatgatgggcaagcgggaaaagaagctgggggagttcggtaaggcaaagggcagtcgcgctatctggtacatgtggctgggggctcggttcctagagtttgaggccctgggcttcctgaacgaggaccactggttctcccgcgagaatagcctctctggggtagagggggaggggttacataagctgggctacattttgcgggacgtaagcaaaaaggagggcggcgccatgtacgcggacgacaccgccggctgggatacccgcatcaccctcgaggacctaaagaacgaggaaatggtaacgaaccatatggaaggggagcataagaagctcgccgaggccatatttaagctgacttaccagaacaaggtggtgcgggtccagaggcccacgccccgaggcactgtcatggatatcatcagccgccgggaccaacgcgggtcaggccaggtgggaacgtacgggttgaacacgttcacaaacatggaagcgcagctcatacggcaaatggagggcgagggggtcttcaagaacatccagcacttgaccgctacggaggaaattgccgtgcagaactggctggcccgcgtaggtcgagagcggctctcacgcatggccatctccggggatgactgcgtagtgaaaccccttgacgaccggttcgccagcgcgctaaccgccctcaacgacatgggcaagatccgaaaggacatccagcagtgggagccgtcccgggggtggaatgattggacccaggtaccgttctgcagccaccactttcacgagctgatcatgaaagacgggcgcgtcctggtggtaccatgtagaaatcaggacgagttaatcggccgggcgcggatctctcagggggcgggttggagcctgcgcgaaacggcctgcttagggaagtcctatgcgcagatgtggagcctcatgtacttccaccggcgcgacctgaggctggccgccaacgccatctgttccgccgtcccctcacactgggtgccgacgagtaggaccacatggagcatccacgctaaacacgaatggatgaccaccgaggacatgctaacggtgtggaacagagtctggatccaggagaacccgtggatggaggacaagacccccgtggaatcctgggaagaaatcccctatctgggcaagagagaggaccagtggtgcggcagcctgatcggactcacttcccgggccacatgggccaagaacatccaggccgctatcaaccaggttcgaagccttatcggcaacgaggaatacacggattacatgcctagcatgaagcggttccggagggaggaagaggaggcaggcgttctgtggtga

SEQ ID NO: 25612 - RNA, 9876 nt, synthetic construct
  misc_feature 1..9876: note = derived and/or modified CDS sequence (opt11) from DENV-2__AF169685__SS-prME
  source 1..9876: mol_type = other RNA
agcgccggaatgataatcatgctgattcccacggttatggccttccacctcaccacccgcaacggggagccccacatgatagtcagcatccaggagaagggcaagtctctactgttcaagactgaggacggggtgaacatgtgcactctcatggccatggatctgggagagctgtgcgaggacacgatcacctacaagtgccccctcttacggcagaacgagccggaggatatcgactgctggtgcaacagtacctccacctgggtaacatacgggacatgcaccacaaccggcgaacacaggcgagaaaagcgctccgtcgccctggtgccccatgtgggcatggggctcgaaacgcggaccgagacttggatgagctccgaaggtgcctggaagcatgcccagcgcatcgagacctggatcctgcggcacccgggtttcacgatcatggccgctatcttggcctacacgataggcaccacccactttcagcgcgctctcatcttcatcctgctgacagctgtggcgcctagcatgactatgcgctgcatcgggatctccaaccgcgacttcgtggagggagtgagcggagggtcctgggtggacatcgtgctcgagcacggcagctgcgttaccaccatggcgaaaaacaagcccacgctcgacttcgagctgatcaagacggaggcgaagcaacccgccaccctccggaagtactgcatcgaggccaagctgaccaatacgaccaccgagtcccgctgcccgacccagggggaaccctctctgaaggaggagcaggacaaacggttcgtctgcaagcactccatggtggaccgcggctgggggaacgggtgtggcctcttcggaaagggcgggatcgtgacctgcgcgatgttcacgtgcaagaagaacatggaaggaaagatcgtccagccggagaacctggagtacaccatcgtggttactccccacagcggagaggagcacgccgtcgggaacgacacgggcaagcacgggaaggagatcaaagtgacaccgcagtctagcatcaccgaggcagagctgaccggctacgggactgtgacgatggagtgctccccccggaccggcctggacttcaacgagatggtcctgctgcagatggagaacaaggcctggctcgtacaccgccagtggttcttggacttacccctcccctggctgccaggcgccgatactcaggggagcaactggatccagaaggagaccctggtgacgtttaagaacccccacgcaaagaaacaggacgtagtggtgctaggctctcaggagggggccatgcacacggccctgaccggcgccaccgagatacaaatgtcctctgggaacttactatttacgggccacctgaagtgccggctgaggatggataagctccagctgaagggcatgtcctacagcatgtgcaccggtaagtttaaggtggtgaaggagatcgccgagacccagcacggcaccattgtgatccgggtacagtacgagggggacggctccccctgccgcatccccttcgagataatggacctggaaaagcggtacgttctcggccgcctgatcaccgtcaaccccatcgttaccgaaaaggactctcccgtgaacatcgaggcggagccgcccttcggggactcctatatcattatcggcgtcgagcccgggcaactgaagctcaactggttcaagaagggcagctccatcgggcaaatgttcgagacgaccatgcgcggcgccaagaggatggccatccttggcgacacggcctgggacttcgggagcctgggcggggtgtttacctccatcgggaaggccttgcaccaggtgttcggggcgatctacggcgccgcgttctcaggcgtctcatggaccatgaagatcctgataggagtgatcatcacctggatcggcatgaacagccgctccacgagcctgtcagtcagccttgtcctcgttgggatcgtgaccctgtacctgggcgtcatggtgcaggccgactccggttgcgtggtcagctggaagaacaaggagctcaagtgcggctctggcatctttatcaccgacaacgtgcatacctggacggagcagtataagttccagcccgagtccccaagcaaactcgcgagtgccattcagaaggcccaggaggaggggatttgtggcatccggtccgtgacccgcctggagaacctcatgtggaagcagatcactcccgagctgaatcacatactcgccgaaaatgaagtcaaactcacaatcatgacgggggacatcaagggtatcatgcaggccggaaagcggagtctgcgcccgcagcccaccgagctgaagtacagctggaagacctggggcaaggcgaagatgctctccaccgagagccacaaccagacgtttctgatcgacggccccgagaccgccgagtgcccgaacaccaaccgggcctggaactcactggaggtggaggactacgggttcggggtgttcaccacgaacatctggctcaaacttaaggaaaaacaggatgcgttctgcgactcaaagctcatgagcgctgccatcaaggacaaccgcgccgtccacgccgacatggggtactggatcgagagcgccctgaatgatacctggaagatcgagaaggcctccttcattgaggtgaagaactgccactggcccaagagccatacattatggtccaacggcgtgctggagagcgagatgatcatcccgaagaacctcgcgggccccgtctcccagcacaattaccggccggggtaccacacccagatcgccggcccctggcatctggggaagctggaaatggacttcgacttctgcgacggtaccaccgtggttgtcaccgaggactgcgggaaccgcggcccctcgctacggacgaccaccgcctcaggcaagctgatcaccgagtggtgctgccgctcgtgtaccctgcccccgctccggtatcgcggggaggacggttgctggtacggaatggagatccgccccctgaaggagaaggaggagaacctggtgaacagcctggtaaccgcaggccacgggcaggtcgacaacttcagtctgggcgtgctaggcatggccctattccttgaggagatgcttcgcacacgggtcgggacgaagcacgccatcctcctggtcgccgtgagcttcgttaccctgattacaggcaacatgtcctttaaagacctcgggcgcgtagtggttatggttggcgcaacaatgaccgacgacatcggaatgggcgttacctacctagccctgttggcagccttcaaggtgcggcccaccttcgcagccggcctgctgctccgcaagctgacgagcaaggaactgatgatgaccaccatcgggatcgtcctcctgtcccagtccaccatcccagagacgatcctggagctcacagacgccctggcgctaggcatgatggtgctcaagatcgtgagaaacatggagaagtaccagctggccgtaaccatcatggccatcctgtgcgtgccgaatgcagtcatcttgcagaacgcctggaaggtgtcctgtacaatcctggcggtggtctccgtcagccccctaatcctcacatcctcccagcagaagaccgactggattccgctggccctgaccatcaaaggcctcaaccccacggccatcttcctgacgaccctgagccgcaccaacaagaaacgctcctggccgctaaacgaagccatcatggcggtgggcatggttagcatcctggcctcctccctgctaaagaacgacatacccatgaccggtcctctggtggccgggggcctgctcacggtgtgctacgtcttaactggccggtccgccgacctcgagctcgagcgcgccaccgacgttaaatgggaggaccaagccgagatctcaggctcatccccaatcctcagcatcaccatctccgaagacgggagcatgtccatcaagaacgaagaggaggagcagacgctgaccatcctcatccggaccgggcttctggtgatcagcggcctcttcccggtttccatccccattacggccgccgcctggtacctgtgggaggtgaaaaaacagcgcgcgggggtactgtgggacgtcccttccccgccgcctatgggcaaggcggagttggaggacggggcttaccggatcaagcagaagggcatattagggtactcccagatcggcgcaggcgtatacaaggaggggaccttccacacgatgtggcacgtgacccgcggcgccgtcctgatgcataagggcaagcggatcgaacccagctgggccgacgtgaagaaggacctcatctcctacggcggtggctggaagctggaaggagagtggaaggagggggaggaggtgcaggtacttgcgctcgagcccggcaagaacccgcgggccgttcaaaccaaacccgggcttttcaagaccaacacgggcaccatcggggccgtcagcctggacttctcccccgggaccagcggctccccgattatcgacaagaaggggaaggtcgtgggtctctacgggaacggcgtggtcacccgttctggcgcgtacgtgtccgccatcgcgcagacggaaaagtccatagaggataaccccgaaatagaggacgatatcttccgcaagcggcgcctgactatcatggatctgcaccccggggccggcaagactaagcggtacctgccggccatcgtgcgtgaagccatcaagcggggactccggaccctgatcctggctccgacccgggtcgtcgccgctgagatggaggaggccctccgcggcttgccaatccggtaccagacccccgcgatccgtgcggaacatacggggcgcgagatcgtggacctgatgtgccatgccaccttcacgatgcgcctgctgtcccccgtccgcgtgccgaactacaacctgatcatcatggacgaggcccacttcacggatcccgcctcaattgccgctagaggctacatctctacccgagtggagatgggcgaagccgccgggattttcatgaccgccacccctcccggctcccgggacccgtttccccagagcaacgcccccatcatcgacgaggagagagagatccctgagcggtcatggaacagcgggcacgagtgggtcaccgacttcaagggcaagaccgtttggttcgtgccgtccatcaaggcgggaaacgatatcgccgcctgtctccgcaagaacggcaagaaggtcatccagctgagccggaagaccttcgactccgagtacgtgaagactcgcactaacgactgggacttcgtggtcaccaccgacatcagcgaaatgggcgccaacttcaaggcggagcgggttatcgacccccgccggtgcatgaagcccgtgatcctcacggacggagaggagcgcgttatactcgccggcccaatgccggtgacccacttctccgcggcccagcggcgcgggcggatcggtcgcaaccccaagaacgagaatgaccagtacatctacatgggagagcccctcgagaacgacgaggactgcgcccactggaaggaggcgaagatgcttctcgacaatatcaatacccccgagggcatcatccccagcatgtttgagcccgagcgagaaaaggtggacgccatcgacggcgagtaccgcctgcgcggcgaggcccggaagaccttcgtcgacctgatgcgccgcggcgacctgccggtgtggctggcctacaaggtggccgcagaggggatcaactacgcggaccgacggtggtgctttgacggcatcaagaacaaccaaatcctggaggagaacgtcgaagttgagatctggacgaaggagggagagcgcaagaagctcaagccgcggtggctcgacgcccgcatctacagcgaccccttggccctcaaggagttcaaggagttcgccgcgggccgaaagagcctggccctaaacctaatcactgagatgggccgcctgccaaccttcatgacccaaaagaccagggacgccctggacaacctcgccgtcctgcacacagcggaggccggtggccgcgcgtacaatcacgcattgtccgagctccccgagaccctggagaccctgctcctattaacgctcctggccaccgtgaccgggggcatcttcctgttcctcatgagcggccggggaatcggtaagatgactctggggatgtgctgtatcatcaccgcgtccatcctgctatggtacgcccaaatccagccgcactggatcgccgcttccataatcctggtgttcttccttatcgtcctcctgattcccgagcccgagaagcagcgcacgccccaggacaaccagctgacctacgtggtgatcgccattttgaccgtcgttgccgccaccatggccaacgagatgggattcctggagaagacgaagaaggacctggggttcggcagcatcgccacccagcagccggagagcaacatcttggacatcgacctgcggccggcctccgcttggaccctgtacgccgtggccacaacgttcgtaacgcccatgctccgccacagcatcgagaactcctccgttaacgtgtccctgacagctatcgcgaaccaggcgaccgtcctgatggggctaggaaagggctggcccctgtccaagatggacatcggtgtgccgctgttggcaatcggctgctacagccaggtgaaccccatcacgttaacggcagccctcctcctgctcgtcgcgcactacgccatcattgggcctggcctgcaggccaaggccacccgggaggctcaaaagcgcgcagcggctggcatcatgaagaaccctaccgtggatgggatcacggtgatcgatttagacccgatcccctacgaccccaagttcgagaagcagctgggacaggttatgctcctggtgctgtgcgtgactcaggtgctcatgatgcggacaacttgggctttgtgcgaggccctgacgctcgcgaccgggcccatctccaccctgtgggagggcaatccgggaaggttctggaacacgactatagccgttagcatggccaacatcttccgcggctcctacctggcgggtgccgggctcctatttagcatcatgaagaacacaaccaacacccgaagaggcacggggaacataggcgagactttaggagaaaagtggaagtcccggctcaacgcgctgggcaagagcgagttccagatctacaagaagagtggcatccaggaagttgatcgcaccttagccaaggaggggatcaagcggggtgaaaccgaccaccacgcagtgtcacgggggtccgccaaactccggtggtttgtggagcgcaacatggtgacgcccgaaggaaaggtagtggacttaggctgcgggcgtggcggatggagctactactgcggcgggcttaagaacgttcgcgaggtcaagggcctcaccaagggcgggccaggtcatgaggagcccataccgatgtccacctatgggtggaacctggtgcggctgcagagcggcgtggacgttttcttcatcccgcccgagaagtgcgacacgctactgtgcgacattggggagtccagcccgaaccctacggtggaggcgggccgcaccctgcgggtgctcaacctggtagagaactggcttaacaacaacacccagttctgcataaaggttctaaacccctacatgccgtccgtgatcgagaagatggaggccctgcagcggcggtacggcggggccctggtaaggaacccgctgagccggaacagcacacacgagatgtactgggtatccaacgccagcggcaatattgtatcaagtgtaaatatgatctcccgcatgttgatcaaccggttcaccatgcggcacaaaaaggccacgtatgagcccgacgttgatctggggagcggcacccgaaacatcggaatcgagtccgaggtgcccaatctggacatcatcggcaaacgcatcgagaagattaagcaagagcacgagaccagctggcactatgaccaggatcatccctataagacctgggcttaccatggctcctacgagacgaagcagaccgggtcggcctccagcatggtcaatggcgtggtgcgcctactgaccaagccgtgggacgtcctgcccaccgtgacgcagatggccatgacagacaccaccccctttggtcagcagcgggtatttaaagagaaggtagacacgcgcacccaggagcccaaggagggcaccaagaagctcatgaagatcaccgccgagtggctttggaaggagctgggcaagaagaaaactcctcggatgtgcacgcgcgaggagtttacccggaaggttcgctccaacgccgcgttaggggcaatcttcaccgacgagaacaagtggaagtccgcccgggaggcagttgaagactcccgcttctgggagcttgttgacaaagagcgaaatctgcatctcgagggcaaatgcgagacgtgcgtgtacaacatgatgggaaagcgcgagaagaagctgggcgagttcggtaaggccaagggcagccgggcaatctggtacatgtggctgggcgcgcgcttcctcgagttcgaggccctgggcttcctgaacgaggaccactggttctcccgggagaacagcctcagcggcgtagagggggagggcctgcacaaactgggatatattctccgcgacgtgtccaagaaagaaggcggcgcgatgtatgcggacgacacggccgggtgggacacccggatcaccctggaggacctcaagaacgaagagatggtcacgaatcacatggagggcgagcacaaaaagctcgccgaggccatcttcaagctgacctaccagaacaaggtcgtgcgcgtgcaacggcccaccccccgggggaccgtcatggatatcattagccggcgcgaccagcgggggtccggccaagtgggcacgtacgggctgaacaccttcaccaacatggaggcccaactaatccgccaaatggagggggagggggtattcaaaaacatccagcacctgaccgccacggaggaaatcgccgtccagaactggctggctcgcgtggggcgggagcgcctctcacgcatggccatctctggcgacgactgtgtggttaagcccctggacgaccgcttcgccagcgcactcaccgccctaaacgacatgggcaagatacggaaggacattcagcagtgggagccatcccgcgggtggaacgactggacacaggtacctttttgcagccaccacttccacgagttgatcatgaaagacggccgggtcctggtcgtgccctgtcgcaaccaggacgagctcatagggcgggcccgcatctcccagggtgccgggtggagcctgcgtgaaaccgcctgcttaggtaagtcctacgcgcaaatgtggagcctcatgtatttccacaggcgggacctgcgtctggccgccaacgctatctgctccgccgtgcccagccactgggtaccgacgtcccggaccacctggagcatccacgctaagcacgagtggatgaccaccgaggatatgttgacggtgtggaatcgtgtgtggatccaggaaaacccctggatggaggataagactcccgtcgagtcctgggaggagattccctacctgggaaagcgggaagaccaatggtgcggcagcctgatcggtctcacttcgcgcgccacatgggcaaagaacattcaggccgcgatcaaccaggttcggagtctgatcgggaatgaggagtacacggactacatgccgtcaatgaagaggttccggcgggaggaggaagaggccggcgtgctgtggtga

SEQ ID NO: 25613 - RNA, 9876 nt, synthetic construct
  misc_feature 1..9876: note = derived and/or modified CDS sequence (opt11) from DENV-2__AF169686__SS-prME
  source 1..9876: mol_type = other RNA
agcgccgggatgatcatcatgctgatcccaaccgtgatggctttccacctcaccacacgcaacggggaaccccacatgatcgtcagcatacaagaaaagggtaagtccctcctgtttaagaccgaggacggggtgaacatgtgtaccctcatggcgatggatctgggggaactgtgcgaagacacaattacctataagtgccccttgttgcggcagaatgaacccgaggacatcgactgctggtgcaactccaccagcacctgggtgacttacgggacgtgcaccaccacgggcgaacaccgccgggagaaaagatccgtggccctggttccgcacgtgggcatggggttggagacccggacagagacctggatgagctccgagggcgcctggaagcacgcccagcgcatcgagacgtggatcctccggcaccccgggttcacgatcatggccgcaattctggcctacaccatcggcaccacccacttccaacgcgccctcatcttcatcttgctgacagccgtcgcgcccagcatgaccatgcggtgcatcgggatctccaaccgagacttcgtagaaggcgtgagcggtggctcgtgggtcgacatcgtattggaacacgggagctgcgtcaccaccatggccaagaataagcccactttggacttcgaactgatcaaaaccgaggccaagcagcccgccactttgcggaagtattgcatcgaggccaagctgaccaacacgacaaccgagtcccgctgcccaacccagggggagcccagcctgaaggaggaacaagataagcggttcgtctgcaagcactcaatggtggaccgcggctggggcaacgggtgcggcctattcggtaagggcgggatcgtgacttgcgcgatgttcacgtgcaagaagaacatggaggggaagatagtccagcccgagaacctggagtacacaatagtggtgacgccccactccggcgaggaacacgccgtcgggaacgacacgggcaaacacgggaaggagatcaaggtgaccccgcagtcttcaatcaccgaggccgagctgaccggctacgggaccgtgactatggagtgctctccacggacaggcctcgacttcaacgagatggtcctgcttcagatggaaaacaaagcctggctcgttcatcgccagtggttcctggacctgcccctaccctggctgcctggcgctgacacccaagggagcaactggatacagaaggagacgctggtcacgttcaagaatccgcacgcgaagaagcaggacgtcgtggttttgggcagccaggaaggggccatgcatacggccttgacgggcgccaccgaaatccagatgtcctccgggaacctcctgttcacaggacacttgaagtgccgcctgcgcatggataaacttcaactgaagggcatgagctacagcatgtgcaccggtaagttcaaggtggtcaaggagattgcagagacgcagcacggcaccatcgttatccgggtgcaatacgagggggacggttctccgtgccgcatcccttttgagatcatggacctggagaagcgatacgtgctcggccgcctgataacggtcaacccgatcgtgacggagaaggatagccccgtcaacatcgaggcggagccgccctttggggactcctacatcatcataggcgtggaaccggggcagctgaaactcaattggttcaaaaagggcagctccatcggccagatgtttgagaccaccatgaggggcgccaagcgtatggccatcttaggcgacacggcctgggatttcgggagcctcggcggggtgttcacatcaatcgggaaggccctccaccaggtgtttggggcgatctacggcgccgcctttagcggggtctcctggacgatgaagattttcatcggggtgatcatcacgtggataggcatgaacagccgaagtacgagcctgtccgtgagcctggtccttgtggggatcgtgactctctacctgggcgtcatggtgcaggccgactccgggtgcgtggtcagctggaagaacaaggagctgaaatgtggcagcggaatctttatcaccgacaacgtgcacacatggacggagcagtacaagttccagcccgagtcccccagcaaacttgcgtccgctattcaaaaggcgcaagaggaggggatctgcggcatccggagcgtgacccgtctggagaatctgatgtggaaacagatcacgcccgagttaaaccacatcctggccgagaacgaggtcaagctcaccattatgacgggggacatcaagggcattatgcaggccgggaaacgaagcctcaggccacagccaaccgagctgaagtacagctggaaaacctggggcaaggcgaagatgctgtccaccgagagccataaccagactttcctaatcgacggccccgagacggcggagtgcccgaacaccaaccgggcctggaacagtctggaggtggaggactacgggtttggcgtgttcaccacaaatatctggcttaagctcaaggagaagcaggacgccttctgcgatagcaagctgatgtccgccgcgatcaaggacaaccgcgccgtacatgcggacatggggtattggatagagtcagccctgaatgacacctggaagatcgagaaggcctccttcatcgaggtgaagaactgccactggcccaaaagccacacactctggtccaatggggtcctggagagcgaaatgattatccccaagaacctggccggcccggtgtcccagcataactaccgcccggggtatcacacccagatcgcgggcccttggcacctcgggaaacttgagatggacttcgacttctgcgacggaactacggtggtggtgacggaggactgtgggaaccggggcccctcactacgaacaactacggccagcggcaagctcattacggaatggtgttgccgctcctgcaccctgccaccgctgcgataccgcggggaggacggctgctggtacgggatggagatccggccgttaaaggagaaggaagaaaacctggtgaacagtctcgtgaccgccgggcacgggcaggtcgacaatttcagcctcggagtgctgggcatggcgctgttcctcgaggagatgctgcggacacgggtggggacgaagcatgccatactgctcgtcgccgtgagcttcgtgaccctgatcaccggcaacatgagttttaaggatctgggtcgcgtcgtcgttatggtcggggctacaatgaccgacgacatagggatgggagttacctacctcgcgttacttgcggccttcaaggttcgacctaccttcgccgccggcttactgttacgcaagctcaccagcaaggagctgatgatgaccacaatcggaatcgtcctgctcagccagtccaccatccccgagaccattctagaactgaccgacgccctcgcgctcggtatgatggtgctgaagatagtaaggaacatggagaagtaccagctcgctgtcaccatcatggcaatactatgtgtaccaaacgcagtcatcctgcagaatgcctggaaggtttcctgcacgatattggcggtggtcagcgtgtctcccctgatcctgacaagctcccagcagaagaccgactggatccctctcgccctgactataaaagggcttaacccaaccgccatcttcctcacgaccttgagccgtaccaacaagaaacgctcctggcctgtgaacgaggccataatggcagtcgggatggtgagcatccttgctagttcgctcctgaagaacgacatccccatgaccggccccctggtggccggagggctcctgactgtatgctatgtgctgactgggcggtccgccgatttggagctggagcgcgccaccgacgtaaagtgggaggaccaggccgagatctcaggtagttcccccatcctgtccatcacaatctccgaggacggctccatgagcatcaagaacgaggaggaggagcagactttaaccatccttatccggaccggcttgctggtcatcagcggtctgttccctgtgtccatccctattacggccgccgcctggtacctttgggaggtgaagaagcagcgcgccggtgtactttgggacgtgccctccccgccgcctatgggcaaggcggaactggaagacggagcctaccggatcaagcagaagggcatcctggggtacagccagatcggggccggcgtgtacaaggaggggaccttccacacgatgtggcatgtcacccgcggtgccgtactcatgcacaagggtaagcgtatcgagccgagctgggccgacgtgaagaaggacctgatctcctacggcgggggatggaagctggagggagagtggaaggagggggaggaggtccaggtgctcgcgctggagcccggcaagaaccccagagccgtccagaccaagcccgggttatttaagaccaacacgggcaccataggggctgtgtccctcgacttctcccctggcaccagcggctcccccataatcgacaagaaggggaaagtggtgggcttatatggcaacggcgtcgtgaccagatccggcgcctacgtgtccgcaatagcgcagacggagaaatccatcgaggacaaccccgagattgaggatgacatcttccgcaagcggcgcttgaccatcatggaccttcaccctggggccggcaagaccaagaagtacttacctgccatcgtccgtgaggcaatcaagcgcgggttacggaccctgatccttgcgccaacacgtgttgtggccgccgagatggaggaggccctgcgcggcttacctatacgataccagacgcctgccatccgggcggagcataccgggagggagatcgtcgacctcatgtgccacgcgaccttcacgatgcgcctgttgtcacccgtgcgggtgccgaattacaacctcatcatcatggacgaggcgcatttcaccgacccagctagtatcgcagcgcgcggctacatctccacccgggtcgagatgggcgaggcagccggaatcttcatgaccgccacgccacccggcagcagggacccgttcccccaaagcaacgctcctattatcgatgaggagcgcgaaatccccgagcgatcctggaacagcgggcacgagtgggtgaccgacttcaaaggcaagaccgtgtggtttgtcccgtccatcaaggcggggaacgacatcgccgcgtgtcttcgtaagaacggcaagaaggtcatccagctgagccgcaagacctttgactccgagtacgtgaagacgagaaccaacgactgggacttcgtcgtgaccaccgacatcagtgagatgggagccaacttcaaggcggagcgagtgatcgacccccgtcgctgcatgaagcccgtcatcctcacggacggcgaggagcgagtgatcctggccggccccatgccggtaacgcacttctcagctgctcagagacgtgggcgcatcggccggaaccccaagaatgaaaacgaccagtacatctacatgggggaaccgctcgagaacgacgaagactgcgcccattggaaagaagcgaagatgctgctagacaacataaacacccccgagggaatcatcccttcaatgttcgagcccgagcgcgagaaggtcgacgcaatcgacggagagtaccgactgcgaggggaagcccgtaagacattcgtagacctgatgcggaggggtgaccttcccgtgtggctggcctataaggtcgctgcggagggcatcaactacgccgaccggcgctggtgtttcgacgggatcaagaacaaccagatactcgaggagaacgtggaggtagagatctggacgaaggagggggagcggaagaaacttaaaccgcgttggctggacgcccggatctactccgaccccctcgccctgaaggagttcaaggagttcgccgccggacgtaagagcctggccctaaacctcatcacagagatgggccggctgcccaccttcatgacccaaaagacgcgcgacgcactcgacaacctggccgttctgcacaccgcggaagccgggggccgggcatacaaccacgctctctcggagctgcctgagaccttggagaccctcctactgttgaccttactggccaccgtgacaggaggcatcttcctcttcctgatgagcggcaggggaatcggaaagatgactttagggatgtgctgcatcatcaccgcgtccatcctcctgtggtacgcacagattcagccgcactggatcgcagcaagcatcatcctggtcttcttcttaatcgtgctgctaatcccagagcccgagaaacagcggacgccccaggacaaccagctcacatacgtggtaatcgccatcctgaccgtggtggcggccaccatggccaacgaaatgggcttcctcgagaagacgaagaaggacctcgggttcgggagtatcgccacccaacagcctgagagtaacatcctggacatcgacctgcgacccgcgtccgcgtggaccctgtacgccgtggcgaccacgttcgtgacccccatgttgcggcacagtatcgagaactcctcggtcaacgtgagccttactgccatcgccaaccaggcgacagttttgatgggtcttgggaaaggctggcccctgtccaagatggacataggggtacctctgttagccattggctgctatagccaggtcaacccaatcacgctcaccgccgccctgctcctgctagtggcgcactacgccatcatcggccccggcctgcaggccaaggcaacgcgggaggcccaaaagcgggctgccgccggcataatgaagaacccgactgtcgatggtataacggtgatcgacctagacccgataccttacgacccgaagtttgagaaacaactcggccaggttatgctgctggtcctatgcgtcacccaggtgctgatgatgcgcaccacctgggccctatgcgaggccttaacgttggcgacagggcccatctccaccctgtgggaaggtaaccccgggcggttctggaacacaacgatagccgtgagcatggccaacattttccgtggctcctacttagcgggcgcggggctactgttttcgataatgaaaaacaccacaaatacccggcgtggaacggggaacattggcgagaccctaggcgaaaagtggaagtcccgactgaacgcgttgggaaagagcgagttccaaatatacaaaaagtccggcatccaagaggtcgataggaccctagccaaggagggtatcaagagaggcgagacggaccaccacgccgtgagccggggatccgccaagctgcgctggtttgtcgaacggaacatggtcacgcctgaaggcaaggtagttgacttgggctgcgggcgagggggctggagctactattgcggcgggctcaagaacgtccgggaagttaaaggccttactaagggcggtcctggccacgaggagcccatcccgatgtccacttacgggtggaacctggtgcgcctacagtcaggcgtcgacgtgttctttacaccgcccgagaagtgcgacacgctgctttgcgacatcggtgagtcaagcccgaacccgacggtagaggcgggccgaaccctcagggtgcttaacctggtcgagaattggttaaacaacaatacccagttctgcattaaggtgctgaacccctatatgccgtcggttatagagaagatggaggctctccagcggcgctacggcggggccttagtgcgtaacccgctgagccgcaatagcactcacgagatgtattgggtgtccaacgccagcggcaacattgtctccagcgtgaacatgatctcacggatgctgataaaccgcttcacgatgaagcacaagaaggctacctacgagcccgacgtcgacctggggagcggcacacggaatatcgggattgagtccgaagttccaaacctcgacatcatcggcaagcgcatcgagaagatcaaacaggagcacgagaccagctggcactacgaccaggaccatccctacaagacttgggcgtaccacggcagctatgagactaaacagaccgggagcgcctccagcatggtgaatggcgtggtgcgtctactgacaaagccctgggacgtgctccccacggtgactcagatggccatgaccgacactacgcccttcgggcaacagcgggtcttcaaggagaaggtggacacccgcacacaagagcccaaggagggcaccaaaaagctaatgaagatcacggccgagtggttgtggaaggagctcggcaagaaaaagaccccgcggatgtgcacacgcgaggagttcacccgtaaagtccgaagcaacgccgcgctgggggctatcttcacggatgagaacaagtggaagtccgctcgggaagccgtggaggactctcgcttctgggagctggtcgacaaggagcggaatctccacctggaaggcaagtgcgagacctgcgtctacaacatgatggggaagcgcgagaaaaagctgggcgagttcgggaaggcaaagggcagccgagcgatctggtatatgtggcttggcgcacgtttcttagagttcgaaaccttagggttcctgaacgaggatcactggttctcccgggagaacagcctgtccggtgttgaaggcgagggcttacacaagctcgggtacatcctgcgcgacgtgagcaagaaggagggcggcgcgatgtatgccgacgacaccgcgggatgggatacacggatcaccttagaggacttgaaaaacgaggagatggtcaccaaccatatggaaggtgagcataaaaagctggccgaggccatcttcaagctaacctaccaaaataaggtggttcgcgtccagcggccgactccccgcgggactgtgatggatatcatcagccgccgggaccagcggggctccggtcaggtgggcacatatggcctcaacaccttcacgaacatggaagcccaactgatccgacagatggagggggagggcgtctttaagaacatccagcacctgaccgcgaccgaggagatagcggtgcagaactggctcgcccgcgttgggcgagagcgcctgagcaggatggccatctccggcgacgactgcgtggtgaaacccctggacgaccggttcgcgagcgccctaaccgcgttaaacgacatgggcaagatccggaaggacatccagcaatgggagccgtcccgcgggtggaacgactggacgcaagtaccattctgcagccaccactttcacgaactgatcatgaaggacggccgagtcctcgtcgtgccctgtcgaaaccaggatgagctgatcgggcgggcccgcatcagtcagggcgccgggtggagcttacgggagaccgcctgtttaggcaagtcctatgcccaaatgtggagcctgatgtacttccatcgccgcgacctacgcctcgcggccaacgccatctgctccgctgtgccaagccactgggtgccgacttcacggaccacctggagcatccacgccaaacatgaatggatgactaccgaggacatgctggcagtgtggaaccgcgtctggattcaagagaacccctggatggaggataaaacccccgtggagtcctgggaggagatcccctacttaggtaagcgggaggaccagtggtgcggaagcctaatcggcctgacctcccgggccacgtgggcaaagaacattcaggccgctatcaaccaggtgcggagcctgatcgggaacgaggaatacactgactatatgccgtctatgaagcggttccggcgagaggaggaggaggccggtgttctgtggtga

SEQ ID NO: 25614 - RNA, 9876 nt, synthetic construct
  misc_feature 1..9876: note = derived and/or modified CDS sequence (opt11) from DENV-2__AF169687__SS-prME
  source 1..9876: mol_type = other RNA
tctgcaggaatgattataatgctgataccaacagtgatggcattccacttaaccacgcgaaatggcgaaccacacatgatagtttccatccaagaaaaaggcaaatccctgcttttcaaaaccgaagacggtgtgaatatgtgtacgctcatggcaatggacttaggcgaactctgcgaagacacaataacgtataaatgccccctacttcgtcaaaatgagccagaggacatcgactgctggtgcaattctacgagtacctgggtgacctacggaacctgcacaacgactggcgagcatcgcagagaaaaacgctccgtagcactcgtaccccacgttgggatgggcttggaaaccagaacagaaacgtggatgtcatcagaaggagcatggaaacacgcacaaagaatagagacatggatactacgacacccgggcttcaccatcatggccgctatactggcctacaccataggtaccactcatttccaacgtgctcttatattcatcctcctgacggcagtagccccttcaatgaccatgcgctgcatagggatctcgaaccgggacttcgtagagggagtaagtggaggcagctgggtagatatagtccttgagcatggctcatgcgtgaccacgatggcgaaaaataaacccacactcgattttgagctgattaaaacagaagcaaaacaaccagccactctgaggaaatattgcatcgaggcaaaacttaccaacaccacaaccgagtcaaggtgtcccacccaaggggaaccgagcctaaaagaggaacaagataagcgatttgtatgcaagcactcaatggtggaccgaggctggggcaacggctgcgggctctttggaaaaggagggatcgtaacctgcgcgatgtttacctgtaaaaagaacatggaagggaagatcgtgcagcccgagaatttagaatatacaatcgttgtaaccccgcacagcggcgaagaacacgcagtaggcaatgacacaggcaagcacggaaaagaaataaaggtaacaccacagtccagcatcaccgaggccgagctgacagggtacggaacggtcacgatggaatgctcaccccggacaggcctagattttaacgagatggtactactccaaatggaaaacaaggcctggctcgtccaccgccagtggtttctggacctaccccttccttggctgccgggggccgacacacagggctccaattggatccaaaaggagacattggtgacattcaaaaacccgcacgccaagaaacaagacgtcgtcgtgctaggcagccaggaaggcgcaatgcatacagcattgaccggcgcgacagaaatacagatgtccagcggaaatctcttattcaccggacatctcaagtgcagactacgaatggacaaactccaactaaagggtatgagctactcaatgtgcacaggaaaattcaaagtagtgaaggaaatcgcagaaacacaacacggcacgatagttatcagggtccaatatgagggcgacggcagcccctgtcgcatacccttcgaaattatggaccttgaaaagaggtacgttctaggccgtctaatcactgttaacccaatcgtaacggagaaggactcgcccgtgaacatagaagcagaacccccgtttggcgactcatacattattattggggtagaaccgggacaactcaagctaaactggtttaagaaagggagttccattggacagatgttcgagacgaccatgagaggcgccaaacgaatggcaatactaggagatacagcatgggacttcgggtccctaggaggagtattcacctcgataggcaaggcactacatcaggttttcggcgccatttacggcgctgccttcagcggggtatcgtggacaatgaagatattgataggtgtcatcatcacgtggatagggatgaacagcagatctaccagcctcagtgtatccttagtcctagtcgggatagtcacgctgtacttgggagtcatggtgcaagccgactcggggtgcgtcgtgagctggaagaacaaagaactgaaatgcggtagcggaattttcataaccgacaacgtacacacctggaccgaacaatacaaatttcagccagaatccccgagcaaactcgcaagcgcaattcaaaaggctcaagaggagggcatttgcggcattaggtcagtgacccgactggaaaatttaatgtggaaacagataaccccggaactcaaccacatcttgagcgagaacgaagtcaagctcaccattatgacaggggacattaaggggattatgcatgcaggtaagaggagtctgagaccacagcccacggaactcaaatactcgtggaagacctggggcatcgcgaaaatgctgagtaccgagagccataatcagacattcctaatagatggaccagagaccgcagagtgccccaacactaacagagcatggaatagcctagaagtagaagactatggattcggcgtattcacaacgaatatctggctaaaacttaaagaaaaacaggatgccttctgcgacagcaaactaatgtctgccgctatcaaagataatagggcggtccacgcggacatgggctactggatcgaatccgcccttaacgacacctggaagatcgaaaaagccagctttatagaagtcaaaaactgccactggcccaagagccacactctctggagcaatggtgtcctcgaatctgaaatgataatcccgaaaaacctagcagggccggtgagtcaacacaactaccgccctggatatcacactcaaatcgccggaccctggcacttggggaagttagaaatggacttcgacttctgcgatggaaccaccgtcgtagtaacagaggactgtggcaaccgaggacccagcttgagaacgacgactgcgagcgggaagttgatcacagaatggtgctgccgcagctgcacactcccgccgctcaggtaccggggagaagacggctgctggtacggaatggaaatacgcccactcaaggaaaaagaggagaacctagtaaattcgctagtcacagccgggcacggacaagtggacaacttcagtttgggcgtattaggaatggccctatttctggaagaaatgctgcgaacccgcgttggaaccaaacacgcgatcctcctcgtagccgtctcgttcgtgaccctaataacgggaaacatgagcttcaaagaccttggacgagtagtggtaacagtcggcgccacaatgacagacgacataggcatgggagtgacttacctggcgctactcgccgcatttaaggtaagacccacgttcgcggcgggactattactccggaagctcactagcaaggaactcatgatgacgacaatcggcatagtgctgctgtcgcaaagcacaatcccggaaacaatactagaactaacggacgccctcgcgttggggatgatggtactcaaaatcgtccgtaacatggaaaagtaccagcttgcggtcactatcatggccattctatgcgtaccaaacgccgtaatccttcagaacgcctggaaagtcagctgcaccatactagcggtagtctcagtaagcccgctgatactcaccagcagtcagcagaaaaccgactggattcccttagcccttacgataaaaggactcaaccccaccgcgatcttcctgaccacgctaagccgaacgaacaagaaaaggagctggccgttgaacgaggcaatcatggcggtcggaatggtttcgatactcgcaagcagcctactgaaaaatgacatcccgatgacaggacccctagttgcgggcggcctccttacagtatgctacgtgctcaccggcagaagcgcagacctagaactcgaacgagccaccgatgtcaaatgggaagaccaagccgaaatctcaggaagctccccgatcctctcaataacaataagtgaagacggctcaatgagtatcaaaaacgaagaagaagaacaaaccttaaccatcttgattcgaaccggactcctcgtgattagtgggctttttccggtaagcatcccaattaccgcagcagcatggtacctatgggaggtcaagaaacagcgagctggagtcctgtgggacgtcccaagcccgcctccaatgggaaaagcagaattagaagacggggcgtatcgaattaaacaaaaaggcattctcgggtactcacaaatcggggcaggagtgtacaaagaaggcacattccacacaatgtggcacgtcacacgaggggcggtgctgatgcacaaaggtaaaaggatcgaacccagctgggccgacgtcaagaaagacctaatcagctatggcggcggatggaagctcgaaggtgaatggaaagagggggaggaagtacaagtcctagcattggagcccggaaagaatccccgcgcagtacaaacaaaaccaggcctatttaagacaaacacaggcacgataggagcagtctccctagacttttcgccaggaaccagcggaagccccatcatcgacaagaaagggaaagtggtaggactgtatggcaacggcgtcgttactagaagtggcgcttacgtgagcgccatagcacagaccgagaaaagtatagaagacaaccctgagatcgaagacgacatctttcgcaaacgcaggctgacaataatggatctgcacccaggcgcaggcaaaacaaaacggtatctcccggcaatcgtacgggaggccatcaagaggggcctcaggactctaatcctagcacccaccagggtagttgcggccgagatggaagaagcgctccgtggacttcctatccggtaccagacaccggccattcgagcagaacacaccggacgcgagatcgttgacttgatgtgccatgcgacgttcacgatgcgtttgctgagtccagtccgggtgccaaactacaacctcataataatggacgaagcacacttcacagaccccgccagtatagcggcacgaggatacatatcaacacgggtcgagatgggagaggcggcgggcatcttcatgacagctaccccacctgggagccgcgacccatttccacaaagcaacgcaccaatcatcgacgaggaacgcgagattccagagcgctcatggaactccggacacgaatgggtcacggacttcaaaggtaaaaccgtatggtttgtaccaagtatcaaagccggaaatgacattgcggcgtgtttgaggaagaacgggaagaaggtcattcaactatcgagaaagacgttcgactctgaatacgttaagacgagaacaaacgattgggactttgtggtcacaactgacatatcggaaatgggcgcgaattttaaagccgaaagagtcatcgacccccgccggtgcatgaaacccgtaatcctaaccgatggagaagaaagagtaatcctcgccggaccaatgccagtcacacactttagtgcagcccagcgccgaggacggataggcaggaatccaaagaatgagaacgatcaatatatatatatgggggagccactagagaatgacgaggactgcgcgcactggaaggaagcgaagatgctgctggacaacatcaacaccccggaaggcataataccctccatgttcgagcctgaaagagagaaggtcgacgctatagacggggaataccggcttaggggtgaggcgagaaagacatttgtagacctgatgcggcgcggggatctgcccgtgtggctcgcctacaaagttgctgctgaaggcataaattacgcagaccgcagatggtgcttcgacggcatcaaaaacaatcagatactggaggaaaatgtagaagtagagatctggaccaaagagggcgaacgcaagaagctgaagccacgatggctcgatgcaaggatatacagtgacccactagctttaaaggaatttaaagagttcgccgcagggaggaagagtctggccctgaacctgataacggagatgggcagactgccgaccttcatgacgcagaaaacccgcgacgctcttgacaaccttgctgttctccacacagcagaagcagggggccgggcatacaaccatgcgctctcagagctgccagaaacgctagaaaccttgctgcttctaacccttctcgcaactgtgacaggagggatcttcctcttcctcatgtccggccgaggaatcgggaaaatgactcttgggatgtgttgcataataacagcctcgatactactatggtacgcccagatccagccccattggatagccgcttccatcatcctagtattctttttaatagtgttactaataccggaaccggagaaacagcgcacaccacaggacaatcaactcacatacgtcgtaatagcaatcctcacagtggtcgccgctaccatggcgaacgaaatgggcttcctggaaaagactaagaaagacctgggattcggatcaatcgccacccaacagcccgaatccaacatcctggacatagacctgcgccctgccagtgcctggacactctatgcagttgcgacgacattcgtaacccccatgctacgacactccatagaaaactcaagtgtcaacgtatccctaacagctatagcaaaccaagcaaccgtgctgatgggcctaggaaaagggtggccgctgtcgaagatggacataggcgtccccctactggcaataggctgctactcccaagttaatccaataacgctgacagctgccttgttactgctagtggcccactacgccatcatcggccccggcctgcaagcgaaggcaacccgcgaagcccagaaaagagcggctgcaggtataatgaaaaacccgaccgtcgacggcatcaccgtcatcgacctagatcccataccatacgatccaaaattcgaaaaacaattaggccaggtgatgcttctagtcctatgcgtaacgcaagtgctcatgatgagaacaacatgggcgctatgcgaggccctgacactggcaacaggtccgatctctaccctatgggaagggaaccccgggcgtttctggaataccacgatcgcggtatcgatggcgaacatttttaggggatcttacctcgcaggagccggccttctattctccattatgaagaacacaaccaacacaagaaggggcaccgggaacataggtgaaacgctgggcgaaaaatggaagtccagactcaacgcattaggcaaatctgagttccaaatttacaagaaaagcgggatacaagaagtggacaggaccctagcgaaagaaggcataaaacgcggtgaaacagaccaccatgccgtctcaagggggagtgccaaattacgatggttcgtcgagaggaacatggtaacccccgaaggcaaagtcgtggatctaggaagcggacggggcggctggagctactactgtggaggcctgaaaaacgtacgggaggtgaagggtctaacaaaaggaggacccggccacgaagaacccattccaatgtcaacatacggctggaatttagtaaggttacagtcgggggtggacgtattcttcattccacccgaaaaatgcgacacacttttgtgtgacataggggagtctagcccgaaccctacagtggaagccggacgaacgttgcgcgtgctgaacctagttgaaaattggctaaacaataacacgcaattctgtatcaaggtactcaacccctacatgccaagcgtgatcgagaaaatggaagcccttcaaaggaaatacgggggagccctagttagaaacccactgtcaaggaactctacacatgagatgtattgggtcagcaatgcgagcgggaatatagtctcgtctgtcaacatgataagccgcatgcttataaaccgattcacgatgcgtcataagaaagcgacttacgagcccgacgtggatctaggatcgggcactagaaacattggcatcgagagcgagataccgaacctagacatcatagggaaacggattgagaaaataaaacaagaacatgaaacaagctggcactacgaccaagaccacccatacaaaacctgggcttatcacggttcctacgaaacaaagcaaacggggtcagcgtcgagcatggtaaacggagtggttcgcttactgaccaaaccgtgggacgtgttgccgacggtaacccagatggctatgaccgacacaacacccttcgggcaacagcgcgtcttcaaagaaaaagtagacacgaggacacaggagccaaaggaaggcacgaagaaactgatgaagatcaccgctgaatggctttggaaagagctaggcaagaagaaaacacccagaatgtgcacacgggaagagttcacacgcaaggtgagatcgaatgcggcactgggagcgatattcaccgacgaaaacaaatggaaatcagctcgcgaggccgttgaagattcacgcttctgggaattagtcgacaaagagcgtaacctccacctagaaggaaagtgcgaaacctgcgtctacaacatgatggggaagagagagaagaaactcggggagtttggcaaggcaaaaggaagtcgcgctatctggtatatgtggctcggggcccggttcctagagttcgaggccttaggttttctcaacgaagaccactggtttagccgagaaaactcgttatcaggggttgagggggagggcagccacaagctagggtacatacttcgggacgtttctaaaaaggagggcggcgcaatgtacgccgacgatacggcggggtgggatacgagaataacgctagaagacctgaaaaacgaggagatggtgacaaaccacatggaaggggaacacaagaaacttgcagaagccatcttcaagctaacgtatcaaaacaaggtcgttcgcgttcagcgcccaacacccagaggaaccgttatggatataatatccagacgggatcaaagaggctctggacaagtcgggacatacggattaaacacgttcacaaacatggaagcccaactaatacgacagatggagggggagggcgtctttaagaacatacagcatttgacggcgacagaagaaatcgcagtccagaactggctcgcaagggtgggacgagagagactttcacgcatggccataagcggagatgattgcgtagtaaagccgctcgacgatagatttgccagtgccctaaccgccttaaacgatatgggcaaaatccgcaaagacatacaacaatgggaaccatcgcgcggctggaacgactggacacaagtgccattctgctcccaccacttccacgagctcatcatgaaagacggccgggtcctagtcgtgccatgtcgaaaccaagacgagctcatcggaagggcccgtatctcccagggggccggatggagcctaagggagactgcctgccttgggaaatcctacgcacagatgtggagtctcatgtacttccacaggcgtgacctaagactggcagccaacgcaatctgcagcgcagtaccatcccactgggtgcctacttcacggaccacatggtcgatacacgctaaacatgaatggatgacaacggaggacatgctaaccgtgtggaatagagtatggatacaagaaaatccatggatggaagacaaaaccccggtagaatcgtgggaagaaatcccctatctcggaaaacgagaggatcaatggtgcgggtcgctaatcggcttaacaagcagagcaacctgggctaaaaacatccaggcagccattaatcaagtccgaagccttataggcaacgaggagtacacggactacatgccctcaatgaagcgtttccgtcgtgaggaggaagaagcgggggtactgtggtag

SEQ ID NO: 25615 - RNA, 9876 nt, synthetic construct
  misc_feature 1..9876: note = derived and/or modified CDS sequence (opt11) from DENV-2__AF169688__SS-prME
  source 1..9876: mol_type = other RNA
agcgcgggcatgataatcatgctgatccccaccgtgatggccttccacctcacgacccgtaatggggaaccccacatgatcgtaagcatccaagaaaagggcaagagtctgctgttcaaaaccgaagacggggtgaacatgtgtacactcatggcgatggatttaggtgagctgtgcgaggacaccatcacctataagtgtcccctactgagacagaacgaaccagaggacattgactgctggtgcaactccaccagcacgtgggtcacctatgggacctgcaccaccaccggcgagcaccgccgggagaagcgctcagtcgccctcgtgccgcacgtgggcatggggttggagacacggaccgagacctggatgagctccgagggcgcctggaagcacgcgcagaggatcgagacctggatcttgcggcacccggggttcaccatcatggccgcgatccttgcctacaccatcggtaccacacactttcagcgcgcgctcatcttcatcttgctgactgccgtggcgcccagcatgaccatgcggtgtataggtatctccaaccgcgattttgtggagggtgtgtcaggaggatcctgggtcgacatcgtgctcgaacacggaagctgtgtgaccaccatggcgaagaataagccgacgctggacttcgagctaatcaagaccgaagccaagcagccagccacattgcggaagtactgcatcgaggcaaagctgacaaatacgactacagagtcccgctgtcccacccagggggaacccagcctgaaggaagaacaggacaagcgattcgtctgtaaacactctatggtggaccgcggctgggggaacgggtgcggcctcttcgggaaaggcgggatcgtcacgtgcgctatgttcacgtgtaagaaaaacatggagggcaagatcgttcagcccgaaaacctggaatacaccatcgtggtgacgcctcacagcggtgaagaacatgccgtcgggaacgatacgggcaagcatggaaaggagatcaaggtgaccccgcagtccagcatcaccgaggccgagctgaccggctatgggaccgtaacgatggagtgttcgcctcgtaccggactcgacttcaacgagatggtcttgttacagatggagaacaaggcctggcttgtgcatcgtcagtggttcctggacttgcccctaccctggctgccaggcgccgatacccagggtagcaactggatccaaaaggagaccctggtgacgttcaaaaacccccatgcgaagaagcaagacgtagtggtcctaggaagccaggaaggggccatgcacaccgctttgacaggcgccaccgagatccagaccagttcggggaacctcctgttcaccggccacctgaagtgccggctgcgcatggacaagttgcaactgaaaggcatgtcctacagtatgtgcaccggcaagttcaaggtggtgaaggagatcgccgagacacaacacggcactatcgtcatcagagtgcagtacgaaggggatggctccccttgccgcatccccttcgaaatcatggacctggagaagcggtatgtactcggccgattgatcaccgtcaacccgatcgtgaccgaaaaggacagccccgtgaacatcgaggcggagccgcccttcggggactcatacatcattatcggcgtcgagccggggcagctgaagctcaattggttcaaaaaggggagcagtatcgggcagatgttcgagactacgatgcgcggggccaagcggatggcaatcctcggcgacaccgcctgggacttcggaagcctgggcggggtgttcacctctatcggcaaggccctccaccaagtgttcggtgctatctacggcgccgcgttctcaggcgtatcctggaccatgaagatcctaatcggggtgatcatcacgtggatcgggatgaacagtcgctccaccagcctgtccgtgagcttagtcctcgtggggatcgtaaccctgtacctgggcgtcatggtgcaggccgactccgggtgcgtggttagttggaagaacaaggagttgaaatgcggctcgggaatcttcataaccgataacgtgcacacgtggaccgaacagtacaagtttcaacccgagtcccctagcaagttggcttccgccatccagaaggcccaggaggaagggatctgcggcatcagaagcgtgacgcgcctggagaacctcatgtggaagcagatcacgcccgaactgaaccacatcctggccgagaacgaggtcaaactcacgataatgacgggggatatcaaggggatcatgcacgccgggaagcggagcctgcgaccgcaacccaccgagctgaagtacagctggaagacctggggtaaggcgaagatgctcagcacggagagccacaaccagaccttcctgatcgacggccccgagaccgccgagtgcccaaataccaatcgggcttggaactcccttgaggttgaggactacgggttcggcgttttcacaaccaacatctggctcaaacttaaggagaagcaggacgcgttctgcgactctaagctgatgtccgccgcgatcaaggacaatcgcgccgtccacgcggatatggggtactggatcgaaagcgccctcaacgatacctggaaaattgaaaaggcctccttcatcgaggtcaaaaactgccactggcccaagagccatacactgtggtctaacggcgtgctggagtctgagatgatcatccctaagaacctcgcgggccccgtcagtcagcacaactatcgtccgggataccacacccagatcgcaggtccttggcacctggggaaattggagatggacttcgacttttgcgacggtacgaccgtggtggtcaccgaggactgtgggaacaggggaccctctctccggacaacaactgccagcggcaagctcatcaccgaatggtgctgccgctcctgcaccctgcccccgttgcgctaccgcggggaggacggctgctggtacgggatggaaatccgacccctgaaggagaaggaggaaaacctggtgaactcgctcgtgaccgccggccacgggcaagtcgacaacttttcgctgggcgtgctgggcatggccctcttcctggaggagatgctgcgcacacgagtgggaacaaagcacgccatcctcctggtcgccgtcagctttgtaacacttatcacgggcaacatgtccttcaaggacctcggacgcgtcgtagtgatggtcggagccactatgactgacgacatcgggatgggggtaacctacctggccctcctcgcggctttcaaggtccggcccactttcgccgccggcctgctgctgcgcaagctgaccagcaaggagctgatgatgaccaccatcgggatcgtcctactgtcccagagtacgatccccgagaccatcctggagctgactgatgctttagcgctgggaatgatggtgcttaagatcgtgaggaacatggagaagtaccaactggccgtcaccatcatggccatcctgtgcgtgccaaatgccgtcatcctacagaatgcctggaaggtttcctgcacgatcctggcggtggttagcgtgagcccactcatcctcacatcctcgcagcagaagaccgactggatcccactagccttgaccatcaaggggctcaaccctacggccatcttcctgaccaccctgagccggaccaacaagaaacggtcctggccgctcaacgaggccattatggcggtcggtatggtcagcatcctggcctcctcgttactcaagaacgacatacccatgacgggacccctggtggccgggggcctgctcaccgtctgctacgtcctgaccgggcggtccgctgatttagagctcgaacgcgccactgacgtgaagtgggaggaccaggcggagatcagcgggtcgtctcctatcctatctatcacgatcagcgaagacggaagcatgtccatcaagaacgaggaagaggagcagaccctgaccatcttgatccggaccggtctgctggtgataagtggtctctttccggtctccatccccatcactgccgccgcctggtacctgtgggaggtgaagaagcagcgcgcaggggtgctgtgggacgtcccctcccctccgcctatgggcaaggcggaactcgaggacggagcctacagaatcaagcagaagggcatcctggggtatagccaaataggcgccggtgtctacaaggaggggacgtttcataccatgtggcatgtgacccgaggcgcggtcctgatgcataaaggtaagcggatagaacccagttgggcggacgtgaaaaaggatctcatctcctacggagggggctggaaactagagggagagtggaaggagggagaggaggtgcaggtcctggcgctcgagccaggaaagaacccccgcgccgttcagaccaagcccgggctgtttaagacgaacaccgggaccatcggagccgtgagcctcgacttctcgcccggcacgagcggttcccccatcatcgacaagaaggggaaggtagtgggactgtacggcaacggagttgtcacgcggagcggcgcctacgtgtcagccatagcgcaaacggagaagtccatcgaggacaaccccgagatcgaggacgacatctttcgcaagcggagactgaccatcatggacctgcaccccggggccggcaagaccaaacggtacctgcccgctatcgtccgcgaggcgatcaagcgggggctccgcacactgatactcgctccgacccgggtcgtagccgccgagatggaggaggccctcagaggccttccgatccggtaccagaccccggccatccgcgcggaacacactggacgcgagatcgtggacctgatgtgccatgccacgttcaccatgcggctcctgagcccggtccgcgtgccgaactacaacctgataatcatggatgaagcccactttaccgaccccgcaagcatcgccgctcggggctacatctcgacccgcgtggaaatgggcgaggccgccgggatcttcatgactgccacgccgccagggtccagggatccgttcccccaatcaaacgcccctatcatcgacgaggagcgcgagatccccgagcggagctggaacagcgggcacgagtgggtcactgacttcaagggcaagaccgtatggtttgtgccgtcaatcaaagcggggaacgacatcgctgcctgcctgcgcaaaaacggcaagaaggtcatccaactgagccgaaagacgttcgacagcgagtacgtgaagacccgtaccaacgactgggacttcgtggtcaccacggatatcagcgagatgggagccaacttcaaggcggagcgggtgatcgacccccgccggtgtatgaagcccgtcatactgaccgacggcgaggaacgcgtcatcctcgcaggccccatgccggtgacccacttcagcgccgcccaaaggcgcggtcggatcggccgcaaccccaagaacgaaaatgaccagtacatctacatgggggaacccctggagaatgatgaggactgcgcccactggaaggaagccaagatgttgctcgacaacatcaacacccccgagggtatcataccgagcatgttcgagcccgagcgggaaaaggtcgacgctatagacggcgagtaccgactgcggggcgaggccaggaaaacgttcgtcgacctcatgcgcagaggcgatctccccgtgtggctggcctacaaggttgccgccgaagggattaactacgccgaccgccgatggtgcttcgacgggatcaaaaacaaccagatcctggaggaaaacgttgaggttgagatctggacgaaggagggggagcgcaagaagctcaagccgcggtggctggacgccaggatctattccgaccccctggccctcaaggagttcaaggagttcgccgcggggcgcaaaagcctggccttgaacctcatcaccgagatgggccgcctgcccaccttcatgacgcagaagacccgggacgcgctggataacctcgccgtcctgcacaccgcggaggccgggggccgtgcctacaaccacgccctgtccgagctccccgaaacgttggaaacgctcctcctgctgaccctcctggcaaccgtcaccgggggcatattcctgttcctcatgagcggacgggggatcggcaagatgaccctcgggatgtgctgcatcatcactgcgagtatcctgctctggtatgcgcagatccagccgcattggatcgccgccagcattattctggtgttcttcctgattgtcctcctgatccccgagcccgagaagcagcgaactccccaggacaaccaactgacctacgtggtaatcgccatcttaaccgtcgtggccgcgacgatggccaatgagatgggtttcctggaaaagaccaagaaggacctggggtttggctccatcgctacccagcaaccggaatctaacatactcgatatcgacctgcggcccgcctctgcctggaccctgtacgccgtggctacgacctttgttacccccatgctccgtcatagcatcgagaactcgtccgtgaatgtgtcgcttaccgccatcgcaaatcaagcgacggtcctaatgggtttgggtaaaggctggccgttgtccaaaatggacattggggtgccgctgcttgctattggctgctacagccaggtcaaccccattacccttaccgcagccctgttgctgctggtcgcgcattacgcgatcatcggtcctggcctccaggccaaggccacccgggaggcccaaaagcgcgcggccgccggaatcatgaagaacccaacggtggacgggattaccgtgatcgatctggaccccattccgtacgatcccaagttcgagaagcaactgggccaggtcatgttgctggtcctgtgcgttacccaggtcctcatgatgcggaccacgtgggccctgtgtgaggctctgaccctcgccaccgggccgatttccaccctttgggagggcaacccagggcggttctggaacacgaccattgccgtgtcaatggccaacatcttccggggctcctacctggctggcgcagggctcctgttcagtatcatgaagaacaccacaaacacgcgtcggggcaccgggaatatcggaaagaccctgggagagaagtggaagtcccggctcaacgcgctggggaagatagagttccagatttacaaaaagagcggcattcaggaggtggaccgcaccctggccaaggaagggataaaacggggtgagacggaccaccacgccgtatccagagggtcggccaagctccgttggttcgtggagcggaacatggtgaccccggaaggcaaggtcgttgacctgggctgcgggcggggcgggtggtcctactactgtggcgggctgaagaacgtacgcgaagtgaagggcctcacgaagggcgggcccggccacgaggagcccatcccgatgtctacttacggttggaacctggtgcggctgcagtccggcgtcgatgtcttcttcatcccgccggaaaagtgcgacacgctactgtgcgatatcggggagagctctcccaaccctaccgtggaggcaggccgcacattacgcgtgttaaacctggtcgagaactggctaaacaacaacacccagttctgcatcaaggtgctcaacccctatatgcccagcgtgatagagaaaatggaagccctccagcgcaaatacggcggggccctggtccggaacccgctctcccgcaacagcacccacgagatgtactgggtcagcaacgcctccggcaacatcgtgagctccgtcaatatgatctcgcgtatgctaatcaaccgcttcacgatgcggcacaagaaggccacttacgagcccgacgtggacctagggtccggcacacgtaacattggcatcgagagcgagatccccaacctggacattataggcaaacgaatcgagaaaatcaaacaggaacacgagacctcttggcattacgatcaagatcacccctataagacatgggcgtaccacgggtcatacgagaccaagcagaccgggtccgcctctagcatggtgaatggtgtcgtacgtctcctgaccaagccgtgggacgtgctgcctacggtcacccaaatggcgatgacagacacaactcccttcgggcagcagagagtgttcaaggagaaggtggatacccggacccaggaacccaaggaggggactaaaaagctaatgaagataacggccgagtggctttggaaagagttaggcaagaagaaaactccccgcatgtgcacccgggaagagttcacccgtaaagtccgctcgaacgccgccctaggcgctatcttcacagatgagaataagtggaagtcagctcgcgaggccgtagaggacagccggttctgggagcttgtcgacaaggaacgcaacctgcacctcgagggcaagtgcgagacctgcgtttacaacatgatggggaagcgtgagaagaagttaggcgagtttgggaaagcgaaaggctcacgcgccatctggtacatgtggttaggcgcccggttcctggagtttgaggccctcgggttcctgaacgaggaccactggttctcaagggaaaactccctcagcggcgtagagggtgaaggtctccacaagctgggttacatcctccgggacgtctccaagaaggagggcggcgccatgtacgcggacgacaccgcgggatgggacacccggatcacgctggaggacctgaagaacgaggagatggtgaccaaccatatggagggcgagcataagaagctcgctgaagcaatcttcaagctgacatatcagaacaaggtggtccgtgtccaacgccccacgccacgcgggacggtgatggacatcatcagccgccgggaccagcgcggcagcggtcaggtcggcacctatggcttaaacaccttcaccaacatggaggcacagctaattcggcaaatggagggggagggcgtgttcaagaacatacagcacctgacggcgaccgaggagatcgccgtccagaactggctggcccgcgtcgggcgcgagcggctctcccgcatggccatctctggcgacgactgtgtcgtgaagccattagacgaccggttcgccagtgcgctcaccgctctgaacgatatgggaaagatccgcaaggatatccagcagtgggagccgagccggggttggaacgactggacccaggtccccttctgctcccaccacttccacgagttgatcatgaaggacggccgcgttctggtagtcccctgcaggaaccaagacgagctcattggccgcgcaagaatcagccagggcgccggatggagcctgcgcgaaaccgcctgcttgggaaagagctatgcgcagatgtggagtctcatgtacttccaccggcgcgacctgcgactggcagccaacgccatctgctcggccgtgccctcccactgggtgccgaccagccgcaccacctggtccatccatgcgaagcatgagtggatgaccactgaagacatgctcacggtatggaaccgggtgtggatccaggagaacccgtggatggaggacaagacccccgtggagagctgggaggagatcccatacctgggaaagcgcgaggaccagtggtgtgggtctctgatcgggctcacctcacgggccacgtgggccaagaacatacaagcggccatcaaccaggtccgaagccttatagggaacgaggaatacacagactacatgccgagcatgaagcggttccgccgcgaggaggaggaggcaggggttctgtggtga

SEQ ID NO: 25616 - RNA, 9873 nt, synthetic construct
  misc_feature 1..9873: note = derived and/or modified CDS sequence (opt11) from DENV-3__AB189125__SS-prME
  source 1..9873: mol_type = other RNA
acctccctgtgcttgatgatgatgctgcccgcaaccctggccttccacctcacctcccgggacggggaaccccgaatgatcgtggggaaaaacgaacgcggcaagagcttactgttcaaaaccgcatccgggatcaacatgtgcacgctcatcgccatggacctgggtgagatgtgcgacgacacagtgacctataaatgccccctgatcaccgaagttgaacccgaggacatcgactgctggtgcaaccttaccagcacttgggtgacctatgggacctgcaaccaggccggcgagcatcggcgagacaagcggtccgtggccctggcgccccatgtgggcatgggactggacacccgcgcgcagacctggatgtcagccgagggggcctggcgccaggtggagaaggtggagacatgggccttccgccacccggggttcaccatcctggcgctgttcctggcccactacatcggcacctcccttacgcagaaggtcgtgatcttcatcctgctgatgcttgtcacccccagcatgaccatgcggtgcgttggggtgggcaaccgcgacttcgtagagggcctgtccggggccacttgggtggatgtggtcctggagcacggcgggtgcgtgaccacgatggccaaaaataagcccaccctcgacatcgagcttcagaagaccgaggccacccagcttgcgacgcttcggaagctatgcatcgaggggaagatcaccaacgtaaccacggactctcgttgcccaacccagggagaggcgatcctgcccgaggagcaggatcagaactacgtctgcaaacatacctacgtggaccgggggtggggcaacgggtgcggcttattcgggaagggctccctggttacgtgtgccaagttccagtgcctggagctcatcgaaggaaaggtcgtgcagcacgagaacctgaagtacaccgtgatcatcacggtccacaccggtgaccagcatcaggtgggcaacgagacgcaaggggtcaccgccgagatcacaccccaggcaagcaccgtggaggcgatactgcccgagtacggcaccctggggctggagtgcagcccccgaaccggcctggacttcaatgagatgatcctcctgaccatgaagaacaaggcctggatggtacaccggcaatggttcttcgacttgccgctcccctggacgtcgggcgcgacaaccgagacccccacgtggaacaagaaggagctgttggtcactttcaaaaacgcccacgccaagaagcaggaggtggtggtactcgggtcccaggagggcgcgatgcacaccgccctcactggggccacggagatccagaccagcggcgggacctccatttttgccggtcacctgaagtgtaggcttaagatggacaagctggagctgaaaggcatgagctacgccatgtgctccaacgcgttcgtgttgaagaaggaggtgagcgagacccagcacgggacgatcctgataaaggtcgagtacaagggcgaggacgccccctgtaaaatccctttcagcaccgaagacggacagggaaaggcccacaacggacggctgatcaccgccaatcccgtggtgaccaaaaaggaggagccagttaacatcgaggcggagcccccgttcggggagtccaacataattatcggcatcggggacaaggccttgaagataaactggtacaagaaaggcagctccatcgggaagatgttcgaggccaccgcccggggcgcgcgacgcatggcgatccttggtgacactgcctgggacttcggaagcgtgggtggtgtgctaaattcattgggcaagatggtccaccagatcttcgggagcgcctacaccgccctcttctccggcgtgagctggattatgaagatcgggataggagtgctgctgacctggatcgggctcaactccaagaacacgagcatgtccttcagctgcatcgtaatcggcatcatcaccctgtacctgggcgccgtggtgcaggcggacatggggtgtgtcatcaactggaagggcaaagaacttaagtgcggttccgggatattcgtgacaaacgaggtgcacacctggacggagcagtacaagttccaagccgactctcccaagcggttagcgaccgccatcgccggcgcgtgggaaaatggggtctgcggcattaggtccaccacccgcatggaaaaccttctctggaagcagattgcgaacgagctcaactacattctgtgggagaacaacatcaagttgacggttgtggtcggggacataatcggaatactggaacagggcaagcggacactgacgccccaacccatggagctcaagtactcgtggaagacctgggggaaggccaaaatagttacggccgagatccagaactccagttttatcatcgacggcccaaacacacccgagtgccccaacgcctcccgcgcctggaacgtatgggaggtagaagactacgggtttggcgtgttcaccacaaacatttggttgaagctacgcgagatgtacacacagctctgcgaccaccgcctgatgagcgccgccgtcaaggacgagcgggcagtccatgcggacatgggttattggatcgagagccagaagaacgggagctggaagctggaaaaggccagcttaatcgaggtgaagacctgcacctggcccaagtctcacaccctgtggagcaacggcgtgctggagtccgacatgattatccccaaatcactcgccgggcccatatcccaacacaactatcgccccggctatcacactcagaccgccgggccgtggcaccttgggaagctggagctcgacttcaactactgcgagggaactaccgtcgtgatcaccgagaattgtgggacgcggggccccagcctgcgcaccaccaccgtgagcgggaagctgatccacgagtggtgctgccggagttgcacgctgccgcccctccggtacatgggcgaggacgggtgctggtacggcatggagatcaggccgatcaacgagaaggaggagaacatggttaagagcctggtgagcgccgggtcggggaaggtagacaacttcactatgggagtcttgtgtttagcgatcctgttcgaggaggtgatgcgcggaaagttcggcaagaagcacatgatcgccggggtcctgttcaccttcgtcctgctgctcagcggccagatcacctggcgggacatggccagaaccttaataatgatcggcagtaacgcttcagaccggatgggtatgggcgtgacctatcttgccctcatcgctactttcaagatccagccatttctcgccctaggcttcttcctccgcaagctgaccagccgggagaacctactgcttggcgtgggcctcgccatggccacaaccctccagctgcccgaagacatcgagcagatggcgaatgggatcgccctgggcctcatggccttgaagctgatcacccagttcgaaacctaccagttatggacggccctggtaagcctgatgtgcagcaataccattttcaccctcaccgtggcctggagaactgcgaccctgatactggccgggatctccctcctgcccgtgtgccagagctccagcatgcggaagaccgactggctcccgatgaccgtcgccgccatgggcgtgccgcccctccccctgttcatcttcagcctgaaggacaccttaaagcgccgcagctggccgctgaacgagggagtcatggcggtgggcttagtgtcgatcctcgcgtcatccctgctgcgtaacgacgtccccatggccggccccctcgtggccggaggactgctgatcgcctgctacgtgatcaccgggacgagcgccgacctcaccgtcgagaaggcggccgacgtgacctgggaggaggaggccgagcagacaggcgtgtcccacaaccttatgatcaccgtcgacgacgatgggaccatgcgcataaaggacgatgagacggagaacatcctgaccgtgctcctaaagactgcgctgttaatagtgagcggcatctttccgtactccatcccggcgaccctgctggtctggcacacctggcagaagcagacgcagcggagcggcgtgctctgggacgtgcccagcccgcccgagacccagaaggcggagctggaggagggggtctacagaatcaaacagcagggcatcttcggcaagacccaggtgggcgtgggcgtccagaaggaaggcgtatttcacacaatgtggcacgtgacgcggggcgccgtcctgacctacaatgggaagcgcctcgagccgagctgggcctccgtgaagaaggacctgataagctacggcgggggctggcggctgtccgcacagtggcaaaagggagaggaggtgcaggtcatcgcggtggagcccggcaagaacccaaagaacttccagaccatgcctggcatcttccagacgacgaccggtgagatcggggccatagctctggacttcaagccagggaccagcggcagtcccatcataaaccgtgagggcaaggtagtcggactctacggcaatggggtggtgactaagaacggcggatatgtatccggtatcgcccagacgaatgcggagcctgacggcccgaccccggagctcgaagaggagatgttcaagaagagaaacctgacgatcatggacctccacccgggaagcggcaagacccgcaagtacctgcccgctatcgtgcgggaggccataaaacgccggttacgcacgctcatcctggcgccgacccgggtggtcgccgccgagatggaggaggcgctgaaggggttgcccatccgctaccaaaccacagctaccaagtctgagcacaccggcaaggaaatcgtggacctaatgtgccatgccacttttaccatgcgactcctcagcccggtgcgcgtcccaaactacaacctgatcatcatggacgaagcccacttcaccgacccggcctctatcgcggcccggggatacatcagcacccgcgtgggcatgggcgaggccgccgcgatcttcatgaccgccacgccgcccgggacggcagacgcatttccacagtccaacgccccgatacaggacgaggagcgggacattccggagcgcagctggaactccggtaacgattggatcaccgatttcgcggggaaaacagtgtggttcgttcctagcatcaaagccggcaacgacatagccaactgcctgagaaagaacggcaaaaaggtgatccaactctcccggaagaccttcgacaccgagtaccaaaagacgaagctgaacgactgggacttcgtggtcaccaccgatatcagcgagatgggcgctaacttcaaagccgatcgagtgattgacccccggcgctgcctgaagccggtgatcctaacggacggccccgagcgggtaatcctggcggggcccatgcccgtcactgtggcctccgccgcccaacgccggggtcgcgtcgggcggaacccgcagaaggagaacgatcagtacatcttcaccggccagcccctgaacaacgacgaggaccacgcacactggaccgaggcgaaaatgctcctcgataacatcaacacgccggaggggatcatccccgccctgttcgagccggagcgcgagaagtccgccgccatcgacggggagtaccggctcaagggcgagagccgcaaaacgtttgtggagctgatgcggagaggggacctgcctgtgtggctcgcgcacaaggtcgccagcgagggaatcaaatacaccgaccgtaagtggtgctttgacggggagcgcaacaaccagatcctggaggagaacgtggacgtcgagatttggacaaaggagggggagaagaaaaagctgcggccacgctggttagacgcccggacgtattcggaccccctggccctcaaggagttcaaggactttgccgcgggccgcaagagcatcgccctcgacctggtgacggagatcggtcgcgtgccgtcccacctagcccatcggacccgcaacgccctcgacaacctagtgatgctgcacaccagcgagcacggcgggcgtgcctatcgccacgccgtagaagaactccccgaaaccatggagaccctgctgctcctgggcctgatgatcctcctgacagggggcgtaatgctgttcctcatcagcggcaagggggtcggaaagacttccatagggctaatctgtgtcgtggccagctccggaatgctatggatggctgacattcccctccagtggatcgccagcgccatcgtcctggagttcttcatgatggtgctgctcatccccgaacccgagaagcagcggacgccccaggacaatcaactggcgtacgtggtcatcggaatcctcacgctcgccgccatcgtggccgccaacgagatgggcctgctggagaccaccaaacgcgacctcggcatgtccaaggagcccggggtcgttagcccgacatcttacctggacgtggacttacaccccgccagcgcttggacgctctacgccgtggccacaaccgtcatcacccccatgctgcggcacacgatcgagaactccaccgctaacgtgagccttgcagccatcgcaaaccaagcagttgtattgatgggtctggacaaggggtggcccatctccaagatggacctgggtgtgcccctcctagcgctgggatgctacagccaggtgaaccccctcaccctcaccgccgcggtcctgctcctggtgacgcactacgccattatcggccccgggctgcaggcgaaagcgacacgcgaggcccaaaagcgcactgccgccgggatcatgaagaaccccaccgtggatggaatcatgacgatcgatctcgacccggtcatctacgactccaagttcgagaaacagctgggccaggtgatgctgcttgtgctgtgcgccgtacagctgctccttatgcggactagctgggcgttttgcgaggcccttactcttgccaccggccccatcacgaccttgtgggagggcagtcccgggaaattctggaacaccaccatcgccgtgagcatggcgaacatcttcaggggcagctacctagctggagccggcctcgccttctcgattatgaagtccgtggggaccggcaagcgcggcaccgggagccagggtgagaccctgggggagaagtggaagaaaaagctgaatcagctcagccggaaggagttcgacctgtacaaaaagagtggcatcacggaggtcgaccgcacggaagcgaaggagggactgaagcggggcgagataacccaccatgccgtgagccgtgggtccgccaaactccaatggttcgtggagcgcaatatggtcatccccgaggggcgcgtaatcgacctcgggtgcgggcggggcgggtggagctactactgcgccggactgaagaaggtgaccgaggttcgcggctacaccaagggcgggccggggcacgaggagcccgtgcctatgtcaacctatgggtggaacatcgtgaaactaatgagcgggaaggacgtattctacctacccccggagaagtgcgacacgctactgtgcgacatcggcgagtccagcccctcccctaccgtggaggagagccggaccatccgcgtgctcaagatggtcgaaccttggttaaagaacaatcagttctgcatcaaggtgcttaacccgtacatgcccgccgtgatcgaacacttagagcgcctgcagcggaagcatggtggaatgctggtaaggaaccccctctcccgcaacagcacccatgagatgtactggatcagcaacggcacggggaacatcgtcagctccgtcaacatggtctcgagactgcttctcaaccggttcaccatgacctaccgcaggcctacaatcgagaaggacgtggacctgggtgccggcacgcgccacgtcaacgcggagccggagacccccaacatggacgttatcggtgagagaatccgccggatcaaggaggagcactccagcacgtggcactatgacgacgagaacccttacaagacatgggcctaccacggcagttacgaggttaaggccacagggagcgccagctccatgataaacggcgtcgttaagctcctcaccaagccttgggacgtggtccccaccgtgactcagatggcgatgacggacaccacgcctttcgggcagcaacgcgtgttcaaggagaaggttgatacccggacgcctaagccgatgcccggcaccagaaaggtgatggagataaccgcggaatggctgtggcggaccctgggccgcaacaaacggccgcgcctctgcacgcgtgaggagtttaccaagaaagtgcgtacgaacgccgccatgggggctgtcttcaccgaggaaaaccagtgggactcagcgcgtgccgccgtggaggacgaagagttctggaagctcgtggaccgggagcgcgagctgcacaagctcggcaaatgcgggtcatgtgtgtataacatgatgggcaagcgggagaagaagctgggagagtttggcaaggccaagggcagccgcgccatctggtacatgtggttaggggcgcggtacctcgagttcgaggcgctgggcttcctgaacgaggatcactggttcagccgagagaactcttactcgggggtggagggcgagggactccacaagctgggctacatcctgcgagacatcagcaagattcccggcggggccatgtacgccgacgacacggcgggctgggatacccgcatcaccgaagacgatctccacaacgaagagaaaatcacacagcagatggatccggagcaccggcagctggcgaatgccatcttcaagctgacgtaccagaacaaggtggtcaaggtacagcgccccactcccaaggggaccgtgatggacatcatcagccggaaggaccagcgcggtagcggccaggtcgggacctacggcctcaacactttcaccaacatggaggcccagctgatcagacaaatggagggggagggcgtgctgtccaaaaccgacctcgagaacccgcacctcctggagaagaagatcactcaatggttggagactaagggggtagaacgcttaaaacgtatggccatctccggcgacgactgcgtcgtcaagccgattgacgaccgattcgccaacgcgctgttagccctgaacgacatgggcaaagtcagaaaggacatcccccagtggcagccctccaaaggttggcacgactggcagcaggtccctttttgcagccatcacttccatgagctcatcatgaaagacggtcggaagctagtggtgccatgccggtcccaggacgagctgatcgggagagcccggatttcccagggcgccggttggtcactgaaggaaacggcctgcctcggaaaggcgtacgcccagatgtgggctctcatgtacttccatcgccgcgacctgcggctcgcctctaacgccatatgctccgccgtccccgtgcattgggtgcccacgagccgtacaacatggtcgatccacgcccaccaccagtggatgaccacggaggacatgctgaccgtctggaaccgcgtgtggatcgaagataacccctggatggaggacaagaccccggtgacgacttgggaggacgtcccatacctgggcaagcgcgaggaccagtggtgcgggtccttgatcggcctgacctctcgggctacctgggcgcagaatatcctgacggcgatccaacaggttcgatccctgatcggcaacgaagagtttctggactacatgcccagcatgaagcgttttaggaaggaggaggaaagtgagggtgccatctggtga

SEQ ID NO: 25617 - RNA, 9873 nt, synthetic construct
  misc_feature 1..9873: note = derived and/or modified CDS sequence (opt11) from DENV-3__AB189126__SS-prME
  source 1..9873: mol_type = other RNA
accagcctgtgcctcatgatgatgctgccggccacgttagccttccacttgacgtcccgcgacggcgaaccgcgaatgatcgtggggaagaatgaacgcggcaagagcttgttgttcaagaccgcgtccgggatcaacatgtgtaccctgattgccatggacctgggggaaatgtgcgacgacaccgtcacgtataagtgccccctgatcacagaagtcgagcccgaagacatcgattgttggtgcaatctcaccagcacctgggttacgtacgggacctgcaaccaggccggcgagcaccggcgcgacaagcggtccgtcgccctcgcgccccacgtgggcatggggttagataccagggcccagacctggatgagcgctgagggcgcctggagacaggtggagaaggttgagacgtgggccttccgccaccccgggttcaccatcttggcgctgttcctggcccactacattggcacatccctcactcagaaggtggttatcttcatcctgctgatgctcgtcacgccctctatgaccatgcggtgcgtgggagtgggcaaccgcgacttcgtagaaggactgtccggggcaacctgggtggacgtcgtcctggagcacggcgggtgcgtgaccacgatggccaagaacaagcccacactcgatatcgagctgcagaagaccgaggcgacccagctggcgacgttacggaagctctgcatcgaaggcaagattaccaacgtgaccaccgactccaggtgccccacacagggcgaggccatactgccggaggagcaggatcagaactacgtctgtaagcacacctacgtcgaccgggggtggggtaacgggtgtggcctctttgggaaggggagcctggtcacgtgcgcgaaattccaatgtctggagctcatagaggggaaggttgtgcagcacgagaacctgaaatacaccgtgatcatcacggtgcacaccggagaccagcaccaggtggggaacgaaacccaaggggtaacggccgagatcacgccccaggctagtaccgtggaggctatcctgcccgagtacggaaccctggggctggaatgctcacccaggaccggcctggacttcaacgagatgatcctcctgacaatgaaaaacaaagcctggatggttcaccggcagtggtttttcgatctccctctcccctggacgagcggggccaccaccgaaacccccacttggaacaagaaggaactgctggtcaccttcaaaaacgcccacgccaagaagcaggaggtggtggttctcgggtcccaggagggagcgatgcacaccgcgttgaccggggccacggagatccaaaccagtggcgggaccagcatcttcgccgggcacctgaagtgcaggctcaagatggacaagctggagctgaagggtatgagctacgccatgtgctcgaacgcgttcgtactcaagaaggaagtgagcgagactcagcacggaaccatcctgatcaaggtagaatataagggtgaggacgccccttgcaaaattccgttcagcacagaggatggacagggaaaggcccacaatgggcgtctgatcaccgccaatcccgtcgtgaccaaaaaggaggagcccgtcaatatcgaggcggagccacccttcggggaatccaatatcatcatcggcatcggcgacaaggccttaaagatcaactggtacaagaagggatcttcgatcgggaagatgttcgaggccacggcccgcggtgcgaggcgcatggcgattctcggagacaccgcgtgggacttcgggagcgtgggcggggtgctgaactcgctgggcaagatggtccaccagatcttcggaagcgcctacaccgccctcttctccggcgtcagctggatcatgaagatcggcatcggagtgttgctgacctggatcggcctcaactcaaagaacacgagcatgtccttctcgtgcatcgtcatcgggatcattactctgtacttaggcgccgtggtgcaggcggacatgggttgcgtcatcaactggaagggtaaagagcttaagtgcggctccggcatcttcgtgaccaacgaggtgcacacctggaccgagcagtacaagttccaagccgacagccccaagcggctggccacggcgatcgcgggcgcgtgggagaatggggtctgcggcatccggtccaccactcgcatggaaaacttattatggaagcagattgccaacgagctgaactatattctttgggagaataatatcaagctcactgtggttgtcggagacatcatcggtgtgctagagcagggaaagcggacgctgaccccacagcccatggagctcaagtacagttggaagacctggggcaaggcaaaagttgtaacggccgagattcaaaattccagcttcatcattgatggcccaaatacccccgaatgccctaacgcatcccgagcctggaacgtttgggaggtggaagactatggattcggtgtcttcacaaccaacatctggctgaaattacgtgagatgtacacgcaactctgtgatcaccgcctcatgagcgccgccgtgaaagatgagcgagccgtgcacgccgacatgggctattggatcgaaagccagaagaacgggtcatggaagctggagaaggccagcttgatcgaggtcaagacgtgcacctggccaaagagtcacaccctgtggagcaacggcgtgttagagtccgacatgattatacccaaaagtctggccgggcccatctcccagcacaactaccgcccaggctaccacacccagacggccggtccgtggcacctgggcaagctagagctagacttcaactactgcgaaggcaccactgtagtcatcactgagaactgtgggaccaggggccccagcctgcggaccactaccgtttccgggaagctgatccacgagtggtgttgtcgatcctgtacgctaccaccccttcgctacatgggcgaagacggttgctggtacggcatggagatccggccgatcaacgagaaggaggagaacatggtgaagtccctcgtcagcgctggctccgggaaggtggataacttcaccatgggcgtcctgtgtctcgctatcctgtttgaggaagtcatgcgcgggaagttcgggaagaagcacatgattgcagggatcttgtttatcttcgtgctgctgctcagcggccaaataacctggcgggacatggctcgcaccctgatcatgatcggatccaatgcctccgatcggatggggatgggcgtgacatacctggcgctcatagcgacttttaagatccagccttttctggcattaggattcttcctccgcaagctaacctcccgcgagaacctgctcctgggcgtggggctcgccatggccaccacgctccagttgccggaagacatagagcagatggccaacgggattgcgctaggcctaatggcactaaagctgatcacccaattcgagacctaccagttgtggaccgccctcgtgagcctcacgtgcagcaacacgatattcacccttaccgtggcctggcgcacggcaaccctgatcctggctgggatctccctactgcccgtctgccaatctagttcgatgcggaagaccgactggctgccgatgaccgtagccgccatgggcgtaccacccttacccctgttcatattctccctaaaggatacgctcaagcgacgcagctggccgctgaatgagggggtgatggccgtgggactggtctcaattctcgcgagctcccttctgcggaacgacgtgccaatggccgggcctctcgtggccgggggcctactgatcgcctgttacgtaatcaccgggaccagcgccgacctcactgtggagaaggcagccgacgtgacgtgggaagaggaagctgaacaaaccggcgtgtcacacaatctgatgatcaccgttgacgacgacgggaccatgcgcatcaaggatgacgagacggaaaacattctcactgttctcctgaaaaccgcactgctcatcgtgtcgggaatcttcccctattccatcccggcaaccctgctggtatggcacacctggcagaagcagactcagagatccggggtgctgtgggatgtaccaagcccacccgaaacacaaaaggcggagctggaggagggggtgtaccgcattaagcagcaagggatcttcgggaaaacccaggtgggcgtcggggttcagaaagaaggcgtcttccacaccatgtggcacgtcacccggggcgctgtcctaacctacaacggcaagcgtctcgagccgaactgggcttcagtgaagaaggacctgatctcctatggtgggggctggcgtctatcggctcagtggcagaaaggggaggaggtccaggtaatagcagtggagcccggaaagaacccgaagaactttcaaaccatgcccggtatcttccagacaacgaccggggagattggcgctatcgccctggacttcaagccggggacctccggatcgcccatcatcaacagggagggcaaggtcgtggggctctacggcaacggggttgtcaccaagaacggcgggtacgtgagcggcatcgcccagacgaacgccgagcccgacggtccgacccccgagttggaggaagagatgttcaaaaagcggaacctcaccataatggatctccatcccggatccggcaaaacgcgaaagtacctgcccgctattgtgcgtgaggcgatcaagcgtcggctgcgcacactcatcctggcccctacccgggtagtggccgctgagatggaggaggcccttaaagggctccccatcaggtatcaaacaacggccacgaagtccgagcacaccggcaaggagatcgttgacctgatgtgccacgccacattcaccatgcggctgctctccccagtcagggtgcccaactataaccttatcatcatggacgaagcccacttcacagaccctgccagcatcgcggcccggggatacatctccacccgcgtgggcatgggggaggccgcggctatcttcatgaccgccacaccccctgggacggcggacgccttcccgcagtcaaatgcccccatccaggacgaggagcgtgacatccccgaacgctcctggaacagcggcaacgactggatcaccgacttcgcggggaagaccgtctggttcgtgccctctatcaaggcaggcaacgacatcgccaactgtctgcgcaagaacgggaagaaagtgatccagctcagccggaaaacgttcgacacggaataccaaaagacaaaactgaacgactgggacttcgtcgtgaccaccgacatatccgagatgggcgccaactttaaagccgaccgcgtgatagatccacgtcgctgcttaaaacctgtcatcctcacggacggcccagagcgggtgatcctggcgggacccatgcccgtgacagtagcctccgccgcccagcgacggggcagagttgggcggaatccccaaaaggaaaacgaccaatacatctttaccggacagcccctgaacaacgacgaggaccacgcccattggaccgaggcgaagatgctcctggacaacataaacacgcccgaggggatcatccccgccttatttgagccggagagggagaaatccgccgccattgacggcgagtaccggcttaagggtgagagcagaaagacattcgtggagttgatgagaagaggggacctgcctgtctggctcgcgcacaaagttgcctccgagggcattaagtacacagacaggaaatggtgctttgacggggaacgaaacaaccagatcttagaggaaaacatggacgtcgaaatctggaccaaggagggtgagaagaagaagctgcgaccccgctggctggacgcccgcacctacagcgaccccctggccctgaaggaatttaaggacttcgccgctggcagaaagtccatagcgctcgacctggtcacggagatcgggcgcgttcctagccacttggcccaccgtacacgcaatgcccttgacaacctggtcatgctgcacaccagtgagcacggcgggcgggcctaccgccatgcggtggaggagctccccgagaccatggagacgctgctgctccttggactgatgattcttctgaccggcggtgccatgctgttcttaatctcaggcaagggggtgggcaagaccagtatcgggctgatctgcgtagtggcctccagcggcatgctgtggatggccgacatccccttacagtggatcgccagcgcgatcgtgctggagttcttcatgatggtcctgttaatcccggagcccgagaaacagcgtacaccccaggacaaccaactggcttacgtggtgatcggtattctgacgctcgccgccattgtcgccgctaacgagatgggtctgctggagaccaccaagcgcgacctcggtatgagcaaggagcctggagtcgtgccgcccacctcctacctagacgtcgacctgcaccccgccagcgcttggacgctctacgccgtggcgaccaccgtcataactcccatgttacggcacacgatagagaactccaccgccaacgtctcactggctgcaatcgctaaccaagcggtggtgctcatgggcctggataaggggtggcccatctccaagatggacttaggcgtccccctcctggccctggggtgctatagccaggttaaccctctcaccctgactgccgccgttctgctcctggttacccactacgccatcatcggccccggccttcaggcgaaggccacacgagaggcccaaaagcggaccgccgcggggataatgaagaacccgaccgtggacggaatcatgacgatcgatctcgaccctgtgatctacgactctaaattcgagaagcaactgggtcaggtcatgctcttagtgctctgtgcggttcagctactcctgatgaggaccagttgggccttctgcgaggcccttaccctcgccaccggccccataaccaccctgtgggagggctcccccgggaagttctggaacaccactatcgcggtcagcatggccaacatcttcaggggctcctacctggccggtgccggcctcgcctttagcattatgaagtccgtggggacggggaaacggggtaccgggagccaaggcgagaccctgggcgagaagtggaagaagaagctgaaccagttaagccggaaggagttcgacctgtacaaaaagagcggtattaccgaggtggatcgcaccgaggcgaaggagggcctgaagcggggtgagatcacccatcatgctgttagccgcggcagtgcgaagctccagtggttcgtcgagcgcaacatggtgatcccggaggggcgcgtcatcgacctgggctgcggtagagggggctggagctactattgcgccggcttaaagaaggtgaccgaggtgcgtggatacacaaagggcggccccggtcacgaagaacccgtacctatgtccacctacggctggaatatcgtgaagctcatgtcgggcaaagacgtgttttacctgccgcccgagaagtgcgacacgctgctgtgtgacatcggggaatccagcccctcccccaccgtagaagaaagccgcaccattcgagtacttaagatggtcgaaccgtggttgaagaacaatcagttctgcataaaggtgctgaacccgtacatgcccaccgtgatcgaacacctcgagagactgcaacgaaagcacggagggatgctggtgcgcaaccccctgtcccgcaacagcacgcacgagatgtactggatctccaacggaaccgggaacatcgttagctccgttaatatggtgagcaggctactattaaaccggttcaccatgacgcaccgccggccgactatcgagaaggacgtagacctgggagccggtacccgacatgtgaatgcggagcctgagacgcccaacatggacgtcatcggggaaagaatccgccgcatcaaggaggaacactccagcacctggcactacgacgacgagaacccgtacaagacgtgggcctaccatggctcctacgaggtaaaggcgaccggcagcgcctcgagcatgatcaacggagtggtcaagctgctcaccaagccctgggacgtggtccccaccgtcacacagatggccatgaccgacaccaccccctttgggcagcagcgcgtgttcaaggaaaaagtggacacgcggactcctaagcccatgcccggaacgcgcaaggtgatggagataaccgcggagtggctgtggaggacgctgggaaggaacaagcggccacgcctctgcactcgggaagagtttaccaagaaggtccgcaccaacgccgcaatgggtgcagtgttcacagaggagaaccagtgggacagcgcgcgagccgcagtcgaggacgaggagttctggaagctggtcgatcgggagcgcgagctccacaaacttggcaaatgcggaagttgcgtgtacaatatgatgggcaagcgggagaagaagctaggggagtttggtaaagccaaaggcagccgcgccatctggtacatgtggttgggggcgcgatatctcgagttcgaggcgttggggttcctgaacgaggaccactggttctccagggagaactcatactccggtgttgagggcgaggggctccacaagttaggctacattctgcgtgatatcagcaagatcccgggcggagccatgtatgctgatgacaccgcggggtgggacaccaggatcaccgaggacgatctccacaacgaggagaagatcacacaacagatggaccccgagcaccgccagctggcgaacgccatcttcaagttaacctaccagaacaaagtggtgaaggtccagcgccccacccccaaggggaccgttatggacatcatctcccgcaaagaccaacgcggaagcggccaggtggggacgtacggcctcaacaccttcaccaatatggaagcacagctgattcggcagatggagggggagggcgtcctgtccaagacggacttggaaaaccctcatctgctggagaagaagatcacccagtggctcgaaacgaagggcgtggagcgcttaaagcggatggccatcagcggcgatgactgcgtggtcaaacccatcgacgaccggttcgccaacgcgctactagccttgaacgacatggggaaagttcggaaagacatcccccagtggcaaccctccaaggggtggcacgactggcaacaggtgccgttttgcagccaccacttccacgagctgattatgaaggatggccgcaagctcgtcgtgccctgccggccacaggacgagctgatcggacgtgcccgaatttcccagggcgccgggtggtctttgaaggagaccgcctgcctggggaaagcgtacgcccaaatgtgggccctgatgtactttcaccgtcgcgacctgcggctcgcctccaacgcgatctgcagtgccgtgcccgtccactgggttccgacctcgcgcacaacgtggtcgatacacgcccaccaccagtggatgaccaccgaggacatgttgaccgtctggaaccgggtctggatcgaggataacccctggatggaggacaagacgcccgtgactacctgggaggacgtgccctatttaggcaaacgcgaggaccagtggtgcgggtccttgatcggcctaaccagcagagccacgtgggcgcagaacatcttaactgcgatccagcaggtccgcagcctaatcgggaatgaggagttcctggactacatgccaagtatgaagcgattccgcaaggaggaggagctggagggcgccatctggtga

SEQ ID NO: 25618 - RNA, 9873 nt, synthetic construct
  misc_feature 1..9873: note = derived and/or modified CDS sequence (opt11) from DENV-3__AB189127__SS-prME
  source 1..9873: mol_type = other RNA
actagcctgtgcctcatgatgatgctgcccgcaactctggcatttcacctgaccagccgcgacggagagccgcgcatgatcgttgggaaaaacgagcgcggcaagagcctgttattcaagaccgccagtgggatcaatatgtgcaccctcatcgcgatggacctgggcgagatgtgcgacgacaccgtgacctacaagtgccccctgatcaccgaagtagagcccgaggacattgactgctggtgcaacttaaccagcacctgggtgacctacgggacctgcaaccaggccggcgagcaccgccgagacaagcgttccgtggccctggcgccccacgtcggcatggggctggacactcgcgcgcagacctggatgagcgccgaaggtgcctggcgccaggtggagaaggtcgagacgtgggccttccgccaccccgggttcaccatattagcactgttcctggcccactacattggaacctccctgacccagaaggtggtgatcttcatcctgttaatgctcgtaacgccctcaatgaccatgcggtgcgtgggggtgggcaatcgcgacttcgtcgagggcctgtccggggccacctgggtggatgtcgtcttagagcacggcgggtgcgtgaccacgatggccaagaacaaacccaccctcgacatagaactgcagaagaccgaagccacccagctagcgacgctccggaaactgtgcatcgagggcaaaatcactaacgtaaccaccgacagccgttgccctacgcagggcgaggccatcctgcccgaggaacaagaccaaaactacgtctgcaagcacacctacgtggaccggggatggggcaacggctgcggcctcttcgggaagggctccctggtgacctgcgctaagtttcaatgcctggagcttatcgagggcaaggtcgtgcagcacgaaaacctgaaatataccgtgatcatcacggtccacaccggggaccagcaccaggtgggcaacgagacccaaggcgtcaccgccgagatcacaccccaggccagcaccgtggaagcgatcttgcccgaatacggcacactcgggctggagtgctcgccgcggaccgggctggacttcaatgagatgatcttactgaccatgaagaataaggcttggatggtgcaccggcaatggttcttcgacttgccgctcccctggacgagcggcgctaccaccgaaacacccacgtggaacaagaaggagttgctggttaccttcaagaatgcccacgccaagaaacaggaggtggtggttctcgggtcccaggaaggcgcgatgcacaccgccctaaccggagccacggagattcagaccagcggcgggacctccatcttcgccggccacttaaaatgccgtctcaagatggataaactggagctgaagggcatgagctacgccatgtgctccaacgcgttcgtgctcaaaaaggaggttagcgagacccagcacgggacgatcctgattaaggtcgagtacaagggcgaggacgctccctgcaagatccccttcagcactgaggacgggcagggcaaggcccacaacggacggctgatcactgcgaaccccgtggtaaccaagaaggaggagcccgtaaatatcgaggcagaacccccgttcggggagagtaacatcatcatcggcataggggacaaggccctaaagatcaactggtacaagaagggcagcagcatcgggaaaatgttcgaggcaacggcccgcggagcgcggcgcatggcgatcctaggcgacaccgcctgggacttcgggagcgtgggcggggtgctgaactccctgggcaagatggtacaccagatcttcgggagcgcctacaccgccctcttctccggtgtgagctggatcatgaagatcggcatcggcgtgctgctcacttggatcggcctcaactctaagaacaccagtatgtccttcagctgcatagttatcgggataatcaccctatacttgggcgccgtcgtgcaggcagacatgggttgcgtcatcaactggaagggcaaggaattaaaatgcggctccggtatcttcgtgaccaacgaggtccacacctggacggagcagtacaagttccaggccgatagccccaagcggctggccaccgccatcgccggcgcgtgggagaacggggtatgtggcatcagatccacaactcgcatggagaacctgctctggaaacagatcgccaacgagctgaactacatcctgtgggagaataatatcaagttaacggttgtcgtaggggacatcatcggcgtactggagcagggcaagcggaccctgacgccccagcccatggaactcaagtacagctggaagacctgggggaaagccaaggtggttacggccgagatccagaactccagctttatcatcgacggccccaatacccccgagtgccccaatgcttcccgggcctggaacgtgtgggaggtggaggactacggattcggcgtcttcaccaccaacatctggctaaagctgcgcgagatgtacacgcagctttgcgatcaccgcctgatgtccgccgccgtgaaggacgagagagcgatccacgcggacatgggctactggatagagagccagaagaacggctcgtggaagctggagaaggcctccctcatcgaggtgaaaacctgcacctggcctaagtcccacaccctgtggagcaacggcgtcctagagagtgatatgatcatccctaagtccctcgccgggcctatctcccagcataactaccgacccggctatcatacccagacggccggcccgtggcatctgggcaaactggagctcgactttaactattgcgagggcacaaccgtggtgataaccgagaactgcggaacgcgggggcccagcctgcgcaccaccaccgtctccgggaaattaattcatgaatggtgctgccggagttgcacgctgccgcccctccgctacatgggcgaggacgggtgctggtacggcatggagatccggccaataaacgagaaggaagaaaacatggtgaagtcgttggtgagcgctggctccggcaaggtcgacaacttcaccatgggggtgctgtgcctggcaatcctgttcgaggaggtgatgcgcgggaaattcggcaagaaacacatgatcgccggcatcctctttatgttcgtccttctgctctctggccaaataacctggcgggacatggcccgcaccctgatcatgatcggatccaacgccagcgatcggatggggatgggcgtgacgtaccttgccctaatagcgaccttcaagatccagcccttcctggcccttgggttctttctccgtaagctgacctcccgggagaacttgcttctaggagtgggtctggcgatggccaccacgctccagctccccgaggacatcgagcagatggccaacgggatcgccctgggcctaatggccctgaagttaatcacacagttcgagacctatcagctctggaccgccctggtctccctgacgtgcagcaacaccatcttcaccctcaccgtggcctggcgcacggcgacactgatcctggccgggatctctctcctccccgtgtgccaaagctccagcatgcggaaaaccgactggctgccgatgacagttgccgccatgggagtgccgcccctgcccctgttcatattttccttgaaggacacgctcaaacgccgctcctggcccctgaacgagggggtcatggccgtgggcctcgtgagcatccttgcgagctccctgctgcggaacgacgtccctatggctggccccctggtcgccgggggcttactcatcgcgtgctacgtgatcacaggcaccagcgccgacctcaccgtcgaaaaggcggccgacgtgacatgggaggaggaagccgaacagaccggcgtctcccacaacctgatgatcaccgtcgacgacgacgggaccatgcgcatcaaggacgacgagacggagaacatactgaccgtattactgaagaccgccctgctaatcgttagcggcatcttcccctactcgatcccggcaaccctgctggtctggcacacctggcagaaacagacgcagcgtagcggtgttctctgggacgtccccagccctcccgagacccaaaaggcggagctggaggagggggtctaccgcatcaagcagcaaggcatctttgggaagacccaggtaggggtgggcgtccaaaaggagggcgtgttccacacgatgtggcacgtgacgcggggcgcggtactgacttacaatgggaagcgcttagaaccgagctgggccagcgtgaaaaaggacctgatcagctacggcgggggctggcggctgtccgcccagtggcagaagggggaagaagtgcaggtcatcgccgtagagcccggcaagaaccccaagaacttccaaaccatgcccggcatcttccagaccacgacgggggagatcggcgcgatcgcactggactttaaaccggggacctctggtagccccattattaaccgcgagggcaaagtcgtcgggctctacggcaacggtgtggtgaccaaaaacggcgggtacgtctccggcatcgcccagacgaacgccgagcccgacggcccgacccccgagctggaagaggagatgttcaagaagcggaaccttaccatcatggacctccaccccggcagcgggaagacccgcaagtacctgcccgcaatcgtgcgggaggcaatcaagcgccgtctgagaaccctcatcctggccccgacccgagtggtcgccgccgaaatggaggaggcgctcaagggcctccccatccgctaccagacaaccgccacgaagtccgagcacaccggcaaggagatcgtggacctaatgtgccacgccaccttcacgatgaggctgctcagcccggtgcgcgtccccaactataatctgatcatcatggacgaggcccacttcacggacccggcatcgatcgcggcccggggctacatcagcacccgcgtgggcatgggcgaagccgccgcgatcttcatgaccgccacacctcccgggacggccgatgcgttccctcagtcaaacgccccgatccaggacgaggaacgggacatccccgagcgctcatggaactccggcaacgactggatcaccgacttcgcggggaagaccgtgtggtttgtcccgtcaatcaaggccggtaacgacatcgccaactgtctgcgtaaaaacgggaagaaggtaatccagctttcacggaagaccttcgacacggagtaccagaagaccaagctgaacgattgggacttcgtggtcaccactgacatcagcgagatgggcgccaacttcaaggccgatcgcgttatagacccccggagatgtctgaagccggttatcctcacagacgggcccgagcgggtgatcctggcggggcccatgccagtgactgtggcctccgccgcccagcgccgggggcgcgtcgggcgaaaccctcagaaggagaatgaccagtacattttcacgggccagccactgaacaatgacgaggaccatgcccattggaccgaggcgaagatgctcttggacaacatcaacacgccggaggggattatccccgccttattcgagccggagcgcgaaaaatccgcagccatcgatggcgagtacagactgaaaggcgagagccgcaagaccttcgtagagctgatgcggcgtggggacctacccgtgtggctcgcgcacaaagtcgccagcgagggtatcaagtacaccgacaggaagtggtgcttcgacggggagaggaacaaccagatcctggaggagaacatggacgtggagatctggactaaggagggcgagaaaaagaaactgcggcccaggtggctcgatgccaggacctactccgatccgctggcccttaaggagttcaaggacttcgccgccggccgcaagagcatcgcgctcgacttagtcacggagatcgggagggtgccgagtcacctggcacaccggacacgcaacgcgctcgacaacctggtgatgctgcacaccagcgaacacggtgggcgggcttaccgtcacgcggtcgaggagctcccagagaccatggaaacgctcctgctcctgggactgatgatccttctgaccgggggcgcaatgttattcctcatcagcggcaagggggttggcaagacctccatcgggcttatctgcgtggtcgccagctccggcatgctgtggatggctgacatccccctccagtggattgccagcgcgatcgtgctggagttcttcatgatggttctgctcatcccggaaccagagaagcagcggactccccaagataaccaattggcgtacgtcgtgatcgggatcctgacgctagccgccatcgtggccgcgaacgagatgggcctgctggagaccaccaagcgtgacctcggcatgtccaaggagcccggggtcgtgccacccacaagctacctggacgtggatctgcaccccgcctccgcgtggacgctctacgccgtggccaccaccgtgatcacccccatgctgcggcacactatcgagaacagcaccgccaacgtgtccctagccgcgatcgccaaccaggccgtcgtgctcatgggcctggacaaggggtggcccatcagcaagatggatctgggcgtgcccctcctggccctggggtgctactctcaggtcaaccccctaacgttaaccgccgcagttttactcctggtgacgcattacgctatcattgggcctgggctgcaggcgaaggccacccgcgaggcccagaagcggaccgccgcagggatcatgaagaacccgactgtcgacggcattatgacgatcgacctcgaccccgtgatctacgacagcaagttcgagaagcaactgggccaggtgatgctcctcgtcctttgcgcggttcagctgctcctgatgcggacctcctgggccttctgcgaggccctgaccctcgcgacgggccccatcacgaccctgtgggagggctcgcccgggaagttctggaacaccaccatcgcggtgtccatggccaacatcttccggggaagctacctggccggggccggattagctttctccataatgaagtccgtcgggacgggcaagcgcggaaccggatcgcagggcgagactctgggggagaagtggaagaaaaagctgaaccagctcagccgaaaggagttcgacctgtacaagaaaagcggaatcaccgaggtggaccgcacggaggcgaaggaggggctgaagcggggcgaaatcacccaccacgcggtgtctcgcggcagtgctaagctccagtggttcgtcgagcggaacatggtgatccccgaggggcgagtgatcgacctgggctgcgggcggggcggctggtcttactattgcgccggcctgaagaaagtaaccgaagtgcgtggctacaccaagggcgggcccgggcacgaggagcccgtacccatgagcacctacggctggaacattgtcaagctcatgtcggggaaggacgtgttctatctgccacccgagaagtgtgacacgctgctgtgcgacatcggggagtcaagtcccagccccaccgtggaggagtcccggaccatccgcgtcctaaaaatggtggagccgtggctgaagaacaaccagttctgcatcaaggttctgaacccctacatgcccaccgttatcgagcacctcgagcgcctgcagcggaagcacggcggtatgctggttagaaaccccctgtcccggaactccacgcacgagatgtactggatatccaacggcaccgggaacatagtatccagcgtcaacatggtgtcgcgcctgctgctcaaccggtttaccatgacccaccgccgcccaacgatcgaaaaggacgtggacctgggcgccggcacccgtcacgtaaacgccgagcccgagacccccaacatggatgtgatcggggagcggattcgccggattaaggaggagcactcttccacctggcactatgacgacgagaacccgtacaagacgtgggcttaccacggaagctacgaggtcaaggccacgggttccgccagctctatgatcaacggcgtggtgaagctgctgaccaagccctgggacgtcgtgccaactgtgactcagatggccatgaccgacaccactcctttcgggcagcagagagtcttcaaggagaaagtggacacacggaccccgaagcccatgcccggcacccgcaaggtgatggaaatcaccgcggagtggctgtggcgaacgctgggccgcaataagcggccccggctctgcacccgggaggagttcaccaagaaggtccgaacgaacgccgccatgggggccgtgttcacggaggagaaccaatgggattccgcgcgcgccgccgtggaggacgaggaattttggaagctggtcgaccgggagcgcgagctacacaagctcggcaaatgcgggtcctgtgtgtataacatgatgggcaagcgggagaagaagctgggagagttcggaaaggccaagggctcccgcgccatctggtacatgtggctgggggctcggtatttggagtttgaggcgctgggtttcctgaacgaggaccactggttcagccgcgagaactcctacagcggggtggagggcgagggcctacataagctgggctacattctgcgggatatctcaaagatcccgggcggggccatgtacgccgatgacaccgccgggtgggacaccagaatcaccgaggacgacctccacaacgaagagaagatcacgcagcagatggaccccgagcaccggcagctggcaaacgcgatcttcaagttaacctaccagaacaaggttgtgaaggtgcagcgtcccacgcccaaagggaccgtcatggacatcataagccggaaggaccaacgcggatccggacaggtggggacttacggcctcaataccttcactaacatggaggcccagctgatccggcagatggagggggagggtgtgctgagcaaaaccgacttagagaacccacacctattagaaaagaaaatcacccagtggctcgagaccaagggggtcgagcgcctgaagcggatggccatctccggcgacgattgcgtggtgaaacccatcgacgaccgcttcgccaacgcgctgctcgccttgaacgacatgggcaaggtccggaaggacatcccgcagtggcagcccagcaaggggtggcacgactggcagcaagtcccgttttgttcccaccacttccacgaactgatcatgaaggatggccgcaagctcgtggtcccttgtcggccacaggacgagctgatcgggagagcccggatcagccaaggggccgggtggtcactgaaggagaccgcctgcctcggcaaggcgtacgcccagatgtgggccctaatgtactttcaccgccgcgacctgcggctcgcctctaacgcgatctgctccgccgtgcctgtgcactgggtccccactagcaggaccacctggtccatccacgcccaccatcagtggatgacgaccgaggacatgctgactgtgtggaatagggtctggattgaggacaacccctggatggaggacaagacacccgtaacgacctgggaggatgtgccctacctgggcaagcgcgaggaccagtggtgcgggagcctcattggcctgaccagccgggccacgtgggcccagaacattctgaccgcgatccagcaggtacgctccctcatcggtaacgaggagttcctggactacatgccgagcatgaagcggttcagaaaggaggaggagctagagggggccatctggtga

SEQ ID NO: 25619 - RNA, 9873 nt, synthetic construct
  misc_feature 1..9873: note = derived and/or modified CDS sequence (opt11) from DENV-3__AB189128__SS-prME
  source 1..9873: mol_type = other RNA
acctctctgtgcctcatgatgatcctgcccgccaccctcgccttccacctcacgtcccgggacggagaaccgcggatgatagtgggaaagaacgagcgcggcaagagcctgctgttcaagaccgcgtcagggatcaacatgtgcaccctcatcgccatggacctgggcgagatgtgcgacgacaccgtcacgtacaaatgccccctcatcaccgaagtggagcccgaggatatcgactgctggtgcaacctcaccagcacgtgggtgacgtacgggacctgcaatcaggccggcgaacaccgacgcgacaagcgatcagttgccttagcaccccacgtgggaatgggactggacacccgcacccaaacgtggatgagcgcggagggcgcctggagacaggtggagaaggtcgagacctgggccttccgccacccgggctttaccgtgctcgccctgttcctcgcgcactttataggcacctccctcacgcagaaggtggtcatcttcatcctgcttatgctcgtgactcccagcatgaccatgcgctgcgtgggggtcggcaaccgcgacttcgttgagggcctttccggggccacttgggtggacgtggtgctggagcacggcgggtgtgtcacgaccatggccaagaacaaacccacgctcgacatcgagctgcagaagaccgaggccactcagctggccaccctccggaagctgtgcatcgagggcaagattaccaacgtcaccacggactctcgctgccccacccagggcgaggcgatcctgcccgaggagcaggaccagaactacgtgtgcaagcacacatacgtggaccgggggtgggggaacgggtgcggcctcttcggcaaaggatccctggtaacctgcgccaagttccagtgcctggagagcatcgagggcaaggtggtgcagcacgagaacctcaagtacacggtcatcatcaccgtgcacaccggggaccagcaccaggtcgggaacgagacccagggggtgacggcggagataacccctcaggcctccaccgttgaggcgatcctgcccgagtacggcaccctgggcctcgagtgctcccccaggaccggcctggacttcaacgaaatgatcctgctcacgatgaagaacaaagcctggatggtccaccggcagtggttcttcgacctgccgctgccctggacctccggcgccaccaccgagactcccacctggaacaaaaaggaactcctggtgaccttcaagaacgcccacgccaagaagcaggaggtggtcgtcctgggaagccaggagggcgctatgcacaccgcgctcacgggggccaccgagattcagaccagcggcgggacgagcatcttcgctggccacctgaagtgccgcctgaagatggacaagctcgagctgaagggcatgtcctacgccatgtgcctgaacgccttcgtgctcaagaaggaggtcagcgagacccaacacgggaccattctcatcaaggtggagtacaagggcgaggacgcgccctgtaagatccccttcagcaccgaagacgggcagggcaaagcccacaacggccgtctgattaccgctaaccccgtggtcacgaagaaggaggagcccgtcaacattgaggcggagcccccgttcggggaatccaacatcgtgattggaatcggagataaggcgctgaagatcaactggtacaagaagggctcgtccatcgggaagatgttcgaggccacggcccgcggcgcccggcgcatggccatcttgggcgacaccgcgtgggacttcgggagcgtcggcggggtgctgaactccctgggcaagatggtgcatcagatcttcgggagcgcctacactgccctcttctccggcgttagctggatcatgaagatcggcatcggggtgctgctgacgtggatcggcctaaactccaagaacacgagcatgagtttcagctgcatcgtgatcgggattatcacgctatacctgggcgccgtcgtgcaggcggacaccgggtgcgtgatcaactggaagggcaaggagctgaagtgtggctcagggatcttcgttacgaacgaggtgcacacctggaccgagcagtacaagttccaggcggacagccccaagcggctcgccaccgccattgccggcgcctgggagaacggggtgtgtggcatccgctccacgacccggatggagaacctgctatggaagcagatagcgaacgagttgaactacatcctgtgggaaaacaacattaagctcaccgtcgtggtgggggacatcatcggcgtccttgagcagggaaagcggaccctgacgccgcagcccaccgagctcaagtacagctggaagacctgggggaaggccaagatcgtgacagccgagacgcagaactccagcttcatcatcgacgggcccaacacccccgaatgcccctccgccagccgcgcgtggaacgtgtgggaggtcgaggaatacggttttggagtgttcactaccaacatctggctgaagctgcgggagatgtacacccagctctgcgaccaccgcctgatgagcgctgcggtaaaggacgagcgggccgtccacgccgacatgggctactggatcgagtcccagaagaacgggagctggaagctggagaaggcatccctcatcgaggtgaagacgtgcacctggcccaagtcacataccctgtggtccaacggtgtgctggaaagcgacatgatcataccgaaatccctcgcggggcccatctctcagcacaactatcgccccggctaccacacacagacggcaggtccgtggcacctgggcaagctggagctcgacttcaactactgcgagggcaccaccgtcgtgatcaccgagaactgcgggacgcgaggcccctccctgcgcaccaccaccgtgagcgggaagctgatccatgagtggtgctgccggagctgcacgctaccacccttacgctacatgggcgaggacgggtgctggtatggaatggagatccgtcccatcaacgagaaggaggagaacatggtcaagagcctggtgtccgccgggagcgggaaggtggacaacttcaccatgggcgtcctctgcctggccattctgttcgaagaggtgatgcgcgggaagttcggcaagaagcacatgattgccggggtgctgttcaccttcgtgttgctgctctctggccaaatcacctggcgggacatggcccgcacgctgatcatgatcggcagtaatgcctccgaccggatggggatgggcgtaacctacctggcgctcatcgccaccttcaaaatccagccgttcttggcgctggggtttttcttacgcaagctgaccagccgggagaacctgctcctgggcgttggcctggccatggccactaccttgcagctgcccgaggatatcgagcagatggccaacgggatcgcgctgggcctcatggccctgaagctgatcacccagttcgagacctaccagttatggacggccctggtcagcctgatgtgctcgaacacaatcttcaccctcacggtggcctggagaacggccaccctgatcctggcggggatctctctcctgcccgtatgtcagtccagctccatgaggaagaccgactggctgccgatgaccgtcgctgccatgggcgtgccacccctccccctgttcatcttcagcctgaaggacaccctcaagcgtcgctcctggccgctgaatgagggggtcatggccgtaggacttgtgagcatactcgcctccagcctgctgcggaacgacgtccccatggcgggcccccttgtggcagggggcctgctgatcgcatgctacgtgatcaccggcaccagcgccgacctcaccgtcgagaaggccgcgaacgtcacgtgggaggaagaggccgagcagaccggtgtgagccacaatctgatgatcaccgtcgacgatgacgggaccatgcgcatcaaggacgacgagaccgaaaacatcctgaccgtgctcctgaaaaccgccttgctcatagtgtccggcatcttcccctacagcatacccgccactctgctggtctggcacacctggcagaagcagacgcagcggtcgggcgtgctctgggatgtgcccagtccacccgagacccaaaaggccgaactggaggacggggtctatcgcataaagcagcagggcatcttcgggaagacccaggtgggcgtcggggtccagaaggagggcgtgtttcacaccatgtggcacgtgacgcggggcgctgtactgacccacaacgggaaaaggctcgagccgaattgggcctccgtgaagaaggatctgatcagctatggcggaggctggcggttatcagcccaatggcagaagggggaagaggtgcaggtcatcgccgtcgagcccggaaagaaccccaagaacttccagacaatgcccggcatcttccagaccacgaccggggagatcggcgcgatcgccctggattttaagccggggacctctggcagccccataattaaccgcgagggcaaggtggtcgggctctacggcaacggtgtggttaccaaaaacggcggttacgtttcaggcatcgcccagacgaacgccgagcccgacggcccgacccccgagctggaggaggagatgttcaagaagaggaacttaaccatcatggacctccacccagggagcggtaagacccgcaagtacctgcccgcgatcgtacgggaggcgatcaaacgcagactacgcacgctcatcctggccccgacccgggtggtcgcggccgagatggaggaagccctgaaggggctccccatccgctaccagaccaccgcgacgaagtccgaacacaccggcaaggagatcgtggacctgatgtgccacgccaccttcaccatgcggctgctctccccggtgcgcgtccccaattacaacctgataatcatggatgaggcccacttcacggacccggccagtatcgctgcgcgggggtacataagcacccgcgtgggcatgggcgaagccgccgccatcttcatgactgcgacaccacccgggacggccgacgccttcccccaatccaacgccccgatccaggacgaggaacgggatatccccgagcgcagctggaactccggtaacgagtggatcaccgatttcgccgggaagaccgtgtggttcgtcccctcaatcaaagcgggaaacgacattgccaactgcctgcgcaagaacgggaagaaagttatccagctctcccggaagaccttcgacacggagtaccagaagaccaaactgaacgactgggacttcgtggtcaccaccgatatcagcgaaatgggcgccaatttcaaggcagatcgcgtaatcgacccccggcgatgcctaaagccagtgatcctcacggatggcccagagcgggtcatcctggccgggcccatgcccgtgaccgtagcttcagccgcccagcgccggggccgggtcgggcggaacccgcagaaggagaacgatcagtatatcttcaccggccagcccctaaataacgacgaggaccacgcccactggaccgaggccaagatgctcctggataacatcaacaccccggaggggatcatccccgcgctgttcgagccggagcgcgagaaaagcgccgccatcgacggcgaatatcggctcaaaggcgaatcccgcaagacgttcgtggaactgatgcggcgcggtgacttgcccgtctggctcgcccacaaggtggcgagcgagggaatcaagtacaccgaccggaaatggtgttttgacggggagcgcaacaaccagatcctggaggagaacatggacgtggaaatctggaccaaggagggcgagaagaagaagctgcggccccgctggctggatgcccggacatactccgaccccctggcgctcaaggagttcaaggacttcgccgccgggcgcaagagcatcgcgctcgacctggtaactgagatcgggcgcgtgccgtcacacctggcccatcggacccgcaacgcactcgacaacctggtgatgctgcacaccagcgagcatggagggcgagcctaccgccacgccgtcgaggaactccccgagaccatggagacgctgctgctcctgggcctgatgatcctcctgacagggggcgcgatgctgtttctcatcagtggtaagggtatcgggaagacctccatcggtctgatatgcgtggtggccagctccgggatgctgtggatggccgacgtgcctctccagtggatcgccagcgccatcgtgctggagttcttcatgatggtgctgctcatcccggagcccgagaaacagcgtacaccccaggacaaccagctggcgtacgtcgtgatcgggatcctgacgctcgcggctatcgtggccgccaacgagatgggcctgctggagacaaccaagcgcgacctcggcatgtcaaaagagcccggggtcgtaagccctatttcctacctggatgtggacctgcaccccgcgagcgcctggaccctctacgccgtggcaacgactgttataactcccatgctgcggcacaccatagagaactccacggcgaacgtgagcctggccgccatcgccaaccaagccgtcgtgctcatgggcctggacaaggggtggcccatctccaagatggacctgggcgtaccgctcctggcgctggggtgctacagccaggtaaaccctctcaccctgaccgccgccgtcctgctcctagtaacccattacgccatcatcggccccggactgcaggccaaggcgacgcgcgaagcccagaagcggactgccgccggtatcatgaagaaccccaccgtcgacgggatcatgaccatcgacctcgatccagtgatttacgactccaagttcgagaagcagctcggacaggtgatgctgctcatcctatgtgccgtccaactgctactgatgcgtacgagctgggcgttttgcgaggccctgaccttggccactggccccatcaccacgctgtgggagggctcccctgggaaattctggaacacgaccattgccgtgtctatggcgaacatcttccggggctcctacctggccggggccggcctcgccttcagcatcatgaagtcagtggggacaggcaagcgcggcacggggagtcaaggcgagacactgggggagaagtggaagaagaagctgaaccagctcagcaggaaggagttcgacctgtataagaagtccggcatcaccgaggtcgaccgtacagaggctaaggagggcctgaaacggggtgagatcacacaccacgccgtgagccgcggctccgccaagctacagtggttcgtggagcgtaacatggtcatccccgaggggcgcgtcatcgacctgggctgcggacggggcgggtggtcatactattgcgccggcctgaagaaggtgacggaggtccgcggctataccaagggaggcccggggcacgaggagcccgtacccatgtccacctatggctggaacatcgtgaagctaatgagcgggaaagacgtcttctacctgcctccggagaagtgcgacacattgttgtgcgacatcggcgagtccagcccctcccccacagtggaggagtctcgaaccatccgggtgctcaagatggtcgagccctggcttaaaaacaaccagttctgcatcaaggtgctgaacccgtacatgcccaccgtaatcgagcatctcgagcgcttacagagaaagcacggcgggatgctggtccgcaatcccctttcccggaactcgactcacgagatgtactggatctccaacgggacgggtaacatcgtcagctcggtgaacatggtgagccgcttacttctcaatagattcaccatgacccaccgccgccccaccatcgagaaggatgtcgacctgggtgccggcacgcgccacgtcaacgccgagccggagacccccaacatggacgtgatcggggagcggatccgccggataaaggaggagcactccagcacctggcattacgatgatgagaacccctataagacctgggcgtaccacggctcatacgaggtgaaagccacggggtctgccagctccatgatcaatggcgtcgtgaagctgctcacaaagccgtgggacgtggtccctacggtgacccagatggccatgacggacaccacacccttcgggcagcagcgcgtgttcaaggagaaggtcgacacccggacgccccgcccgatgcccggcacccggaaggttatggagatcaccgccgagtggctgtggcgcaccctcggccggaacaaacgcccacgcttatgcacccgcgaggagttcaccaagaaggtgcgaaccaacgctgcgatgggggccgtcttcaccgaggagaaccaatgggacagcgcccgggcggccgtggaggacgaagagttctggaagctggtggaccgggagcgggagctgcacaagctcggtaagtgcgggtcttgcgtctacaacatgatgggcaaacgcgagaagaagctaggggagttcggcaaggcaaagggcagccgagccatctggtatatgtggctgggggcccgctacctcgagttcgaagcgctggggttcctgaacgaggaccactggttctcccgggagaacagctactccggcgttgagggcgaaggactccataaactgggctacattctgcgcgatatcagtaaaatccccggcggggccatgtacgccgacgacacggcaggctgggacaccaggatcaccgaggacgacctccacaacgaagagaagatcacccaacagatggacccggagcatcgccagctggccaacgcgatcttcaaactgacgtaccagaacaaggtggtcaaagtacagcggcccacccccaaggggaccgtgatggacatcatctcccgcaaggaccagcggggcagcggccaggtcgggacctacggcctcaacacattcacgaatatggaggcccagctgatccgccagatggagggagagggcgtactgtccaaggccgacctcgagaacccccatctgctggagaagaaaattactcaatggctcgaggccgagggggtggagcggctgaaacgcatggccatcagcggtgacgactgtgtcgtgaagccgatcgacgaccggttcgcgaacgccctgctcgccctgaacgacatgggcaaggtgcgcaaggacatcccgcagtggcaaccgtccaagggatggcatgactggcagcaggtccccttctgtagccaccacttccacgagctgattatgaaggacggccggaagctcgtagtgccgtgccgcccccaggatgagctgataggtcgggcccgcatctcccagggagccgggtggagtctgaaagaaaccgcgtgcctcggaaaggcctacgcacagatgtgggccctgatgtacttccaccgtcgggacctgcgcctcgcgagtaacgctatctgcagcgccgtccccgtgcattgggtgcccacgtcccggacgacctggagcatccatgcccaccatcagtggatgacaaccgaggacatgctgacggtctggaaccgcgtgtggatcgaggacaatccgtggatggaggacaagacccccgtgactacctgggaggacgttccctacctgggcaagcgggaggaccagtggtgcgggagtctcatcggccatacgtcccgcgcgacctgggcgcagaacatcctgaccgccatccaacaggtgcggtccctgatcgggaacgaggagttcctggactacatgccttccatgaaacgcttccggaaggaggaggagagcgagggcgccatctggtga

SEQ ID NO: 25620 - RNA, 9873 nt, synthetic construct
  misc_feature 1..9873: note = derived and/or modified CDS sequence (opt11) from DENV-3__AB214879__SS-prME
  source 1..9873: mol_type = other RNA
accagcctgtgcctgatgatgatgctgcccgccaccctggccttccatctcaccagccgggacggtgagcctcggatgatcgtgggcaaaaacgagcgcggcaagagcctgcttttcaagaccgcttcagggatcaatatgtgcaccctcattgcaatggacctgggagagatgtgcgacgacaccgtgacatataagtgccccctgatcaccgaggttgagcccgaagacatagactgctggtgcaacctcacgagcacctgggtgacctacggaacctgcaaccaagccggcgagcaccggcgcgacaaacgatccgtggcgttagcgccccacgtggggatggggctggacaccaggacccagacgtggatgagcgcggagggcgcctggcgccaggtcgagaaagtcgagacatgggctttccgccaccccgggttcaccattctcgccctattcctggcgcactacattggcacctcactgacccagaaagtggtgatattcatcctactgatgctcgtcaccccgagtatgaccatgcggtgcgttggggtgggcaaccgcgacttcgtcgagggcctgagtggcgcgacttgggtggacgtggtcctggagcacggcgggtgcgttacgaccatggctaagaacaaacccaccctcgatattgagctgcaaaagaccgaggccacgcaactggccaccctccggaaactgtgcatcgagggcaagatcaccaacgtgaccacggacagccgctgccccacccagggcgaggcgatcctgcccgaggagcaggaccagaactacgtgtgcaagcatacctacgtggaccgggggtgggggaacggctgcggcctcttcgggaagggctccctggttacctgcgctaagttccaatgtttggagagcatcgagggtaaagtcgtgcagcacgagaatctcaagtacacggtaatcatcaccgtccacaccggggaccaacatcaggtgggcaacgagactcagggtgtgacggccgagatcacgccccaggcctcaactgtggaggctgtgctgcccgagtacggcaccctggggctcgaatgcagcccccgcaccggactggacttcaacgagatgatcctgctcacaatgaagaacaaggcgtggatggtccaccggcagtggttcttcgacttaccgctgccctggacctccggtgccaccactgagacgcccacctggaacaaaaaggagctcctggtaacgttcaagaacgcccacgccaagaagcaggaggtagtcgtgctggggagccaggagggcgctatgcacaccgcgttgacgggtgccaccgaaatacagacctccggggggaccagcgtgttcgccgggcacctcaaatgtcgactcaaaatggacaaactcgaactgaagggcatgtcctacgctatgtgttctaacgccttcgtcctgaagaaggaggtgtctgagacgcaacatgggaccatcctcatcaaggtggagtacaagggcgaggacgccccctgcaagatcccgttctccaccgaggacggtcaggggaaggcgcacaacggccggctgatcaccgccaaccccgtcgtgacgaagaaggaggagccggtgaacatcgaagccgagcccccgttcggggagagcaatatcatcatcggcatcggggacaaggctcttaagatcaactggtacaagaagggctccagcatcggaaagatgtttgaggccaccgcccgcggggccagacgcatggccatcctaggcgacaccgcgtgggacttcgggtccgtcggcggtgttctcaacagcctgggcaagatggtgcatcagatcttcgggagcgcctataccgcattattcagcggcgtctcctggatcatgaagatcggcatcggggtgctcttgacatggatcggcctgaactcaaagaacacctccatgtcattctcctgcatcgtcatcgggatcatcaccctctacctgggcgccgtcgtgcaggccgacatgggatgcgtgatcaactggaagggcaaggagctgaagtgcggcagtggtatcttcgtcaccaacgaggtgcacacctggaccgagcaatacaagttccaggcggacagtccgaagcggctcgctactgccatcgccggcgcctgggagaacggggtgtgcggcatccgcagcaccacgcgcatggagaacttactgtggaagcagatagcaaacgagctcaattacatcctgtgggagaacaatatcaagctgacagtcgtggtgggggatatcatcggagtccttgagcagggcaagcggactctgacgccccagcctatggagctgaagtactcctggaaaacgtgggggaaggccaagattgtgaccgccgagacccaaaactcatccttcatcatcgatggtcccaacacccccgagtgcccaagcgccagccgcgcgtggaacgtatgggaggtcgaggactacgggtttggcgtgtttacgacaaacatctggctcaagctgcgggagatgtacacccagctgtgcgatcaccgattaatgtccgccgctgtgaaggacgagcgggccgtacacgccgacatgggatactggatcgagagccagaagaacgggtcctggaagctggagaaggcaagcctgatcgaagttaagacctgtacctggccgaagtcccatacgctctggagtaacggcgtgctagagtccgatatgataatccccaagagcctggccgggccaatctcccagcacaactatcgccccggctaccacacccagaccgccgggccctggcacctcggcaaactggagctcgatttcaactactgcgaaggcactacggtcgtgatcaccgagaattgcggcacccggggccccagcctcaggaccacgaccgtgtctgggaagctgattcacgagtggtgctgccggagctgtacgctgccccccctgcgctacatgggcgaagacgggtgctggtacggcatggagatccggccgatcaacgagaaggaggagaacatggtcaagtcactagtgagcgccggctccgggaaggtggacaacttcaccatgggcgtcctgtgcctagccatcctgttcgaggaagttatgagagggaagttcggcaagaaacacatgatcgcgggggtgctattcacgttcgtcctcctgctgagcggccagatcacctggcgggacatggcccgcacactcatcatgatcggcagcaacgccagcgaccggatggggatgggcgtaacctatctggccctgatcgccacattcaaaatccagcccttcctcgctctgggatttttcctgcgtaagctcacctcccgggagaacctgctgctcggcgtgggcctggccatggccaccaccctgcagttacccgaggacatcgagcagatggccaacggaatcgcgctcggtctgatggccctcaagctgattacgcagttcgagacctaccagctgtggaccgcccttacctccctgatgtgctccaacacgatctttaccctcacggtcgcctggcgcaccgccacgttgatcctggcggggatctcactgctcccagtgtgccagagctccagcatgcggaagaccgactggctcccgatgacggtcgccgcgatgggggtgccgcccctccccctcttcatcttctccctgaaggacacgctgaagcgccgcagctggccgctcaacgagggggtgatggccgtcggcttggtttccatcctggcgtcatccctcctacggaacgatgtgcccatggcgggccccctggttgccggcggcctcctgattgcctgctacgtcattactgggacgagcgctgatcttaccgtagagaaggccgcggacgtcacctgggaagaggaggccgagcaaacgggcgtctcccacaacttaatgataaccgtcgacgacgacgggactatgaggatcaaagatgacgagaccgagaacattctgaccgtccttcttaagacggcccttctgatcgtgagcggaatcttcccctactccatcccggccaccctcctggtgtggcacacctggcagaaacaaacccagcgtagcggcgtcctatgggacgtgcccagtccgcccgagacgcagaaagccgaattagaggagggggtgtaccgcataaaacagcagggcatcttcgggaagacccaggtcggcgtgggggttcaaaaggagggcgtcttccacaccatgtggcacgtgacccggggagcagtgttaacgcacaacgggaagaggctggagccgaactgggcgagcgtcaagaaggacctcatctcctacggcgggggctggcggctgagcgcccagtggcaaaagggggaggaggtccaggtgatcgccgtcgagcccggtaagaacccgaagaacttccagaccatgcccggcatcttccagaccaccacaggcgaaatcggtgcgatcgccctggacttcaagccggggacctcgggttcccccataatcaaccgcgagggcaaggtggtggggctgtacggcaacggggtcgtgaccaagagcggagggtatgtgtccggaattgcccagacaaatgccgagccagacggcccgacgcccgagttagaggaggagatgttcaaaaagcggaacctgaccatcatggacctgcatcccgggagcggtaagacccgcaaatacctacctgccatcgtacgggaagcgatcaagcgacggcttcgtactctgatcttagccccgacgcgggtggtggccgccgagatggaggaggcccttaaggggctgcccatccgctaccagacaaccgcgaccaagagtgagcacacgggtaaggagattgttgacctcatgtgccacgccaccttcactatgcgactgctgtctcccgtgcgcgtgcctaactacaatctcatcataatggacgaggcccacttcactgacccggcttccatcgccgcccgcgggtacatctctacgcgcgtcggtatgggcgaggctgccgccatttttatgacagcgacgcctcctggaacagcagacgccttcccccaaagtaacgccccgattcaggacgaggagcgggacatccccgaacgctcctggaactccggaaacgactggatcacggatttcgctgggaaaaccgtctggttcgtgccaagtatcaaggctggcaatgacatcgccaattgccttcgcaagaacgggaagaaagtcatccagctgtcacggaaaactttcgacaccgaataccagaagaccaaactcaacgactgggacttcgtggttacaaccgacatcagcgagatgggcgctaacttcaaggcagaccgcgtcatcgaccccaggcgctgtctgaagcctgtgatcctgaccgacggccccgagcgggtgatcctcgccgggcccatgcccgtgacggtggcgtccgccgcccaaaggagaggccgcgtggggcggaacccgcagaaggagaacgatcagtacatcttcaccggccagccgctgaataacgatgaggaccacgcccactggaccgaggccaaaatgctgctcgacaacatcaacacccccgaggggatcatcccggcgctgttcgagccagaaagggagaagagtgccgctatcgatggcgagtaccggctgaaaggcgagtccaggaaaacgttcgtcgagctcatgagacgcggggacctgcccgtgtggctggcacacaaagtcgcgagcgagggaatcaagtacacagaccggaagtggtgctttgacggggagcgaaacaaccagatcttggaggagaacatggacgtggagatttggaccaaggagggcgagaagaagaagttgcggcctcgttggctggatgcccggacctactctgaccccctcgctctgaaggaattcaaggatttcgctgccggacgcaagtcgattgcgttcgaccttgtgaccgagatcgggcgcgtcccgagccacctcgcccaccggacgcgcaatgccctggacaacctggtgatgctccacacctccgaacacggaggacgggcctatcgccacgcagttgaggagctgcccgagacaatggagaccctgctcctgctgggcctgatgatcctgttgaccggcggggcgatgttattcctgatatctgggaaagggatcggaaagacctccatcgggctgatctgcgtagtagccagctccggcatgctctggatggccgacatacccctgcagtggatcgccagcgccatcgtgctggaattcttcatgatggtcctcctgatcccagagcccgaaaagcagcgcacgccccaggacaaccagctggcgtacgtggtgattgggatattgaccctggccgccattgtcgccgccaatgagatgggactgctcgaaacgaccaagcgcgacctgggcatgtccaaggagccgggggtggtgtccccgacctcctacctggacgtcgacctccacccggcttcagcctggactctgtacgccgtggccacgaccgtgatcacccccatgctaaggcacaccatcgagaactccacggcgaacgtctccctcgccgccatcgccaatcaagccgtggtgctaatgggcttagacaagggctggcccatctccaagatggacctcggcgtcccgctcctggcgctcgggtgttatagccaagtgaaccccctgaccctgaccgctgccgttctcctgctggtcacccactacgccatcattggccccggcctacaggccaaggcgacgcgcgaggctcagaagaggaccgccgccgggatcatgaagaaccccaccgttgacggcatcatgaccatcgacctggacccggtgatctacgactccaagtttgaaaagcagctggggcaagtcatgcttctggtactgtgcgccgttcagctcctcctgatgcgcacgagctgggcgttttgcgaagccctcaccctggccaccggccccatcaccaccttgtgggagggatcacccgggaagttctggaataccaccatcgcggtcagcatggcgaacattttccggggttcttacctcgccggcgcaggcctggccttcagtatcatgaagtccgtgggcaccgggaagcggggcacggggagtcagggcgagaccctgggggagaagtggaagaagaagttaaaccagctaagccggaaagaatttgacctgtataagaagtccggcatcaccgaagtggaccgcaccgaagccaaggaagggttaaagcgaggcgagatcacccaccatgcggtcagccgcggctccgccaagttacagtggttcgtggagcgaaacatggtaatccccgaggggagggtcatagacttgggctgcggacgcggggggtggtcctactattgcgccggcctcaagaaggtaacggaagtgcgaggctacactaagggaggaccggggcacgaggagcccgtccccatgtcaacctacggctggaacatcgtgaagctgatgtctgggaaggatgttttctacctacccccggagaagtgcgacaccctcctctgcgacattggcgaatctagtcccagcccaacggtcgaggaaagcagaaccatccgcgtactgaagatggtggaaccctggctgaaaaacaaccagttctgtataaaggtcctcaatccgtacatgcccaccgtaatcgagcacctggaacgcctccagcggaagcatggcggtatgctcgtgcgcaacccgctctcccggaacagcacacacgagatgtactggatatccaacggcacggggaacatcgtcagctccgttaacatggtgagccgcctgctcctaaacagattcaccatgacctatcgccgtcccaccatcgagaaggacgttgacctaggcgccggcacccgccacgtgaacgccgaaccggagacccccaacatggacgtaattggtgagcggatccgtcggatcaaggaggagcactccagcacttggcactatgacgacgagaacccttataagacgtgggcgtaccacggcagctacgaggtgaaagccacggggagtgccagctccatgatcaatggcgtggtcaagctcctgaccaaaccgtgggatgtggtgcccaccgtcacccagatggcgatgacagacacaacccccttcgggcagcagcgtgtgttcaaagagaaggtggacacccggaccccaaaaccgatgcccggcacccgcaaggtcatggagatcaccgccgaatggctgtggcgaaccctcgggcgtaacaagcgaccccgcctgtgtactcgtgaagagttcacaaagaaggtgcgcaccaatgcggcgatgggggccgtgtttaccgaggagaaccagtgggacagcgcccgggccgccgtcgaggacgaggagttctggaagctggtggaccgggagcgagaactccacaagctggggaagtgcggttcctgcgtgtacaacatgatgggcaagcgggagaagaagctgggggagttcggcaaggccaaaggctcgcgcgccatctggtacatgtggctcggggccagatacctggagttcgaggcgctgggcttcctcaacgaggaccactggttctcccgcgagaacagctactccggggtagagggcgagggcctgcacaagctgggctacatcctccgcgacatcagcaagatccccgggggggccatgtatgccgacgacacggctggctgggacactcgcatcaccgaggacgacctgcacaacgaggagaagatcacccaacagatggaccctgaacaccggcagctggcaaacgcgatcttcaaactcacgtaccagaacaaggtggtaaaggtccagcgccccacacccaaggggacggtaatggacattatctcccggaaagatcaacggggctcaggccaggtgggaacctacggcctgaacaccttcactaacatggaagcccagctgatccggcagatggagggggagggagtactttccaagaccgacctggagaacccccacctcctcgagaaacgcatcacccagtggctggagaccaagggggtggagcgtctgaagcgcatggccatcagcggcgacgactgcgtcgtcaagccgatcgacgaccggttcgccaacgccttactggcactgaacgatatgggtaaagtgcgcaaggacataccccagtggcagccttcaaaggggtggcacgactggcagcaggttcccttctgcagccaccatttccacgagctcataatgaaagacggcaggaagctggtcgtgccttgccgtccccaggacgagctgatcgggcgggcccgcatatcccagggcgcggggtggagcctcaaggaaaccgcctgcctggggaaggcctacgcgcagatgtgggccctgatgtattttcaccgccgggacctccggctcgcctccaacgcaatctgcagcgcggtgcccgtccactgggtgcccaccagcaggaccacctggtccattcacgcccaccatcagtggatgacgaccgaggacatgcttacggtatggaaccgcgtgtggatcgaggacaacccttggatggaggacaagacaccggtgacgacttgggaggatgtcccctacttaggcaaacgggaggaccaatggtgcgggtcgctgatcggcttaacctcccgcgccacctgggcccagaacatcctcacggccatccagcaggtccggagcctgatcggaaacgaggagttcctggactatatgccttccatgaagcgctttcgtaaggaggaggagagcgaaggcgcgatctggtga

SEQ ID NO: 25621 - RNA, 9873 nt, synthetic construct
  misc_feature 1..9873: note = derived and/or modified CDS sequence (opt11) from DENV-3__AB214880__SS-prME
  source 1..9873: mol_type = other RNA
accagcctgtgcctaatgatgatgttacccgccacgctggcgttccacctcacctccagagatggggaaccccgcatgatcgtcggaaagaacgaaagagggaaatcactattattcaaaacagcctcagggataaatatgtgtacactgatagctatggatttaggagaaatgtgtgacgacacagtgacgtataaatgccccctaatcaccgaagtcgaacccgaagacattgactgctggtgcaacctgacctcaacttgggtcacctatggaacatgcaaccaagcgggggaacaccgtcgggacaaaaggagtgtggcgctggctccacacgtcggaatggggctggatacaaggacacaaacgtggatgtccgcagaaggggcatggcgacaagttgaaaaagtcgaaacctgggccttcagacaccccggcttcacaatactagcactcttcttagcacactacataggaacttctctaacccaaaaagtcgtaatattcatccttctgatgttggttacgccaagcatgacgatgcgatgtgtcggtgtgggaaaccgagatttcgttgaaggattatcaggtgcgacttgggtcgacgtggtattggaacacggagggtgcgtaacaaccatggccaaaaataaaccaactctggatatagaactccagaagacggaagcaacacaactagcgacccttagaaaactctgcatagaaggaaagattactaatgtaacaacggacagtcgctgcccgacccaaggcgaagcaatccttcctgaagaacaagaccaaaactacgtatgcaaacatacctacgtagaccgcggatggggcaatggatgcggtctgtttggaaaagggagcctagtaacctgcgcgaagttccaatgccttgaatccatcgaaggcaaagtcgtacaacacgaaaatctgaaatacacagtcatcatcacagtacacacgggtgatcaacaccaggtcggaaacgaaacacaaggggtcaccgccgaaataacaccacaggcgtcaacagtcgaagccgtactgccggaatacggcacactcggactagaatgcagccctcggacaggactggactttaacgaaatgatcctcctaacaatgaagaacaaagcgtggatggtgcaccggcaatggttcttcgatctgccgctgccctggacatccggcgcaaccaccgaaaccccgacctggaacaagaaagagcttttagttacgttcaaaaacgcacacgccaagaaacaggaagtggtagtacttggcagccaggagggagccatgcataccgcgctcacaggggccacggaaatacagacatccggaggcacgagcatatttgctgggcatttgaaatgccgtctgaagatggacaaactagagctgaaaggcatgagttacgctatgtgcagcaacgccttcgtacttaagaaggaagtctccgagacgcagcatgggacgatcctcatcaaagtagagtacaaaggcgaagacgccccttgcaagatcccattcagcacagaagacggacaaggaaaagcacacaacgggcgacttatcacagcaaacccagtggtcacgaagaaagaggagccggtcaacattgaagccgaaccacccttcggggagtcgaatataattatcggaatcggtgacaaagcgctcaagatcaactggtacaagaagggaagcagcattggcaaaatgttcgaggccaccgcaaggggtgcccggcggatggcaatcttgggcgatacagcatgggatttcgggtccgtaggcggcgttctcaatagcctgggtaagatggtacaccaaatattcggctcagcttacacagcattgttcagcggcgtcagttggatcatgaaaattggaatcggtgtactgctgacttggatcggactaaattccaaaaacacctcgatgtcattctcgtgcatagttataggcatcataacactataccttggcgcggtagtacaagccgacatgggctgcgtgattaattggaagggaaaagagctaaaatgcggatccggcatattcgtcaccaacgaagtccacacgtggactgaacaatacaaattccaagcagattcaccgaagaggcttgccacagccatagccggcgcatgggaaaatggagtctgcggcatcaggagcacgacccgaatggaaaaccttctctggaaacaaattgcaaacgaactgaactacatcctctgggaaaacaatattaaactaaccgtagtcgtgggggacataattggtgttttggagcaagggaaaagaactctcacacctcagcctatggaactaaagtattcatggaaaacatggggaaaagccaaaatcgtcacggcagagacccaaaatagttccttcataatagacggcccaaacacacccgagtgcccatccgcgagtagggcatggaacgtatgggaagtggaagactacggtttcggggtgttcacaacgaacatctggctcaaactgcgcgaaatgtacacccaactctgcgatcaccgcctaatgtctgcggcggtaaaagacgaaagagccgtgcacgcggacatgggttattggatagagagccagaaaaacgggtcctggaagctagaaaaagcgagcctgatcgaggtaaagacatgtacatggccaaaaagccacacgctatggagtaacggtgtcctagaatctgacatgataatcccgaaaagccttgccggacccataagccaacataattacaggcctggctaccatactcaaactgcaggcccgtggcatcttggtaaactcgaattagacttcaactattgcgaaggaaccacagtcgtaataacagagaactgcggcaccaggggaccgagtctcaggactacaacagtcagcgggaagctgatacacgaatggtgctgccgcagttgcacattgccacctttgcgctacatgggggaagacggatgctggtacggaatggagatccgtccaataaacgagaaggaagagaacatggtcaaatccctcgtctcggcgggctcaggaaaggtcgataacttcaccatgggtgtactctgcctagctatcctattcgaagaagtcatgagaggaaagttcggcaagaaacacatgatagctggtgtactcttcacattcgtcctacttctttctggccagatcacgtggagagacatggccagaacgctcatcatgattggaagtaatgcaagcgacagaatgggcatgggcgtcacctatctggctctaatcgcaaccttcaaaattcagccattcctggcactaggcttctttctgcgaaaacttaccagcagagaaaacctcctcctaggagtcgggctggcaatggcaacaaccttgcaactaccagaagacatcgaacagatggcaaacggaatcgcgctcggcctgatggcgctaaaattaataacgcagttcgaaacataccaactgtggaccgcactagcgagcctaatgtgtagcaacaccatctttacattaacagtcgcttggcggacagctaccctgatcctggccggcatatcactcctcccagtctgtcagagtagtagcatgagaaagacggactggctccccatgacagtagcggcaatgggggtaccacccttacccctctttatattctcgctaaaagacaccctaaagcgcagatcctggccactgaacgaaggagtaatggccgttggcctggtctcgatactcgccagcagcttactacgaaacgacgtccccatggcaggcccactcgttgctggcggcctgctgatagcctgctacgttatcaccggaaccagcgccgacctcaccgtcgagaaagccgccgatgtgacatgggaggaagaggcggagcagactggggtaagtcacaatctcatgataacagtggacgatgacggaaccatgcgaatcaaagacgacgaaacggaaaatatcctaactgtactactaaaaaccgcactccttatcgtaagtgggatttttccgtactccataccagccacattactcgtatggcacacttggcagaaacagacacaacgctcgggcgtcctctgggacgtcccgtcaccacccgaaacacagaaagcggaactagaagagggcgtctacaggatcaaacaacaaggaatattcggaaaaacgcaagtaggtgtaggggtccagaaagagggtgtcttccacaccatgtggcacgtgaccagaggagccgtcctcacccacaatggaaaacggctcgagccgaactgggccagcgtcaagaaagacctaatctcatatggcggtggctggagactcagcgcgcaatggcaaaaaggggaagaggtacaagtcatcgcggtcgaaccggggaagaacccaaagaacttccaaacaatgccaggcatcttccaaactactacaggtgaaatcggagccatagccctcgactttaaacccgggacctcgggaagtcccataatcaaccgggaaggaaaagtggttggactatatggtaacggcgtcgtcacaaagtcaggcggatacgtgtcaggcatcgcacaaaccaacgcggagcccgacggcccaacccctgaactggaagaagaaatgtttaagaaacgcaatttaactatcatggacctacacccgggcagcgggaagactcgcaagtacctgccggcaatagtccgagaagcaataaaaaggagactaaggaccttaatactggcaccaacgcgcgtcgtagcagccgagatggaggaagcgctaaaaggcctccccataagataccagacgactgccactaaatcggaacacaccggcaaggaaatagtcgacctgatgtgccacgctacttttaccatgaggctactaagccctgtcagggtgccaaactacaacttaataatcatggatgaagcgcatttcacagatccagcatcaatagcagcacgggggtacatctcaactcgggtgggcatgggagaagcagcagcaatattcatgacagcaacgccgccaggaacagctgacgcattcccgcaatctaatgcgcccatacaggatgaagagagagacataccagagaggagctggaactctggtaatgactggatcacagacttcgctggcaagaccgtgtggttcgttcccagcatcaaagcgggtaacgatatcgccaactgcttgaggaaaaacggaaagaaagtaatccagttgtctaggaagaccttcgacaccgaataccagaaaacgaaactgaacgattgggattttgtcgtcacaactgacatcagcgaaatgggggcgaacttcaaagcggacagagtcatagacccaagacgctgcctaaaacccgtgatcctaacagacggcccagagcgagttatactcgccggaccaatgcccgtcacggtagcatcggccgcacagcggcggggaagagtcggccgtaacccgcaaaaagaaaacgaccaatatatctttaccggacaacccctaaacaacgacgaagaccacgcacattggacagaggccaagatgttactggataacatcaacacccccgagggtatcatcccggcgttatttgagcccgaaagagaaaaatctgcggcaatagacggcgagtatcgcctcaaaggagaatccaggaaaacattcgtagagcttatgagacgcggcgacctgccagtatggctggcacacaaagtagcttcggaggggataaaatatacggatagaaaatggtgcttcgacggtgagcgaaacaaccaaatattagaagaaaacatggatgtggaaatatggacgaaagaaggggagaaaaagaaactgcgtcctcgctggctcgatgcaagaacgtatagcgaccccctcgcactgaaagagttcaaagactttgcggcaggacgaaagtctattgcttttgacctggtcaccgagatcggacgcgtaccatcacacctagcacataggacaaggaacgcccttgataaccttgtgatgctacacaccagcgaacatgggggccgggcttatagacacgccgtcgaggagcttccggaaaccatggaaactcttctactactcggcctcatgatcctactaacgggcggggccatgctttttcttatatcgggaaaaggcataggaaaaacatcaataggcttaatatgcgtggtagctagctcaggtatgttgtggatggccgatatcccactacagtggatagcaagcgcaatagtccttgagttctttatgatggtattactaatacccgaaccggaaaaacagagaacaccgcaagataaccaactcgcgtacgtagtgatcggaatcctaacgctcgcggccatcgttgcagcgaacgaaatggggctgttggagacaaccaagcgagaccttggtatgagcaaagagcccggggtagtatcgccaacaagctacttggacgtagacctgcatccggcgtcggcctggacactatacgcggtggccactaccgtgataacccctatgctacgccacacaattgaaaactcaacggcaaacgtaagtctggcggccatagccaaccaagcggtcgtcctcatgggcctcgacaaagggtggccaataagtaaaatggacttgggagtacccttactggcactcgggtgttacagccaggtcaatcccctaacgctgaccgccgcggtactactcctagtcacacattacgcgatcatcggcccaggactacaggccaaggctacccgcgaagcgcagaaacgaaccgcggcaggcataatgaagaatcccacggtggatggaataatgacgatagacctcgacccggtaatatatgacagcaaattcgaaaagcagctcggacaggtcatgctactggtactatgcgctgtccagctcctcctaatgcggacatcatgggctttctgcgaggccctgacactagcaacgggccccataaccaccctctgggaagggagtccaggaaaattctggaacaccaccatcgcagtcagcatggcaaacatcttcagaggatcgtacttagcgggcgcaggtctagcgttctcaatcatgaagtcggttggcacggggaaacgtggaaccggatcgcagggcgaaacgctcggcgaaaaatggaagaagaaactaaaccaactctcacgcaaagagttcgacctttacaagaaaagcgggataactgaggttgaccgcaccgaagcgaaagaagggctgaagcgaggtgaaattacacaccacgccgtgagtcgcgggagcgcgaagctccagtggtttgtggagagaaacatggtcatccccgaaggacgagtgatcgacctcgggtgcggtagaggaggctggagctactactgcgccggactcaaaaaggtcactgaggtacggggctacaccaaaggagggcccggccacgaagaaccagtacccatgagcacatacggttggaacatagtcaaattaatgagcggaaaggacgtgttttacctacccccggagaaatgcgacacactactgtgcgacatcggcgagtcgagtccgagcccaacggtcgaggaaagccggaccataagagtgttgaaaatggtagaaccatggctgaagaacaatcagttctgtattaaagttctaaacccttatatgcccacagtaatcgaacatctcgaacggctgcaacggaaacacggtggcatgctggtccggaaccccctatcccgcaacagtacccacgagatgtattggataagtaatggaacgggtaacattgtgagcagcgtaaacatggtcagccgactcctgctgaacaggtttacgatgacatataggagaccaacgatagagaaagacgtagatctgggcgcgggcacaagacacgttaacgcggagccagagacgcctaacatggatgtgatcggggaacgaatcagacggataaaggaggaacacagctccacgtggcactacgacgacgagaacccatacaagacgtgggcataccacggatcctacgaagtaaaagcgaccggaagtgccagcagcatgataaacggggttgtgaagctactaacaaaaccatgggacgttgtcccgactgtcactcaaatggcgatgactgatacgacacccttcggacaacaaagggtgttcaaagagaaggtcgacaccagaactcccaagcccatgcccgggacgcggaaggtcatggagattacggctgaatggttgtggcggacactcggacgcaacaagaggccgcgtctatgtacaagagaagagttcaccaagaaagtccgaacgaacgcggcaatgggcgcggtatttacggaagaaaatcaatgggactccgcgagagctgctgtagaggatgaagaattttggaagctagtagacagagaacgtgaactccataaactgggaaaatgcggaagctgcgtgtacaacatgatgggtaaacgagagaagaaactgggggagttcggaaaggcgaagggcagtcgggccatctggtacatgtggcttggcgcaagataccttgagttcgaagccctaggctttctgaatgaagatcactggttcagcagagaaaattcttactccggggtagagggtgagggcctccacaagctagggtacattctgagggatatttcgaagatcccaggcggcgcaatgtacgccgacgacaccgcagggtgggatacacgcataactgaagatgacctccataacgaggagaaaatcactcaacagatggaccccgagcaccgccaattggcaaacgcgatattcaaacttacataccagaataaagtagtcaaagtgcaaaggcccacaccaaaagggacggtaatggacataattagcagaaaagatcaacggggcagcgggcaagtaggaacttacgggctaaatacgttcaccaacatggaggcccagctcataagacaaatggaaggtgaaggcgttctcagtaagacagacctagagaacccacatcttctagagaaaagaataacacaatggttagaaacaaagggtgtagagcgattaaagcgaatggccatatcgggtgacgactgcgtggtcaagccgatcgacgaccggttcgccaacgcccttctagcgctaaatgacatgggcaaagttaggaaggacattccgcaatggcaaccaagcaagggatggcacgactggcaacaagtcccattctgctcccaccatttccatgagcttatcatgaaggacggacggaaacttgtagtaccctgcaggccacaagatgaactaattggccgcgcccgcatctcgcagggcgccgggtggagcctcaaggaaacggcctgcctaggcaaggcatacgcacaaatgtgggccctaatgtacttccaccgacgggacctccgtctagccagcaacgccatatgctcggccgtgcccgtccactgggtcccgacatcaaggaccacatggagcatacacgcacatcatcaatggatgactacagaagacatgctcacagtatggaatcgagtttggatcgaggataatccatggatggaagataaaaccccggtcacgacatgggaggacgtgccatacctaggcaaacgcgaggaccaatggtgcggctctctaataggactgacctcacgagcgacttgggcacaaaacatattaaccgcaatccaacaagtccgctccctaatcggtaatgaggagttcctcgactatatgccctcgatgaaaagattccggaaagaggaagaaagcgagggtgcaatctggtag

SEQ ID NO: 25622 - RNA, 9873 nt, synthetic construct
  misc_feature 1..9873: note = derived and/or modified CDS sequence (opt11) from DENV-3__AB214881__SS-prME
  source 1..9873: mol_type = other RNA
acttccctctgcctcatgatgatgctgcccgcaacgttggcgtttcacctaacatcgcgggacggggaaccgagaatgatagtaggcaaaaatgaaagggggaagtcgctactcttcaagaccgcatcgggtataaacatgtgtacgctcatagcaatggacctcggtgaaatgtgcgacgacacagttacatacaagtgcccactgataacggaggtagagcccgaagatatcgactgctggtgtaacttgacgagcacgtgggtcacctacgggacgtgcaatcaggcaggcgagcaccgacgagataaaagaagcgtggcactagcaccgcacgtagggatggggctggacacccggacccaaacatggatgtccgccgagggcgcctggcgacaggttgagaaggttgagacctgggccttccgccacccaggcttcaccatcttagcactattcctagcccactacataggaacctcgttaacacagaaggtcgtaatatttatcctcttaatgctcgtaacaccctctatgaccatgcgctgcgtgggagttggcaaccgggactttgtagaaggtctcagtggggcgacatgggtggacgtagtattggaacatgggggctgtgtaacaacaatggcaaagaacaagcccaccctagacatagaactccaaaagacggaagctacacagttagccacactccggaaactttgcatagaagggaaaattacgaacgtaaccacagactcacgatgcccaacacaaggagaagccatcctaccagaagaacaagaccaaaactacgtatgcaagcacacctacgtggatagaggatgggggaatggatgtgggctgttcgggaaggggtctttagtcacatgcgcgaaattccaatgcctagagtcaatagaagggaaagtggtgcaacacgagaatctgaagtacacagtgatcatcacggtgcacacgggggaccaacatcaagtaggcaacgaaacacagggcgtcaccgccgagatcaccccacaagcatcaaccgtcgaagcggtcctcccagagtacggcacgctaggcctagagtgcagcccaaggacaggcctagactttaatgaaatgatcttactaactatgaaaaacaaggcgtggatggtccatcgtcaatggttctttgacttacctcttccctggacaagcggcgcgaccaccgaaacaccaacctggaataaaaaggaacttctcgtgacattcaagaacgcccacgcaaagaagcaagaagttgtggtccttggaagccaggagggcgcaatgcacacagccttaacaggcgcgacggaaatacaaaccagcgggggaacaagcatttttgcggggcatctaaaatgtagactcaaaatggacaaacttgagctcaaaggcatgagttacgcaatgtgcagtaacgccttcgtcctgaagaaggaggtgtctgaaacacagcacggaacgatactgatcaaagtcgagtacaaaggcgaggacgcaccatgcaaaataccgttctcaactgaagacggccaggggaaagcgcacaacggcaggctaataactgcgaaccccgtggtgaccaagaaagaggaacccgttaacatagaggctgagccgcccttcggagaatccaacatcataataggaatcggtgacaaggcactaaagataaactggtacaaaaagggcagctcaataggaaagatgttcgaggctacagcacggggcgcgaggcggatggcaatactcggggacacagcatgggatttcgggtcagtaggtggggtcctaaattcacttggtaagatggtacaccaaatctttggaagcgcctacacagcattattcagcggagtaagctggataatgaaaatagggataggggttcttctcacatggatagggctaaactccaaaaatacgtcaatgagcttcagttgcatcgtgataggaatcatcaccctctacctaggggccgtcgtacaagcagacatgggctgcgtgatcaactggaaggggaaagaactaaagtgcggcagcggcatttttgtaacgaatgaggtacacacctggaccgaacagtacaagttccaggcagacagtccaaagcgtctcgccaccgccattgcgggcgcatgggagaacggcgtgtgtggcatccggagtacgacccgaatggagaacctgctttggaaacaaatcgcgaacgaactcaattacatactttgggaaaataacataaaactaacagtagtcgtgggggatataatcggcattctcgagcaaggtaagagaacgctgacaccgcaacccatggaactaaaatatagctggaaaacatgggggaaagctaaaattgtaactgcagaaacccaaaatagcagctttataatcgacggcccgaacacacctgaatgcccgagcgcaagcagggcgtggaacgtttgggaagtagaggactatggattcggagtcttcacaactaatatctggcttaaactccgggaaatgtacacccaactgtgcgaccacagattaatgtccgccgcagtgaaagacgaacgggccgttcatgctgacatgggctattggatcgaaagtcagaagaacgggagttggaaactggagaaagcaagtctcattgaagtaaaaacctgcacatggccaaaaagccacaccctgtggtccaacggagtactcgaatcagacatgataattccgaagtcactggctggccccatatcgcaacataactaccgaccaggctaccacacccaaacggcagggccgtggcacctaggaaaactggaactagatttcaactactgtgaggggactacggtggtaatcaccgaaaactgcggaacccgcggaccaagtttgcgcacaaccaccgtatccgggaagctcatacacgaatggtgttgcaggagttgcaccttaccgccactccgctatatgggtgaggatggctgctggtacggcatggaaattcgtccaattaacgaaaaagaagaaaacatggtcaagagtttggtaagtgcaggcagcggaaaagtagacaacttcacaatgggagtgctatgtctagcaatattgttcgaagaggtaatgagaggaaagttcgggaagaaacacatgatagctggcgtcctattcaccttcgtcttgctattgtcaggacaaatcacatggcgggacatggcgaggaccctaatcatgatcggtagcaacgcgagcgaccgaatggggatgggtgtgacttatctcgcgctcatagcaacattcaaaattcagcctttcctcgccttagggttctttctacgaaaacttacaagtagggaaaacttgctgctcggagtaggactagccatggcaacaaccctgcaactacccgaagatatcgagcaaatggcgaacggtattgcactagggctgatggcactaaagctcataacacagttcgagacttaccagctatggaccgcactggcaagcctaatgtgtagcaatacgatatttaccctcacggttgcatggcggaccgcaacgttgatattggccggtatcagcctcctacccgtatgccaatcctcatcgatgcgaaagaccgactggctaccgatgaccgtcgccgcaatgggggtaccaccccttcccctgttcatattctctctaaaggacactctgaaaaggaggtcctggccgctaaacgaaggggtaatggccgtgggcctagtatcgatactcgccagctccctactaagaaacgacgtgccgatggccggcccccttgtcgcgggcggcctattaatagcgtgctacgtaataacgggcacgtctgctgacttaaccgttgagaaagcagcagacgtaacatgggaggaagaggcggagcaaacaggagtctctcacaatctcatgattacagtggacgacgacggaacaatgcgaataaaggacgacgagaccgaaaacatattaaccgtacttctaaagaccgcgctcctaatagtgagtggaatatttccatatagcatacccgccacacttctggtctggcacacatggcagaagcaaactcaaaggtccggcgttctctgggacgtgcctagcccaccggagacacagaaagcagaactagaagaaggggtttataggattaagcagcaaggaatattcggcaaaacacaggtaggtgtcggtgtgcagaaggaaggcgtcttccacacgatgtggcacgtcactcgtggagcagtcttaacccacaacgggaaacgacttgaaccaaactgggcgagcgtgaagaaagatttaataagctatgggggcggatggagactatccgcccagtggcagaagggggaagaagtacaagtcatcgcagtggaaccaggtaagaatccgaagaatttccaaactatgccgggcatattccaaactaccacgggagagatcggagcgatcgcgctggacttcaaaccaggaactagcggctcaccaatcataaaccgggaaggcaaggtagtaggcctctacggaaatggggttgtcaccaagtccggaggctacgtgagtggaatcgcacagacgaatgccgaaccagacggaccaacaccggagctcgaggaggaaatgttcaagaaaaggaacctcacaattatggacctgcaccccggaagtggaaaaaccagaaaatacctacccgctatagtccgggaagctataaaacgtagactccgaacattaatactagctcctacaagagtcgtagcagcagaaatggaagaggcgctcaaagggctaccaatccgataccaaacaacagcaacaaagtcggaacacacgggaaaggagatcgtggacctgatgtgccacgcgacgttcacaatgaggctattaagcccggtccgagtgccaaattataatctgatcatcatggatgaagcccatttcaccgacccggcaagcatcgcagcacgaggctatatatctaccagggtaggaatgggtgaagcagcggctatattcatgactgcaaccccacccggaactgccgatgcctttccccagtcaaacgccccaattcaggacgaagaaagggatataccggaaaggagctggaactccgggaacgattggataacagactttgccggcaagacggtatggtttgtacccagcataaaggcaggcaacgatatagccaactgcctgcggaaaaacggtaaaaaggtcatacaactctcccggaagacattcgacaccgaataccagaaaacaaagttaaacgattgggactttgtagtgaccaccgatatcagcgagatgggggccaacttcaaggcagaccgagtaatagacccaaggcgatgcttaaaacctgtgatactgaccgatgggccagaacgggttatcctggcaggaccgatgccagttaccgttgccagcgccgcccagagacgcggacgcgtaggccgaaacccccaaaaggaaaacgaccagtatatattcaccggacaaccgctaaataacgacgaggaccatgcgcactggacggaagcaaaaatgctacttgacaacataaatacaccggaaggcatcataccagcgctatttgagccagagcgagaaaaatcagccgcgatcgacggcgaataccgactcaaaggagagagccgaaaaacattcgtcgagctcatgcgacggggcgacctcccagtatggctggctcacaaggttgcgagtgagggcataaagtatacagacaggaaatggtgcttcgatggggagcgtaacaaccaaatactggaagagaacatggacgtcgaaatctggacaaaagagggcgagaagaagaagctccgcccccgctggttggacgcccgaacctatagcgaccctctggcattgaaagaatttaaggacttcgccgcaggacgcaagagcattgccttcgaccttgtaacggagataggacgtgtcccctcacacctggcccatcgcaccaggaatgctcttgacaatctagtaatgctacatacgtcagaacacggcgggagggcatacagacacgcggtcgaagaacttcctgaaactatggagacccttcttctcctaggactcatgatactactaaccggaggggccatgctattcctcataagcggcaagggaataggaaagactagcatcggcctaatatgcgtagtggcatcgagcgggatgttgtggatggctgacataccgctacaatggatcgcatcagcgatcgttctggagttctttatgatggtgctcctaatccccgaaccagagaagcagagaacaccacaggacaaccagcttgcgtacgtggtgataggaatactgacactagcggcaatagtagccgctaatgaaatggggctactagaaacaaccaaaagagaccttgggatgagcaaagagcctggcgtggtgtcccccacgagctatctcgatgtagacctccacccggcgagcgcttggacgctatatgcggttgccacaacggtcatcacaccgatgctgaggcacacgatagagaatagcacggccaacgtatccctagcggcaattgcaaatcaggcggtcgtcctcatggggctcgacaaaggctggcccatcagtaaaatggacctaggcgtgccactgctggccttggggtgttattctcaggtcaacccactgacactaaccgcggcggtactgcttcttgtcacgcactacgctattatcggaccaggattacaggccaaggccacacgcgaggcacaaaaacgaaccgcggcaggaataatgaaaaatcccacagtggatggcattatgacgattgacttagacccagtcatctatgactcaaaatttgagaagcaactcggccaagttatgctcctggtcctgtgcgctgtccagctactgcttatgagaacctcgtgggcattctgtgaagcccttactctcgccaccggaccaataacaacattatgggaaggatcccccgggaaattctggaacactacgatcgcagtgtcaatggcgaacatattccgaggcagttatctagcgggcgcgggacttgcattttcaatcatgaaatcggtgggcacaggaaaacgagggaccggcagtcaaggggaaacacttggcgaaaaatggaaaaagaaactaaatcagctcagccgcaaagaatttgacctgtacaagaaatcgggtataaccgaagtggaccgaacggaagccaaagaaggactaaagagaggggaaattacacaccatgcagtatcaaggggcagcgccaaattacaatggtttgtagaacgaaatatggtaattcctgaaggacgagtcatcgacttggggtgcggaaggggaggatggtcatactactgcgcagggttgaagaaagtcactgaggtccgcggctacaccaaaggagggcccggccacgaagaacccgttccaatgagcacgtatggttggaacatagtgaagctcatgtcggggaaggacgtgttctacctaccaccagaaaaatgtgatactcttttatgcgacataggtgaatcgtcgccttctccaactgtagaagagagcagaacgattagagtgctaaagatggtagagccatggctaaagaacaatcagttttgcatcaaagtactcaacccgtatatgccgaccgtcatagagcatctggaacgactacagcgtaagcacggcgggatgctagtaaggaacccactgtccagaaatagtacccatgagatgtattggattagcaacggtaccggaaatatagtaagtagcgtaaatatggtttccagactactcctcaaccgcttcacgatgacctacagacgcccaaccatagagaaagatgtggaccttggggcgggcacacgccacgtcaacgcggaaccggagaccccgaacatggacgtgataggggaacgcatacgacgcattaaagaagaacattcatccacatggcactacgacgacgaaaacccctataaaacgtgggcctaccacgggagttacgaagttaaggcgacaggatccgcctctagtatgatcaatggagtcgtaaaactgctcacaaagccgtgggatgtcgtccctacagtaacccagatggcaatgacagacacgacccctttcgggcagcaacgggtattcaaggaaaaggtagacacccggacccccaaacccatgccaggcaccagaaaggtgatggaaataactgcggagtggctctggagaaccctaggtcgcaataaacgtcccagactatgcacaagggaagaatttacgaagaaagtacggaccaacgccgcgatgggagcggtcttcacggaggaaaaccaatgggactccgcaagggcagcagtagaagatgaggagttctggaaactcgttgacagggagagagaattacacaaactgggcaagtgcggcagctgcgtatacaatatgatgggaaagagagagaagaaactcggggagttcggaaaagcaaaaggtagcagggcaatatggtacatgtggctaggcgccagataccttgagttcgaggcactcggatttctaaatgaagaccattggttcagccgtgaaaattcttattccggggtcgaaggcgagggtctacacaaactagggtacatattgagagatatatccaaaatcccagggggagcaatgtacgccgacgacacggccggctgggacacacgaattaccgaagacgacttacataatgaagagaaaattacacagcagatggatccggagcaccgacaactagcaaacgcgatcttcaaactcacttaccagaacaaagtcgtaaaagtgcagcgcccaactcctaaaggaacggtgatggacattatttcgcgcaaagaccagcgcggatcaggacaggtaggcacgtatggcctaaatacctttacgaacatggaagcacagctaattcggcagatggaaggagaaggagtcctctcaaaaacggacctcgaaaacccacacctccttgagaagcgcataactcagtggctcgaaacaaaaggggttgaaagactcaagagaatggcgatttctggtgatgactgcgttgtaaaaccgatcgacgatagattcgcgaacgccttactagcacttaacgacatgggaaaggtgcgaaaggacatacctcagtggcaaccgtctaagggctggcacgactggcagcaagtcccattctgctcccaccacttccacgaacttataatgaaggatggccgcaagctcgtcgtcccgtgcagaccacaagacgagcttatcggcagagcgaggataagccagggggccgggtggtctctgaaagaaacggcctgcctagggaaagcatacgcgcaaatgtgggcactgatgtactttcatagaagagacctgcgcctggctagcaacgcaatctgctctgccgtccccgttcattgggtaccgacgagcagaacaacctggtccatccacgcgcaccaccagtggatgacgaccgaggacatgctgacagtgtggaatcgagtctggatcgaagataacccttggatggaggataagacacccgtaacgacgtgggaagatgtcccgtaccttggcaagcgggaagaccagtggtgtgggagcctaatcggcttaacgtcacgagccacgtgggcgcagaacattctaacagccatacaacaggtgcgaagcctcatagggaatgaggagttcctagattatatgccaagcatgaaacgattcaggaaagaagaggaacttgaaggggcgatatggtaa

SEQ ID NO: 25623 - RNA, 9873 nt, synthetic construct
  misc_feature 1..9873: note = derived and/or modified CDS sequence (opt11) from DENV-3__AB214882__SS-prME
  source 1..9873: mol_type = other RNA
accagcctatgcctaatgatgatgctgcccgccacgcttgccttccacctcaccagccgggacggcgagcctcgaatgatcgtgggcaaaaacgagcgtggcaagagcttactattcaagaccgcctcggggattaacatgtgcactctcatcgcaatggacctaggcgagatgtgcgacgacactgtgacctacaagtgccccctgatcacagaggtggagcccgaggatatagactgctggtgcaacctcaccagcacctgggtgacctacgggacctgcaaccaggccggtgagcaccgacgtgacaagcggtccgtcgccctggcgccccacgtaggcatggggctggacacccgcacccagacgtggatgagcgcggagggggcatggcgtcaggtggagaaggtcgagacctgggccttccggcaccccgggttcactatcctcgccctgttcctggcgcattacatcgggacttccctcacgcagaaggtggtgatcttcatcctgctgatgctggtcaccccatccatgacgatgcgttgcgtgggggtcggcaaccgcgatttcgtcgagggcctctccggggccacctgggtggacgtggtcctggaacacggcgggtgtgtcacaaccatggctaagaacaagcctaccctcgacatcgagctgcagaagacggaggcgacgcagctggccaccctccggaaactgtgcattgagggaaagatcaccaacgtgaccaccgacagcagatgccccacccagggagaggcaatcctacccgaggagcaggaccaaaactacgtctgtaagcacacctatgtggaccgggggtggggtaacgggtgcggcctctttggtaagggctccctggtgacctgcgctaagttccaatgcctggagagcatcgaaggcaaggtcgtgcaacatgaaaacttaaagtacacagtgattatcaccgtccacaccggggatcaacaccaggtgggcaacgaaacccagggggtgacggccgagatcacgccccaggcctcgaccgtggaggccgtgttgcctgagtacggcaccctgggactcgaatgtagcccccgcactggcctggacttcaacgaaatgatcctactcacgatgaaaaacaaagcttggatggtccacagacagtggtttttcgacctgcctctgccttggacctccggcgccacgaccgagactcccacctggaacaagaaagagctcctggttaccttcaagaatgcccacgccaagaagcaagaggttgtggtcttaggcagccaggagggcgctatgcacacggcactcacgggggccacagagatccagacctccggcggaacctcaatctttgccggtcacctgaagtgccgtctgaaaatggataagctcgaattgaagggcatgtcctatgccatgtgtagcaacgcctttgtgctgaagaaggaggtctccgagactcagcacggaaccatcctcatcaaggtggagtacaagggcgaggacgcgccctgtaagataccattctccaccgaagacgggcagggcaaggcgcacaacggccggctgattaccgctaaccccgtggtcactaagaaggaggagcccgtgaacatcgaagcggagccgccgttcggggagagcaacatcatcataggcataggggacaaggctctgaagatcaattggtataagaagggctccagcatcggtaagatgttcgaggcgacggcccgcggcgcccggcgcatggcaatcctgggcgacaccgcgtgggacttcgggtccgtgggcggggttctcaacagcctgggaaagatggttcaccagatcttcggatccgcatacaccgccctgttcagcggcgtctcctggatcatgaagatcgggataggagtcctcctgacatggattgggctgaacagcaaaaataccagtatgtctttcagttgcatcgtgatcgggatcatcaccctctacctgggcgcggtggtccaggctgatatggggtgcgtgatcaactggaagggcaaggaactgaagtgcggtagcgggattttcgtgaccaacgaggtccacacgtggaccgagcagtacaagttccaggcggactctccaaagcggctcgccaccgccatagccggggcctgggagaatggggtgtgtggcatccgcagcaccacccgcatggagaacctgctgtggaagcagatcgctaatgagctcaactacatcctgtgggagaacaacataaaacttaccgtcgtcgtgggggacattacaggcattttagaacagggaaagcggacactgacgccgcagccaatggagttgaagtattcctggaaaacgtgggggaaggccaagatcgtaacggcagaaacccagaacagctccttcatcatcgacggaccgaacacccctgaatgtcccagcgcgagccgcgcctggaacgtctgggaggtggaggactacggcttcggtgtgttcacaaccaacatatggctcaagctgcgggagatgtacacccagctgtgcgatcacagactcatgtccgccgccgttaaagacgagcgggccgtgcatgccgacatgggatattggatcgagagccaaaagaacggttcctggaagctcgaaaaggcgtccctgatcgaggtgaagacatgcacgtggcctaagtcccacaccctctggtcaaacggcgtcctggagagcgacatgatcatcccgaagagcctggccggacccatcagccagcataactatcgcccgggctaccacacccagaccgccggaccgtggcatctcggtaagttagagctggactttaactattgcgaaggaacgaccgtagtgatcaccgagaactgcggaacccgcggccccagcctccgcacgaccaccgtgtccgggaagcttatccacgagtggtgctgccggagctgcaccctcccgcccctgcgctacatgggcgaggatgggtgttggtacgggatggagatccggccgataaatgagaaggaggagaacatggtaaagtcacttgtgagcgccggctccgggaaggtcgacaacttcactatgggtgttctgtgcttggcaatcttattcgaggaagtgatgcgcggtaaattcgggaagaagcacatgatcgcgggggtcctgttcaccttcgtgctcctgctgagcggccagattacttggagggacatggcccgcaccctcatcatgatcggatcaaacgccagcgaccgtatggggatgggcgtgacgtacctggccctgatcgcaacttttaagatccagcccttcttggcgctggggttcttcctgcgcaagctcacctcgcgggagaacttgctgctcggcgtaggtctcgccatggccaccacgctgcagctccccgaagacatcgagcagatggccaatgggattgcgttgggcttgatggccctcaagctgatcacccagttcgaaacctaccagctgtggaccgccctcgcatccctgatgtgtagcaacactatcttcacgctaaccgtggcctggcgcaccgcgacactcattctggccggtatctccctgctcccagtgtgccagtcgagcagcatgcggaagaccgactggctgccgatgacggtcgccgcaatgggcgtgccgcccttgccccttttcattttttccctgaaggatacactgaaaaggcgcagctggccattaaacgagggggtcatggccgtgggcctggtctccattctggcgagcagccttctgcggaacgacgtccccatggccgggccactggtggccgggggcctcctgatcgcctgttacgtcatcacgggaaccagcgcagacctgaccgtcgaaaaggcggccgacgtgacctgggaggaggaagccgagcagacaggcgtgagtcacaacctcatgatcactgtcgacgacgatggaacgatgcgcatcaaggacgacgagaccgagaacatactgaccgtgctgttaaagacggcccttctgatagtgagcgggatctttccctattctatcccggcgacgctcctggtctggcatacctggcagaagcagacccagcggagcggcgtgctgtgggatgtgccctcgccgccagagacgcaaaaggccgagctcgaggaaggggtttatcgcatcaaacaacaggggatcttcgggaagacccaggtgggcgtaggtgtccagaaggagggtgtgttccacacaatgtggcacgtgacccgcggtgccgtcctgacgcacaacgggaagcgactggaaccgaattgggcaagcgtgaagaaggacctcatctcctacggcggtggttggcgcttaagcgcacaatggcagaagggggaggaggttcaggttatcgcggtggagcctgggaagaaccccaagaatttccagaccatgcctggcatcttccagaccaccacgggggaaatcggcgccatcgccctggacttcaagccggggacctctgggtcccccatcataaatcgcgagggcaaggtggtcgggctctacggcaacggggtagtgaccaagagcggcgggtatgtctccggcatcgctcagacgaacgccgagcccgacggtccgacgcccgaactcgaggaggagatgtttaagaagagaaacctgacgatcatggacctgcaccccgggagcggaaagacccgcaagtacctccctgcaatcgtgcgggaggccattaagcgccggctgcgcaccctgatactcgccccaacgcgggttgtcgccgccgagatggaggaggcgctgaaggggctgccaatccgctaccagaccaccgccaccaagtcggagcacacgggaaaggagatcgtggacctcatgtgccatgccacattcaccatgcggctgctgtcgcccgtgcgcgtacccaactataatctaatcatcatggacgaggcccatttcaccgacccggcatcaatcgcggcccgggggtatatctcaacacgagtaggcatgggcgaggccgccgcgattttcatgaccgccacgccgccagggaccgccgatgccttcccccagagtaacgcccctatccaggacgaggaacgggacatccccgaacgcagctggaactccggcaacgactggataacggactttgccgggaagacggtgtggttcgtccccagcatcaaggcagggaacgacatcgcaaactgcctgcgcaagaacgggaagaaggtgatccagctgtcccgaaagacctttgacacggaataccagaaaaccaagctcaacgactgggacttcgtcgtaaccaccgatatcagcgagatgggcgcaaactttaaggccgatcgcgtgatcgacccgcggagatgcctgaagccggtgatcctgacagatggccccgagagggtcatactcgcggggcccatgccagtgacggttgcctccgctgcccaacgccggggtagagtcggtcggaacccgcaaaaggagaacgaccagtacatattcaccggccagccacttaacaacgatgaggatcacgcccactggaccgaagcgaagatgctattagataacatcaacactccagaggggataatacccgccctattcgagccggaacgcgagaagtccgccgccattgacggcgagtaccggctaaagggcgaatcccgcaagaccttcgtggaactcatgcgtcgcggggatctgcccgtgtggctcgcgcacaaggtcgccagcgagggcattaagtacacggaccggaagtggtgcttcgacggagagcgcaacaaccagatcctagaggagaacatggacgtggagatctggaccaaggagggggagaaaaagaaactccgtccacgttggctggacgctcggacctactcagaccccctcgctctgaaggagtttaaggacttcgcggcagggcgcaagtcgatcgctttcgacctggtaaccgagatcgggcgcgtgcctagccacttagcccaccggacgcgcaacgccctggacaacctggtgatgctccacacgtccgagcacggcgggcgggcataccgccatgctgtcgaagagctgccagagaccatggaaaccctccttcttctgggcctcatgatcctgttgactggaggggccatgttattcctcatcagcggtaaagggatcggtaagacatccatcgggctgatatgcgtagtcgcgtcttcaggtatgctctggatggccgacatcccgctgcagtggatcgccagtgccatcgtcctggagtttttcatgatggtgctcctgatcccggagccagaaaagcaacggacgccccaggacaaccaactggcctatgtagtcatcgggatattaaccctggcggccattgttgccgcgaacgagatgggtctactcgagactacgaagcgcgacctgggcatgtccaaggaaccgggggtggtctcaccgacgtcctacctcgatgtggacctccacccggcgtccgcctggaccctatacgcagtcgcaacgactgttatcacccccatgctccgacacacaatcgagaactccacggccaacgtgtctctcgcggcaatcgccaaccaagcggtcgtgctgatgggactagacaaagggtggcccatcagcaagatggacctcggtgtgccgctgctggccttggggtgctacagccaagtgaaccccttaaccctgactgccgccgtcctcctgctggtgacccattacgcgattataggccccggcctccaagcgaaggctacccgcgaggcccagaagagaaccgcagctgggataatgaagaatcccaccgtggacggcatcatgaccatagacctggatccggtcatatacgactccaagttcgagaaacagctgggccaagtaatgctcctcgtactgtgcgctgtgcagctcctgctgatgcgcacttcgtgggccttctgcgaggccttgaccctggccaccggccccatcactacactttgggagggctcccccgggaagttctggaacaccaccatcgcggtcagcatggccaacatcttccggggctcctacctcgccggggccggcttagccttctcgatcatgaagtccgtagggaccggcaaaagaggcacgggtagtcagggggaaacactgggggaaaagtggaagaagaagctcaaccaattaagccggaaggagttcgacctatataaaaagtccggcatcactgaggtcgatcgtaccgaggcgaaggaagggctcaagcgaggcgagataacccaccacgcggtgagccgcggctccgccaagttgcagtggtttgtggagcggaacatggtgatccccgaggggcgtgtgatcgatctgggctgcggccgggggggttggagctattactgcgctggcctcaagaaggtgacggaggtcagaggctacaccaagggtgggccggggcatgaggagcccgtgccaatgtcgacatacgggtggaacatcgtgaagttaatgagcgggaaggacgttttctacctaccaccggagaagtgcgacaccctcctctgcgacatcggcgagtccagcccctcccccacggtggaggagagccggacgattagagtgctgaagatggtcgagccctggctgaagaacaatcagttctgcattaaggtgctcaacccctacatgcccacagtgatagagcaccttgagcgcctacagcggaagcacggcgggatgctcgtccgcaacccgctgtcccggaatagcacccacgagatgtactggatctccaacgggactgggaacatagtgagctccgttaacatggtgagccgcctacttctgaatcggttcaccatgacctaccgccgtcccaccatcgagaaagatgtggacctgggcgccggcacgcgccacgtgaacgccgagccggaaacccccaacatggacgtcattggggaacggatccgccggataaaggaagagcactccagcacctggcactatgacgacgaaaacccctataagacctgggcctatcacggcagttacgaggttaaagccactgggagtgccagctccatgataaacggcgtcgtgaagctcctcaccaagccatgggacgtggtccccaccgtcacacagatggccatgactgacaccacgcccttcgggcagcagcgcgtgttcaaagagaaagtcgacacccgtacgcccaagccaatgcccggcacacgcaaggtgatggaaatcaccgcggagtggttgtggcggacactcggccgcaacaagcggccgcgcctctgtacgagagaagagttcacaaagaaggtgcgtaccaacgcggccatgggtgccgtctttacggaagagaaccagtgggacagcgcgcgggccgccgtggaggatgaggagttctggaagctggtggaccgagaacgcgagctccacaaattaggcaaatgcggcagttgcgtctacaacatgatgggcaagcgggagaagaagctgggggagttcgggaaggcaaaagggagccgggccatctggtacatgtggctcggagcgcggtacctagaattcgaggcgctcggcttcctcaacgaggatcactggttttcccgcgagaacagctactcaggggtagagggtgaggggctacacaagctgggctatatcctccgggacatcagcaaaattcccggcggggctatgtacgccgatgacacggccggatgggacacccgtatcaccgaggatgacctgcacaacgaggaaaagatcacccagcagatggaccctgaacaccggcagctggccaacgcaatatttaaactcacgtaccagaacaaagtggtcaaggtgcagcgcccgacccccaagggtacggtgatggacatcatctcccggaaggaccagcgtggatccggccaggtcgggacctacggtctgaacaccttcacgaacatggaagcccagttaatccggcaaatggagggggagggtgtgctatccaagacggacctagagaacccccacctcctcgagaagcgtatcactcaatggctcgaaacaaagggggtggaaagattaaagcgcatggccatcagcggcgacgactgtgttgtaaagccgatcgacgaccggttcgccaacgcgctccttgccctgaacgacatgggaaaggtgcgcaaggacatccctcaatggcagccctcgaaggggtggcacgattggcagcaggtccccttctgcagccaccacttccacgagctgatcatgaaggacggccggaagctggtggtgccgtgccgcccacaggatgagctgatcgggcgggcccgcatctctcaaggcgccgggtggtccctcaaggagacggcctgcctcggcaaggcatacgcccagatgtgggccctgatgtacttccaccgccgggacctccgcctcgcctccaacgcgatctgcagcgcggtgcccgtgcattgggtgccgacttctcggacgacctggtccatccacgcccatcaccagtggatgaccaccgaagacatgttgacagtctggaaccgggtctggattgaggacaacccatggatggaggacaagacccccgtaacgacctgggaggacgtcccctacttaggcaaacgggaggaccaatggtgcgggagcctgatcgggctgacctcccgagccacctgggcccagaacatactcacggcgatacagcaggtacgaagcctgataggcaacgaggagtttctggactacatgccttccatgaagaggttccggaaggaggaggagagcgagggtgccatctggtga

SEQ ID NO: 25624 - RNA, 9873 nt, synthetic construct
  misc_feature 1..9873: note = derived and/or modified CDS sequence (opt11) from DENV-3__JX669489__SS-prME
  source 1..9873: mol_type = other RNA
acctcattgtgtctcatgatgatactacccgccgccctggcgttccacctcaccagccgtgacggagagccgagaatgatcgtggggaaaaacgagcgcggcaagagcctgctgtttaagaccgccagtgggatcaacatgtgcactctcatcgcaatggacctgggggaaatgtgcgacgacaccgttacatacaagtgccctcacataacggaggtggaaccagaggacatcgattgttggtgcaacctgactagcacatgggtgacctacggtacgtgtaaccaggccggagagcggcgtcgggacaagcgctccgtggccttagcgccccatgtgggcatggggctggacacccggacccagacctggatgtctgccgagggcgcttggcgccaggtggagaaggtggagacgtgggctctgcggcatccggggttcaccatcctcgcgctcttcttagcccactacatcggcaccagtctcacccaaaaggtggttatctttatcctgctaatgctcgttacgccctcaatgactatgcgctgcgtgggcgtcggaaaccgggacttcgtcgagggcctgtcgggggcaacctgggtggacgtagtcctggaacacggcgggtgtgtgacgaccatggccaagaataagcccaccctcgacattgaacttcaaaagacagaggccacacagctagccacgctccgcaaactgtgtatcgagggaaagattaccaacataacgactgacagcaggtgtcccacacagggcgaagctgttctgcctgaggaacaggaccaaaattacgtctgcaaacacacgtacgtggacagggggtggggaaacggttgcggcctctttggaaagggttcccttgtgacctgcgcgaagttccagtgccttgagcccattgagggaaaggtcgtgcagtacgagaacttaaaatacaccgtcatcatcacggtgcacactggggaccagcaccaagtgggcaacgagacgcagggcgttacggcagaaataacgccccaagccagcacaaccgaggcgatcctccccgagtacggaaccctggggctcgagtgctccccgcggaccggcctcgatttcaacgagatgatattactcactatgaaaaacaaggcctggatggtacaccgccagtggttcttcgacttgccgctgccttggaccagcggcgcgaccaccgagacacccacctggaaccggaaggagctcctggttaccttcaagaatgcccatgctaagaagcaggaggtcgtggttctggggtcccaagaaggcgcgatgcacacagcactcacaggggccaccgagatccaaaacagcggtgggacttccatctttgcgggccacctgaagtgtcgcctgaagatggacaaactggagctgaagggcatgagttacgctatgtgcactaacacgttcgtcctgaagaaggaggtatccgagacccagcacggtaccatcctcatcaaggtcgagtatcggggcgaagacgcgccgtgcaagattccattctcgaccgaggatgggcaggggaaagctcacaacggccgactgatcacggccaaccccgtagtgaccaagaaggaggaacccgtgaacatcgaagcagagcctccctttggggagagcaacatcgtcatcggcatcggagacaatgcgctgaaaataaactggtacaagaagggctccagcatagggaaaatgttcgaggccaccgcacggggtgcccgtcgcatggccatcttgggcgacactgcgtgggacttcgggtccgtgggcggggtgctcaactcactcggaaagatggttcaccagatattcgggtccgcatatacggccctgttctcaggcgtatcctgggtgatgaagatcggcatcggcgtcctcctaacctggattgggctgaactcgaagaatacttccatgagcttttcctgcatcgccatcgggatcatcaccctctacttgggcgccgtggtgcaggcggacatggggtgcgttatcaactggaagggcaaggagttaaaatgtggtagcgggatcttcgtgaccaacgaggtgcacacctggaccgaacagtacaagttccaggcggactcccccaagcgactggcgaccgcgatcgccggcgcatgggagaacggggtctgtggcatccgctcgacgacccggatggagaacctgctctggaaacaaatcgccaacgagctaaactatattctgtgggaaaacaacatcaagctgaccgtggtagtaggtgacataatcggggtgttggagcagggcaagcggacgctgacgccccaaccaatggagctgaagtattcctggaaaacctgggggaaggccaaaatcgtcacagccgaaacccaaaacagctcctttatcatcgacggccccaacacgcccgaatgcccgtcagcgtcccgggcctggaacgtctgggaagtagaggactacggtttcggcgtgttcaccaccaacatctggttgaagctccgtgaggtctacacacagttatgcgatcaccggttaatgagcgccgccgtgaaggatgagcgtgccgtccatgccgacatgggctactggatcgagtcacaaaagaacggtagttggaagctggagaaggcatccctgatcgaggtcaagacctgtacgtggccgaagtcccacaccctatggagcaacggcgtgctagagtcagacatgatcattcctaagagcctggcgggacccatctctcagcacaaccaccggccgggctaccatacccaaacggccggaccttggcatctcggcaagctggagctggatttcaactactgtgagggcacgaccgtggtcatcaccgaaaactgcgggacgcgcggccccagcctccggacgacgaccgtgtccgggaagctgatccacgagtggtgctgtcgcagttgcacattgccccctttacggtatatgggcgaggatgggtgctggtacgggatggagatccgccccatttccgaaaaggaagaaaacatggtcaagagcctggtctccgctggcagcgggaaagtggacaactttacgatgggcgtgctgtgcctcgccatcctattcgaagaggtcatgcgggggaaattcggcaaaaagcatatgatcgccggggtgctgttcacctttgtgcttctgttgtccggccagattacctggcgcgacatggcccataccctcatcatgataggcagcaacgccagcgaccgcatggggatgggtgttacctaccttgctttaattgcaaccttcaagattcagcccttcctcgccctgggtttcttcctaagaaagttaacctcgcgcgagaacttactgctcggtgtgggcctggccatggccacaactttacagttgcccgaggacatagagcaaatcgcgaacgggatcgccttgggcctaatggccctcaagttaattacccagttcgagacgtaccagctctggactgcgctcatcagcctcacctgttccaacaccatgttcaccctaaccgtagcatggcgcacagcaacccttatcctggccggtgtcagcttattacctgtgtgccagtcttcttccatgcgcaaaactgactggctgcccatggcagtggccgccatgggcgttccgcctctgccactattcatattcagcctgaaagatacactgaagcgccgctcctggcccctaaacgagggggtgatggccgtcggcctggtgagtatactggcctccagcctcctacggaacgacgtgcccatggccggccccctggttgccgggggcctcctgatcgcatgctatgtaatcactggcacctccgctgatttaactgtggagaaggccgccgacattacatgggaagaggaggccgagcagactggcgtcagccacaacctcatgataaccgtcgacgacgacgggacaatgcgaatcaaggacgacgagactgagaacatcttaaccgtgctgttaaagactgccctgctaatagtctccggcgtcttcccctacagcatcccggcgacactattggtatggcacacctggcagaagcaaacgcagcggtccggggttctgtgggacgtgcccagcccgccagaaacccagaaggccgagctagaggagggtgtatatcgcatcaagcagcaggggatcttcgggaagacacaggtcggagtgggggtgcagaaagaaggcgtgttccacaccatgtggcacgtaacgcggggagccgttctgacgtacaatggaaagcgcctggagcccaactgggccagcgtaaagaaagacctcattagctacggggggggatggcggctgagtgcgcaatggcagaagggggaagaggtacaggtgatcgccgttgagccggggaagaaccccaagaacttccagacgatgcctggcacgtttcagaccacgaccggggagatcggagccatcgccctggacttcaagccgggaaccagcggcagccccattatcaatcgcgagggcaaggtggtgggcctttacgggaacggtgtcgtgactaaaaacggcggttatgtgtcaggcatcgcgcagacgaacgcagagcccgatggacccacccccgagctcgaggaggagatgttcaagaagcggaacctgacgattatggacctgcacccaggctctggcaagacgagaaagtacctcccggccatcgtccgggaggccatcaaacgccggttgcggacgttgatcctcgcccccacccgtgttgtggccgcggagatggaggaggcgctaaaagggctgcccatccgctaccagaccacggccaccaagtccgagcacaccgggcgggagattgtcgacttaatgtgtcacgcgacctttactatgcgcctgttaagtcccgtgcgtgttccgaactacaacctcatcatcatggacgaggctcactttacagaccccgcaagtatcgccgcccgcgggtacatttctacccgcgttgggatgggggaggccgcggcaatctttatgacagccacacctccgggcacggccgacgccttcccgcagtccaacgcgcccatacaggacgaagagagggacatccccgaacggagctggaattccgggaacgaatggatcaccgacttcgccgggaagaccgtctggttcgtgccctctatcaaggccggcaacgacatcgccaattgcctacgtaagaacgggaaaaaagtaatccagttatcccgaaagacctttgacacggagtaccagaagactaaactcaatgactgggacttcgtggtcaccaccgacatttccgagatgggcgccaacttcaaagcggaccgggtcatcgacccacgccggtgcctgaagcccgtgatactgacggatggtcccgaacgggtgatcctcgcggggcccatgcccgtcaccgcggcctccgcagcgcagcggcgcgggcgggtgggtcgcaacccccagaaagagaacgaccaatacatcttcacaggccagcccctgaacaacgacgaagatcacgcccactggacggaggccaagatgctcttggacaatatcaacacacccgaggggatcatcccggccctgttcgagccagagcgggagaaatccgcggccatcgacggcgagtatcgcctgaagggtgagtcccggaagacgtttgtggaattgatgcgccgtggtgacttacccgtatggctagcccataaggtggcctctgagggcataaagtacaccgaccgcaaatggtgcttcgacgggcagcgaaataaccagattctcgaggagaacatggacgttgagatctggaccaaggagggggagaagaaaaagctgcgaccccgctggctggatgcccggacctattccgacccgctcgcactgaaagagttcaaggattttgccgccgggcggaaatcaatagccctggacctcgtcacggagatcggccgggtgccctcccacctcgcccacagaacacgaaacgcgctggacaacctcgttatgttacacacttccgagcatgggggtcgcgcatacagacatgccgtcgaggagcttccagagaccatggagacgctcctgctgctcggcctgatgattctgctaacgggaggcgcgatgctgttcctgataagcggcaagggaattggcaaaacctccatcggtctcatatgcgtgatcgccagctccggcatgctatggatggccgagatcccgctgcagtggatcgcaagcgcaatcgtcctggagttcttcatgatggtgctgctgatcccagagcctgagaagcagcgcacgccccaggacaatcagctcgcgtacgtggtgatcgggattttgactttggccgcaatcattgccgccaacgaaatgggcctcttggagaccaccaaacgagatctgggcatgtctaaggagccgggggtcgtgagccctacctcctacctcgacgtcgacttacatcccgccagcgcttggacgctatacgccgtcgcaacgaccgtgatcactcccatgctccgtcacactatcgagaactccaccgcaaacgtctcgttggccgcgatcgccaaccaggcagttgtacttatggggctcgacaaggggtggccgatctccaagatggacctgggcgtccccctgctcgccctggggtgctactctcaagtgaaccccctgactctcactgccgcggtgttactgctcatcacgcattacgcgattatcggccccggcttacaggccaaggctacccgggaggcccagaagcgcaccgccgccggaatcatgaaaaaccccaccgtcgacggcatcatgactatcgatttggacccagtaatctacgactccaagttcgagaagcaactgggccaggttatgttactggtcctctgcgccgtacagctgctgctaatgcggaccagctgggcactctgcgaggcgctgaccctcgctacgggccccataacgactctgtgggagggctcccccgggaagttctggaataccaccatcgccgttagcatggctaacatcttccgcgggagttacctcgccggggcaggcctcgcattcagcatcatgaagtccgtggggacgggcaagcggggcaccgggagccagggggagaccctgggggaaaagtggaagaagaaactaaaccagctcagcaggaaggagttcgatctatacaagaagagcggcatcaccgaggtcgaccggacggaggccaaggagggcttaaaacgcggtgagatcacgcaccacgcggtatcgcggggttccgccaagctccagtggttcgtcgagagaaatatggtgatcccagaagggcgggtgatcgacctaggctgcgggcgcggcgggtggtcatactattgcgcgggcttgaagaaggtcaccgaagtgcgcggctataccaagggcgggcccgggcacgaggagcccgtccccatgtctacctacggctggaacatagtcaagctcatgagcggtaaagacgtgttctatctgccacccgaaaagtgtgacacgttactgtgtgatatcggcgagtcctccccctcgcccaccgtggaggagagcagaaccatccgcgtcctcaagatggtggagccgtggctgaagaacaaccaattctgcatcaaggtgctaaacccctacatgcctaccgtcattgagcacctagagaggctgcagcgaaaacatggcgggatgctagtccggaaccccctctcccgcaacagcacccacgagatgtattggatctccaacgggactgggaacatagttgccagcgttaacatggtgtcgcggttactactcaaccgctttaccatgacccacagacgtccgacgatcgagaaagatgtggacttgggcgcgggcactagacacgtcaacgctgaacccgagaccccaaacatggacgtgatcggggagcgcatcaagcggatcaaggaggagcacaacagcacgtggcactacgacgacgagaacccatacaagacgtgggcttatcacgggagctacgaggtgaaggcgacggggagcgcctcctcgatgatcaacggcgtagttaagctcctcaccaagccctgggacgtcgttcctatggtaacccagatggccatgacagacaccacccccttcggacagcagcgggtctttaaggaaaaggtggacacccggacaccgaggtctatgcccggcacccggcgcgtgatgggcatcaccgccgagtggctatggcggaccctgggtcgcaacaagaagcctcgcctctgcacccgggaggagttcaccaagaaagtccggaccaacgcggcaatgggcgccgtattcacggaggagaaccaatgggattcggcaaaggccgcggtggaggacgaggatttctggaaactggtagaccgggaacgcgagctgcacaagttggggaagtgcggcagttgcgtgtataacatgatgggtaaacgggagaagaagctgggcgagttcggcaaggcgaaggggtcccgagccatttggtacatgtggctcggcgctaggtacctagagttcgaggccctggggtttctgaacgaggaccattggttcagcagagagaattcctacagtggcgttgagggcgagggcctccacaagctaggatacatcctaagggacatctcgaagatccccgggggcgcgatgtacgcagacgacacggccgggtgggacacccggataaccgaggacgacctccacaacgaagagaagatcactcagcagatggacccggagcatcggcagctcgccaacgcgatctttaaactcacgtaccagaataaggtagtgaaggtgcagcgccctacccccaccggaaccgtcatggacatcatctccaggaaggaccagaggggctccggacaggtgggtacctacgggctcaacacgtttacgaacatggaggctcagctgatccggcagatggaaggcgaaggggtgctgtcgaaggccgacctggagaacccccacctcccggagaagaagataacccagtggctggagaccaagggcgtcgagcgcctcaagcggatggcaatctccggcgacgactgcgtggtgaaacctatcgacgaccgattcgccaacgccctgctggcgcttaacgacatggggaaggttcgtaaggatatcccccagtggcagcccagcaagggctggcacgactggcagcaggtgccgttctgctcccaccacttccacgaattaataatgaaggacgggcgtaagctggtggtcccctgtcggccccaagacgaactaattggccgcgcgcgcataagccagggggcgggctggtccctgcgagaaacggcttgtttaggcaaggcgtacgcccaaatgtggagcttaatgtatttccaccgaagggacctacgcctggcgtccaatgccatatgcagcgcggtgcccgtgcactgggttccgacctcccggaccacgtggagtatccacgcccaccaccagtggatgaccaccgaagacatgttgaccgtgtggaaccgcgtgtggatcgaggacaacccctggatggaggacaagactcccgtcacgacctgggagaacgtgccgtacctgggtaaacgagaggatcaatggtgtggcagcttgatcggcctgacttcccgcgccacgtgggcccagaacatcccgacagcaatccagcaggtccgttcacttataggaaacgaggaattcctagactacatgccctccatgaagcgcttccggaaggaggaagagagcgagggcgccatctggtaa

SEQ ID NO: 25625 - RNA, 9873 nt, synthetic construct
  misc_feature 1..9873: note = derived and/or modified CDS sequence (opt11) from DENV-3__JX669498__SS-prME
  source 1..9873: mol_type = other RNA
accagcctctgtctcatgatgatactgccagccgcattggcattccatctcaccagtagggacggggagccccgcatgattgtggggaagaacgagcgcggcaagagcctgctgttcaaaaccgcctcggggataaacatgtgcaccctcattgctatggacctgggtgagatgtgcgacgacacagtgacttacaagtgccctcacataacggaggtggagcccgaggatatcgattgttggtgcaacctcaccagcacctgggtgacatacgggacgtgcaaccaggccggcgagcgtcgccgggacaaacgctccgtagcactcgcgccccatgtgggcatggggctggacacccggacacagacctggatgagcgccgagggtgcgtggcgccaggtggaaaaagtggagacgtgggccttacggcatcccggctttaccatcctcgcgctatttctggcccactacatcggcacctccctcacgcaaaaagtggtgatcttcatcctactgatgctcgtcacacccagcatgaccatgcgatgtgtgggggtgggcaaccgggactttgtcgagggcttatccggagccacttgggtggacgtggtcctggaacacggtggttgcgtcaccactatggccaagaataaacccaccctcgatatagagctgcaaaagaccgaggccacccagctagccacgctgcggaagctgtgcatcgagggcaagataaccaacatcaccactgatagccggtgccccacgcaaggcgaggcagtgctgcccgaggagcaagaccagaactacgtctgtaagcacacatacgtagatcggggttggggcaacggttgcggcttgttcgggaaaggctcactggtgacctgcgccaagttccaatgtctggaaagcatcgaagggaaagtcgtgcagtacgagaaccttaagtatacggttatcatcacggtgcacacaggggaccagcaccaggtgggcaatgagacacaaggggttaccgcagagattacgccacaggcatcgacaacagaggctatactgcccgaatacggcaccctgggactcgagtgcagcccccgtaccggccttgactttaacgagatgattctactcaccatgaagaacaaggcatggatggtccaccgccagtggtttttcgacctgcctctaccttggacctccggcgccaccacagagacacctacctggaaccggaaggaactcctggtgaccttcaaaaacgcccacgcaaagaagcaggaggtcgtggtgctgggtagccaggagggtgcaatgcacacggccctcacgggggcaaccgagatacagaactccgggggcaccagcatctttgcggggcatctgaagtgccgcctcaagatggacaagcttgaattaaaggggatgagctacgcaatgtgcaccaacacgttcgtcctgaagaaggaggtgtcggagacgcagcacgggacaatccttatcaaagtggagtacaagggcgaagacgccccctgcaagataccgttcagcaccgaggacgggcagggcaaggcccacaacggccggctaatcaccgccaatcctgttgtgaccaagaaggaggagcccgtgaatatagaggccgagcccccgttcggggagtctaacatcgtaattggcactggcgataacgcgctgaagattaattggtacaagaagggcagcagtattgggaagatgtttgaggccaccgcccgcggcgcccgacgtatggccatcctgggcgatacagcgtgggacttcgggtcagtcggcggggtgttaaactcccttggcaagatggtccaccagatcttcgggagcgcctacaccgccctgttctccggcgtgagctgggtaatgaaaatcggtatcggggtcttattaacttggattgggttaaattccaagaacacaagtatgtcgttcagctgtatagctatcgggatcatcaccctgtatttaggcgccgttgtgcaggcggacatgggctgcgtcatcaactggaagggaaaagagctgaagtgcggctccgggatcttcgtgacaaacgaagtgcacacctggactgaacagtacaagttccaggcggacagcccgaaacgcctcgccacggctattgcgggcgcttgggagaatggggtctgcggaatccggagtaccacccgcatggagaacctgttatggaagcagattgccaacgaactcaactacattctgtgggagaacaacatcaagctgaccgtcgtggtcggggacattatcggcgtcctcgagcagggcaaacggacgctgacgccacagccgatggagctgaagtacagctggaagacttgggggaaggcaaagatcgttaccgccgagactcagaattccagcttcatcatcgatggccccaacacccctgagtgcccgtcagcaagccgcgcctggaacgtgtgggaggtggaggactacgggttcggtgtgttcactacgaacatatggcttaagcttcgcgaggtgtacacccagctgtgcgaccaccgcctcatgtccgccgccgtcaaggacgaaagggcagttcatgcggacatgggttattggatcgagtcccagaaaaacgggtcatggaagcttgagaaagcctcccttatcgaagtcaagacatgcacctggcccaaaagccacaccctctggtccaatggcgtgctggagtcagacatgatcattccaaagtccttggccggccccatcagccagcacaaccacagacccggataccatacacaaactgccgggccgtggcatctcggcaaattagaactggacttcaactattgcgagggaaccaccgtggtcataaccgagaattgcgggacgcggggcccgtccttacgcaccacaacggtgtccgggaagctgatacacgaatggtgttgccggtcctgcacgctgccgcccctgagatacatgggggaggacgggtgctggtacggcatggagatccggcccatcagtgaaaaggaggagaacatggtgaaaagtctggtaagcgctggttccgggaaggttgacaacttcacgatgggcgtcttgtgcttggccatcttgttcgaggaggtcatgaggggcaagttcggcaagaaacatatgatagccggtgtgttcttcaccttcgtgttactcctgagcgggcagataacgtggcgggacatggctcacactctgattatgatcgggtccaatgccagcgaccgcatggggatgggcgtcacctaccttgcgctgattgccaccttcaaaattcagccattcctggcgctcgggttcttcctccgtaagctgacttcgagggaaaatctgttgctgggcgtaggtctagcgatggcaacgaccctacagctgccagaggacattgagcagatggcgaatgggatcgctcttgggctcatggccctgaagcttatcacccaattcgagacctaccagctgtggactgcactgatctccttaacttgcagcaataccatgttcaccctgacggtggcctggcggaccgcgaccctgatcctggccggggtctcccttctgcccgtgtgccagagctcaagcatgcgcaagaccgactggctcccgatggctgtggctgccatgggcgtcccgcccctcccgctgttcatcttctccctcaaggatacgctgaagcgcagaagctggccgctgaatgagggcgtgatggcggtcggattagtgagtatcctggccagcagcctgctccgcaacgatgtaccaatggcaggaccccttgtcgccggaggcctgctcatcgcatgctacgtcatcaccgggacaagcgcggacctgaccgtcgagaaggccgcggacatcacgtgggaggaggaggcggagcagaccggagtatcccacaaccttatgataaccgtggacgatgacgggaccatgcggatcaaggatgatgagaccgaaaacatactcacggtactgctgaagacggccctgctgatcgttagcggcgtcttcccatattcaatcccggccaccctgcttgtgtggcatacatggcagaagcagacacagcggagcggcgtcctgtgggatgtgccctccccgcctgaaacccagaaagcggagctggaagagggagtgtaccgaataaaacagcagggcattttcggcaagacccaggtcggcgtgggtgtgcagaaggagggtgtcttccacactatgtggcacgtgacgcgcggagccgtgctcacctacaacggtaagcggctggaaccgaactgggcaagcgtcaagaaggacctgatctcctatggtgggggctggaggctcagcgcgcaatggcagaaaggggaggaggtacaggtgatcgccgtcgagcccggcaagaatcccaagaacttccaaaccatgcctggcaccttccagacaaccacaggcgagatcggtgccatagccttggacttcaagccaggcactagcggcagcccaatcatcaaccgcgagggaaaggtagtggggctgtacggtaacggtgtcgtgacaaaaaacggaggttatgtaagcggcatagcccaaaccaacgccgagcccgatggccccactcccgagctggaggaggaaatgttcaagaagagaaatctgactatcatggacctgcacccggggagcggcaagacacggaaatatctgccggccatcgtccgcgaggccattaagcggcgccttcggactctgatccttgccccgacacgagtggtggccgcggagatggaagaggccctcaagggcctccccattcgataccagaccacggccacaaagagcgaacacaccgggcgagagatcgtcgacctgatgtgccatgccacctttacgatgaggctcctgtcccccgtgcgagtgcccaattacaaccttatcatcatggacgaggctcacttcaccgacccggcgtcgatcgcagcccgggggtacatctccacccgcgtcggaatgggcgaggccgcagcaatcttcatgaccgctacgccgcccgggaccgcggacgccttcccccagagcaacgcgcccatacaggacgaagaacgcgacatccccgagcggtcctggaacagcggaaacgagtggatcaccgacttcgccgggaagaccgtgtggttcgtgccttccatcaaagccggcaacgatatagccaattgtctcagaaagaatggaaagaaggtcatccagcttagccggaagacgtttgacaccgaataccaaaagaccaagctgaacgattgggactttgtggtgacaaccgacatctccgagatgggcgccaacttcaaggcggaccgcgtgatagacccccggcgatgcctgaagccggtcatcctgaccgacggccccgaacgggtgatactggccggacccatgcccgtaaccgccgctagcgccgcccagcgccgtggccgcgtggggagaaacccgcaaaaagagaacgaccagtacatctttaccggtcagccactcaacaacgacgaggaccatgcgcattggacagaggccaagatgctgctggacaatataaacacgcccgaggggatcatccccgccctttttgagccggagcgcgagaagtccgcggccatagatggcgagtaccggctgaagggagagtctcgcaaaaccttcgtggagctgatgcgacgcggtgacctcccagtttggctggcacataaggtggccagcgagggcataaagtacacggaccgcaagtggtgcttcgacggccagcgcaacaaccaaattcttgaggaaaatatggacgtcgaaatttggactaaggagggggagaagaagaagctccggccgcgatggctggacgcaagaacgtactctgaccccctggcgctgaaggagttcaaggatttcgccgccggccgtaagtccatcgcactggacctggtgacagagatagggcgggtgccgtcccacctcgcccatcggacgcgtaacgcgctggacaacttagtcatgcttcacaccagcgaacatggcgggcgggcgtaccgccatgccgtggaggagctgccagagacgatggagaccctgttacttctcgggctcatgatactgctgaccgggggggccatgctgttcctgatctctgggaaagggatcggaaaaactagtatcgggcttatttgcgtgatcgcatcaagcggcatgctctggatggccgagattcccttgcaatggatcgccagtgctatcgtcctagaattcttcatgatggtgctactgatcccggaacccgagaaacagcgaacgccccaggacaaccagttagcgtacgtcgtcatcgggattctcactctggccgcgattatcgccgccaacgaaatgggcctgctcgagaccacaaagcgcgacctaggcatgtcgaaggagcccggggtggtgtctccgacgtcctacctcgacgtcgatctgcacccagcctcagcgtggaccctatacgcggtggccacaaccgtaatcacaccgatgcttcggcacactatagaaaattcgaccgctaatgtctccctcgccgcaatcgccaaccaggccgtggttctaatgggccttgacaaggggtggcccataagcaagatggatctcggcgtcccgctactggccctgggatgctatagccaggtgaaccccttgacgctgacggccgctgtgttactattgatcacccactacgccatcatcggtcctggcctgcaggctaaggccacccgcgaggcacagaagcggacggcggcggggataatgaagaaccccacggtcgacggcattatgactatcgacctggaccctgtgatctatgatagtaaattcgaaaaacagctgggccaagtgatgctattggtgctatgcgcagtgcagctcctgctcatgcgaacaagttgggccctctgcgaggcgcttacactagccactggacccatcactaccctctgggagggcagcccggggaagttctggaacaccacaatcgcagtttccatggccaacatattccggggcagctacctggcgggagcgggactggcgttctccatcatgaaatccgtcgggacgggcaaacgtgggacagggagccagggcgaaacactaggggagaagtggaagaagaagctcaaccagctgagcaggaaagagttcgacttatacaagaagagtggcatcaccgaggtagaccggacggaggcaaaggaggggctaaagcgcggcgagatcacccaccacgccgtgtcccggggctctgcaaagctgcagtggttcgtcgagcggaacatggtgatccccgaggggcgagtgatagatctcggctgcgggcgggggggctggtcctactattgcgcgggcttgaaaaaggtcaccgaagtgcgtggctacacgaagggggggccgggacatgaggagcccgttcccatgagcacttacggatggaacatagtcaagctgatgtccgggaaagacgtgttctacctcccgcccgagaagtgtgatacgttgttgtgcgacatcggcgagagctcccccagccccacggtggaagagtcccgtaccattcgggtcctgaagatggtggagccatggttaaagaataaccagttctgcatcaaggttctgaatccctacatgcccacagtcatagagcacctggagcgtctccagcgtaagcacggcggcatgctggtgcgcaaccccctgagccgaaactcgacccacgagatgtactggatcagtaacggcacggggaatatcgtcgcctccgtaaacatggtgtcgcgtctcctacttaaccggtttacaatgacacaccgccggcccaccatagagaaggacgtggacctcggagctggcacccgccacgtcaacgctgagccggaaacgcccaatatggacgttatcggggagaggataaagcgcatcaaggaggagcacaactcgacgtggcactacgacgacgagaatccttacaagacctgggcatatcacggcagttacgaggtgaaggcgacggggtcggccagcagcatgattaacggcgtcgtgaagctgctgaccaagccgtgggatgtggttccaatggtgacgcaaatggcaatgaccgataccacccccttcgggcagcagcgggtgttcaaggaaaaggtggacaccaggacgccccggtccatgcccggcacacggcgagtcatgggcatcacggccgagtggctctggcgtacacttggtcgcaacaaaaagccccgactgtgcactcgcgaagagttcaccaagaaagtcaggaccaacgctgccatgggggcggtgttcacagaggaaaaccagtgggacagcgccaaggccgcggtggaggacgaagatttttggaaactagtcgaccgtgagcgggagctgcacaaactgggcaagtgcggctcctgcgtttacaatatgatgggcaagcgcgaaaagaagctgggagaattcggcaaggccaaggggagtcgggccatttggtacatgtggttaggcgcgcgatacctggagttcgaggcccttgggttcttaaacgaagaccactggttttcgagggagaattcctatagcggagttgaaggggagggcctccacaagttgggctacatcctacgcgacataagcaagatacccggtggcgcgatgtacgcggatgataccgccgggtgggacacacggatcacagaggacgacttacataatgaggagaagatcacgcagcagatggacccagagcaccgacagttagcgaatgccatattcaagttgacgtaccagaataaggtagtgaaagtacaacggccaacgcccaccggcactgtaatggacatcatctcgcgaaaagaccagaggggatcgggccaagtgggcacgtacgggctgaatacttttaccaacatggaggcgcaactcatacgacagatggagggtgagggcgtgctttcaaaagccgacctagagaacccacacctcccggagaagaagatcacgcagtggctggaaacgaagggtgtcgagcggctgaaacgcatggccattagcggcgacgactgcgtggtgaaaccgatcgacgacaggttcgggaacgccctcttggcgctcaacgatatgggcaaggtgcgcaaagacataccccagtggcagccctccaaggggtggcacgactggcagcaggttccattctgcagccatcatttccatgagctcatcatgaaggatggccggaagctggtggtcccttgccgcccccaggacgaactgatcggtcgcgcacgcatctcccagggcgctggatggtcgctccgcgaaaccgcctgtctggggaaggcctacgcgcaaatgtggtccctgatgtacttccatcgtagagaccttcggctggcttctaacgccatctgctccgctgttcccgtgcattgggtgccgacctctcgaaccacgtggagcatccacgcccaccatcaatggatgaccaccgaagacatgctgacagtgtggaatcgggtgtggattgaagacaacccgtggatggaggacaagacacccgtcaccacatgggagaacgtaccctacctcggcaagcgcgaagatcagtggtgcggatcccttatcggcctgaccagccgggcgacgtgggcccagaacattcccaccgccatacaacaggtccgatccctcatcgggaatgaggagttcttggactacatgccgagcatgaagcggtttaggaaggaggaggagtccgagggagcaatctggtga

SEQ ID NO: 25626 - RNA, 9873 nt, synthetic construct
  misc_feature 1..9873: note = derived and/or modified CDS sequence (opt11) from DENV-3__KF954946__SS-prME
  source 1..9873: mol_type = other RNA
acatcactatgcttgatgatgatcctgcccgcggcactggcattccacctaaccagccgagatggggaaccccgcatgatagtggggaaaaatgaacgcggcaaaagcctattattcaaaaccgcgagcggcatcaacatgtgtaccctaatagcaatggatcttggcgaaatgtgcgacgacacggtcacttacaaatgtccacacataacagaagtagaacctgaagatattgactgttggtgtaacttaaccagcacctgggtcacctacggcacatgtaaccaagccggcgaacacaggcgcgacaaaaggtccgtggcgttggcaccgcacgtagggatgggcttagacaccagaactcaaacgtggatgtccgcagaaggcgcctggaggcaagtagaaaaagtagagacctgggccctaagacaccccggcttcacgatcctggctctcttcctagcacactacatcggaacctcgctcacccaaaaggtcgtgatattcatcctactaatgctcgtaacaccaagtatgaccatgaggtgcgtgggcgtcggaaaccgtgacttcgtcgagggcttgagcggtgccacctgggttgatgtagtcctagaacacggcgggtgcgtgacgacaatggccaaaaacaagcccacgttagacattgaattacagaaaacagaagcaactcaactagccatactcagaaaattgtgcatagaaggcaaaatcaccaatatcactacggattctaggtgccctacacaaggagaagcagtattgccggaagaacaggaccaaaattacgtctgcaagcacacctatgtagaccgaggctggggcaacggttgcggattattcggaaaaggaagcctagtcacgtgcgctaaattccaatgcctagagcccattgaaggaaaagtagtacaatacgagaacttaaaatacactgtaataataaccgtacatacaggcgaccaacatcaagtcggcaatgagacacaggggatcaccgcggaaatcaccccgcaagcgtctaccacagaggcgatactgccagaatacgggacgttaggactcgaatgttccccacggacagggcttgacttcaacgagatgatcctactgactatgaagaacaaggcatggatggtccaccggcaatggttcttcgacctccctctcccctggaccagcggggcaaccaccgagaccccgacctggaatcgaaaagaactactggtcacattcaagaacgcgcacgccaagaaacaagaagtagtagtcctgggctcccaagaaggagccatgcacacagctctcacgggtgcgactgaaatacaaaactcaggtggcactagcatatttgcggggcatttaaagtgccgcctaaagatggacaagctcgaactgaaaggcatgagctacgccatgtgcacaaacacctttgtcttgaaaaaggaggtaagtgagacgcagcacggaactattctaataaaagtcgaatacaagggggaagatgccccatgcaaaatcccattcagcacggaagacggccaaggcaaggcacacaacggccgcctcatcaccgcgaatccagtcgtaacaaagaaagaggaacccgtaaacatagaagcggaaccaccattcggcgagtctaatattgtaatcgggataggtgacaacgcactcaaaataaactggtacaagaaaggaagcagcatcggaaaaatgtttgaagcaaccgcaaggggagcgagaagaatggcgatactaggcgacaccgcgtgggacttcggtagcgtaggtggggtcctcaactccctcggaaagatggtccaccaaatattcggatccgcatacaccgccctgttctcaggcgttagctgggtgatgaaaataggaataggagtactactgacgtggattgggctcaacagcaagaacacgtcgatgtctttctcatgcatcgccattggcataatcaccctctatctgggcgcagtagtacaagcggacatgggctgcgtcatcaactggaaaggcaaggaattaaaatgcggctccggaatcttcgttacgaacgaagtccacacatggaccgaacaatacaaatttcaagcagactcccctaagcgccttgccaccgccatcgttggagcatgggaaaacggggtatgcggtatcagaagtacgacccgtatggaaaacctgctttggaaacaaatagcgaatgaacttaactatattttatgggaaaacaacataaaactcaccgtagtagtaggcgatacgatcggcgtcctggagcagggaaaacggaccctaactccccagccgatggaactgaagtatagctggaaaacatggggaaaagcaaagatagtaacggccgagacacaaaacagctcgttcataatcgatgggcccaataccccagagtgcccgagtgcctcacgggcatggaatgtctgggaagtcgaggactacggatttggggtcttcactacaaacatatggctcaaactgagggaagtttacacacagatgtgcgaccatcgcctaatgagcgctgcagtcaaagatgagcgtgccgtacacgcagacatgggatactggatcgaaagtcagaaaaacggttcctggaaattagaaaaagccagtttaatagaggtaaaaacttgcacgtggcccaaatcgcatacactctggtctaatggagtgttagagtctgacatgatcattccgaagagtctagcgggcccaatatcgcaacacaactaccgccctggctaccacacacagaccgcgggtccttggcatctaggaaaattggaattagacttcaattattgcgaagggacgaccgtagtgatcacggaaaactgcggaacccgaggcccatcactccggacgaccaccgtcagcggtaagctgatccatgaatggtgctgtcgctcttgtaccctgccacccttacggtacatgggggaagacggatgctggtacggcatggagatacgacccataagtgagaaggaggaaaatatggtgaaatccctagtgtccgccggctcgggaaaggtcgataactttaccatgggagtattgtgccttgccattctattcgaggaggtaatgcggggaaaattcgggaagaaacacatgatagctggagtgttcttcacattcgtactactcctatcgggacagattacatggcgcgacatggcacatacactgatcatgataggctccaatgcaagtgatcgaatgggaatgggcgtgacatacctcgcattgatagccacattcaaaatacaaccgttcctagcactaggtttcttcctcagaaagttaacaagccgcgagaacttacttcttggagtaggtctggccatggcaactaccctccaattacccgaggacattgagcaaatggcaaatgggattgcactaggcctgatggccttaaagctaatcacacagttcgagacgtaccaactctggactgccttgatctcgctgacatgcagcaataccatattcacacttaccgtagcatggcgcaccgccacgctgatccttgcaggcgtctcccttctaccggtttgccagagcagcagtatgaggaagacagattggctgcctatgacagtagccgccatgggggtcccgccgttaccactcttcatattttcactcaaagacaccctcaagaggcgatcctggcccctcaacgaaggcgtgatggccgtaggcctagtatctatgttggcctcctccctgttgagaaatgacgtgcccatggcaggtcccctggttgccggtggcctcctgatagcgtgctacgttatcacgggcacaagcgcggacctcacagtagaaaaagcggccgacgtgacctgggaggaagaagcagaacaaaccggagtatcccataaccttatgattacagttgacgacgatggaacaatgcgaatcaaagacgacgaaacagagaacatcctgacggtactgctgaagactgccctgctgatcgtatccggaatattcccctacagcataccggcgacgctcctcgtatggcacacctggcagaaacagacgcaaaggagcggagtactctgggacgtcccatcgccgcccgaaacacaaaaagcggagttagaggaaggcgtttacaggatcaaacagcaaggaatcctcggcaaaacgcaagtaggtgtgggcgtacagaaggacggagtgtttcacaccatgtggcacgtgacccggggcgcggtgctaacacacaacggcaaacgactggagcctaactgggcgagtgtcaagaaggacttaattagttacgggggtggctggagactttcggcccaatggcagaaaggcgaagaagtccaggtaatcgccgtagaaccagggaagaatccgaaaaacttccagactatgccaggaacgttccagaccaccacgggagaaatcggcgcaatcgccttagacttcaaaccaggaacgagcgggtcccccatcattaacagggaaggtaaagttgtaggactctatggcaatggcgtagtaaccaaaaatggagggtacgtatcgggaatcgcccaaacgaacgccgagcctgacggaccaacaccggagctcgaagaggaaatgtttaagaagagaaacctcaccattatggacctacacccgggctcaggcaagacgaggaaatacctacccgccatcgtaagggaggcgattaagaggcgtttgagaaccctcatccttgcacccacccgggtcgtggcagcagagatggaagaggccctgaagggcctcccgatccgataccagaccacagcgacgaaatctgagcataccgggagagagatcgtagatctgatgtgtcacgcgacctttacgatgcgtctattaagtccagtccgagtccctaattacaacctaataattatggacgaggcacactttacagatccagcgtcgatcgcagcaagggggtatataagcacgagagtcggcatgggagaagcagccgccatatttatgactgcaacccctcccggtacagcagacgcattccctcaaagcaacgcacccatccaggatgaggaaagggacatacctgaacgcagctggaatagcgggaacgaatggataacagacttcgccggcaaaacagtgtggttcgtgccaagcattaaggccggaaacgacatcgcgaactgcctacggaaaaatggaaagaaagtcatccaactaagccgcaaaacgttcgacacggaataccagaaaacgaaacttaacgactgggactttgtagtcaccacggatatatccgaaatgggcgccaacttcaaggccgaccgggtaatagacccaagaaggtgtctcaagccagtgatcctcacagacggccccgagcgagtaattctggcggggcccatgcccgtgaccgccgctagtgctgcccaaaggagaggacgcgtgggacgcaatccacaaaaagaaaacgaccagtacatcttcaccggacagcctctgaacaatgacgaagaccacgcccactggacggaggcaaagatgctactagacaatataaacacccctgagggcatcattcctgcactttttgagccagaacgagagaaaagcgcagcaatagatggagaataccgtctgaaaggagagagccggaagactttcgtagagcttatgcgtcgcggagacttgccagtctggctagcccataaggtagcatcagagggcataaagtacactgacagaaagtggtgcttcgatggccaacgcaacaatcaaatactagaggaaaacatggacgtagaaatttggacaaaagaaggcgagaagaagaaactacgcccaagatggctcgatgcccgtacatacagtgacccgctagccctcaaggagttcaaggatttcgccgccggcaggaaaagcatagccttagacctcgtcactgagataggtagagtaccttcacacctcgctcataggacacgcaatgcattagacaaccttgtcatgctgcatacgagtgaacacggaggccgtgcctatcgccacgccgtagaggaactaccggaaacgatggaaacactcctactcctcggccttatgattttactcacagggggcgccatgctattcctcattagcggcaaagggatcggaaaaacttcaatcggattgatatgcgtaatcgccagtagcggtatgctctggatggcagagattccactccagtggatcgccagtgctatagtcctagagttcttcatgatggtgctcctaatccctgaaccagaaaaacaaagaactccgcaagacaaccagctcgcatacgtagtaataggcatactcacaatggcagcgataatcgccgccaatgaaatgggcttgcttgagacgacaaaacgagatctcggcatgagcaaagagccaggcgtggtaagcccgacatcatacttggacgtagacctacatccagcaagcgcatggacactgtatgcggtagcaacaaccgtaataacaccgatgttaagacacacaatcgaaaactcaacagcaaacgtatcactcgccgcgatagcgaaccaggccgtggtcctcctcggcttggacaaaggatggccaattagcaaaatggaccttggtgttcctctcttagccctgggttgctacagccaggtaaatccactaacgctaacagcggccgtgcttcttttggtcacccactacgctatcatcggaccgggtctgcaggcgaaggcaacgagagaggctcagaaaaggaccgcagcgggaatcatgaaaaaccccacggtcgacggaatcatcacaatcgatctggacccagtgatctacgacagcaagttcgaaaaacaactcgggcaggtcatgctgcttgtactctgcgctgtgcagctgttattaatgcgtacgtcgtgggcattgtgcgaagcactcacgctcgctacgggaccaattacaacgctatgggaaggctctccgggcaagttctggaacacaacaatcgccgtatcaatggcaaacattttccggggtagttacctcgcaggagctggtctagccttctcaataatgaaatcagtcggaactggaaaacgagggacaggatcacaaggggagacactcggggagaagtggaagaaaaagctaaaccaactttcccgaaaagaatttgatttatacaagaaatccggcatcacagaggtagaccgaactgaagcaaaagaaggcctgaaacgtggtgaaacgactcaccacgcagtctcaaggggcagcgcaaaacttcaatggttcgtcgaacgtaacatggtcatccccgaagggagagtgattgacctgggatgcggacgcggagggtggagctattactgtgcagggctcaagaaagtaacggaagtccggggttacactaaaggaggcccgggacacgaagaacctgtaccaatgtccacatatggctggaacatagtaaagttaatgagcgggaaggacgtattttacttgccacctgagaaatgcgacaccctcctatgcgatatcggcgagagctcacccagccccacggtcgaggagtcgagaaccataagagttctcaaaatggtagaaccctggctaaagaacaaccagttttgtatcaaggtccttaacccttacatgcctgctgtgattgagcatctagagcgcctccagcggaaacacggagggatgctcgtgcgcaacccgctctcacgcaactctactcatgaaatgtactggatttcgaacggcacaggcaacatcgtcagttcagtcaatatggttagccgcctgttacttaatcggttcaccatgacccacagacgtccgacaatagagaaggacgttgacctaggagcggggactcgccacgttaatgcagagcccgaaaccccgaacatggacgtaataggcgaacgaataaaaagaatcaaagaagaacataacagtacatggcactacgacgacgagaatccctacaagacctgggcgtaccatggctcatacgaggttaaggcaaccggttccgcaagctccatgatcaatggggtagttaaattgctcacaaagccgtgggacgtagtcccgatggtgacccaaatggctatgacagataccacaccgttcggacaacagagagtgtttaaggaaaaagtggacacgaggaccccacgccccatgccaggaacacgcaaggtcatggaaattaccgcagaatggttatggagaacactcggccggaacaagcgcccaagactctgcactcgtgaggagttcacgaagaaagtgcgcacaaacgcagcgatgggcgcagttttcacagaggagaaccaatgggactcggctaaagcagctgtcgaggacgaagagttctggaagctcgtagaccgggagcgagagctacacaagctgggcaagtgcggctcatgcgtctacaacatgatggggaagcgggaaaagaaacttggcgagttcgggaaagcgaagggctcccgagcaatttggtacatgtggctgggagctcgctacttggagttcgaggcactcgggttcctgaacgaagaccattggtttagcagagagaacagctattccggcgtagaaggcgaaggactgcataagctggggtacatactaagggacataagcaaaataccagggggagcaatgtacgcggatgacaccgctgggtgggacacgcgcataaccgaagacgatttgcataacgaagagaagatcacccaacaaatggacccggaacatcgcctactagcgaacgcaatctttaaactcacctaccaaaataaagtcgttaaagtgcagcgccccacgcccacgggaaccgtcatggacattatctcccgaaaggatcaacgcgggagcggacaggtaggcacgtatggactaaacactttcacaaacatggaagcgcaactcgtcagacaaatggaaggtgagggagttctctcaaagactgacctggaaaacccccacttgcctgagaagaaaattacccaatggctagaaaccaaaggagtcgagcgcctaaaaagaatggcaatctcgggagacgactgtgtagttaaaccgattgacgatcggttcgcaaacgccctcttagccctaaatgacatgggcaaagtacggaaagatataccccagtggcaaccaagtaaaggctggcacgactggcaacaagtaccgttctgctcccaccacttccacgaacttattatgaaagacggacgtaaactcgtggtaccgtgccggccacaagacgaactcatagggagagccaggataagccaaggagctggctggtccctaagggagacagcgtgtcttgggaaagcgtacgcccaaatgtggtcacttatgtacttccacaggcgagatctaagactggcgagcaacgccatatgctcagcgataccagtacattgggtaccgacatcgcgaacaacatggtccatccacgcacatcaccagtggatgacaacagaagacatgctaacagtctggaaccgagtctggatagaagacaacccgtggatggaagacaaaacacccatcaccacgtgggagaacgtgccctatctggggaaacgagaggaccaatggtgcggctctctaatcggactgacgtcaagggccacctgggcccagaacatacccacggccatacaacaagtcaggagcctgatcggcaatgaagagttcctcgattacatgcccagtatgaaaaggttccgcaaggaggaagaaagcgaaggggccatatggtga

SEQ ID NO: 25627 - RNA, 9873 nt, synthetic construct
  misc_feature 1..9873: note = derived and/or modified CDS sequence (opt11) from DENV-3__KF954947__SS-prME
  source 1..9873: mol_type = other RNA
accagcttatgcttgatgatgatcctgccggcagcgctggcctttcacctaacatcccgggacggggaaccccgaatgatcgtgggcaagaatgaacgaggaaagtcgctgctttttaagacagcctcaggaatcaacatgtgcacgcttattgccatggacctgggggaaatgtgcgacgacaccgtcacatacaaatgcccccacatcaccgaagtagaaccggaggatatcgactgctggtgcaacctgacgtctacatgggtgacctacggcacctgtaaccaagccggagaacatagacgcgataagaggtcagttgcgcttgcgcctcacgtcggaatgggcctagacacaaggacacaaacgtggatgagcgctgaaggcgcttggcgacaggtcgagaaagtggagacatgggcgctacggcatccaggcttcacaattcttgccttattcctggcgcattacatcggaacaagcctcacccagaaagtcgtaatcttcatcttgctaatgctggtaaccccaagtatgactatgagatgtgtaggtgtcggcaaccgcgacttcgtggagggtctatcgggagccacatgggtggacgtcgtattagaacatggtggatgcgttacaaccatggcaaagaacaaacccacactcgacatagaactccagaagaccgaggcaacccaactagctaccctacgcaagctctgtatagaaggcaaaatcaccaacataacaacggactccagatgtccaacgcagggggaagcagtacttcctgaagaacaagaccaaaactatgtctgtaagcatacgtacgttgatagaggatgggggaacggctgtggattattcggaaagggaagcctggtgacgtgcgcaaaattccagtgcctagaacctatagaaggtaaagtggtccagtacgaaaacctaaagtacacagtaatcataacggtgcacactggagaccagcaccaagttggaaacgagacgcaagggatcaccgccgaaataacaccgcaagcgtccaccaccgaagccatattacccgaatacggcacattaggcttagaatgcagcccccgcacaggtctagacttcaacgaaatgatactcctgacaatgaaaaacaaggcatggatggtacacagacaatggttcttcgacctgccactcccctggacaagcggggccacgacagaaacgcccacatggaaccggaaagagctactcgtaactttcaaaaacgcccacgcaaagaagcaggaggtagtagtgctaggatcccaggaaggggcgatgcatacagctctcacgggcgcaactgagatacaaaactctggcggaacctcgatatttgccggccatctcaagtgccggcttaaaatggacaaacttgaactaaaaggaatgtcgtacgccatgtgcacgaacacattcgtgctaaagaaagaagtatccgaaacacagcatggaactatcctgatcaaggtagagtacaagggagaggacgcgccgtgcaaaatcccttttagcacagaagatggccaagggaaggcacacaacgggcgtctaataactgcaaacccagttgtaactaaaaaggaagaacccgtgaacatagaagcagagcccccattcggcgaaagcaacatcgtgatcggcattggagataacgccctaaaaatcaactggtataaaaagggatcgtcaatcggaaaaatgttcgaggcgacagcacgcggtgcacgacggatggccatcctcggcgacacagcatgggactttggctccgtaggaggagttctgaactctctcggcaagatggtccatcaaattttcggtagtgcctacacggcactcttcagcggagtatcatgggtgatgaaaatcggaataggcgtcctcctaacgtggataggactgaacagcaaaaacacatcaatgagtttttcctgcatcgcaatcggaatcatcacactttacctcggcgccgtagtacaagccgacatgggctgcgtaataaactggaagggcaaagagctcaaatgcggcagcgggatctttgtgacgaacgaggtgcatacatggacagaacagtacaaattccaagcagatagtccaaaacgtctcgccaccgcaatagtcggcgcgtgggagaacggcgtatgtggtatacgaagtaccacgcgaatggaaaatctcctttggaaacaaattgcgaatgaactaaactatatactctgggaaaacaacatcaagttaactgtcgtggtaggcgacaccataggcgtcctggaacagggcaagcggaccctcactccgcaacctatggaactaaagtacagctggaaaacctggggcaaggcgaaaatcgtgaccgcagaaacgcaaaattcgtcctttatcatcgatggacccaacacacccgagtgtccctcggctagtcgggcgtggaatgtctgggaagtcgaggactatggatttggagtcttcacaaccaacatatggctaaagctcagggaggtatacacgcaaatgtgtgaccaccgactcatgagcgctgccgtcaaggacgaaagagcagtgcacgcagacatgggctattggattgaaagccagaaaaatggtagctggaaactagaaaaggcctccctcatcgaggtcaaaacctgcacttggcctaaaagccacacactgtggagcaacggcgtcctagagtcggacatgataataccgaaaagcctagcgggaccgatatcacaacacaactaccgccccggctatcacacccaaacagccgggccatggcacctaggtaaactggagctcgacttcaattattgtgaagggacgacggtggttataacagaaaattgtgggacgagaggcccatcactgaggacaacaacagtgtcgggaaaactcatccacgagtggtgctgccgcagctgcacactaccaccactgagatatatgggggaagatggctgctggtacggcatggagataagacccataagcgagaaagaggagaacatggtaaagagcctagtatctgcgggatccggtaaagtggataactttaccatgggcgtcctctgcctagcgatactctttgaggaggtaatgaggggcaagttcggcaagaaacacatgattgcaggcgtgttcttcacattcgttctattattatcggggcaaataacctggcgcgacatggcacacaccttaatcatgatcggatctaacgcgagcgatcgcatgggtatgggggtaacctacttagcgctcatagccacgttcaaaattcagcccttcttggcactaggatttttcctacggaagctcacttcacgcgaaaacctcttactcggcgtcggcttagccatggccaccacgctacaacttcccgaggatatagaacagatggcaaatggaatcgcgctgggactaatggccctaaaactaataacgcagtttgagacctatcaattatggactgccctgataagtttaacatgcagcaatacaattttcacactcacggtcgcttggcgaacagcaacgctaatcctagcaggcgtctcgctcctaccagtgtgccagtcttcgtctatgcgcaagacagactggctaccaatgacagtagccgccatgggggtgcctccgctgcccctctttatcttctctctgaaggacacgcttaaaagaaggagctggccactgaacgagggagtgatggctgtaggattagtctcaatgctcgccagctccctactgaggaacgacgtgcccatggccggcccactcgttgcgggtggacttctcattgcatgctacgtcattaccggaacctcggcagatctcaccgtcgagaaggcagcagacgtaacctgggaagaagaagcggagcaaacaggagtcagtcacaacctcatgataaccgtagacgacgatggaacaatgcgcatcaaggacgatgagacagaaaacatcctgaccgtactccttaaaacagccctgctcattgtctctgggatatttccgtacagcatacccgcaacactcctagtctggcatacctggcaaaaacagacccagcgaagcggcgtcttatgggacgtcccgtctccaccagaaacccagaaagcggaactggaagaaggcgtatatcgcataaaacaacaaggtatcctcggtaaaacacaagtgggcgtaggtgtacaaaaagacggagttttccacactatgtggcacgtgaccagaggggctgtcctcactcacaacggaaaaagattagaacctaactgggcctccgtaaagaaagatctcatcagttacgggggcggatggcgtctgtcggcacagtggcaaaaaggcgaagaggtacaggtaatcgccgtcgagcccggaaagaacccgaagaactttcaaaccatgcccggaaccttccaaactacgacgggcgagatcggggccatagcactcgacttcaaacccggaacatccggatccccaattataaaccgggagggaaaggtagtagggctgtacggcaacggcgtagtcaccaaaaacggcggatatgtaagcggaatagcacaaacaaacgccgaacctgatggccctactcccgaactggaagaagagatgttcaaaaagcgtaacctgacaatcatggacctgcacccggggagcggaaaaacacgcaaatacctaccggcgatagtccgtgaagctatcaaacgacgcctcagaacgctgatacttgcccccacgcgtgtagtcgccgcggaaatggaggaagcgctcaaaggcctacccattcgctaccagacaacagcgacaaaaagcgaacacacaggccgcgagatcgtagacctgatgtgccacgctacctttaccatgcgactactaagccccgtcagagtcccgaattacaacttaattatcatggacgaggcccacttcacggaccccgcaagtatcgccgcgagaggctacatctcaacaagagtcgggatgggagaagcggcagcaatctttatgaccgcaacaccacctggtacagcagacgcgttcccccaatcaaatgcccctatccaagacgaggaacgcgacataccagaacgctcctggaactctgggaatgagtggattaccgacttcgctggtaaaacggtatggttcgtaccttcgatcaaagccggcaacgacatagcaaactgcctacgaaagaacggcaagaaggtcattcaattgtctcggaagacatttgacacagaataccagaaaaccaagttgaacgactgggacttcgtcgttactactgacatctcagaaatgggggcaaatttcaaagccgaccgcgtcatagacccacgccgatgcctgaagccagtaatcttgactgatgggccagagcgtgtgatactggccggaccaatgcccgtcacggcagcgtcggctgcgcaaagacggggccgcgtcggcaggaaccctcagaaagaaaacgaccaatacatattcacgggacagccactaaacaacgacgaggaccatgcacactggacagaagcgaaaatgctcttggacaacatcaacactccggaagggatcattccggccctgttcgaacccgaacgcgaaaaatccgcagcaatagacggagagtaccggcttaaaggggaatctcgcaagacattcgtagaactcatgcgccgaggagaccttccagtatggctagcacacaaggtagcaagcgaggggatcaaatacaccgaccgaaaatggtgtttcgatggacaacgcaacaaccaaatcctggaagagaatatggacgtagaaatatggaccaaggagggtgagaagaagaagctgcgcccgagatggctagacgcacgcacatactccgaccccctagcgttaaaggaatttaaggatttcgcggccgggcgaaaaagcatagcgttagatctggtgaccgaaatagggcgagtcccatcccatttagcgcaccggaccaggaacgccctagataacttggtcatgctacacacttcggaacacggcggacgagcatatagacatgctgtcgaagaactacccgagaccatggaaacactcctccttctgggactcatgatcctccttacgggaggagctatgctgttcttaatttcggggaaaggcatagggaaaacaagcataggattgatttgtgtcatcgcgtccagcggcatgctatggatggcagaaatacccttacaatggatagcgagcgccatagtgctcgagttcttcatgatggtcctactaatccccgaaccggaaaagcagcgaactccgcaagataaccagctcgcatatgtcgtgataggaatacttaccatggccgccataatagcagctaacgagatgggtctcttggaaacgaccaagagagacctaggcatgtctaaggaacccggcgtagtctcaccaacaagctatctagacgtagatctacatcccgcaagcgcctggactctatacgcggtcgcaacgaccgtaataacacccatgctccggcacacgatcgagaactcaaccgcgaacgtatcccttgcagccatagcaaaccaagccgtggtcctcatgggactcgacaagggctggccaatatccaagatggacctgggcgtgccgcttctcgcgctcggatgttattctcaagtcaaccccctgacactgacggcagccgtactcctactcgtcacacactacgccataatagggcccggactgcaggccaaagcgaccagagaagcccagaaacgcacggcagccggaatcatgaaaaatcccacagtggatggaattatcacaatagatcttgaccccgtgatctacgacagtaaatttgaaaaacagctcggccaggtgatgctcctagtcctatgtgccgtgcaattactactcatgaggacgtcgtgggcactctgtgaagcattgaccctcgccaccggacctatcacaacgctctgggaaggcagcccaggcaaattctggaacacaaccatagcggtgtccatggccaacatatttagggggtcatatctcgctggcgccggcctggcattctcgataatgaaatcggtaggaacgggcaagcgcggcaccggaagccaaggtgagacactcggagaaaagtggaagaagaaacttaaccagctatcgcgcaaagagttcgacctatacaagaaatcaggcatcacggaggtcgatcgaacagaggcaaaggaggggctaaagcggggcgagacgacccaccacgcagtctcaagaggctcagcaaagctccaatggttcgtagaacggaatatggtgattccagaagggagagtaatcgatttgggatgcggcagagggggttggagctactactgtgccggcctgaagaaggtaaccgaagtccgaggatatactaagggcggacccggacacgaagaaccggtacccatgtcgacttacggatggaacatagtcaagctcatgtcaggcaaagacgtgttctatctaccacccgaaaagtgcgacactttattatgcgacataggcgaatcatcaccgtccccaaccgtcgaggagtcgcggacgatacgagtgttaaaaatggtggagccctggctcaaaaacaaccaattctgtattaaggtcctgaacccgtatatgccggccgtgattgaacatctggaacgcctacaaaggaaacacggtggcatgcttgtgcgcaaccccttgagtagaaactccacgcacgaaatgtattggatcagcaacggaaccgggaacatcgtatcaagcgtaaacatggtgagccgattgctactaaacagattcacgatgacgcaccgccggcccactatcgaaaaagacgtagacctcggcgcaggtacgaggcacgttaacgccgaacctgagacaccaaacatggacgtaatcggtgaacgcatcaaacgcatcaaagaggaacacaactcgacatggcactacgacgacgaaaacccgtacaaaacatgggcatatcacggcagttacgaagtcaaggccacagggtccgcgtccagcatgatcaacggagttgtaaaactgctaacaaaaccttgggacgtggtgccgatggtgacgcagatggcgatgacagatacgaccccttttggccaacaaagagtgttcaaggaaaaagtagacacaagaacgccccgcccgatgccaggcacacggaaggtaatggaaatcaccgccgaatggctttggaggacgcttggacgcaataagaggccccgcctctgcactagggaggagttcaccaagaaagtgcgcacaaacgcggctatgggagcggtattcactgaagaaaaccaatgggactcggcaaaagctgccgtagaagacgaagaattttggaaactggtagaccgtgaacgggaactccacaagctgggcaaatgcggtagctgcgtctacaacatgatgggaaaacgcgagaagaaactcggtgaatttgggaaagcaaaagggtcacgcgccatttggtacatgtggctcggggcccggtatctcgagttcgaagctcttggattcctaaatgaggaccactggttttcaagagaaaactcgtacagcggagtagaaggtgagggtctacacaaacttggctacatattacgggatatctcgaaaatcccaggcggggccatgtacgcagacgatacagccggttgggatacccgaatcaccgaagacgatctgcacaatgaggagaaaataacccagagaatggatcccgaacataggctactagcgaacgccatattcaaacttacataccagaataaggtagtgaaggtacaacgaccaacccccactggcacggtaatggacataatcagccgaaaggaccaacgcggcagtggtcaggtcggaacgtacgggctcaacacgttcacaaacatggaggcacagttagttcgacagatggagggagaaggcgtactaagcaaaacggatctcgaaaacccacacctaccagagaagaaaataacgcagtggctagaaaccaaaggcgttgaacgtttaaagcggatggcgataagcggcgacgactgcgtcgtcaaaccaatcgatgacagattcgcgaacgccctcttggccctcaacgacatggggaaagtacgcaaagacataccacagtggcagcctagcaaaggttggcacgactggcaacaggtaccgttttgcagccaccacttccacgaactgatcatgaaggacggccgcaaactggtggtaccgtgcagaccacaagacgaacttattggccgtgcacggatctctcaaggtgccggctggtccctacgtgagacggcatgcttgggtaaggcatacgcacagatgtggtccttgatgtactttcaccgccgagacctgagattagcgtccaacgcgatatgttccgccataccagtccactgggttcctaccagtcgcaccacctggagcatccacgcacaccaccaatggatgaccaccgaagacatgctcaccgtatggaaccgtgtgtggattgaagataacccatggatggaggacaagaccccaattacgacatgggaaaatgtcccttacctcgggaagagggaagatcagtggtgtggatccctaataggactaacctcacgcgcaacatgggcccaaaatataccaacggcgatccagcaggtcagatcccttattggcaatgaggagttcctggactacatgccctctatgaaacgctttcggaaggaagaggagtccgaaggagccatttggtaa

SEQ ID NO: 25628 - RNA, 9873 nt, synthetic construct
  misc_feature 1..9873: note = derived and/or modified CDS sequence (opt11) from DENV-3__KF954945__SS-prME
  source 1..9873: mol_type = other RNA
acaagcctctgcctcatgatgatcctgcccgccgcactagcgtttcacctcaccagccgggacggcgaaccccggatgatagtggggaaaaatgaacggggcaaaagcctgctgttcaagaccgcctccggaataaatatgtgcaccctcatcgccatggacttaggcgaaatgtgtgacgacaccgtgacctataagtgcccccacatcacggaggtggagcccgaggacatcgactgctggtgtaacttgaccagcacatgggtgacctacgggacgtgcaaccaggcaggcgagcaccggcgcgataaacggagtgtagccctcgcacctcacgtcggaatggggctggacacccgcacgcagacgtggatgagcgccgagggggcctggcgccaggtggagaaggtggagacctgggccctccgccacccgggattcaccatcttggctctgttcttggcccactacatcggcaccagtctaacccagaaggtggtgatcttcatcttactgatgctcgtcacaccgagcatgaccatgcggtgcgtgggggtgggcaatcgcgacttcgtcgagggcctgtccggtgccacctgggtggacgtggtcctagaacacggcggatgcgtgaccacgatggccaagaacaagcccaccctcgacattgagctgcagaagaccgaggccacccagctggcgattctccggaagctgtgcatcgagggcaagatcacgaatatcaccaccgacagccgctgccccacacagggcgaggccgtgctgccggaggagcaggaccagaactacgtttgcaagcacacctacgtggaccgggggtggggaaacggctgcggcctcttcggtaagggctccctggtgacctgcgcaaagtttcagtgtctggaaccgatcgagggcaaggtcgtgcagtacgagaacctcaagtacacagtgatcattaccgtacacacaggggaccaacatcaggtgggcaacgagacccaggggattacagccgagatcactccccaggcctccacaaccgaggcgatcttgccggagtacgggaccctggggttggagtgctctccgcgcacaggcctggacttcaacgagatgatcctgctcaccatgaaaaacaaagcctggatggttcaccgtcaatggtttttcgacctgcccctgccctggacgagcggtgccaccacggaaacccccacgtggaaccgcaaggagttgttagtgaccttcaagaatgcacatgctaaaaagcaagaggtggtcgtgctggggtcccaggagggcgcgatgcacaccgcgttgaccggagctacggaaatccagaacagcggcgggacctccatcttcgccggccacctaaagtgccggctcaagatggacaagctcgaactgaagggcatgtcctacgccatgtgcaccaacaccttcgtgttgaagaaggaagtcagtgagactcagcacgggaccatcctaatcaaggtggagtacaagggcgaggacgccccgtgcaagatacccttcagcaccgaggacggccagggcaaggcacataatggccgcctaatcaccgcaaaccccgtggtgacgaagaaggaggagccggtgaacatcgaggccgagcccccattcggtgagagcaacatcgtgatcggcatcggtgacaacgcgttaaagatcaactggtataaaaagggatcaagcatcgggaagatgttcgaggcgaccgcacggggcgcccgccgtatggccatcctgggcgataccgcgtgggacttcgggtccgtcggtggtgttctcaacagcctgggcaagatggtgcaccagatcttcgggtccgcttacactgccctgttcagtggcgtatcctgggtgatgaagatcggaatcggggtactcttaacttggattggtctgaatagcaagaacacctccatgagcttctcctgcatcgccatcgggatcatcacattgtacctgggcgctgtcgtgcaggccgacatgggctgtgtgatcaattggaaaggcaaggagttaaaatgcggcagcggtattttcgtcaccaacgaggtgcacacgtggaccgagcaatacaagttccaggctgactcccccaagcgcctcgccacagccatcgtgggcgcctgggagaacggagtgtgtggcatcagaagcacgacccggatggagaacctactgtggaagcagatcgcgaacgagctcaactacatcctgtgggagaacaacatcaagctgaccgtcgtagtaggagacacgatcggcgtcctcgagcaggggaaacgcaccctaacgccccagccgatggagctgaagtactcatggaagacctggggtaaggctaagatcgtgactgcggaaacccagaatagctccttcatcattgacggcccgaacacgcccgaatgccccagcgcctcccgggcctggaacgtctgggaggtggaagattacgggttcggggtgttcaccacgaatatctggctcaaactgcgggaggtctacacccagatgtgcgaccaccgcctgatgagcgccgcagtgaaagacgaacgcgccgtgcacgccgatatgggctactggattgagagccagaagaacgggagttggaagctcgagaaggccagccttatcgaggtcaagacctgcacttggccgaagtcccacaccctctggagcaacggcgtgttggagtctgacatgatcatccccaagagcctggccggtcccatatcccagcacaactaccggcccggctatcacactcagaccgcggggccatggcacctgggtaagctagagctggacttcaactattgcgagggcacgaccgtcgtcatcaccgagaactgcgggacccgcggaccctccctgcgcacgaccaccgtgtccgggaaactcatccacgagtggtgctgccgcagctgcaccctccccccgctgcggtacatgggcgaggacggttgctggtacggaatggaaatccgccccatctccgagaaggaggagaacatggtaaagagcctcgtctccgccggctcggggaaggtggacaatttcacgatgggcgtgctctgtctggccatcttgttcgaggaggtcatgagaggtaagttcggcaaaaaacacatgatcgcgggggtattcttcaccttcgttctgctgctgtccggccaaatcacctggagagacatggcccataccctaatcatgataggcagcaacgcctccgaccggatggggatgggcgtcacgtacctggccctaatcgctaccttcaagatccagcccttcctggctctgggattcttcctcagaaagctgacaagccgggagaacctgctcctgggcgtgggcctggccatggccaccacgctccagttacccgaagacatcgagcaaatggccaacgggatcgctcttggcctcatggccctgaaactcatcacacagttcgagacctatcagctctggactgccctgataagcctgacgtgctccaacaccatcttcaccctcacggtcgcgtggcgcacggccacccttatccttgcgggggtcagcctgctgccggtgtgccaatcaagctccatgcggaagaccgactggctgcccatgaccgtggccgccatgggcgtgccgcccctcccgctgttcattttcagcctgaaggatacgctcaaacgccgctcgtggcccctgaacgagggggtgatggccgtcggcctggtgagcatgctcgcctccagcctgctccgtaacgatgtgcccatggccgggcccctcgtcgccgggggcctgctgatcgcgtgctatgtgatcacggggacctccgctgatttaaccgtggagaaggccgctgacgttacgtgggaagaggaggccgagcagaccggtgtgagccacaacctgatgatcaccgtggacgacgatgggaccatgcgcatcaaggatgacgagactgagaacatcttaacggtcctactcaagaccgccctgctcatcgtgagcggcatcttcccgtacagcatccccgcaacccttcttgtgtggcacacctggcagaagcagacgcagcggtccggcgtcctctgggacgtgcccagcccgcccgaaacccagaaggctgaactggaggagggggtataccgcatcaagcagcagggaattctggggaaaactcaggtcggcgtgggggttcagaaggacggcgtcttccacaccatgtggcacgtgacgcggggcgcggtgctgacccacaacgggaagcgcctggagcccaattgggcctccgtcaagaaggacctgatcagctacggggggggctggcggctctccgctcagtggcagaaaggggaggaggtccaggtgatcgccgtcgaaccgggcaagaaccccaagaactttcagaccatgcccggcaccttccagacgaccaccggggagataggtgcgatcgccttggacttcaagcccggcacctcgggcagccccatcatcaaccgcgagggcaaggtcgtagggctgtacggcaacggggtcgtgacgaagaatggcgggtatgtgtccggcatcgcccagaccaacgccgagccggatggccccacccccgagctagaggaggagatgttcaagaagcggaatctaaccatcatggacctgcaccccgggtcgggcaagacccgcaagtacttgccggccatcgtgcgggaggctatcaagcgccggctccgcaccttgatactggcgcccacccgggtcgtggccgcggagatggaggaagccctcaaaggcctgcccatccgctaccagactaccgcgacaaagtccgagcacaccgggcgggagattgtggacctgatgtgtcacgccacttttacgatgcgcctcctgagccccgtacgggtgccgaactacaacctgatcatcatggacgaggcacactttaccgatcccgcctccatcgccgcgagagggtacatcagcacccgggtcggcatgggcgaggccgccgccatctttatgaccgcgacgccgcctggcaccgccgacgccttcccgcagtccaacgcccccattcaggacgaggagagggacattccggagcgcagctggaactccggcaatgagtggatcacggacttcgccgggaagacagtgtggttcgtgcctagcatcaaagcgggcaacgacattgcaaactgcctaaggaagaacgggaaaaaggtcatccagctgtcccgcaagacgttcgacaccgagtaccagaagaccaagttgaacgactgggactttgtggtaaccacggatattagcgagatgggggccaacttcaaagcagaccgggttatcgaccctcggcggtgccttaagccagtgatcctgaccgacggccccgaacgcgttatcctggccgggcccatgccggtcaccgcggcctcagccgcccagcggcgcggccgggtggggcggaacccccaaaaggagaacgaccagtacatcttcaccggccagcccctcaacaacgatgaggaccacgcccactggaccgaggcgaagatgctgttagacaacatcaatacgcccgaggggatcatcccggccctctttgagcccgagcgggagaagtccgcagccatcgacggcgagtaccgcctgaagggcgagtcccgaaagacattcgtggagctgatgcgccgcggggatctccccgtctggcttgcgcacaaagtggcttccgagggcatcaagtacaccgaccgcaagtggtgcttcgacgggcagcggaacaatcaaatcctggaggagaacatggacgtggagatatggacaaaggagggggagaagaagaagctccgccctcggtggctggacgcccgcacatacagtgaccccctggccctcaaggaattcaaagacttcgcagcgggccgcaagagcatcgcccttgacctggtgacggaaataggtcgggtgccctcccacctcgcgcaccgcacccggaacgcgctggacaatttggtcatgttgcacaccagcgaacatggcgggcgcgcctaccggcatgcggtagaggagctgcccgagacaatggagactctgctcctgctaggcctcatgatcctgctgaccgggggcgccatgctgttcttgataagcggcaaggggatcgggaagacctccatcgggctgatttgcgtcatcgccagcagcggtatgttgtggatggccgagattccgctgcagtggatcgcgagcgcgatcgttctggagttcttcatgatggtgctgctcatccctgagcccgagaagcaacgcacgccccaggacaaccaactggcctacgtcgtcatcgggatcttgactatggccgccatcatagccgcgaacgaaatgggcctgctggagaccactaagcgggacctcggcatgtctaaggaaccgggtgtggtctcccccacgtcctacttggacgtggaccttcaccccgcgagcgcctggaccttgtacgccgtggcgaccacggtaatcactcccatgcttcgccataccatcgagaacagtaccgccaatgtcagcctggctgccattgcgaatcaggcggtggtgctaatgggattagacaagggctggcccatctccaagatggacctgggcgtgcccctgctggccctggggtgctattcacaggtgaacccacttaccctcacggcagcagtgctgttactggtcacccactacgccataataggccccggcctgcaggcgaaggccacccgggaggcccaaaagcgcaccgcggccgggatcatgaaaaacccgaccgtggatggcataatcaccattgacctagaccccgtgatctatgactccaaattcgagaagcagctggggcaggtcatgctgctcgtgctgtgcgcggtgcagctgctcctgatgcggacgagctgggccctttgcgaggccctcacccttgccacgggccccatcaccaccctgtgggagggctcccccgggaagttctggaacacgacgatcgcggtcagcatggccaacatcttccgcgggtcctacctcgccggggcaggcctggccttcagcatcatgaagtccgtcgggaccggcaaacggggcaccgggagtcagggcgaaaccctgggggagaagtggaagaagaagctcaaccagctcagccgcaaggagttcgacctgtacaagaagtccgggatcaccgaggtggaccgtacggaggcgaaggagggactcaagagaggagagaccacacaccacgccgtcagccggggcagtgccaagctgcagtggttcgtggagcgcaacatggtgataccggagggccgagtcatcgacctgggctgcgggcgcggcgggtggagctactactgcgccggcctcaagaaggtgaccgaggtgagaggctacaccaagggcggacccgggcatgaggagccagtccccatgtccacgtacggctggaacatagtgaagctgatgtctggaaaggacgttttctacctgccgcccgagaagtgcgacaccctcctgtgcgacatcggagagtccagcccctcccctaccgtagaagagagccgcacgattagggtgctgaaaatggtagagccgtggctgaagaacaaccagttctgcatcaaggtcctcaacccttacatgcccgcagtgatcgagcacctcgagcggctgcaacgcaagcacggcgggatgctcgtgcgtaaccccctgtctcgcaacagtacccacgagatgtattggatctccaacggcactgggaatatagtcagctcggtgaacatggtgagccggctgctcctgaaccgcttcaccatgacacaccggcggccgaccatcgagaaggacgtcgacctgggcgcgggtacccggcatgtcaacgccgagcccgagacccccaacatggacgtgattggggagcgcatcaagcggataaaggaggagcacaactccacctggcactacgacgacgagaacccttacaagacctgggcctaccacggcagctatgaggtaaaggccactgggtctgccagctcgatgatcaacggcgtggtcaagctgctgaccaagccatgggacgtggtgccgatggtcacccagatggcgatgaccgataccactcccttcgggcagcagcgcgtgttcaaggagaaggtggacacacggaccccgcgccccatgcccggcacccgaaaggtcatggagataaccgccgagtggctctggagaactcttggccgtaacaaacgcccccggttatgcacccgcgaagagttcacgaagaaagtgcgcacgaacgccgcgatgggggcggtgttcacggaggaaaaccagtgggattccgccaaagccgccgtcgaggacgaagagttttggaaactggttgaccgggaacgagagctccacaagctgggcaagtgtgggtcgtgcgtgtacaacatgatgggcaagcgcgagaagaagctgggggagtttgggaaggccaagggctcccgagcgatctggtacatgtggctcggggcccggtaccttgagttcgaggccctgggcttcctgaacgaggaccactggttcagccgcgagaacagttatagcggggtcgagggcgaggggctccacaagcttggctacattctccgggacatcagcaagatcccgggcggcgccatgtacgccgacgacaccgcgggctgggacacccgcatcactgaggacgatctgcacaacgaggagaagatcacgcagcagatggaccccgagcatcggctgctcgccaatgccatatttaagcttacctaccagaacaaggtggtgaaggtgcagcgtcccacacccaccggtacagtgatggacattatctcgcggaaggaccagcgcggcagtgggcaagtagggacgtacggcctgaacacatttaccaatatggaagcacaactggtccgtcagatggagggcgagggcgtgctgagcaagaccgacctggagaacccgcacctccccgagaagaaaatcacacagtggcttgagaccaagggggtggaaaggctgaaacgaatggccatcagtggcgacgattgcgtcgtgaagcccatcgacgatcgcttcgcgaacgccctcctcgccctcaacgacatgggcaaggtgcggaaggatatcccacaatggcagccgagcaaggggtggcacgactggcagcaggtcccattctgcagccaccacttccacgaactcatcatgaaggacggccgcaaactggtggtaccttgccggccccaggacgagctcatagggcgcgcccggatcagccagggcgccgggtggtccctccgagagaccgcgtgcctgggcaaagcctatgctcagatgtggagcctgatgtattttcaccgccgggacctccgcctagcttcaaacgcgatctgcagcgccatcccggtccactgggtgcccacctctcggacgacctggagcatccacgcccaccaccaatggatgaccaccgaggacatgctgacggtgtggaaccgcgtctggatcgaggacaacccctggatggaggacaagacccccatcacaacctgggagaacgtgccgtacctcggcaagcgggaagaccagtggtgcgggagcttgatcggcctgacgtcccgggccacctgggcccaaaacatccccaccgcgatccagcaggttcggagccttatcgggaacgaggagttcctggactacatgccctccatgaagcgcttccggaaggaagaggagagcgagggagccatctggtga

SEQ ID NO: 25629 - RNA, 9873 nt, synthetic construct
  misc_feature 1..9873: note = derived and/or modified CDS sequence (opt11) from DENV-3__JX669495__SS-prME
  source 1..9873: mol_type = other RNA
acctccctgtgcttgatgatgatcctgccagcagccttggctttccatctaacgtctcgggacggagaaccccggatgatcgtggggaaaaatgagcgcggaaagtctctactgtttaagacggcctccgggattaacatgtgcactctcatagccatggacctgggggagatgtgcgacgataccgtgacctacaaatgcccccacatcacggaggtcgaaccagaggacattgactgctggtgcaatttaacttcgacctgggtgacctacggcacctgtaaccaggccggcgagcgaaggcgggataagaggtccgtggcgctcgcgccccacgtgggcatgggactggacaccaggacgcagacctggatgtctgcggaaggcgcgtggcgccaagttgagaaggtcgagacatgggcgctgcggcaccctggtttcacaatcctcgccctgttcctggcgcactacattggcacgtcccttacccaaaaggtcgtgatcttcatcttgcttatgctcgttacgccctcaatgactatgagatgtgtgggagttggcaaccgggacttcgtggagggcttatctggggcaacctgggtcgacgtggtcctagaacatggcgggtgcgttaccacaatggccaaaaataaacccaccctagacatcgagctacagaaaaccgaggccacccagctggcgacactacgcaagctgtgcatagaggggaaaattactaacatcaccaccgacagtcggtgcccgacgcagggcgaggccgtgctgcccgaggaacaggaccagaactacgtctgcaagcacacctacgttgaccgtgggtggggcaacgggtgtggtttatttgggaaagggtccctggtgacctgcgccaagttccagtgcctagaaccaatcgagggtaaggttgtgcagtacgagaacctcaagtacacagttatcataacagtccacaccggagaccagcaccaagtgggcaacgagactcagggtgtcactgccgaaattacgccacaggcgtcaacgaccgaagcgatcctgccggagtacggaactctgggacttgagtgcagcccgcgaaccggtctggacttcaacgagatgatcctgctcacgatgaagaacaaggcctggatggtccaccggcagtggttcttcgacctgccgctgccttggacctcaggggctaccaccgagacgcccacatggaaccggaaggagctcctggtcacctttaaaaacgcccacgccaagaaacaggaggtagtagtgctggggagtcaggagggcgcgatgcacactgccctcacaggggccaccgagatccaaaactccggcggtacctccatatttgccggccacctgaaatgccgcctgaagatggacaagctcgagctgaagggcatgagctacgccatgtgtaccaacacatttgtgctcaagaaagaagtatccgaaacccaacacgggacaatcctcatcaaagttgaatacaaaggcgaggatgctccgtgcaaaatcccgttcagcacagaggatgggcaaggaaaggcgcataacggtcggcttatcaccgccaacccggtcgtaacgaagaaagaggagcccgtgaatattgaagccgagccacccttcggggagtcaaacattgttatcggtatcggtgacaatgcactgaagattaactggtacaagaaaggctccagcattggcaaaatgttcgaagccaccgcccgcggggcccggcgcatggccattctgggggacactgcatgggactttggttccgtgggcggggtgctgaactccttgggcaaaatggttcaccagatattcgggtcagcctacaccgcacttttcagcggcgtctcctgggttatgaagatcgggataggggtcctcctgacctggataggcctaaacagcaaaaatacctccatgagcttcagctgcatcgctatcgggattattacgctttacctaggcgcagtcgtgcaagcggacatggggtgtgtaatcaactggaagggcaaggagctgaagtgcggaagtggaatcttcgttacgaatgaggtgcacacctggactgagcagtacaaattccaggctgactctcccaaacgtttggccaccgccatcgcaggagcctgggaaaatggggtctgcgggatcaggagcacgactagaatggagaacttattatggaagcagatcgccaacgagctaaactacatcttatgggagaataatataaaactgaccgtggtggtcggagacataattggggtgctcgagcagggcaagcggaccttaacaccccagccgatggagcttaagtacagttggaagacctgggggaaggcaaagatcgtcaccgccgagacccagaactcaagtttcatcatcgacggccctaacacgccagagtgccccagcgcgtcccgcgcgtggaacgtatgggaggtggaggactacggcttcggagtgttcacgaccaacatatggctcaagttacgggaggtctacacgcagttgtgcgaccacaggctcatgtctgcagccgtaaaggacgagagagctgtccacgcagatatgggctattggattgagtcacagaagaatgggtcctggaaacttgaaaaagccagcctgatcgaagtcaagacctgtacttggccgaagtcccatacgctctggtccaatggcgtactggagtccgacatgatcatcccaaaaagcctggccgggcccatctctcagcacaaccaccgcccgggttaccacacccaaaccgcagggccctggcatttaggcaaactggagctggacttcaactactgcgagggcacgaccgtcgtcattaccgagaactgcgggacacgtggccccagcctccgcacgacaaccgtgagtggaaaacttatacacgaatggtgctgtcgctcttgcaccctgcccccgctacgatacatgggcgaggacgggtgctggtacggaatggagatacggcccatttccgagaaggaggagaatatggtcaagagcctggtctcagccggttccgggaaggtagacaactttacgatgggagtgctgtgcttggcaattctctttgaggaggtcatgcgtggaaagttcggcaaaaagcacatgatcgccggggtgtttttcaccttcgtgcttcttttgagtggtcagatcacatggcgagatatggcccacaccctgatcatgatcggcagcaatgcctccgaccgcatggggatgggcgtcacgtacctcgccctcatcgcaaccttcaagatacaacccttcctggccttagggttctttctgcggaagctgacttctcgcgagaatctccttctcggagtgggcttggccatggctaccacgctacaattacctgaagatatcgagcagatggcgaacgggattgccctcggactgatggctctgaaactcatcacccagttcgagacctatcagctatggacggccctgatctccctaacatgcagtaataccatgttcaccttgaccgtggcctggcggacggcgactttaatcctagcaggggtttctctgctgcctgtatgtcagagtagctccatgcgtaagacggactggctcccaatggcagtcgccgctatgggcgtgccccctctcccgttattcatttttagcctcaaggacaccctaaagcgccggtcctggcctctgaacgagggggtgatggctgtaggcctcgtttcgattcttgccagtagcttgctccgcaacgacgtacccatggccgggccactggtagcaggcgggcttcttatagcctgctacgtcatcacggggacctccgcggacctgaccgtggagaaggctgctgacataacatgggaggaagaggccgagcagacgggcgtgagtcacaacttaatgatcactgtcgatgacgacgggactatgcgcatcaaggacgacgaaaccgaaaacatcctcaccgtgctgctgaagaccgccctcttgatcgtctctggtgtgttcccgtactccatacctgcgaccctgttggtgtggcacacctggcagaagcagacacaacggtccggcgtcctgtgggatgtgccttcacccccagaaactcaaaaggcggagctcgaggaaggagtttaccggatcaaacagcagggtatattcgggaaaacccaggtcggcgtcggggtgcagaaggaaggcgtctttcacaccatgtggcacgtgacgcgcggcgcggtgctcacgtacaacggcaagcggctggagcccaactgggcctccgtcaagaaggacctgatctcgtatggcgggggctggaggcttagtgcgcagtggcagaagggagaggaagtccaggtaatcgccgtcgagcccggcaaaaaccccaagaacttccagaccatgcctggcacattccagaccacgaccggggagatcggcgccatcgcactggacttcaagcccgggacaagcgggagcccgattattaatcgggagggcaaggtggtggggctgtatggcaacggggtcgtgaccaagaacggcgggtacgtgtccggcattgcgcaaacaaacgctgagccggatggccccacccccgaactcgaggaggagatgttcaagaaacgcaatttaaccattatggatttgcaccctgggagtggcaaaaccaggaagtatctgcccgccatcgtcagggaggcaattaagcggaggctccggacgcttatcctagcacccacacgcgtcgtggcggcggagatggaggaggccctcaagggactaccgattcggtaccagactaccgcgacgaagtctgagcatactggacgcgagatcgtcgacctgatgtgccacgctactttcaccatgcggctcttaagcccagtgcgagtaccgaattataacctgattatcatggatgaggcccacttcacggacccggcgtccatcgcggcgagagggtatatctccacccgagtcggcatgggcgaggcggcggccatcttcatgacagccacgccgccagggaccgctgacgcctttcctcagtcaaacgcccccatccaggacgaggaacgagacatcccggagcggagctggaactccggaaacgagtggattaccgattttgccggaaagaccgtttggttcgtgcccagcataaaggccggcaacgatatcgctaactgtctgaggaaaaacggcaagaaagtaatacaactgtctcgtaagaccttcgacaccgagtaccaaaagaccaaactcaatgactgggacttcgtggttaccaccgacatcagcgagatgggcgccaacttcaaggcagatcgtgtcatcgacccacggcgctgtctcaagcccgttatcctaacggacggccctgaacgggtgatcctggccgggccgatgcctgtcaccgccgcctctgccgcgcaaaggcggggccgtgtggggagaaacccccagaaggaaaacgatcagtacatcttcacgggccagccgttaaacaacgacgaggaccatgcacactggaccgaagccaaaatgctgcttgacaacatcaacacccccgaagggatcatccccgccctctttgagccagagcgcgagaaatccgctgccattgatggcgagtaccggctgaagggtgagtcccgaaagacattcgtagagctgatgcggagaggggacctcccggtctggctagcccacaaggtggccagcgagggcatcaagtacaccgatcggaagtggtgctttgacggccagcgcaacaatcagatcctcgaggagaacatggacgtcgagatctggacgaaggagggagagaagaagaagttacgaccccgctggttggacgcccgcacttacagcgacccgctggcgttgaaggagttcaaagatttcgccgcagggcggaaatcaatcgcactggatctggtgaccgaaatcgggcgagttccctcccacctggctcatcggacccgtaacgcgctggacaatctggtaatgctccacacgagtgagcacggagggcgggcctaccgacacgccgtagaggaactacccgagacgatggagactctgctcctgctgggtttaatgatattgctcaccgggggagccatgctgtttctgatcagtgggaaggggatagggaaaacctcgattgggttgatatgtgtgatcgccagctctggcatgctctggatggcggaaataccgctgcagtggatcgctagcgccatcgtcttggagttcttcatgatggtgctgctgatccctgaacccgaaaagcagcggacgccgcaggacaaccagttggcttacgtggtcattggtattttaacgcttgcagctatcattgcggccaacgagatgggcctgctcgaaaccaccaagagagatcttggcatgtccaaagagccgggcgtggtttcgcctacctcctacctggacgtggacctccaccccgcaagcgcgtggacgctctacgccgtagcaacgaccgtaatcacacccatgctgcggcatacgattgagaatagcacggcaaacgttagcctcgccgcgatagccaaccaggccgtggtcctgatgggcctggacaagggatggccgatctccaagatggacctcggggtccccttgttagcactagggtgctacagtcaggtgaatccactgacgctgaccgcggctgtgctcctgctgatcacgcactatgctattatcgggcccggcctccaggcgaaagccaccagagaggcccagaagcggaccgcggccgggataatgaagaacccgacagtggacggaataatgaccatcgacctggaccccgtcatctacgactctaagttcgagaagcagttaggccaagtgatgctgctggtcctgtgtgcggttcaactcctgctgatgcgcacctcttgggcattatgcgaggcgctgaccctcgctaccgggcccatcacgacactctgggagggctcgcccggaaagttctggaacaccaccatcgcggtgagcatggccaacatcttccggggcagctaccttgcaggagcggggttagcctttagcatcatgaagtccgtcggcaccggcaagcgtggcacaggtagccaaggagagacgcttggtgagaagtggaagaagaaactgaaccagttaagccggaaggagttcgacctctacaaaaagtccgggattactgaggtggaccgcaccgaggccaaggaggggctgaagagaggcgaaattacccaccatgccgtatcgagaggttccgcgaagctgcagtggttcgtcgaacggaatatggtgattccggagggtcgcgtcatagacttgggctgcggacggggcggctggtcatactactgtgcggggctgaagaaagtaaccgaggttagagggtacacgaagggagggcccggacacgaggaacccgtgcccatgtccacgtacgggtggaatatagtcaagctcatgtctggcaaggacgtattttatctcccacccgaaaagtgcgatactctgctgtgtgacatcggagaaagctctcccagcccaaccgtagaggaaagtagaaccatcagagtcttaaagatggttgagccctggctcaaaaacaaccagttttgcatcaaggtactgaacccctacatgccgactgtcattgagcacttagaacgcctccagcggaagcacggtggaatgctggtgcgcaaccccttatccaggaacagcacccacgagatgtattggatatctaacggaaccgggaacatcgtggcctcagtcaacatggtgagtcgattactgctaaaccggttcactatgactcaccgccggccaacaatcgagaaggacgtggacctcggcgctggcacccgccacgtcaacgctgagcccgagacgcccaacatggacgtgatcggcgagcggatcaagcgcataaaggaggagcataatagcacctggcattatgatgatgagaatccatataagacatgggcctaccacggttcctacgaggtaaaggctaccggaagcgctagcagcatgatcaacggcgtagtaaaacttttaaccaagccatgggacgttgtgcccatggttacccaaatggctatgacggacaccacgcccttcgggcaacagcgggtcttcaaggagaaggtggacactcgcacgccgaggagcatgcccggtacccggagagtgatgggcattaccgccgagtggttatggaggaccctaggtcgcaacaagaaaccacgactgtgtactcgcgaagagtttaccaagaaggtccggaccaacgcggctatgggcgcggttttcaccgaagagaaccaatgggactccgccaaagcggctgtggaggacgaggacttctggaaactcgtggaccgcgagcgcgagctgcacaagctgggaaagtgcggcagctgtgtgtacaatatgatgggcaaacgcgagaaaaagctcggcgagttcggaaaagccaaggggtcccgagctatctggtatatgtggttaggtgcacgctacctcgagttcgaagcccttggcttccttaacgaggaccactggtttagtcgggaaaattcatacagcggagtggagggggagggcctacacaagctgggctatatcctgcgcgatatatccaagatccccgggggagccatgtacgctgacgacactgccgggtgggacacccgaatcactgaagacgacctgcacaatgaggagaaaatcacgcagcagatggacccggagcatcgccagttagccaatgcaatcttcaagctcacgtaccagaacaaggtcgtgaaagtgcaacgcccgacccccacgggaaccgtaatggacattataagccgcaaggaccagcggggatcgggacaggtgggtacctacggactgaatacgttcaccaacatggaggcgcagctaattcgtcagatggagggcgagggggtcctgagcaaggccgacctcgagaacccccacctcccggagaagaaggtcacccagtggctggaaacgaaaggggtggagcgcctgaaacgcatggccatatccggcgacgactgcgtggtaaagccaatagacgaccggttcgccaacgctctcctggcgctaaacgacatggggaaggtccgcaaggacataccgcagtggcagccttccaagggttggcacgactggcagcaagtgccgttttgctctcaccactttcacgagctcatcatgaaagatgggaggaaacttgttgttccctgtcgcccccaggatgagcttatcggccgggcccgcataagccagggagccggttggtctctccgcgagacagcctgcctggggaaggcctacgcccagatgtggtcgctgatgtatttccatcgtcgggatctccggcttgcctccaatgccatttgtagcgcggtccccgtccactgggtcccgacctcccggaccacctggagcatccacgcgcaccaccaatggatgacgacagaggacatgcttacggtgtggaacagggtctggatagaggataacccctggatggaggacaagacccccgtgacgacctgggagaacgtgccctacctcggaaagcgcgaggaccaatggtgcggctctctgatcggattaacctcccgggccacttgggcccaaaacataccgaccgccatccagcaagtgaggagcctgatcgggaatgaagagttcctggactacatgccctctatgaagcgcttcagaaaggaagaggagagcgagggggccatctggtag

SEQ ID NO: 25630 - RNA, 9873 nt, synthetic construct
  misc_feature 1..9873: note = derived and/or modified CDS sequence (opt11) from DENV-3__JX669499__SS-prME
  source 1..9873: mol_type = other RNA
accagtctttgcctcatgatgatcctgccagccgccctggcgttccacctcacctcgcgggacggggagccccggatgatagtgggcaagaacgaacgcggcaagagcctgctgttcaagaccgcctccgggatcaacatgtgtaccctcatcgccatggacctgggggagatgtgcgatgatactgtgacctacaaatgcccccacatcaccgaggtagagcccgaggatatagactgctggtgtaacctgaccagcacctgggtgacctacggaacgtgcaatcaggccggcgagcgccgccgggacaagcgatccgtggccttggcgccgcacgtgggcatgggcctggacactcggacccagacctggatgagcgccgagggcgcctggaggcaggtggagaaggtcgagacgtgggctctgcgtcacccggggttcaccattctcgcgctgttcctggcccactacatcggcacctccctcacccagaaggtggtgatctttatcctactaatgctcgtcacgcccagcatgaccatgcgctgcgttggggtgggcaaccgtgatttcgtcgagggcctgtccggggccacctgggtagacgtggtcctggaacacggcgggtgcgtgaccacgatggctaagaacaaacccaccctcgatattgagttacagaagacggaggccacccagctagcaactctacgcaagctgtgtatcgaaggcaagataaccaacatcacgaccgactcccgctgtcccacgcagggcgaggccgttctgccggaggagcaggaccaaaactacgtttgtaaacacacctacgtggaccgcgggtggggcaacgggtgcggtctcttcgggaaaggcagcctcgtaacttgcgccaagttccaatgtctagagcccatcgagggcaaggtcgtgcaatacgaaaacctcaagtacacagtcatcatcacggtccacacaggggatcagcaccaggtgggcaatgagacccaaggggtcacggccgagataacgccccaggcctcgaccacggaggcgatactgcccgaatacggcaccctgggactcgaatgcagcccgcggaccggcctggatttcaacgagatgatcctgctcacgatgaaaaacaaggcttggatggtgcatcgccagtggttcttcgacctgcccctgccgtggaccagcggagcgacaaccgaaacgcccacctggaaccggaaagagctactggtgacatttaagaacgcccacgccaagaaacaggaggttgtggtgctagggtctcaggagggcgcgatgcataccgccttgactggggccaccgagatccagaacagcggcggcaccagcatattcgccggccacctcaagtgccgactgaagatggacaaactcgagctgaagggcatgtcatacgccatgtgcaccaataccttcgtcctgaagaaggaagtgtccgaaacccagcatggcactatcctcatcaaagtggagtacaagggcgaggacgcgccgtgcaagatccccttcagcacagaggacgggcagggcaaggcccataacggccggctgatcacggcaaaccccgtcgtgaccaagaaggaggagcccgtgaacatagaggccgagccgcccttcggggagtcaaacatcgtcatcggcatcggggacaacgcgcttaagatcaactggtataaaaagggctcctcgatcgggaagatgttcgaggccaccgcccgcggcgcccggcgcatggccatcctgggcgacacagcgtgggacttcggttccgtgggtggtgtgctcaacagcctgggcaagatggtccaccagatcttcggatcagcctacacggccctattcagcggcgtgtcctgggtgatgaaaatcggcatcggagtcctcctaacctggatcggcctgaattccaagaacacctccatgagcttctcctgcatcgccatcgggatcatcacgctctacttaggcgccgtggtgcaggccgacatggggtgcgttatcaactggaaaggcaaggagctaaaatgcggcagcgggatcttcgtgacgaacgaggtgcacacctggaccgagcaatacaagttccaggccgactctcctaagaggctcgccacagccatcgctggcgcgtgggagaacggggtctgcggcattcggagcacgacccgcatggagaacctgctgtggaagcagatcgccaacgagctcaactacatactgtgggagaacaacatcaagctgaccgtggtggtaggggacatcatcggcgtcctagagcagggcaagcggacgctgactccccagccgatggagctgaagtacagttggaagacctggggcaaggccaagatcgtgactgccgagacccagaacagctccttcataatagacggccccaacacgcctgagtgtcccagcgcgtcccgcgcctggaatgtctgggaagtggaagactacgggttcggcgtgttcacgaccaatatctggctcaagctgcgggaggtctacacccagctgtgcgaccaccgcctcatgagcgcggccgtgaaggacgagagagcggtgcacgcggacatgggctactggatcgagagccagaagaacgggtcctggaagctggagaaggcctcgctgatcgaggtcaagacctgcacgtggccgaaatcccacaccctatggagcaacggcgtgctggagtccgacatgatcatccccaagagccttgcggggcccatctcacagcacaaccatcgcccgggctaccacacccagaccgcggggccctggcatctcggcaagctggagctggatttcaactactgcgagggcacgaccgtggtcatcaccgagaattgcgggacacggggccccagcctccgaacgaccaccgtgagcgggaaactgattcacgagtggtgctgccggtcatgcacactgcccccgctacgctacatgggagaggacggatgctggtacggcatggagatccggcccataagcgaaaaggaggagaacatggtcaagagcctcgtttctgccggttcgggtaaggtggacaacttcacgatgggcgtgctgtgcctcgcgatcctgtttgaggaggttatgcgcgggaagttcggcaaaaagcacatgatcgccggggtgtttttcacattcgtgctgctcctgtccggccagatcacctggcgcgacatggctcacacccttatcatgatcggaagcaatgcatccgaccgaatggggatggggatcacgtatctagccctgatcgcgaccttcaagatccagcccttcctggccttagggttcttcctgcgaaaactgaccagccgcgagaacctcctcttgggcgtaggcctcgcaatggccaccacgctgcagctgcccgaggacatcgagcagatggcgaacgggatcgcccttggcctgatggcactgaagctcataacgcagttcgagacctaccagctatggactgccttgatcagtctcacgtgctcgaacaccatgttcaccctgaccgtggcctggcggactgcaacactgatcctcgccggggtgagcctgctgccagtctgccaatccagctcgatgcgcaaaaccgactggcttcccatggcggtggccgcaatgggcgtgccgcccttaccgctgttcatcttcagcttaaaggacaccctgaagcgccggtcctggccgttaaacgagggagttatggctgtgggcctcgtcagcattctggcctccagcctgctgcgcaacgacgtgcccatggcgggccccctggtggccgggggcctgctcatcgcctgctacgtcataacggggacctccgcggacctgacagtggagaaggccgcggacatcacctgggaagaggaggccgaacagacgggcgtgagccacaacctgatgatcaccgtcgacgatgacgggaccatgcggattaaggacgacgaaaccgagaacatcttaacggtgctgttgaagacggccctcttaatagtctccggcgtcttcccgtatagtatccccgcgactctgctcgtgtggcatacctggcagaagcagacccagcgctccggcgtgctgtgggacgtccccagccctcccgagacgcagaaggcggagctggaggagggggtgtacaggataaagcagcagggtatcttcgggaaaacccaggtgggcgttggggtgcagaaggaaggcgtgttccacaccatgtggcacgtcactcgcggcgccgtgctcacatacaacggcaagcggctggagcccaactgggcctccgtgaaaaaggacctgatatcatacggcgggggctggcgcctctccgcgcagtggcagaagggggaggaggtccaggtgattgccgtggagcccggcaagaaccccaagaatttccagaccatgcccggcacttttcagaccacgaccggagagatcggcgccatcgccctggacttcaagcccggtacgtcgggcagccccataatcaacagggagggcaaggttgtgggtctgtacggcaacggggtggtcacgaagaacggcgggtacgtgtccggcatcgcccagacgaacgccgagccggacggccccacccccgagctcgaagaggagatgttcaaaaagcgcaacctcaccatcatggacctgcaccccggctccggcaagacgagaaaatacctaccggccatcgtgcgcgaagccatcaagcggcgccttcggacgctgatcctcgcccctacccgcgtcgttgccgcggagatggaggaggccttaaaggggcttcccatccggtaccagaccaccgccacgaagtctgaacatactggccgagagatcgtggacttgatgtgccacgccaccttcaccatgcggctactgtcgcccgtccgcgtgccgaactacaatctgatcatcatggacgaggcccacttcacggaccccgcgtccatcgccgcccggggttatatcagtacccgagtaggcatgggcgaggcagcggccatcttcatgaccgccacgccgcccgggaccgccgatgccttcccgcagtccaacgctcccattcaggacgaagagcgcgacatcccggagcggagctggaactccggcaacgagtggatcaccgacttcgccgggaagacagtctggtttgtacctagcatcaaggccgggaacgacattgcgaactgcctccgcaagaacggtaaaaaggttatccagttatcccggaaaaccttcgacaccgaataccagaagaccaagctgaacgactgggacttcgtcgttaccacagatatatcagagatgggagccaacttcaaggcggatcgcgtgatcgacccgcggcgctgcctcaagcccgtcatcctcacggatggccccgagcgggtgattttagccgggcccatgccggtgaccgcagcctccgccgcgcaacgcagaggccgcgtcggtcggaacccccaaaaggagaacgaccagtacatattcaccggccagcctctcaataacgacgaggatcacgcgcactggaccgaggccaagatgctgctggacaatatcaatacgcccgaggggatcatacccgcactcttcgagcccgagcgcgagaagtccgcggccatcgacggggaatacaggttaaagggcgagagccgcaagacgttcgtggagctgatgcggcgcggggacctccccgtgtggctggcccacaaagtcgccagcgagggcatcaagtacaccgaccgaaagtggtgcttcgacgggcaacgcaataaccagatcctggaggagaacatggacgtggagatctggaccaaggagggcgaaaagaagaagctccggccccgctggctggatgcccgcacctactccgaccccctggcgctcaaggaattcaaagacttcgcagccgggcgcaagagcatcgccctggacctggtcacggagattgggcgcgttccttcccacctagcccaccggactcgcaacgcgctggacaatctggtgatgctccacaccagcgagcacggcgggcgggcgtatcgccacgccgtggaggagctgccagaaaccatggagacgcttttgctgctgggcctcatgatcctgctgaccgggggcgccatgctgttcctgataagcggcaaggggatcgggaagacctccatcgggttgatctgcgttatcgccagctccgggatgctctggatggcggaaatcccgctgcagtggatcgcaagcgcgattgtgttggagttttttatgatggtcctactgatcccggagcccgagaagcagcggacgccccaggacaaccagctagcttacgtggtgatcggaatcctcacgctggccgcgatcatcgccgctaacgagatgggcctgctcgagaccaccaagcgagacctggggatgtctaaggagccgggggtcgttagccccacctcctaccttgacgtggacttacacccggcttcggcgtggacactgtacgcagtcgccaccaccgtgatcaccccaatgctgcggcacacgatcgagaactccaccgccaacgtgagcctcgctgccattgccaaccaggccgtagtactgatgggcttggacaaggggtggccgatctccaagatggacctcggcgtgccactgctggcacttgggtgctacagccaggtcaatcccttaaccctgaccgctgcggtcctgttactgatcacgcactacgcaattatcggccctggattgcaggccaaggccacccgcgaggcccaaaagcggacagctgccgggatcatgaaaaacccgacggtggacggcatcatgacgattgacctggatcccgtcatctacgactccaagttcgagaagcagctgggccaggtgatgttgctggtgctgtgcgccgtccagttactgctgatgaggacgagctgggcactctgcgaggcacttaccctggccacgggccccatcacgaccctgtgggaagggtctcccggtaagttctggaacacaaccatcgccgtgagcatggccaacatcttccggggcagctatctggctggggccggcttagccttcagcatcatgaaatcggtaggtacgggcaagcgcggcacagggtcacagggtgagacccttggggagaagtggaagaagaagttgaaccagctgtctcggaaggagttcgacctctataagaagtccggcataaccgaggtggaccgcaccgaggccaaggaggggctaaagcggggagagatcacgcaccacgccgtgtcaagaggctccgccaagctgcagtggttcgtggagcggaacatggtgatcccggagggacgcgtgatcgacctcggctgcgggcggggcgggtggagctactactgtgcgggcctgaagaaggtgaccgaggtacgcggttacaccaagggggggcctgggcacgaagagcccgtgcccatgtccacctacggctggaacattgtgaagctaatgagcgggaaggatgtcttctacctcccgcccgagaagtgcgacacgttgctttgtgatataggagagtccagcccatcccccaccgtggaggagagccgcaccattcgggtgctgaagatggtcgagccgtggctcaagaacaaccagttctgcattaaggttctaaatccctacatgcccaccgtgatagagcacctcgagcgcctccagcggaaacacggaggcatgctagttcgtaaccccctgtcccggaacagcacgcacgagatgtactggatctccaacggcactgggaacatcgtggcgagcgttaacatggtctcccgcctcctgctgaacaggttcaccatgacccatcgccggccgacgatcgagaaggacgtcgacctgggcgccggcactcgccatgtgaacgccgaaccagaaaccccaaacatggacgtcatcggagaacgaatcaagcgcattaaggaggagcacaattctacctggcactacgacgacgagaacccgtacaagacgtgggcctaccacggctcctacgaggtgaaggctaccgggagtgcctccagcatgatcaacggtgtggtcaagctgctgactaagccttgggacgtggtccccatggttacccagatggccatgacggacaccaccccgttcgggcagcagcgggttttcaaagagaaagttgatacgcgcacgcccagaagcatgcccggcacgcggcgggtaatggggatcactgctgagtggctatggcgcaccctgggtcggaataagaaaccccgcctgtgcacgcgcgaggagttcacaaagaaggttagaaccaacgcggccatgggcgccgtcttcaccgaggagaaccaatgggactccgccaaagccgccgtagaagacgaggacttttggaagttggtggaccgagaacgggaactgcacaagctggggaagtgcggcagttgtgtatacaatatgatgggaaagagagagaaaaagctcggcgagttcgggaaggccaaggggagcagggccatctggtacatgtggctgggcgcccgctacctggagttcgaagccctcggcttcctgaacgaggaccactggttctcacgggagaactcatacagcggcgtcgagggggagggccttcacaagctcggctacatcctgcgcgacatctctaagatccccgggggcgcgatgtacgcagacgacaccgccgggtgggacacacgtatcaccgaggacgacctgcacaatgaggagaagattacacagcagatggacccggaacaccgccagcttgcaaacgccatcttcaagctgacgtaccagaacaaagtggtcaaagtgcagcggcctacccccaccggcaccgtgatggacatcatctctcgcaaggaccagcggggctccggacaagtcggcacctacgggctcaacacgttcaccaatatggaggcgcaactcatacgacagatggagggggagggggtgctgagcaaggcagatctggaaaatccccacttgcccgagaaaaagatcacccagtggctggagacaaagggtgtggaacggctgaagcgaatggccatctccggagatgattgcgttgtgaagcccattgacgaccggttcgcaaatgccctcctggccctgaacgacatggggaaggtgcgcaaggatataccccagtggcagccctcgaagggctggcacgactggcagcaggtcccattttgctcgcatcacttccatgagctcatcatgaaggacgggcggaagctggtggtaccctgccgcccccaggacgagctgatcggtcgggcacgcatcagccagggggcaggctggtccttacgagaaacggcctgcctgggcaaggcgtacgcccagatgtggagccttatgtacttccacaggcgagacctccggctggctagcaacgctatctgcagcgccgtccccgtgcactgggtgccgacatcacgcaccacctggagcatacacgctcaccatcagtggatgacaaccgaggatatgctgaccgtctggaaccgggtttggatcgaggataatccctggatggaggacaagacccccgtaacgacctgggagaacgtcccctacctcgggaagcgggaggaccagtggtgcggcagcctgatcgggttgacctcccgggccacctgggcccagaacatcccgacggccattcaacaggtccgcagcctcatcggcaacgaggaattcctggactacatgccctccatgaagcggttccgtaaggaggaggagagcgagggggctatctggtga

SEQ ID NO: 25631 - RNA, 9873 nt, synthetic construct
  misc_feature 1..9873: note = derived and/or modified CDS sequence (opt11) from DENV-3__JX669492__SS-prME
  source 1..9873: mol_type = other RNA
accagcttttgtctgatgatgatcctccctgcggccctcgccttccacctgaccagtagggacggggagccgcggatgatcgtcgggaagaatgagcgcggaaagagccttctgttcaagaccgcctcagggataaacatgtgcaccctgattgccatggacttaggggagatgtgcgacgataccgtgacctacaagtgcccccacatcaccgaggtcgagcccgaggacatcgactgctggtgcaacctgacctctacctgggtgacctacgggacgtgcaaccaggccggcgagcggcgtcgggacaagcgatcagtggccctggcgccccacgtgggcatgggcctcgacactcggacgcagacctggatgtcagccgaaggcgcctggcgccaggtggagaaagttgaaacttgggccctgcgtcaccccgggttcaccatcctggcgctcttcctggctcattacataggcacctccttaacccagaaggtggtgatcttcattttgctcatgctggtgacgcccagcatgaccatgcgctgcgtgggtgtcggcaaccgggacttcgtggagggcctctctggggcaacctgggtggacgtcgttctggagcatggcgggtgcgttaccaccatggccaagaacaagcccaccttggacatcgagctccagaagactgaggccacccagctggcgacgctgcgcaaactttgcatcgaaggcaagataacgaacatcaccaccgactcgcgatgccccacgcaaggcgaggccgtcctgccggaagagcaggaccagaactacgtctgcaagcacacctatgtggaccgcggatgggggaacgggtgcggcctgttcgggaagggcagcctcgtgacctgtgccaaattccagtgtctggagcccatcgagggcaaggtcgtgcagtacgagaacctcaagtacaccgtgatcatcacggtccacaccggggatcaacatcaggtgggcaatgaaacccagggggtcaccgcagagatcacgccccaggccagcaccaccgaggcgatactccccgagtacggcaccctcgggctggaatgttccccgaggaccggccttgacttcaatgagatgatcctgctgaccatgaagaacaaggcctggatggtgcaccgacaatggttcttcgacctccccctaccatggacgagcggcgccaccacggagacacccacctggaacagaaaggagctgctcgtcactttcaaaaacgcccacgccaagaagcaggaggtagtggtgttggggtcacaggagggcgctatgcacaccgccctgacgggagctaccgagatccagaactcgggcgggacctccatcttcgcgggccatctgaagtgccgcctgaagatggacaagctggagttgaaggggatgagctacgcgatgtgcaccaacaccttcgtcctgaagaaggaggtgtccgagacacagcacgggaccatccttatcaaggtggagtacaaaggcgaggacgcgccttgcaaaatccccttctcgaccgaggatgggcagggcaaggcccacaacgggcgcctcatcacggcaaaccccgtcgtgaccaagaaggaggagccggtgaacatcgaggccgagccccccttcggggagagcaacatcgtcataggcattggggacaacgcgctgaagatcaactggtacaagaaaggctcctcgatcgggaagatgtttgaggccaccgcccggggggcccggcgcatggccatcctgggcgacaccgcctgggacttcgggtccgtgggcggggtgctgaacagcctcggcaaaatggtccaccagatcttcgggtctgcgtacacggccctgttcagcggcgtgtcctgggtgatgaagattggcatcggggtcctgctcacctggatcggcctgaactcgaagaacaccagtatgagtttctcctgcatcgccatagggatcatcacattatacctcggcgccgtcgtgcaggcggacatgggatgcgttatcaactggaaaggtaaggaactgaaatgtggctccggaattttcgtgacgaacgaggtgcacacttggaccgagcagtacaaattccaggccgactcccccaaacgcctggccaccgccatcgcgggcgcatgggagaacggggtctgcggcatccggtcgactacccgcatggagaacctgctgtggaagcagatcgccaacgagctgaattacatcctctgggagaacaacatcaagctgacagtggtggtcggggatatcataggcgtgctggagcagggcaagcggaccctcacgccccaaccgatggagctgaagtactcctggaagacctgggggaaggccaagatcgtgacagccgagacccagaatagctcctttatcatagatggccccaatacccccgagtgccccagcgcgtcacgcgcatggaacgtatgggaggtggaggactacgggttcggcgtgttcaccacgaacatttggctgaagctccgcgaggtctacacccagctgtgtgaccaccgcctcatgtctgccgccgtgaaggacgagcgggcggtgcacgcggacatgggctactggatcgagagccagaagaatggctcctggaagctcgagaaggccagcctgatcgaggtcaagacctgtacgtggccgaagagccacacactttggagtaacggcgtgctcgagtcagatatgatcatccccaagagcctggccgggcccatctcccagcacaaccaccgcccgggctaccacacccaaaccgccggtccctggcacctgggcaaactcgagctggactttaactactgcgaaggtacgaccgtggtcatcacggagaactgcgggacccggggccccagcctgcgcacgaccactgtgtcagggaagctgatccacgaatggtgctgccggtcctgcaccctgcccccgctgcgctatatgggcgaggacgggtgctggtacggcatggagatccggcccatctccgaaaaggaggagaacatggtcaagagcctcgtctccgccggcagcgggaaggtcgataacttcacgatgggcgtgctgtgcctggcgatactattcgaggaggtcatgcgcggaaagttcggcaaaaagcacatgatcgccggggttttttttaccttcgtgctgctgttgtccggccaaattacctggcgggacatggcccacactctgatcatgatcggcagcaacgcctccgataggatggggatgggcgtcacgtatctggccttaatcgcgacgtttaagatccagccctttctagcacttgggtttttcctccgtaagctgacaagcagggagaacctgctgctgggcgtgggcctggccatggcaacgacgctccaattaccggaggacatcgagcagatggccaacgggatcgcactgggcttaatggccctgaagctaatcacccaattcgagacctaccagctctggaccgcactgatcagcctgacgtgctccaacaccatgttcaccctcaccgtggcctggcggacggcgaccctgatcctggccggggtcagcttattaccggtgtgccagtcctcctccatgcgcaagaccgactggttacccatggccgtggccgccatgggtgtgccgcccctcccgctgttcatcttcagccttaaggacaccttgaagagacggtcctggccgttgaacgagggagtgatggcggtcggcctggtaagcatcctagcctccagcctgctgcgcaacgacgtgcctatggccggacccctcgtcgccggcggccttctgatcgcctgctacgtcattacggggacctccgcggacctcaccgtggagaaagctgccgacattacctgggaagaggaggccgagcagacaggggtcagccacaacctgatgataaccgtggacgacgacgggaccatgcgaatcaaggacgacgagaccgaaaacatcttgaccgtgttactaaagacggccttactcatcgtttccggcgtgttcccttacagcatccccgcgaccctactggtctggcacacctggcagaaacagacccaacgctccggcgtcctctgggacgtgccttccccgcccgagacgcagaaggccgagctggaggagggggtgtaccggatcaagcagcaaggcatattcggaaagacccaggtcggtgtgggggtgcagaaggagggcgtattccataccatgtggcatgtgacccgcggcgccgtgctgacctacaacgggaagcggctcgaacccaactgggcctccgtcaagaaggatctgataagctacggtgggggctggcgcctgagcgcgcaatggcagaagggagaggaggtccaggtgatcgccgtcgaaccaggcaagaaccccaagaatttccaaaccatgcccggcacctttcagacaacgaccggggagatcggcgccatcgccctcgactttaagccagggactagcggctcaccaatcatcaaccgggagggtaaggtggttggcctgtacggaaatggggtcgtgaccaagaacggtggatacgtctcgggcattgcccagacgaacgcggagcctgacggccccacccccgagttagaggaggagatgttcaagaagcgaaacctgaccattatggacctccaccccgggagcggcaagactagaaagtatctgcccgccattgtccgcgaggccatcaagcgtcggctacggacgctcatcttagcgcccacccgggtggtagccgcggaaatggaggaggccctgaaggggctccccatccggtatcagacaaccgccacgaagtccgagcacactggccgcgaaatcgttgacctcatgtgccacgccaccttcaccatgcggctgctcagccccgtacgcgtgccgaattataacctgatcatcatggacgaggcccactttacggaccccgcgtccatcgccgcccggggttacatcagcacgcgcgtcgggatgggcgaggccgcggccattttcatgaccgccacgccgccgggaacggccgacgccttccctcagtccaatgcgcccattcaggatgaggagcgcgacatcccggagcggagctggaacagcggcaacgagtggatcacagacttcgcggggaagaccgtgtggtttgtgcccagcattaaggccggcaatgacatcgccaactgtctgcgcaagaacgggaagaaggtcatccagctctcccggaagacctttgacacggagtaccagaagaccaagctgaatgactgggacttcgtggtgaccacggacatctcggagatgggcgctaatttcaaggcggaccgcgtcatcgacccgcgccgctgcctgaagcccgttatcctcacggacggccccgagcgtgtgatattagccgggcctatgccggtcaccgcagcttccgccgcgcagaggcggggacgcgtcggacggaacccccagaaggagaacgaccagtacatcttcaccggccagcccttaaacaacgatgaggaccacgcccattggaccgaggcgaagatgctcctggacaatatcaacactcccgaggggatcatcccggccctgttcgaacccgagcgcgagaaatccgcggccatcgacggcgagtaccggctcaaaggcgagtcccgcaagacgttcgtggagctgatgcggcgcggagacctgccagtctggctcgcccataaggtggcctctgagggcatcaagtataccgaccggaagtggtgcttcgatggtcagcgcaataaccagattttggaagaaaacatggacgtcgagatctggactaaagagggcgagaagaaaaagctccggccccgctggctcgacgcacggacttattccgacccgctggcgctgaaagagttcaaggacttcgccgccggccgcaagagcattgccctcgacttagtcacggagattgggcgcgtaccctcccacctggcccaccgaacccgcaacgccctagataatttagttatgctgcacaccagcgagcatggtggtcgggcttacaggcacgccgtggaggagctccccgagactatggagacgctgctgctcctgggcctgatgatcctcctgaccgggggtgccatgctgttcttgatcagcggcaaggggatcggcaagaccagcatcgggctgatctgcgtgatcgccagctccggcatgctctggatggcggaaatccctctccagtggatcgcctcagccatcgtcctagagttcttcatgatggtactgctcattcccgaacccgagaaacagcggacgccccaagataatcaactggcctacgtagtcatcgggatcctgacgctggccgctatcatcgccgctaatgagatgggcctgttagagaccaccaagcgcgacctcggcatgagcaaggagccgggggtggttagccccacttcctacctggacgtcgacctgcaccccgccagcgcgtggacgttatacgcagtggccaccacagtgatcacccccatgctgcggcatacgatcgagaactccaccgccaacgtcagcctggccgcgatcgcgaaccaggcggtggtgcttatgggcctggataagggctggccaatctccaagatggacctgggcgtccccctattggccctgggatgctactcacaagtgaatcctctcaccctgaccgccgcggtgctcctcttaatcacgcattacgccataatcggccctggcctgcaagcaaaggccacccgcgaggcccagaaacggaccgcggccggtatcatgaagaaccctaccgtagacggcattatgacgatcgacctcgatcccgtgatctatgacagcaagttcgagaagcagctgggccaggtgatgcttctcgtcctttgcgccgtgcagctgctcctgatgcgaacctcctgggccctgtgtgaggcgttaaccctggccaccggccccatcacgaccctgtgggagggctcccctgggaagttctggaacacgacaatcgccgtgtctatggctaacatcttcagaggctcctacctcgccggggccggcctggccttcagcataatgaagtccgtcgggacgggcaagagaggcaccgggagccagggcgagaccctgggggagaagtggaagaagaagctcaaccagttaagccggaaggagttcgatctttacaagaagtccggcattacggaagtcgaccgcaccgaggccaaggaagggttgaagcggggcgagatcacgcaccacgccgttagccgcggcagcgccaagttgcagtggttcgtcgagcggaacatggtaatcccggaggggagggtgatagatctgggctgcgggcggggcgggtggtcttactactgcgcgggccttaagaaggtcacagaggtccgcgggtacaccaagggcgggccaggccatgaggagcccgttcccatgtcaacctacggctggaacatcgtcaagctcatgagcgggaaggacgtgttctacctgccgcccgagaagtgcgacaccctcctgtgcgatatcggcgaatccagcccttcccccaccgtggaggagtcgcgcaccatccgggtgctgaagatggtggaaccgtggttgaagaacaaccagttttgcatcaaggtgctcaacccttacatgcccaccgtcatcgagcatctggagcgactgcagcggaagcatggcgggatgctcgttagaaaccccctgtcgaggaatagcacgcacgagatgtattggatttccaacggcaccggcaacattgtagccagcgtcaacatggtgtcccgcttactcctcaaccggttcaccatgacccacagacgcccgacaatcgagaaggatgtggacctgggagctggcacccgacacgtcaacgccgaacccgaaactcccaacatggatgtaatcggggagcggatcaagcgcatcaaggaggagcacaacagcacttggcactatgatgacgagaacccgtacaagacctgggcctaccatgggtcatacgaggtgaaggcgaccggatctgcctccagcatgatcaacggcgttgtgaaactcctgaccaagccctgggacgtcgtccccatggtaacccagatggccatgacggacaccacccccttcgggcagcagagagtcttcaaggagaaggtcgacacccgcacgccgcggagcatgcccggcacccgccgtgtgatgggcatcaccgcggagtggctgtggcgcaccctcgggcggaacaagaagccccgcctgtgcacccgtgaggagttcactaaaaaggtccggaccaacgcggccatgggcgccgtgttcaccgaggagaaccaatgggactccgccaaggccgccgtggaggacgaggatttctggaaactggtcgaccgcgagcgggaactccacaaactggggaagtgcggcagctgcgtgtacaacatgatgggtaagcgcgagaagaagctgggggagttcgggaaggccaaggggtcgcgggccatctggtacatgtggctcggggcgcgctacctggagttcgaggccctggggttcctcaacgaggaccactggtttagccgggagaactcctacagcggcgtggagggggagggactgcacaagctgggttacattctccgcgacatctcgaagatcccggggggcgcgatgtacgcggacgacacagcgggctgggacacccggatcaccgaggacgacctgcacaacgaggagaaaatcacccagcagatggacccggaacaccgccagctggctaacgctatcttcaaattgacgtaccagaacaaggtcgtaaaggtgcagcggcccaccccgaccggcaccgtcatggacatcatcagccgaaaggaccagcggggctccggccaagtgggcacctacgggttgaacacgttcaccaacatggaggcgcagttgatccgccagatggagggcgagggggtgctcagcaaggcggacctggagaatccccatctccccgagaagaagatcacgcagtggctggaaaccaagggcgtcgagcggctgaagcgcatggccatcagtggcgacgactgcgtggtgaaacccatcgacgaccggttcgcgaacgccctgctcgcgctgaacgacatggggaaagtgaggaaggacatcccccagtggcagcccagcaagggctggcacgactggcagcaggtcccgttctgctcccatcacttccacgagttgattatgaaggacgggcggaagctcgtggttccctgccgcccccaagacgaactgatcggccgggcccgcatcagccaaggtgccggctggtcgctccgcgagacggcctgcctcggcaaggcgtatgcccagatgtggagcctgatgtacttccaccggcgcgatctgcggctcgccagtaacgccatttgcagcgccgttcctgtgcactgggtcccgacctcacgcaccacctggagcatccacgcgcaccaccagtggatgacaacggaggacatgctgaccgtgtggaaccgggtttggatcgaggacaacccgtggatggaggataaaacacccgtcacgacctgggagaacgtcccctatctggggaagcgcgaggatcaatggtgcgggagcctcatcggcctgacgtccagagccacctgggcacagaacatcccgacggccatccagcaggtccgcagcttgatcggcaatgaggagttcttggactacatgccctccatgaagcggttcagaaaagaagaggagagcgagggggccatctggtga

SEQ ID NO: 25632 - RNA, 9873 nt, synthetic construct
  misc_feature 1..9873: note = derived and/or modified CDS sequence (opt11) from DENV-3__JX669500__SS-prME
  source 1..9873: mol_type = other RNA
acctcgctgtgcctcatgatgatcctacccgcagccctggcgtttcacctaacctctcgggacggggagccgcggatgatcgtcgggaagaacgagcgcggcaagagcctgttattcaagaccgcctcaggaatcaatatgtgcacgctcatcgccatggacttgggcgagatgtgcgacgacaccgtgacctacaagtgtcctcacatcaccgaggtagagcctgaagacatagactgctggtgcaacctgaccagtacctgggtgacctatggcacgtgcaatcaggctggcgagcggcgccgggataagcgctccgtggccctcgcgccccacgttggcatgggcttggacacacggacccaaacttggatgagcgccgaaggcgcctggagacaggttgaaaaggtggagacgtgggcactgcgacacccggggtttaccatcctcgcgctgtttctagcccattacatcggtacctccctcactcagaaggtggtgatcttcatcctgctcatgcttgtgacgccgagtatgaccatgcgctgcgtaggggttggcaaccgcgactttgtcgaaggcctctccggggccacctgggtggatgtggtcctggagcacggcggttgcgtgacgacgatggccaaaaacaagcccaccctcgatatcgagctgcagaagaccgaggccacccagttggcgacactaagaaaactgtgcatcgaagggaaaatcaccaacatcaccacagactcacggtgccccacgcagggggaggccgtgctacctgaggagcaggatcagaattacgtatgcaagcacacttacgtcgaccgaggatggggcaatgggtgcggcctcttcggcaagggctccctggtgacctgcgccaagtttcagtgcctggagcccatagagggcaaggtggtgcagtacgagaacctcaagtataccgtgattatcacggtccataccggggaccagcaccaggtaggcaacgagacccagggggtgaccgctgagatcacgccccaggcaagtaccacagaggcgatcctgcccgagtacggcacgctggggctcgagtgctctccgcggaccggcctcgacttcaatgagatgatactgctcacgatgaaaaacaaggcttggatggtgcacaggcagtggttcttcgacctccccctgccctggacgagcggtgcaaccaccgagacgcccacctggaaccggaaggaactcttagtgacgttcaagaacgcccacgccaagaagcaagaggtcgtggttctagggtcccaggagggcgcgatgcacaccgccttgaccggggccaccgagatccagaacagcggcgggacctccatcttcgccggccacctgaagtgccgcctgaagatggacaaattagagctgaagggaatgagctacgccatgtgtactaacacgtttgtcttaaagaaggaggtgtcggagacccagcatggaaccatcctcatcaaagttgagtacaagggagaggatgcgccgtgcaagatccccttcagcaccgaggacgggcaaggcaaggcccacaacggccgactgatcacggccaaccccgtggtcacaaagaaggaggagcccgtgaacatcgaggcggaaccaccattcggggagagcaacattgtcattggcatcggggacaacgcgttgaagatcaattggtacaagaagggctccagcatcgggaaaatgttcgaggccaccgcacgcggggcccggcgcatggccatcctgggcgacaccgcctgggacttcgggtccgtgggaggggtgctgaacagcctgggcaagatggtccaccagatatttggttccgcctacacggcgctgttcagcggcgttagctgggtgatgaagatcggcatcggggtcttgctgacctggatcggcctgaacagcaagaatacctcaatgtcgtttagctgtatcgccatcgggataatcaccctctacctaggcgccgtagtgcaggcagacatgggatgcgtcatcaattggaaaggcaaggaactgaagtgcggcagcgggatcttcgtgacgaacgaagtacatacctggaccgaacagtacaaattccaggccgactccccaaagcgcctcgccaccgccatcgcaggcgcgtgggagaacggggtttgcggtatccggagcacgacacgcatggagaacctgctgtggaaacagatcgccaacgaactcaactacatcctgtgggaaaacaacatcaaacttaccgtggtggtcggcgacatcatcggcgtcctcgagcagggtaagcggacactgacgcctcagccgatggaactgaagtactcatggaagacctgggggaaggccaagatcgttaccgcagagacacagaacagctcgttcatcatcgacggcccaaacacgcccgaatgccccagcgcgtcccgcgcctggaacgtctgggaggttgaggactacgggttcggagtcttcaccaccaacatttggctcaagttacgggaagtctacacacagctgtgcgaccaccgcctaatgagcgccgcagtaaaggacgaacgggcagtgcacgcggacatgggttactggattgagagccaaaagaacgggtcatggaagctggagaaagcgagcctaatcgaagtcaagacctgcacctggcccaagtctcacaccttatggagcaatggcgtgctggaatccgacatgatcatcccaaagtccctggcaggaccgatctcccagcacaatcacagaccgggctaccatacccagaccgcagggccctggcacctaggcaaactggagctggacttcaactactgcgagggtactaccgtggtcattaccgagaactgcgggacacggggccccagcttgcgcacgaccaccgtatccgggaagcttatacacgagtggtgctgccggtcttgtaccctgccaccgctccgatacatgggcgaagacgggtgttggtacggtatggagatccggccgatttctgagaaggaggaaaatatggtgaaatccctggtctctgcgggaagcggaaaggtggataatttcacgatgggagttttatgcctcgcgattctgttcgaggaggtgatgcgcgggaagttcggaaaaaagcacatgatagccggggtgttcttcaccttcgtactcctcctgagtggccaaatcacctggcgggacatggcccacaccctgattatgatcggttcaaacgccagcgaccgcatggggatgggagtcacttacctcgccctgatcgcgaccttcaagatccagccatttctggccctcggtttcttcttacggaaactgaccagcagggagaatctactgctgggagtgggcctcgccatggcaactaccctacaactgcccgaggacatcgagcagatggcgaatgggatcgccctcggcctgatggcactgaagctcatcacacaattcgagacgtaccaactgtggacagccctgataagccttacttgttccaacaccatgtttacactgaccgtggcctggcggactgcgaccctgatcctcgcgggggtcagcttgctgccagtgtgtcagtccagctccatgagaaaaaccgactggctccccatggccgtcgccgccatgggtgttccgccgctcccgctgtttatcttcagcctcaaagataccctgaagcgccggtcctggccattgaacgagggagtcatggcggtgggcctggtgagcatcctggcctccagcctgctgcgcaatgacgtgcccatggccggaccactggtagccgggggcctgctcatcgcctgctatgttatcacggggacctccgcggacctgacggtggagaaggccgctgatatcacctgggaggaggaggccgaacagacaggcgtcagccataatctgatgatcaccgtggacgatgatggaaccatgcggatcaaggacgacgagaccgaaaacattctcacagttcttttaaagacagccttgctgatagtttccggcgtgttcccgtattctatccccgcgaccctgcttgtgtggcatacctggcagaagcagacccagcgctccggtgtcctctgggatgtcccgtccccgccagagacgcagaaggccgagttagaggagggtgtgtatcggataaaacagcagggcatctttgggaaaacccaggtcggcgtgggggtgcagaaggagggcgtcttccacacgatgtggcacgtgacccgcggagcagttctcacttacaacggcaaacgcctagaacccaactgggcctctgtcaaaaaggacctgatctcgtacggcgggggctggagactctccgcgcagtggcagaagggggaggaggtccaagtaattgcggtcgagcccggcaaaaacccgaagaacttccagaccatgcccggcaccttccagaccacgaccggcgaaataggcgcaattgccctcgactttaagcccgggaccagtggttctcccatcatcaaccgggagggcaaagtggttgggctatacggaaacggggtcgtgaccaaaaacgggggttacgtttccggcatcgcacagaccaacgctgaaccagatggaccaacgcccgagctggaggaagagatgttcaagaagagaaacctcaccattatggacctacaccccgggagcggcaaaacacgcaagtacctgccggccatagtcagggaggccataaagcggaggctccggaccctgatcctggcccccacccgcgtggtggcggcggagatggaagaagccctcaaagggctgcccatccggtaccagacgactgcaacgaagtcagagcacactggacgcgagatcgtcgatctgatgtgccacgccaccttcaccatgcggctcctgagccccgtgcgcgtccccaactataaccttatcatcatggacgaggcccatttcacggaccccgcgtccattgccgcccgggggtatatcagcacccgcgtcggcatgggcgaggcggcggccatattcatgaccgccacgccgcccgggacggccgatgccttcccgcagtcgaacgcgcccatccaggacgaggagcgcgatatccccgagcggtcctggaactccggcaacgagtggatcacggacttcgccgggaagaccgtgtggttcgtgcccagcatcaaggcgggcaacgatatcgccaactgcctccggaagaacgggaaaaaggtaatccaactgtctaggaagaccttcgacacagagtaccagaaaacgaaactgaacgactgggacttcgtcgtaaccaccgacatttcagagatgggcgctaatttcaaggcggaccgtgtcattgacccgcggcgctgccttaaacccgttatcctgaccgacggccctgagcgggtcatcctagccgggcctatgccggtaaccgccgcatcggccgcgcaacgccggggccgcgtcgggcggaacccccagaaagaaaacgaccagtacatcttcacgggccaaccactcaacaacgacgaggaccatgcacactggaccgaggccaaaatgctgctggacaacatcaacacacccgaggggatcatccccgcattgttcgaacccgagcgcgagaagtcggcggccatcgatggcgagtaccggctgaagggcgaatcccgcaagacatttgtcgagcttatgcgtcgcggggatttaccagtatggctggcccacaaggtagccagcgagggaattaagtacacggatcgcaagtggtgtttcgacgggcagcgaaacaaccagatcctagaggagaatatggacgtggaaatctggaccaaggagggtgagaagaagaagctacggccccgctggcttgatgcgcgcacgtactcggatccgctggcgctcaaggagttcaaggatttcgccgctggccgaaaaagcatcgccctcgacctggtgacggagatcgggcgcgtcccctcccacctcgcacaccggacacgcaacgccctggacaatctggtcatgctccacacctcagaacacggcggccgggcgtaccgccacgctgtggaggagctgcccgagaccatggagaccctactcttattgggcttgatgatacttttgaccgggggcgctatgctgttcctgatctccggcaaggggatcggcaagacctctatcggattaatttgcgtgatcgccagctccggcatgctctggatggcggagatcccgttacagtggattgccagcgcgatcgtcctagagttctttatgatggtgctcctgataccggagcccgagaagcagagaaccccccaggacaaccaactggcctacgtggtcatcgggatcctcacgttggcggcgataattgctgccaacgagatgggcctgctcgaaacaactaaacgcgacttggggatgtccaaggagccgggggtggtgagcccaacgtcctatctagacgtcgacctccatcccgcgagcgcctggacgctatacgccgtggccaccaccgtaatcacccccatgctacggcatacgatcgaaaattccaccgccaacgtatctctcgcggcgatcgctaaccaggccgtggtgctgatgggcctggacaaggggtggccgatctcaaagatggacctcggcgtccccttattggccctcgggtgctactctcaagtgaacccactgaccctgaccgcggcggtcctcctgctgatcacccactacgccatcatcggccctggcctccaggcaaaggctacccgcgaggcgcagaagcgtaccgcggcagggataatgaagaaccccaccgtcgacggcatcatgacgatagacctcgaccctgtgatttacgactccaagttcgagaagcagctgggccaagttatgcttctggtcctctgcgccgtgcagctcctgctgatgcgcacgagctgggccctgtgcgaggcgctgaccctggcgaccggtcccatcacgaccctctgggagggctcccccgggaagttctggaacaccaccatcgccgtgagcatggctaacatcttccggggctcctaccttgccggggcgggcctggccttcagcattatgaagtccgtagggacgggcaagcgaggaaccggtagccagggggaaaccctcggggagaagtggaagaaaaaactgaatcagctgagccggaaggaattcgacctctataagaagagcggtataacggaggtagaccgcacggaggctaaggaagggctgaagcggggcgaaattacgcaccacgccgtgagccggggctcagcgaagctgcagtggttcgtcgagcgtaacatggtgattccagaggggcgcgtgatcgacctcggctgcgggcgcggtgggtggtcatactactgcgcaggtttgaagaaggtcacggaggtgcgcgggtacaccaaaggcggaccggggcacgaagagccagtgcccatgtcgacctacggctggaacatcgtaaagctgatgtcagggaaggacgtgttctacctcccgcccgaaaagtgcgacactctactgtgcgatatcggcgagtccagcccctccccaacggtggaggagtctcgcacgatcagagtactgaagatggttgagccatggctcaagaataatcagttctgcataaaagtgctgaacccctacatgcccactgtcatagagcacttggagcgcctacagagaaagcacggcgggatgctggtgcgtaaccctctgtcacggaactcgacccacgagatgtactggatatcaaacggcaccggcaacatagtggcgagcgtcaacatggtctccaggctgttgttgaaccgatttaccatgacccaccgccgaccgacgatcgagaaggacgtggatctcggggccggaaccagacacgttaatgccgagcccgagactcccaacatggacgtgatcggggagcgaatcaagcgaatcaaggaagagcacaactcaacctggcactatgatgacgaaaacccgtacaagacatgggcctatcatggctcctacgaagttaaggcaaccgggtctgccagtagcatgatcaacggcgtcgttaagctgctgactaagccgtgggacgtcgtgcccatggttacccagatggccatgacggataccacccccttcgggcaacaacgggtcttcaaggagaaagtggacacccgcaccccgcggcccatgcccggcaccagacgggtgatgggcatcaccgccgagtggttatggcgcactcttgggaggaacaagaagccccggctgtgcacgcgagaggagttcaccaaaaaagtccggactaacgcagcgatgggcgccgtgttcaccgaggagaatcagtgggatagcgccaaagccgcggtcgaggacgaggacttctggaagttggtcgaccgcgagcgtgagctgcacaaattagggaagtgcggctcctgcgtttacaatatgatgggaaagcgcgagaaaaagctaggcgagttcgggaaggccaaggggtcccgggccatatggtacatgtggcttggggcccgctacctggagttcgaggctttggggttcctgaacgaggatcactggttctcccgggaaaacagctactccggtgtggagggggaggggctgcataagctcggctacattctgagggacatctcgaaaatccccggtggtgcgatgtacgccgacgacacggccgggtgggacacacgaatcaccgaggacgatctgcacaacgaagagaaaatcacccaacagatggatcccgagcaccgccaactcgccaacgctatattcaagcttacgtaccagaacaaggtcgtgaaggtgcagcgtcccacgcccaccgggaccgtcatggacatcatcagtcgtaaggaccaaagaggcagtggccaggttggcacctacgggctgaacaccttcaccaacatggaggcgcaacttattcggcagatggaaggcgagggcgtgctgtcaaaggccgacctggagaacccgcacctgcccgaaaagaagatcacgcagtggctggagacaaagggcgtcgaaagactgaagcgcatggccatatcaggcgacgactgtgtggtgaaacctatagacgaccgctttgctaacgcgctcttagctctgaatgatatgggaaaggtccgcaaagatatcccccaatggcaaccctctaagggctggcatgactggcagcaggtccccttttgtagtcatcatttccatgagctgataatgaaggacgggaggaagttggtggttccttgtcgtccccaggacgagttaatcggtcgggcccgcatttcacagggggcaggctggagcctcagagagacagcgtgcttaggcaaggcgtacgcccagatgtggagtctaatgtattttcatcggcgagacctccggctggccagcaatgccatctgctcagccgttcccgtgcactgggtacccactagccgcaccacctggtccattcacgcgcaccaccaatggatgacgaccgaggacatgctaaccgtgtggaaccgggtgtggatcgaggacaacccatggatggaggataagacccccgtcacgacctgggagaacgtgccgtaccttggaaaacgcgaggaccagtggtgtggcagcctgattggtctgacctcacgggccacgtgggcacagaatatcccaaccgcaattcaacaggttaggtccctgatcggcaacgaagagttcctagactacatgccaagcatgaagcggttccgcaaggaggaagagtccgagggcgccatctggtga

SEQ ID NO: 25633 - RNA, 9873 nt, synthetic construct
  misc_feature 1..9873: note = derived and/or modified CDS sequence (opt11) from DENV-3__JX669497__SS-prME
  source 1..9873: mol_type = other RNA
accagcttatgcctaatgatgatcctgcctgccgccctggcgtttcatcttaccagccgcgacggggagccgcggatgatcgtgggcaagaacgagagaggcaaaagcctgctgttcaagaccgccagcgggatcaacatgtgcaccctcattgccatggacctgggggagatgtgcgatgatacagttacatacaagtgcccccacatcacagaggtcgaacccgaagacatagactgctggtgcaacctgacgtctacctgggtgacctacgggacgtgcaaccaggccggagagcggcgccgggataagcgctccgtggcactcgcgccccacgtaggaatggggctggacacccggacccagacctggatgagcgccgagggggcctggcgccaggtggagaaggtggagacatgggccttgcgacacccggggttcaccatcctcgctctgttcctggcccactacatcggcacctccttgacccagaaggtggtgatcttcatcctgctgatgctcgtcacgcccagcatgaccatgcgctgcgtgggggtgggcaaccgggacttcgtcgagggactgagcggtgccacctgggtggacgtggtcttagagcacggcgggtgcgtgaccacgatggccaaaaacaaaccaaccctcgacatcgagctacaaaagaccgaggccacccagctggctacgcttaggaagctctgcatagagggtaagatcaccaacatcaccactgatagccggtgccccacccagggcgaggccgtgctgcccgaggagcaggatcaaaactacgtctgcaaacacacctacgtggaccgcgggtggggcaacgggtgcggcctgttcggcaagggctccctcgtgacctgcgccaagttccaatgcctggagcccatagagggcaaggtcgtacagtacgagaacctcaagtatacggtcatcatcacggtccacaccggggaccagcaccaggtgggcaacgaaacccagggggtcaccgccgagatcacgccccaggccagcaccacggaggcaatccttcccgagtatggcaccctggggctcgagtgctccccgcgtaccggcctggacttcaatgagatgatcctgctcacaatgaagaacaaggcctggatggtgcaccgccagtggttcttcgacctgcccctgccctggaccagcggggccaccacggagacccccacctggaaccggaaggagctcctggttacattcaagaacgcacacgccaagaagcaggaggtcgtggtcctgggatcccaggagggcgcgatgcataccgctttaacgggggcgactgagatacagaacagcggcgggacctccatcttcgccggccacctgaagtgccgcctgaagatggataagctcgagctaaagggcatgagctacgccatgtgtaccaacacgttcgtcctgaagaaggaggtaagtgagacccagcacgggaccatcctcatcaaggtggagtacaagggtgaagacgcgccgtgcaagatcccttttagcaccgaggacgggcaaggcaaggcccacaacggccggctgatcacggccaacccagtagtgaccaagaaggaggagcccgtgaacattgaggccgagccgcccttcggggagagcaacatcgtaatcggcatcggtgacaacgcgtccaagatcaactggtacaagaaaggcagttccatcggcaagatgttcgaagccaccgcccgcggtgcccggcgcatggccatactgggcgacaccgcatgggacttcgggagcgtgggcggggtgctcaactccctcggcaagatggtccaccagatcttcggaagcgcatacacggccctgttctccggagtgtcatgggtgatgaagatcggcataggggtcctgctcacctggatcggcctgaattccaagaacaccagcatgtccttttcctgcatcgccatcggaatcatcactctgtacctcggcgccgtcgtgcaggcagacatggggtgtgtcatcaactggaagggcaaagagctgaagtgcggcagcgggatcttcgttacaaatgaggtgcacacctggaccgagcagtacaagtttcaggccgacagcccaaagaggctggctaccgccatagccggagcgtgggagaacggcgtctgcggcatccggtccacgacccgcatggagaacctcctgtggaagcagatcgccaacgagctgaactacattctttgggagaacaatatcaagctgaccgtggtggtcggggacatcatcggcgtgctggagcagggcaagcggaccctcaccccccagccgatggagctgaagtactcatggaagacatgggggaaggccaagatcgttacggccgagacccagaactccagcttcatcatcgatggccccaacacgcctgagtgcccgtccgcgagccgcgcctggaacgtctgggaggtggaggactacgggttcggcgtgttcactaccaacatctggctgaagctccgggaggtttacacccagttatgtgaccaccgcctcatgagcgccgccgtgaaggatgagagggccgtccacgcggacatgggctactggatcgagtcccaaaagaacgggagctggaagctcgagaaagcctccctaatcgaggtcaagacctgcacgtggcccaagtctcacaccctgtggtccaacggcgtgctggagagcgacatgatcatccccaagtccttagccgggcccatcagccagcacaaccacagaccgggctaccacacccagacagccggtccctggcacctgggcaagttagagctggactttaactactgtgagggcaccaccgttgtcatcacggagaactgcgggacgcggggcccctccctgcgcacgaccaccgtgagcgggaagctcatccacgagtggtgctgccggtcttgcacccttcccccgctgcgctacatgggcgaggacgggtgttggtacggcatggagatccggccgataagcgaaaaggaggaaaatatggtgaagtccctcgtctctgccggatcggggaaggtcgacaacttcacgatgggcgtattgtgcctggcgatactcttcgaggaggtgatgcgcgggaagttcggtaagaagcacatgatcgccggggtgttcttcacctttgttctgctgctctcaggccagatcacatggagggacatggcccacaccctgatcatgatcgggtccaacgcaagcgaccgcatggggatgggcgtcacgtacctggccctcatcgcgaccttcaaaatccagcccttcctggccctggggttctttctccggaagctgaccagccgcgagaacctgctcctgggcgtcggactggccatggctaccacgctccagctgcccgaggacatcgagcagatggcgaacgggatcgcccttggacttatggccctgaagctgatcacccagtttgagacctaccagctctggaccgctctgatctctctgacgtgcagcaacaccatgttcaccctcaccgtggcctggcggacggcgaccctgatcctggctggggtatccctcctcccagtgtgccagtcgtccagcatgcgcaagaccgactggctgcccatggccgtcgccgccatgggcgtcccacccctgccgctcttcatcttttccctgaaggacaccctcaagcgacggtcctggccactgaacgagggggtgatggcggtcggcctggtgtccatcctcgccagctcccttctgcgcaacgacgtgcccatggccggccccctcgtcgcggggggcctgttgatcgcctgctacgtgatcacggggaccagcgcggacctgaccgtggagaaggccgcggacataacctgggaggaggaggccgagcagacgggcgtctcccacaacctgatgattaccgtagacgacgacgggacgatgcggatcaaggacgacgagaccgagaacatcctgactgtgctcctaaagacggcccttctcatcgtcagcggcgtgttcccgtactccattcccgctaccctgctagtgtggcatacatggcagaagcaaacccagcgcagcggcgtcctgtgggatgtgcccagcccgcccgagacgcagaaagccgagctggaagagggggtgtacaggatcaagcagcagggcatcttcgggaagacccaagtcggcgtgggggtgcaaaaggagggcgtattccacaccatgtggcacgtgaccagaggcgccgtactgacatataacgggaagcggctcgaaccaaattgggcctcggtgaagaaggacctgatctcctacgggggaggatggagactgagcgcgcagtggcagaagggggaggaggtccaggttatcgccgtcgagcccggcaagaacccgaagaacttccagaccatgcccggaaccttccagaccacgactggggaaatcggcgccatcgcactcgactttaagcccgggacaagcggctcccccatcatcaaccgggagggtaaggtagtggggctgtacggcaacggtgtggtgacgaagaacggcgggtacgtaagcggcatcgcccagaccaacgcggagccggacggccctacccccgagctggaggaagaaatgttcaagaagcgcaacctgactatcatggacctccacccagggtccggcaaaacccggaaatacctgccggccatcgtccgggaggccatcaagcggcgcctgcggacgctcatcttagcccccacccgcgtggtcgccgcggagatggaggaggcactgaagggtctccccatccggtaccagaccaccgccaccaagagcgagcacaccggccgcgagatcgtcgacctgatgtgccacgccactttcaccatgcggctactttcgcccgttcgcgtgccgaattacaacctgatcatcatggacgaggcccacttcaccgatcccgcgagcatcgccgcccgggggtacatttccacccgcgttggcatgggcgaggccgcggccatcttcatgaccgccacgccacccgggacggccgacgcctttccgcagagcaatgcgcccatccaggacgaggaacgggatatccccgagcggtcctggaacagcggcaacgagtggatcaccgacttcgccgggaagaccgtgtggttcgtgccctccatcaaggccggcaatgacatcgccaactgcctgcgcaaaaacgggaagaaggtcatccagctcagccggaagacgttcgacaccgaataccagaagaccaaactgaacgactgggacttcgtggtgaccaccgacatctctgagatgggcgccaacttcaaagcggacagagtcatagacccgagaagatgcctgaagcccgtgatcctcacggacggccccgagcgagtgatcttggccgggccgatgccggtcacggccgctagcgccgcgcagcgccggggtcgggtgggccggaacccccagaaagagaacgaccagtacatcttcacaggacagccactgaacaacgacgaggaccacgcccactggaccgaggccaagatgcttctggacaacatcaacacccccgaggggatcattccggccctgttcgagcccgagcgcgagaagtccgcggccatcgacggcgagtaccgcctcaagggcgagagccgcaagacgttcgtagagctcatgcggcgcggtgacctgcccgtctggctcgcccacaaggtggcctccgagggtatcaagtacaccgaccggaagtggtgcttcgacgggcagcgcaacaaccagattctagaggaaaacatggacgtcgagatctggaccaaggagggcgagaaaaagaagctgcggccacgctggctcgacgcccgcacctactcagaccctctggcgctgaaggagttcaaggacttcgccgctggtcggaaatccattgccttagacctggtaacagagattgggcgcgtgccaagccacctcgcccaccgaacccgcaacgcgctcgacaacctggtgatgctgcacaccagcgagcacggcgggcgggcctaccgccacgccgtggaggagctcccagaaaccatggagacgttgctgctcctgggcttgatgatcctcctgaccggcggcgcaatgctgttcctcatctccggcaaggggatcggcaagaccagcattgggctgatctgcgtgattgcctccagtggcatgctgtggatggcggagatcccgctccagtggatcgcatccgcaatcgtactggagttcttcatgatggtgctgctcatccccgagcctgaaaagcagcggacgccccaggacaaccagctggcatacgtggtaatcgggatcctgacgctcgccgcgatcatcgccgccaacgagatgggcctgctggagaccacgaagcgcgacctcggcatgagcaaggagccgggtgtggtgtccccaaccagctacctggacgtcgacctacaccccgcctccgcatggacgttatatgcagtggccaccaccgtgatcacccccatgctgcggcacacgatcgagaacagtaccgccaacgtctccctggccgcgatcgccaaccaagccgttgtgctcatgggcctggacaaggggtggccgatcagcaagatggacttaggcgtaccactcctggccctggggtgctactcccaggtcaaccccctcaccctgaccgccgcggtgctgctcctgatcacgcactacgccatcatcggccccggcctgcaggccaaagccacccgcgaggcccagaagcggaccgcagcaggtatcatgaagaacccgaccgtcgacggcatcatgacgattgacctcgaccccgttatctacgacagcaagttcgagaagcagctcggccaggttatgctgctcgtcctgtgcgccgtgcagctgctcttgatgcgcacctcctgggcgctgtgcgaggcgctcaccttggccaccggccccatcacgaccctgtgggaggggagccccggaaagttctggaacaccaccatcgccgtgtccatggcaaacatcttccggggcagctacctcgctggagcgggtctggccttctccatcatgaagtcggtcgggacgggcaaacgcggcaccgggagccagggagagaccttaggggagaagtggaagaaaaagctcaaccagctgtcccggaaggagttcgacctgtacaagaagtccggcatcactgaggtggacagaaccgaggccaaggaggggctcaagcggggcgagatcacgcaccatgccgtgtcccgcggcagcgccaagctccagtggttcgtggagcggaacatggtgatcccggaggggcgcgtgatcgacctgggctgcggtaggggcgggtggtcctactactgcgcgggtctcaagaaggtgaccgaggtgcgcggctacaccaaaggcgggcccgggcacgaggagcctgtccccatgtctacctacggctggaacatcgtcaagttgatgtccgggaaagatgtgttctacctgccgccggagaagtgcgatacgctcctgtgcgacatcggcgaatcgtccccgagccccacggtggaggagtcccgcaccatccgggtcctcaagatggtggagccgtggctgaagaacaaccagttctgcatcaaggtgctgaacccctacatgcccaccgttatcgagcacctggagcgcctgcagcggaagcacggcgggatgctcgtgcgcaaccccttaagccgaaactccacgcacgagatgtactggatcagcaacggcacggggaacattgtggcttccgtcaacatggtgtcccgcctgttgctgaacaggttcaccatgactcatcggcggccgacgatcgagaaggacgtagacctgggcgccggcacccgccatgtcaacgcggagcccgagacccctaacatggacgttatcggggagcggattaagcgcatcaaggaggagcacaactcaacctggcactacgacgacgagaacccctacaagacatgggcctaccacggcagctacgaggtgaaggcaaccgggtccgccagcagcatgattaacggcgtcgtgaagctcctgaccaagccatgggacgtcgtgcccatggtgacccagatggccatgacggacaccacccccttcgggcagcagcgggtcttcaaggaaaaggttgacacccgcacgccgcgctccatgcccggcacgcgacgggtgatgggcatcacagccgagtggctgtggcgcactctcggccggaacaagaagccacgcctttgcacgcgcgaggagttcaccaagaaagtccggaccaacgcggccatgggcgccgtgttcaccgaggagaaccaatgggacagcgctaaggccgcggtggaagacgaggatttctggaagctggtcgaccgagaacgggagctccacaaactggggaagtgcggctcctgcgtgtacaacatgatggggaagcgcgagaaaaagctgggcgagttcggcaaggccaaggggagccgggccatctggtacatgtggctcggcgcccgatacctggagttcgaggcgcttggattcctcaacgaggaccactggttctcccgggagaactcgtactcaggcgtggagggggaaggcttacacaagctgggctacatcctgcgggacatcagcaagatcccagggggcgcgatgtacgccgacgacacggccgggtgggacacgcggatcaccgaggatgacctgcacaacgaggagaaaatcacccagcagatggatccggagcatcgccagctggccaacgccatcttcaagctcacgtaccagaacaaggtcgtgaaggtgcagcggcccacccccaccggcaccgtcatggacatcatcagtcgcaaggaccagaggggcagcggccaagtgggcacctacggccttaacacgttcaccaacatggaggcgcaactgatccgccagatggagggcgagggggtactctcgaaggctgacctggagaaccctcacctcccggagaagaagataacccagtggctcgaaacaaagggcgtcgaaagactcaaacgcatggccatctctggcgacgactgcgtagtgaagcccatcgacgaccgcttcgccaacgccctgctcgccctgaatgacatggggaaggtccgcaaggacatcccccagtggcagccctccaagggctggcacgactggcagcaggtcccgttctgtagccaccacttccacgagctgattatgaaggacggccggaagctcgtggtcccttgtcgcccacaggacgagctgatcggcagggcacgaatctcccagggggccggctggagcctacgcgagacggcctgcctcggcaaagcgtacgcgcagatgtggtccctgatgtacttccatcggcgcgatctgcggttggccagcaacgccatttgttccgccgtgccagtgcactgggtcccgacaagccgcaccacctggagcatccacgcgcaccatcagtggatgacgaccgaggacatgctgaccgtgtggaaccgtgtatggatcgaggacaacccctggatggaggacaagacccccgtcacgacctgggaaaacgtgccctacctggggaagcgggaagaccagtggtgcggctctctcatcgggctgacctctcgggccacctgggcccagaacatcccgactgccatccagcaggtcagatccctgatcggcaacgaggagttcctcgactacatgcccagcatgaagcggttcagaaaggaggaggagtccgaaggggccatctggtga

SEQ ID NO: 25634 - RNA, 9873 nt, synthetic construct
  misc_feature 1..9873: note = derived and/or modified CDS sequence (opt11) from DENV-3__JX669501__SS-prME
  source 1..9873: mol_type = other RNA
acatcactatgcctcatgatgatactcccggcggcattagctttccacctcaccagtcgagacggcgaaccccgaatgattgtagggaaaaatgaaagaggcaaatctcttctcttcaaaactgcctccggcattaacatgtgcacactgatagccatggaccttggcgaaatgtgcgatgacaccgtaacatataaatgcccccacataacagaagtggaacctgaagacattgattgctggtgcaacctaacctcaacttgggtcacctacgggacctgtaatcaagcgggggaacggcgaagagacaaaagaagcgtggcgttagccccgcacgtaggcatgggtctggatacgcgtacacagacctggatgtcagcagaaggcgcatggcgccaggtcgaaaaagtcgaaacttgggccctcagacaccccggattcaccatcctcgcgctgttcttggctcactatatcggaacatcgcttacacagaaagtcgtcatcttcatcctcctgatgttagtcacccccagcatgaccatgcgatgcgtaggagtagggaacagggacttcgttgaaggcctaagcggcgccacttgggtcgacgtggttttggaacacggcggctgcgtaacaactatggccaaaaataaaccaacgctcgacatcgaattacagaaaacagaagcaacgcaactggcaacactacgcaagctctgtattgagggtaaaataacgaacataactaccgactcgagatgcccaacccaaggagaggctgtcttaccggaggagcaagaccaaaactacgtatgcaaacatacgtacgtcgacagaggctggggcaatgggtgcgggctctttgggaaaggaagcctcgtcacatgtgctaaatttcaatgtctggaacctatcgagggaaaagtcgttcagtatgaaaacctcaaatacaccgtaataataacagtgcacacgggagaccagcaccaggtcggaaacgaaacacagggagtgaccgccgagataactccacaggctagcaccaccgaagcaatcctgccggaatacggcacactgggcctggaatgctccccacggacgggcttagacttcaatgagatgatcttgctaactatgaagaacaaagcatggatggtccaccgtcagtggttctttgatctacccctcccatggacaagtggagccactactgagaccccgacatggaacaggaaggaactattagtaacgttcaaaaacgcccacgccaagaagcaggaagtggtggtgttgggaagccaagaaggtgcgatgcacacagcgctcacgggcgctacagaaattcaaaacagtggcgggacatcgatattcgcaggccacttgaaatgtcggttaaagatggataagctcgagctaaaaggaatgagctacgcgatgtgcaccaacacatttgttctcaagaaagaggtgagcgaaactcagcacggcacgatattgataaaagtcgaataccgaggggaggacgctccatgcaagatccccttctcaaccgaagacgggcaggggaaggcgcacaacggacgactcatcacagcaaaccccgtcgtgactaaaaaggaagaacccgtcaacattgaggcagaacctccgtttggtgaatcgaacatcgtcataggaatcggcgacaacgcgctgaagataaattggtacaagaaaggctcctcgatcggcaaaatgttcgaagcgacagcgaggggagcccgacgaatggccatattgggagacaccgcatgggattttggaagcgtcggaggggtccttaatagcctaggcaaaatggtgcaccaaattttcggcagcgcatacaccgcgcttttctccggcgtgagctgggttatgaagatcggaatcggagtactgctgacatggatagggctgaactcgaagaacacaagcatgagttttagctgcatagccataggaataatcacgctgtaccttggagcggtcgtacaggcagacatgggttgtgtggtcaactggaagggcaaagaactgaaatgcggcagcgggatttttgtcacgaatgaagtccacacgtggaccgagcaatacaaatttcaggctgactcaccaaaaagacttgcaacggccattgcaggggcttgggaaaacggagtctgtggcatcagatccacgacgcgcatggaaaacttactctggaaacagattgcaaatgagctcaactacatactgtgggagaacaacatcaagctgacagtcgtagtaggcgacatcatcggggtacttgaacaagggaaacggaccctaacaccacagccgatggaactcaagtacagctggaagacgtggggcaaagcgaaaatcgtaaccgcggaaacgcaaaattccagctttatcatcgacggaccgaataccccagaatgccccagcgcaagtcgcgcatggaacgtctgggaagtagaagattacggattcggggtattcacaaccaacatatggctgaaacttagggaagtctatactcagctctgcgaccaccggctaatgagcgccgcagttaaggatgaacgagcggtccacgcagacatgggctattggatcgaaagtcaaaagaacggaagctggaagttagaaaaagcaagccttatcgaagtaaaaacatgcacctggccaaagtcacacacactctggtctaacggagtactagaaagtgacatgataattcccaagtcgctagcgggccccatatcccaacataaccaccggccagggtaccacactcagacggctggcccgtggcatctaggcaaactcgagctggacttcaactactgcgaaggtaccaccgtcgtaataacagaaaactgcgggactaggggacctagcctgcgcacaaccacggtgtctggaaagctgattcacgaatggtgctgcagatcatgtacattaccaccgctaaggtacatgggagaggacgggtgctggtacgggatggagatcaggccaatcagtgagaaggaggagaatatggtgaaaagcctcgtcagcgcaggctcaggaaaggtagacaattttacaatgggggtcctatgccttgcaatcctgtttgaagaggtgatgcgcggaaaattcgggaagaaacacatgatagctggcgtcttcttcaccttcgtgctactcctctcaggtcaaataacttggagagacatggcccacacactcactatgatcggctcaaacgcctcagaccgcatggggatgggagtgacatacctagcactcatcgcgacgtttaagatccaaccatttttggcattaggattcttcctcaggaaactgacatcacgagaaaacctcctcctaggagtcggcctggcaatggcaacaaccctacaactcccagaggacatcgaacaaatggcaaacggaatagcactcggcctgatggccctcaaactaataacacaattcgagacttaccaactatggacagccctcatctcactcacgtgctcaaacacgatgttcacactcacagtcgcttggcgcacggccactctaatcctcgcaggagtctcgctactaccagtgtgccaaagtagctctatgcgtaagaccgactggctgcctatggccgtagccgcaatgggggtcccacccttaccacttttcatcttttccttgaaggacacactaaaacgacgatcatggccgctaaacgagggagtaatggcggtcgggttagtcagtatacttgcatcatcccttctcaggaacgacgtcccgatggcgggaccgctagtcgctggcggcctattgatagcttgctacgtaataacaggtacatctgccgacctaacggtggaaaaggcagccgatattacctgggaagaggaagcagagcagacgggggtctcccacaacctgatgattaccgtggacgacgacggaaccatgcggataaaagacgatgagacggagaatatccttacagtcctcctaaaaaccgcccttctcatcgtttccggggttttcccttattccataccagctacactgctggtatggcacacctggcagaaacaaacacaacgctccggcgtcttgtgggatgtacccagtccaccagaaacccagaaagcagaattagaggagggggtctaccgaatcaagcaacaaggaattttcggcaagacgcaggtaggcgtaggggtacagaaagagggggtgttccacaccatgtggcacgtaactagaggggcggtgctaacctacaacgggaaacgcctagaacccaactgggcaagtgtgaagaaagatctgatctcctatgggggcgggtggagactctccgcgcaatggcagaaaggcgaagaagtacaagtaatcgcggtagaaccaggtaagaaccccaagaacttccaaacgatgcctggaacctttcaaacaacgacaggtgagatcggggcgatagccctggacttcaaaccgggcacctctggatccccgatcatcaaccgagaaggtaaagttgtgggcctttatggcaacggggtggtcacgaaaaatggaggctacgtatcaggaatcgcacaaacgaacgcagagcctgacggccccacacctgaactggaagaagagatgttcaaaaagcgcaacctcacgattatggacctacaccccggttcagggaagacgagaaaatacttaccagcaatcgtccgcgaggcgataaagcgacgactacggacactgatcctcgccccgacacgcgtcgtcgcggcagagatggaggaggccctgaaagggctcccgatcaggtaccaaaccaccgcaacaaaatccgaacacacggggcgagagatagtggacttaatgtgccacgcgacctttaccatgaggctgctcagtcccgtgagagtaccaaactacaacctcataattatggacgaagctcacttcacggacccggcatccatcgcggcccgaggatacatctctaccagggtaggcatgggcgaagccgcagcaatattcatgactgcaacccctccggggaccgcggatgcgtttccccagagcaatgcgcccatccaagacgaagagagggacatcccagagcgcagctggaacagcgggaacgaatggattacggactttgcaggtaagaccgtgtggtttgtcccgtcaatcaaagccggaaacgatatcgcgaattgcctgcgcaagaatgggaagaaagtaatacaattgagtagaaaaacgttcgacacagaatatcagaaaacgaagttgaacgattgggattttgtagtaacgacggacataagcgaaatgggcgctaacttcaaagcggaccgagtcattgacccacgtcgatgccttaaaccagtgatactaaccgacggtccagagagggtcatcctcgcagggcccatgcctgtgacagcggcctcagccgcgcagagaagaggtagagtcggcagaaacccccaaaaggaaaacgaccagtacatattcactggccagccacttaacaacgacgaggaccatgcacattggacagaggcgaagatgctcctagacaacattaacacccccgagggcatcattcccgcattatttgaacccgaacgagagaaaagtgcagccatcgacggcgaatacaggctcaagggggaaagtagaaagacattcgtcgagctgatgcggagaggcgatctcccagtctggttagcacataaagtagccagcgagggcataaagtacacagaccgcaaatggtgcttcgatggccaaagaaacaaccagatactggaggaaaatatggatgttgagatttggaccaaggaaggtgaaaagaagaagctccgcccgagatggttagacgcgagaacgtacagcgacccgctagccctaaaagagttcaaagatttcgctgccgggagaaaaagcatcgccctggatctcgtgacggagattggccgagtaccatcacacctcgcgcaccgtacgagaaacgccctcgataaccttgtaatgctacacaccagcgaacacgggggtagggcgtatcgacatgcaatggaggaacttcctgagacaatggaaaccttattgctactcggtctcatgattttactgaccggaggcgcaatgctttttcttatatcagggaaaggtattggaaagaccagcatcggactgatctgcgttatagcatcgagcggcatgctctggatggcagagataccactccagtggatagcatccgcaatagtgcttgagttctttatgatggtgctcctcatacccgaaccagaaaagcaacgcacaccccaagacaatcaactggcgtacgtcgtgataggcattctaaccctagccgccataatagcggctaacgaaatgggactcttggaaaccaccaaaagggacttaggaatgtccaaggaaccgggggtcgtatcgccgacatcctacctggatgtagatctacaccctgccagcgcctggaccttgtatgcagtagccaccaccgttattacaccaatgctacgccacacgatagaaaactcaacagcgaacgtgtcactagctgcaatagctaaccaggcggtagtactaatgggattggacaagggctggcctatctcaaagatggatcttggcgtacccctactcgccctagggtgctacagccaagtcaacccactcacactgacggcggccgtcctactactcattacacactatgcgataataggcccaggcctccaggctaaggcaacgagagaagcacaaaagcggacggcggcaggcatcatgaaaaatccaaccgtagacggaatcatgaccatcgacctagaccccgtgatgtatgatagcaaatttgaaaagcaacttggccaggtgatgctactcgtcctatgcgcagttcaattgctgcttatgcgcacatcgtgggcactctgcgaggcgctgacccttgccacaggcccaattacaacgctatgggagggcagtccaggcaagttctggaatactaccatagctgtcagcatggcaaacatattcagaggatcgtatctggcaggcgcaggattggctttcagcattatgaaatccgtaggcaccggcaagcgcggcacagggagccaaggagagaccctaggcgagaaatggaaaaagaagctcaatcaactgagccgtaaggaatttgacctctataagaaaagcgggataacagaagtggaccggacagaagcaaaagaaggacttaaaagaggggaaatcactcaccacgctgtcagccggggatcagctaaactccaatggtttgtagagcgaaatatggtaatccctgaaggtagagtaatagacctcggctgcggccgaggagggtggagttactactgcgcaggcctgaagaaggtcacagaagtccgtggatacacgaagggaggccctggtcacgaggagcctgtacccatgtccacatatggctggaatatagtgaaactcatgtccggaaaggacgtattctacctcccaccagagaagtgcgatacactcttatgcgacatcggggaaagctcacccagccccacagttgaagaatctaggaccatcagagtcctcaagatggtagaaccgtggctgaagaataatcaattctgcattaaagtcttaaacccgtacatgccgacggtcatcgagcaccttgaaaggctgcagcgtaaacacggaggcatgctagtcaggaatccgctctcacgtaactcgacgcacgaaatgtactggatctccaacggaaccggaaacatcgtagcgtccgtaaatatggtgagccgcctactacttaaccgcttcactatgacccacaggcgacctacgatagaaaaggatgtcgacttaggcgcgggaaccagacacgttaacgcggaaccagaaaccccaaacatggacgtcataggagaacggataaagcgcataaaggaagaacacaacagcacgtggcactacgacgacgaaaatccttacaagacatgggcgtaccacggcagctatgaagtcaaggcaacagggagcgcatcaagtatgatcaacggagtggtcaaactattaacgaagccctgggacgtagtacctatggtaactcaaatggccatgaccgacaccacaccgttcgggcagcagcgtgtttttaaggagaaagtcgatacccggacaccgaggtcaatgccaggcacccggcgagtgatgggaataacggcggaatggctatggcgaaccttaggtcggaataagaaacccagattatgcacccgcgaagagttcacgaaaaaggtacgaaccaacgccgccatgggcgccgtgttcactgaagaaaaccaatgggatagcgccaaagccgctgtcgaagacgaggatttctggaaactggtcgatagggaacgtgaacttcacaagttagggaaatgtgggagctgcgtttacaatatgatgggaaagagagagaagaaattaggggagttcggaaaagcgaaaggaagtcgcgcaatatggtacatgtggcttggggccagatacctggagttcgaggcccttggattcctaaatgaagaccactggttttcgagagagaatagctattcaggggtggaaggagaaggtctgcataaactgggctatatactacgagacatttcgaaaatcccaggaggggcaatgtacgctgatgacacagcaggctgggacaccaggatcacggaggacgacctacacaacgaggagaaaataacccaacagatggaccccgaacacagacagctggccaacgcaatctttaaactaacgtaccaaaataaagtcgtcaaggtccaacgtcccacgcccaccggaacagtaatggacattatatcccgtaaggatcaacgaggctccgggcaagtcggcacttacggcctcaacacgttcactaacatggaggcccaactaatcaggcagatggagggggaaggcgtactttcgaaggcggacctagaaaacccccacttacccgagaagaaaattacacagtggctagaaaccaaaggtgtagagagactgaagcgcatggcgatcagcggcgacgactgcgtcgttaaacccatagacgaccggttcgccaatgcgctcctcgcccttaacgacatgggaaaagtccgcaaggacataccccaatggcaacccagtaaaggatggcacgactggcaacaagtgcccttttgcagccaccacttccacgaactgataatgaaagacggccgcaaactcgtggtcccgtgtaggccccaagacgaacttatcggacgggcaaggatcagccagggtgccggatggtccctacgcgaaacagcatgcctaggaaaagcatatgctcagatgtggtccctgatgtacttccacagacgagacctaaggctggcatccaacgccatctgcagcgccgtaccagtgcattgggtgccgacgagccgaacaacatggagcatacatgctcatcaccaatggatgacaaccgaggatatgctaaccgtctggaacagagtctggatcgaagacaatccctggatggaagacaagacccccgtaacaacatgggagaatgtgccctacctaggaaaacgagaagaccagtggtgtggttccctcatcgggctcacctccagggccacatgggctcaaaacatcccgactgctatccaacaggtccgaagcctcatcgggaatgaagagttcctggactacatgccctcaatgaaacgattccgcaaggaagaggaatcagaaggtgcaatatggtag

SEQ ID NO: 25635 - RNA, 9873 nt, synthetic construct
  misc_feature 1..9873: note = derived and/or modified CDS sequence (opt11) from DENV-3__JX669494__SS-prME
  source 1..9873: mol_type = other RNA
accagcttgtgcctcatgatgatacttccagccgccctggcgtttcacctcacaagccgggacggagagccgcggatgatcgtgggcaaaaatgagcgcggaaaaagcctgctgttcaagactgcgtccggtaccaacatgtgcaccctcatcgccatggacttgggggagatgtgtgacgacactgtgacttacaagtgcccccacatcacggaggtagagccggaggacatagactgctggtgcaacctgacaagcacctgggttacttacgggacctgcaatcaagccggtgagcggcgcagggacaaacgctcggtggccctagcgccacacgtgggcatggggctggacacgcggacccaaacctggatgagcgccgagggtgcctggagacaggtggagaaggtggaaacctgggcactgcggcacccggggttcaccatacttgcgctgttcctagctcactatatcgggacctctctcacgcagaaagttgtgatcttcatcctgctgatgctcgtgaccccgagcatgaccatgagatgtgtgggggtgggcaaccgggacttcgtcgagggcttgtccggggccacctgggtggacgtagtcctagagcacgggggctgcgtgacgacaatggccaagaacaagcccaccctagacatcgagctgcaaaagacagaggccacgcagctggcaaccctccgtaagctgtgcatagaaggcaagatcaccaatatcacaacggattcgcggtgcccaacccagggcgaggcggtcctgcccgaggagcaggaccagaactacgtctgcaagcacacctacgtcgaccgcggttggggcaacgggtgtggcctcttcgggaagggatccctagtgacgtgcgccaagttccagtgtcttgagcccatcgagggtaaggtcgtgcagtatgagaacctaaagtacactgttatcatcaccgtccacaccggggaccagcaccaggtgggcaacgagacccagggggtaacggccgagatcacgccccaggccagcactactgaggcgatcctgcccgagtacggcacactgggcctcgagtgttccccgcggacgggcctggactttaacgagatgatcctgctcaccatgaagaataaggcctggatggtgcatcggcagtggttcttcgacctgcccctcccctggaccagcggggccaccacagaaacccccacctggaaccggaaggagcttctagtcaccttcaagaacgctcatgctaagaagcaggaggtcgtggtgctggggtcccaggagggcgcgatgcacacggccctgaccggggccaccgagatccagaatagcggtgggacctccatcttcgccggccatttgaagtgccgcctgaagatggacaaactcgagctaaagggcatgagctatgccatgtgcactaacaccttcgtcctgaagaaggaggtgtccgagacccagcacgggaccatccttatcaaggttgaataccggggcgaggacgcgccgtgcaagatccccttcagcacggaagacgggcagggcaaggctcacaacggccgcctgatcaccgccaaccccgttgtgaccaagaaggaggaaccggtgaacatcgaagccgagccgccttttggggagagcaacatcgttatcggaatcggggataacgcgctaaagatcaattggtacaagaaggggtccagcatagggaagatgttcgaggccaccgcacggggcgccaggcgcatggccattctgggcgacacggcgtgggacttcgggtccgttggcggggtgctaaatagcctgggcaagatggtgcaccaaatcttcggaagcgcctacaccgccctgttcagcggcgtgtcctgggtgatgaagatcggcattggggtccttttaacctggatcggcttaaacagcaaaaacacctcgatgagcttctcctgcatcgcaatcggtatcatcacgttgtaccttggcgccgtggtgcaagctgacatggggtgcgttattaactggaagggcaaggaactgaagtgcgggagcgggatattcgtgaccaacgaggtgcacacctggaccgagcagtacaaattccaggccgacagccccaaacggttggccacggccatcgccggcgcgtgggagaacggggtttgcggcatccgcagcaccacccggatggagaacctgttatggaagcagatcgccaacgagcttaactacatcctgtgggagaacaacatcaaacttaccgtggtggttggggacatcatcggcgttctagagcagggcaagcgcacgctgacgccccaaccgatggagctgaagtacagttggaagacctgggggaaggcaaaaatagttaccgcggagacgcagaactcctccttcattatcgatggccccaacacacccgagtgtcctagcgcgtcccgggcctggaatgtctgggaagtggaggactacgggttcggcgtgttcaccacaaacatctggctgaagctgagggaggtgtacactcagctgtgcgaccatcggctcatgagcgctgccgtgaaggacgagcgcgccgttcacgcagacatggggtactggatcgaaagccagaaaaacgggtcctggaagctagagaaggcctccctgattgaggtcaagacatgcacttggccgaaaagccacaccctctggagcaacggcgtgctggagtccgacatgatcatccccaagagcctggcggggcccatctcccagcacaaccaccggccgggctaccatactcaaacggccgggccctggcatttgggcaaactggagctggactttaactactgcgaaggcaccaccgtggtcatcacggagaactgcggcactcgaggccccagcctccggaccacaaccgtgtcggggaagctgatccacgagtggtgctgccgctcttgcacgttacccccgttacggtacatgggcgaagacggttgctggtacggcatggagattcgccccatctccgagaaggaggagaacatggtcaagagcctggtctccgccggaagcgggaaggttgacaacttcaccatgggcgtgctgtgcctcgcgatcctgttcgaagaggtcatgcgtgggaagttcggaaagaagcacatgatcgccggggtgctgttcaccttcgtcttactgctgtccggccagataacgtggcgcgacatggcccacacgctcataatgatcggcagcaacgcctccgaccggatggggatgggtgtgacctacttggccctgatagcaaccttcaagatccagcccttcctcgccctggggttcttcctaaggaagttaacaagccgggaaaacctactactcggagtgggcctggccatggccacgaccctacagctccccgaggacatagaacagatggcgaacgggatcgccctggggcttatggccttaaaactaatcacccagtttgagacctaccagctgtggactgccctcatcagcctgacgtgctccaataccatgttcaccctgactgttgcttggcgcaccgcgaccctcatcctcgccggggtcagcctgctcccggtctgtcagtccagctccatgcgcaaaaccgactggctgcccatggccgtcgccgccatgggcgtccctcccctgcccctgttcatcttcagcctgaaggatacgttaaagcggcgctcgtggccactcaacgaaggggtgatggcggtcggcctggtgagtatcctggcctcctcgctcctgcggaacgacgtgcccatggccggccccctggttgcagggggcctcctgatcgcttgctatgtgatcaccggtacctccgcggacctgaccgtggagaaggccgccgatatcacgtgggaagaggaggcagagcagaccggcgtcagccacaacctcatgatcaccgtggacgacgacgggacgatgcgcatcaaggacgatgagaccgaaaacatcctgacggtgcttctcaagaccgccctgttaatcgtctccggcgtgttcccatactcaatccccgccaccctcctggtgtggcacacatggcagaaacagacgcagcggtcaggtgtcctgtgggatgtgccaagtccccctgagacccagaaggccgaactcgaggagggggtgtatcgcatcaagcagcaaggcatcttcgggaagacccaagtcggcgtgggggtgcagaaggagggcgtcttccacacgatgtggcacgtgacgcggggtgcggtgctgacctacaacgggaagagactcgagcccaactgggcctccgtcaagaaggacttgatcagctacggcgggggatggcgattatccgcgcaatggcaaaagggggaagaggtccaggtgatcgcggtggagcccggcaagaatccaaagaacttccagaccatgccgggcaccttccagacgaccaccggggaaatcggcgccatcgccctagacttcaagcctgggacctccggcagccccatcatcaaccgcgagggcaaggtggtagggctgtacggcaacggggtcgtgacgaagaacggcgggtacgtctccgggatcgcgcagaccaacgcggaaccggacggccccacccccgaactcgaggaggagatgttcaagaaacggaatctgaccatcatggaccttcaccccgggtcgggcaagacgcgcaagtacctccctgccatcgtccgggaggccatcaagcgccgcctgcgcaccctgatattagcacccaccagggttgtggctgcggaaatggaagaggccctgaaggggctgcccatccggtaccagacgacggccaccaaatccgagcacaccggccgggagatcgtcgacctcatgtgtcacgctacgttcacgatgcgcctgctgagcccggtgcgggtcccgaactacaacctcatcatcatggacgaggcccacttcaccgatcccgcatccatcgcagcccgcggctacatcagcactcgcgtcggtatgggcgaggcggcggccatcttcatgactgcaacgccgcccggaaccgccgacgcattccctcagtccaatgcccccatccaggacgaggagagggacattcccgagcgcagctggaactctggcaatgagtggataaccgatttcgccgggaagaccgtgtggttcgtgccctcgattaaggccggcaacgacatagccaactgcttgcggaagaacgggaagaaggtcatccagctgtcccgcaagacgttcgacaccgagtaccagaagaccaagctcaatgactgggatttcgtggtgaccacggatatctccgagatgggcgcgaacttcaaggcggatcgggtgatcgatccgcggcggtgcctgaagcccgtgatcttaaccgacggccccgagcgagtgatcctcgctggaccaatgccggtgacagccgcctccgccgcgcagcggagaggccgcgtagggagaaaccctcagaaggaaaacgaccagtacatattcaccggacaacccctgaacaacgacgaggaccacgcccactggaccgaggcaaagatgctgctcgataacatcaacacgcccgaagggatcatcccggccctattcgagcccgagcgggagaagtccgcggccatcgacggcgagtaccgcctgaagggcgagtctagaaagaccttcgtggagctcatgcgccgcggcgacctgcccgtctggctggcccacaaggtggcctcggaggggatcaagtatacggaccgaaagtggtgcttcgatgggcagcggaacaaccaaattctcgaggaaaacatggatgtggagatctggaccaaggagggcgaaaagaagaagctgcgcccccgctggctggacgcacgcacgtactccgatccgctcgcgctgaaggagttcaaggatttcgccgccggccgcaagagcatcgccctggatctcgtgactgagatcgggcgcgtgccctcccaccttgcccatcgcaccaggaacgcgcttgacaacctcgtcatgttgcacactagcgagcacggcggacgcgcctaccgtcacgccgtggaggagctacccgaaacgatggagaccctcctgctgctcggccttatgatcctgctgacagggggtgccatgctgttcttgatcagcggcaaggggatcggcaaaacctccatcggactcatctgcgtgatagcctcctccggcatgctgtggatggcagaaatcccactacaatggattgccagcgccatcgtccttgagttcttcatgatggtgctgctgatccccgagcccgagaagcagaggacgccccaggacaaccaactcgcctacgtggtcatcggaatccttaccctggccgccataattgccgccaacgagatgggcctcctagagaccaccaagcgggacctcggcatgtccaaggagccgggggtggtgagccccacgtcctacctcgatgtcgacctgcatccggccagcgcttggaccctgtacgccgtggccaccaccgttatcacgcccatgttgagacacaccattgagaactccacagccaacgtcagcctggccgcaatcgcaaaccaggccgttgtgctgatgggactcgacaagggatggccgatatccaagatggacctgggcgtccccctgctcgccctgggctgctacagccaagtgaaccccttaaccctcaccgccgctgtgctgttgctcattacccactatgccattatcggtccaggcctccaggccaaggccacccgggaggcgcaaaaacgcaccgcggccgggatcatgaagaacccgacggtcgacggcatcatgaccatcgacctggaccccgtgatctacgactccaagtttgagaagcagctcggtcaggtgatgctgctggtcctttgcgccgtgcagctgctgctcatgcggaccagctgggccctgtgcgaggcgctgaccctcgccactggccccattaccaccctgtgggagggctcccccgggaagttctggaatacgacgatagctgtgagcatggccaacatcttccgaggcagttacctggccggggcgggcctcgccttcagcatcatgaagtccgtcgggaccggcaaacggggcaccgggagccagggcgagaccctgggggagaagtggaagaagaaactgaatcagctcagccgcaaagagtttgacctttataagaagtccggcattaccgaggtggaccggacggaagccaaagaggggttaaaaagaggcgagatcacccaccacgccgtctcgcggggctccgcgaagctccagtggttcgtcgagcgcaatatggtgatcccggagggacgggtgatagacctgggctgcggaagaggcggctggagctactactgcgcaggtctgaagaaggtcaccgaggtgcgggggtataccaagggcgggcccgggcacgaggagcctgtaccaatgtccacctacggctggaacatcgtcaagttgatgagcggaaaggacgtgttctacctgccgcccgagaagtgcgacaccctactgtgcgacatcggtgagtcctcaccctccccgaccgttgaggaaagccggaccatcagagtactcaagatggtggagccatggctgaagaacaaccagttctgcattaaggtgctcaacccctacatgccaacagtcatcgagcacctagagcggttacagcgcaagcacggcgggatgctcgtccggaaccccctctccagaaacagcacccacgagatgtattggatctccaacggcaccgggaacatcgttgcaagcgtaaacaccgtgagtcggctgctgctcaatcggtttacaatgacccaccggcgcccgactaccgagaaggacgtcgatctgggcgctggcacgcggcacgtaaacgccgagccggagacacccaacatggacgttatcggggagcgaatcaagcggattaaggaggagcacaacagcacctggcattacgacgatgagaatccgtacaagacctgggcgtaccacggcagctacgaggtgaaagcgacggggagcgcatctagcatgataaacggtgtcgtgaaactgttaaccaaaccctgggacgtggtgcccatggtgacccagatggctatgaccgacacaacccccttcgggcaacagcgcgtcttcaaggagaaggtggacacccggacaccccggagcatgccaggaacgcggcgcgtaatgggaatcacagcggaatggttatggcggaccttagggcgcaacaagaaaccccgcttgtgcaccagggaggagtttacgaaaaaggtccgcactaacgcggccatgggggccgtgttcacggaggagaaccagtgggactccgcaaaggcggcggtagaggacgaggacttctggaaactggtcgaccgggaacgcgagctgcacaagctcggtaagtgcggcagctgcgtgtacaacatgatggggaaacgcgagaagaagctcggcgagttcggcaaggccaagggatcccgcgccatttggtacatgtggctgggtgcccgataccttgagttcgaggccctgggctttctgaacgaggaccattggttcagccgagagaactcctacagcggcgtggagggggagggcctccacaaattagggtacatcttgcgggacatctcaaagatcccaggaggggcgatgtacgcagacgacaccgctggatgggacacgcgaatcaccgaggacgatctgcacaacgaggagaaaatcacccaacagatggaccctgaacaccggcaactggccaatgccatcttcaagctgacctatcagaacaaggtcgtgaaggtgcagcgccccacccccacgggcaccgttatggacataatcagccggaaggaccagcgcggcagcggccaggtgggcacgtacggtctcaacaccttcacgaacatggaggcgcagctaatccggcagatggagggcgagggggtgctgagcaaagcggacctcgagaatccacacctcccggagaagaagatcacccagtggctggagaccaagggggtcgagcgcctaaagcggatggccatctccggcgacgactgcgtggtgaagcccatcgacgaccgcttcgccaacgccctgctggcattgaacgatatggggaaggttcggaaggacatccctcagtggcagcccagcaagggttggcacgactggcagcaagttccgttctgctcccaccacttccacgagctgataatgaaggacgggcgcaagctggtggtcccctgccgaccccaggacgagctgatcggccgcgcccgcatctctcaaggggcgggctggtcactgcgggagactgcctgcctgggcaaggcctacgcccagatgtggagcctcatgtacttccataggagggacctgcgcctggcctccaacgccatatgcagcgccgtacccgtgcactgggtcccgacgtcccgaaccacgtggtcaatacacgcgcaccaccagtggatgaccacagaggatatgctcaccgtgtggaaccgcgtatggatcgaggacaacccgtggatggaggacaaaacccccgtgaccacgtgggagaacgtgccctatctggggaagcgggaagaccagtggtgcggaagcctgatcgggctcacctccagagccacctgggcccagaacatcccgaccgccatccagcaggtccggagcctgatcggcaacgaggagttcctcgactatatgccgtcaatgaagcgcttccggaaggaggaggagagcgagggggccatctggtga

SEQ ID NO: 25636 - RNA, 9873 nt, synthetic construct
  misc_feature 1..9873: note = derived and/or modified CDS sequence (opt11) from DENV-3__JX669503__SS-prME
  source 1..9873: mol_type = other RNA
accagcttctgtttaatgatgatacttcccgcggcgctggcgtttcatctgaccagtagggatggtgagccgcgcatgatcgtggggaagaacgagcgcggcaagagcctgctgttcaagacagcttccgggatcaatatgtgcaccctgatcgccatggacctcggcgagatgtgcgacgacactgtgacctacaagtgcccccatatcactgaggtggaacccgaggatatcgattgctggtgcaacctgaccagcacatgggtaacctacggaacgtgcaatcaggccggcgagcgccgccgcgacaaacgctcagtggcccttgcgcctcacgtgggcatggggctcgacacgcggacccagacctggatgagcgccgagggagcctggcgccaggttgagaaggtggagacgtgggccctgcgacacccggggttcaccatactggccctttttctggcacattatataggcacttccctaacccagaaggttgtgatcttcatcttactgatgctggttacgcctagtatgacgatgcgctgcgtgggggtcgggaaccgggacttcgtcgaaggcctctccggggcaacctgggtggacgtggtcttagagcacggcgggtgtgtgaccacgatggccaagaacaagcccaccctggacatcgagctccaaaaaaccgaggctacccagctggcgacgttgcgcaagctctgcatcgagggcaagatcaccaacattaccaccgacagccggtgccccacacagggcgaggcggtgctgccggaggagcaggatcaaaactacgtctgcaaacacacctacgtggaccgcgggtggggcaacgggtgcggccttttcgggaagggctccctcgtgacatgcgccaaattccagtgcctggagcccatcgaagggaaggtcgtgcagtacgagaacctgaagtataccgtgatcatcacggtccacaccggagaccagcaccaggtgggcaacgagacgcagggtgtcaccgccgagattactccccaggcaagtaccacagaagccatccttcccgagtacggcaccttagggctggagtgctctccgcggactggcctcgacttcaacgagatgatcctgctgacgatgaagaacaaggcctggatggtgcaccggcagtggttcttcgacctccccctgccctggaccagcggcgccactaccgaaacacccacatggaatcggaaggagctgctcgtgacattcaagaatgcccacgcgaagaagcaggaagtcgtggtgttggggtcccaggaaggcgcgatgcacaccgcgctgacgggggccaccgagatacagaacagcggcgggacctccatcttcgccggccatctcaagtgccgcctgaagatggacaagctggagctcaagggcatgagctacgccatgtgcaccaacacgttcgtcctgaagaaggaggtgtcggagacgcagcacggaacaatccttatcaaggtggagtacaagggcgaggacgcgccgtgtaagatacctttcagcaccgaagatgggcagggcaaggcccacaatggtcggctcatcacggccaaccctgtcgtgaccaagaaagaggagcccgtgaacattgaggcagagccgccattcggggagagcaacattgtgatcgggatcggggacaacgcgctcaagatcaactggtacaagaagggctccagcatcgggaaaatgttcgaggctaccgcccgcggcgcccgacgcatggccatcctgggagacaccgcatgggacttcggttccgtgggcggagtgctgaacagcctcggaaagatggtacaccagatcttcgggtccgcatacacggccctgttcagcggggtctcctgggtgatgaagatcggtatcggggtactgctcacctggatcggcctgaactcgaagaacaccagtatgagcttctcctgcatcgccatcgggatcataaccctgtacctcggcgccgtggtacaagcggacatggggtgcgtcattaactggaagggcaaggagttgaagtgcggcagcgggatctttgtgacgaatgaagtgcacacctggactgagcagtacaagtttcaggccgactcccctaagaggctggccaccgcgattgccggcgcttgggagaacggggtatgcggcatacggagcacgacccgcatggaaaacctcctgtggaaacaaatcgccaacgaactgaactacatcctctgggagaacaacatcaagctgactgtggtggtcggtgacatcataggggtattagagcagggcaaacggaccttgacgccccaaccgatggagttgaagtattcctggaagacctgggggaaagccaagatcgtaaccgctgaaacgcaaaacagctccttcatcattgacggccccaacacccccgaatgccccagcgcgtcgcgcgcttggaacgtatgggaggtggaggactacgggttcggcgtgttcaccaccaacatctggctgaagctccgggaggtctacacccagctgtgcgaccaccgactgatgagcgcggccgtgaaggacgagcgtgccgtacacgctgatatgggctactggatcgagagccagaagaacggttcctggaaactcgagaaggcatctttaattgaggtcaagacctgcacgtggcctaagtcccataccctgtggtccaatggcgtgctcgagtccgacatgatcatcccaaagagcctggccgggcccatatcccagcataaccaccgcccgggctaccacacccagaccgcagggccgtggcacctggggaagctcgagctggacttcaattactgcgagggcacgaccgtggtcatcaccgagaactgcggcacccggggtccctccctgcgcacgaccaccgtgtccggtaagctcatccacgaatggtgctgccggagctgcacacttcccccgctgcgctacatgggcgaggacgggtgctggtacggcatggagatccggccaatctccgaaaaagaagaaaacatggtcaaaagcctcgtctccgccggcagcgggaaggtggacaatttcacgatgggcgtgctgtgcctagcgatcctcttcgaggaggtcatgcgaggaaagttcggcaagaagcacatgatagccggggtgttcttcaccttcgtgctgctcctctccggccagataacctggcgggacatggctcacaccctgatcatgatcggcagcaacgcctccgaccgcatgggaatgggagtaacgtacctggccttaatcgcgacattcaagatccagcccttcctggccctggggttcttcttacggaagttaaccagccgcgagaacctgctcttaggcgtgggcctggctatggccaccacgctgcagctgcctgaggacatagagcagatggctaacgggatcgccctgggccttatggcgttgaagctgatcacccagttcgagacctaccaactctggacagccctaataagcctgacctgctcgaacaccatgttcacccttaccgtggcctggcggacggcgactttaatcctggccggcgtcagtctcctgccggtatgccagtccagctccatgcgcaagactgactggctgcctatggcagtcgccgccatgggcgtgccgcccctcccgcttttcatcttcagcctcaaggacacactcaaacgccggtcctggccactgaacgagggggtgatggcggtcggcttggtgagcatcctcgcctccagcctgctgcgcaacgacgtgcccatggcgggcccgctcgtcgccggggggctgctgatcgcctgctacgtgatcacggggacctccgccgacttaaccgtggaaaaggccgccgacatcacctgggaggaggaggcagagcagacgggcgtcagccacaacctgatgatcaccgtggatgatgatgggaccatgcggatcaaggacgacgagaccgagaacatcctgaccgtgctcttaaagacggctctgcttatcgtgtccggcgtgtttccttacagcatccccgcgaccctgctggtgtggcacacctggcagaagcagacccaacgctccggtgtcctttgggacgtgcctagcccgcccgagacgcagaaggccgagctggaagagggggtgtaccggatcaaacagcaggggatcttcggaaagacccaggtcggcgtgggggtgcagaaggaaggcgtttttcacaccatgtggcacgtgacccgcggtgccgtgctgacgtacaatgggaagcgactcgaacctaattgggcctcggtcaagaaggatctgatctcctacggtgggggctggaggctgtccgcgcagtggcagaagggggaggaagtccaagtgatcgccgttgagcccggaaagaaccccaagaacttccagaccatgcccggcaccttccagacaacgaccggcgagatcggcgccattgccctcgactttaagcccgggaccagcggcagcccaatcatcaaccgggagggcaaggtggtggggctgtatggcaacggagtcgtgactaagaatggcgggtacgtatccggcatcgcccagacgaacgcagagccggatggcccgacccctgagttggaggaggagatgttcaagaagagaaacctaaccattatggacctccatcccgggagcggcaagacccggaagtacctgcccgctatagtcagggaggccataaagcggcgacttcgtacgctcatattagcccccacccgcgtggtggccgcggagatggaggaggcactgaaggggctcccaattcgttaccagaccaccgccacgaagtccgagcacaccggccgcgagatcgtcgacttaatgtgccacgccaccttcacgatgcggctgctcagcccggtgcgcgtaccgaactataacctgatcatcatggacgaggcccacttcacggaccccgcgtccatcgccgcccggggatacatcagcacccgcgtcggcatgggagaggccgccgccattttcatgacagcaacgccgcccggcacagccgacgccttcccgcagtccaacgcgcctattcaggatgaggagcgcgacatcccggagcggtcgtggaacagtggcaacgagtggattaccgatttcgccgggaaaaccgtgtggttcgtcccaagcatcaaggctggcaacgacatcgccaactgcctgcgcaagaacgggaagaaagtaatccagctcagccggaagaccttcgacacggagtaccagaagacaaagctgaacgactgggacttcgtggttacaaccgatatcagcgagatgggcgccaacttcaaagcagaccgcgtcatcgacccacggaggtgcctgaaacccgtgatcctcacggacggccccgagcgcgtggtcttggccgggcccatgcctgtgacggccgcgagtgccgcgcagcgccggggccgcgttgggcggaacccccagaaggagaatgaccagtacatcttcaccggccagcccctgaataacgacgaggaccacgcccactggaccgaggccaagatgctcctggataacatcaatacccccgaggggatcattccggccctgttcgagcccgagcgcgagaaatccgcggccattgacggagaataccggctcaagggcgagtctcgcaagacattcgtggagttaatgcggcgcggggatctgcctgtgtggctcgcccacaaggtagccagcgagggcatcaagtacaccgaccggaaatggtgcttcgacgggcagaggaacaaccagatcctggaggagaacatggacgtggagatctggacgaaggagggcgaaaagaagaagctgcggccccgctggctcgatgccaggacctactccgacccgctggcgctgaaggaattcaaagacttcgccgccggccgcaagtcgatagctctggacctggttacggagataggaagggttccctcccacctggcccatagaactcgcaacgcgctcgacaacctggtgatgctgcacacctctgagcacgggggtcgggcataccgccacgccgtggaggagctccccgagacaatggagactctgctgttgctggggctgatgatcttgctgaccgggggcgccatgctgttcctcataagcggcaaggggattgggaagaccagtatcgggctgatctgcgtcatcgccagctccggcatgctgtggatggcggagatcccactccagtggatcgccagtgccatcgtgctggagttcttcatgatggtcctgctcatccccgagccagagaagcagagaacgccccaggacaatcagctagcctacgtcgtgatagggatcctgaccttagcagcgatcatcgccgctaacgagatgggcctgctggaaaccaccaagcgcgacctcggcatgagcaaggagccgggggtagtcagccctacctcctaccttgacgtggatctgcaccctgccagcgcgtggacgttgtacgccgtggccaccaccgtcatcactcccatgctgcggcacacgatagagaatagcacagccaacgtgagcttggccgcgatagccaaccaggccgtggttctcatgggcctggacaaggggtggccgatctccaagatggacctaggcgtcccccttctggcactggggtgctacagtcaggtgaaccccctaaccctgactgccgcggtcctgctactgattacgcattacgccatcataggcccggggctgcaggccaaggccacccgcgaggcgcagaagcggaccgcggccggtatcatgaagaacccgaccgtggacggcatcatgacgattgacctcgacccagtgatctacgactccaagttcgagaagcagcttgggcaagtcatgctgctcgtgctgtgcgccgttcagctactcctcatgcgcacaagctgggccctgtgcgaggcgctcaccctggccacgggcccgatcacgaccctgtgggagggctcgcccgggaagttttggaacaccaccatagccgtctctatggccaatatcttccggggctcctacctcgccggggcaggcttagcctttagcattatgaagtccgtggggacgggcaagcgcggcacggggagccagggcgaaactctgggcgagaagtggaaaaagaagttaaaccagctaagccggaaggagttcgacttatacaagaagtccggcatcaccgaggtggaccgcaccgaggctaaggaggggctcaagcggggcgagataacgcaccatgcggtcagcaggggcagcgctaagctgcagtggttcgtggaacggaacatggtcatcccggaagggcgcgtcattgatctgggctgcgggcggggcgggtggagctattactgcgcgggccttaagaaggttacggaggttcgcggttacaccaagggcgggcctgggcacgaggagcccgtccccatgtccacatacggctggaacatcgtgaagctgatgagcgggaaggacgtgttctacctgccgcccgagaagtgcgacacgctcttgtgcgacataggcgagagtagcccctcccccaccgtcgaggaaagccgcaccatacgggttctcaagatggtggagccgtggctgaagaacaaccagttctgtatcaaggtcctcaacccttacatgccaactgtgatcgaacacctggagcgcctgcaaaggaagcacggcggtatgctcgtgcgcaaccccttatcccggaacagtacgcacgaaatgtattggatctccaacgggaccgggaacatcgtcgccagcgtgaacatggtgtcgcgactgctcttgaatcggttcaccatgacccatcgccggccgaccatagagaaggacgtcgatttgggcgctggtacccgacacgtgaacgcggagcccgagacccccaacatggacgtgatcggggaacggatcaagcgaataaaggaggagcacaacagtacctggcactacgatgatgagaacccgtacaagacctgggcctatcacggctcatacgaggtcaaggctaccgggagcgcctccagcatgatcaatggcgtggtcaagcttctaaccaagccctgggacgtggtgcccatggttacgcagatggccatgacggacaccacccccttcgggcagcagcgggtatttaaggagaaagtggacaccagaactccgcggagcatgccgggcacccgcagagtgatgggcatcaccgccgagtggctgtggcgcaccctcggcagaaacaaaaagccccggctgtgcactcgagaagagttcaccaaaaaggtgcggaccaacgctgccatgggcgccgtgttcaccgaggagaaccagtgggactccgccaaggccgcggttgaagatgaggatttctggaagctggttgaccgcgaacgggagcttcataagctggggaagtgcggtagctgcgtgtacaatatgatggggaagcgcgagaaaaagctgggcgagttcggcaaggccaaggggtcgcgggccatctggtatatgtggctcggcgcccgctatctggaattcgaggccctggggttccttaacgaggaccactggttcagccgagagaactcctacagcggcgtcgagggggaggggctgcacaaactgggttacatcctccgcgacatctccaaaatcccggggggcgcgatgtacgccgacgacacggccggttgggacacccggatcaccgaggacgacctgcacaatgaggagaagatcacccaacagatggacccggagcaccgccagctggccaacgccatcttcaagctaacctaccaaaacaaggttgtgaaggtccagcggccaacccccaccggaaccgtgatggacatcatcagccgcaaagaccagcgaggctcgggccaggtcggcacctacgggctgaatacgtttacaaacatggaggcgcaactgatccgccagatggagggtgagggggtcctcagcaaggccgatctcgagaacccccacctcccggagaagaagatcacccagtggctagagacaaagggtgtcgaacggttaaagcgcatggcaatctccggggacgactgcgtggtaaagcccatcgacgaccggttcgccaacgccctgctcgcgctcaacgatatggggaaggtgcgcaaagatatcccccaatggcaaccaagtaagggctggcacgactggcagcaggttcctttctgctcccaccacttccacgagctgattatgaaggacgggcggaagctcgttgttccctgccgaccccaagacgagctgatcggccgcgcccgcattagccagggggctggctggagcctgcgggagacggcctgcctcggcaaggcgtacgctcagatgtggagcctgatgtacttccatcggcgcgacctgcggctcgcatccaatgccatttgctcagccgttcccgtgcactgggtgccgacatccagaaccacctggagcatccacgcacatcaccagtggatgacgaccgaggacatgttaaccgtgtggaaccgggtctggattgaggacaatccctggatggaggacaagacacccgtgaccacctgggagaacgtgccttacctggggaagcgcgaggaccaatggtgcggctcgctcatcgggctaacctcccgagcaacctgggcgcagaacatcccgacggccatacagcaggttcgcagcctgattggcaacgaggagtttttagactacatgccctcaatgaagcggttccgcaaggaagaagagagcgagggggctatctggtga

SEQ ID NO: 25637 - RNA, 9873 nt, synthetic construct
  misc_feature 1..9873: note = derived and/or modified CDS sequence (opt11) from DENV-3__JX669493__SS-prME
  source 1..9873: mol_type = other RNA
accagcttttgccttatgatgattctccctgcggccctggcgttccacctgacgtcgagagacggggaaccccggatgatcgttgggaagaacgaacgcggcaagagcctcctgttcaagaccgcttccgggatcaatatgtgcacccttatcgccatggacctcggtgagatgtgcgacgacaccgtgacgtacaagtgcccccacatcaccgaggtggagcccgaggacatcgactgctggtgcaacttaacctcgacctgggtgacttatggtacctgtaatcaggctggtgagcgcagacgggacaagaggtccgtggccctggcgccccacgtgggcatggggctcgacacccgaactcagacctggatgtccgccgagggtgcttggcgtcaggtcgagaaggtggagacgtgggccctgagacatccgggcttcaccatcctcgccctctttctggctcactacatcggcacctcactgacccagaaggtggtgatcttcatactcctgatgctcgtgacgcccagcatgactatgcgctgcgtgggtgtgggcaaccgagacttcgttgagggcctcagtggggccacctgggtggacgtggtactggagcacggtggctgcgtgaccacgatggccaagaataagcccacattggacatcgagctccagaagactgaagccacccagctggcaacgctgcgcaagctctgcatcgagggcaagatcaccaacatcaccactgatagccggtgtcccacacagggcgaggccgtgcttccggaggaacaagaccagaactacgtctgtaagcacacctacgtggaccgggggtggggcaatgggtgcggcttatttgggaaaggctcactcgtgacctgcgcgaagttccagtgcctcgagcccatcgagggtaaggtcgtgcaatacgaaaacctgaagtacaccgtaatcatcacggtccacaccggtgatcagcaccaggtcggcaatgagacccagggggtcactgccgaaataactccccaggccagcaccaccgaggccatcctccccgagtacggcacgctggggttggagtgctccccgagaaccggcctggattttaatgaaatgatcctgctgacgatgaagaacaaggcatggatggtgcaccgccaatggtttttcgacttgcccctgccctggaccagcggtgccaccaccgaaacaccgacctggaacagaaaagagctgctcgtgacattcaaaaacgcccatgccaagaagcaggaggtcgtggtgttggggtcccaggagggagctatgcacaccgccctgacgggggccaccgagatacaaaatagtggcgggacgtccatcttcgccggacacctcaagtgccgcctgaagatggacaagctagagctcaagggcatgagctacgctatgtgtacaaacacgttcgtcttgaagaaggaggtgagcgaaacacagcacggcaccatcctgatcaaggtcgagtacaagggcgaggacgcgccgtgcaagatcccgttctcaaccgaggatggccaaggcaaggctcacaacggcaggttaatcacggccaaccctgtcgtgaccaagaaggaggagccagtgaatatcgaagcagagccgcccttcggggaatcgaatatcgtgatcggcatcggggataacgcgctgaagatcaactggtataagaagggctccagcatagggaagatgttcgaggccaccgcccgcggagccaggcgaatggccatcctgggcgatacagcgtgggacttcgggtccgtgggcggggtgctgaactctctcggaaagatggtccaccagatattcggatccgcctacacggccctgttcagcggcgtgtcctgggttatgaagatcggcataggggtcctgctgacctggatcggactaaacagcaagaacacgagtatgtccttttcgtgtatcgctatcgggatcatcaccctgtacctcggcgctgttgtgcaagccgacatggggtgcgtcattaactggaaaggaaaggagctaaagtgcggctcggggatcttcgtgacgaacgaggtacatacttggactgaacagtacaagttccaggccgacagccctaagcgcctggctaccgccatcgcaggagcgtgggagaacggggtctgcggcatccggagcacgacccgcatggagaatctcctctggaagcaaatcgccaacgagctcaactacatcttatgggagaacaacatcaagctaaccgtggtggtcggcgacatcatcggcgtgctggagcagggcaagaggaccctcacgccccagccgatggaactgaagtactcctggaagacgtgggggaaggccaagatcgtaactgccgagacccagaacagttcctttataatcgacggccccaacactcccgagtgcccaagcgcgagtcgcgcctggaatgtctgggaagtagaagactacgggttcggcgtattcaccacgaacatctggctcaagctccgggaagtctacacccagctttgcgatcaccgtctgatgagcgccgccgtgaaggacgagcgggccgtgcacgccgacatgggctattggatagagagccagaagaacgggtcctggaagctcgagaaagcctcgcttatcgaagtcaaaacctgcacctggcccaaatctcacactctgtggagcaacggcgtgctcgagtccgatatgatcatccccaagagccttgcggggcccatctcgcagcacaaccaccgcccgggctaccacacccagaccgctgggccatggcatctgggcaagctcgaactggacttcaattactgcgagggcacgacggtggtcatcacggaaaattgtgggacacggggtccctccctgagaacgaccacggtatcggggaaactcatccatgaatggtgttgccggagctgtacccttccgccgctgcgctatatcggagaggacgggtgctggtacggcatggagatccggcccatctccgagaaggaggagaacatggtcaagagcttagtctccgcgggtagcgggaaggtggataacttcaccatgggcgtgctgtgcctagcgatcctgttcgaggaggtaatgcgtgggaaattcggcaagaagcacatgatcgccggggtgttcttcactttcgtgctgctgctctccgggcagatcacctggcgggacatggcccacaccctgataatgattggtagcaacgcttccgaccgcatgggaatgggtgtcacgtacctggctctaatcgcgacctttaagatccaacccttcttagccctcgggttcttcctccggaagctgacctcaagagaaaacttgctcctcggcgtgggcctggccatggccaccacactgcagctgcccgaagacatcgagcagatggcgaacgggatcgccttaggcctgatggccctgaagttaatcacccagttcgaaacctaccagctttggaccgccttaatcagtctgacctgctccaacacgatgttcaccctcaccgtggcttggcggactgcgacgctgatactcgccggggtctccctgctgcccgtatgccagtccagctccatgcgcaagactgactggctgcccatggcagtcgccgccatgggggtgccacccctcccgttgtttatattctcactgaaggacaccctcaagcgccggtcctggcccttaaacgagggggtgatggcggtcggactggtgagcattttggcctcttctctcctacgaaacgacgtgcctatggccggacccctcgtcgccgggggcttgctgatcgcgtgctatgtgatcactggaacctccgcggacctcaccgtggagaaggccgccgacatcacctgggaggaggaggccgagcagacgggagtcagccacaacctgatgatcaccgtagacgacgacggaacaatgcggatcaaggacgacgagaccgagaacatcctgaccgtgctcctgaaaacagccctactcatcgtgagcggcgtgttcccgtacagcatccccgcaaccctgctggtgtggcatacctggcagaagcagacccagagatccggcgtcctctgggacgtcccctctcctcccgaaacgcagaaagccgaactggaggagggggtatatcggatcaagcagcagggtatcttcgggaagacgcaggtcggggtcggggtgcagaaagaaggagtcttccacacaatgtggcacgtaacccgcggcgcagtgttaacgtacaacgggaagcggctcgagcctaactgggcatctgttaagaaggacctgatatcgtacggcgggggctggcgcctgagtgcccagtggcagaagggggaggaggtccaggttatcgccgtcgagccgggcaagaaccccaagaacttccagacaatgcccggcaccttccagaccacgaccggggaaataggcgccatcgccttggacttcaagccggggacctcgggttctcccatcatcaatcgggaaggcaaggttgtgggtctgtacggcaacggggtcgtgaccaaaaacggaggctacgtgtctggaattgcacagacgaacgccgagcccgatggaccgaccccggagctggaggaggagatgttcaagaagcgcaaccttacgatcatggacctccaccccggatcgggcaagacccgaaaatacctgccggctatcgtccgggaggcgatcaaaagacgcttgcggacattaattctggctccaaccagggtggttgccgccgaaatggaggaggctctaaaggggctacccatccggtatcagaccaccgcaacgaaaagtgaacacaccggccgtgagatcgtagacctgatgtgccatgccactttcaccatgcggctgctcagccccgtgcgcgtgccgaattacaatctgatcatcatggacgaggcccacttcacggaccccgcgtcgatcgccgcccgggggtatatctcgacgcgcgtgggcatgggtgaggcagcggccatctttatgaccgcaacgccgcccgggacggccgacgccttcccgcagtccaacgcccctatccaggatgaggagagagacatccctgagcggagctggaactctggcaacgagtggatcacggatttcgccggaaagaccgtgtggttcgtgccaagcatcaaggccggtaacgatatcgctaactgcctgcgcaagaatggtaaaaaggtcatccagctatcccggaagaccttcgacacggaatatcagaagaccaagctgaacgactgggacttcgttgtgactacggacatctcggagatgggcgccaactttaaggcagaccgcgtcatcgacccgcggcgctgcctgaaacccgtcatcctcactgacggacccgaacgggtcatactggccggacccatgccggtaaccgccgcctccgccgctcagcgccgggggcgagtggggcggaacccccagaaggagaacgaccagtacatcttcaccggccagcccctgaacaacgacgaggatcatgcccactggaccgaggccaagatgcttctggacaacataaacactcccgagggaataatcccggccttgtttgagcccgagcgggaaaagtccgcggccatcgatggcgagtatagactaaagggcgagtcacgaaagacgtttgtggagctgatgcggcgcggtgatctgcccgtctggcttgcccacaaggtggcatccgagggcatcaaatacaccgaccggaagtggtgcttcgacgggcagcgcaacaaccagatactggaggaaaacatggacgttgagatctggaccaaggagggcgagaaaaagaagctgcggcccagatggctcgacgcacgcacctactccgacccgctggcgctgaaagagttcaaagactttgccgccggtcgcaaaagcatcgcgctcgacttggtgacggaaatcgggcgcgttccttcacatctggcccaccgcacccgcaatgcgctagacaacctggtgatgctgcacacgagcgaacacggcgggcgggcctaccgtcacgccgtggaggagctccccgagactatggagactctgctgctcctgggcctgatgatcctgctgacaggaggcgcaatgctgtttctaatcagcggtaaggggatagggaaaacgagcatcggcctgatctgcgtgatcgccagctccggaatgctatggatggctgagatcccactgcagtggatcgccagcgcgatcgtactagaatttttcatgatggttttgttgatccccgagcccgagaagcagcgaacaccccaagacaaccagctggcatacgtagtcatcgggattctgacgctcgccgcgatcatcgcggccaacgagatgggcctcctggagacaactaagcgcgacctcggcatgtcaaaggaacctggagtggtgagccccacctcctacttagatgtggacctgcatccggcctctgcgtggacgctctacgcagtcgccaccaccgtgataacccccatgctgcgccacacgatcgaaaattcaacagctaacgttagcttggccgcgatcgccaaccaggccgtggtgctcatgggcctggacaagggctggcccatatccaagatggacctgggcgtccccctgctggccctggggtgctatagccaggtgaacccactgaccctgacagccgcggtgctgttgctgatcacgcattacgccatcatcggccccggcctgcaagctaaggcaacgcgtgaggcccagaagcggacagcggccgggatcatgaagaacccgaccgtcgatggtatcatgaccatcgatctcgaccccgtgatctacgactccaagttcgagaaacagctgggccaggtgatgctgctcgtcctgtgcgccgtgcagctgctcctgatgagaaccagctgggccctttgcgaggcgcttacgctggccaccggccccatcactaccctgtgggaaggctcccccgggaaattctggaacaccacaatcgcggtgagcatggccaacatcttccggggctcctacttagccggtgcgggcctggccttctctatcatgaaatccgtcgggacgggcaagcgcggtaccgggagccaaggcgagaccctgggggagaaatggaagaagaagctcaaccaactgagccggaaggagttcgacctgtacaagaagtccggcatcaccgaggtggataggactgaggcaaaggaggggctcaagcggggagagatcacgcaccacgcagttagcagaggctccgcgaagctgcagtggttcgtggaacggaatatggtgatcccagaggggcgcgtgatcgacctgggatgcgggcgaggcgggtggtcctactactgcgcgggactgaagaaggtcacggaggtgcggggctacacgaagggagggcccgggcacgaggagcctgtgcccatgtccacctacggctggaacatcgtcaaacttatgagcgggaaggacgtgttttatctgcctcccgagaagtgcgacaccctcctttgcgacataggcgagtccagcccctcccccaccgtggaggagagccgcaccatccgggtgttgaagatggtggagccctggctgaagaacaaccaattctgcatcaaggtgctcaacccctacatgcccaccgtcattgagcacctggagcgcctccagcggaagcacggcgggatgctcgtgcgcaatcccctatcccggaactcgacgcacgagatgtactggatctcgaacggaaccggtaacatcgtagcgtccgtcaacatggtgtccagactgctcctgaaccggttcaccatgacacaccgccggccgacgatcgagaaggacgtcgacctgggcgccggcacccgccacgtcaacgctgagcccgaaactcccaacatggacgtgatcggagagcgcatcaagcgcatcaaggaggaacacaacagtacctggcattacgatgacgaaaacccgtacaaaacttgggcgtatcacggctcctacgaggtgaaggccaccgggagtgcctccagcatgatcaacggcgtcgtgaaacttttaaccaagccctgggatgtagtgcccatggttacacagatggccatgacggacaccacaccattcggtcagcagcgcgtcttcaaggagaaggtagacaccagaacaccgcggagcatgcccggcacgcgccgggtaatggggatcaccgccgagtggctgtggcgcacgctaggtcggaacaagaagccccgactgtgcacgagagaagagttcaccaagaaagtccggactaatgcggcaatgggcgccgtcttcacggaggagaaccagtgggattccgcaaaggccgctgtcgaggatgaggatttctggaagctggtcgaccgcgagcgggagctccacaagttagggaaatgcggcagctgcgtctacaacatgatgggtaagcgcgagaagaaacttggggagttcggcaaggccaaaggaagcagagccatctggtacatgtggctcggtgcccgctacctagagttcgaggccctgggtttcctgaacgaggaccactggttcagccgggaaaattcctacagcggcgtggagggggaaggtctgcacaagctgggctatatcctccgagacatctccaagatccccgggggcgcgatgtacgccgacgacacggccgggtgggataccagaataaccgaggacgacctgcacaacgaggaaaagatcacccagcagatggacccggagcaccgacagcttgccaacgcgattttcaagctaacgtaccagaacaaggtcgtgaaggtccagcgacccaccccgaccggcacagtcatggacataatcagccgcaaggaccagcggggctccggtcaagtgggaacgtatgggctgaacacgttcaccaacatggaggcgcagctaatccgccaaatggaaggcgagggtgtcctcagcaaggccgatctggagaacccccacctacctgagaagaagattacccaatggctggaaaccaaaggcgtcgagcggctaaagcgcatggcgatctccggcgacgactgcgtggtgaaacctatcgacgaccgtttcgccaacgccttactcgcgctgaatgacatggggaaggtgcgtaaggacatccctcagtggcagcccagcaaaggatggcacgactggcagcaagttccgttctgctcccaccacttccacgaactgatcatgaaggacgggcggaagctcgtcgtcccctgccgcccgcaggatgaactaattgggcgcgcccggatcagccagggagccggctggtcccttcgcgagacggcttgcctcggcaaggcgtacgcacaaatgtggagccttatgtacttccaccgacgggacctgcggctggcctctaacgccatatgcagcgccgtgcccgttcactgggtcccgacctcccgcacaacctggagtatacacgctcatcaccagtggatgacgaccgaggacatgctgaccgtttggaaccgagtgtggatagaggacaacccctggatggaggataagacccccgttaccacttgggagaatgtgccctatctggggaagcgtgaggatcagtggtgcggcagcctaatcgggctaacttcccgggccacctgggcccagaacatcccgactgctattcaacaggttcgcagcctgattggcaacgaggagttcctcgactacatgccctccatgaaacggttccgcaaagaggaggagagcgagggggccatttggtga

SEQ ID NO: 25638 - RNA, 9873 nt, synthetic construct
  misc_feature 1..9873: note = derived and/or modified CDS sequence (opt11) from DENV-3__JX669504__SS-prME
  source 1..9873: mol_type = other RNA
accagcctttgcctcatgatgatcctccccgccgccctggcgttccacttaacgagccgggacggggaaccgagaatgatcgtagggaaaaatgagcgcggcaagagcctgctgttcaagaccgcttccgggaccaatatgtgcaccttaatcgccatggacctgggagagatgtgtgacgatacggtgacatacaagtgcccccatattactgaggtggagcccgaggacattgactgctggtgcaacctcaccagcacatgggtgacgtacgggacgtgtaaccaggccggcgagcgccgccgcgacaagcgctccgtggccctagcgccccacgttggcatggggctggacacgcggacccagacgtggatgagcgcggagggcgcctggcgccaggtggagaaagtcgagacctgggctctgaggcaccccgggttcaccatcctcgcgctgttccttgcccattatatcggaacctccctcacgcaaaaggtagtgatcttcatcctgctgatgctagtgaccccaagcatgaccatgcgctgcgtcggggtgggcaacagggacttcgtcgaaggtctgagcggggctacgtgggttgacgtggtgctcgagcacggcgggtgtgtgacaaccatggcgaagaacaagcccactctcgacatcgagttgcagaagaccgaggccacgcagctagccaccctgcgcaaactgtgtatcgaggggaagatcactaacataaccacggatagccggtgcccgactcagggcgaagccgtgctgccagaggagcaggatcagaactacgtctgcaaacatacctacgtggaccgtgggtggggcaacgggtgcgggctcttcggtaagggcagtctggtgacctgcgccaagttccagtgtttggaacccatcgagggcaaggtcgtgcagtacgagaacctcaagtacacggtaatcattacggtccataccggggaccaacaccaggtagggaacgagacccagggggtcacggccgagataacgcctcaagcaagcaccaccgaggccatcctgcccgaatacggcaccctgggactcgagtgtagcccgcggacgggactggacttcaacgaaatgatcctgttgactatgaagaataaggcctggatggtgcaccgccagtggttctttgacctgcccctgccgtggacctctggcgcaaccacggagacccccacctggaaccgaaaagagctcctggtgacattcaagaacgcccacgcaaagaagcaagaagtagtggtgttagggagtcaggagggcgcgatgcacacggccctcacaggtgccactgagatccagaactctggtggcacctccatctttgccgggcaccttaagtgccgtctcaagatggacaagctagagcttaagggcatgagctacgctatgtgtacaaacaccttcgtgctgaagaaggaggtatcggagacccaacacgggaccatcttaatcaaggttgagtaccggggcgaggacgcgccgtgcaagatccccttcagcacggaggacgggcaggggaaggcccataatggccgcttgatcaccgccaaccccgtcgtgaccaagaaggaggaaccagtgaacatcgaggcggaaccacccttcggggaatcaaacattgtcataggcatcggggacaacgcgcttaagatcaattggtacaagaaaggatcaagcatcgggaaaatgtttgaggcgacggcccggggggcccgccgcatggcaatcctgggcgacaccgcgtgggactttgggtccgttggcggggtgttgaatagcctgggcaagatggtccaccagatcttcgggtccgcctacaccgccctcttcagcggcgtgtcctgggtgatgaagattggaatcggggtcctccttacctggataggcctgaactcaaaaaataccagcatgagcttctcctgcattgccatcgggatcattacgttatacctgggcgccgtagtacaagcggacatggggtgcgtcataaactggaagggcaaggagctcaaatgcggcagcggcatcttcgtgacgaacgaagtgcatacctggaccgagcagtacaagttccaggcagactccccaaagcggctcgcaactgcaatcgccggcgcatgggagaacggggtttgcgggataagaagcaccacccggatggaaaacctattgtggaaacagatagccaacgagttaaactacatcttgtgggaaaacaacatcaagctgaccgtagtagttggggacatcatcggcgtgttagaacaaggcaagcggacgctgacgccccagccgatggagttaaagtactcctggaagacgtggggcaaggctaagatcgtgacagccgaaacgcagaacagctcctttatcatagacggcccgaacactcctgaatgcccgagcgcttcccgggcctggaacgtctgggaagtggaggactacggtttcggcgtgttcaccaccaacatctggctcaagctgcgtgaggtctacacccagctgtgcgaccaccgattgatgagcgcggcggtgaaggacgaacgcgccgttcatgccgacatgggttattggatagagtctcagaagaatgggtcctggaagctggagaaagcatctctgatcgaggtgaaaacgtgcacctggccaaaatcccacaccctctggagcaacggtgtgctggaatccgacatgatcatacccaagtccctagccggtccgatctcccaacacaatcaccgtccgggataccacacccagacggccgggccctggcacctaggcaagctggagttagactttaattactgcgaaggcacgaccgttgttatcaccgagaactgtggaacgcgagggcccagtctccggacaacgaccgtgtccggaaaactgatccacgagtggtgctgccgcagttgtaccctgccccccctccgatacatgggcgaggacgggtgctggtatggcatggaaatccgccccatctccgagaaggaggagaatatggtcaagtcgctggtatctgccggcagcggcaaggtggacaattttaccatgggcgtgctgtgcctcgcgatcctgttcgaggaagtcatgcggggaaaattcggcaagaagcacatgatcgccggggtgttcttcacactggtgcttctgctgtccgggcagatcacctggcgggacatggctcacactctcatcatgattggatctaacgcctcggaccggatggggatgggggtcacctacctggcattaatcgcgactttcaagatacagcccttcctcgcccttggtttttttctgaggaagttaaccagccgggagaacctgctgctcggcgttggcctggccatggccacgaccctgcagctccccgaggatatcgaacagatggcgaacgggatagccctgggcctaatggcactcaagctgatcacccagtttgagacgtatcagctgtggactgccctaatcagcctgacctgttccaacaccatgttcactctcacggtggcatggcgcactgcgaccctcatcctggccggagtcagcctgctcccagtgtgccagtcctcgtccatgcgcaagactgattggctgcccatggccgttgccgccatgggtgttccaccgctgcctctgttcatcttctccctgaaggacacgctgaagcgaagatcctggccactcaacgagggagtgatggcggtcggcctggtgtctatcctggcaagtagcttactgcggaacgacgtgcctatggctggccccttagtcgccggaggccttctgatcgcttgctacgtcattaccgggacctccgcagaccttacggtggagaaagccgccgacatcacgtgggaagaggaggccgagcagaccggcgtcagccacaacctcatgattaccgtagacgatgacgggaccatgcgcatcaaagacgacgagaccgagaacatcctgacggtgctgctcaagaccgccctgctgatcgtctccggggtgtttccctacagcatccccgcgaccttactggtgtggcacacctggcagaagcagacgcagcggtccggtgtgctgtgggacgtaccttcaccgcccgagacacagaaggccgagctcgaggagggggtgtaccgtataaaacagcagggcatcttcgggaagacccaggtcggcgtgggcgtgcagaaggagggcgtcttccacaccatgtggcatgttacccgaggcgccgtcctgacatacaacggaaaacgcctggagcccaactgggcctccgtcaagaaggacttaatcagctacggcgggggttggcgcttatccgcgcagtggcagaaaggtgaggaggtccaagtgatagcagtggaaccaggcaaaaacccaaagaactttcagaccatgcccgggaccttccaaacgaccactggggaaatcggcgccatagctctcgactttaaacctggcaccagcgggagccccatcataaatcgagagggaaaggttgtgggtctgtacggcaacggggtcgtgacgaaaaacggcggatacgtgagcggcattgcccagaccaacgcggagccggacggaccgacccccgagctcgaagaggagatgttcaagaagaggaacctgaccatcatggatctgcatcccgggagcggcaaaactcgcaagtacctcccggcgatcgtccgggaggccatcaagcgccgtctgcgcaccctgatcctcgcgcccacccgcgtggtcgcggcggaaatggaagaggcgctcaaggggcttccgatccgctaccagaccacggccaccaagtcagagcataccggacgcgagatagtggacctcatgtgccacgccacattcacgatgaggttgctgtcgccagtgcgggtgccgaactataacctcatcattatggatgaagcgcacttcaccgacccggcgtccattgccgcgcgtgggtacatcagcacccgggtcggaatgggcgaagccgcagccatattcatgacagccacgccgcccggaaccgccgacgccttcccccagtccaacgcgcccatccaggacgaagagcgggacatccccgagcgtagctggaacagcggcaatgagtggatcactgacttcgccgggaagactgtgtggttcgtgccgagcatcaaggctggcaacgatatcgccaactgcctgcggaaaaacgggaagaaggtcatacagttgtctcgcaagacgttcgatacagagtaccagaagaccaagctgaacgactgggacttcgtggtgacaacggacatctccgaaatgggcgccaactttaaagctgaccgggtaatcgacccgcgccgttgtctgaaaccggtgatcctgaccgacggccccgagcgcgtgattctcgccgggcccatgccggtcaccgcagcttcggcagctcagaggcgcggacgagtggggcgcaatccccagaaggagaacgaccaatatatcttcaccggccagccactgaataatgacgaggaccacgcccactggaccgaagccaagatgctgctcgacaatataaacactccggaagggattatcccggccctgttcgagcccgagcgagagaagtccgcagccatcgatggcgaataccgactgaagggagagtcccggaaaaccttcgtggagctcatgcgccgaggagatctgcctgtctggctggcccacaaggtggccagcgagggcattaaatacacagaccgaaagtggtgcttcgacggacagcggaacaaccaaatacttgaggagaacatggacgtagagatatggacgaaggaaggcgagaagaagaagctgcgcccccgctggctggacgcacgtacgtattccgatccgctcgcgctgaaggagttcaaggactttgcggccggccgcaagagcattgctctggacctcgtgaccgaaatcgggagggtgccgtcccatctggcccaccgcacccgcaacgcgctggacaacttggtcatgctgcacacctccgagcacggtggccgcgcctacagacatgcagtggaagagctgccggaaacgatggagacccttctgctactcggacttatgatcctactcaccgggggcgccatgctgtttctcattagcgggaaggggatcggcaagacctccataggtttgatctgcgtcatcgcgagctcaggcatgctatggatggcggagatcccgctccagtggatcgcctcggccatcgtcctcgaatttttcatgatggtgctcctaatcccggagcccgagaaacagcgaaccccccaggacaatcagctcgcctacgtagtcatcgggatattgacactggccgcgatcatagccgcaaacgagatggggctcctcgagaccaccaagcgggacctgggcatgagtaaggagccgggggttgtgagccctacatcctacctcgacgtggacctgcatccggccagcgcgtggaccctctacgccgtggcaaccaccgtaatcacgccaatgctccgccacaccatcgaaaacagtaccgccaacgtctccctggcggctatcgccaaccaggccgtggtcctgatgggcctggacaaggggtggccgatctccaagatggacctgggagttcccctcctggccctagggtgctactctcaggtgaacccactgaccctcacggccgcggtgttactgctcataacccactatgccatcatcggccccggcctgcaggccaaggccaccagagaagcgcagaagcgcaccgcggccgggatcatgaaaaacccgaccgtcgacgggatcatgacgatcgacctggaccccgtgatctacgattccaagttcgagaaacagctcggccaagtaatgctactggtcctctgcgccgtgcagctgctgctgatgcgaaccagctgggccctgtgcgaagcgctgactctcgccactgggcccatcaccaccctctgggaaggatcccccggcaagttttggaacaccacgatagccgttagcatggccaatatattcaggggctcctatctcgcaggggccggcttggcgttctccatcatgaagtccgttgggaccggcaagagaggcaccgggtcccagggcgagacgctgggcgagaagtggaagaagaaacttaaccaactcagcaggaaggagttcgacctgtacaaaaagtctggcatcaccgaggtcgatcggacagaggcaaaggagggattgaagcgcggagagatcacccaccacgctgttagccggggctccgcaaagctccagtggtttgtagagcgcaacatggtgatccccgagggtcgggtgatcgatctaggttgtgggcgcggcgggtggagctactactgcgcaggactgaagaaagtcacggaggtgcgcggctacaccaagggcgggcctggccacgaagagcctgttccgatgagtacgtatggctggaatatcgtcaagctcatgagcggtaaggacgtgttctacctgccgcccgagaagtgcgacacattgctatgcgacatcggcgagagtagcccgtcccctactgtcgaggagagcagaaccatccgagtcttaaagatggttgagccgtggctcaagaacaatcagttttgcataaaggtgttaaatccgtacatgcccacggtcatcgaacacttagagcggctacagcgaaagcacggcggtatgctggtgcggaaccccctctcaagaaacagcacccacgagatgtactggatctccaacggcaccgggaacatcgtggcgtcagtgaacaccgtgagtcggttgctgttgaaccgattcacgatgactcaccggcggccgaccaccgaaaaagatgttgaccttggcgccggcacgcgccacgtcaatgccgaaccagagacccccaacatggacgtgatcggggagcgcattaagcggatcaaggaggagcacaatagcacctggcactacgatgatgagaacccttataagacctgggcctaccacggctcctatgaggtgaaggcgacgggcagtgcctcgtccatgatcaacggcgtcgttaagttgctcactaaaccctgggacgtcgtgccgatggtcacccagatggccatgaccgacacgaccccctttgggcaacagcgtgtgttcaaggagaaggtggacacccgcaccccgcgcagcatgccaggcacgcgtcgcgtgatgggcatcaccgccgagtggctttggcggaccctggggcgaaacaagaagccgcgcttgtgcacgcgggaggagttcacaaagaaggtccgcacaaatgcggcgatgggcgcagtattcaccgaagagaaccaatgggactccgccaaggcggctgtggaggacgaggacttctggaagctggtggaccgggagcgcgagttacacaagcttggtaagtgcggcagctgcgtgtacaacatgatggggaagcgggaaaagaagctgggcgagttcgggaaggccaaaggatcccgcgctatctggtacatgtggctgggagccagatacctcgagttcgaggctctgggcttcctgaacgaggaccactggttcagccgcgagaactcctactcgggagtagagggtgagggccttcacaagctaggatacatcctgagggacatatccaaaatccccgggggcgcaatgtacgcggatgacacggccgggtgggacacgcgcatcaccgaggacgacctccacaatgaggagaagatcacccagcagatggatccggagcaccggcaactggcgaacgccatcttcaagctgacctaccaaaataaggtggtaaaggtccagcgccctacacccactggcacggtcatggacataatcagccggaaggaccagcgcggctccggccaggtgggcacctacgggctgaacacattcacgaacatggaggcccagctgatccggcagatggagggggagggggttctcagcaaagccgacctcgaaaacccccaccttcccgagaagaagatcacacagtggctggagactaaaggagtagagcgcctcaagcggatggccatcagcggggacgactgcgtagtgaagcccatcgatgaccgcttcgcaaacgccttgcttgcactgaatgatatgggcaaggtacggaaggacataccccagtggcagccaagcaaaggatggcacgactggcagcaggtcccattctgttcccaccacttccacgagctgatcatgaaggacgggagaaagctggttgtcccctgccggccgcaggacgagctcatcggccgggcccgcatctcccagggggcaggttggtcccttcgggagactgcctgtttgggaaaggcgtacgcacagatgtggagcctcatgtacttccaccgccgggacctgcgcctagcctcgaacgccatctgtagcgctgtgcccgtgcactgggtcccgacctccaggaccacctggtcaatccacgcgcaccaccagtggatgactaccgaagacatgctaaccgtgtggaaccgggtgtggatcgaggacaacccctggatggaggacaaaacccccgtgactacgtgggagaacgttccttacttggggaagcgggaggaccagtggtgcggctccttgattgggctcaccagccgcgcaacctgggcccagaacattcctaccgctatccagcaggtgagatcactgatcggaaacgaggagttcctggattacatgccctccatgaagcggttcagaaaggaggaagaatcggagggggccatatggtga

SEQ ID NO: 25639 - RNA, 9873 nt, synthetic construct
  misc_feature 1..9873: note = derived and/or modified CDS sequence (opt11) from DENV-3__JX669506__SS-prME
  source 1..9873: mol_type = other RNA
accagtttctgcctgatgatgatcctccctgccgccctggcattccacctgacctcgcgggacggggaaccgcgcatgatcgtggggaaaaacgagcgcggaaagagcttactgttcaaaaccgcctccgggattaacatgtgcacgctgatcgccatggatttaggggagatgtgcgacgatactgtcacgtacaagtgcccccacataaccgaggtggagcccgaggacatcgactgttggtgtaacctgacctcaacctgggtaacgtacgggacttgcaaccaggccggagagcggcgccgagacaagcggtccgtggccctggcgccgcacgtcggcatgggactcgacacaagaacccagacctggatgtcggccgaaggcgcctggcgccaggtagagaaagtggagacctgggcactacgccaccctggtttcaccatcctcgccctctttctggcacactacataggcacctcactaacccagaaggtggtgatattcatcctcttaatgctggtaacgcccagcatgactatgcggtgcgtgggtgtgggcaaccgggacttcgtcgaggggctatccggggccacttgggtggacgtggtgttggagcacggcgggtgcgttaccactatggccaagaacaagccaaccctagacatagagctccagaaaaccgaggccacccaattggcgacgctgaggaaactatgcatcgaaggcaagatcaccaacatcaccaccgatagtagatgtccaacgcaaggcgaggccgtgctgccggaggagcaggaccagaactacgtctgtaagcacacctacgttgatcgtggctggggtaacgggtgtggcctgttcgggaagggctccctagtgacttgcgccaagttccagtgcctggaacccatagaaggcaaggttgttcagtacgagaaccttaaatacaccgttataattacggtccacaccggggatcaacaccaggtgggcaacgagacccaaggggtcaccgcagaaatcacaccccaggcatcaacaacagaggcgatcctccccgagtacggtacgcttggactagagtgctcccctcggaccggcctggatttcaacgagatgatccttctgacaatgaagaacaaggcctggatggtgcatagacagtggttctttgaccttcccctgccctggaccagcggcgctaccaccgagacgcccacctggaaccgaaaggagctgctcgtgacattcaagaacgcgcatgccaagaaacaggaggtcgttgtactggggtcccaggagggcgcgatgcataccgcccttacgggggccacagagatccagaactccggagggaccagcatcttcgctggccacttaaagtgccgactgaagatggacaagctggagcttaaggggatgagctatgcaatgtgtaccaacacgttcgtgctgaagaaggaagtgagcgagacccagcacggtactatcttaatcaaggtggagtacaagggcgaggatgcgccgtgtaagataccattctcgacggaggacgggcagggcaaggcttacaacgggcggttgatcacggccaacccggtcgttaccaagaaagaggagccggtcaatatcgaggctgagccacccttcggtgaaagcaacattgtcatcggcattggtgataacgcgctgaagatcaactggtataagaagggctccagcatcgggaaaatgtttgaggctaccgccagaggcgcaaggcggatggccattctaggcgacaccgcgtgggacttcgggtccgtgggcggtgtactgaactcactcgggaagatggtgcaccagatctttggatccgcctacacggcacttttctccggcgtctcctgggtgatgaagataggcatcggggtgctgctcacctggatcggcttgaactccaagaacacctctatgagcttcagttgcatcgccatagggatcataaccctgtacttgggtgctgtggtccaggccgatatggggtgcgtcattaactggaagggcaaagagttaaagtgcggcagcgggatttttgttacgaacgaggtacacacctggaccgaacagtacaagtttcaggcagactcccccaagcgactagctaccgccatcgccggcgcgtgggagaacggggtctgcggaatccgtagcacgacccgcatggagaacctgctctggaagcagatcgccaacgaactgaactacatcttgtgggagaacaacatcaagctcacggtggttgtcggtgacatcataggcgtgctcgagcagggcaaacgtaccctaacaccccaacctatggagctgaaatactcctggaagacctggggcaaggccaaaatcgttacagcagagacccaaaatagctcctttataatcgatggccccaacacgccagaatgcccctcagcgtcccgagcctggaacgtctgggaagtagaggattacgggtttggagtgttcacaactaatatctggctgaagctacgggaggtctacactcagctgtgcgaccaccggcttatgagtgctgccgtgaaggacgagagggctgtccacgcggatatgggctactggattgaaagccagaaaaatggtagctggaagctggagaaagccagcctgatcgaggtaaagacctgtacatggccgaagtcccacacactatggagcaatggagttctcgaatccgacatgattatccccaagtcattggccgggccgatcagtcagcacaaccaccgcccggggtaccacacgcagacggccggaccctggcacctgggcaagctcgagctggacttcaactattgtgaaggcactaccgtggttataaccgagaactgcgggactcggggaccgtctctgcgcacgaccacagtttccggaaaactcatacacgagtggtgctgcagaagttgcaccctgcccccgctacgctatatgggcgaggacggttgctggtacggcatggaaatccggcctatatccgagaaggaggagaacatggtcaagtcgttagtttcagccggcagtgggaaggttgacaacttcacgatgggcgtgctgtgcctcgctatactcttcgaagaagtcatgcgagggaagttcggcaagaaacacatgatcgccggcgttttcttcacgttcgtcttgctgctcagtggccagatcacctggcgggacatggcccacaccctgatcatgattgggagcaacgcctccgacaggatgggaatgggtgtcacgtacctggcccttatcgcgaccttcaaaattcagccttttctggccctggggttcttcttacgcaagctgaccagccgagagaacctgctccttggggtgggccttgctatggcaaccacgctccagctgcccgaggacatcgagcagatggcgaatgggatcgccctgggcctcatggccctgaagctgatcacacagtttgagacataccagctctggaccgccctaatatccctaacgtgctccaacaccatgtttaccctcaccgtagcatggcgaacggctaccttaatcctggccggagttagcctcctgccggtatgtcagtctagctccatgcggaagaccgactggctcccaatggccgtcgccgctatgggtgtaccgcccctcccgttattcattttctcactcaaggacacgctcaagcgtcggtcctggcccctcaatgaaggtgtgatggcagtcggccttgtgagcattctcgcctccagcctgttgcgcaatgacgtccccatggccggccctttagtcgcagggggcctgctgatcgcttgctacgtgatcaccgggacctccgcggacctcacagtggagaaggccgctgacatcacttgggaggaggaggccgaacagacgggtgtctctcacaacctgatgatcaccgttgacgacgacgggacaatgcggatcaaggacgacgagaccgagaacatcctcactgtgcttctgaagacggctctgctcatcgtctccggggtattcccatacagcatcccagctaccctgctggtgtggcacacctggcagaaacaaacccaaagatctggcgtactctgggacgttcccagtccgccagagacacagaaggcggagctggaggagggggtctaccggattaaacagcagggcatttttgggaagacgcaggtcggggttggagtgcagaaggagggtgtattccataccatgtggcacgtgactaggggtgcagtgcttacgtacaacgggaaacggctcgagcccaactgggcgtccgtaaagaaggacctgattagttatggcgggggatggcgcctgtcggcgcaatggcagaagggggaggaggtccaggtaatcgccgttgagcccggcaaaaatcccaagaacttccaaaccatgcccggaacctttcagacaaccaccggggagattggcgcgatcgccctcgatttcaagcccgggaccagcgggagccccattatcaatcgggagggcaaggttgtggggctatatggcaacggagtcgtgaccaagaacggcgggtacgtatctggaatcgctcagacgaatgcggagccggacggcccaacacccgagctggaggaggagatgttcaagaaaagaaatctgactatcatggacttgcaccccgggagcggtaagacgcggaagtacctgccagccatcgtgcgtgaggccatcaagcggcgcctgcggacgctcatcctggcccctacgcgcgtggtggccgcggagatggaggaagctctgaaggggttgcccattcgttatcagactaccgccacgaagtccgagcacaccggcagggagatcgtggacctgatgtgccacgccaccttcaccatgcgtctgctctcgcccgtgcgcgtacctaactacaacctgatcattatggacgaggcccatttcacggaccccgcctccatcgccgcgaggggttacatcagcacaagagtcggaatgggcgaggcagcggcgatcttcatgaccgccaccccacccggtacggccgatgccttcccacaatccaacgctcctatccaggacgaggaacgcgacatccctgaacggagctggaactcaggcaatgaatggataaccgacttcgccgggaagaccgtgtggtttgtgccctctatcaaagctggcaacgatatcgccaactgcttgagaaagaatgggaagaaggtcattcagttgagccggaaaaccttcgacacggaatatcagaagacgaagctaaacgattgggacttcgtcgttaccacggacatatcggagatgggcgccaacttcaaggcagaccgtgtaatcgacccgcgacgctgtctgaagccggtcatcttgactgacggtcctgaaagggtgatcttagccggtcccatgccggtcaccgccgcctccgccgcgcagcgccgggggagagtgggacggaacccccagaaggaaaacgaccaatacatcttcaccggacagcccctaaacaacgacgaggaccacgcccattggaccgaggccaagatgttgctggacaacatcaacacccccgagggaataatccctgcgctattcgagcccgagcgagagaagtccgcggccatagacggagagtatcggttgaagggtgagtcccgcaagacattcgtagagctgatgaggcgcggcgacctgccagtgtggctcgcccacaaagtggccagcgaaggcatcaagtacaccgatcggaagtggtgcttcgacggccaacgcaataaccagatcctggaggaaaatatggatgtagagatctggacgaaggagggcgagaagaagaagctgagaccccgctggcttgacgcccgcacctactccgacccgctggcgttgaaagagttcaaagacttcgctgctggcaggaagtcgatcgccctcgatcttgtcactgagatcgggcgcgtgccctcccatctggcccaccggacccgcaacgccctggacaatctcgtaatgctccacaccagcgagcacggcggccgggcatatcggcatgccgtggaggagctccccgaaaccatggaaacgctgctgttactgggcctgatgatactcctgaccgggggagcaatgctctttctcatcagtggtaaagggatcggcaagacctccatcgggctcatctgcgtgatcgcctcgtccggcatgttgtggatggcggagattccgctccagtggatcgccagcgctatagtcctggagttctttatgatggttctactgatccccgaacccgagaagcaacggacgccccaggacaaccagttagcctacgtggttattggcatcctgacgctcgcggcgatcattgccgcgaacgagatgggactgctggagaccaccaagcgcgaccttgggatgtccaaggagccgggggtggtgagtcccacctcctacctggacgtcgacttacatcccgcaagtgcgtggacgctctatgccgtcgccactacggtgataaccccgatgctgcggcacacgatcgagaactctactgccaacgtcagcttggccgcaatcgccaaccaggcggtggtcttaatgggtctcgacaaggggtggccaatctccaaaatggacctgggagttcccctcctggccctagggtgctatagccaggtgaatccactcacactgacagccgcggtgttgctcctcatcacgcactatgccatcatcggcccaggcctgcaggccaaggcaacgagggaggcccagaagcgaaccgcggctgggatcatgaagaaccctaccgtagacggcatcatgacgatcgacctcgatcccgtcatttacgacagtaaattcgagaagcagctgggacaggtgatgctgctagtactgtgcgcggtgcaactactcctgatgcgcaccagctgggccctatgcgaggcgctcactctggccacgggaccgataacgacactgtgggagggctcccccgggaagttctggaatacaaccattgccgtcagcatggccaacatattccggggctcctaccttgctggggcggggttggcctttagcattatgaagtccgttggtacggggaagcgcggaaccgggtcgcagggcgagactttgggggagaaatggaaaaagaagctcaatcagctaagccgtaaagagtttgacttatacaaaaagtctggcatcacggaggtcgaccgcacggaggcgaaggaagggctcaagcggggtgaaatcacgcaccacgccgttagccgcggcagtgctaaacttcagtggttcgtagagagaaatatggtgatccctgaggggcgcgtgatcgacctgggctgcgggcggggcggctggtcgtactactgcgcgggcctgaagaaggtcaccgaggtgcgcggctataccaagggagggccggggcacgaggagcccgtcccaatgtccacctacggatggaatatcgtcaagctgatgagcggcaaggatgtgttctacctccctccagagaaatgcgacacgttgctgtgcgacatcggcgagtccagtccctcgcccacggtcgaggagtccaggacaatcagagtccttaagatggtggaaccgtggctcaagaacaaccagttctgcatcaaggtcttaaacccctacatgccaacggtaatcgaacacctagagaggctgcagaggaagcacggcgggatgttggtgcgcaatcccttatcaagaaattccacccacgagatgtattggatatccaacggcacggggaacattgttgccagtgtcaacatggtatcccgcctgctcctaaaccgattcaccatgacacaccgacgtccgacgatcgagaaggacgtggacctgggcgccgggacacgccatgtaaacgccgagcccgagacacccaatatggacgtgattggagaacggattaagcgcataaaagaggagcacaatagcacctggcactacgacgacgagaacccgtacaagacatgggcctaccacggaagttacgaggttaaggcgaccggtagcgcctccagcatgattaacggcgtagtaaagttgctgacgaaaccctgggacgtagtgcccatggttactcagatggcgatgaccgacaccacccccttcgggcagcagcgggtctttaaagaaaaggtggacactcgcacgccgcgtagcatgcccggcacgcggcgggtcatgggtatcaccgccgagtggctgtggagaactctaggtcggaacaaaaagccacgcctgtgcacgcgcgaggagtttaccaaaaaggtgcggaccaacgcggcaatgggggcggtgttcactgaagagaaccagtgggactccgccaaggccgcggtagaggatgaagatttctggaagctggtagaccgtgagcgcgagctccacaagctggggaagtgcggctcttgcgtgtacaacatgatggggaagcgcgagaagaagctcggcgagttcggtaaggccaaagggtcacgggctatctggtacatgtggctcggcgctcgttacctggagtttgaggcccttgggttcctcaacgaggaccactggttcagccgggaaaattcctatagcggcgttgagggggagggcctgcacaagctgggctacatcctccgggacatatccaagatccctgggggagctatgtacgccgacgacacagccgggtgggacacacggatcaccgaagacgaccttcacaatgaggaaaagataacccagcaaatggaccctgagcatcgacagcttgccaacgctatattcaaactcacgtaccagaacaaggtcgtgaaggtgcagcggcccactcccaccggcaccgttatggatatcatctcccgcaaagaccaacgggggtccggccaggtgggaacatacggtttaaacacgttcactaacatggaggcccagttaatccgtcagatggaaggcgagggggtactatcgaaagcggacctggagaacccacatctgccggagaagaagatcacccaatggctggaaaccaagggcgtagagcgtctaaagcgtatggccatctctggcgacgactgcgtagtcaagcccattgacgatcggttcgctaacgccctcctcgctctgaatgatatgggaaaggtccgtaaggacatcccccaatggcagccctctaagggctggcatgactggcagcaggtcccattctgctcccaccattttcatgagttgatcatgaaggacgggcggaaattagtcgtcccctgcagaccacaggatgagctgatcgggcgggcacgcataagccaaggcgccgggtggtccctgcgcgaaacggcctgcttaggcaaggcgtacgcccagatgtggagcctgatgtatttccataggagggacctgcggctcgccagcaacgccatatgcagcgccgtgcctgtgcactgggttcctacctcccgcaccacctggagcattcacgcacaccaccagtggatgactaccgaggacatgctaacggtgtggaaccgggtgtggatcgaagacaacccctggatggaggacaagacccccgtaacgacctgggagaacgtgccctacctggggaaacgcgaagaccagtggtgcggctcattgatcgggctgacttcaagggctacctgggcccagaatataccgacggcaatccagcaggttcgctcactgatcggcaacgaggagttcctggattatatgccctccatgaagcggtttcgcaaggaagaggagagcgaaggggcaatctggtga

SEQ ID NO: 25640 - RNA, 9873 nt, synthetic construct
  misc_feature 1..9873: note = derived and/or modified CDS sequence (opt11) from DENV-3__JX669496__SS-prME
  source 1..9873: mol_type = other RNA
acgtcactgtgcctcatgatgatccttccggccgccttggcgttccacctgaccagccgggacggcgagccgagaatgatcgtggggaagaacgagcgcggcaagagcctgctgttcaagaccgcatccgggaccaacatgtgcactctcatcgctatggaccttggggagatgtgcgacgacacagtgacctacaagtgcccacatatcaccgaggtggagccagaggacatcgactgctggtgcaacctgacgagcacctgggtgacctacgggacctgcaatcaggccggcgagaggaggcgggataaacgctcggtggccctagcgccccacgtcggcatggggctggatacccggacccagacttggatgtcagccgagggcgcctggcgccaagtggaaaaggtggagacctgggccctgcggcacccggggttcaccatcctcgcgctgttcctcgcccactacatcggaacctccctcacgcagaaggtggtgatcttcattctgttgatgctcgtgaccccctctatgaccatgcgctgcgtaggggtgggtaatcgagatttcgtcgaaggcctctccggggccacttgggtggatgtggtgctagagcacggcgggtgcgtgacgaccatggctaagaacaaacccaccctcgacatcgaactgcaaaagacagaggccacacagttggcgaccctccgcaagctgtgcatagagggcaagattactaatataaccacggacagccggtgccctacccagggcgaggctgtgctgcctgaggagcaggaccagaattacgtttgcaagcacacctacgtggaccgcgggtggggcaatggttgtggcctcttcgggaagggatctctggtgacctgcgccaagttccaatgcctggaacccatcgaaggcaaagtcgtgcagtacgagaacctcaagtacacggtcataatcaccgtacacacgggggatcagcaccaggtgggtaacgagacccagggggtgacggctgagatcacgccccaggccagcacaaccgaggcgatcctccccgagtacggcaccctgggactcgagtgttccccgcgtacgggcctggacttcaacgaaatgatccttctcaccatgaaaaacaaggcgtggatggtacaccgccagtggttcttcgaccttcccctaccctggaccagcggcgccacgactgagacccccacctggaaccggaaggagctattagtgacctttaagaacgcccacgccaagaagcaggaggtcgtggtcctgggctcccaggagggcgcgatgcacacggccctcacgggagcgaccgagatccagaacagcggcggaacctccatcttcgccggccacctgaaatgccgcctgaagatggacaagctcgagctcaagggcatgagctacgctatgtgcgcgaacactttcgtcttaaagaaggaggtgtccgagacccagcacggaaccatcctcataaaggtggagtacaggggtgaggacgccccatgcaagattccgttcagcaccgaggacgggcagggcaaggcccacaatggccgcctgattacggccaaccccgtcgtgaccaagaaggaggagcctgtgaatatcgaagcggagccgcctttcggggagagcaacatcgtcatcggcatcggggacaacgccctgaagatcaactggtacaagaaaggctcctccatagggaagatgttcgaagcgaccgctcggggcgcccgacgcatggcgatcctgggcgataccgcctgggacttcgggtccgtgggcggagtgctcaactctctgggcaagatggtccaccagatcttcggctccgcgtacacggcgctgttcagcggcgtgtcctgggtgatgaagatcggaatcggggtactcctgacttggatcggcctgaactcaaaaaacaccagcatgagcttcagctgcatcgccatcgggatcatcaccctctacctgggcgcggtcgtgcaggccgacatgggttgtgtcattaactggaagggcaaggagctgaagtgcggcagcgggattttcgtgacgaacgaggtgcacacctggactgagcagtataagtttcaggccgactcccccaagcggctcgccaccgccatcgcgggtgcgtgggagaacggggtctgcggcatccgaagcacgacccggatggagaacctgctgtggaagcagatcgccaacgagctcaactacatcttatgggagaataacatcaagttgaccgtagtagtgggggatataataggcgttcttgagcaaggcaaacgcaccctaacgccacagccgatggagctgaagtactcgtggaagacctgggggaaggccaagatcgtgaccgcagagacacagaatagcagtttcattatcgacggcccaaacacgcccgagtgcccctcggcctcccgggcctggaacgtctgggaggtggaagattacgggttcggagtgttcaccacaaacatctggctcaaactgcgcgaggtctacacccagctgtgcgaccatcggctcatgagcgctgccgtgaaggacgaaagagcagtacacgcagacatgggctactggattgagagccaaaagaacggctcctggaagctcgagaaagcctctctgatcgaggtaaagacgtgcacgtggcccaagtcccacacgctctggtcgaacggagtgctggagtccgacatgattatccccaagtcactggccgggcccatctcccagcacaaccaccggccgggctaccacacgcagaccgccgggccctggcacctaggcaagctggagctggacttcaactactgcgagggaactaccgtggtcatcaccgagaactgcgggactcgcggccccagcctccggacaaccaccgtgtccgggaagctgatccacgagtggtgctgccgcagctgcaccctccccccgctccggtacatgggcgaggacgggtgctggtacggcatggagatccgccccatatccgagaaggaggagaatatggtaaagagcctggtctccgcgggaagcgggaaggtagacaacttcacgatgggcgtgctgtgcctcgccatcctgtttgaggaagtcatgcgggggaagttcgggaagaagcacatgatagctggcgtgctgttcaccttcgtcctcctgctgtccggccagatcacctggcgcgacatggcccacaccctcatcatgatcggcagcaacgcctctgacaggatggggatgggcgtcacgtaccttgcgctgatcgccaccttcaagatccagccctttctagccctgggattctttctgcgcaagctcacctcccgggagaacctgctgttgggcgtgggcttggccatggcgactacgctgcagctccccgaggacatcgagcagatggcaaacgggatcgccctcggcttaatggccctcaagttaatcacccagttcgaaacctaccagctgtggaccgcccttatcagcctgacctgctccaacaccatgtttactctgaccgttgcttggcgcacggctaccctcatcctggccggcgttagtttactgccggtgtgccagtccagctccatgcgcaagaccgactggctgcccatggccgtcgcggcgatgggcgtgccgcccctgcccttgtttatcttctctctgaaagataccctgaagcggcgctcatggcccctcaatgagggggtgatggcagtcggcctggtcagcatcctcgccagcagtctgctgcggaatgacgtgcctatggccggacccctggtcgcagggggcttactgatcgcttgctacgtaatcacggggacatccgccgacctaaccgtggagaaggccgccgacatcacctgggaggaagaggccgagcagacgggcgtctcccacaacctcatgatcaccgtggacgacgacgggaccatgcgcatcaaggacgatgagaccgagaacatcctgaccgtactgctcaagacggcgctgctgattgtctccggtgtgttcccgtacagcattcccgccaccctcctggtatggcacacctggcaaaagcagacccagcggtccggcgtcctgtgggacgtgcccagcccgcccgagacgcagaaggcagaactcgaggagggggtgtaccggataaagcagcaaggcatattcggcaagacccaggtcggcgtgggggtgcagaaggagggcgtcttccacactatgtggcacgtgacccggggcgccgttctgacgtacaacggtaagcgcctggagcccaactgggcgtccgtcaagaaggatctgataagctatggcgggggctggcggctgagcgcccagtggcagaagggggaagaggtccaggtgatcgccgtcgagcccggcaagaacccgaagaatttccagactatgcccggtaccttccagaccacgaccggggaaatcggcgccatcgccctggacttcaagcccgggacctcgggcagcccaatcataaaccgcgagggcaaagtggtggggttgtacggcaacggggtcgtgaccaaaaatggcgggtacgtatccggcatcgcgcagacgaacgccgagccggacggtcccacccccgaattagaggaggagatgttcaagaagcggaacctgaccatcatggacctgcaccctgggagcggcaagacgcgcaagtatttaccggccatcgtccgggaggccatcaagcgccggctgagaacgctgatcttagcaccaactcgggtggtcgcggccgagatggaagaggccctgaaggggctgcccatccgctaccagaccacagccacgaaatccgagcacaccggacgggaaatcgtcgacctcatgtgccacgccaccttcacgatgcgcctgctgagccccgtccgggtgccgaactacaacctcatcataatggacgaggcgcacttcacggaccccgcctccatagccgcccgcgggtatatcagcacacgagtgggcatgggcgaggcggcggccattttcatgaccgccacgccgccagggacagcagacgcgttcccgcaatccaacgcccccatacaggacgaggagcgggacatcccggagcgcagctggaattccggaaacgagtggatcactgacttcgccgggaagaccgtgtggttcgttccttcgataaaggccggcaacgacattgccaactgcctgcggaagaacgggaaaaaggttatccagttatctcgcaagaccttcgacacggagtaccagaagactaagctcaacgactgggacttcgtcgtcacgaccgacatcagcgagatgggtgccaactttaaagcggacagagtcatcgacccgcgccggtgccttaagcccgtgatcctgacggacggccccgagcgggtcattctcgccgggcccatgccggtcacagctgcctccgcggcccagcggcgcggccgggtaggccgcaacccccagaaggagaacgaccaatacatcttcactggccagcctctcaacaacgacgaggaccacgcccactggaccgaagccaagatgctgcttgacaacattaacaccccagaggggatcatcccggcgctgttcgagcccgagcgggagaagtccgccgccatcgatggcgagtaccgccttaagggcgagtcccgtaaaacgttcgttgagttaatgcgccgcggggacctgcccgtctggctggcccataaggtggccagcgagggaatcaagtataccgatcgtaagtggtgcttcgacggccagcggaacaatcagatcctcgaggagaatatggacgtcgagatctggacaaaggagggcgaaaagaagaagctgcgacctcgctggctggacgcgcggacctactcggacccgctcgccctgaaggagtttaaggactttgccgccggccgcaaaagcatcgcactagacctcgtgacggagatcgggagggtgccctctcacttagcgcaccgtaccagaaacgccctggataacctcgtcatgctgcacaccagcgagcacggcggccgcgcttaccggcacgccgtggaggagctgccagagactatggagacgttgcttctgctcggcctgatgatactgctcacgggtggcgccatgctgttcttaatcagcggtaaggggatcggaaagacctccatagggctcatctgtgtgatcgcgtcgtccggcatgctgtggatggccgagatcccgctccagtggatcgctagcgccatcgtcctggagtttttcatgatggtgctgttgatccccgaacccgaaaagcagcgcacacctcaggataaccaactcgcctacgtggtcatcgggattctgacgctggcggccatcatagcagcaaatgagatgggcctcctggaaaccaccaagcgggacctgggcatgtccaaagaaccgggggtggtgagccccacctcgtacctcgacgtcgacctgcacccggcaagcgcttggacactgtacgccgtcgccaccaccgtgatcacccccatgctccgccacacgatagagaactccaccgcaaatgtcagcctggctgcgatcgccaaccaagccgttgtgctgatgggcctcgacaaggggtggccgatctcgaagatggacctgggagtgcccctgctcgcccttgggtgctacagccaagtgaaccccctgaccctcaccgcggcggtgctgcttcttatcacgcactacgccattatcggacccggcctgcaggccaaggccacccgggaggcgcagaaacgcaccgccgccgggatcatgaagaatcctaccgtcgacggcataatgactatcgacttggaccctgtgatctacgactcgaagttcgaaaagcagctcggccaggtgatgctgctggtcctttgcgctgtgcaactgctgctcatgcggaccagctgggcgctttgcgaggccctgaccctcgccacgggccccatcacgaccctctgggagggctcccccgggaagttctggaacaccaccatcgccgtgtcaatggccaacatcttccgcggatcctacctggcgggggccggcctcgccttttccatcatgaagagcgtcgggacgggcaagcggggtaccgggagccagggtgagaccctgggcgagaagtggaagaagaaactgaaccaactcagccgcaaggagttcgacctgtacaagaagtctggcatcactgaggtggaccggaccgaggccaaggaggggctgaagcgaggggagatcacgcaccacgccgtgtcacgcggttctgcgaagctccagtggttcgtcgagcgcaacatggtgatcccggaggggcgggtgatcgatctgggctgcgggcgaggcgggtggagctactactgcgccggcctgaagaaggtcacagaggtgcgcggctacaccaagggcggtcccggtcacgaggagcccgtgcctatgtccacctacggctggaacatcgtcaagctcatgagtgggaaggacgtattctacctgccgcccgagaagtgcgacacgctgctgtgcgatatcggcgagagtagccccagtcccacagtggaggaaagccggaccatccgtgtcctcaagatggtagagccgtggctgaagaacaaccagttctgcatcaaagtgctgaacccctacatgcccaccgtcatcgagcacctcgagcggctgcagcgcaagcacggcgggatgctggtgcggaaccccctctcacgcaatagcacgcacgagatgtactggatctccaacggcaccggaaacatcgtggccagcgtcaataccgtgtcccggctgctgctcaaccgctttacgatgacgcatcggcgcccgactacagagaaggacgtggacctgggcgccggaacccggcacgtcaacgccgagcccgagactcccaacatggacgtgatcggggagcgcataaagcggatcaaggaggagcacaattctacttggcactacgacgacgaaaacccttacaagacctgggcataccacggctcttatgaggtgaaggccaccgggtccgcctccagcatgataaatggcgtcgtaaagctgctcacgaagccctgggacgtagttcccatggtcacccagatggcaatgaccgacacaacccccttcgggcaacagcgcgtcttcaaagagaaggttgacacccgcaccccgcgctccatgcccggcacgcgccgcgtgatgggtatcacggcggagtggctgtggagaaccctggggagaaacaagaaaccgaggctctgtacccgagaggagttcaccaagaaggttcgcacgaacgcagcaatgggggccgttttcaccgaggaaaaccagtgggactccgccaaggcggccgtggaggatgaagacttctggaagctggtcgatcgggagagagagctgcacaagctcgggaagtgcggtagctgcgtgtacaacatgatggggaagcgggagaagaagctgggagaattcggcaaggccaaggggtcccgagccatctggtatatgtggctgggcgccagatacttggaattcgaggcgctagggtttctgaacgaggaccactggttcagccgcgagaactcctacagcggcgtggagggggagggcctccacaaactgggctacatcctgagggatatctccaaaatccccgggggcgccatgtacgccgacgacaccgccgggtgggacacgcgtataactgaggatgacctccataacgaggagaagatcactcagcagatggacccggagcaccggcaactggccaacgcgatattcaaattgacttaccagaacaaggtcgtgaaagtgcagcgccccacccccaccggcacggtaatggacatcatcagtcggaaggaccaacggggctccggacaggtgggcacctacgggctcaacaccttcaccaacatggaggcccagctgattcggcaaatggagggcgagggtgtgctgagcaaagccgacttggagaacccccaccttccagagaagaagatcacgcagtggctggagaccaagggcgtcgaacgcctcaagcggatggccatctccggagacgactgcgtggttaagcccatcgatgaccggttcgccaacgctctgctggccctcaacgacatgggcaaggtccggaaggacattccccagtggcagccaagcaagggctggcacgactggcaacaggtaccgttctgctcccaccacttccacgagctgatcatgaaggacgggcgcaagctggtggtcccctgccggccccaggacgagctcatcgggagggcccgcatcagtcagggtgccggctggtcactgagggagaccgcgtgcctgggcaaggcgtacgcccagatgtggagcctcatgtacttccaccgtcgggacctgcgcctagcctcaaacgccatctgcagcgcagttcctgtgcactgggtcccgacctctcggacgacctggtcaatccacgcccatcaccagtggatgaccaccgaggacatgctcacagtgtggaaccgcgtgtggatcgaggacaacccttggatggaggacaagaccccagtcacaacctgggagaatgtaccttacctggggaagcgggaggaccagtggtgtggcagtctaatcgggctgacgtcccgcgccacctgggcacaaaatatcccaaccgccatccagcaggtgcggagcctaatcggcaacgaggagttcctggactacatgccctccatgaaacgcttccggaaagaagaggaaagcgagggcgcgatctggtga

SEQ ID NO: 25641 - RNA, 9873 nt, synthetic construct
  misc_feature 1..9873: note = derived and/or modified CDS sequence (opt11) from DENV-3__JX669490__SS-prME
  source 1..9873: mol_type = other RNA
accagcctgtgcctgatgatgatcttgccggccgccctggcgttccacctcacttcacgggacggcgaaccccggatgattgtggggaagaatgaacgcggcaagagcctgctgttcaagactgcttccggcatcaacatgtgcaccctcattgccatggaccttggggaaatgtgcgacgacacggtgacctacaagtgccctcatatcaccgaagtggagcccgaggacatcgactgctggtgcaacctgacctcaacctgggtgacttacggcacgtgcaaccaggccggggagcggcgccgggacaaacgctccgttgccctcgcgccccacgtggggatggggctggacacgcgtacccagacctggatgagcgcagaaggcgcctggcgccaagtggagaaggtggagacctgggccctgcggcaccccgggttcaccatcctcgcgctgtttctggcgcactacatcggcacgtccctcacccagaaggtggtgatattcatcctgcttatgcttgtgacgccgtccatgacgatgcgatgcgtgggcgtgggcaatagggacttcgtagagggcctgtccggggcgacttgggtagacgtagtcttggagcacggagggtgtgttacgacgatggccaaaaataagcccaccctcgatattgagcttcagaagaccgaggccacccaactggctacgctccgcaaactttgcatcgagggcaagataacaaacatcacaaccgactccaggtgccctacgcagggcgaggctgtcctgccggaggagcaggaccagaactacgtctgcaagcacacgtacgtggaccgcgggtggggcaacgggtgcgggctctttggaaaggggagcctcgtgacctgcgccaagttccagtgcctggaaccgattgagggcaaggtggttcagtatgaaaacctcaagtacaccgtgataatcactgtgcacaccggggaccagcatcaagtgggcaacgagacacaaggggtcaccgcggagattacgccccaggcaagcactaccgaggctatactgcccgagtacggcaccctgggactcgagtgcagcccgcggaccggcctggacttcaacgagatgatcctgctcacgatgaagaacaaggcatggatggtgcaccgtcaatggttctttgacctccccctgccctggacctcgggggcaaccactgaaacacctacctggaaccggaaggagctcttggtaacttttaagaacgcccatgccaagaagcaggaggtcgtggtgctggggtcacaggagggggcgatgcacactgccctcacgggagccaccgagatacagaacagcggcgggacctccatcttcgccggccatctgaagtgccgcttgaagatggacaagctcgagctcaagggcatgagctatgccatgtgtaccaacacgttcgttctcaagaaggaggtgtccgaaacccagcatggcactatcctcatcaaggttgagtacagaggtgaggacgcgccgtgcaagatcccgttctctaccgaggacgggcagggcaaggcccataacggccgcctcataacggccaaccccgtagtgaccaagaaggaggagcccgtcaacatcgaggcagaaccgccctttggggagagcaacattgtaatcggcatcggggacaacgcgctgaagatcaattggtataagaaggggtcttcaatcgggaagatgtttgaagctaccgcacggggagcccgccgcatggccatcctgggagacaccgcgtgggacttcgggtccgtgggcggggtgctcaacagcctgggcaagatggtccaccagatcttcgggtccgcctacacggctctgtttagcggcgtgtcctgggtgatgaagatcggcatcggcgtcctcctgacctggatcggcctgaactctaagaacaccagcatgagtttttcctgcatcgccatcggcatcatcacgctctacctgggcgccgtggtgcaggctgatatggggtgcgttatcaactggaaaggcaaggagctaaagtgcggcagcgggatcttcgtgacgaacgaggtgcacacctggaccgagcagtacaagttccaggccgacagccccaagcgcctcgctacggcaatcgccggtgcgtgggagaacggggtctgcggcattcgcagcacgacccggatggagaatttgctgtggaagcagatcgccaacgagctcaactacatcctgtgggagaataacatcaagctgacagtggtggtcggggacatcatcggcgtgttagagcagggcaagcgcaccttaacaccccagccgatggagctgaagtactcgtggaagacatgggggaaggctaagatcgtgaccgctgagacacaaaacagctccttcattattgatggccccaacacacccgagtgccccagcgcgtctagggcctggaacgtctgggaggttgaagactatggattcggcgtgtttaccaccaacatctggctgaagctgcgcgaggtatacacccagctgtgcgaccatcggctcatgtcagccgccgttaaggacgaacgcgccgtgcacgcggacatgggctattggatcgaaagtcagaagaacgggtcgtggaaacttgagaaggcctcactgatcgaggttaagacctgtacgtggcccaaatcacacactctatggagcaacggcgtgctcgaatccgacatgataatccccaagtcactggcagggcccatctcccagcacaaccatcggccgggctaccacacacagaccgccgggccctggcacctcggcaagctggagttagacttcaattactgtgagggcacgacggtggtcatcaccgagaactgcggcacccgcggccccagcctccgcacgaccaccgtgtccggtaagctgatccatgaatggtgttgcagaagctgcaccttgcccccactacggtacatgggagaggacgggtgctggtacggcatggagatccgacctatctccgagaaggaggagaatatggtcaaaagcctggtctccgccggctccgggaaggttgacaacttcacgatgggcgtgctgtgtctcgcgatcttgtttgaggaggttatgcgggggaagttcggcaagaagcacatgatcgctggggtgttcttcactttcgttttactcctgtcaggccagatcacctggcgcgacatggcccataccctgatcatgatcgggagcaacgcctccgatcgtatgggaatgggagtcacatacctagctctgattgcgaccttcaagatccagccgttcctggccctcgggtttttcctccgaaaacttacctcgcgtgagaatctcctgctgggcgtgggcctcgccatggccacgaccctgcagctgcccgaggatatagagcagatggcgaacggtatagcgcttggcctgatggcgttaaaactcatcacccagttcgagacctaccagctgtggaccgccctgattagcctaacctgctccaacaccatgttcacattgacggtagcatggcgcactgcgaccctgatcttggccggggtctcgctgttacctgtgtgccagtccagctccatgcgcaagacagactggctccccatggccgtcgctgccatgggcgttcctcccctcccgctgttcatcttctcgctcaaggataccctgaagcggcgctcctggcccctgaacgagggagtgatggcggtcggcctagtgagtatcttagcttccagcctgctccggaacgacgtgcccatggccgggccactggtcgccggagggctgctcatcgcctgctacgtgatcacggggacctcagcggatctgaccgtagagaaggcggcggatatcacctgggaggaagaggccgagcagacgggagttagccacaacctgatgatcaccgtggacgacgacgggactatgcgcattaaggacgacgagaccgagaatatcctcaccgtgctgctgaagacagccctactgatcgtttccggcgtattcccgtactctatccccgcaaccctgctcgtgtggcacacctggcagaagcaaacccaacgcagtggcgtcctatgggacgtgcccagcccacccgagacgcagaaggccgagctagaggagggtgtgtaccgaatcaagcagcagggcatcttcggcaagacccaggtcggcgtaggggttcagaaggagggcgtcttccatacgatgtggcacgtcacgcggggcgctgtgttaacgtacaacggcaagcgcctggaacccaactgggcctcggtcaagaaggatctaatcagctacggcggagggtggcggctgtccgcgcagtggcagaagggggaagaggtccaggttatcgccgtcgagccaggcaagaaccccaaaaatttccaaaccatgcccgggaccttccaaaccacgaccggagaaattggagccatcgcgctggatttcaagcccggtaccagcgggagccccataatcaaccgcgagggtaaggtcgttgggctgtacggcaatggggtcgtgacaaagaacggcgggtacgtgtccggcatcgcccaaacgaacgcggagccggatgggcccacgcctgagctagaggaagaaatgttcaagaagcgaaacctcactatcatggacctccaccccgggagcggcaagacccggaaatacctgccggccatcgtcagggaggccatcaaacgccgactccggacgctgatcctagcccccacccgggtggtggccgccgagatggaggaggcgctcaaggggctgcccatccgctaccagaccaccgccaccaagtccgaacacaccggccgggaaatcgtcgacctgatgtgtcacgccacattcacgatgcgcctcctgtcacccgtgcgggtcccgaactacaacctgatcatcatggacgaggctcacttcaccgacccggcgagcatcgccgctcgcgggtacatcagcacgcgtgttggcatgggcgaggccgcagccatcttcatgaccgcgacgccgccggggacggccgacgcctttccacaatctaacgcccccattcaagacgaggagcgggacatccccgagcgctcgtggaactccgggaatgagtggatcaccgacttcgctgggaaaaccgtgtggttcgtgccatccattaaggccggcaacgacatcgccaactgtctccggaagaacgggaagaaggtcatccagctgagtcgcaagaccttcgacacggagtaccagaagacgaaactgaacgattgggacttcgtcgtgactacagacattagcgaaatgggagccaactttaaagcggaccgggtcatcgacccgcgccggtgccttaaacccgtgatcctgacggacggtcccgagcgggtgatcttggccgggcccatgccggtcaccgccgcctccgccgctcagcgacgcggccgggtgggcagaaaccctcaaaaagagaacgaccagtacatcttcaccggccagcccctcaacaacgacgaggaccatgcccattggaccgaggcaaagatgctgctggacaacatcaacacccccgaggggatcatcccggctcttttcgagcccgagcgggagaagagtgcggccattgacggcgagtacagattaaagggtgaatcccggaagacgtttgtggaactgatgcgccgcggggatctcccagtctggttggcgcacaaagtcgccagcgaaggcatcaagtacaccgaccgcaagtggtgcttcgacggtcagcggaataaccagattctggaagaaaatatggacgtcgagatctggacaaaagagggcgagaaaaagaaactccgtcccaggtggttggacgcccggacctactccgacccgctcgcgctcaaggagttcaaggacttcgctgccggtagaaagagcatcgccctggaccttgtgacggagatcggacgggtaccctcccacctcgcccaccgcacccggaacgcgctggataatttggtcatgttacacacctcagagcacggcgggcgcgcctaccggcacgccgtggaggaactgcccgagaccatggagacgctgttgctgctgggcctcatgattttactgaccgggggcgccatgctgttcctgatcagcggcaaagggatcggcaagacgtccatcgggctcatatgcgtgatcgcctcatccggcatgctgtggatggcggagatcccgctgcagtggatcgccagcgccatcgtcctggagttcttcatgatggtgctcctaatccccgagcccgagaagcagaggaccccgcaggacaaccagttagcctacgtggtaattggaatcctaacgctcgccgccataatcgccgcgaatgagatgggtctactcgagaccaccaagcgcgacctgggcatgtccaaggaaccgggggtggtatcacccacatcctatctggacgtcgacctccacccggcctctgcgtggacgctgtatgcggtagccactactgtgattacccccatgctgcgccacactatcgaaaactccaccgctaatgtaagcctcgcggcgatcgccaaccaagccgtggtgctaatgggcctggacaaggggtggccaatatccaagatggacctcggagtccccttgctggctctcgggtgctacagccaggtgaaccccctcaccctgaccgccgcggtgctcctgctgatcacgcactacgccatcatcggccccggcctccaggccaaggcgactcgggaggcccagaagcgcaccgcggctgggatcatgaagaatccgaccgtcgacggcatcatgacgatcgacctggaccccgtgatctacgactccaagttcgagaagcagctcggccaggtgatgctcctggtcctgtgtgccgtgcagctcttactaatgagaaccagctgggccctctgtgaggcgctgaccctggccacaggccccattaccacgctctgggagggttccccggggaaattctggaacaccacaatcgccgttagcatggctaacatcttccgcggctcctacctggccggggctggcctggccttctcgatcatgaagtcagtcgggacgggcaagcggggcacagggagccagggtgagactctcggggagaagtggaaaaagaagctgaatcaactatctcgcaaggagttcgacctctacaagaagtccggaatcacggaggttgatcgaaccgaagcgaaggaggggctgaagcgcggcgagatcacgcaccacgccgtgtcccggggctccgcgaaacttcagtggttcgtcgagcggaacatggtgatcccggaggggcgggttatcgatctaggctgtgggcgtggcgggtggtcgtactactgcgcaggactgaagaaggtcaccgaggttcgcggctataccaagggcgggcccgggcacgaggagcccgtgccaatgtccacgtacggctggaatatcgtaaaacttatgagcgggaaggatgtgttctacctaccacccgaaaagtgcgacacgctgctgtgcgacatcggcgagtctagcccctcgcccaccgtggaagaaagcagaacaatccgcgtcctgaagatggtggagccttggcttaagaacaatcagttctgtatcaaggtactgaacccctacatgcccacggttatcgagcacttagagcggctccagcgcaagcacggcgggatgctggtgcggaaccccctgtcccgcaacagcacgcatgaaatgtactggatctccaacggaacagggaatatcgtggccagcgtgaacatggtttcccggctcttgttaaacagattcaccatgacccacagaagacctacgatcgagaaggacgtggatctcggcgcaggcactcgccacgtcaacgccgagcccgagacgccgaacatggacgtcatcggggagcgcatcaaacggattaaggaggagcacaacagcacctggcactatgacgacgagaacccctacaaaacgtgggcctaccacgggtcctacgaggtgaaggcgacagggagcgcttcctctatgatcaacggcgtcgtgaagttgctgaccaagccctgggacgtcgtgcccatggtgacccagatggccatgacagacaccacgcccttcgggcaacagcgcgtcttcaaggaaaaggtagacacccgcacgccgcgtagcatgcctggcaccagaagggttatgggcatcacggccgagtggctctggcggaccctaggtcgcaataagaagccccgcctttgcacgcgggaggagttcaccaaaaaggtacgcaccaacgcggccatgggcgccgtgttcaccgaagagaaccaatgggacagcgccaaagcagcggtggaggacgaggacttttggaagctcgtcgacagagagcgagagctgcacaagctggggaagtgcggcagctgtgtgtacaacatgatggggaagcgggagaagaaattaggggagttcggcaaggcaaaggggtccagggccatctggtacatgtggctgggcgcccgctaccttgagttcgaggctctcgggttcctgaacgaggaccactggttcagccgcgagaactcctacagcggggtggagggggaagggctccacaaacttggctacatcctgcgcgacatctccaagatccccgggggcgccatgtacgccgatgacacggcggggtgggacactcgcatcacggaggacgaccttcacaacgaggagaagatcactcagcaaatggaccctgagcaccggcagcttgccaacgccatcttcaagctcacgtaccaaaacaaggttgtgaaggtgcagcgccccaccccgaccggcaccgtgatggatataattagcaggaaggaccagcgaggctcgggccaggtgggcacctacgggctgaacacgtttaccaacatggaggctcagttgatccggcaaatggagggcgaaggggtgctaagcaaggccgacctggaaaaccctcacctcccagagaagaagatcacccaatggctagagaccaagggtgtcgagagactgaagcggatggccatctccggcgacgactgcgtagtcaagcccatcgacgaccgattcgccaacgccctcctggcactgaacgacatggggaaggtccggaaggacatcccccagtggcaacccagcaagggctggcacgactggcagcaggtccctttctgctcccaccactttcacgaactcataatgaaggacgggcgcaagctggtggttccctgccggccccaggacgagctgatcggccgtgcccgtatttcgcagggggccggctggtccctccgggagacagcctgcctgggaaaagcctacgcccagatgtggagcctgatgtatttccatcgccgggacctacgcctggcctccaatgccatctgttcggccgtgccggtgcactgggtcccgacctccagaaccacgtggagcatacacgcgcaccatcagtggatgaccaccgaagacatgctgaccgtgtggaacagggtgtggatcgaggacaacccctggatggaagacaagacccccgtcacgacctgggagaacgttccctacctcgggaaaagggaggatcaatggtgtggcagcctgatcggcctgacctcccgcgccacctgggcgcagaacatcccgacggccatccagcaggtccgaagcctcatcggcaatgaggagttcctggactacatgccctccatgaagcggttccggaaggaggaggagagcgagggggccatctggtga

SEQ ID NO: 25642 - RNA, 9873 nt, synthetic construct
  misc_feature 1..9873: note = derived and/or modified CDS sequence (opt11) from DENV-3__JN406515__SS-prME
  source 1..9873: mol_type = other RNA
accagcctgtgcttaatgatgatgctgcccgccaccctcgcgttccacctcacctcccgggacggcgagccccggatgatcgtggggaagaacgagcggggcaaaagcctgctgttcaagacagcctccgggatcaatatgtgcaccctcatagctatggacttaggcgagatgtgcgacgacaccgtgacatacaagtgccccctgatcaccgaagtggaacccgaggacatcgactgctggtgcaaccttacgagcacctgggttacgtatgggacgtgcaaccaggccggagagcaccggcgcgacaagaggtccgtggccctggcgccccatgtgggcatgggtctggatacccgcgcgcagacctggatgagcgcagaaggcgcctggcgccaggtggagaaggtggagacgtgggcatttcgacatcccgggttcactattttagctctgttcctggcccactacatcggcaccagtctcacccaaaaggtcgtcatcttcattctgttgatgctcgtaacccccagcatgaccatgcggtgcgtcggcgtcggcaaccgcgacttcgtcgaggggctgtccggggcaacctgggtggacgtggttctggaacacggcgggtgcgtgaccaccatggccaagaacaagcccaccttagacatcgagctgcagaagaccgaggccacccagctggccacgctgagaaaactgtgcattgaggggaagatcacgaacgtcaccactgacagcaggtgccccacgcagggcgaggctatactgccggaggagcaagaccagaactacgtctgcaagcacacctacgtggacagggggtggggcaacgggtgcggcctgtttgggaagggctccctggtgacctgtgcgaagttccagtgcctggaactcatcgagggcaaggtcgtgcagcacgagaatctgaagtacaccgtgatcatcactgtccacaccggggaccagcaccaggtgggcaacgagacccagggggtcacagccgagataacgccccaggcctcgaccgtggaggcgatccttcccgagtatggcaccctcggcctggagtgttcgcctaggaccggtctggactttaatgagatgattttacttacgatgaagaacaaggcctggatggtgcaccggcagtggtttttcgacctgccgctcccctggacatccggcgcgacaaccgagacccccacttggaataagaaagagctgcttgtcaccttcaagaacgcccatgccaagaagcaggaggttgtggtcttggggagccaggagggcgcgatgcacaccgccctcaccggagccacggagatccagaccagcggcgggacctccatattcgccggccacctgaagtgccgcctaaagatggacaagttagagctgaagggcatgtcgtacgccatgtgctccaacgcgtttgtgctaaaaaaggaggtgagcgaaactcagcacgggacgatcctgatcaaggtggagtacaagggcgaggacgccccctgtaagatcccgtttagcaccgaggacgaacaggggaaagcccataacggacggctgattaccgcgaacccagtcgtgaccaagaaggaggagcccgtcaacatcgaggcggagcccccgttcggcgagtccaacatcatcattgggatcggagacaaagcactgaagattaactggtacaagaaagggagctccatcggcaagatgttcgaggccacggcccgcggagcaaggcgcatggctatcctcggcgacaccgcatgggacttcggaagcgtcgggggcgttctgaactccctcggtaagatggtccaccagatcttcggctcggcctacactgccctcttcagtggggtgagctggatcatgaagatcggcatcggggtgctcttgacgtggatagggctcaattccaagaacactagcatgagctttagctgtattgtcatcggcatcatcaccctgtacctgggggccgtggttcaggcggatatgggctgcgtcataaactggaaggggaaggagttaaagtgcgggtccggcattttcgtgaccaacgaggtccacacgtggacggagcagtacaaattccaggccgacagcccaaagcggctggccaccgccatcgctggggcttgggaaaacggtgtctgcggaatcaggtccactacccgcatggagaatctgctctggaagcagatagcaaacgagctgaattacatcctgtgggagaacaacatcaaactcacggtggttgtcggcgacatcatcggggttttggagcagggaaagagaactctaacgccccagcccatggagttgaagtacagctggaagacgtggggcaaggccaaaatcgtgacggcggagacccagaactccagcttcatcatagacgggccgaacacccccgagtgccccaatgcttcccgcgcctggaacgtctgggaggtggaggactacgggttcggggtgttcaccacgaacatctggctgaagctgcgggagatgtacacccagctctgcgaccatcgcctgatgtcagccgccgtcaaggacgaacgggccgtgcacgcggacatgggatactggatagaaagccagaagaacggctcctggaagctggagaaggccagcctcatcgaggtgaagacctgcacctggcctaagagtcacacgctgtggtcgaacggggtcttagagagcgacatgatcatccctaagtccttggcaggccccatcagccagcacaactaccgccccgggtatcacacgcagaccgccggtccgtggcacctggggaagctggagctcgacttcaattattgcgagggcaccaccgtggtgatcacggagaattgcgggacacgaggacccagcctgcgcaccaccacggtctccggtaagttgatccacgaatggtgctgccggagctgcacgctgccacccctgcgctacatgggtgaggacggctgctggtacggcatggagatccggccgatcaacgagaaggaggaaaacatggtgaagagcttggtgagcgccggctccggcaaggtcgacaactttaccatgggggtgctctgcctggctatcctattcgaggaggtgatgcgaggcaagttcgggaaaaagcacatgatcgccggcgtgctcttcaccttcgtactgctgctcagcgggcagatcacgtggcgggacatggcccggaccctgatcatgatcggctccaacgccagcgaccggatgggcatgggggtgacttacctggccctcatcgcgaccttcaagattcagcccttcttggccttaggcttcttcctccgcaagctgacgtcccgcgagaatctgctcctgggggtcggactggccatggccacgaccctccagctgcccgaagacgtggagcaaatggcgaacggcatcgccctgggcctcatggccctgaagctgatcacccaattcgagacgtaccagctctggacagccctggtgtctctgatgtgcagcaacaccatctttaccctcacggtggcgtggcgcaccgccactctgatcctggctggaatcagcctcttccccgtgtgccaatcgtccagcatgcggaagaccgactggctgccaatgacggtcgctgctatgggtgtgccgcccctgcccctcttcatcttctccctgaaggacacgctcaagcgccgtagctggccgctcaacgagggcgtcatggccgtcgggctggtgtccatcctggcgagctccctcctgcggaacgatgtgcccatggccggccccctggtcgccggcggcttgctgatagcctgctacgtgatcacaggtaccagcgccgacctgacagtggaaaaggcggccgacgtcacgtgggaggaggaggccgagcagaccggggtgagccataacctcatgataaccgtggatgacgacggcacgatgcgcatcaaggacgacgagaccgagaacatcctgaccgttctgctcaagaccgccctgctaatcgtgagcgggatcttcccttactccatcccggccacgctcctggtgtggcacacgtggcaaaagcaaacacaaagaagcggagtcctgtgggatgttcccagcccgcccgagacccagaaggccgagctagaggaaggcgtttacagaattaagcagcaggggatcttcggcaagacccaggtcggggtgggcgtgcagaaagagggtgtcttccatacgatgtggcacgtgacccggggcgctgtgctgacctacaacggcaaacgcctggagcccaactgggcctccgtcaagaaggacttaatctcctatgggggcggctggcggctgagcgcccagtggcagaaaggcgaggaggtccaggtgatcgcggtcgaaccaggaaagaaccccaagaacttccagaccatgcccggcatcttccagactaccaccggcgagatcggggcgattgccctagacttcaagccgggcacctcggggagccccattatcaatcgcgagggcaaggtggtgggcctctacggaaatggcgtggtgacgaaaaacgggggctacgtgagcgggatcgcccagacgaacgcggagcccgacggcccgacccccgagctcgaggaggagatgttcaagaagcggaaccttactatgatggacttacacccaggctccgggaagacacgcaagtacctccccgcgatcgttcgggaggcgattaagcgtcgactgcgcacgctgatcctcgccccgactcgggttgtggccgctgagatggaggaggcgcttaagggcctgcccatccgctaccagacgacggccaccaaaagcgagcatactgggaaagagatcgtagacctcatgtgccacgcaaccttcacgatgcggctgctgtccccggtgcgcgtgccaaattacaacctaattatcatggatgaggcgcatttcaccgacccggcaagcatagcggcccgaggatacatctccacccgcgtcgggatgggcgaggcggccgcgatcttcatgaccgccacgccgcccggcaccgcagatgcctttccccagagcaacgccccgatccaggacgaggagcgggacatccccgagcgctcatggaactcagggaacgattggataaccgatttcgcgggcaagaccgtatggttcgttccctcgatcaaggctgggaatgacatcgccaactgccttcgcaagaacggcaagaaggtcattcagctgagccggaagacgttcgacaccgagtaccagaagacaaagctcaacgactgggatttcgttgtgacaacggacatcagcgagatgggtgccaacttcaaggccgaccgggtcattgacccccggcgctgcctcaagccggttatcctgaccgacggccccgagcgggtgattttagccggccccatgcccgtcaccgtggccagcgccgcccagagacgggggcgcgtgggcagaaacccgcaaaaggagaacgaccagtacatattcaccgggcagcccctgaacaacgacgaggaccacgcacactggacggaagcgaagatgctactcgataacataaacaccccggagggcatcatccccgccctgttcgaaccggagcgcgagaaatccgcagccatcgacggggagtaccggctgaagggcgagtcccgcaaaaccttcgtcgagcttatgcggcgcggggacctgcccgtgtggctggcccacaaggtcgcctccgaggggattaagtacacagaccggaagtggtgcttcgacggcgagcgcaataaccagatcctcgaggagaacatggacgtggagatctggaccaaggagggggagaagaagaagctgcggccccgatggctggacgcccggacgtacagcgaccctctggccctgaaggagttcaaggatttcgccgcgggccgcaagtccatcgccctggacctcgtgaccgagatcggccgcgtaccgagccacctggcccaccggacccgcaacgccctggacaacctcgtgatgctgcacacgtccgaacacggtggccgggcctaccgccacgctgtcgaggagctccccgagacgatggagaccctcctgctgctcgggctgatgattctgctcaccggcggggccatgctcttcctcatcagcggcaagggcgtcgggaaaaccagcatcggcttgatctgcgtggtggcctccagcgggatgctgtggatggccgacatcccactgcaatggatcgcctctgcgatcgttctagagttcttcatgatggtgctgctgataccggagcccgaaaaacaacggacgccccaggacaaccagctcgcctacgtggtcatcggcatcctgaccctggccgccattgtcgctgcgaacgagatgggcctgctggagaccaccaagcgcgatctgggcatgtcgaaggaacccggcgtggtctccccgacgagctacctcgacgtggacctgcaccccgcttccgcctggaccttatacgccgtagcaaccaccgtcataacgccaatgttgaggcacaccatcgagaacagcacggccaacgtgtccctggccgccatagcaaaccaggcggtggtcttgatggggctcgacaagggctggcccatcagcaaaatggacctgggggtcccgctgctcgccctgggctgctactcacaggtgaatccccttacgctcaccgccgcggtcctgctgttggtcacccactacgccatcattgggccgggcctgcaggcgaaagccacccgtgaggcccagaagcggaccgccgccggcataatgaagaaccccacggtggacgggatcatgacgattgacctggacccggtcatctacgacagcaagttcgagaaacagctcggccaggtgatgctgctggttctctgcgctgtgcagctgctgctcatgcgcacctcctgggccttctgcgaggcgctgacccttgccactggtcccatcaccacactctgggaggggagcccaggcaagttctggaacaccactatagcggtgtccatggccaacatcttccgggggagctacctggccggcgccgggctcgccttctccatcatgaaatccgtgggtacagggaagaggggcaccggcagccagggggagaccctcggtgagaagtggaagaagaaactgaaccaattaagccggaaggagttcgacctctacaagaagtccgggatcacggaggtcgaccgcaccgaggcgaaggagggccttaagcggggggagataacccaccacgccgtatcccgcgggtccgccaagctccaatggttcgtggaacggaacatggtcatccccgaaggccgcgtgatcgacctcggctgcggccgcgggggctggtcctactactgcgcagggctgaagaaggtgaccgaggtccgcgggtacaccaaaggcggtcctgggcatgaagagcccgttccgatgtctacgtacgggtggaacattgtgaagctgatgtccgggaaggacgtcttctacctcccgccggagaagtgtgacaccctgctgtgcgacataggggagagctccccgagccccaccgtggaggagtcccgaacgatcagggtgctgaagatggtcgaaccatggcttaagaacaaccagttctgcatcaaagtgctgaacccctacatgcccacggtgattgaacacctggagcggctccagcggaagcacggcggcatgctggtccgcaaccccctgagccggaactctacccacgaaatgtactggatatctaacgggaccggcaacatcgtgtccagcgttaacatggtcagtcgcctgctgctgaatcggttcaccatgacgtaccgccggcccaccatcgaaaaggacgtcgacctcggtgccggcacccgccatgtcaacgcggaaccggagactcccaacatggacgtgatcggcgagcggatccgccggattaaagaagagcacagctccacgtggcattacgacgacgagaacccctacaaaacttgggcttaccacgggagctacgaggtgaaggccaccggctccgcctcttcaatgatcaacggtgtcgtgaagctgctgaccaagccctgggacgtggtccccactgtgactcagatggctatgaccgacaccacacccttcggccagcagcgagtattcaaggagaaggtcgacacgcggacacccaagccgatgcccggcaccaggaaagtgatggagattactgccgagtggctctggaggaccctgggacgcaacaagcggccccgcttgtgtacgcgggaggagttcaccaagaaggtgcgcaccaatgccgccatgggcgccgtcttcaccgaggagaaccagtgggactccgcgcgcgctgcggtggaggacgaagagttctggaagctcgttgaccgggaacgcgaactgcacaagctcgggaagtgcggcagctgcgtctacaacatgatggggaagcgagagaagaagctcggcgaattcgggaaggccaagggatcccgcgcaatctggtacatgtggctgggcgcgcggtacctggagttcgaggccctcggtttcctgaatgaggaccactggttctcccgcgagaactcctacagcggcgtggagggtgagggcctgcacaagctcgggtacatcctgcgggacatatccaagatccccggcggcgccatgtacgcggacgacaccgccgggtgggacacacgcataaccgaggacgacctacacaacgaggagaagatcacccaacagatggatcccgagcacaggcagctcgctaacgcgatcttcaagctgacgtaccagaacaaggttgtcaaggtacagcgccccacccccaagggcactgtgatggacatcatctcgcggaaggaccaacgagggtccggccaggtcggcacctacgggctgaacacattcaccaacatggaggcccagctcatccggcagatggagggcgagggggtgctgagcaagacggacctggagaacccccacctcctagagaaaaagatcacgcagtggctggagaccaagggcgtagagcgcttaaaacggatggctatctccggggatgactgcgtcgtgaagccgatcgacgaccgattcgccaacgccctgcttgcccttaacgacatgggtaaggtgcgtaaggatatcccccagtggcagcccagcaagggctggcacgactggcagcaggtcccattttgctcccatcacttccacgagctgatcatgaaggacgggcgcaagctggtggtgccgtgccggccccaagacgagctcatcggccgcgctcggatcagccagggggccggctggtccctgaaagaaaccgcgtgcctgggcaaggcgtacgcccagatgtgggcactcatgtatttccaccgacgcgacctgcggctggcgagcaatgcgatctgctccgcagtccccgtgcactgggtgccaaccagccgtaccacctggtcaatacacgcccaccaccaatggatgaccacggaggatatgctcacggtatggaaccgggtttggatcgaggacaacccgtggatggaggacaaggcccccgtgaccacctgggaggacgtaccctatctgggcaagcgcgaggaccagtggtgtggaagcctgatcgggttgaccagccgggccacgtgggcgcagaatatccttaccgccatccaacaagtccgctccctgatcggcaacgaggagttcctcgactacatgcccagcatgaagcgattccgcaaagaagaggagtccgaaggtgcgatctggtga

SEQ ID NO: 25643 - RNA, 9873 nt, synthetic construct
  misc_feature 1..9873: note = derived and/or modified CDS sequence (opt11) from DENV-3__JN406514__SS-prME
  source 1..9873: mol_type = other RNA
acaagcctgtgccttatgatgatgctgcccgccacattagcctttcacctgacctctcgagatggggagccccggatgatcgtgggtaagaatgagcgcggcaagagcctgctgtttaagaccgcgagtgggatcaacatgtgcaccctcatcgccatggacctgggcgagatgtgcgatgacacggtgacctacaagtgtcccctgatagccgaagtggagcccgaggacatcgactgctggtgcaacttgaccagcacctgggtgacctacggaacatgtaatcaggccggggagcaccgccgcgacaaacggtctgtggccttggcgccccacgttggaatggggctggatactcggacccaaacttggatgtctgccgagggggcctggcgccaggtggagaaggtcgagacgtgggcgctccggcaccccgggttcaccatcctggctttattcctcgcccattacatcggtacgtctttgactcagaaggtggtgatcttcatcctcctcatgctggtcacgccaagcatgaccatgcggtgcgtgggggtgggtaaccgcgacttcgtcgagggcctgtccggcgcgacctgggtggatgtggtgctcgaacacggagggtgtgtgacgacgatggccaagaacaagcccaccctggacatcgagctccaaaagaccgaggcaacccagctcgccacgctgcggaagctttgtatagagggcaagatcaccaatatcacgaccgatagcagatgccccacccagggcgaggccatactcccggaggagcaggaccagaactacgtctgcaagcacacgtacgtggaccggggctggggcaatggatgtggcctgttcggtaagggatctctggtgacctgcgccaagttccagtgcctcgagcccatcgaggggaaggtggtccagtatgagaacctgaagtacaccgtgatcatcacggtgcacaccggagaccaacaccaggtgggaaacgacacccagggggtgaccgtggagatcacgccccaggccagcaccgtggaggcggtgctgcccgagtatggcaccctcggtctggagtgcagtccgcgcaccggcttggacttcaacgagatgatcctgctcacgatgaagaacaaggcgtggatggtccaccggcagtggttcctggacctcccattaccatggacgagcggcgcgaccacagagcgacccacctggaaccgtaaggagttgctcgtgacgttcaaaaacgcacacgccaaaaagcaagaggtggtcgtgctgggctcccaggagggcgccatgcacaccgcgctaaccggagccaccgaaatccaaaactcaggcggaacgtcaatattcgccggccacctcaagtgccgactgaagatggacaagctggaactgaagggcatgagctacgcgatgtgcctgaacacctttgtgctgaagaaggaggtctccgagactcaacacgggactatcctgattaaggtggagtacaagggcgaggacgccccgtgcaagatcccgttcagcacggaggatgggcagggcaaggcgcacaacggccggctcatcacagccaaccccgtagtcacaaagaaagaggagcccgtgaacatagaagccgagccgccctttggggagagcaacatagtgatcggcatcggggacaaggcgctgaagattaactggtacaagaagggcagtagtatcgggaagatgttcgaggcgaccgccagaggcgcccgccgcatggccattctgggcgacacggcctgggacttcgggtccgtgggcggggtgctcaatagcttaggcaagatggtacaccagatcttcgggagcgcttacaccgcactgttcagcggcgtatcctggatcatgaagatcggcatcggggtgctactgacctggataggcttaaacagcaagaatacctcaatgagcttctcttgcatcgtgatcgggatcatcacgctctacttgggagccgtggtccaagcagacatggggtgcgtcatcaactggaaaggcaaggagctgaaatgtggctcggggatcttcgtcaccaacgaggtgcacacctggaccgagcagtacaagttccaggccgactccccgaaacgccttgcaactgccatcgcgggcgcctgggagaacggggtgtgcggcatccgaagcaccacccgcatggaaaacttactgtggaagcaaatcgccaatgaactcaactatatattgtgggagaacaacattaaactgacagttgtggtgggggacacaatcggcgtgctggagcagggaaagcggaccctgacgccccagccgatggagctgaagtactcctggaagacctgggggaaggcgaagatcgtgacggccgagacccagaacagctccttcatcatcgatggccccaacacgcccgagtgtcccagcgcctcgagggcctggaacgtgtgggaggtcgaagattatggattcggcgtattctccaccaacatctggctcaagttgcgcgaggtttacacccaaagctgcgatcaccgccttatgtcggcggcaataaaggatgagcgggccgtccacgccgatatgggttactggatcgagtctcaaaagaacggatcctggaagctcgagaaagccagcttcatcgaggtgaagacgtgcatctggccgaaatcgcatacgctctggagcaacggcgtgttagagtccgacatgatcatccccaagtccctcgcggggcccatttcccagcataaccaccgcccgggataccacacacagaccgctgggccctggcatctgggcaagctggagctcgactttaactactgcgaggggacgaccgtcgtgataaccgagaattgcggtacccgcggcccctcgctgcgcactacgacagtgtcagggaagttaattcacgagtggtgctgccggtcctgcaccctaccacccctgcgctacatgggcgaggacgggtgctggtacggcatggagattcggcccatcaacgagaaggaagagaacatggtcaagtccctagtgtccgccggcagcggcaaagtagacaatttcacgatgggggtgctctgtttagccatcctgttcgaagaggtgatgcgtgggaagttcggcaagaagcacatgatcgccggggtcctgtttacctttgttctgctgcttagcgggcagatcacctggcgggatatggcgcacaccctgatcatgatcggatccaacgccagcgaccgcatggggatgggcgtgacgtatctggccctcatcgccacctttaagatccagccgttcctggccctggggttctttctccggaagctgaccagccgcgagaacctgctcctgggcgtgggcctagcgatggctaccacactacagctgccagaggacatagaacaaatggccaatgggatcgcgttgggcctcatgaccctgaagctgatcacccagtttgaaacctaccagctgtggacggcgctagtctcgttgacctgcagcaacaccattttcaccctcacggtggcctggcggaccgccaccttaatcctggctggagtcagcctcctgcctctttgccagtcatccagcatgcgaaagaccgactggctccccatgacggtggccgcaatgggcgtcccgcccctccctctgttcattttctccctaaaggataccccgaagcggcggtcctggcccttaaacgagggggtcatggcggtaggcctggtctccatactcgctagctccctgctgcgcaacgacgttccaatggccgggccgctcgtggccgggggcctgctgatcgcgtgctacgtgatcaccggcaccagcgccgatctcacggtcgagaaagcagccgacgtgacctgggaggaggaggccgaacagaccggtgtgtcccacaacctgatgatcactgtcgacgacgacgggacgatgcgaattaaggacgatgagacggaaaacatcctgacggtactgcttaagacagcgctgctcattgtgagcggaatcttcccttactccatccctgccaccctgctcgtatggcacacttggcagaagcagacccagaggagcggcgtgttgtgggatgtgccctccccacccgagacccagaaggccgagcttgaggaaggggtctaccggattaagcaacagggcatctttggcaagacccaggtaggcgttggggtccagaaagagggcgtgttccatacgatgtggcacgtgacccgcggtgccgtcctgacacacaacggaaagcggctcgagcccaactgggccagcgtaaagaaggacctgatctcctacggagggggctggcgacttagcgcgcagtggcaaaagggcgaggaagtgcaggttatcgccgtggagcccggcaagaacccgaagaacttccagaccatgcccggcatcttccaaacgactaccggggagatcggagccatcgctctcgacttcaagcccgggaccagcggttccccgatcataaatcgggagggaaaagtggtcgggctctacggcaacggcgtggtgacgaaaaacggcggatacgtctccggcatcgctcagaccaacgccgagccagacggaccaacccccgagctggaagaggagatgtttaagaaacggaatctgactatcatggacctccaccctgggtctggcaagacgcgaaaatacctgccagccatcgttcgcgaggccatcaagcggcgtttacggaccctaatcctggcccccactcgcgtggtggcggcggagatggaggaggccctgaaagggctccccatccggtatcaaactactgccaccaagagcgagcacacagggcgcgagattgtggacctgatgtgccacgccaccttcacgatgcggttattgagtccggtgcgcgtcccaaactacaacctgatcatcatggacgaggcgcacttcactgacccagccagcatcgccgcccgggggtacatctctacgcgcgtgggcatgggggaagctgcggccatattcatgaccgccacgcctccagggaccgccgaggcgttcccccaaagcaacgcacccatccaggacgaagagcgcgacatccctgagcggtcatggaactcgggcaatgagtggataactgacttcgtcgggaaaacagtctggtttgtaccctccatcaaagccggcaacgatatcgccaactgtctgaggaagaacggcaagaaggtgatccagctcagccggaagacgttcgataccgaataccagaagacccgcctaaacgactgggacttcgtcgtgaccacagacatctccgagatgggcgcaaacttcaaagccgaccgggtaatcgacccccgcagatgcctgaagcccgtcatcctcacggacggccccgagcgcgttatcctggccggcccaatgcccgttaccgccgccagcgccgcgcagcggcgcggccgggtcgggcgcaacccccagaaagagaacgaccagtacatcttcaccggccagcccctgaacaacgacgaggaccacgcccactggactgaggcgaagatgctcctggacaacatcaataccccagagggcatcatccccgccctgttcgagcccgagcgagagaagtccgccgcgattgacggggagtatcgcctcaaaggcgagagcaggaagaccttcgtggagctgatgcgccgcggcgacctgcccgtctggctcgcccacaaggtggcctccgaaggcatcaagtacactgatcgcaaatggtgcttcgacggggagagaaacaaccaaatcctggaggagaacatggacgtggagatctggaccaaagagggtgagcgcaagaagctgagaccgcgctggctcgacgcccgcacatacagcgaccccctcgcactgaaggagttcaaagactttgccgccggtcggaaatcgatcgcactagacttggtgaccgagatcggtcgcgtcccaagccacctggcccatcggacccgcaacgcgctagacaaccttgtgatgctgcataccagcgagcacggcgggcgggcatatagacacgccgtcgaggaactcccagagacgatggagacccttctgttgctgggcctgatgatcctactgaccgggggcgcgatgctgttcctaatctccggtaagggcattggcaagaccagcatcgggctgatctgcgtgatcgtatccagcggcatgctgtggatggccgacgtccccctccagtggatcgcgtcggcaatcgtgcttgagttcttcatgatggtgctacttattcctgagcccgagaagcagcggactccccaggacaaccagcttgcttacgtcgtgatagggatcctgaccctcgctgcgatcgtggccgccaacgaaatgggcctgttggagactaccaaaagagacctcggaatgagtaaggagccgggggtcgtgagtccgacaagctacctggatgtagacctgcaccccgcctccgcctggacactctacgctgtggcaaccactgtgatcacgccgatgctgcggcacaccatcgagaactctacggccaacgtttccctggccgccatcgcgaaccaggccgtcgtgttgatggggttagacaaggggtggcccatcagcaagatggaccttggcgtgcccctcctagctctcgggtgctactcccaagtcaacccccttacgctgacggccgccgtgctgcttctggtgacccattacgcgatcatcggcccgggcctgcaggccaaggccacccgcgaagcccagaaacgcactgccgcggggattatgaagaatcccacggtcgacggcatcatgactatagatctagaccccgtgatctatgatagcaaattcgagaagcagttaggccaggtgatgctgctcgtcctgtgtgccgtgcaattgttactgatgaggacttcctgggccttatgcgaggccctcacactggccacgggccctatcaccacactttgggaaggctccccggggaagttctggaacaccaccatcgcggtgtccatggccaacatcttccggggcagttatctcgctggggccggcctggcgttctcaatcatgaagtccgtcgggaccggccgtcggggaaccgggtcacagggcgagaccctgggagagaagtggaagaagaagctcaatcagctgtcccgcaaggaattcgacctgtacaagaagtccgggattacggaagtggaccgaaccgaggcaaaggaagggctcaaacgcggcgaaaccacccatcacgcggtatcccggggcagcgcaaagttgcaatggtttgtcgagcgcaacatggtgatccccgagggaagagtgatcgacctgggctgcgggcggggagggtggtcttactactgtgccggcctcaagaaagtcaccgaggtgaggggttacactaaaggagggcccgggcacgaggagcctgtgccgatgagcacgtacggctggaacatcgtaaagttaatgtctgggaaagacgtgttctacctgccgcccgagaaatgcgacaccctgctctgtgacatcggggagagctcccccagcccgaccgtggaggaatcccggacgatcagagtcctgaagatggtggagccctggctgaagaataatcagttctgcatcaaggtactcaacccctacatgccaaccgtcatcgagcacctggagcggctgcagcgcaagtacggcggtatgctcgtgcggaacccgctcagccgcaactccacccacgagatgtactggatcagcaatggcaccgggaacatcgtgtccagcgtcaacatggtgtcccggctgctcctgaaccgcttcacgatgacccaccgtcgtcccactatcgaaaaggatgttgatttgggagcgggcacccggcacgtaaacgccgagcccgaaacgccgaatatggacgtgatcggggagagaataaagcggatcaaggaggaacacagctccacatggcattacgacgacgagaacccctacaagacctgggcctaccatggcagctacgaggtcaaggccaccgggagcgcctcctctatgatcaatggagtggtgaagctcctcacgaagccctgggacgtcgtgccgatggtaacccagatggcgatgacagacaccacgccgtttgggcagcagagggtatttaaagagaaagtcgacacgcggacgcctcggcccatgcccggcacacggaaggtaatggagatcacagcagaatggctgtggcgcaccctcggcaggaacaagaaaccgcggctatgcacccgcgaggagttcaccaagaaggtcagaacgaacgccgccatgggggccgtgttcactgaagagaaccagtgggactcggcgcgcgccgccgtggaggacgaagaattctggaagctggttgaccgggagcgcgagctccacaagctgggtaaatgcgggagctgcgtatacaatatgatgggcaagcgagagaagaagctgggggagttcggaaaagcaaagggctcccgcgcgatctggtacatgtggctgggggcccggtacctggagttcgaggctctgggtttcctcaacgaggaccattggttcagtcgcgagaattcctacagcggagtagaaggcgaggggctgcataagctcggctacatcctccgggacatcagcaagattcccggcggggcgatgtacgctgatgacaccgcgggttgggacacgcgcatcacagaggacgacctgcacaacgaggagaagattacccagcaaatggaccccgagcacaagcagctggcgaacgccatcttcaagctcacgtaccagaacaaggtcgttaaggtgcagcggcccaccccgaaggggaccgtcatggacatcatctcgagaaaggaccagagaggctccggccaggtggggacctacggcctgaacacctttaccaacatggaggcccagctggtgagacagatggagggggaaggcgtgttatcaaaggcagacctggagaacccccacctactggagaagaagatcactcagtggcttgagacgaaaggggtggagcggctgaaacgcatggcgatctccggcgacgactgtgttgtcaaaccaatcgacgaccggttcgccaatgccctgctggcgctgaacgacatgggcaaagtgcgcaaggacatcccccaatggcagccgagcaaggggtggcacgattggcagcaggtccccttctgctcgcaccatttccacgaactaatcatgaaggacggccggaagctggtcgttccctgcaggccacaggacgagctaatcggccgcgcccgcatctcacagggcgcgggatggtcgttaaaggagacggcctgcctgggcaaagcttacgcacaaatgtggtcgctgatgtacttccaccgccgggacctccgcctggcctcaaatgcaatatgtagcgccgttccggttcactgggttcccaccagccggaccacgtggtccatccacgcccaccatcagtggatgaccaccgaggacatgctgacggtgtggaaccgtgtctggatcgaggacaacccctggatggaggacaagacgccagtgaccacgtgggaggatgttccgtatctaggcaaaagagaggaccagtggtgtggaagcctgataggattgacttcccgggccacgtgggcgcagaacatcctgactgccatccagcaagtccgcagcctcatcggggacgaggagttcctggactacatgccctccatgaagcgcttcaggaaggaggaggaaagcgagggcgcaatctggtga

SEQ ID NO: 25644 - RNA, 9873 nt, synthetic construct
  misc_feature 1..9873: note = derived and/or modified CDS sequence (opt11) from DENV-3__KT726340__SS-prME
  source 1..9873: mol_type = other RNA
accagcctttgcctcatgatgatcctgcccgccgccctggcgttccacctcaccagcagagacggggagccccggatgatcgtggggaaaaacgaacggggcaagtccctgctgttcaagacggcctccgggatcaacatgtgtaccttaatcgccatggacctgggggagatgtgcgacgacaccgtgacatacaagtgcccgcacatcacggaggtggagccagaggacatcgactgctggtgcaacctgaccagcacctgggtgacctacggaacgtgcaaccaagctggtgagcaccggagagacaagcggtctgtggccctcgcgcctcacgtgggcatggggttggacacccgtacccagacctggatgtcggccgagggggcctggcgccaggtggagaaggtcgagacctgggccctccgccatccggggttcaccattttggcgctgtttctggcccactatatcggcacctccctcacgcagaaggtggtgatcttcatcctgctgatgctcgtcacgcccagcatgaccatgcgatgcgtaggggtgggtaaccgcgatttcgtcgaagggctgtccggtgccacttgggtggatgtggtcctggagcatggcgggtgcgtgaccacgatggccaagaacaagcccacactcgacatcgagttacagaagacagaggcaacccagctggcaacgttacggaagttgtgcatcgagggcaagataaccaacatcaccaccgacagcagatgccctacgcagggggaggccgtgctgccggaggagcaagaccagaactacgtctgcaagcacacgtacgtggaccgggggtggggcaatgggtgcggtttattcgggaagggatccttagtgacctgcgccaagttccaatgcttggagcccatagagggcaaggtcgttcagtacgagaaccttaagtacaccgtgatcatcacggtacacaccggggatcaacaccaggtgggcaacgagacgcaaggggtcaccgccgagatcacgccccaggccagcaccacagaggctatcctgccagagtacggcaccctggggctcgagtgctccccgcgcaccggactggacttcaacgagatgattctgctcacaatgaaaaacaaggcctggatggtgcaccgtcagtggtttttcgacctgccgctgccctggaccagcggcgccaccaccgagacgcccacttggaaccgcaaggagcttctggttaccttcaagaacgctcacgccaagaaacaagaggtcgtggtgctggggtcccaagaaggggccatgcacaccgcgttgacgggggccaccgagatccagaacagcggagggacctccattttcgccggccacctgaagtgccgactgaagatggacaagctagagctgaagggtatgagctacgccatgtgtaccaacacattcgttctgaagaaggaagtgtccgaaacccagcacggtaccatcctcatcaaggtagagtacaagggcgaggacgtcccgtgcaaaatccccttcagcactgaggacgggcagggcaaggcccacaatggccgactgatcacagctaaccccgtggtgaccaagaaggaggagccagtcaatatcgaggccgaaccaccgttcggggagagcaatatcgtgattggcattggggacaacgcccttaagataaactggtacaaaaagggctccagcattgggaagatgttcgaggcgaccgcccgcggcgcccgcagaatggccatactgggcgatacagcctgggacttcgggagcgtcggcggggtcttgaactctctgggcaagatggtgcaccagatctttggctctgcgtacacagccctcttcagcggcgtgtcctgggtcatgaagataggcatcggggtactcctgacctggatcggcctaaacagcaagaacacctccatgagcttctcttgtatcgccatcgggataatcaccctctacttgggcgccgttgtgcaggccgatatgggatgcgtgatcaactggaagggcaaggagctgaagtgcgggagcgggatcttcgtgacgaacgaagtccacacctggaccgagcagtacaagttccaagcggactcccccaagcgtctcgccaccgcaatcgctggcgcatgggagaacggggtttgcggcatccgctcgacaactcggatggagaatctgttgtggaagcagattgcgaacgagctcaactacatcctgtgggaaaacaacatcaagctgacagtggtagtgggcgacatcatcggcgtgctcgagcaaggcaagcgcactcttacaccccaaccgatggagttgaagtactcctggaagacttgggggaaggcaaagatcgtcaccgcggagacccagaactcctccttcatcatcgacggacccaacacgcccgagtgccccagcgcatcccgggcgtggaacgtctgggaggtggaggactatgggttcggggtcttcaccaccaatatttggctcaagctacgcgaagtgtacacccaactgtgcgaccaccggctcatgagcgccgcggtgaaggatgaacgcgcagtacacgcagatatgggctactggatcgaaagccagaagaacgggtcctggaaactggagaaggcgagcttaatcgaggtgaagacctgcacgtggccgaagtcccacaccctctggagcaacggcgtgctggagtctgacatgatcattccaaagagcctggctgggcccatctcccagcataactatcgtccgggctaccatacccagaccgcagggccgtggcacctcggcaagttggagctcgacttcaactactgcgagggcacgaccgtcgtcatcaccgagaactgcgggacgagaggtccctccctccggaccaccacagtgtccggcaaactgattcacgaatggtgctgccgcagctgcaccctgccaccgctccggtacatgggggaggacggctgctggtacggcatggaaatcagacccatctccgagaaggaagagaacatggtcaagagccttgtctccgctggcagcggggaagtcgacaacttcacgatgggcgttttgtgcctcgccatactgtttgaggaggtaatgcgggggaagttcggcaagaagcatatgatcgcgggggtgttcttcaccttcgtcctgctcctgtccggccaaatcacctggcgcgacatggctcacaccctgatcatgatcggcagcaatgcctccgacaggatgggcatgggcgtgacgtacctcgccttaatcgcgaccttcaagatacagccgttcctggccctcgggtttttcctgcgcaaactgactagccgggagaatctacttctgggggtggggctggcaatggccaccacgctgcagctgcccgaggatatcgagcagatggccaacggcatcgcgctcggccttatggccctgaagctcatcacccagttcgagacttaccagctgtggaccgccctgataagcctcacgtgctctaacaccatcttcaccctgaccgtggcctggcgcacagccaccctgatcctcgcgggggtgagcctgctgccggtctgccagtcaagcagtatgcggaagacagactggctccccatgaccgtagctgccatgggcgtgccccccctaccgctgttcatcttcagcctcaaggacacgttgaagcggcgctcctggcccctgaacgagggcgtcatggccgtggggctcgtgagcattctggcctctagcctgttgcggaacgatgtgcccatggcgggccccctggtggccggtggcctgctcatcgcctgctatgtgattaccgggacctccgccgacttgactgtcgagaaagccgcggacgttacctgggaggaggaggcagagcagacaggcgtgagccacaacctgatgatcaccgtggacgacgacgggactatgcgaatcaaagatgacgagaccgaaaacatacttacagtgctgctgaagaccgcactcctgatcgtgtcggggattttcccgtacagcatccccgccaccctgctcgtctggcacacgtggcagaagcagacgcagcggtccggcgtgctgtgggacgtgcctagcccgcccgagacccagaaggccgagctggaggagggggtctaccggatcaagcagcaaggcatattcgggaagacccaggtaggcgtcggagtccagaaggaaggggtgtttcacaccatgtggcacgtgacgcgaggcgcggtcctgacctacaacgggaagcgcctggaacccaactgggcatccgtgaagaaggacctgatctcttacggcgggggctggcggctctccgcccagtggcagaagggggaagaggtgcaggtcatcgccgtggagccgggtaagaaccccaagaacttccagaccatgcccggcaccttccagacgacgacaggggaaatcggagcgatcgcactggacttcaaacccgggacgagcggctctcccatcatcaaccgtgagggcaaagtggtcgggctgtacggcaacggggtcatcacgaagaatggcgggtacgtttccggcatagcccagaccaacgccgagcctgacgggcccacccccgaactggaagaagagatgttcaagaagcgaaacctcaccatcatggatctgcaccccggaagtggaaagacgcgcaagtatctgccggccatcgtgagagaagcgatcaagcgccggctccgcaccctgatcctggcccccacccgggtcgtggcggccgagatggaagaagcgctcaaggggttacccatacgctatcagaccacggcaacgaaatccgagcataccggccgggagatcgtagacctgatgtgccatgccaccttcacgatgagactcctgagccctgtgcgggtgccgaactacaacctgattataatggacgaggcgcatttcaccgaccccgcatccatagccgctcgagggtacatcagtacccgggtcggcatgggcgaggccgccgccatcttcatgaccgcgacgccgccagggaccgccgacgccttcccgcagagcaacgcaccgatccaggatgaggagcgcgacatccccgagcgcagctggaactccggcaacgagtggatcaccgacttcgccgggaagaccgtgtggttcgtgccaagcatcaaggcgggaaacgatatcgccaattgcctcagaaagaacgggaagaaggtcatccagctgtcccgcaagacgttcgacaccgagtaccagaagaccaagttgaacgactgggactttgtagttaccacggacatctcggagatgggggccaacttcaaagccgaccgggtcatagacccgcgccggtgtctcaagcccgtgatcctgaccgacggccccgagcgcgtgatcctggcggggcccatgccagtcaccgcggcctccgccgcccagcggcgcggccgggtggggcgcaacccccagaaggagaacgaccaatacatcttcaccggccagcccctcaacaacgacgaggaccacgcccactggaccgaggcgaagatgctgctggacaacatcaatacgcctgaggggatcatccctgccctcttcgagcccgagcgggagaagtccgccgccatcgacggcgagtacagacttaagggcgagagtcggaagaccttcgtggagctgatgcgacgcggggacctacccgtctggctcgcacacaaagtggccagcgagggcatcaagtacaccgaccgcaagtggtgcttcgatgggcagcggaacaaccagatactggaggagaatatggacgtcgagatctggacaaaggagggcgagaaaaagaagctccgcccccggtggctggatgcccgcacgtattccgacccgctagccctcaaggagttcaaggacttcgcagctggacgtaagagcatcgccctggacctggtcaccgagatcgggagggtgccctcgcacctcgctcacaggactcggaacgccctggataacctggtcatgctccacaccagcgagcacggcgggaaggcataccgccacgcggtcgaggagcttccggagacgatggaaaccctgcttctgctgggcctcatgatcctgctgaccgggggcgccatgctattcctgatcagcggcaaagggatcggcaagacctccatcggactaatatgcgtgatcgccagttccggcatgttgtggatggctgagatcccactgcagtggatcgccagcgcgatcgtcttggagttctttatgatggttttactgatacctgagcccgagaagcagcggacgccgcaggacaatcagcttgcctacgtggtcatcgggatcctcacactggccgccatcatcgcagccaacgagatgggcctgctcgaaacaaccaagcgcgacctgggcatgtccaaggagccgggggtagtctctccaacgtcctacctggacgtcgacttgcaccctgccagcgcatggacgttatacgccgtggcgacaaccgtgatcacgcccatgctgcggcacacgatcgagaactccaccgccaatgtcagcctcgccgccatcgccaaccaggcggtggtgctgatgggactggacaaggggtggcctatcagtaaaatggatcttggcgtccccctgctggccctcggatgctacagccaggtgaaccccttgactcttacggccgccgtccttcttcttatcacccactacgccatcataggccccggcctccaggcgaaggccaccagggaggcccagaagcggaccgctgccgggatcatgaagaacccgaccgtcgacggcatcatgacaattgacctggaccccgtgatctacgactccaagttcgagaagcagttgggccaggtgatgctcctggtcctgtgcgcggtgcagctccttcttatgcgcaccagctgggctctctgcgaggctcttaccctcgccacgggccccatcaccaccttatgggagggctctcccgggaagttctggaacaccacgatcgcggtgagcatggccaacatcttccggggcagttacctggccggggccggcctggccttcagcataatgaagagtgtcggaaccggcaagcgcggcaccgggagccaaggcgaaaccttgggcgagaagtggaaaaagaagctgaatcagctaagtcggaaggagttcgacctctacaagaagtccggcatcacagaggttgaccgcaccgaggctaaggaggggctgaagcggggcgagatcacccaccacgccgttagccgcggttccgccaagctgcagtggttcgtcgagagaaacatggtgatcccagaggggcgcgtgatcgacctcggctgcgggcggggcgggtggtcttactactgcgccggcctgaagaaggtgactgaggttcgaggatacacaaagggagggcccgggcatgaggagccggtgcctatgtccacgtacggctggaatatcgtcaaactgatgagcgggaaggacgtgttctacctccctcccgagaagtgcgatacacttctgtgcgatatcggtgagagtagcccctcacccacagtggaggagagcagaacaatacgcgtccttaagatggtggagccgtggcttaaaaacaaccagttctgcattaaggtgttgaacccctacatgccgacggtcgtggagcacctggaacgcctccagcgaaagcacggggggatgctggtgcgaaaccccttatccagaaacagcacccatgagatgtactggatctccaacgggaccgggaacatcgtagccagcgtgaacatggtgtcccgcctcctgctgaaccggttcaccatgacacaccggagaccgaccatcgagaaggacgtcgacctcggagcgggcacccgccacgtgaacgctgagcccgagacgcccaacatggatgtgatcggggagcggataaagcgcatcaaggaggagcacaacagcacgtggcactacgacgacgagaacccgtacaagacctgggcctaccacggctcatacgaggtcaaggctaccgggtccgcctcctctatgatcaacggcgtagtcaagctgttgacaaagccctgggacgtggtccctatggtcacgcaaatggcgatgaccgacaccaccccattcgggcagcagcgtgtgttcaaggagaaagtggacacccgcaccccgcgcagcatgccgggcacccgccgggtcatggggatcaccgccgaatggctctggaggacgctaggccggaacaaaaagccccgcctgtgcacccgtgaggaattcacaaagaaggtccgcaccaacgccgccatgggcgcggtgttcacggaggagaaccagtgggactccgccaaggccgcagttgaagacgaagacttctggaagctcgtggaccgcgagcgggagctgcacaagctggggaagtgcggcagctgcgtgtacaatatgatggggaagcgcgaaaagaagctcggtgagtttggcaaagccaaggggtcccgggcgatctggtacatgtggctgggcgcacgctacctggaattcgaggcactcgggttcctgaacgaggaccactggttctcacgggagaattcgtactccggggtagaaggggagggcctgcacaaactggggtacatactgcgcgacatctccaagatccccgggggcgccatgtacgctgacgatacagctgggtgggacacccggatcaccgaggatgacctgcacaacgaggaaaagatcacgcagcagatggacccggagcaccgccagctcgccaacgccatcttcaagttgacatatcagaacaaggtcgtgaaggtccagcggccaacccccaccgggaccgtgatggacattatctctcgcaaggaccagcgggggtccggccaggtcggcacttacgggctgaacaccttcaccaatatggaggcgcagctaatccgccagatggagggcgaaggggtcctcagcaaagccgacctggaaaacccccggctcccggagaagaagatcacccagtggctggagacgaagggcgtggagcgattgaaacgcatggcgatctccggggatgactgtgtggtcaagcccatcgacgaccgcttcgccaacgccctcctggcactgaacgacatggggaaggtgcggaaggatatcccccagtggcaacccagcaaaggctggcacgactggcagcaggttccgttctgttcccaccacttccacgagctcatcatgaaggacggaaggaaactggtcgtgccatgccggccccaagacgagcttatcggcagagcccggatcagccagggggcgggctggtccctccgcgagaccgcctgcctgggaaaggcctacgcccaaatgtggagccttatgtacttccacagacgggacctccgcctggcgtccaacgccatttgtagcgccgtgcccgtccactgggtgccgacctcccggaccacgtggagcatacatgcccaccaccagtggatgaccaccgaggacatgctgaccgtgtggaacagagtgtggatcgaggacaacccctggatggaggacaagacgcccatcaccacatgggagaacgtgccttacctggggaagcgggaggaccagtggtgtgggagcctgatcgggctgacttcccgtgccacttgggcgcagaacatcccgaccgccatccagcaggtccggtcgctcatcggcaatgaggagttcctggactacatgccatccatgaaacgcttccgcaaggaggaggagagcgagggagccatctggtga

SEQ ID NO: 25645 - RNA, 9873 nt, synthetic construct
  misc_feature 1..9873: note = derived and/or modified CDS sequence (opt11) from DENV-3__KT726345__SS-prME
  source 1..9873: mol_type = other RNA
accagcttatgcctcatgatgatcctgcctgcagctctggcgttccacctcacctcccgggacggagaaccccggatgatagtgggaaaaaacgaaagaggcaagagcctgttgttcaagacagcctccgggatcaacatgtgcaccctcatcgcgatggacctgggcgagatgtgcgacgatacagtgacatacaaatgcccccacatcactgaggtggagcccgaggatatcgactgctggtgcaacctgacctctacctgggtgacgtacggtacgtgcaaccaagccggcgagcacagacgagataagcggtctgtggccctcgcgcctcacgtaggcatgggcctggatacccggacgcagacctggatgagcgcggaaggcgcctggaggcaggtggagaaggtagagacgtgggccctgcgacacccgggcttcaccattctcgccctgttcctggcccattacatcggcacctctcttacccaaaaggtcgtgatattcattctgttaatgctcgtcactccctccatgaccatgaggtgcgtgggggtgggcaaccgcgacttcgtcgaaggcctgtcgggggctacgtgggtcgatgtggtcttagagcatggggggtgcgtgacaacgatggcgaagaataagcccaccctcgatatcgagctgcagaagaccgaggccacccagctggcgacgctccgtaagctgtgcatcgagggtaagatcaccaacatcaccacagactctagatgccctacgcagggcgaggccgttctgccggaggaacaggaccagaactacgtctgtaagcacacctacgtggacaggggttggggaaacgggtgcgggctcttcggtaagggctccttagtaacctgcgcgaaattccagtgcctggagcccatcgagggcaaggtcgtgcagtatgagaatctcaaatacacggtcattattacggtacacactggtgaccagcatcaggtgggcaacgagacccaaggggtcaccgctgagatcacgcctcaagccagcaccactgaggcaatcctgcccgagtacggcaccctggggttggagtgctccccgcgcaccggcctggacttcaacgaaatgattcttctcacgatgaaaaataaggcctggatggttcaccggcagtggtttttcgacctgcccctgccctggactagcggcgccaccactgagacacccacctggaacaggaaggagctcctggtgaccttcaaaaacgcccacgccaaaaagcaggaggtcgtggtcttggggtcccaagagggcgcgatgcacacggccttaacgggggccacagaaatccagaacagcggagggacctccatcttcgcaggccaccttaagtgccggctgaagatggataagctcgaactaaaggggatgagctacgccatgtgcacgaatacgttcgttctgaagaaagaggtgtcggagacccagcacgggaccatcttaatcaaggtggagtacaagggcgaagacgtcccgtgcaagatccctttcagcactgaagacggtcaggggaaagcgcacaacggacgcctgatcacggccaaccccgtggtgactaaaaaagaggagcccgttaacatcgaagccgagccgcccttcggggagagcaacattgtgatcggaatcggggacaacgctctgaaaatcaactggtataagaaaggctctagcatcgggaagatgttcgaggcgaccgcccgtggcgcacgcagaatggccatcctgggcgataccgcctgggacttcgggtccgtgggcggggtcctcaatagcctggggaagatggtgcaccagatattcgggtccgcgtacactgccctattcagtggagtgtcctgggtcatgaagattggcatcggcgttctcctgacctggattggtctaaacagcaagaacacctccatgagcttctcatgtatcgccatcgggataattaccttgtacctgggggccgtggtccaagctgacatggggtgcgtgatcaactggaagggaaaggagctgaagtgcggaagtgggattttcgtgacgaacgaggtacacacctggaccgagcagtacaagtttcaggcggactccccgaagcgcctcgctacagccatcgccggcgcctgggagaatggggtctgcggcatccgctcgacgacccggatggaaaacctgttatggaaacagatagctaacgagctcaactatattctgtgggagaacaacatcaaactgacagtggtcgtaggggacatcatcggcgttttagaacaaggcaaacgcacgctgaccccccagccgatggagctgaagtattcctggaagacctggggaaaggcgaagatagtcaccgcagaaacccagaatagctccttcattatagatggcccaaacacgccagagtgcccaagcgcctcccgggcgtggaacgtatgggaggtggaagattatgggttcggtgtcttcaccaccaacatctggctaaagctgcgcgaggtgtacacgcaactttgtgatcatcggttaatgagcgctgcggttaaggacgaacgcgccgttcatgcggacatgggctattggatagagagccagaaaaacgggtcgtggaagctggagaaagcaagcctgatcgaggtgaagacctgcacttggccgaagagccacaccctatggagcaacggcgtgctggaatctgacatgatcatccccaaaagcctggccgggcccatctcgcagcataaccaccggccgggctaccatacccagaccgccggcccctggcatctcggcaagctggagttagacttcaattactgcgaaggcacgaccgtcgtgataaccgagaactgcggcacgcgcgggccgagcctccggacgaccacggtgtccgggaaattaattcacgagtggtgctgcaggtcatgcacactgcccccgctacggtatatgggggaggacgggtgctggtacggaatggagattcgccccatctccgagaaggaagagaacatggtcaaaagtctggttagtgcgggtagcgggaaggtagacaactttacgatgggcgtcctgtgtctcgccatactgtttgaggaggtcatgcgggggaagttcggtaaaaaacacatgatcgcgggggtgttcttcaccttcgtcctgctcctgtccggccagataacatggcgtgacatggcccataccctcataatgatcggcagcaacgcctcggacaggatggggatgggcgtgacgtaccttgccctgatcgcaacgttcaaaatccagccttttctggcgctcggcttctttctgcgcaaactgaccagccgggaaaacctcctactgggtgtgggccttgcgatggccaccacgctccagctgcccgaggacatcgaacaaatggcaaacggaatcgcgttaggcctgatggccctgaaactcattacccagttcgagacctaccagctttggacagcgctaattagcctcacttgttccaacacgattttcaccctgaccgtcgcttggcgcacggcgaccctgatactcgccggggtgagcctgctgccggtgtgccaatccagcagcatgcggaagacggattggctccccatggccgtggccgccatgggagtgcccccactcccgctgttcattttcagcctcaaggacaccctaaagcgtcgctcctggccgctgaatgaaggggtcatggcggtgggcctcgtgagcatcctggcgtccagcctgctccggaacgacgtccctatggccggcccgctggtagccgggggcctgctcatcgcatgttacgtgataaccggaacaagtgcagacctgaccgtggagaaagcggccgatatcatctgggaggaggaggctgagcagaccggcgtcagccacaacctgatgatcacggtggacgacgacgggaccatgcgcattaaggacgacgagaccgaaaacatattgactgtgctgctgaagactgctctcctgatcgtctccggtatcttcccgtactcaatccccgccacgctgctggtgtggcacacatggcagaagcaaacccagcggtccggagtactgtgggacgtacccagcccgcccgagactcagaaggccgagttagaagagggagtgtaccgaatcaaacagcaaggtatatttgggaaaacccaggtcggcgtgggggtgcagaaggagggagtctttcacaccatgtggcacgtgacccgaggggccgtgttaacccataatgggaagcgcctggagccaaactgggcttccgtcaagaaggacctgatctcttacggcgggggttggcggctctccgcacagtggcaaaagggggaagaagtccaggtgatagcggtcgagcccggcaagaaccccaagaactttcagacgatgcccggcacgttccagaccaccacaggggaaatcggcgccatcgccctggactttaagccagggaccagcggcagccccattatcaaccgtgaagggaaggtggttgggctgtacggcaacggggtagttaccaagaacggcgggtacgtgtccggcatcgcccagaccaacgcggaaccggacggcccgacgcctgagttagaagaggagatgttcaagaagcggaacctcaccatcatggacctccaccctgggagcggcaagacgcgcaagtacctgccggctatagtccgagaagctatcaagcgccggctgcgcaccctgatccttgctcccacgcgggtggtggccgcggaaatggaggaggcactcaaggggttgcccattaggtatcagaccaccgccaccaagagcgagcataccggacgggaaatcgtcgacctcatgtgccacgcaaccttcacaatgcggcttttgagccccgtgagagtgccaaattataacttgattatcatggacgaggcccacttcaccgaccccgccagtatcgccgcccgcggctacataagcacgcgggtcggcatgggagaggccgcggcgatcttcatgaccgccacgcccccggggacagccgacgccttcccgcagagcaacgcccctatccaggacgaggagagggacatccccgaacgctcctggaactccggcaatgagtggatcacggacttcgcggggaagacagtgtggttcgtacccagcatcaaggcggggaacgacatcgcaaactgtctccggaagaacgggaaaaaagtcatccagctcagtcgaaagaccttcgataccgaataccagaaaacgaagctaaacgattgggacttcgtggtgactaccgatatcagcgagatgggcgcaaattttaaagctgatcgggtcatcgacccgcgccggtgccttaagcccgtaatcctgaccgacggcccggaacgcgtgattcttgcgggccccatgccggtcaccgcggccagcgccgcccagcgtcgaggcagggttgggcgcaaccctcagaaggagaacgaccaatacattttcacaggccagccgctcaacaacgacgaggaccatgcgcactggactgaggccaaaatgctgctggacaacatcaacacccccgaggggatcatcccggcgctattcgagcccgagcgggagaagtccgccgcgatcgacggagaatacaggctgaagggcgagtctaggaagaccttcgtggagctgatgcgccgcggggacctccctgtctggctggcacacaaggtggcgagcgagggcatcaaatatacggataggaagtggtgcttcgacggtcagcggaacaaccagatcctggaagaaaacatggatgtcgagatctggacaaaagagggcgagaagaagaaactccgccctaggtggctggacgcgcgcacctattccgacccgctggccttaaaggagttcaaagacttcgcggccgggcgcaaaagcatagcgctcgacttagtcaccgagatcgggcgggtgccctcacatctagcccaccgcactcggaatgccttggacaacctggtcatgctgcacacaagcgaacacggcgggcgcgcttacaggcatgccgtggaggagctcccagaaactatggagacactgcttttactgggcctcatgatactgctgaccggcggtgccatgctgtttttgatcagcgggaaggggatcggcaaaacctccatcgggctgatctgcgtgatagccagctccggcatgctctggatggccgagatccctctgcagtggatcgcgagtgccatagtcctggagttttttatgatggtgcttctgatccccgaaccagagaagcaacgcacgccccaggacaaccaactggcatacgtggtcatcgggatcctgaccctagccgccattatagcggccaatgagatgggcctcctagagacgaccaaacgggacctggggatgtccaaggagccgggggtggtcagcccgacctcgtacctcgacgtcgacctccatcccgcctcagcatggaccctctacgcagtggccactaccgtgatcacccccatgctccgccacactatagagaactcgacggccaacgtcagcctcgccgccatcgcgaaccaagcagtggtgctgatgggcctggacaaggggtggccgatctccaaaatggatttaggcgtccccctgctggctctcgggtgctacagccaggtgaatcccctgaccctgaccgccgccgttctcctgctgatcacgcactacgcgattatcggccccgggctccaagcaaaggctacgagggaagcccaaaagcgcaccgcagcgggcatcatgaagaacccgaccgtcgacggcatcatgacgatcgacctggaccctgtgatctatgattccaagttcgagaagcagcttggccaggtaatgctcctggtgctgtgcgccgtgcagctcctgctgatgcggacgtcctgggcattgtgcgaggcactgaccctggcgaccggccccatcaccaccctctgggagggaagtcccgggaagttttggaacacgaccatcgccgtgtcgatggcgaacattttcagaggatcctacctagccggggccggcctggcgttcagcatcatgaaatccgtcggcactggcaagcggggcacggggagccagggcgagacccttggggagaagtggaagaagaagctgaatcagctgagccgcaaggaattcgacctctacaagaagtccgggatcaccgaggtcgatcggaccgaagcgaaggaggggctaaaacgcggcgagatcacacaccacgctgtcagccggggttcagcaaagctgcagtggtttgtcgaaaggaacatggtgataccagagggccgagtgatcgacctgggctgcgggcgcgggggttggagctactattgcgccggccttaaaaaggtcactgaggtgcggggctacaccaagggggggcctgggcatgaggagcccgtcccaatgtccacctacggctggaacatcgtcaagttaatgagcgggaaggacgtattctacctcccgcccgagaagtgcgataccctgctgtgcgacataggagagtcctcgccgtctccgactgtcgaagagagcagaacaatccgcgtgttaaagatggttgagccgtggctcaagaacaaccagttctgcattaaggtgcttaacccatacatgcctaccgtcatagagcacctggagcggctgcagcgcaagcatggtgggatgctagtccggaaccccttgtcccgcaatagcactcacgagatgtattggatttctaacggtacggggaacattgtcgcgagcgtcaatatggtgtcccggctgctgctgaaccggttcaccatgacccaccgccggcctaccatagaaaaagacgttgacttgggagccggcacgcggcacgtcaacgccgagcccgagacccccaatatggacgtgatcggcgagcgcatcaagcgtatcaaggaagaacataacagtacctggcactacgacgacgagaatccgtataaaacctgggcctaccacggctcctacgaggtaaaagcgaccggatcggcttcaagcatgataaacggcgtcgtcaagctgcttaccaagccctgggacgtcgtgcctatggtgactcagatggctatgaccgatacgaccccctttgggcagcaacgcgtcttcaaggagaaggtggacacccggacgccgcgcagcatgcccggtacgcggcgagttatgggtattacggccgagtggctctggcggactctggggcgcaataagaaaccccggctgtgcacccgcgaggaattcaccaaaaaagtccgcaccaatgccgcgatgggggctgtgttcacggaggagaaccagtgggactccgccaaagctgccgtggaggacgaggatttttggaagcttgttgaccgggagcgagagttgcacaaactgggcaagtgcggctcgtgtgtctataatatgatggggaagcgggagaaaaagctcggcgaattcggcaaggcgaagggctccagggccatttggtacatgtggctgggtgcgagatacctggagttcgaggctctcgggttcctgaacgaggatcactggttctcgcgcgagaactcttactcgggcgtcgagggggagggcctacacaaactcggctacatcttacgtgacatatctaaaatccccgggggagcgatgtacgcagacgacaccgccggttgggacacgcgcattacagaggacgacctacataacgaagaaaagattactcagcagatggacccggagcaccgacagctcgccaacgccatcttcaagttgacctatcagaacaaagttgtcaaggtccagcgccccacaccaacgggtaccgtgatggacatcatatcacggaaggaccagaggggctccggccaagtgggaacctacgggttgaacaccttcacgaacatggaagcccagctcatcaggcagatggagggcgagggggtgctgagcaaggcggacttggagaacccgcacctcccagagaagaagataacccagtggctggagactaagggcgtcgagcgcctgaagaggatggccatctcaggtgatgactgcgtggtgaagcccatagacgaccgattcgccaacgccctcctggccctaaacgacatggggaaggtaaggaaagacatcccccagtggcagccttcaaagggctggcatgactggcagcaggttccgttctgttcccaccacttccacgagctcatcatgaaggatggacgcaagctggtggtaccctgccggcctcaggacgagctgatcggccgcgcgcggatcagccagggggccggctggtcgctccgcgagaccgcctgcctgggcaaggcctacgcccagatgtggagcctgatgtactttcacaggagggacctccgcctggcctccaacgccatctgcagtgccgtacccgtgcactgggtcccaacttcacgaaccacatggtcgatccatgcccaccaccagtggatgaccacggaggacatgctgaccgtgtggaaccgagtgtggatcgaggacaacccctggatggaggacaaaacgcccgtcaccacgtgggagaatgtgccctacctcggtaagcgggaggaccaatggtgcggctcgttaatcggattgacctcccgagcgacctgggcccagaacatcccgaccgctatccagcaggtcaggagcctaatcggcaacgaggagtttttggactacatgccctccatgaagcgcttccggaaggaggaggaaagcgagggggctatttggtga

SEQ ID NO: 25646 - RNA, 9873 nt, synthetic construct
  misc_feature 1..9873: note = derived and/or modified CDS sequence (opt11) from DENV-3__KT726349__SS-prME
  source 1..9873: mol_type = other RNA
accagcctgtgcttgatgatgatcctgccagctgccctggccttccaccttactagccgggacggagagccccgtatgatcgtaggtaagaacgaacgggggaagtccctactgtttaagaccgcctctggcatcaatatgtgcaccctcattgcgatggacctcggggaaatgtgcgacgatactgtgacctacaaatgcccccacattacggaggtggagcccgaggacatcgactgttggtgcaatctgactagcacatgggttacctacggaacatgcaatcaggctggcgagcatcggcgcgacaaacgatccgtcgccctcgcgccgcacgtggggatgggactggacacgaggacccagacctggatgagcgccgagggtgcctggcgccaggtggagaaggtggagacgtgggcgctgcgccatccagggttcaccatcttagcgttgtttctggcccactacatcggaacgagtctcacccagaaggtggtgatctttatcctgctgatgctcgtgacgcccagcatgaccatgcggtgcgtgggagtgggtaacagggacttcgtcgaagggctatccggggctacctgggtggacgtagttttggagcacggcggttgtgtaaccacgatggccaagaacaagcccaccttggacatcgaactgcagaagaccgaggcaacccaactggcgacgctccggaagctgtgcatcgagggcaaaataaccaatatcactaccgacagccgctgccccacgcagggcgaggccgtgttgccggaggaacaggaccagaactacgtctgcaagcatacctatgtggaccggggttggggaaacggctgcggactattcggcaagggctccctggtgacctgcgccaagttccaatgcctggaacccatcgagggaaaggtcgtgcaatacgagaatctcaagtacacagtgatcatcacggtccataccggtgaccaacaccaggtcggcaatgagacccagggggtcaccgccgagataacaccccaagccagcacgaccgaggcgatcctgcccgagtacggtaccctgggactagagtgctccccgcgcacaggcctggacttcaacgagatgatcctgctgacgatgaagaacaaggcctggatggttcaccgacaatggttctttgatctgcctctgccctggactagcggcgcaaccacggaaacccccacgtggaaccgaaaggagctactggtgacgttcaagaacgcgcacgctaagaaacaggaggtagtggtgctgggttcacaggagggcgccatgcacaccgccttaaccggggcgacagagatacaaaacagcggggggacgtccatctttgctggccatctcaagtgtcggctgaaaatggacaaattggagctgaagggcatgagctacgccatgtgcaccaacacgttcgtactgaagaaggaggtgtctgagactcagcacgggaccatcctcatcaaggtagagtacaagggcgaggatgttccgtgcaagatccccttcagcaccgaggatgggcagggcaaggcgcacaatggccggctaatcacggccaacccagtggtcaccaagaaggaagagcccgtcaacatcgaagcagaaccgccctttggggagagcaacatagttattggtatcggggataacgccctgaagatcaactggtacaagaagggctcttcaattggtaaaatgtttgaggcgaccgcaaggggcgcacgccggatggccatcctgggcgacaccgcctgggacttcggatccgtgggtggggtcctcaacagccttggcaagatggtgcatcagatatttgggtcggcgtatacggccctgttcagcggggtgtcgtgggtcatgaaaattggcatcggggtcctcctcacgtggataggcctgaacagcaaaaacacctccatgtccttcagttgcatcgccatcgggatcatcacgctgtacctgggcgccgtggtccaggccgatatgggttgcgtaatcaattggaaggggaaggaactgaagtgtggcagcggaattttcgtgacgaacgaggtccacacctggaccgagcagtacaaattccaggcggactcccccaagcgcctcgccaccgccatcgcgggcgcctgggagaacggggtgtgtggcattcgctcaacgacccggatggagaacctgctgtggaagcagatcgcgaacgagctcaactacatactgtgggagaacaacatcaagctgaccgttgtcgttggtgacatcatcggcgtattagagcagggaaagagaaccctgacgccccagccgatggagctaaagtattcctggaagacatggggaaaggccaagatcgtcacggccgaaacccagaacagctccttcatcatcgacgggccgaacactcctgaatgccctagcgcctcccgggcgtggaacgtatgggaggtagaagactacgggttcggcgtcttcaccacgaacatatggctcaagctgcgcgaggtgtatactcagctatgcgatcacagactcatgtcggccgctgtgaaggacgagcgtgccgtccacgccgatatgggatactggatagagagtcagaaaaacggatcatggaagttggagaaagcgtcactgatcgaagtgaagacgtgcacctggccgaagtcacacactctatggtcgaacggcgtactggagtccgacatgatcatccccaagtcgttggccgggccaatctcccagcacaaccaccggcccggttatcatacgcaaactgcagggccctggcacctcggaaaactggagctggacttcaactactgcgagggaacgaccgtcgtgatcactgaaaactgcgggaccaggggccccagcctgcgtactaccaccgtgtctggtaagcttatacatgaatggtgctgtaggagctgcactctgcccccgctccggtacatgggcgaggatgggtgctggtatggcatggagatacgcccaatttcagagaaggaggagaacatggttaagtcgctggtgtccgccggctccggaaaggtggacaatttcactatgggtgtcctgtgtcttgctatactgtttgaagaggttatgcggggcaaattcggcaagaagcacatgatcgcgggggtttttttcaccttcgttcttttactttccggtcagatcacgtggcgcgacatggcccacaccctgattatgattggtagcaacgcctctgaccggatggggatgggcgtaacgtatctggcactgattgcaacttttaagatacagcccttccttgcgctcggattcttcctgcgaaagctgacctctcgggagaaccttctgttaggcgtggggcttgcaatggccaccacgctccaactccccgaggacatcgagcagatggcgaacgggatcgccttaggcctaatggctctcaagctaatcacgcagtttgagacctaccagctctggaccgccctgatcagcctcacgtgttcgaacacgatcttcaccctgaccgttgcctggaggacggccaccctcatactcgcaggggtcagcctgttgccggtctgccagtccagctccatgcggaagacagactggctccccatggcggtggccgctatgggtgtgccgcctctccccctgtttatcttcagcctgaaggatacccttaaacgccgctcctggcccctgaatgaaggggtcatggcggtgggcctggtgagcatactggcgtccagcctgttacggaacgacgttcccatggcaggacccctggtcgccgggggcctgctcatcgcctgttacgttattacagggaccagcgccgaccttaccgtcgagaaggcagcggacatcacctgggaggaggaggccgaacagacaggcgtcagccacaatctgatgatcacagtagacgacgacggcaccatgcgcatcaaggacgacgagaccgaatccatactcaccgtcctgctgaagaccgccttgctgatcgttagcggcatctttccgtactcaatcccagctactctgttggtttggcacacctggcaaaagcagacccagcggagcggcgtcctgtgggacgtgccctccccgcccgagacgcagaaggcggaactggaggagggggtgtaccgcatcaagcagcagggcattttcggaaagacccaggtcggcgtgggggttcagaaggagggggtcttccacaccatgtggcacgtgacgcggggcgccgtgttaacgcataacgggaaacgcctggagcccaactgggcctcagtcaagaaggaccttatctcctacggcggtgggtggcggctcagcgcccaatggcagaagggggaggaggtccaagtaatcgccgtcgagcccggcaaaaaccccaagaacttccagacgatgcccgggacattccaaaccaccactggagagatcggcgcgattgccctggactttaaacccggaacgtctggctccccgataatcaaccgcgagggcaaggtggtggggctgtacgggaacggggttgtgacaaaaaacggcgggtacgtaagcggcatcgcccagactaacgccgagccggacggccctacccccgagctggaggaggaaatgttcaagaagcgtaacctaaccatcatggatttgcacccaggttccggcaagactcgcaagtatctgccagcgatcgtccgggaagccatcaagcgccgtcttcgcacgctgatcctggccccaacgcgggtggtcgctgccgagatggaggaggcgctcaaggggctgccaatcaggtaccagaccaccgccacaaagagcgagcataccggccgggaaatcgtagacctgatgtgccatgccactttcaccatgcggctcctgtcccctgtgcgggtgccgaactacaatctcatcattatggacgaggctcactttacggacccagccagcatcgcggcccgcggatacatctccacacgggtcggcatgggagaagccgccgcgatctttatgactgctacgccgcccgggacggctgacgcctttccacagagtaacgcccccatccaggatgaggagcgcgatatacccgagcgcagttggaacagcggcaacgagtggatcaccgacttcgccgggaaaacagtgtggtttgtcccgtccatcaaggccggcaacgatatagccaactgcttacggaagaacgggaagaaagtcatccagctctcccgaaagacgttcgacaccgagtaccagaagaccaagctaaacgactgggactttgtggtaaccaccgacattagtgagatgggcgcaaacttcaaggccgaccgggtcatcgatccgcgacggtgtctcaagccagtcatcctgactgacgggcccgagcgcgtaatattagcggggccaatgccggtcaccgccgcaagcgccgcccagcggaggggccgggtcggacgcaaccctcagaaggagaatgaccagtacatcttcaccggccagcccctaaacaacgacgaggaccacgctcattggaccgaggccaagatgctattagacaacatcaacacaccggaagggataatacctgccctcttcgagcccgagagagagaaatcagccgcgatagatggcgaataccgcctgaagggggaaagccggaagacgttcgtggagctgatgcgcagaggtgaccttcccgtctggttggcccacaaggttgcttccgagggcattaaatacaccgaccgcaaatggtgcttcgacgggcagcggaacaaccagatccttgaggagaatatggacgtggaaatctggactaaagagggcgagaaaaagaagctcagaccccggtggcttgacgcgaggacctactctgacccgctggccctcaaggagttcaaagactttgcggccgggcgcaagtctatcgcactggacctggtgacggagataggccgggtacccagccatcttgcccacagaacccggaacgccctggacaatctggtcatgctccataccagcgagcacggtgggagagcgtaccggcacgccgtcgaggagctgcccgagaccatggagacgctgctcctgctgggcctgatgatcctacttactgggggtgctatgttattcctgatctcagggaaggggatcggtaagaccagcattgggctgatttgcgtaatcgcgtcatcgggcatgctctggatggcagaaatccccttacagtggatcgcgtccgccatagtgctggagtttttcatgatggtactcctgatcccagagccggagaagcagaggacgccccaggataatcagctggcatatgttgtcattgggatactcacgctggccgccataatcgcggccaacgaaatgggcctgctcgaaactaccaagcgcgacctggggatgtcaaaggaaccgggggttgtgtcccccaccagctacctggacgtcgatttacaccctgcgtccgcgtggactctgtacgcggtagccactacggtaatcacccccatgctacgtcacacgatcgagaacagcaccgccaacgtatccctcgccgcaatcgcgaaccaggcggtggtgctcatgggcttggataagggttggccgatcagcaaaatggacctaggggttcccctattggccctcggttgctactcccaggtgaacccattgacgctaaccgccgccgtgcttttactgatcacgcactacgctataataggccccggtctacaagccaaggccaccagggaggcccaaaagcgcacagcagcggggatcatgaaaaaccccactgtagacggaatcatgacgatagacctggaccccgtcatctacgacagcaagttcgagaagcagctgggccaggtgatgcttctggtactctgtgccgtccagctcctgctgatgcggacctcatgggcgctctgcgaagccctgaccttagcgacgggcccgatcacgacgttatgggaaggaagccccgggaaattttggaataccaccatcgccgtgtcaatggccaacatattccgcggaagctacctggcgggggcgggcctggcattctccataatgaaatccgtggggacgggtaagcgaggcaccgggagccaaggcgagaccttgggggagaagtggaagaagaaactgaaccagctgagtcgcaaggagttcgacctctacaagaagtccggcatcaccgaggtggaccggaccgaagccaaagagggtctgaaacgcggcgagattacacaccatgccgtatcccgggggtcagccaaattacagtggttcgtggaacgcaatatggttatcccggaggggagagtgattgacctcggctgcggacgtggcggatggtcctactactgcgccggcctaaagaaagtcaccgaagtgcggggctacaccaagggcggccccggacacgaggagcccgtgcccatgagcacctatggctggaacatcgtcaagctgatgtccgggaaggatgtgttctacctcccgcccgaaaagtgcgatacgctgctgtgcgacattggggaaagctccccgagccccaccgttgaggaatcccgcaccatcagagttctgaagatggttgagccttggctcaagaacaaccaattttgtatcaaagtgttgaacccctacatgcccaccgtcatcgagcacctggaacggcttcagcgcaagcacggcggtatgctggttcggaacccccttagccgcaactccacccacgagatgtattggatcagcaatggcacaggtaacatcgtggcgtccgtcaacatggtgtcgcggctcctgctgaatcgctttaccatgacgcaccggcgcccgacgatcgagaaggacgttgacctcggtgccggaacccggcatgtcaacgctgagcctgagacccccaacatggacgtcatcggggagcgcattaagaggatcaaggaggagcacaactccacatggcactacgacgacgagaacccgtataagacgtgggcataccacggcagctacgaggtgaaggccactggttccgctagcagtatgatcaatggcgtggtgaagttgttgaccaagccatgggatgtcgtgccaatggtcacacagatggccatgacggacaccacccctttcgggcagcagcgcgtcttcaaggagaaggtggacacccgcacgcctcgcagcatgcccggtacccggagagtgatgggcatcactgccgaatggttatggcgcacactgggtcgcaataagaagccccggctgtgcacgcgcgaggagttcaccaagaaggtccgcaccaatgccgcaatgggcgccgtgttcaccgaagagaaccagtgggacagtgcaaaggccgccgtggaggatgaggacttctggaagctagtcgatagggagagggagctgcacaagctggggaagtgtggctcctgtgtgtacaacatgatggggaaaagggagaagaagctcggcgagttcggcaaggcgaaggggtctcgtgccatttggtacatgtggcttggcgcacggtacctggagttcgaggccctcggcttcctgaacgaggaccattggttttcccgcgaaaacagttactcgggcgtggagggggagggcctccataagctcggttacatcctacgggacataagcaagatcccgggcggcgcgatgtatgcggacgacacggctggctgggacacccgcatcaccgaggacgatctgcacaatgaggaaaagataacccagcagatggacccggagcaccggcagctcgccaacgctatattcaagctgacgtaccaaaacaaggtcgtcaaggtacaacgccccacccccaccggcaccgtcatggacatcatcagtcggaaggaccagcgcggatcaggtcaggtaggaacctacgggctcaacacgttcaccaatatggaagcccagttaatccggcaaatggaaggcgagggggtgctgtctaaggcggacctggaaaatccccacctcccggagaaaaagattacccagtggctggaaaccaagggagtcgaacgcctaaagcggatggctatctcgggcgacgactgtgtggtgaagccgatcgacgaccgcttcgcgaacgccctcctagccctgaacgatatggggaaagtccgtaaggacataccccagtggcaaccgtcgaagggctggcacgactggcagcaagtgccgttctgtagccatcacttccacgagttgatcatgaaggacggacgcaagctggtagtcccctgcaggccacaggatgagctgatcggacgcgcgaggatttcccagggcgcgggttggagcctcagggaaaccgcctgtctgggcaaggcctacgctcagatgtggtcccttatgtactttcacaggcgggacttacgcctcgccagcaacgccatatgcagcgcggtgcccgtccactgggtccctacctcgcggaccacctggtctatacacgcccaccaccagtggatgaccaccgaggacatgctgacggtgtggaatcgcgtctggatcgaggacaacccgtggatggaggacaaaacccccgtgacgacatgggagaacgtcccctacctcgggaagcgggaggaccagtggtgcggcagcctgatcgggctgacttctcgcgcgacctgggcccagaatatcccgacggctatccagcaggtccggtccctcatcggaaacgaggagttcttagactacatgccaagcatgaagcgcttccgtaaggaggaggaatccgagggggctatttggtga

SEQ ID NO: 25647 - RNA, 9873 nt, synthetic construct
  misc_feature 1..9873: note = derived and/or modified CDS sequence (opt11) from DENV-3__KT726347__SS-prME
  source 1..9873: mol_type = other RNA
acctctctatgtctgatgatgatcctgcctgccgccttagcgttccacctcacttcccgggacggggagccccggatgatcgtggggaaaaacgagcggggtaagagtctgctgttcaagaccgcctccgggatcaatatgtgcaccctcattgccatggacctgggcgagatgtgtgacgataccgtgacatacaaatgcccccatattaccgaagtcgagccagaggacatcgactgctggtgtaacttgaccagcacatgggtgacctacggcacgtgtaaccaggcgggcgagcacagacgcgacaaacggtccgtggcgctcgctcctcacgtgggaatggggctggacacgcgcacccagacctggatgagcgccgagggcgcctggcgccaggtggagaaggtggagacctgggccctgcgtcacccggggttcaccatcctagcgctgttcctggcccattacataggcacctccctcacccagaaggtagtgatcttcatccttctgatgctcgtcacgcccagcatgactatgagatgtgtcggagttggcaacagagacttcgtcgagggcctatctggggcgacgtgggtggatgtggtccttgagcacggggggtgcgtcacaacgatggccaagaacaagcccaccctcgacatcgagcttcagaagacggaggccacccagttagcgacgctccggaagctgtgcatcgagggcaaaatcaccaatattaccaccgactccagatgtcccacgcagggcgaagccgtactgcctgaggaacaagaccagaactatgtctgcaagcacacttatgtggaccgaggatgggggaacgggtgcggcctcttcggcaagggttccctggtgacctgtgccaagtttcagtgcctggagcccatcgagggcaaggtcgtccagtacgagaacctcaaatacaccgtgattatcacggtgcacaccggggatcagcaccaggtgggcaacgaaacccagggggtcaccgccgagataacgccccaggccagcacaaccgaggctatcctgcccgagtacggaaccctggggctcgagtgctccccgcgcaccggcctggacttcaacgagatgatcttgcttgccatgaagaataaagcctggatggtgcaccggcagtggttctttgacttgcccctgccctggacgagcggcgctacgaccgagacccccacgtggaaccgcaaggagctcctcgtcacatttaaaaacgcccacgctaagaagcaggaggtagtggtattgggaagtcaggagggcgcaatgcataccgccctcaccggggccacggagatccagaacagcggcgggacctccatcttcgccggccatttgaagtgccggctgaagatggataaactcgagctgaagggcatgagctacgcgatgtgcaccaacaccttcgtcttaaaaaaggaagtgtccgagacgcagcacgggactatcctcataaaggtggagtataagggtgaggacgttccttgcaagatccccttcagtaccgaggacggccaggggaaggctcacaacggccgcctgatcaccgccaatccggtggtaacgaaaaaggaggagccggtcaacatcgaggccgagccgccctttggagagagcaacatagtgatcgggatcggggacaacgcgctgaagatcaactggtacaagaaggggtccagcatagggaagatgttcgaggcaaccgcccgtggcgccaggcggatggccatcctgggggacaccgcgtgggactttgggtccgtgggcggagtcctcaacagcctgggaaagatggtgcaccaaatattcgggtccgcctacaccgctcttttctccggcgtttcctgggtcatgaagatcggtatcggggttctcctcacgtggatcggtctgaactccaagaatacctccatgagcttctcctgcatcgccatcggaatcatcaccctctacctgggcgccgtggtccaggctgacatggggtgcgtgatcaactggaaagggaaggagctgaaatgcggcagcgggatcttcgtgacgaatgaagtccacacgtggaccgagcagtacaagttccaggccgactccccgaagcggctcgccaccgccatcgccggggcgtgggagaatggggtttgcggcattcgcagcacaacgcggatggaaaacctgctgtggaaacagatcgccaacgagctcaattacatcctgtgggagaacaatataaagttgacggtggtcgtgggggacatcatcggcgtgctcgaacagggcaagaggaccctgacgccccagccaatggagctgaagtacagttggaaaacctgggggaaggcgaagatagtaaccgccgagacccagaactcatccttcatcatcgacggcccaaatacccccgagtgccccagtgcgagccgggcttggaacgtgtgggaggtcgaggactacggcttcggtgtgttcactaccaacatctggctcaaactgagggaggtgtacacccagctgtgcgaccaccggctcatgagtgccgccgtgaaggacgagcgagccgtccacgctgacatgggctactggattgagtcccagaagaacgggagttggaagctggagaaggccagcctgatagaggtgaagacatgcacgtggccgaagagtcacactctctggagcaacggcgtgctggagtccgacatgatcatccccaagagcctggccgggcctatctcccagcacaaccaccggcctggctatcacacccagaccgcagggccgtggcacctcggcaagctggagctggacttcaactactgtgaggggaccacggttgtgatcaccgagaattgcggtacacgcgggcccagtttacggacgactactgtgtccggaaagctgatccacgagtggtgctgcaggagctgcacgctacccccgctccggtatatgggagaggacggctgctggtatggcatggaaatccggcccatctccgagaaggaggagaacatggtcaagtccctggtgtccgccggcagcggcaaggtggataacttcaccatgggcgtcctatgtctcgcgatcctgtttgaagaggtcatgcgggggaagttcggcaagaaacacatgatcgccggggtgttcttcaccttcgtcctgttactgtccgggcaaatcacctggcgcgatatggctcacaccttgatcatgatcggcagcaatgcctccgaccggatggggatgggcgtgacctacctcgcactgatcgcaactttcaagatacaacccttcctggcccttgggttcttcctgcgtaagctgaccagtcgggagaatctgctgctgggcgtcggcttggccatggccaccacactgcagctgcccgaggacatcgagcagatggcgaatggtatcgccctcggccttatggcgctgaaactcatcacgcagttcgagacctaccaactgtggacagccctgataagccttacctgcagtaacacgatcttcaccctgaccgtagcatggcgcacagcaacgctaattttggccggggtcagcctgctgccggtctgccagtcgagctccatgcggaaaaccgactggctccccatggccgtagctgccatgggcgtgccgcccctcccgctctttatatttagcctcaaggacacgctaaagcgccgctcgtggcccctgaacgagggggtaatggcggtgggccttgtgagtattctggcgtcctccctgttacggaacgacgtcccaatggccggccctctggtggccgggggtctcctcatcgcttgctatgtgatcaccgggacctccgctgatctgaccgtcgaaaaagccgccgacatcacctgggaggaggaggccgagcagaccggcgtgtcgcacaacctgatgatcacggtggacgacgacggtactatgcgaatcaaagacgacgagaccgaaaatatcctcaccgtcttactcaagactgccctcctgatcgtgtccggcatcttcccgtacagcatccctgcgacgctgctcgtatggcacacatggcagaagcagacgcaaaggtccggcgtgctgtgggatgtgcccagcccgcccgagacccagaaggccgagctggaagagggggtctatcgcatcaagcagcagggcattttcgggaagacgcaggtcggagtaggtgtgcagaaggagggcgtcttccacaccatgtggcacgtgacaagaggcgccgtcctaacccacaatggaaagcgcctggagcctaattgggcctccgtcaagaaggatctgatcagctacggcgggggctggcggctctccgcgcagtggcagaagggggaggaggtccaagtcatcgcggtcgagccaggcaagaaccccaaaaacttccagacgatgcctggcaccttccagaccaccacgggggagatcggcgcaatcgcgctggacttcaagcccggaaccagcggctcacctatcatcaaccgggagggcaaggtggtggggctgtacggaaacggggtcgtgaccaagaacggcgggtacgtaagtggcatcgcacagactaacgcggaaccggacggccccactcccgagctggaggaggagatgttcaaaaaacggaacctcaccatcatggatctgcaccccgggagcggcaagacccgcaagtacctgccggccatcgtcagagaggcaatcaaacgtcgcttgcgtaccctgatcctggccccaacccgggtggtcgccgcggagatggaggaagccctcaaggggctgccaatacgctaccagacaaccgctacgaagtccgagcacacgggccgggaaatcgtcgatttgatgtgccacgccacattcaccatgcgcctcctgagccccgtgcgggtcccaaactacaacctaataatcatggacgaggcccacttcaccgaccccgcgtccatcgctgcccgcggatacatcagcacgcgggtcggcatgggcgaggcggcggctatcttcatgaccgcaactccgcccgggaccgccgacgctttcccccagtcaaacgcgcccatccaagatgaagaacgcgatatccccgagagaagctggaactccggcaacgagtggatcacggacttcgcgggtaaaaccgtgtggttcgtgccctcaatcaaggcgggcaacgacatcgctaactgcctccggaagaacggcaagaaggttatccaactgtcacggaaaaccttcgacacagaatatcaaaagacgaagctgaacgactgggacttcgtggtgaccacggacatcagcgagatgggcgccaactttaaggcggaccgggtcatcgacccgcgccgttgcctcaagcccgtgatcttgaccgacggcccggaaagggttatcctggccggtcccatgccagtaaccgcagcctccgccgcgcagcggcgaggccgggtggggcgcaatccccagaaggaaaacgatcagtacatctttaccggccagcccctcaacaacgacgaggaccacgcccactggaccgaggcaaagatgctgttggataacatcaacactcccgaggggattatcccggcgctcttcgagcccgagcgggaaaaatccgcggccatcgacggagagtacaggctcaagggcgagtcgcggaagacgttcgtggagctaatgcggcgcggggacttgcccgtctggttagcccacaaggtcgcctccgagggcattaagtacacggaccgcaagtggtgctttgacggccagaggaacaatcagatattggaggaaaacatggacgtcgagatctggacgaaggagggcgagaagaaaaagttgcgccctcgatggctggacgcccgcacctactctgatccgctggccctcaaggagttcaaagactttgccgccggccgcaagagcatcgccttggatctagtgacggaaatcggtcgggttccctcccacctcgcccaccgcacgcggaacgcgctggacaaccttgtcatgctccacacctctgagcacggcgggcgcgcctaccgacacgccgtggaggagctgccagagaccatggaaaccctgctcctgctgggcctgatgatcttgctgaccggcggggccatgttgttcctgatcagcgggaaagggatcgggaagacctccatcgggctgatctgcgtgatcgcaagctccggcatgctttggatggccgagatcccgcttcagtggatagccagcgcgatcgtcctggagttcttcatgatggtgctcctgatccccgagcccgagaagcagcgcaccccccaggacaatcagctggcctacgtggtgatcggtatactcacgctggccgcgataatcgccgcgaacgaaatgggcctgctcgagacgactaagcgggaccttggaatgtccaaggagccgggggtggtgagccccacctcctacctggacgtagacctccaccctgcctcggcatggaccctgtacgccgtggcgaccaccgtcataactcccatgcttcgccacaccatcgagaactccacggccaacgtctccctcgccgcgattgccaaccaagccgttgtgctcatgggcctggacaagggttggccgatctcgaaaatggacctcggagttcccctcctggccttaggatgctactcacaggtgaaccccctgaccctgaccgccgctgtgctcttactgatcacccactatgcaattattggccccggcctccaggctaaggccacgcgggaggcccaaaaacgtaccgcggccggcatcatgaagaacccgaccgtagatggaatcatgaccatcgacttggaccctgtgatttacgactcgaagttcgagaaacagctgggtcaggtgatgctcctggtcctgtgcgcggtgcagctcctgctgatgcggacgagttgggccctctgcgaggcgctgacgctggccaccggcccaataacaacactctgggaggggtcgcccggaaagttttggaacaccaccatcgccgtaagtatggccaacatcttccgcggctcctacctggcaggggcaggcctggcgttcagcatcatgaagtccgtcgggaccggcaaacgcgggacggggagccaaggtgaaaccctcggcgagaagtggaagaagaagctgaaccagctgtcgagaaaggaattcgacctctacaagaaaagcggcatcaccgaggtcgaccggaccgaggcgaaggaggggctgaagcgcggcgaaatcacgcaccacgccgtcagcagggggtccgccaagctacagtggtttgtcgagcgcaacatggttatcccggaggggcgggtaatagatctcgggtgcgggcgcggcgggtggagctactactgcgcgggtctgaagaaggtcacggaggtgagaggctacaccaagggcgggcctgggcacgaggagcccgtacccatgtccacttacgggtggaacattgtaaagctcatgagtggcaaggacgtcttctacctcccacctgagaaatgtgacacacttctgtgcgacatcggcgagtccagcccgtctccgacggtagaggaaagccgcaccatccgggtactgaagatggtcgaaccatggttaaagaacaaccagttttgcatcaaggtcttaaacccctacatgcccaccgtgatcgagcaccttgagcggctccagcgcaagcacgggggcatgttggtgcggaaccccctttcccgcaacagcacacacgagatgtactggatctctaacggcacggggaatatcgtggcatccgtcaacatggtgtcgcggctcttgcttaaccgcttcaccatgacccaccgccgcccgacgatcgagaaagacgtggatttaggcgccgggacccggcacgtaaacgccgaacccgagacccccaatatggatgtaataggggaacggatcaagcggatcaaggaggagcacaactcaacctggcactatgatgacgagaacccgtacaagacctgggcctatcacggctcctatgaggtcaaggcgacggggagcgccagcagcatgataaacggcgtagttaagttgctgacaaagccctgggacgtcgtgcccatggtgacccaaatggccatgaccgacacaacccccttcgggcagcagcgggtgtttaaggagaaggtggacacaaggacaccgagatcaatgcccggcacgagacgcgtgatgggcataaccgccgagtggctctggcggaccttggggcgcaacaaaaagccccggctgtgcacccgcgaggagttcacgaagaaggtacgcaccaatgcggccatgggcgccgtgttcaccgaagaaaaccaatgggactccgctaaagccgcggtggaagacgaggacttctggaaactcgtcgaccgggagcgcgagctgcacaagctagggaaatgcgggagctgcgtgtacaatatgatggggaagcgggaaaagaaactcggcgagttcggcaaggccaagggcagccgcgccatctggtacatgtggcttggcgcccggtacctggagttcgaggcccttgggttcttaaacgaggaccactggttcagccgcgagaactcatatagcggcgtggagggggagggcctacataaactcggatacatcctgcgagacatctccaagattcccgggggcgcgatgtacgcagacgacactgccggttgggacaccaggatcaccgaagacgatctgcacaacgaggaaaagatcacacagcagatggacccggagcaccggcagcttgccaacgccatcttcaagctcacctaccagaataaagtcgtgaaagtacagcgccccacacccaccggcactgtcatggacatcatcagccgtaaggaccaacgcggctccggccaggttggcacgtacggcctgaatacctttacgaacatggaggcacaactcatccgacagatggagggcgagggtgtcttgagcaaagccgacttagagaatcctcacctcccggagaagaagataacccaatggctggagaccaagggagtcgagcgcctgaaacgtatggccatatctggtgacgactgcgttgtgaagcccattgacgaccgcttcgccaacgccctcctggcgctgaacgatatggggaaagtccgtaaggacatcccccaatggcaaccaagcaagggctggcacgactggcagcaagtcccgttctgttcgcaccacttccacgagctcatcatgaaggacgggcgcaagcttgtggtcccgtgtagaccccaggacgaactgatcggccgcgcccggattagccagggggcgggctggtccctccgcgagacagcctgcctcggcaaggcgtacgcgcagatgtggtcgctgatgtacttccaccgtcgggacttacgactagccagcaacgcgatctgtagcgccgtgcccgtgcactgggtgccgacttcccgaacgacatggagtatacacgcgcaccatcagtggatgaccacggaggacatgctgaccgtttggaaccgcgtgtggatcgaagacaatccctggatggaggacaaaacccccgtcaccacgtgggaaaacgtgccctaccttggcaagcgggaagaccagtggtgcggctcgctgatcgggctgacgtcccgcgcaacatgggcccagaacatccctaccgccatccagcaggtccggagcttaatcggcaacgaggagtttttggactatatgccatccatgaaacgcttccggaaggaggaggagagcgagggtgccatatggtag

SEQ ID NO: 25648 - RNA, 9873 nt, synthetic construct
  misc_feature 1..9873: note = derived and/or modified CDS sequence (opt11) from DENV-3__KT726352__SS-prME
  source 1..9873: mol_type = other RNA
accagcctgtgcctcatgatgatcctacccgccgcactggcgttccacctcacctctcgggacggagagccccggatgatcgtcggtaagaatgaacggggcaagtcactgttgtttaagaccgcctccgggatcaacatgtgcactttgatcgcgatggatctgggggaaatgtgtgacgacaccgttacgtacaagtgcccacatatcaccgaggtggagcccgaggatatagactgctggtgcaatctgacaagcacttgggtgacctacgggacgtgcaaccaggcaggcgagcaccggagggacaagaggtccgtggccctcgcgccccacgttggcatgggcttggacacccgcacgcagacctggatgagcgccgagggtgcctggcgccaggtggagaaggttgagacgtgggcgctgaggcacccggggttcaccatcctcgcactgttcttagcacattacatcggcacctccctcacacagaaggtagtgatcttcatcctgctgatgctcgtgaccccatccatgaccatgcggtgcgtcggtgtaggcaaccgcgatttcgtagagggcttatccggagccacatgggtcgacgtggtcctggagcacggagggtgcgtgactaccatggccaagaacaagcccaccctcgacatcgagctgcagaagacagaggccacccagctggcgacgttacgaaaactgtgcatcgaggggaaaataaccaacataaccaccgacagccggtgtcccacgcagggcgaggccgtgctaccggaggagcaggaccagaattacgtctgcaagcatacctacgtggaccgggggtggggcaacggttgcggcctgttcgggaaaggctccctggttacctgcgcaaagttccagtgcctggagcccattgagggtaaagtcgtgcagtacgagaacctcaagtacaccgttatcatcacggtccacaccggggaccagcaccaggtgggaaacgagacccagggggtcacagcggagatcactccccaagcctctacaaccgaagcgatactgcccgagtacggcaccctcgggctcgagtgctctccccgcaccggcctagacttcaacgaaatgatccttctcacgatgaagaacaaggcgtggatggtccatcggcagtggttcttcgacctgcccctgccgtggacaagcggcgccacgacggaaacgcccacctggaaccgcaaggagctcctggttactttcaaaaatgcccatgccaagaagcaggaagtcgtggtgctggggagtcaagaaggcgcaatgcacactgccctcactggcgcaaccgagatccaaaacagcggcggaacctccatcttcgctgggcatcttaaatgtcggctgaagatggacaagctcgagttgaagggcatgtcatacgccatgtgcaccaatacgttcgtgctgaagaaggaggtgtccgagactcagcacggaaccattctcataaaggtggagtacaaaggtgaggacgtcccatgcaagatccctttcagcaccgaggacgggcaaggcaaggcgcataatggcagactgatcacggccaaccccgtggtgacgaagaaggaggagcccgtcaacatagaggcggagccgccgttcggggaaagcaacatcgtgatcggcattggggacaacgcccttaagatcaactggtataagaagggatccagcatcgggaaaatgttcgaagctactgcaaggggcgcgcgccggatggccatcctgggagatactgcatgggacttcgggtccgtgggcggggtcttgaactccctgggcaagatggtgcaccaaattttcggcagcgcgtacacggcactgttcagcggcgtgtcctgggtcatgaaaattggcatcggcgtgctcctgacttggataggcctgaatagcaagaacacctccatgtctttctcctgcattgctatcgggatcatcaccttatatctgggcgccgtggtccaagccgacatggggtgtgtaatcaattggaagggtaaggagttaaagtgtggctccgggatcttcgtgacgaacgaggttcatacctggaccgagcagtacaagttccaagcggacagcccaaaacgtctcgccaccgccatagccggcgcgtgggagaatggagtttgcggcatccgcagtactaccagaatggagaacctgctgtggaagcagattgcgaacgagctgaactatatcttgtgggagaacaacatcaagctgacggtggttgtcggggacattatcggtgtgttggaacagggtaaacgcaccctcacgccccagccgatggagctgaaatacagctggaagacctgggggaaggcgaagatcgtcacggccgaaacccagaacagcagctttatcatcgatggcccaaatacgcccgagtgtccctcggcctcgcgggcgtggaacgtgtgggaggtagaagattacgggtttggcgtgttcaccaccaacatatggcttaagctgcgcgaagtgtacacccagctgtgcgaccaccggctcatgtcggccgcggtgaaagacgagcgcgctgtccatgccgacatgggctactggatcgagtctcagaagaacgggtcctggaaactggaaaaggcgagccttatagaggtaaagacctgtacgtggcctaagtcccacaccctttggagcaacggcgtgctggagtccgacatgattatccccaagagcctggccgggcccatttcccaacacaaccacaggccgggctaccatacccagactgccgggccctggcacttgggaaagctggagctagacttcaactattgcgagggcactaccgtggttatcaccgagaactgcgggacgcgcggacccagcctccggacgactaccgtatccgggaagctgattcacgagtggtgctgcaggagctgcacgcttccccctctcagatacatgggcgaggacggatgttggtacggcatggagatccgccccatctcagaaaaggaggagaatatggtcaagagcctggtctccgccggcagcgggaaggtggacaactttaccatgggcgtcctttgtttggccatcctgtttgaagaagtgatgcgggggaagtttggcaaaaagcacatgattgcgggggtgttctttacatttgtgctgctcctgtccggccagatcacgtggcgagacatggcgcataccttgataatgataggctctaacgcctccgaccggatgggaatgggcgtgacgtacctcgcactgatcgccacgttcaagattcagcccttcctggccctcgggttcttccttagaaagcttacgtcccgagagaacctcctgctgggcgtgggactcgccatggcaacaactctgcaactacctgaggacatagagcagatggccaacgggatcgcgcttggcttgatggctctgaagctcataacgcagttcgagacgtatcagctctggaccgcgttaatcagcctcacttgcagcaataccatcttcactttgacggtcgcatggcgcacggctacccttatactggccggggtctctctgctgcccgtctgccagtccagctccatgcggaaaaccgactggttacccatggcagtggccgcaatgggcgtgccaccgctcccattattcatcttctcactaaaggacaccctgaagagacgctcgtggcccctcaacgagggggtcatggcggtgggcttagtcagcatcctggcatccagcctgctccgcaacgatgttccaatggccggtcccttggtggcaggtggcttgctcatcgcctgctatgtgatcaccgggacctccgccgacctgaccgtcgagaaagcggcggacatcacctgggaagaagaggccgagcagacgggcgttagccataacctgatgatcaccgttgacgacgatgggacaatgcgcatcaaggacgatgagaccgaaaatatcctcaccgtcctactgaaaacggccctattgatcgtgtccggaatcttcccctacagcattcctgccaccctgctcgtgtggcacacctggcagaagcaaactcagcgttccggggtcctatgggacgtccccagccctcccgaaacgcagaaggcggagctggaggagggggtgtaccgcatcaaacagcagggcatctttgggaagactcaagtcggcgtgggcgtgcagaaggagggcgtcttccataccatgtggcacgtgacccggggagccgtcctcacgcataatggaaagcgtctggagcccaactgggcctccgtcaagaaggacctgattagctacggcgggggctggcgtctgtccgcccagtggcagaaaggggaagaagtccaggtgattgcggttgaacccggtaagaaccctaagaacttccagaccatgccaggcaccttccagactaccaccggggagataggcgccattgccctggacttcaagcccgggaccagcgggtccccgattatcaaccgcgaaggcaaggtggtgggactgtacggcaacggggtcgtgaccaagaacggcgggtacgtatcgggcatcgctcagactaacgccgagccggatggcccaactccggagctcgaagaggagatgtttaagaagcgcaatctgaccataatggacctgcaccccggctctggcaagacccgcaagtacctgccggcgatcgtcagagaggccattaagcgccggctccgcacgctgatcctggcgccgaccagggtggtggccgccgagatggaagaagcacttaaggggttgccaatcagatatcaaaccacggcaacgaagtccgagcacaccggccgggaaatcgtcgatctgatgtgccacgccaccttcaccatgcgtctattatcgccagtccgtgtgccgaactacaacctaatcatcatggacgaagcgcacttcacggaccccgcctccattgcggccagggggtatatcagcacccgcgtcggtatgggcgaagccgcagcgatcttcatgactgctacgcctcccgggaccgccgacgccttcccgcagagtaacgctcccattcaggacgaggagcgcgacatccccgagcgcagctggaactccggcaacgagtggatcaccgacttcgcggggaagaccgtgtggttcgtcccgtctatcaaggccggtaatgatatcgccaattgcctccggaaaaacgggaagaaggtcatccaactgtcgcgcaagaccttcgacacggagtaccagaaaaccaaactgaacgattgggatttcgttgtgaccaccgacatcagcgagatgggggccaactttaaggctgatcgggtcatagacccgcgccggtgtttgaagcccgtgatcctgacggacggccccgagcgggtgatattagctgggcccatgccggtcaccgccgcctctgcagcccagcggcgcggccgcgtgggacgcaacccccagaaggagaatgatcagtacatcttcaccggtcagcccctcaacaacgacgaggaccacgcccactggacggaggccaagatgctcctggacaacatcaacacgcctgaggggatcatcccggccttgttcgagccggagcgggagaagtccgccgcgatagatggtgaatacagactgaagggcgagtcgcggaaaacgttcgtagagctgatgcgccgcggggacctccccgtttggctggcgcacaaggtggcttctgagggtatcaagtacaccgatcgtaaatggtgctttgacggtcagcggaataaccagatcctggaggaaaacatggacgtggaaatctggacgaaggagggcgagaagaagaaattacgcccccggtggctggacgcacgcacctactccgacccgctggccctcaaggagtttaaggatttcgcggctggcaggaagagtatcgccctggatctggtgacggagatcgggcgggtgcccagccatctcgcacaccgcacccggaacgcgctggataatctggtaatgttgcacacgagcgagcacggcgggagggcgtatcggcacgctgtggaagaactccctgagacaatggagactctgctcctactgggcctcatgatcctgttgaccgggggtgccatgctgttcctgatcagcggcaaggggatcggaaagacatccatcggtctgatctgcgttatcgccagctctggcatgctctggatggcggaaatccctctacaatggatcgcgagcgccatcgtcctggagttctttatgatggtgttgctaatacccgagcccgagaagcagcgaacgccccaggacaaccagttggcctacgttgtaatagggatactcacgctagccgcgatcattgcggccaacgaaatgggacttctggagaccaccaagcgcgatctgggcatgtccaaggagccgggggtggtgtctcccacatcctacctagacgtcgacctccaccccgccagcgcatggacgctgtacgcggttgccaccaccgtgatcacgcccatgctgcgccacactatcgagaactccaccgccaacgtgagcctcgctgctatcgcgaaccaggccgtggtcttgatgggcctagataagggatggcctatctccaagatggacctcggcgtcccccttctggccctcgggtgctactcgcaggtgaaccccctaactctgaccgccgccgtgctcctactgatcacacactacgcgatcataggccccggcctccaggccaaggccacccgcgaggcgcagaagcgcaccgccgcggggatcatgaagaacccaaccgtcgacggcatcatgacgatcgaccttgaccccgtgatctacgactccaagttcgaaaagcagctgggccaggtaatgctcctggtcctgtgcgcagtgcaactcctgttgatgcggaccagctgggcgttatgcgaagccctgaccctggcgaccggcccgatcacgacgctctgggagggttcacccgggaagttctggaacacaacgatcgccgtgtcaatggctaacatcttccgcgggagttacctggctggggcgggccttgccttcagcattatgaaaagcgtcggtactggcaagcggggcacaggaagccaaggagagaccctcggggagaagtggaagaagaaactcaatcaactgagcagaaaggagttcgacctctacaagaaaagcggcatcaccgaggtggaccgaaccgaggcgaaggaggggctgaagcgcggggagatcacgcaccacgccgtgagccgtgggtccgccaagctccagtggttcgtcgagaggaacatggtgatcccggagggtcgggtgatcgatctcggctgcgggcgaggaggttggagctactactgtgcgggcctgaagaaagtcacggaggtgcggggctacaccaaaggggggcccggtcatgaggaacccgtacccatgtctacctatggctggaacatcgttaagctgatgagcggtaaggatgtgttctatctcccacccgagaagtgcgacacgctgctttgcgacattggtgagtcatcaccgtccccgaccgtggaagagtcacgcaccatccgcgtcttaaaaatggtggagccgtggctcaagaacaatcaattttgtataaaggttctgaacccctacatgccaacagtcattgaacatctggagcgcctccagaggaagcacggcgggatgctggtgaggaacccgctgtcccgcaacagtacgcacgagatgtactggatctcgaacggaaccgggaacatcgtcgcgtcagtcaacatggtcagtcggctcttgctgaatcgatttacgatgacacaccggcgcccggctatagagaaggacgtggacctaggcgccgggacacggcacgtcaacgccgaacccgagacccccaacatggacgtgatcggggagcgcatcaagcggattaaggaagagcacaatagcacctggcactacgatgacgagaatccgtacaagacttgggcgtatcacggctcctacgaagttaaggcgactgggtcggcctcaagcatgatcaacggcgttgtgaaactgctgaccaaaccctgggacgtcgtgcccatggtgacccaaatggccatgaccgacacaacccccttcgggcagcagcgtgtcttcaaggagaaagtggacacgcggacccctcgcagcatgcccggcacgcggagagtcatgggcattacggcagagtggttgtggaggaccttggggcggaacaagaagcccagactttgcacccgcgaggagttcacgaagaaggtcaggaccaacgctgccatgggcgccgtattcaccgaggagaatcaatgggactctgcaaaagccgcggtggaggacgaggacttctggaaactcgttgaccgggaacgcgagctgcacaagctgggtaagtgcggcagctgcgtgtacaacatgatggggaagcgggagaagaaacttggcgaattcggcaaggctaaagggtcccgcgccatatggtacatgtggctcggcgcccgatacctggagtttgaagccctcgggttcctgaacgaagatcattggttcagccgagagaactcctacagcggcgtagagggggaaggactgcacaagctcggctacattcttcgggacatctccaagatccccgggggcgcgatgtacgccgatgataccgccgggtgggacacgcgcataactgaagatgacctgcacaacgaggagaagattacccagcaaatggacccggaacatcgtcagctagccaatgccatcttcaaactgacttaccagaataaggtcgtaaaggtgcagcgccccacgccaaccggcactgtcatggatattatctcgaggaaggaccagcgcggctccggacaggtgggcacttacgggttaaacaccttcactaacatggaggctcaactcatccggcagatggagggcgagggagtactttcaaaagccgacctggagaatccccacttgccggagaagaagattacccagtggctggagacaaagggagtcgagcgcctgaagcggatggccatcagtggagacgactgcgtggttaagcccatcgacgaccggttcgcgaacgccctgcttgcgctgaacgatatggggaaggtgcggaaggacatcccccagtggcagcccagcaagggctggcacgactggcaacaggtgcctttctgttcccatcacttccacgagctgataatgaaggacgggcggaagctggtcgtcccgtgccggccccaggacgagctgatcggccgagcccggatctcacagggggccggctggtccctccgggagaccgcctgcctgggcaaagcatacgcccagatgtggagcctgatgtatttccaccgcagagatctgcgcctggcttctaacgctatctgcagcgcagtccctgttcactgggtaccgacgtcccggactacctggagcatccatgcgcaccaccaatggatgaccacggaagatatgctgaccgtctggaatcgcgtgtggatcgaggacaatccctggatggaagacaaaacccccgtcaccacgtgggagaacgtgccgtacctgggtaagcgggaggaccagtggtgcggtagcctgatcgggttaacctcccgagccacctgggcccagaacatcccgactgcaatccagcaggttaggagcctcatcggcaacgaggagttcctggactacatgccctccatgaagagattcaggaaggaagaggagagcgaaggggccatctggtga

SEQ ID NO: 25649 - RNA, 9873 nt, synthetic construct
  misc_feature 1..9873: note = derived and/or modified CDS sequence (opt11) from DENV-3__KT726356__SS-prME
  source 1..9873: mol_type = other RNA
accagcctgtgcctcatgatgattctgcccgcagcactcgcgttccacctcacctcacgggacggagagccgaggatgatcgtggggaagaatgagcggggcaaatctctgctgttcaagaccgcctcaggaatcaacatgtgcacactgatagctatggacctgggcgagatgtgcgacgacacagtgacatacaagtgcccccacattaccgaggtcgaacccgaggatatcgactgttggtgcaatcttacgtcaacctgggtcacatatgggacgtgcaaccaggcaggggaacaccgtcgggacaagcggagtgttgccctcgcgccacacgtgggaatgggcctggacacccgcacccagacctggatgtcggccgagggcgcatggcgccaggtggagaaagtagagacctgggctctgcggcacccagggttcaccatcttagcgctattccttgctcactacatcggcaccagcctcacccagaaagtggtgatcttcatcctgttgatgctcgtcacgccgagcatgactatgcggtgcgttggtgtcggcaacagagacttcgtagaagggctgtccggggccacctgggttgacgtggtcctcgagcatggcgggtgcgtgaccacgatggccaaaaacaaacccaccctcgacatcgaactgcaaaagaccgaggcaacccaactagccacgctcaggaaactctgtatcgagggaaagatcaccaacataaccactgacagccgctgccccacgcagggagaggctgtgctgccggaggagcaggaccagaactacgtatgcaagcacacatatgtggaccgcgggtggggaaacggatgtggcctctttgggaaggggtccctggtgacctgcgccaagtttcaatgcctggagccaatcgagggaaaggtagtacagtacgaaaacttgaagtacactgtaatcatcaccgtccacaccggggaccagcaccaagtgggcaacgaaacgcagggggtcaccgccgaaatcacgccacaagcatcaaccaccgaggcaattttgcccgagtacggcactctcgggttagaatgcagcccgaggaccggactggatttcaacgagatgatcctcctcacgatgaagaacaaggcttggatggtgcaccggcagtggttcttcgacttacccctgccctggacctctggcgccaccaccgagacaccgacctggaatcgcaaggaacttttggtgacgttcaagaacgcacacgccaagaagcaagaggtagtggtgctggggtcacaggagggcgctatgcacaccgccttgacgggggccacagaaatccaaaatagcggagggaccagcatcttcgccggccacctgaaatgccggctgaagatggacaagctcgagttaaagggaatgagctacgccatgtgcacaaatacgtttgtcctgaaaaaggaggtgtccgagacccagcacggtactatcctcatcaaggtggagtacaagggcgaagacgtgccgtgtaagatccccttcagcaccgaggatgggcaggggaaggcgcataacggccgcctcattacggctaacccagtagtgacgaaaaaggaggaacccgtcaacatcgaagccgagccgcccttcggggagagcaatattgtgatcggcataggtgacaacgccttaaagatcaattggtacaagaagggttccagtataggcaagatgttcgaggcaaccgcgcggggggctcgtcggatggccattctgggtgatacggcatgggacttcgggtccgtcggcggggtgctcaactcactgggaaagatggtacaccagatttttggctccgcgtacactgccctgttcagcggggtgtcatgggttatgaagataggcattggggtgctcctgacctggatcggtctgaactctaagaacaccagcatgagcttttcctgtatcgctatcggtattatcaccttatatctgggcgccgtagtccaagccgacatgggatgcgtgatcaattggaagggcaaagagctgaagtgcgggagcggaatcttcgtgacgaatgaggtgcacacgtggacggagcagtataaattccaggctgactccccaaagagattggccaccgcgatagccggcgcctgggagaatggggtgtgcggcatcaggagcacgacccggatggagaacttgttatggaagcagatcgcgaatgagttaaactacatcctgtgggagaacaacattaagctgaccgtggtcgtgggggacatcatcggtgtgctcgagcagggcaagcgtacactgacgccccagccgatggagctgaagtacagctggaagacctgggggaaggccaagatcgtcactgctgagacccagaacagctcgttcatcattgacggccccaacacgcccgagtgcccctcggcgtcccgggcgtggaacgtgtgggaggtagaggactacgggtttggcgtattcaccaccaacatctggctaaagctgcgcgaggtgtacacccagctctgtgaccaccggttgatgagcgcagcagtgaaagacgaacgggcagtacacgcggacatgggttattggatcgagagtcaaaagaacgggtcctggaagcttgagaaggctagcctcatcgaagtgaagacgtgtacgtggccgaagtcccatacgctctggtctaacggcgtgttagagtccgacatgattattcccaaatcgctggccgggccaatctcgcagcacaatcaccggccgggctaccacacccagacagctgggccctggcaccttggcaagctcgagctggacttcaactattgtgagggaacgacggtcgtcatcaccgaaaattgcggaacacgcggccccagcttacggacgaccaccgtgtccgggaagctgatccacgagtggtgctgcagaagctgcacgctgcccccgctccgttacatgggcgaggatgggtgttggtacggcatggagattcgacccatctccgaaaaagaggagaacatggtcaagagtctggtgtctgcaggctcagggaaggtagacaacttcacgatgggggtcttgtgccttgcaatcctgtttgaggaggtgatgcgggggaagtttgggaagaagcacatgatcgcaggggtctttttcacattcgtcctactcctttccggacaaatcacctggcgcgatatggcccataccctgatcatgatcgggagcaacgcatcggatcggatggggatgggcgtgacgtacctcgccttaatagccaccttcaagatccaacccttcctggcgctcgggttcttcctgcgcaagctgacaagccgagaaaacctcctgctgggggtgggactcgccatggccactacgttacagctcccggaggacatcgagcagatggccaacgggattgcgctcggccttatggctttaaagcttatcacccagtttgagacctaccaactgtggaccgccctgatcagcctgacctgctccaacaccatcttcactctaaccgtcgcttggcgtacggctaccctgatactcgcgggtgtttcgctgctacccgtctgtcaatcctcatccatgcggaagaccgattggctccccatggcggtcgccgccatgggagttccgcctctgccgctgttcatttttagcctcaaggacaccctgaaacgccgctcttggccgctgaacgagggagtaatggctgtgggcctcgtttcgattctggcgtccagcctgctccggaacgacgtccccatggccggcccactgctggctggaggcttattaattgcctgctacgtgatcactggcacctcggccgacctgacggtggagaaggcggccgatatcacctgggaggaagaggccgagcagacaggcgtcagccataacctcatgatcaccgtggacgacgacgggaccatgcgtattaaagacgacgagaccgagaacatactgactgtgctgctcaagacggcgttattgatcgtctccggcatttttccgtacagcatccccgccacactcctggtgtggcacacctggcagaagcagactcagcggtccggcgtactgtgggacgtcccatctcctcccgagacgcagaaggcggaactcgaggagggggtgtaccgaatcaaacagcaagggatatttgggaaaacccaagtgggcgtaggggtgcagaaggagggcgtctttcataccatgtggcacgtaacccggggcgccgtgctgacgcataatggaaagcgcctggagcccaactgggcctcggtgaaaaaggatctcatctcttatggcgggggctggaggttatcggcccagtggcagaagggagaagaagtccaggtaattgcggtggagcctggtaaaaaccccaaaaatttccagaccatgcccggtactttccagacaaccacaggcgagatcggcgccatcgccctggatttcaagcccggtacatctggctcccccataatcaaccgcgaggggaaggtcgtggggttatacggtaacggagttgtcacaaagaacggcgggtacgtgtccggcatagcacagacaaacgccgagccggacgggccaacacccgagttggaggaagagatgtttaaaaagcgcaatctgaccatcatggacctgcacccggggagcggcaagacgcgcaagtacctcccggcgatcgttcgggaggccataaagaggagactgcgcacgcttatcctcgcgcccactcgggtagtggccgccgaaatggaggaggcgctcaagggcctccccatccgctaccaaaccaccgctacaaagtccgagcacacaggccgggaaatcgtcgacctaatgtgccacgccaccttcactatgcgcctgctcagccccgtccgcgtaccgaactacaacctaatcatcatggacgaggcacacttcacggaccccgcctcgatcgctgcccgcggctacatcagcactcgcgtcggtatgggcgaggcggctgcaatattcatgactgcgaccccaccaggcacggccgacgccttcccgcagtccaatgctcccatccaagacgaggagcgcgacatccccgagcgcagctggaactccggcaacgaatggatcaccgacttcgcagggaagacggtctggtttgtgccctctattaaggcaggcaacgacatcgccaactgcctgcggaagaatgggaagaaggttatccagctgtcccgcaagaccttcgacacggagtatcagaagaccaagctcaacgactgggacttcgtggtgaccaccgacatttctgagatgggcgctaatttcaaagccgatcgggttatcgacccccgccggtgcctgaagcccgtcatactgacagacggcccagaacgcgttatcctcgcaggacccatgcctgtgactgccgcctccgccgcccaacggcgcggccgggtcgggcgcaatcctcaaaaggagaacgatcagtacatcttcactggccaacccctgaacaacgacgaggaccacgcgcactggaccgaggctaagatgctgctcgacaacatcaacacccccgagggaattataccggccctgttcgaaccagagcgcgagaaaagcgctgcgatcgacggcgagtaccgcctgaaaggcgaatcgcggaagaccttcgtggaacttatgcgacgcggggatttaccagtttggttggcccacaaagtcgcaagcgaggggatcaagtacaccgaccgcaagtggtgcttcgatggacagcgcaacaaccagatcctcgaggagaacatggacgtggagatctggaccaaggagggcgagaagaagaagctgcgccccagatggctggacgcccgcacctattccgatcccctcgccctaaaggagttcaaggacttcgctgccggccgcaagagcattgccctggacctcgtcaccgagataggccgagtgcctagtcacctcgcacatcgcactcggaacgccctggataacctcgtgatgcttcacacctcagaacatggggggcgcgcgtaccggcatgccgtcgaggagctgcccgagactatggagactctcctgctgctcggcttgatgatcctactcacaggaggcgccatgctgttcctgatctcagggaagggaatcggcaaaaccagtatcggcctcatctgcgtgatcgcgtcatccggcatgctgtggatggccgagatcccgctgcaatggatcgcgagcgccatagtcctcgagttcttcatgatggttctgctgatccccgagcccgagaagcagagaacgccccaggacaaccagctagcctacgtcgtgatcggtatcctgacgttggccgcgatcatcgcagctaatgaaatgggcctcttggaaaccacgaagcgggatcttggcatgtccaaggagcctggggtcgtcagcccgacttcctacctcgacgtggacctgcacccagccagcgcctggacgttgtacgcggtcgccaccaccgtgatcaccccaatgctccgccatacgatcgaaaactccaccgccaacgtaagcctggccgctatcgcgaaccaggccgtcgtgttgatgggcctggacaagggttggccgatctcaaaaatggacctgggcgtgcccttgttagccctggggtgctattcacaggttaaccccctgacactcacggccgccgtgctgcttttaatcacccactacgcgatcatcggtccaggccttcaggccaaggccacccgggaagcccaaaaacgcaccgcggccggaataatgaagaacccaacagtggacggcatcatgaccatagacctggaccccgtcatctacgactccaagttcgaaaagcagcttggccaggttatgctgctggtcctctgcgccgtccagctgttgctcatgcggaccagctgggccctgtgcgaagccctcacgctcgcgaccggccccatcaccaccctctgggagggctccccagggaagttttggaataccacaattgccgtgagcatggccaacatcttccgcggctcttatctggccggggcaggcctcgcgttcagcatcatgaagtccgtggggacgggtaagcgaggcaccgggagccagggggagactttgggggagaagtggaagaagaaacttaaccaacttagtcgcaaggagttcgacctgtacaagaagtcaggtatcaccgaggtcgaccggaccgaggccaaggaggggttaaagcggggcgaaattacgcaccacgccgtgagccggggctccgccaagctccagtggttcgtggagcgcaacatggtcatcccggaggggcgggtaatcgaccttggctgcgggcgcggagggtggagctattactgcgccgggttgaagaaggtgaccgaggtgagaggctacaccaagggcgggcccggtcacgaggaaccggtgcctatgtccacgtacggctggaacatcgtgaagctcatgagcgggaaggacgtcttctacctaccgcctgagaagtgtgacacgctgttatgcgatatcggcgaatccagcccctcccccaccgtggaagaaagccggactatccgcgtgctcaagatggttgagccgtggctgaagaacaatcagttttgcatcaaggtactgaacccatacatgcccaccgtgatcgaacatctcgaacggctgcagcgcaagcacggcgggatgctggtcaggaacccgctatcccggaatagcacgcatgagatgtactggattagtaatggcactggtaatatcgtggcctctgtgaacatggtctcccggcttctgctgaaccgatttactatgacttaccggagaccgacgatcgaaaaggacgttgacttaggcgccgggacccggcatgtgaacgctgaacccgagacccccaatatggacgtcatcggcgaacgcatcaagcggatcaaggaggagcataacagcacctggcactacgacgacgagaatccttacaagacgtgggcatatcacggctcctacgaagttaaggcaaccgggagcgcgtccagcatgatcaacggcgtggtcaagctgctcaccaaaccttgggacgtggtcccgatggttacccagatggcaatgacggacaccaccccgttcggtcaacaacgcgtgttcaaggagaaagtagacacccggacgcctcgcagtatgcccgggacccggcgcgtaatgggcatcaccgccgagtggctatggcggaccctcgggagaaacaagaagccccggttgtgtacgcgcgaggaattcaccaaaaaggtgcgcacaaacgccgcgatgggcgccgtgttcaccgaagagaaccaatgggactccgccaaggcagccgtggaggatgaggacttctggaagctcgtggaccgggagcgcgagttgcacaagctggggaagtgtggcagctgcgtctacaacatgatggggaagcgggaaaagaagttaggtgaattcggcaaagcgaaggggtcccgagcgatttggtatatgtggctgggcgcccggtacctcgaatttgaggccctggggtttctgaacgaggaccactggttcagcagagaaaactcctacagcggcgtggagggggagggcctccacaagctgggctacatcctacgggacattagtaagatcccaggtggggcaatgtacgcggacgacacagccgggtgggacacacgcatcaccgaggacgacttacacaacgaggagaagatcacccaacagatggatcccgaacaccggcagctggcaaacgccatcttcaagctgacgtaccagaacaaagtggtcaaagtgcagcgccccacccccaccggtaccgtgatggacatcatttcgcgtaaggatcagcgcgggagcgggcaggtcggcacctacgggcttaacacattcaccaacatggaggcccagctgatacgtcaaatggaaggggagggggtactgtcaaaggctgacctcgagaaccctcacctgcccgagaaaaagatcacccaatggctggaaaccaaaggtgtggagaggcttaaacggatggcaattagtggagatgactgcgtggtgaagcctatcgatgatcgcttcgcaaacgccctgcttgcactcaacgatatgggtaaggtgcgcaaggacattccacagtggcagccgtcgaaaggctggcatgactggcaacaggtcccgttttgctcgcaccatttccacgagctgatcatgaaggacggccgcaagcttgtggttccctgccggcctcaggacgagctcattggccgcgcgcggatcagccagggggccggctggtccctgagggagacggcctgcctgggcaaggcctacgcgcagatgtggagcctaatgtactttcaccgcagggacctacgcttagcctccaatgccatctgcagcgccgtccctgtacattgggtaccaacctcccggacgacctggagcatccacgcccatcaccagtggatgacgacggaggacatgctcaccgtctggaaccgtgtgtggatcgaggacaacccctggatggaagacaagacccccgtgacgacctgggagaatgtcccttacctggggaagcgggaggaccagtggtgtggctcactgatcggcctcacgtcgcgggcgacctgggcacagaacatcccaacggccatccagcaggtccgaagcctgatcggcaatgaggagtttctggactacatgccctccatgaagagattccgtaaggaggaggagagcgagggggccatctggtga

SEQ ID NO: 25650 - RNA, 9873 nt, synthetic construct
  misc_feature 1..9873: note = derived and/or modified CDS sequence (opt11) from DENV-3__KT726342__SS-prME
  source 1..9873: mol_type = other RNA
acctccctttgtcttatgatgatcctccccgcggccttggcgttccacctcaccagccgggacggggaaccccggatgatcgtgggtaaaaacgaacggggcaaaagcctgctttttaagacggcttccggtatcaacatgtgcaccctcatcgcgatggacctcggggagatgtgcgacgacaccgtgacctacaagtgtccacacattactgaggtagaacccgaagacattgactgctggtgcaacctcaccagcacctgggtaacgtacgggacgtgcaaccaggccggcgaacaccggcgggacaagaggtccgtggccctcgcgccccacgtggggatggggctggataccagaacccagacctggatgagcgctgagggcgcctggcgccaggtggagaaggtggagacgtgggccctccgccacccgggattcaccatcctcgcactcttcctggcccactacatcggcacctcccttactcagaaggtagtgattttcattctgctgatgctagtcacgcccagcatgaccatgcggtgcgtgggggtgggtaatcgtgatttcgtcgaaggtctctccggggcaacatgggtggacgtagtcctggagcacggagggtgcgtaaccacgatggccaagaataagcccaccttagacatcgagctgcagaaaactgaagccacccaactggcgacgctccggaagctatgcatcgagggtaagatcactaacatcaccaccgacagccgctgccccacgcagggcgaagcagtgttaccggaagaacaggaccagaactacgtctgtaagcacacctacgtcgacagaggttgggggaacgggtgtggcctcttcgggaagggctccctggtgacctgcgctaagttccagtgcctggagcccatcgagggcaaggtagttcagtacgagaacctcaagtacaccgtcatcatcacggtccacactggggaccagcaccaggtgggcaacgaaacgcagggtgtcaccgccgaaatcacgccccaggcgagtaccaccgaagcgattctgcccgagtatggtacgctcgggctcgagtgcagcccccgcacgggcctggacttcaacgaaatgatcctgctcacgatgaaaaacaaggcctggatggtgcaccgccagtggttcttcgaccttcccttgccctggacctctggcgccactactgagacgcccacctggaaccgcaaggagctcttggtgaccttcaagaatgcccacgcgaagaagcaggaggtcgtggtgctcggcagtcaggagggcgcgatgcacaccgcgctaacgggtgccaccgagatccaaaactcgggcgggacctccatctttgccggacacctcaagtgccggctgaagatggacaagctcgagctgaaaggcatgagctacgccatgtgcaccaatacgttcgtcctgaagaaggaggtgtccgagacgcagcacgggacaatcctcatcaaagttgagtacaaaggagaggacgtgccgtgtaagattcccttcagcaccgaggacgggcagggcaaagcgcacaacggccgcctgatcacagccaacccagtggtgaccaagaaggaggagcccgtcaacatcgaggccgagccgcccttcggggagagcaacatcgtgatcggcatcggggacaacgccctgaagatcaactggtacaaaaagggctccagtatcggcaagatgttcgaggcgaccgcacggggcgcccgccggatggccatcctgggcgataccgcgtgggatttcgggtctgtgggcggggttttgaatagcctgggcaagatggtgcatcagatctttgggtctgcgtatacggccctgttcagcggtgtgtcctgggtcatgaagatcggcatcggggttttgttaacctggatcggcctgaacagcaagaacacttccatgagcttcagttgcatcgccatcggaatcattaccttatacctgggagccgtggtccaggccgacatggggtgtgtgatcaactggaaaggcaaggagctgaagtgcggcagcggaatcttcgtgacgaacgaggtgcacacctggacggagcaatataagttccaggcggatagtcccaagcgcctcgccaccgcgatcgcaggcgcctgggagaacggggtgtgcgggatccgtagcaccacgcggatggagaacctcctgtggaagcagatcgcgaacgagctcaattacatcctgtgggagaacaacattaaacttaccgtagtcgtaggggacatcatcggcgtcctcgagcagggcaagcgcaccttgacgcctcagccgatggagctgaagtactcctggaagacctggggcaaggccaagatcgtgaccgctgaaacacaaaactcatccttcataattgacggccccaatacccccgagtgtcccagcgcctcgcgagcgtggaacgtgtgggaggtggaggactacgggttcggcgtcttcaccacgaacatatggttgaaattacgcgaggtctatacccagctgtgcgatcaccggctcatgagcgcagccgtgaaggacgagcgtgccgtccacgccgacatgggctactggatcgagagccaaaagaacgggtcctggaagctggagaaggcgtcgctaatcgaggttaagacctgtacgtggccgaagtcccacacactctggagcaacggagttctggaatctgatatgatcattcccaagagcctggccgggccaatctcccagcacaaccacagaccgggctaccacactcagaccgccgggccatggcacctcgggaagctggagctggacttcaactactgtgaaggcacgaccgttgtgatcactgagaactgcgggacccgcggcccctcactcaggacgaccaccgtatccgggaagttgatccacgaatggtgttgccgcagctgcaccctgcccccgctccggtatatgggagaggacgggtgctggtacggcatggagatccgccccatctccgagaaggaggagaatatggtcaagtcactggtgtccgcgggcagcgggaaggtggataatttcactatgggcgtcctgtgcctcgccatcttatttgaggaggttatgcggggaaaattcggaaagaagcacatgatcgcgggagtcttcttcaccttcgtcctgctcctgtccggccagataacctggcgcgacatggcacacaccctgatcatgataggcagcaacgcctccgacagaatggggatgggcgtaacgtacctcgccctaattgccaccttcaagatccagcccttcttggcgctcgggttcttcctgcgcaagctcacaagtcgggagaacctcctcttaggtgtggggctcgcaatggccaccacgctgcagctgcccgaggacatcgagcagatggccaacgggatcgcgctcggcctgatggccctgaaattgatcacccaattcgagacctatcaactatggaccgccctgatctctttaacgtgctccaacaccatcttcaccctgaccgtcgcctggcgaacggccacgttgatactcgcgggggtgagtctgctaccggtctgccagtccagctccatgcggaaaaccgattggctacccatggccgtggccgccatgggtgtgccgcccctcccgctgttcatattctccctcaaagacaccctgaagcgccgctcctggcctctgaacgagggggtcatggctgtcggattggtgagcatcctggcatccagcttacttcggaacgacgtccccatggccggtcccctggttgccgggggcctactcatcgcgtgctacgttataaccggcacctccgcggacctgaccgtggagaaggcggccgacataacctgggaggaagaggccgagcagacgggcgtgtcacacaatctgatgataaccgtggacgacgacgggactatgcgcatcaaggacgacgagacagagaacatcctcacggtcctgctgaagacagccctcctcatcgtttccggcatcttcccctatagcatccccgcgacgttgctcgtgtggcacacctggcagaaacagacccaacggtcaggcgtcctgtgggacgtgccctcgccgccggagacgcaaaaagcggaactggaagagggggtgtaccgcattaagcagcagggcatcttcggaaagacccaggtcggtgtgggggtgcagaaggagggcgttttccacacaatgtggcacgtgacgcgaggcgcggtgctcacgcacaacgggaagcgcctggagcccaactgggcctccgtcaagaaggaccttatctcctacgggggcggttggcggttgtcggcccagtggcagaagggtgaggaagtccaggtgatcgcggtcgagcccggcaagaaccccaagaatttccagacaatgcccggcaccttccagaccacaaccggagaaatcggcgccatcgctctggattttaagcccgggaccagcggctcgccgatcatcaaccgcgagggcaaggtggtggggttatacggcaacggcgtcgtgactaaaaacggcgggtacgtctccggcatcgcccaaacgaacgccgagccggacggccccacccccgaactggaggaagagatgttcaagaagcggaacctcaccatcatggacctgcatccagggtcgggcaaaacccggaaatacctgccggcgatcgtccgggaggcaataaaacgccgcctcaggacgctgatcttggccccgacgcgcgtcgtagccgctgagatggaggaggcgctcaaggggctgcccatcagataccagaccaccgctacgaaatccgagcacaccggcagggagatcgtcgacctcatgtgccacgccacctttactatgaggctcctaagccctgtacgggtgccgaactacaacttgataataatggacgaggcccactttacggaccccgcctccattgctgcccgcggctacatcagcaccagggtcgggatgggcgaggccgccgcaatcttcatgaccgccacgccgcccggtacggccgacgcctttccgcagtccaacgccccaatccaggacgaggagcgcgacatccccgagcgcagctggaactccggcaacgaatggatcaccgacttcgcgggaaagaccgtgtggttcgtgccatccatcaaggccggaaatgacatcgccaactgcctccggaagaacggcaagaaggtcatccagctgtccagaaagacctttgacactgagtaccagaagaccaagctgaacgactgggacttcgtggttaccaccgacatcagcgaaatgggcgccaacttcaaggccgaccgggtgatcgacccgaggcgctgtctgaagcctgtgatcttaacggacggccccgagcgcgttatcctggctgggcctatgccggtcaccgccgcctccgccgcccagcggagaggcagagtggggcgcaacccccagaaggagaatgaccaatacatcttcaccggccagcccctcaacaacgacgaggatcacgcgcactggaccgaagctaagatgctgctggacaacatcaacaccccagaaggaataatcccagccctcttcgaaccagaaagggaaaagtccgctgcgatcgacggcgagtatcgattgaagggcgagtcccggaagacgtttgtcgagctcatgcgccgcggggatttgcccgtatggctggcccacaaagtggccagcgagggcatcaagtacactgatcgcaagtggtgttttgacgggcagcgaaataaccagatcctggaggagaacatggacgtcgagatctggaccaaggaaggtgagaagaagaaactccgccccaggtggctggacgcccgaacctactccgaccccctggccctcaaggagttcaaggacttcgcggccggccgcaaaagcatcgccctggacctggtgacggagatcgggcgggtaccatcccacttggcccaccgcacccggaatgctttagacaacctggttatgttgcacaccagcgagcatggcggtcgcgcgtaccggcacgccgtggaggagctacccgagaccatggagacgctgctgctgctgggtctcatgatcttactgaccggaggcgccatgctattccttatctctggcaaggggatcggcaaaacctccatcgggctgatatgcgttatagcaagttccgggatgctctggatggccgagatcccattgcagtggatagcgagcgccatcgttttagagttcttcatgatggtgttgctgatccccgagcccgagaaacagcgcacgccgcaggacaaccagctggcctacgtggtcatcgggattttaacgctggccgccatcatcgcggccaacgagatgggcctgttagagacaacgaagcgtgacctggggatgtccaaggagccaggggtagtgagcccgacatcatatctagacgtggacctccatcccgcctcggcctggacgctgtacgcagtagcgactaccgtcatcaccccaatgctgcgacatacgatcgagaactccaccgcgaacgtctccctcgccgccatcgcgaaccaggctgtggtgctgatgggcctagacaaggggtggccgatatctaaaatggatctcggcgtgcccctgcttgcgctcgggtgctacagccaggtaaatcccttaaccctgacggccgccgtgctcctcctgattacccattacgccattatcggacctggccttcaagccaaggccacccgggaggcccagaagcgcaccgcggcggggataatgaagaacccgacggtcgacggcattatgacaatcgacctggaccccgtgatctacgactcgaagttcgagaagcagctgggccaggtcatgctcttggttctctgcgccgtgcagctcctgttgatgcggacctcgtgggccttgtgcgaggccctgaccttagctaccggccccatcactaccctctgggaaggctccccaggaaagttctggaacaccacaatcgccgtatcaatggccaacatcttccgcggctcctacctcgccggggccggactggcgttcagcatcatgaagtcagtcgggaccggtaagcgcgggacagggtcacaaggcgagactctgggggagaagtggaagaagaaactgaaccagctgagccgcaaggagttcgacctctacaagaaatccggtatcacggaggttgaccgtaccgaggcgaaggaggggttgaagcgcggcgagattacgcaccacgccgtgtccagaggctccgccaagttgcagtggttcgtcgagcgcaacatggttattccggaggggcgggtgatcgacctcggctgcggtcggggcgggtggtcgtactattgcgcgggactgaagaaggtaaccgaggtgcggggctataccaaagggggacccgggcacgaggagccggtgcccatgagcacctacggttggaacatagtcaagctgatgagcgggaaagacgtgttctacctaccacccgagaagtgtgatactctgctgtgtgacatcggtgagtctagcccctcccccaccgtggaggagtcacgcacaattcgcgtcctgaagatggtggaaccgtggctcaagaacaaccagttctgcatcaaggtgctgaacccatatatgcccaccgtcatcgagcacctggaacggcttcagcgcaagcacggcggtatgctggttcggaatcccctgtcccgcaacagcacgcacgagatgtactggatctctaacggcaccgggaacatcgttgcgagcgtgaacatggtctcccggttgcttctcaaccgcttcacgatgactcaccggagaccgacgatcgagaaggacgtggacctcggcgcgggaactcggcacgtcaacgcggaacctgaaacacccaacatggacgtgatcggggagcgcattaagaggatcaaggaggaacacaacagcacctggcactacgacgacgagaacccgtacaagacgtgggcctatcacggctcttacgaagtgaaggccactggaagcgcgtccagtatgatcaacggcgtcgtaaaacttctgaccaagccctgggatgtcgtgccaatggtgacccagatggcgatgacggacacgacgcccttcgggcagcagcgcgtatttaaagagaaggtggacacccggacgccgcgctctatgcccggtacccggcgcgtcatgggcatcaccgccgagtggctctggcggaccctggggcgcaacaagaagccccgtctctgcacccgcgaggagttcaccaagaaggttcgcaccaacgcggcgatgggcgccgtgttcacagaggagaaccagtgggactccgccaaagccgccgtagaggacgaagatttttggaagctcgtcgacagagagcgcgagctacacaagctggggaagtgcggcagctgcgtgtacaacatgatgggcaagcgcgagaagaagctcggcgagttcgggaaggcgaaagggtcccgcgccatctggtacatgtggctgggcgcccggtaccttgagttcgaggccctggggttcctgaacgaagaccactggttcagccgcgaaaattcctatagcggcgtggagggagagggcctgcacaagctcggctatatcctgagggacatctccaagatccccggcggcgccatgtacgccgacgacacggcaggatgggacacccgcataaccgaagacgacctgcacaacgaggagaagatcacccagcagatggacccggagcaccggcaactcgccaatgccatcttcaagctgacctaccaaaacaaagtcgtgaaggtgcagcgccctacgccgaccggcacagtcatggatatcatctctcggaaggaccagcgaggctccggacaggtgggcacctatgggctgaacacgttcacgaacatggaggcccagctcatccggcagatggagggcgagggggtgctgagtaaggcagacctcgagaacccccacctcccggagaagaaaatcacccagtggttggagactaagggagtcgaacgcctgaagcggatggccatctccggcgacgactgcgtggtgaagccaattgacgaccgcttcgccaacgccctcctggcccttaacgacatggggaaggttcggaaggacatcccccagtggcagcccagcaaggggtggcacgactggcaacaggtccccttctgctcccaccacttccacgaactcataatgaaggacggccgtaagttagtggtcccctgtcggccacaggatgaactaataggccgagccagaataagccagggagcaggctggtccctccgcgagactgcctgcctgggcaaggcctatgcccagatgtggagccttatgtacttccatagacgggacctccggctggcctccaacgccatctgctctgcggtcccagtgcactgggtcccgacctcgcggaccacctggagtatccacgcccaccaccagtggatgacgacagaagacatgctcaccgtgtggaatcgcgtctggatcgaggataacccctggatggaggacaagacaccagttacgacctgggaaaacgtgccctaccttggaaagcgggaggatcagtggtgtggaagcctgatcgggctgacctcccgcgctacctgggcccagaatatccccaccgcgatccaacaggtgcggagcctcattggcaacgaggagttcctggactatatgccctcaatgaaacgcttccgaaaagaggaggagagcgagggtgccatctggtga

SEQ ID NO: 25651 - RNA, 9873 nt, synthetic construct
  misc_feature 1..9873: note = derived and/or modified CDS sequence (opt11) from DENV-3__KT726343__SS-prME
  source 1..9873: mol_type = other RNA
accagcttgtgcctcatgatgatattaccggccgccctagcgttccacctcacaagccgggatggggaaccccggatgatcgtggggaaaaatgagaggggcaaaagcctgcttttcaaaacagcctccgggatcaatatgtgcaccctcatcgccatggacttgggcgagatgtgtgacgacaccgttacatacaaatgcccccacatcacggaggtggagcctgaggacatcgactgttggtgcaacctgacctctacctgggtcacctacgggacgtgtaaccaggcgggtgagcaccgccgcgacaagcggtccgtggccttagcgccccacgtgggcatggggctagatacccgcacacaaacgtggatgagcgccgaaggcgcctggcgccaggtggaaaaggtcgagacgtgggccctgcgccacccggggttcaccatcctcgcgttgttccttgcccactatatcggcacttccctcacccaaaaggtagttatatttatcctcctgatgctcgtcacgcccagcatgacgatgcgctgcgtgggggttggcaatcgggactttgtggagggcctgtccggggccacctgggtggacgtcgtcctagagcacgggggatgcgtgaccacgatggccaagaacaagccaaccctcgacatcgagttacagaagaccgaggctacccaactagcgacgctacgaaagctctgcatcgagggcaagatcaccaacatcaccaccgacagcagatgtcccacgcagggagaggccgtgcttccagaggagcaggatcagaactacgtctgcaaacacacctatgtggaccgggggtggggcaacgggtgtggcctctttggcaagggctccctggtcacgtgtgctaaattccagtgcctggagcccattgagggcaaagtggtgcaatacgagaacttaaaatacacggtgatcatcacggtacacaccggggaccaacaccaagtgggcaatgagacccagggggtcactgcagagatcacgccacaggccagcaccaccgaagcgatcctgccagaatatggtacgctggggttagaatgctctccccgaaccggcctggacttcaacgagatgattctgctcactatgaagaacaaggcctggatggtgcaccggcagtggtttttcgacctcccactgccctggaccagcggtgccacgaccgagactcccacctggaaccgcaaggagttgctggtgacctttaagaatgcccacgcgaagaagcaggaggtggtggttctggggagccaggagggagcgatgcacaccgccctcacgggggccacagagatccaaaacagcggcggaacctccattttcgccggtcatctcaagtgcaggctgaagatggacaagttagagctgaaaggtatgagctacgcaatgtgcaccaacacgttcgtcctgaagaaggaagtgtccgagacccagcacgggacgatcctcataaaggtggagtacaagggcgaagacgccccatgcaagatccccttctctaccgaggacgggcagggcaaggcccacaacggcaggctgatcacggccaaccccgtcgtgacaaagaaagaggagcccgtaaatatcgaagccgagcctcccttcggggagagcaacatagtcataggcattggagacaacgcgctgaagattaactggtacaaaaagggctccagcatcgggaaaatgtttgaggccaccgcgcgaggcgcccgccgcatggctatcctgggcgacaccgcgtgggacttcgggtctgtgggcggggtcctgaacagcctgggcaagatggtgcaccagattttcggttctgcctacacggcactgttcagcggcgtttcctgggtcatgaagataggcatcggggtactcctgacgtggattgggctgaacagcaagaacacaagtatgagcttttcttgcattgccatcgggatcatcaccctttacctgggtgccgttgtgcaagccgacatgggctgcgtcatcaactggaagggcaaggagctgaagtgcggctctgggatcttcgtgacgaacgaggtgcacacctggaccgagcagtacaagtttcaggctgactcccctaagcgcctagccaccgccatcgccggcgcgtgggaaaatggggtatgtggcatccgttccacgacgcggatggagaacttattatggaagcaaatcgcgaacgagctcaattatattctgtgggagaacaatatcaagctaaccgtggtggtcggggacatcataggcgtgcttgaacagggcaaacggacactgacgccgcagcccatggaactgaagtactcctggaaaacttggggaaaggccaagattgtaaccgcagagacgcagaactcgtccttcatcatcgacggccccaacacccccgagtgccctagtgcctccagagcctggaacgtctgggaggtggaggactacgggtttggcgttttcaccaccaatatctggctcaagctgcgcgaggtctacacacagctgtgtgaccaccggctcatgagcgccgccgtgaaagacgaacgcgctgtgcacgcggatatgggctattggatagaatcgcagaagaacggatcctggaagctggaaaaggcctctctgatcgaggtcaagacgtgcacttggcccaaatcccatacgctgtggtccaacggggtgctagagtccgacatgattatcccaaaaagcctggccggtcccatctcacaacacaaccaccgcccgggctaccacacccagaccgccgggccctggcacctcggcaagctcgagctggactttaactactgcgagggcacgacagtggtcataaccgagaactgtgggacacgcggtccaagcctgcggacgacgaccgtgtctgggaagctgattcacgaatggtgctgtcgaagctgcaccttaccccctctccggtatatgggcgaagacgggtgctggtacggcatggagatccgccccatctctgagaaagaggagaacatggtcaagtctttagtctccgcaggaagcgggaaggtggacaattttacgatgggcgtgctgtgtctcgcaatcctcttcgaggaagttatgcggggcaagttcgggaagaaacacatgatcgccggggtgtttttcacctttgtgctgcttttatctggacagatcacatggcgcgacatggcccacacgctgatcatgatcggcagcaacgcgtcggatagaatgggaatgggggtcacgtacctcgccctgatcgcgaccttcaagatccagcccttcctggccctcgggttcttcctgcgcaaactgactagccgggagaacctgttactaggggtgggtctcgccatggcgacaacgctgcagctgccagaagacatcgaacagatggccaacgggatcgcactcggactgatggccctgaaacttatcacccagttcgagacctaccaactgtggaccgcactgatcagcctcacgtgttccaataccattttcacattgaccgtggcatggcgcacggcgacactgatactcgcgggagttagcttactgcctgtgtgccagtctagctccatgaggaagaccgactggctaccaatggccgttgccgctatgggcgtgccgccccttccgctgtttatatttagcttgaaggataccctaaagaggcgcagttggcccctgaacgagggggtaatggcggttggccttgtgagcattctggcgtccagcctgctccgcaacgacgtccccatggccggcccactggtcgcaggcgggctgctcatcgcctgttacgtgatcacggggacctctgctgacctgacggtcgagaaagcagccgatattacgtgggaggaagaggccgagcagacgggagtgagccataaccttatgatcaccgtagatgacgacgggactatgagaatcaaggacgatgagaccgaaaacatcctaacggtgctgctgaaaactgctctcctgatcgtcagcggtattttcccgtattccatccccgcgacgctgcttgtgtggcacacttggcagaaacagacccagcgctccggcgtgttatgggatgttcccagtccgcccgaaacgcagaaggccgagcttgaggagggggtctaccgcatcaagcaacagggaatcttcgggaagacccaggtgggcgtcggcgtccagaaggagggcgttttccacaccatgtggcacgtcacccggggcgctgtgctcacgcacaacggaaagcgcctggagcccaactgggctagtgtgaagaaggacctcataagctacggagggggctggcggctctcagcgcagtggcagaagggtgaagaggtacaggtgatcgcggtggaacctggcaagaatcccaagaacttccagaccatgcccggcaccttccaaacgacgacaggggagataggcgccatcgccctggacttcaagccggggaccagcggaagtcccatcatcaacagggagggcaaggtcgtggggctgtatggcaacggggtagtgacaaagaatggagggtacgtgtcagggatcgcccagacgaatgccgaaccggacggtccaacaccagagctggaggaagagatgttcaagaagcggaacctgaccatcatggatctgcaccccggctccggtaagacccgcaaatacctgccagccattgtgcgggaggccatcaagcgccggctccgcactttaatcctggcccccacacgggtcgtcgccgcggagatggaagaagccctcaaggggctgcccatcagataccaaaccacggccacgaagtccgagcataccggccgtgagatcgtggacctgatgtgccacgccaccttcaccatgcgcctattgagtccagtccgcgtcccgaactataacctgatcatcatggacgaggcccacttcactgaccccgctagcatagctgccagggggtacatcagtacccgggttggcatgggcgaggccgctgcgatcttcatgactgccactccgccgggaacggccgacgcattccctcaatccaacgcgcccatccaggacgaggagcgcgacatccccgagcgaagctggaactccggcaacgagtggatcaccgacttcgcgggaaaaactgtgtggttcgtgccgagcatcaaggcgggaaacgacatcgccaactgcttgcggaagaacggaaagaaggtcatccagctgagccgcaagacctttgacacggagtaccagaaaacgaagctgaacgactgggactttgtcgtgaccaccgacatcagcgagatgggcgccaacttcaaggcggatcgggtgattgacccgcggcggtgcctcaagcccgtcatcttgacggatggtcccgagcgtgtgatcctggctgggcccatgccggtgaccgccgcctccgccgcgcagaggcgcggccgggtcgggcgcaacccccagaaggaaaatgaccagtacatattcacggggcagccactcaacaacgacgaagaccacgcccactggaccgaagccaaaatgctgctagacaatattaatacgcccgagggaatcatcccagctctttttgaacccgagcgcgaaaaatcggcggccatagatggcgagtaccggctgaagggagagtcccgaaagacttttgttgagctgatgcggcgcggagacctccccgtatggctggcccacaaagtagccagcgagggcatcaagtacaccgatcggaagtggtgctttgacggtcagcgcaacaaccagatcctggaggagaacatggacgtggagatatggactaaggaaggcgagaagaagaaactccgcccccggtggctggatgcccgcacctactccgacccactggcgttgaaggagttcaaggacttcgccgccggccgtaagagtatcgccctggacctggtcacggagatcggccgggtacctagtcatcttgctcaccgcacccggaatgcgctggacaatctggtgatgctccacaccagcgagcacggtggccgcgcttacagacacgccgtagaggaactccccgaaaccatggagacgctgctcctgctggggctgatgatcctgctgaccgggggcgctatgttgttcctgatcagcggaaaggggataggcaagacctccattgggctgatctgcgtgatcgccagctcaggtatgctctggatggcagagattccgctccagtggatagccagcgcgatcgttttagagttcttcatgatggtcctcctgatcccagaacccgagaagcagcgcactccccaagacaaccagctggcgtatgtggtgatcgggatcttaacgctggccgcaatcattgccgccaacgagatgggtctgctagagaccactaaacgggacctgggcatgtccaaggaaccgggggtggtgtctccaacctcataccttgatgttgatctccaccccgccagcgcctggactctgtatgccgtagccacaaccgtaatcacccccatgctgcgccacaccatagaaaattccaccgccaatgtgagccttgccgcgatcgccaaccaggccgtcgtactgatgggactggacaagggatggcccatctccaagatggaccttggtgtgcccctcttggcgctcgggtgctattctcaggtaaaccccctgaccctgaccgccgcggtgttgttactgatcacgcactatgcgatcattggccctggcctgcaggccaaggctacccgggaagcccagaagcgcaccgcggctggaatcatgaagaacccgaccgtagacggcatcatgacaatcgacctagaccccgtcatttacgactcgaagttcgagaaacagctgggccaggtgatgctgctggtgctgtgcgcggtccagctactgctgatgcggacttcttgggccctttgcgaggcgctgaccctggccaccgggccgatcactaccctgtgggaaggctcccccgggaagttctggaacaccacaatagccgtgagcatggccaacatcttccgaggctcctacctagccggggcgggtttggcattcagcataatgaagtccgtgggcacaggcaagcggggcaccgggagccagggcgagaccctcggggagaaatggaagaagaagctgaaccagctgagccggaaagagttcgatctctacaagaagtccggcatcaccgaagtcgaccggacagaggctaaggaggggttgaagcgcggcgagatcacgcaccacgccgtgagccggggctccgcgaagctccagtggttcgtggaacgcaacatggtcatcccagagggacgagtgatcgacctaggttgcggcagagggggttggtcatactactgcgcgggcctgaagaaggtgaccgaggtccggggctacaccaagggcgggcccgggcatgaggagcccgtgccgatgtccacctacggttggaacatcgtaaagttgatgagcggtaaggatgtattctacctcccgccagagaagtgcgacacccttctgtgcgacatcggcgaaagcagtccgtcacctaccgtggaagaaagcaggaccatccgagtgctgaagatggtcgaaccgtggctcaagaataaccagttctgcatcaaggtgcttaacccctatatgccaactgtgatcgagcacctggagcggctgcaaaggaagcatggagggatgctggtcagaaacccactgtcgagaaacagcacgcacgaaatgtactggatttccaatggtaccggcaatatcgtggcctcggttaacatggtcagtcggctcctgctgaaccgattcaccatgacccaccggagaccgacgatagagaaggacgtggatctcggcgccggcacccggcacgtgaacgccgaaccagagacccctaatatggacgtcattggggagcgcatcaagcggatcaaggaggaacacaacagcacatggcattacgacgacgagaatccgtacaagacatgggcctaccacgggtcgtacgaggtgaaggccaccggaagcgcctccagcatgatcaacggcgtggttaagctgctgaccaaaccctgggatgtggtccccatggtgacccagatggccatgacggataccacccccttcggtcagcaacgagtgttcaaggagaaagttgacacccgcacgccgaggagcatgcccggaacacggcgcgtgatgggcattaccgccgagtggctctggagaaccctggggcgcaataagaagccccggctgtgtacgcgcgaggagttcaccaaaaaggtgcgcaccaacgccgcaatgggcgccgtgttcaccgaggagaaccagtgggactcagcaaaggctgcagtagaggacgaggacttctggaagctcgtggacagagagcgtgaactgcacaaactggggaagtgcggaagctgtgtatacaacatgatggggaagagagagaagaagctcggcgagtttgggaaggccaaggggagccgcgcgatctggtacatgtggctgggcgcccggtaccttgagttcgaagccctcgggttcctgaacgaggaccattggttcagccgcgaaaattcctacagcggcgtggagggagaaggactgcacaaactcggctacatcctgcgggacatttcgaaaatccccgggggtgcgatgtacgcagatgacacggctgggtgggacacccgcataactgaggacgacctgcacaatgaggagaaaatcacgcagcagatggatccggagcaccgtcagctcgccaacgcgatcttcaagctgacgtaccagaacaaggtggttaaagtccagcgccccacccccaccggaaccgtcatggacatcatctcacgcaaggatcagcgcggaagcggacaagttgggacctacgggcttaacacgtttaccaacatggaggcccagcttatacggcaaatggagggagaaggggtgctgagcaaggccgatctggagaacccccacctcccggagaaaaagattacccagtggctggagaccaagggcgtggagcgcctcaaacggatggccatttccggtgatgattgtgtcgtgaagcccatcgacgaccgcttcgctaacgcactcttggcgctgaacgacatggggaaagtacggaaagatatcccccaatggcagcctagcaagggctggcacgactggcagcaagtaccgttctgcagtcaccacttccatgagctcatcatgaaagatggccgcaagctggttgttccctgccgaccccaggatgagctcatcggccgcgcccggatcagtcagggggctggctggagcctccgcgaaactgcctgtctgggcaaggcgtacgcccagatgtggagcttgatgtacttccaccgcagagacctccggctggcctccaacgccatctgctcggccgtccccgtgcactgggtgcccacatccaggaccacctggtcgatccacgcgcaccatcagtggatgacgacagaggacatgctgactgtatggaaccgtgtgtggatagaggacaacccatggatggaggataagacccccgtgacgacttgggagaacgtgccctacctcgggaagcgggaggaccagtggtgcggcagcctgatcgggcttacctccagagccacctgggcccagaacataccgacagcaatccagcaggtccggagcctcatcggtaacgaagagtttctggactacatgccctccatgaaacgcttccggaaggaggaggaaagcgagggtgcaatatggtga

SEQ ID NO: 25652 - RNA, 9873 nt, synthetic construct
  misc_feature 1..9873: note = derived and/or modified CDS sequence (opt11) from DENV-3__KT726351__SS-prME
  source 1..9873: mol_type = other RNA
accagcctgtgtctcatgatgatattacccgcagctctggcgttccacctcacgtcccgagacggggaaccccggatgatcgtaggtaagaacgaaaggggtaagagcctgctgttcaagaccgcctccgggatcaacatgtgcaccctcatcgccatggacctgggggaaatgtgcgacgacacggtgacgtacaagtgtccccacataaccgaggtggaaccggaggacatcgactgctggtgcaaccttaccagcacctgggtgacctatgggacgtgtaaccaggccggggagcaccggcgcgacaagcggtccgtggctctcgcgccccacgtgggcatggggctagacacacgcacccagacctggatgtctgctgaaggagcctggagacaggtcgagaaggtggagacttgggccttgaggcacccggggttcaccatcttagcactcttccttgcccactacattgggacctcccttacccagaaggtggtgatctttatactgctcatgttagtaacaccaagcatgaccatgaggtgcgtgggggtaggaaacagggacttcgtcgagggcctgtccggtgccacctgggtcgacgtggttcttgaacacggagggtgtgtgaccacgatggccaagaacaaacctaccctcgatattgagctacagaagaccgaggctacccagttagcgacgttgcggaagctgtgcatagagggcaagatcaccaacatcaccaccgactcacgctgccccacgcagggcgaggccgtgctgccggaggagcaggaccagaattacgtctgtaagcacacctatgtggacagaggttggggcaacgggtgcggcttattcggtaaaggctccctagttacttgtgccaagtttcagtgcctggagccgattgaaggcaaggtcgtgcagtacgaaaacctcaaatatacagttatcataacggtgcacaccggggatcaacaccaggtgggcaatgagacacagggggtcaccgccgagatcacgccccaggcctccaccaccgaggcgattctacccgagtacggcaccctggggctcgagtgctccccgagaaccggcctggacttcaatgagatgatactgcttaccatgaagaacaaggcatggatggtccaccgacagtggtttttcgacctgcccctgccctggaccagcggcgccaccaccgagacccctacctggaaccgcaaggagctactggtcacattcaaaaacgcccacgccaagaagcaagaggtagtcgtactggggtcacaggaaggcgcgatgcataccgccctcacgggggccaccgagatccaaaacagcggcgggacctccatctttgccgggcatctgaagtgccggctgaaaatggacaagctcgagctgaagggcatgagctacgccatgtgcaccaacacgtttgtcctgaagaaggaggtgtccgaaacacagcacgggacaatcctcatcaaggtggagtataagggcgaagatgtcccctgtaagatccccttctctaccgaggacgggcaaggcaaagcgcacaacggccgcctgatcactgcgaaccccgtggtgaccaagaaggaggagcctgtaaatatcgaggccgagccacccttcggtgagagcaatatcgtgatcggtatcggcgataatgccctgaaaatcaattggtacaagaagggctccagcatcgggaagatgtttgaggctacagcccggggcgcccgccggatggccatcctcggcgacaccgcctgggatttcgggagtgtgggcggagtgcttaatagcctgggcaagatggtacaccagattttcgggagcgcgtacacagccctgtttagcggcgtgagttgggtcatgaagatcggaatcggggtgctcctgacctggattggcttgaatagcaagaacacctccatgagcttctcctgcatcgctatagggatcatcaccctctacctgggagccgtggtacaagctgacatgggctgcgtgatcaactggaagggtaaggaactgaagtgcggcagcggtatcttcgtaacgaacgaagtacacacgtggaccgagcaatacaaattccaagcggacagccccaagcgcctcgcgaccgcgatcgctggggcctgggagaatggagtgtgcggcatccgcagcacgacaagaatggagaaccttctttggaagcagattgcgaacgagttgaactacatcctgtgggagaacaacatcaaacttaccgtggtcgtgggggacattatcggcgtccttgagcagggaaagcgcaccctgacgccccagccgatggagctgaagtattcgtggaagacctgggggaaggctaaaatcgtcacagccgagacccaaaatagctctttcatcatcgatggccccaacacgcccgagtgccccagcgcttcccgcgcatggaacgtctgggaggtcgaggactacgggttcggggtctttactaccaacatctggctcaagctgcgcgaggtgtacactcagctgtgtgatcaccggttgatgagcgcggcggtgaaagacgagcgcgccgtccacgccgacatggggtactggatagagagccagaagaacggaagttggaaactggagaaggcttcactgatcgaggttaagacctgcacgtggcctaagtcccacaccttatggagcaacggcgttcttgagtccgacatgatcatcccgaagtctctggccgggcccatctcgcagcacaatcaccggccgggctaccacacccagaccgccggtccatggcacttgggcaagctggagctggacttcaactactgcgagggcacaaccgtcgtgattaccgagaattgcgggacccgcggccccagcctccgtacgacgaccgtgagcggcaaacttatccacgagtggtgctgccgcagctgtacgctgccgccgctgcgctacatgggcgaggacgggtgttggtacggcatggagatccgccccatctccgagaaggaggagaacatggtcaagagcctagtgtccgccggcagcggaaaggtagacaatttcacgatgggagtattatgcctggccatcctgttcgaggaagttatgcgcgggaaatttggcaagaagcatatgatcgcgggagtattcttcaccttcgtcctattattatccggccagatcacatggcgggatatggcccataccctaatcatgatcggcagcaacgcctccgatcggatgggtatgggcgtcacttatctcgccctgatcgccacatttaagatccaacccttcctggcgctcggattcttcctgcgcaagctcaccagccgggagaatctcttactgggagtgggcctcgccatggccaccacgctgcagctgccagaggatatcgagcagatggccaacgggatcgcgctcggcctgatggccctgaaactcatcacacagttcgagacctaccagctgtggaccgcgctgattagtttaacctgcagcaacacaattttcaccctgacggtcgcctggcgcacagctaccctgatcctcgcgggggtctccttactgcccgtctgccaatcaagctccatgcggaaaactgactggctccccatggccgttgctgccatgggcgtaccgccgctcccgctgttcatcttcagcctcaaggataccctgaagagacgcagctggcccctaaacgagggggtcatggccgtgggcttagtgagcatcctggcgtcctcactactcagaaacgacgtgcccatggccggtcccctggtagctggtggcctgctcatcgcctgctacgttatcacgggtacctccgccgacctgaccgttgagaaagcggccgacataacctgggaagaggaagccgaacagacgggcgtgagccacaatttgatgatcaccgtggacgacgacgggaccatgcgaatcaaggatgacgagaccgagaatatcctcacagtgttactgaagacggctctcctgatcgtgtccggtattttcccctatagcatcccggccaccctgctcgtgtggcatacctggcagaaacagacccagcggtccggcgtcctgtgggacgtgcccagcccgcccgagacacagaaggctgaactggaagagggcgtgtacagaattaaacaacaaggcattttcgggaagacacaggtgggcgtgggggtgcagaaggaaggcgtcttccataccatgtggcacgtgacccggggcgcagtgctcacacacaatggcaagagactggaacccaactgggcctctgtcaagaaggacttgatctcctacggcgggggctggcgcctctccgcacagtggcagaaaggggaagaggtccaggtcatcgcggtcgaacccgggaagaatcccaagaactttcagacaatgccagggactttccagacaacgacgggggagatcggcgccatcgccttggacttcaagcccggtaccagcggcagccctatcataaaccgcgagggcaaggttgtgggcctgtacggcaacggggtagtgaccaagaacggagggtacgtttccgggattgcccagacaaatgccgagcctgacggccccacacccgagctggaggaagagatgtttaagaagaggaacctcaccataatggatctgcaccccgggagcggcaagacccgcaagtacctgccggcgatcgtgcgggaggccatcaaacgacggctccgcacgctgatcctagcacccacccgggtggtggcggccgagatggaagaggcgctcaaggggctgcccatccgctaccaaaccacagccactaagtccgagcacaccggccgggagatcgtcgacctgatgtgccacgcaaccttcactatgcgcctcctgtcccccgtgcgggtgccgaactacaacttaattatcatggacgaggcgcacttcactgacccggcatccatcgcggcccgcgggtatatcagcacccgggtcggcatgggcgaggcggccgcgatcttcatgaccgcaacgccgcccgggacggcggacgccttccctcaaagcaacgccccaatacaggacgaggagcgcgacatcccggagcgctcgtggaactccggtaacgagtggataaccgacttcgcggggaagaccgtgtggtttgtgccctctatcaaggccggtaatgacatcgccaactgcctccggaaaaacgggaagaaggtcatacagctgtcacgcaagacattcgacacggagtaccagaagaccaagctgaacgactgggactttgtcgtaaccaccgacataagcgagatgggcgcgaatttcaaggccgatcgggtcatcgacccccgccggtgcctcaagcccgtgattctcacggacggccccgagcgcgtgattctagccggccccatgccggtcaccgctgcctccgccgcacaaaggcgcggtcgggtcggccgcaatccccagaaggaaaacgaccagtatatcttcacagggcagcccctcaacaacgacgaagaccatgctcattggaccgaggcaaaaatgctgctggacaacatcaacactcccgaagggatcatcccggccctctttgagcccgagcgagagaagtccgccgcgatagacggggagtaccgactaaagggagagtcccgtaagacgttcgtggagctgatgcgccgcggggacctccccgtctggctggcccataaggtggccagcgaaggcataaagtacaccgacagaaagtggtgcttcgacgggcagcggaataaccagatcctcgaagagaacatggacgtcgagatctggaccaaagagggcgagaaaaagaagctcaggccccggtggctcgacgcgcgcacatactccgatccgctggcgctaaaggagttcaaggactttgcggccggccgcaagagcatcgccctggacctggtgaccgagatcggacgggtgccctcccacctcgcccaccgcactagaaacgccctggacaacctggtcatgctccacacctcggaacatggcgggcgggcgtatcgccacgcagtggaggagctgcccgagaccatggagaccctattactacttggcttgatgatcctgttaaccgggggcgcaatgctgttcttaatctctggcaaggggatcggcaaaacttcgatcgggctaatctgcgtgatagccagctccggcatgttgtggatggccgagatcccgctgcaatggatcgcgagcgccatcgtcctggagttcttcatgatggtactcttgattcccgaacccgagaagcagcggacgccccaagacaatcaactggcttacgtggtgatcggaatcttaacgctggccgcgatcatagctgctaacgagatgggccttctcgagaccaccaagcgggatctgggcatgtccaaggagccaggggttgtcagccccacctcctatctggacgtagacctccaccccgccagcgcctggaccttatacgcggtagccaccaccgtgatcacccccatgctgcgccacaccatcgagaacagcaccgccaacgtcagcctcgccgcgatcgctaaccaagccgtagttctgatggggctagacaaggggtggccgatcagcaaaatggatctcggcgtccccttgctggccttggggtgctattcgcaggtcaaccccctgacgctgaccgccgcggtactccttttgatcacgcactacgcgatcatcggccccggcttgcaggccaaggccactcgggaggcacagaagcgcaccgctgcggggatcatgaaaaacccgacggtcgacggcatcatgacgatcgacctcgatcctgtcatttacgactccaagtttgagaagcagcttggccaggtgatgttgctggtgctgtgcgccgtgcagctcctactgatgcggaccagttgggccctctgcgaggctctgaccctggctaccggaccaatcacgaccttgtgggaaggatcccccggaaagttctggaacaccaccatcgccgtctctatggccaacatctttcgcggttcctacttagccggggccggccttgcgttcagcatcatgaaaagcgtcgggacaggcaagcgggggacggggagccagggcgagactttgggagagaaatggaagaagaagttaaaccaattatcccgtaaggagttcgacctctacaagaagagtggcattaccgaggtcgaccggactgaggctaaggaggggctgaaaaggggcgagattacgcaccacgccgtgagccggggctccgccaagttacagtggtttgtcgagaggaatatggtgatcccggagggtcgggtgatcgacttagggtgtgggcgcggcgggtggtcttattactgcgccggcttgaagaaggtcactgaggtgcgggggtacaccaaaggtgggccaggccacgaagaacctgtgcccatgtcaacctacggctggaatattgtaaaactgatgagcggaaaggacgtgttttacttgccgcccgagaagtgcgacacgcttctatgcgacatcggcgaatcctcccccagccccaccgttgaagagagccgcacgatcagagttctgaagatggtggagccgtggttaaagaacaaccagttctgcatcaaggtgctgaatccctacatgccgaccgtcatcgaacatttggaaaggctccagcgcaagcacggcgggatgctggtgcggaaccccctctcccgcaattcaacccacgagatgtattggatctccaatggcaccggcaatatcgtcgcgagcgtcaatatggtcagccggctcctgctgaaccgatttacaatgacccacaggcgtccgaccatcgagaaggatgtagacctcggggcgggcaccagacatgtcaacgccgagcccgagactccgaatatggacgtgatcggggagcgcatcaagcgcataaaggaggagcataacagcacctggcactatgacgacgagaacccctacaagacgtgggcctatcacggcagttacgaggtcaaagccaccgggtccgcgagcagcatgatcaacggcgtcgtgaagctgctgaccaagccctgggatgtagtgcccatggtgacccagatggccatgacggacaccacccccttcgggcaacagagagtcttcaaggagaaagtggacacgcgtacgccgcgtagcatgcccggaaccaggaaggtaatgggcatcactgccgagtggctctggcgcaccctggggcgaaacaagaagccccgcctgtgcacgagagaggagttcaccaagaaagtccgcaccaacgcggccatgggcgcggtgttcactgaggagaaccagtgggactccgccaaagccgcggtggaggatgaggatttctggaaactcgtcgacagagaacgggagttgcacaagctggggaagtgcgggagctgcgtgtacaatatgatggggaagcgcgaaaagaagctcggcgagttcggcaaagcgaaggggtcccgggccatctggtacatgtggttaggcgcgaggtacctggagttcgaggccctcgggttcctgaacgaggatcactggttctcgcgggaaaattcttacagcggtgtggagggggaaggcctacacaaacttggctacatcctacgagatatctcaaagatccccgggggcgccatgtacgcggacgataccgcaggatgggacacccggatcaccgaggacgacctccacaacgaggagaagataacacagcagatggatccggagcaccgacagctcgccaacgctatattcaaattgacgtaccagaacaaggtcgtgaaagtgcagcgacccacccccacaggtaccgtaatggatataatcagccgaaaggatcagcgcggctccggtcaagtggggacctacggactcaatacgttcaccaacatggaggcccagctcatacgccagatggagggcgagggtgtactttctaaggcggacttagaaaacccgcatctgcctgagaagaaaatcacccagtggctggaaacaaagggcgttgagcggctgaagcgcatggccatctcaggcgacgactgcgtggtgaaacccattgacgaccggttcgccaacgccctcttggcccttaacgacatgggtaaagtccgtaaggacattccccagtggcagcccagcaaaggctggcacgactggcagcaggtaccgttctgcagtcaccatttccatgaactcattatgaaggacgggcggaagctggtggtcccctgtcgcccccaagatgagctgataggccgggcccggatctcgcagggggcgggctggtccctccgggaaacggcctgtctgggaaaagcatacgcacagatgtggtcactgatgtacttccaccgccgggacctccgtctggcttccaacgcgatctgcagcgccgtgccagtgcactgggtcccgacctcccgtaccacttggagcatacacgcccatcaccagtggatgacgaccgaggacatgctgaccgtgtggaaccgggtgtggatcgaggacaacccctggatggaggacaagacccccgtaacgacttgggaaaacgtgccctacctcgggaaacgcgaggaccagtggtgcgggagcctgatagggttaacctcccgtgcgacctgggcccagaatatccccacggccatccaacaggtgcgcagcctgatcggcaacgaggagttcctggactacatgcccagtatgaagcggttccgcaaggaggaagagagcgaaggggccatctggtaa

SEQ ID NO: 25653 - RNA, 9873 nt, synthetic construct
  misc_feature 1..9873: note = derived and/or modified CDS sequence (opt11) from DENV-3__KT726360__SS-prME
  source 1..9873: mol_type = other RNA
acctccttatgtttgatgatgatcctgcccgcggccctcgcgttccatctcaccagccgggacggcgaaccccggatgatcgtcgggaaaaacgagcgtggcaagagcctgctgttcaaaaccgcctccgggataaacatgtgcaccctcatcgccatggacctgggggagatgtgcgatgataccgtgacttacaaatgcccccatatcaccgaggttgagcccgaggacatcgattgctggtgcaacctgaccagcacctgggtgacctacggcacctgtaaccaggctggcgagcaccgtcgcgacaagcggtccgttgccttggcaccccacgttggcatgggcttagacacccgcacgcaaacttggatgtcggccgaaggcgcctggcgccaagtggagaaggtggagacgtgggcgctacgccaccccggtttcaccatcctggcgctgttcctggctcactatatcggcacctctctcacccagaaagttgttatttttatccttttaatgttggtcacgccctcgatgaccatgcggtgcgttggtgtcggcaaccgcgacttcgtagaggggctctccggggccacttgggtggatgtagtcctggaacatggcgggtgcgtgaccacgatggctaaaaacaaacccaccctcgacatcgagctgcagaagaccgaggccacccagctggcgacgctccgaaagctgtgtattgaagggaagataaccaacatcactaccgactccaggtgtcccacccagggcgaagccgttctgccggaggagcaagaccagaactacgtctgcaaacacacctacgtagaccgtggttggggcaacggttgcggcctgttcgggaagggctccctggtgacatgcgccaagttccagtgcctcgaacccatcgagggcaaggtagtgcaatacgagaacctcaaatacaccgtcatcattacagtacacaccggggaccaacaccaggtgggcaacgagacccagggtgtcaccgccgaaataacgccccaggccagcactacggaggcgattctacccgagtatggcactctgggcctcgagtgcagcccccgcaccggcctcgacttcaacgagatgatcctgctaactatgaagaacaaggcctggatggtgcaccggcagtggttcttcgacctacccctgccctggaccagcggggcaaccaccgaaacgcccacctggaatcgcaaggaactcctagtaacgtttaagaatgcccatgccaagaagcaggaggtcgtggtgcttgggtctcaggaaggtgcaatgcacaccgccctcacaggtgccaccgagatacagaactcaggagggacctccatcttcgctggccatcttaagtgtcgactgaagatggacaagctcgagttaaaggggatgagctacgccatgtgcaccaacactttcgtcctgaagaaggaggtgtccgagacccagcacgggaccatcctcatcaaggtggagtacaagggcgaggacgtcccgtgcaagatccccttctctaccgaagatggtcagggcaaggcgcataacggccgactcatcacggccaacccagtggtgactaagaaggaagaacccgtgaacatcgaagccgagccgcccttcggggagagcaacatagtaatcggcatcggggacaatgccctgaagataaactggtacaagaagggctccagcatcgggaagatgtttgaggctaccgcacggggtgcccgccggatggccatcctgggcgataccgcctgggacttcgggagcgtgggcggggttctgaacagcctgggcaagatggtgcatcaaatcttcggttccgcgtacacggccctgttcagcggcgtttcctgggttatgaagatcggcatcggcgtgctcctgacctggatcgggttaaacagcaaaaacacgtccatgagcttttcctgcatcgccatcgggatcatcacattatacctgggtgccgtagtccaggccgacatggggtgcgtgatcaactggaaaggtaaagagctgaagtgcggcagcgggatcttcgtgacgaacgaggtccacacctggactgagcagtacaagtttcaggccgactcccccaagcgcttggctaccgcgattgccggcgcctgggagaatggtgtgtgcggcatccgctcgaccacccgtatggaaaacctgctgtggaagcagatcgcgaacgagttaaactacatcctttgggagaacaacattaagttaaccgtggtcgtgggcgatatcatcggagtcttggagcagggcaaacggacgctgacgccgcagcccatggagctgaagtactcttggaagacctggggcaaggctaaaatcgttaccgccgaaacccagaacagctccttcatcatcgatggccccaacacgcccgagtgccccagcgcatccagggcgtggaatgtgtgggaggtggaagactacgggttcggggtcttcactaccaacatctggctcaagctgcgagaagtctatacccagctgtgcgaccaccgcttaatgtctgctgccgtgaaggacgaacgcgcagttcacgcagacatgggctactggattgagagccagaagaacgggtcctggaagttagagaaagcgagcctgatcgaagtgaaaacctgcacctggcccaagtcccacacgctctggagcaatggcgtcctggagtccgatatgataatacccaagtcactggccgggcctatctcccagcataaccaccgtccgggctaccacactcaaaccgccgggccatggcacctcggcaaactggagttggatttcaactactgcgagggcacgaccgtcgtgataaccgagaattgcggtacccgcggacccagcctccggacgaccaccgtgtcgggcaaactgattcacgaatggtgctgccgcagctgtacactgcccccgctccggtacatgggagaggacgggtgctggtacggcatggagatccgccccatatccgagaaggaagagaacatggtcaaatccctagtatccgccggcagcgggaaggtggacaacttcacaatgggagtcctgtgcctcgctatcttattcgaggaagtgatgcggggtaagttcggcaagaagcatatgatagcgggggtgtttttcaccttcgtcctcctcttgtcaggccagatcacctggcgcgacatggcacacaccctgatcatgatcggcagcaacgccagcgacaggatgggcatgggcgtcacttacttggccctgatcgcgacctttaagatccaacccttccttgcgctcggcttcttcctgcgcaaacttacctcacgagagaacctcctgctgggggtcggcctcgccatggccacgacactgcagctgcccgaggacattgagcagatggccaacggtatcgccttggggctgatggcactgaaactcatcacgcaattcgagacgtaccagctgtggactgccctaatctcactcacgtgctccaataccatcttcactctgaccgtcgcctggcgtacggccacccttatcctcgcaggcgtgtcgctgctgcccgtatgtcagagcagctctatgcggaagacggattggctcccgatggccgtggccgctatgggcgtgccgcccctcccgttgtttatctttagtctcaaggatacactaaagcgccgatcttggcccctgaacgagggggtcatggccgtgggcctcgtgagcatactagcgtcctcactgctccgtaacgacgtacccatggccggcccgctggtggctgggggactgcttatcgcctgttacgtgattacggggacgtccgccgacctgaccgtcgagaaggcggccgacatcacctgggaggaagaagccgagcagacgggggttagccacaacctaatgatcacggtggacgacgacgggaccatgcgcatcaaggacgacgagaccgagaacattttaaccgtcctgctgaagacggctctgctcattgtgtccggcatcttcccctattcgatcccggccaccctgctcgtctggcacacttggcagaaacagacccaacggagtggcgtcctttgggacgtgccaagtccccctgagacacaaaaggcggagctagaagagggggtctaccgcatcaagcaacagggcattttcgggaagacccaagtcggcgtgggcgtgcagaaggagggcgtcttccacactatgtggcacgtgaccagaggggctgtcttgacgcacaacgggaagcgcttggagccaaactgggcatcagtcaagaaggacctgatctcgtacggcgggggctggcgcctatccgctcaatggcagaagggcgaggaagtccaagtgattgcggtcgagcccggcaaaaatcccaaaaatttccagaccatgccgggcacattccagacgacgaccggcgagatcggcgccatcgccctggacttcaagcccggaacctcagggagtcccatcatcaatcgcgagggcaaggtggttgggctgtacgggaacggggtcgtgaccaagaacggagggtacgtgagtggcatcgcccagacgaacgccgagccggacggaccgacccccgaactggaggaggagatgtttaagaaacggaacctcacaattatggacctgcaccccggaagcggcaagacccgcaagtaccttccggcaatcgtccgagaggctatcaaacgccggctgcgaacgttgattttggcgcccacccgggtggtggccgccgaaatggaggaagcattaaagggactgcccatccgctaccagactaccgccactaagtccgaacataccggccgggaaatcgtcgacttaatgtgccatgcaaccttcaccatgcgcctcctctcacccgtgcgagtgccgaactacaacctgatcatcatggacgaggcccacttcacggatccggcttccatcgcagcacgcggctatatcagcacccgggtcggcatgggagaggccgccgcgatcttcatgaccgccacgccacccgggaccgctgacgccttcccgcagtccaacgcccccatccaggacgaggagcgggacatcccagaacgttcttggaactccggcaacgaatggatcaccgacttcgcggggaagaccgtgtggtttgtccccagcatcaaggccggaaacgacatagcaaactgcctccgaaagaatgggaagaaggtaatccagctttcccggaaaaccttcgacactgagtaccaaaagaccaagctgaatgactgggactttgtcgtaacgaccgacataagcgagatgggcgccaacttcaaggccgaccgtgtcatagacccgcgccggtgcttaaagcccgtcatcttgacggacgggcccgagcgcgttatcctggcggggcccatgccggtcaccgccgcttccgccgcccagcggcgcggccgggtggggcgcaacccccagaaggaaaacgaccaatacatcttcaccggccagcccctcaacaatgacgaggaccacgcgcattggaccgaagccaagatgctgctggacaacatcaacacacccgaggggatcatccccgccctctttgagcccgagcgggaaaaatccgccgcgatcgacggtgagtacaggttgaagggcgagtcacgtaagacgttcgtggagctgatgcgtcgtggggacctccccgtctggctggcccacaaggtggccagcgagggcatcaagtacacagaccgtaagtggtgcttcgacgggcagcgtaacaaccagatcttagaggaaaatatggacgtagagatctggaccaaagaaggcgagaagaagaaactgaggcccaggtggcttgacgcccgcacctactccgacccgctcgccctcaaggaatttaaggactttgccgccgggcgcaagtcgatcgccctggacctggtgacggagatcgggcgggtgccctcccacctcgctcaccgcacccggaacgctttagacaacttagtcatgctccacaccagcgagcacggcggacgtgcgtatcggcacgccgtggaggagctgcccgaaaccatggagacgctactccttcttggcctcatgatactgctgacagggggcgccatgctgttcctgatcagcggcaaggggatcggcaagactagcatcgggctgatctgcgtcatcgcctcttccggcatgctctggatggccgagatcccgctgcagtggatcgctagtgctatcgtattggagtttttcatgatggtgttgctgattcctgaacccgagaagcagcgcacaccccaagacaatcaattggcttacgtggtcatcgggatcctcaccctggccgccatcatagcggccaatgaaatgggtctgctcgagaccaccaagagagacctggggatgtccaaggaccctggcgtcgtgtctcccacttcctaccttgacgttgatctccaccccgccagcgcctggacgctgtacgcagtagccaccactgtgataacaccgatgttacgccatacaattgaaaactccaccgccaatgtctcgttagccgctatagctaaccaggccgtggtgctaatggggctggacaaggggtggccgatatccaagatggacctcggcgtccccttgttggctctggggtgctacagccaggtgaatcccttaacattgaccgccgctgtgctcctcctaattacgcactatgcgatcatcggccccgggctccaggccaaagcaacccgtgaggcccagaagcgcactgccgccgggatcatgaagaaccctaccgtcgacggcatcatgacgatcgacctagaccccgtgatctacgactccaagttcgagaagcagttgggtcaggtgatgctattagtactgtgcgccgtgcagctcctgctgatgcggaccagctgggccctctgcgaagccctgaccctagccaccggccccattacgaccctttgggagggttccccgggcaagttctggaacaccactatcgcggtcagcatggcaaatatcttccgcgggtcttacctggccggggctggcctggccttttctatcatgaagtcggtcggaacgggcaagcggggcaccgggagccagggcgagacactcggggagaagtggaagaagaaactgaaccagctgagtcgcaaggagttcgacctctacaagaagtcaggcatcaccgaagtagacagaactgaggccaaggaaggtctgaagcgcggggaaatcacacatcacgcggtcagccgaggatcagctaagctgcagtggttcgtcgagcgcaacatggtgattccggaggggcgggtaatagacctcggctgcgggcggggcgggtggagctactactgtgctggcctaaagaaagtgaccgaggtgcgcggctacaccaagggcgggccgggtcacgaggaacccgtgcccatgtctacctacgggtggaacatcgtcaaactgatgagcggtaaggacgtgttttatctcccgcctgaaaagtgcgacacgctgctgtgcgacatcggcgagagtagtccatccccaaccgtagaggagagcagaacgatccgcgtcctaaagatggtggagccatggctcaaaaacaaccagttctgcattaaagtgttgaacccctacatgccgaccgtcatcgagcacctggagcggctacagcgcaagcatgggggaatgctggtgcggaaccctctgtcgcgcaatagcacgcacgagatgtactggatctctaatggcaccggtaacatcgtagcgtccgtcaatatggtgtccaggctcctgctgaatcgctttaccatgacccaccggcgcccgacgatcgagaaagacgtggatcttggggccggaacccgccacgtcaacgccgagcccgaaactcccaacatggacgtgataggcgagaggatcaagaggatcaaggaggagcataatagcacatggcactacgatgatgaaaatccgtacaagacgtgggcctaccacggatcttatgaagtgaaagccactggaagcgcgtccagcatgataaacggcgtcgtgaaactgctgaccaagccctgggatgtcgtgcccatggttactcagatggccatgacggacaccaccccctttgggcagcagcgcgtcttcaaagagaaagtggacacccggacgccgcgcagcatgcctggcacccggcgcgtgatggggatcaccgccgagtggctttggcggaccctggggcgcaacaaaaagccccggctgtgcacgcgcgaggagtttactaagaaagtgaggaccaacgcggcgatgggcgccgtattcaccgaagaaaaccagtgggactcggcaaaggccgccgtggaggacgaggatttctggaagctcgtggacagagagcgcgagctgcacaagctggggaagtgcggcagctgcgtgtacaacatgatggggaaacgggagaaaaagctcggggagttcggcaaggcgaaggggtcccgcgccatctggtacatgtggcttggcgcccggtacttagagttcgaggccctggggttcctaaacgaagaccactggttctctcgcgagaactcctactctggcgtggagggggagggactgcacaagctcggctatatcctccgggacatctccaagatacccgggggcgccatgtacgcggacgatacggccgggtgggacactcgaataaccgaggacgaccttcacaacgaggagaagatcacccagcaaatggaccctgagcaccggcaactggccaacgccatcttcaaacttacgtaccagaacaaggtggtgaaagtgcaacgccccacgcccaccggaaccgtgatggacatcataagccggaaggaccagaggggctcaggccaggttggaacgtacggactgaatacattcactaacatggaggcgcagctcatacggcagatggagggagagggggtcctgagcaaggcagacctggagaacccacacctcccggagaagaagatcacccagtggctagagaccaaaggggtggagcgcctgaaacggatggccatctctggcgatgattgtgttgtgaagcccattgacgaccgcttcgccaacgccctcctggcactgaatgatatggggaaggtgcgcaaggacatcccgcagtggcagcctagcaaagggtggcacgactggcagcaagtgccgttttgctctcaccacttccacgagctaattatgaaggatgggcgcaagctggtggtaccctgccgaccgcaggacgagctgattggtagagcgcggatcagccagggggccggctggtccctccgcgagacggcttgcctgggtaaggcctacgcgcagatgtggagcctcatgtattttcatcgacgggacctccgcctggcaagcaacgcaatctgcagcgccgtgcccgtgcactgggtccccacgtcccggaccacttggagcatccacgcccaccatcagtggatgacgaccgaagacatgctgaccgtttggaatcgagtgtggatagaggacaacccctggatggaggacaaaacccccgtcactacctgggagaatgtgccttacctcggtaagcgtgaagatcagtggtgcggcagcctgatcgggctgacatcccgcgcgacctgggcccagaatatcccgacagcgattcagcaggtccggagcctcataggcaacgaggagttcctagactacatgccctccatgaaacgcttccgtaaagaggaggaaagcgagggggccatctggtga

SEQ ID NO: 25654 - RNA, 9873 nt, synthetic construct
  misc_feature 1..9873: note = derived and/or modified CDS sequence (opt11) from DENV-3__KF041259__SS-prME
  source 1..9873: mol_type = other RNA
acctcgttatgcctcatgatgatcctgcctgccgcactggcgtttcacctcaccagccgggacggggaaccccgtatgatcgtggggaagaacgaacgcggcaagagccttctgttcaaaaccgcctccgggatcaatatgtgtaccctcatcgctatggatctgggcgaaatgtgtgatgacaccgtgacgtacaagtgtccacacattaacgaggtcgagccagaggacatcgactgctggtgcaacctgacctcaacctgggttacctatgggacctgcaatcaggccggcgagcaccggcgtgacaagcggtccgtggccctggcgccgcacgttggcatggggctggacacgcgtacccagacgtggatgagcgctgagggcgcctggcgccaggtggagaaggttgaaacctgggccctgcgccatcccgggttcaccatcctcgcactgttcctagcccactacatcggcacctccttgacccagaaggtggtgatcttcatcctgctgatgctcgtcaccccgagcatgacgatgaggtgtgtgggtgtgggtaaccgcgacttcgtcgaggggctgtctggggccacctgggtggacgtcgtcctggagcacggcggctgcgtgaccaccatggccaaaaacaagcccacgctcgacatcgaattgcagaagaccgaggcgacccaactagcgacactcagaaagttatgcatcgaaggcaagatcactaacatcaccaccgatagccgctgtcccacccagggcgaggctgtcctgccggaggagcaggaccagaactatgtctgtaagcacacgtacgttgaccgggggtggggcaacgggtgcggcctcttcgggaagggctccctggtgacatgtgcaaaattccagtgtcttgaacccatcgagggcaaggtcgtgcagtacgagaatctcaagtacacggtgataatcacggtccacaccggtgaccaacaccaggtggggaatgagacgcagggggtgaccgcggagatcacgccgcaggcaagcacgactgaggccatcctgcccgaatatggcaccctggggctcgaatgctccccgcgcacaggcttagatttcaatgagatgatacttctcacgatgaagaacaaggcctggatggttcaccggcaatggttcttcgatttgccccttccctggacgagcggggccaccaccgagactcctacctggaaccgcaaggaattactggtgacttttaagaacgcacacgcgaagaagcaggaggtcgtggtgttaggttcccaggaaggtgcgatgcacaccgccttgacaggggcgacggagatacagaacagcggagggaccagcatatttgccggccaccttaagtgcagattgaagatggataaactcgaacttaaaggcatgagctatgccatgtgcacaaacacctttgtcttgaagaaggaggtgtctgagacccagcacgggacaatcctcattaaggtggagtacaagggcgaggatgcgccgtgcaagatccccttcagcacggaggatgggcagggcaaggctcacaacggcagactcatcaccgccaaccccgtcgttaccaagaaagaggaacccgtgaatatagaggccgagccgccgttcggggaaagcaacatcgtcataggcatcggggacaacgcgctgaagataaactggtataagaagggatccagcatagggaagatgttcgaggccaccgctcgcggtgcaaggcggatggccatcttaggtgacaccgcttgggacttcggttccgtaggcggcgtgctcaacagcttaggcaaaatggtccaccaaatcttcgggtcggcctacactgccctgtttagcggtgtgtcctgggtgatgaagatcgggataggggtactccttacttggatcgggctgaacagcaaaaatacatcaatgagcttctcctgcatcgccatagggatcatcacgctctatctgggcgctgttgtccaagcggatatggggtgcgtcatcaactggaaaggcaaggagctaaagtgtggtagcggtatcttcgtcactaacgaggtgcacacatggacggaacagtacaaattccaggccgactcccctaaacgcctcgccaccgccatcgcaggcgcgtgggagaacggagtctgcggcatccgcagcacaacacggatggagaacttgctgtggaaacagatcgcaaacgagctcaactacatactgtgggaaaacaatatcaagctgaccgtggtggttggggataccatcggcgtactcgagcagggtaagagaaccctaacgccacagccgatggagctgaagtacagctggaagacctgggggaaggccaagattgtgaccgccgagactcagaacagctccttcatcattgacggccccaacacacccgagtgcccctcagcgtcgcgggcctggaacgtctgggaggtggaagactatgggttcggggtattcaccaccaatatctggctcaagctgcgcgaagtatacactcagatgtgcgaccaccggttaatgagcgccgccgtgaaggatgaacgcgctgtgcatgcggacatgggttactggattgagagccagaagaacggatcttggaaactcgagaaggccagcctgatcgaggtaaaaacctgcacgtggccgaagtctcacaccctctggagcaatggcgtgctagagtccgacatgatcatccccaagtccctggccgggccaattagccagcacaactaccgtccgggctaccacacccaaaccgcagggccgtggcacctcggccgcctcgagctcgatttcaactactgcgagggcacgaccgtggtaatcacagagaactgcgggactcggggcccctccctgcgtacgaccaccgtctcggggaaacttatccacgagtggtgctgccgctcttgcacgctgcccccactcaggtacatgggcgaagacgggtgctggtacggcatggagatccggcccataagtgaaaaggaggagaacatggtaaagagcttagtctccgcaggcagcggcaaggtggacaacttcacgatgggcgtactgtgccttgcgattctcttcgaggaggtgatgcgcgggaaattcgggaagaagcacatgatcgccggcgtgttcttcaccttcgtgctgttactctccggccagataacgtggcgagacatggctcacacattaatcatgatcggatctaatgcctccgaccgtatggggatgggcgtcacgtacctggcacttattgcaacctttaagatccagcctttcctggccctggggttcttcctccggaaactgaccagccgcgagaacctgctcctcggagtcggcttagcaatggccaccactctccaactacctgaggacatcgaacagatggcgaacgggatagctctgggcctcatggcactgaaactgattacccagtttgagacctaccagctctggaccgcactgatctctctgacgtgctccaataccatttttacccttactgtggcgtggcggactgcgaccctgatcctggccggggtgtcgttgctgccagtgtgccagtcctcctcaatgcggaagaccgattggctgcccatgaccgtggccgccatgggcgtacctcccctccccctgtttatcttctcgctgaaagacacgctcaagcgccggtcttggccgctgaacgagggagtgatggctgtcgggctggtaagcatcctcgcttcctcgctgctgcgtaacgatgtacctatggctggacctctcgtcgccgggggtctgctgatagcatgctacgtgatcaccgggacatcagccgacttgacagtggagaaggccgccgacgtcacgtgggaggaagaagccgagcagaccggcgtcagccataaccttatgattaccgtcgacgacgacgggacaatgcggatcaaggacgacgagacggagaatattctcacagtcctcctcaagaccgcacttcttatcgtatccggcatttttccgtacagcatccccgccacccttctggtgtggcacacatggcagaagcaaacgcagcgctccggggtactatgggacgtgcccagtccacccgagacccaaaaggcggagctagaagagggggtctaccggataaagcaacagggtatcctggggaagacccaggtcggagttggggtacagaaggaaggcgtctttcacaccatgtggcacgtgacgcgcggagccgttctcacccacaacggaaagcggctggagcccaattgggcctccgtaaagaaggacctcatcagctacggcggaggctggcgcctctccgcgcagtggcagaagggggaagaggtacaggtgatcgcggtcgagccaggcaagaacccgaagaacttccagaccatgcctggcaccttccagacgacgaccggtgagatcggcgccatagcccttgacttcaaacctggaacctcgggctcaccaataatcaacagagaaggcaaagtagtggggctatatggcaatggggtcgtaacgaagaacggcggatacgtatccgggatcgcccagacaaacgccgagccggacggaccaacccccgagctggaggaggagatgttcaaaaagcgcaacctcaccatcatggacctgcatcccggaagcggcaagacgcggaagtatctgccagccatcgtccgggaggctatcaaacgtcgtctccgtaccctgattttagctcctaccagggtggtggccgccgagatggaggaagccctcaaggggcttcccatccggtaccagacaacagcgactaaatccgagcacacggggcgcgagatcgtcgacttaatgtgtcacgccaccttcacgatgcggttactgtcgcccgtacgcgtgccgaactataatttaattatcatggacgaggcccacttcaccgatcccgcctcgatagctgcccgtgggtacatcagcacacgcgtggggatgggcgaggcggcagcgattttcatgacggccacgccacccgggaccgcagacgcctttccgcaaagcaacgctcccatccaggatgaggaacgcgacattcccgaacggagctggaactccggcaacgagtggatcaccgacttcgctgggaaaaccgtgtggttcgtgccaagcatcaaggcaggcaacgacattgccaattgccttcggaaaaatgggaaaaaggtcatccaactttcccggaagacgtttgataccgaataccaaaagaccaagctgaacgactgggattttgtggtcacaaccgatattagtgagatgggcgccaacttcaaggccgaccgggtcatcgaccctcggaggtgcctgaagcccgtgatccttaccgacggtccggagcgtgtgatactggcggggcccatgccggtcactgccgcctccgccgcccagcgccggggccgcgtagggcggaacccgcagaaggagaacgaccagtatatcttcacgggtcagcccctcaacaacgacgaggaccacgcgcactggacagaggccaagatgctcttggacaacatcaacacgcccgaggggattatccctgctctcttcgaacccgagcgcgagaagtccgccgcaatcgacggagagtaccggttgaagggagagtctcgcaagactttcgtggagctgatgcggcgcggggaccttcccgtctggctagcgcacaaggttgccagcgagggcatcaagtacaccgaccgcaagtggtgctttgatgggcaacgcaacaaccaaatcttggaagagaacatggacgtcgaaatttggaccaaagagggtgagaaacggaagctccgcccccggtggctggacgcccggacatactccgatccactggccctcaaggagttcaaggacttcgcggccggccgcaagagcatcgccctggacctggtgaccgagatcggtagagtcccctcacacctcgctcatcgcacccgtaacgcgctggataacctggtgatgctccacacctcagaacacggcgggcgagcctaccggcacgctgtggaggagctgccggagacgatggagacactgcttctactgggcctcatgatcttactgaccggtggtgccatgcttttcctgatcagcgggaaggggatcggcaagacctctatcgggctgatctgcgtgattgctagctccggaatgctctggatggcagagatcccgctgcagtggatcgcctctgccatcgtcttggagttctttatgatggtgctcctgatccccgagccagagaagcagcgcacgcctcaggacaaccaactggcctacgtagttatcgggattctcacccttgccgccatcatagcggccaacgagatgggattgctcgagacaactaagcgggacctgggcatgtccaaggagccgggggtggtctctcccacgtcctacctggatgtagacctccaccccgctagcgcgtggaccctgtacgctgtggccaccacggtgatcacgcccatgttgaggcacactatcgagaactccacggccaacgtcagcctagccgctatcgcgaaccaggccgttgtgttgatgggattagacaagggttggcccatctccaaaatggatctcggcgtgcccctgctggccctcgggtgttactcgcaggttaaccccctgacactgacggccgccgtactcttgctgattactcactatgccataatcgggcccggcctccaggccaaagccaccagagaggcccagaagaggaccgccgcgggtatcatgaagaacccgacagtagacggcataattaccatcgacctggacccagtgatttatgactcaaagttcgagaagcagcttggccaggtgatgctcctggtcctgtgcgccgtgcagctcctgctgatgcgcacctcttgggccttatgcgaggccctcaccctggcgactggccccatcacgaccctctgggaagggtcccccgggaagttctggaataccacgattgccgtgagcatggcaaacattttcaggggctcctatcttgccggggcggggctggctttcagcatcatgaagtccgtcgggaccggcaagcgaggcactgggagccagggcgagaccctcggtgagaagtggaagaaaaagctgaaccagctgagccgtaaggagttcgatctttacaagaaaagcggtatcaccgaggtggaccggacggaagcaaaggagggtctgaaaagaggcgagaccacccaccatgccgtgtcacggggttccgccaaactgcagtggttcgtcgagcgcaacatggtgatacctgaggggcgggtgattgacctcggctgcggccgaggcgggtggagctactactgtgccggcttgaaaaaggtcaccgaggtgcgaggctacaccaagggcggacccggccacgaggagcccgtcccaatgtcgacgtatggttggaacatcgtgaagctgatgagcgggaaggacgtcttctacctcccgcccgagaaatgcgataccctgctgtgtgacatcggcgagtccagcccgtcccccaccgtggaggagagccggacgattcgcgtcctaaagatggtagagccgtggctcaagaacaatcagttctgcatcaaggttctaaatccctatatgcctgcggtaattgagcatctggagcgactccagcgcaagcatggcgggatgctcgttcggaacccgctgtccagaaactcgacccacgaaatgtactggatctcaaacggaaccgggaacatcgtgagctccgtcaacatggtcagtaggctcctgctgaaccgctttaagatgacccaccggcgcccaacgatcgagaaggacgtggacctgggtgccgggacgagacacgtcaacgccgagcccgagacccctaacatggatgtgatcggagagcgtatcaagcgaatcaaggaggagcacaactccacttggcactacgacgacgagaacccatacaagacgtgggcctatcacggcagctacgaggtgaaggccacgggatccgcgagcagcatgataaatggcgtcgtcaagctgctgaccaaaccctgggatgtggtgccaatggtgacccagatggccatgactgacacgacccccttcggtcaacagagggtcttcaaggagaaggttgacacacgcacgcctcgcccaatgcccggcaccagaaaggtgatggaaatcaccgccgagtggctctggaggaccctgggccggaacaaacgcccaagactgtgcacgcgcgaggagttcaccaagaaagtccgcacgaacgccgcgatgggggctgtattcaccgaggagaaccagtgggacagcgcgaaggcagccgtggaggatgaggagttctggaagctcgtcgaccgggagcgcgagctgcacaagctgggcaaatgcgggagctgcgtgtacaacatgatgggcaagcgcgagaagaagttgggggagttcggcaaggctaagggctcgcgcgccatctggtacatgtggctgggggcccgttacttggagttcgaggcgctcggattcctgaacgaggaccactggttctcccgtgagaacagctacagcggggtggagggggaggggctgcacaaacttggatatatcctgcgggacatctcgaagatcccgggaggggccatgtatgcggacgatacggcgggttgggacactcgcatcaccgaggacgacctgcacaacgaggaaaagataacccagcagatggaccccgagcaccgcttgctagccaacgccatatttaagctcacgtaccagaacaaggtagttaaggtgcaacgccccacgccgaccggaacagtaatggacattatcagcaggaaggatcagcgcggctccggacaggtagggacctacgggcttaacacgttcacgaacatggaggcccagctggtgcggcaaatggagggggagggcgtcctctccaaggcggacctcgagaacccgcatctgcccgagaagaagatcacacaatggcttgagaccaagggggtcgagcgtctcaagcggatggccatcagcggggacgactgcgttgtcaagcccatcgacgacagatttgcaaacgccctgcttgccctcaatgacatgggcaaggtgcggaaggacatcccccagtggcagcccagcaagggttggcacgactggcagcaagtccccttctgctctcaccacttccatgagctcatcatgaaggacggccgcaagctggtagtgccgtgccggccgcaggatgagttgattgggagggcgcgcatcagccagggcgccggttggtccctgcgggagacggcctgtttgggcaaggcctacgcccagatgtggagcctcatgtacttccatcggagggacctacgcctggcctccaatgccatctgcagcgccgtgccggtccactgggtgcctacatcccgtaccacctggagcatccatgctcaccatcaatggatgaccactgaagacatgctcaccgtgtggaaccgcgtctggatcgaagacaacccctggatggaggacaagacccccgttacgacctgggagaacgtgccgtacctgggcaagcgggaagaccaatggtgcgggagcctaattggcctcacatcccgcgcgacctgggcccagaacatccccactgccatccagcaagtacggagcctgatcggaaatgaagagttcctggactacatgcccagcatgaaacgcttccggaaggaagaggagctggaaggagctatatggtga

SEQ ID NO: 25655 - RNA, 9873 nt, synthetic construct
  misc_feature 1..9873: note = derived and/or modified CDS sequence (opt11) from DENV-3__KF041258__SS-prME
  source 1..9873: mol_type = other RNA
acgtctctgtgcctcatgatgatcctgcccgccgcgctggctttccacctgaccagccgggacggtgaaccacggatgatcgtaggcaagaacgagaggggcaagagcctgctgttcaagaccgcttccgggattaacatgtgcaccctcatcgctatggaccttggagagatgtgcgacgataccgtgacctacaagtgcccccacatcaccgaggtagagcccgaagatatcgactgctggtgcaacctgaccagcacctgggtaacgtatgggacctgcaaccaggccggcgaacaccggcgggacaagcggagcgtggccctcgcgccccacgtggggatgggactggacactcgcacccagacctggatgagcgccgagggcgcgtggaggcaagtggagaaggtggagacgtgggcccttcgccacccggggttcaccatactcgctctgttcctggcccactacatcggaacctccctcacccagaaggtagtgatcttcattcttctgatgttggtcacgcccagcatgaccatgcggtgcgtgggggtagggaatagggactttgtcgagggcctgtccggggcaacgtgggtagacgtggtactggagcacggcggctgtgtcaccacgatggccaagaacaagcccaccttagacatcgagctccagaagactgaggccacccagcttgcgacgcttcggaagttatgcatcgaaggcaagatcaccaacattaccactgacagccgctgccccacgcaaggcgaggccgtcctgccggaggagcaggaccaaaactacgtctgcaaacacacttacgtggaccgtggttggggtaatggctgtggcctcttcgggaaggggtccctggtaacctgcgccaagttccagtgcttagaacccatcgagggcaaagtcgtgcaatacgaaaacctcaagtacaccgtgatcattacggtccacaccggtgaccagcaccaggtgggcaatgagacccaaggggtcaccgcagagatcacgcctcaggcctccaccaccgaagcgatactgcccgagtacggcaccctggggctcgagtgcagcccgcgcacaggcctagatttcaacgaaatgatcctcttgacgatgaagaacaaggcctggatggtgcatcgacaatggttcttcgacctacccctgccttggactagcggcgccaccaccgaaacacctacttggaaccgcaaagagctcctggtgacctttaaaaacgcgcacgcaaaaaagcaggaggtcgtggtgctggggagccaggagggtgcaatgcataccgccctcaccggcgcgacagagatccagaactcaggcggtaccagtatttttgccggccacttaaagtgccgactcaagatggacaagttagagctcaagggtatgagctatgccatgtgcaccaacacgttcgtcctgaagaaggaggtgtccgaaacgcagcacgggaccatactgataaaggtggagtacaagggcgaggacgcgccgtgcaagatccccttcagcaccgaggacggccagggcaaggcccacaatggcagactgatcacggccaaccccgtcgttaccaagaaagaggagccggtgaacatagaggccgagccgccctttggggaaagcaacattgtcataggcatcggggacaacgcgctgaagatcaattggtacaagaagggctcctcgatcgggaagatgttcgaggcaacggcccgaggcgcgcgtcggatggccatattaggcgacaccgcgtgggacttcgggtccgtgggcggggtgctcaatagcctgggcaagatggtccaccaaatctttggttccgcctacacggcgctgttcagcggggtatcgtgggtaatgaagatcggcatcggggtcctcctgacctggatcggactgaactccaagaacacctccatgagcttttcctgtatcgcgattgggatcatcaccctctacctgggcgcagttgtgcaagcagacatgggttgtgtcatcaattggaagggtaaggaactgaaatgcggtagcgggatcttcgttacgaacgaggtgcatacctggaccgaacagtacaagttccaggccgactctcccaaacgcttagccaccgccatcgcaggcgcgtgggagaatggtgtctgtgggatccgcagcacgaccagaatggagaacctgctgtggaagcagatagccaatgagctcaactacatactgtgggagaataatatcaagctgaccgtcgtggtcggggacaccatcggcgtgctggagcagggcaagcggacactgacaccccagcccatggagctgaagtactcatggaaaacctgggggaaggccaaaatcgtaactgccgagacccagaacagctccttcatcatcgatggccccaacacccccgagtgcccgtcggcttcccgggcctggaatgtctgggaggtggaggactacgggttcggcgtgtttaccaccaacatttggcttaagctgcgcgaggtctacacccagatgtgcgaccaccggcttatgagcgcggccgtgaaggacgagcgcgcagttcacgctgatatgggctactggattgagtctcagaagaacgggtcttggaagctcgagaaagcaagcctgattgaggtcaagacctgcacctggccgaaatcccacacactgtggagcaacggcgtgttggagtccgacatgattataccgaagagcctggccgggcccatctcccaacacaactatcggccgggctaccacacccagacggccggaccctggcacctgggcaagttggagctggacttcaactattgcgagggcaccaccgtggtcatcaccgaaaattgcgggactcgcggcccctcgttacgaacaaccaccgtgtccggcaagctcatccacgaatggtgctgccgcagctgcacgctgcccccgctgcgctacatgggcgaggacgggtgctggtatggcatggagatccggcccatttccgaaaaggaggagaacatggtcaagagcctcgtctctgcaggcagcgggaaagtggataacttcacgatgggcgtgctgtgtctggcaatcctcttcgaagaggtaatgcgtgggaagttcggcaagaagcacatgatcgcaggggtattcttcacttttgttctgttgttgtctggccagatcacctggcgcgacatggcccacacgttgattatgatcggcagcaacgcaagcgaccgaatggggatgggcgtgacatacctagcgctcatcgcgaccttcaagatccagcccttcctggcactggggttcttcctccgcaagctgaccagccgggagaacctgctcctgggtgtgggcctggcgatggcaacgaccctccaactgcccgaggacatcgagcagatggcgaatggaatcgccctgggcctgatggcgctgaagctgatgacccagttcgaaacctatcagctctggacagccctgattagtctgacctgctccaataccatcttcacactcacggtggcctggcgcaccgcgaccctgatcctggccggggtcagcctccttccggtgtgccagtccagctctatgcggaagacggactggcttcctatgactgtcgccgccatgggggttcctcccctcccgctgttcatcttcagcctgaaggacacccttaagagacgctcgtggcccctgaatgagggggtgatggccgtcggactggtgtcgattctcgcgtccagcctgctgcggaacgacgttcccatggccggcccactcgttgctgggggtctgttgatagcctgctacgtcattaccgggacctccgccgacctaacggttgagaaggcggccgacgtcacctgggaggaggaggccgagcagacgggcgtgagccataacctgatgatcaccgtggacgacgacgggaccatgcggattaaggacgacgagaccgagaacatcctgacagtcctcctgaaaactgctctgctcattgtgtccgggatcttcccgtactcgatacccgccacgctgctggtgtggcacacgtggcaaaaacagacgcagcggtcaggcgtcttgtgggacgtacccagcccccccgagacccagaaagcggagctggaggagggggtgtacagaatcaaacagcagggcattcttggcaagacccaggtcggtgtgggcgtgcagaaggaaggcgtattccacacgatgtggcatgtgacgcggggcgccgtgctcacacataacgggaagcgcctagagcccaactgggcctccgtcaagaaagacctaatcagttacggcgggggatggcggcttagcgcacaatggcaaaagggggaggaggtccaggtgatcgcggtcgagcccggcaaaaaccccaagaacttccaaactatgcccggcacgtttcagaccacgaccggagagatcggtgccatcgccttggacttcaaacccgggacttcaggtagccccatcattaaccgcgagggcaaggtggttgggctgtacggcaacggggtcgtcaccaaaaacggcgggtacgtgtccggaatagctcagaccaacgccgagccagatggccccacccccgagctcgaggaggagatgttcaagaagcgtaacctcactattatggatctgcacccggggagcggcaaaactagaaagtacctgccggccatcgtgcgggaggccatcaagcgccggctcagaacgctgatcctagcccccacccgggtagtcgccgcagagatggaggaggcgctcaagggactacccatccgctaccagacgaccgccacaaagagcgagcatactggtcgggagatcgtagatcttatgtgccacgccacgttcaccatgcgcctcctaagcccagtgcgggtgccgaactacaacctgataatcatggacgaggcccatttcactgaccccgcctctattgccgcccgcgggtacatcagcactcgagtgggaatgggcgaagcggccgcgatcttcatgactgccaccccgcctgggaccgccgacgcctttccgcagtcgaatgcccccatccaggacgaggagcgcgacatacccgagcgcagctggaactccggaaacgagtggatcacagatttcgctgggaagacggtgtggttcgtacccagcatcaaggccgggaacgacatcgcaaactgtctccggaagaatgggaaaaaggtcattcaactgtcccgcaaaaccttcgatacagagtaccagaagaccaagcttaacgactgggacttcgtggtgacgacggacatcagcgagatgggggcgaacttcaaagcagaccgggtcatagaccctcgccggtgcctcaaacccgtgatcctgaccgacgggcccgagcgcgtgatcttggctgggcccatgcccgtcacagccgcctccgctgcccagcggcgcggccgggtggggcgcaaccctcaaaaagagaacgaccagtacatcttcaccggacagcccctcaataacgatgaggaccacgctcactggacggaggccaaaatgctcctggataacatcaacaccccagaggggattatccccgccctcttcgagcccgaacgggagaagtccgcggcaatcgacggcgagtatcgcctcaagggcgagtcccggaaaaccttcgtggagctgatgcgccgcggggatctccccgtctggctggcacacaaggtggctagcgagggcatcaagtacaccgaccgcaagtggtgcttcgacgggcagcggaacaaccagatcctggaggagaacatggacgtcgaaatctggacaaaggagggagagaagcgcaagctccgtccccgctggctcgacgcccggacctactccgatccgctggccctaaaagagttcaaggacttcgcggccggccgcaaatcgattgctctggatctggtgaccgagatagggcgggtgccctcccacctcgcacaccggactcgcaacgccctggacaacctggtcatgttacacacgagcgagcacggagggcgggcctaccgacacgcggtggaggaactgcccgagactatggagaccctgctcctgctaggactcatgatcctgctcaccggtggcgccatgttattcctgatcagcggcaagggaatcggcaagacatccatcgggctgatctgcgtgatcgccagcagtggcatgctctggatggccgaaatcccgctccaatggatagcgagcgccatagtactggagttcttcatgatggtgctcctgattccggagcccgaaaagcagcggacgccccaggataatcagctagcatacgtggttatcgggatcctcactctcgctgcaataattgcggcgaacgagatgggactgctcgagactacgaagcgcgatctgggaatgtccaaggaacctggcgtcgtgagccccacctcctacctggacgtcgatcttcaccccgccagcgcctggaccctgtacgcggttgccaccacggtgattactcccatgctgcgtcacaccattgaaaactccaccgcgaatgtcagcttggctgctatcgcgaaccaggctgtcgtgctgatgggcctggacaaggggtggccgatctccaagatggacttaggcgtgccactactggcactcgggtgctacagccaggtaaaccccctgacactgaccgcagccgtgctcctgctgatcacccactacgcgatcatcggccccggcctccaagccaaggccacccgcgaggcacagaagcggacggccgcggggattatgaagaatcccaccgtagacgggattattacgatcgacctggaccccgtgatctacgactcgaagttcgagaagcaactgggccaggtcatgctcctagtcctgtgcgccgtccagttgcttctaatgcgcaccagctgggccttatgcgaggcactgacgctggcgaccgggccaataaccaccctgtgggagggctcccccgggaaattctggaacacgaccatagccgtgtccatggctaatatttttcgtggctcctatctggccggggccggactggcttttagcatcatgaagtccgtagggaccggcaaacgcggcaccgggtctcagggcgagaccctcggggagaagtggaaaaagaaactgaaccagctgagccggaaggagttcgacctctacaagaagtccggcatcacggaggtggaccgcaccgaggccaaggagggactaaagcggggcgagaccacccaccacgccgtctcacgcggctccgccaagctgcagtggtttgtagagcggaacatggtgatcccggaggggcgcgtgattgacctaggctgcggccggggggggtggagctactactgcgccgggctgaagaaagtcacggaggtgcgcggttacaccaagggggggcccgggcacgaggagcccgtccccatgtcgacctacggctggaatattgtcaagctgatgagcggtaaggacgtgttctatctccctcctgagaagtgcgacaccctgttgtgcgacatcggagagtccagccccagtcccacagtggaagaaagcaggaccatccgtgttctgaagatggttgagccatggctcaaaaataaccaattctgtatcaaggtactgaatccctacatgcccgcggtcatcgagcacctggagcgcctccagcggaagcacggcgggatgctggtccgcaaccccttgtcccggaacagcacccacgagatgtactggatctcaaacggtaccggcaacatcgtgtcttccgtcaatatggtgagtcgcctcctgctgaaccggttcacgatgactcaccgcaggccgaccatcgagaaagatgtggacctcggcgcaggcaccagacacgttaacgcagaacctgagactccaaacatggacgtgatcggagagcggatcaaacgcatcaaggaagagcacaactccacctggcactacgacgacgagaacccatacaagacctgggcctatcacggcagctatgaggtgaaggcgaccggatccgcgagcagcatgatcaacggcgttgtgaagctgctaacgaagccctgggatgtcgtgcccatggtgacacagatggcgatgaccgacactacgcccttcgggcagcaacgggtattcaaggagaaagtggacacccgcaccccgcggcccatgcccggtacccgtaaggtgatggagatcacggccgagtggctctggcggacgctgggccgcaataagcggccgagactgtgtacccgcgaggagttcacaaagaaggttagaacgaatgccgcgatgggggctgtgtttaccgaggaaaaccagtgggattccgcaaaggctgcggtggaggacgaagaattctggaagctcgtcgaccgcgagcgggagctgcacaagctaggtaagtgcgggtcctgcgtctataacatgatgggcaagcgcgagaagaagctcggggagttcggcaaagcaaaaggttcccgggccatatggtacatgtggttgggagcccgctacctggagttcgaagccctcggattcttgaacgaggatcactggttctcccgggagaactcctacagcggggtggagggagagggactgcacaagctcggctacgtcctgcgcgacatcagcaagatcccgggcggggccatgtacgcggacgacaccgccggctgggacacccggataacggaggacgacttacacaacgaagagaagatcacccagcagatggaccccgaacaccgcctcctggcaaacgccatctttaagctgacctaccagaacaaagtggtgaaggtccaacggccaacccccaccgggacggtaatggacatcatcagccgcaaggaccagcgcggctcaggccaggtggggacctacggcctcaataccttcaccaatatggaggctcagcttgtccgtcagatggagggggaaggcgtactgagcaaagctgacttagagaacccgcatctaccggagaaaaaaattacccagtggctggagaccaagggagtagaacgactcaagagaatggccatatccggtgacgactgtgtggtgaagcctatcgacgaccgattcgccaacgccctgttggccttgaacgacatgggaaaggtgcgcaaggacatcccccagtggcagccgagcaaggggtggcacgactggcagcaagttccgttctgctcccaccacttccacgagctgatcatgaaggacggccggaagctggtcgtaccctgtcgcccccaggacgagctcatcggacgggcgcggatcagccagggtgccggttggtccctgcgcgaaaccgcctgcctgggcaaagcatacgcgcaaatgtggagcctcatgtacttccaccggcgcgacttgcggctggcatccaacgccatctgcagcgcggtaccggtacactgggtgcccacctcccgcacgacctggtcaatccacgcccatcaccagtggatgaccaccgaggacatgctcacagtgtggaaccgggtttggatcgaagacaacccctggatggaggacaagacccccgtgaccacctgggagaacgtcccgtacctgggtaagagggaggaccagtggtgcgggagcctgatcggactcacgtcgcgggcgacctgggcccagaacatcccaaccgccatccagcaggtccgaagcctcatcgggaacgaggagttcctggactacatgccctccatgaagcggttccgcaaggaggaggagctcgagggcgcgatctggtga

SEQ ID NO: 25656 - RNA, 9873 nt, synthetic construct
  misc_feature 1..9873: note = derived and/or modified CDS sequence (opt11) from DENV-3__KF041257__SS-prME
  source 1..9873: mol_type = other RNA
acatccctctgtcttatgatgatactaccagcagctcttgcattccacctaacatcaagagacggtgaaccacgcatgatagtaggcaaaaacgaaagaggtaaaagccttctattcaaaacggcgagcgggattaacatgtgcacactcatagccatggacctgggggaaatgtgcgacgacactgtgacatacaaatgtccccacatcacggaagtagaaccggaagacatcgattgttggtgcaacctcaccagtacctgggtgacatacggcacgtgcaatcaagcgggcgaacaccgacgggacaaacgatcagtagcgctggcgccacacgtagggatgggattggatacccggacacaaacttggatgagcgcggaaggcgcatggaggcaagtagaaaaagttgaaacgtgggccctgcggcatccggggttcacgatcctcgcgctattcctcgctcactatataggcactagcctgactcaaaaagtcgtcatattcatcctactcatgctcgtgaccccatccatgacaatgcgctgcgtaggagtgggcaatcgggacttcgtcgaaggactcagtggggcaacatgggtcgacgtcgtcctggaacacggaggctgcgttacgacgatggccaaaaacaaaccaacgctggacatcgaactgcagaaaaccgaagcgacacaactagcaacgctacgtaaactctgcatcgaagggaaaatcaccaacatcaccactgactcacgatgccccacccaaggcgaagccgttctgccagaagaacaagaccaaaactacgtatgtaaacacacgtacgtagaccgagggtggggtaacgggtgcggtctgttcggcaaagggtccctagtaacttgtgcgaagttccaatgcctcgaaccaatcgaggggaaagtcgtacagtacgagaacctaaaatacaccgtcatcataacagtgcacacgggcgaccagcaccaagtagggaacgagacccaaggggtaacagctgagatcacaccccaagcatccaccaccgaggctatactgccagagtatggcaccctaggtctagagtgcagcccccgcaccggcctggacttcaacgaaatgatccttctaaccatgaaaaacaaggcatggatggtccatagacaatggttcttcgacctccccttaccctggacatcaggagcaacaacagagaccccgacatggaatagaaaggaactcctggtaaccttcaaaaacgcgcacgctaagaaacaggaggttgtcgtcctcgggagtcaggagggcgcgatgcacaccgcactgacaggcgctactgaaattcagaactcgggaggcacaagtatatttgcaggacacctaaaatgccgactaaaaatggataagctagagctaaagggcatgtcctacgcgatgtgtactaacaccttcgtcctaaagaaagaggtcagcgaaacacaacatggcacgatcctcatcaaggtagaatacaaaggcgaggacgcgccgtgtaaaatccccttttcgacagaagacggccaggggaaggctcacaatggtcgtctcataacggctaaccccgttgtgacgaagaaagaagaacccgtaaatatagaagccgaacccccattcggtgagagcaacatcgtgattggcatcggggacaacgccctaaaaatcaactggtacaagaaaggctcaagcatcgggaaaatgtttgaagctactgctagaggagcgcgccggatggccatattgggagacaccgcgtgggacttcggctctgtagggggagtgctcaatagtttggggaaaatggtacaccaaatcttcggcagcgcatacacggccctgttctcgggagtgagctgggttatgaaaataggaataggcgtcctcctgacctggataggactcaatagcaaaaatacgagcatgagcttttcttgtatcgcgatcgggattataacactatacctaggagccgtagtgcaagcggacatgggctgcgtcatcaattggaagggaaaggaactaaagtgcgggtctggaatattcgtaacaaatgaagtccacacctggactgaacagtataaattccaagcagactcaccgaagcgcttagccaccgcaatagcaggagcgtgggagaacggcgtatgcgggattcgatcaacaactcgtatggaaaatctcctatggaaacagatagcgaacgagttaaactacatcctatgggagaacaacattaagctcaccgtagtagtaggggatacaataggcgtccttgagcaaggaaaaaggactcttaccccgcaaccgatggagctcaaatattcctggaaaacatggggaaaagccaagatcgtaacggccgagacgcagaactcgtctttcatcatcgacggcccaaacacgccggaatgcccaagcgcctctcgggcatggaacgtgtgggaagtcgaagactacgggtttggagtgtttaccactaatatatggctcaaacttcgagaggtatacacgcaaatgtgtgaccacagactcatgtctgccgcggtgaaagacgagagagctgtacacgccgacatgggatattggatcgagtcccagaagaacgggtcgtggaagctcgaaaaagcatccttgatagaggtgaaaacgtgcacatggccaaagagccacacactctggtccaacggggtattggagagtgacatgatcatcccgaaatccttagccgggcccatcagccagcacaactacagacctgggtaccacacacagacagcaggaccatggcacctcggtaaacttgaacttgatttcaactattgcgaaggaaccaccgtggtgattaccgagaactgcggaactaggggaccatcccttcgaacgaccacagtctcaggtaaactgatccacgagtggtgctgccgatcatgtacgctcccgcccttaaggtacatgggtgaagatgggtgttggtatgggatggaaataagaccaatctccgaaaaggaagagaacatggtaaaatcattagtatcagcaggctcgggaaaagtcgataacttcactatgggagtattgtgtctggccatcctgttcgaagaagtgatgcgcggcaagttcggcaagaaacacatgattgcgggggtcttctttacattcgtcttacttctatccggacaaataacctggagagacatggctcacacactaatcatgatagggagcaacgccagcgacagaatgggtatgggcgtgacatacctagcactgatagcgacattcaaaatacaacccttcttagcactgggcttctttctaaggaaactaacctcgcgagaaaaccttctcctcggagtaggcctggcaatggcgaccaccctgcagcttcccgaagatatagaacagatggcgaacggaatagcattgggccttatggccttaaagctcataacgcaattcgagacataccaattgtggaccgccctcatttcgctaacctgctccaacactatcttcacccttactgtagcttggaggaccgcaacactaatactagcaggcgtctccctcctccccgtttgtcaaagctccagcatgaggaaaacagactggttgccgatgacggtagcagcaatgggggtgcccccactgcccttgttcatattctccttgaaagacaccctaaagcggcgctcctggcccttgaatgagggcgtgatggccgttgggctagttagcatccttgcgtcttcgctactcagaaacgacgtaccaatggctggaccattggttgcaggaggactactaatagcctgctacgtaataacgggcaccagcgctgatttaacggtggaaaaggcagcggatgttacatgggaggaagaggcggagcagactggcgtatcgcacaacctaatgattaccgtagacgacgatggaacaatgcggatcaaggatgatgaaacggagaacatactgactgtcctactgaaaaccgcactattaatcgtatcagggatcttcccatactccataccggcaacactcctcgtttggcacacctggcaaaaacaaacccagcgctccggggtactttgggacgtaccgtccccacccgaaactcaaaaggcagagctagaggagggtgtatacagaatcaaacaacagggcatcctcggcaagacacaagttggagtaggtgtacaaaaagaaggagtcttccacacgatgtggcacgtaacgcggggcgcggtgctgacacacaacggaaaaagactggagccaaactgggcaagtgtgaaaaaggacctgatatcgtacgggggcgggtggcggctgagcgcccaatggcaaaaaggtgaagaggtacaagtgatagcagtcgaacccgggaaaaacccaaagaatttccaaaccatgcctgggacattccagaccacgacaggcgagatcggcgctatagccctagatttcaaacccggcacctctggcagccctataatcaaccgagaagggaaggttgtcggtctttacgggaacggtgtagtcacgaaaaacggtggatacgtctccggtatagcccaaaccaacgcggaacccgacgggccgacacccgagctggaagaagaaatgtttaaaaagcgcaacctcaccataatggacttacatccagggtcgggcaagaccaggaaatacttgcccgcaattgtaagggaagcaatcaaacgtagactacgtacactaatacttgcgcccactagagtcgtcgctgcagagatggaggaagccctcaaagggctcccaataagataccaaaccacggcaaccaaaagtgaacacaccgggcgcgagatcgtcgacctgatgtgccacgcaacgttcaccatgcggctgctctccccggtacgggtgccaaactacaacctgataatcatggacgaggcccacttcacggaccccgcctctatcgccgcgcggggctacatatcgacaagagtcggcatgggagaggcggccgcgatattcatgacggcaacacctccaggcacagcagatgcctttccacaaagcaatgccccgatccaagacgaggaacgcgacatacccgagcgatcctggaactcaggcaacgaatggatcaccgactttgctgggaaaacggtctggttcgtcccgtcgatcaaagccggaaatgacatagccaactgtttaagaaagaacggaaagaaagtaatacaactaagtcggaaaacatttgatacggaataccagaaaaccaaactaaacgactgggatttcgtcgtcaccactgatataagcgagatgggcgcaaacttcaaagcagaccgggtcattgacccgcggcggtgcctcaaaccagtaatactcacggatgggcctgagcgagtaatcctcgctggcccgatgccggtaacagcggcatctgctgcgcaacgacgcggacgcgttggacgcaacccacaaaaggagaatgaccaatacatattcactgggcagcccctgaacaacgacgaagaccacgcccattggacagaggcgaagatgctgctcgacaacataaacacaccggaaggtatcataccagccctgtttgaaccagagagagaaaaatccgcggccatcgacggagaatatcggctcaagggtgaatctcggaagacctttgtagaactaatgcgccgcggagatctacccgtctggctcgcccataaagtcgcatccgaaggcataaaatacacagatagaaaatggtgctttgacggccagaggaataaccagatcctagaggaaaacatggacgtggagatctggacgaaggagggggagaaacgcaaactgaggccgcgctggctggatgcaaggacgtatagcgaccccctagccctgaaagagttcaaagatttcgctgcaggcaggaaaagtatagcacttgatctagtaaccgaaatcggtcgggtaccaagccacctagcccaccgcacacgcaacgccctggataatctcgtaatgttacacaccagcgagcacgggggccgagcataccgacacgccgtagaggagctacctgaaaccatggaaacacttctgctactggggctaatgatacttctgaccggcggggctatgctatttttaatcagcggaaaaggcataggtaaaacctcgatcggactaatctgcgtaatagcctcatcgggaatgctttggatggcggaaatacccctccagtggatcgcctccgccatagtcctcgagttcttcatgatggtattactaattcccgagcccgaaaaacaacgcacaccgcaggacaaccaactagcatatgtggtcataggtatactcaccctagccgccataatcgccgcaaatgagatgggactactggaaacaactaagagggacctcgggatgtccaaggagcctggggtcgtttcgccgacatcatacttggacgtcgacttacacccagcaagcgcgtggacgctgtacgccgtagcgaccaccgtcattacaccaatgctccggcacacgattgaaaactccacagcaaatgttagcctggcggccatcgcaaatcaggccgtagtgttaatggggctggacaaaggatggcccatctcaaaaatggatctcggagtacccctactagccctgggatgttactcgcaagtgaatccactaacgctaaccgctgccgtgctacttctcatcacccactacgccatcataggaccggggctgcaagcgaaagcgacacgagaggcacagaagcgaacagccgcaggtataatgaagaacccaacagtagatgggatcatcaccattgatctggacccggtcatttatgactctaagttcgaaaaacaactcggtcaagtcatgctcctggtactttgcgcagtacaactcctactgatgagaacctcatgggccctctgtgaagcactaacactggccacgggacctataactaccctgtgggagggcagtcccggaaagttctggaacaccacgatcgcagtttctatggccaacatcttccggggctcgtacttggcaggcgcaggccttgccttcagtatcatgaagtcggtagggactgggaagcggggaacgggatcgcaaggcgagaccctcagagaaaagtggaagaagaaactgaaccagttgagtcgaaaagagttcgacctatacaagaaatcagggatcaccgaagttgataggacagaagcaaaagagggcctcaaacgaggagaaacgacacatcacgcagtaagcagaggctcggcgaaactccagtggtttgtagaacggaatatggtgatcccagaggggagagtaatagacttagggtgcgggcgaggcggctggagctactactgcgcagggcttaagaaagttaccgaggtgcgtggttacaccaaagggggtccgggacacgaggaacccgtcccgatgtcaacctacggttggaacatcgtaaagttgatgagcggcaaggacgtcttctacctcccacccgaaaagtgcgacaccctactatgcgacatcggtgaatcatcccctagcccaactgtcgaagaaagccgcactatccgggtcctcaagatggtcgaaccatggctcaaaaacaaccaattttgcatcaaagtgttaaacccctacatgccggcagtgatcgagcatttggagagactacagaggaaacacggcggcatgttagtacgaaaccccctcagcagaaactccacacatgaaatgtactggatctccaatgggacaggaaacattgtctcaagcgtcaatatggtatcgagactactactcaaccgattcacaatgacgcaccggaggcccaccatcgaaaaggacgtggacctaggtgccggaacccgtcacgtgaatgccgagcccgagacaccgaacatggatgtaataggcgaacggatcaagcggatcaaggaagaacataactcaacatggcattacgacgacgaaaacccgtacaaaacttgggcgtaccacggatcatacgaggtgaaagccaccggctccgcctcctccatgatcaatggagttgtgaagctactcaccaaaccctgggacgttgtaccaatggtcacacagatggccatgacagacacaactccattcggacaacaacgggtattcaaggaaaaggtggacacgaggaccccgcggccgatgccgggaacaagaaaggtgatggaaatcactgccgagtggctatggcgtaccctgggacgaaataaacgaccccggctctgcacgcgagaagagttcaccaagaaagtccggacaaatgcagccatgggagcagtcttcaccgaggaaaaccaatgggatagcgcgaaggccgccgtagaagacgaagagttctggaagctagttgaccgggagcgcgaactacataaactgggcaagtgtggatcatgtgtatacaacatgatgggcaaaagagagaagaaactaggagaatttgggaaggcgaaaggctcgagagccatatggtatatgtggctaggcgcaagatacctagagttcgaggccctgggatttttaaatgaagaccattggttcagtcgcgaaaacagctacagcggggtcgagggggaaggattgcacaaattggggtacatcttacgggacatctcaaagattccgggaggcgccatgtatgcagacgataccgccggatgggacaccagaataacagaggacgacctccacaacgaggagaaaataacgcaacaaatggatccagaacacagactcctagcaaatgctattttcaaactgacatatcagaacaaagtggtaaaagtgcaacgacctactcccacgggcacggtcatggacatcatatccagaaaagaccagcgaggatctggacaagtgggtacgtacggacttaacacgtttacaaatatggaagcccagctagttcgacaaatggaaggtgaaggtgtactcagcaaagctgatctagaaaacccgcatctgccggagaagaaaattacacagtggctagaaacaaagggagtagagaggctaaaaaggatggcaatatcaggagacgactgcgtagtaaaaccgatagacgaccgattcgccaacgcactcttagccctcaacgacatggggaaggttcgcaaagacataccccaatggcaaccttctaaaggatggcatgactggcaacaggtcccattttgctctcaccactttcacgaacttatcatgaaggatggcagaaaactggtcgtaccatgcagaccacaggacgaactcatcgggcgcgcccggatcagccaaggagcaggctggagcctgagagaaacagcttgcctgggaaaagcctacgcccagatgtggagccttatgtactttcacaggcgcgacctacgtcttgcgagcaacgcaatctgcagcgcagtgcccgtgcactgggttccaacgtctcggacgacctggtcgatccatgcgcatcaccaatggatgaccactgaggatatgctcacggtctggaaccgcgtatggatagaagacaacccatggatggaggacaagactccagtcacgacttgggaaaatgtaccatacttgggcaagcgcgaggaccaatggtgcggcagcctaataggcctgacaagccgtgccacttgggcccagaacattcccacagcaatacaacaagtaaggagcctaataggaaatgaagagttcctagactacatgccctcgatgaaaagattcaggaaggaagaagaactggaaggcgcgatatggtga

SEQ ID NO: 25657 - RNA, 9873 nt, synthetic construct
  misc_feature 1..9873: note = derived and/or modified CDS sequence (opt11) from DENV-3__KF041255__SS-prME
  source 1..9873: mol_type = other RNA
accagcttgtgccttatgatgatcctgcccgccgccctggcatttcacctcaccagccggaacggggaacccaggatgatcgtggggaaaaacgagcgcggcaagagcctactgttcaagaccgcttccgggattaacatgtgcacactgattgccatggacctgggcgagatgtgcgacgatactgtgacctacaagtgcccacacatcaccgaagtggagcccgaggacatcgattgttggtgcaacctgaccagcacctgggtcacctatggtacctgcaatcaagcaggcgagcaccggcgggacaaacggtcagtggccctcgcaccccacgtgggcatggggctggacacccgaacccaaacctggatgtcagctgagggcgcctggcgccaggtggagaaggtggaaacgtgggccctgcgccacccggggttcaccatcctcgccctgtttctggctcactacattggcactagtctcacccaaaaggtggtgatcttcatactgctgatgctcgtgacgcctagcatgaccatgcggtgtgttggagtggggaaccgcgactttgtcgaaggcctgtccggggccacctgggtggacgtggtcctggagcacggcgggtgcgtgaccacgatggccaagaacaagcccaccctagatatagagctgcagaagaccgaggctacacagctggcgacgctccggaagttatgtattgaggggaagatcaccaacatcaccactgacagcagatgccccacgcagggtgaggccgttctgccggaagaacaagaccaaaattacgtctgcaagcacacctacgtggaccgggggtggggcaacgggtgcggcttattcggaaaggggtccctagtcacctgcgccaagttccagtgcctggagcccatagagggcaaagtagtgcagtatgagaacctcaagtataccgttattatcacggtccacacgggggatcagcatcaagtgggcaacgaaactcagggtgtcaccgccgagatcacgccccaggccagtaccaccgaagccatcttgcccgaatacggcaccctggggctcgagtgctcgccgcgcacaggcctggacttcaacgagatgatcctgctcactatgaagaacaaggcctggatggtacaccggcagtggtttttcgaccttcccctcccctggaccagcggcgccaccaccgaaacgccaacctggaaccgcaaggagctcctggtgacattcaagaatgcccacgccaagaagcaggaggtcgtggtgctggggtcccaagagggcgcgatgcataccgccctcacgggggccaccgagatccagaactcgggtgggacgtccatcttcgctgggcacctgaagtgccggctgaaaatggacaaactagaactgaagggtatgtcctacgctatgtgcaccaacaccttcgtcctgaagaaggaggtgtctgagacccagcatgggaccatactcatcaaggtggagtacaagggcgaggacgcgccgtgtaagatcccattcagcactgaggatgggcaaggcaaagcccacaacggccgcctgattacagccaatcccgtcgtgaccaagaaggaggagcctgtgaacattgaggccgagccgcccttcggggagtcaaacatcgtcatcggaataggcgacaacgcgctgaagattaactggtataagaaaggctccagcatcgggaagatgttcgaggctaccgcacggggtgcgcgcagaatggctatcctgggcgacaccgcgtgggacttcggctccgtgggcggggtgctcaatagcctgggaaagatggtacatcagatcttcggttcggcctacactgccttgttcagcggcgtgtcgtgggtgatgaagataggcatcggtgtcctactgacctggatcggcctgaacagcaagaacacgtctatgagcttttcttgtatcgcaatcggcataatcacgctctacctgggcgccgtggtgcaagctgacatggggtgtgtaattaactggaagggcaaagagctcaagtgcggcagcgggatcttcgtgacaaacgaggtccacacctggaccgagcagtacaagtttcaggccgattcccccaagcgcctcgccaccgcaatagcaggcgcgtgggagaacggggtgtgtggcatccgcagcacgacccgcatggagaacctgctgtggaagcagatcgccaacgagttgaattacatcttgtgggagaataatatcaagctcaccgtggtggtcggggacaccatcggcgttctcgaacaaggcaaacgaacgctgacgccccagccgatggagcttaaatactcctggaaaacgtgggggaaggcgaagatcgtgaccgccgagactcagaacagctccttcatcatcgacggtccaaacaccccagagtgcccctccgcttcccgggcctggaatgtctgggaagtcgaggactacgggttcggcgtgttcacgaccaacatttggctcaagttaagggaggtttacacccagatgtgtgaccatcgcctaatgagcgccgccgttaaggacgagcgagccgtccacgctgacatgggatattggatcgagtctcagaagaacgggtcctggaaactcgaaaaggcctctctcatagaggtcaagacgtgtacatggccgaagagtcacaccttgtggagcaacggcgtcctcgagtccgacatgataatccctaagtctctcgcaggccccatttcccagcataactatcgcccgggatatcacacacagacggccgggccctggcacttgggcaagcttgaactggacttcaattattgcgagggcaccaccgttgtcatcaccgaaaactgcggcacgaggggcccaagcctacggaccaccacagtaagcggaaagttaatccatgagtggtgttgccgcagctgcactctgcccccgctgcggtacatgggtgaagacgggtgctggtacggcatggagatccgccccatctccgagaaagaggagaacatggtcaagagcctcgtctccgctggctcgggcaaggtggacaacttcaccatgggcgtgctgtgcctggcgattctcttcgaggaggtcatgcgggggaaattcggcaagaagcatatgatcgcgggggttttcttcaccttcgtgttattactcagtgggcagatcacctggcgcgacatggcgcacacgctgatcatgataggcagcaacgcctccgaccggatgggaatgggcgtcacctaccttgccctcatagcgaccttcaagatccagcccttcctcgcccttgggttcttcctccgcaagttaaccagccgagagaatctgctcctgggcgtcggcctggccatggccacgaccctgcaactgcccgaagacatcgagcagatggctaatgggatcgccctggggcttatggccctgaaactgatcactcagttcgagacctaccaactctggacggccctgatctctcttacctgctccaataccatattcaccctcacggtggcgtggcgcacggcgacgttaatcctcgctggggtcagcctcctcccggtgtgccagagcagcagtatgcggaagaccgactggctgcccatgaccgtcgccgccatgggagtgccgcccctcccgctcttcatcttcagcctgaaggacaccctgaaacgacgctcatggccgctgaacgagggggttatggccgtcggtctcgtgagtatactcgcatcctcactgttacgtaacgacgtgcccatggctggccccctggtcgccgggggcctgctgattgcctgttacgtgatcaccggtacgtccgccgacctcacggtggagaaggccgccgatgtcacctgggaggaggaggccgagcagaccggcgtcagccacaatctgatgatcaccgtagacgacgacgggaccatgcgtatcaaggacgacgagacggagaacattctgacggttttgctgaagaccgccctgctcatcgtgtccggcatcttcccgtacagcatccctgctaccctgctggtatggcacacgtggcagaaacagacccaacggtccggcgtcctctgggacgtgcccagccctcccgagacccagaaggcggaactggaagagggggtgtaccgcatcaaacagcagggcatcctagggaagacccaggtaggcgtgggggtgcaaaaagagggcgtatttcacacgatgtggcacgtaactcggggcgccgtgctcacccacaacgggaaacgcttggagcccaactgggcctccgtgaaaaaggatctgatctcgtacggtgggggctggcgcctatccgcccagtggcagaagggggaggaggtccaagtgatcgcggtcgagcccggcaagaaccccaaaaactttcaaactatgcctggcactttccagaccacaaccggggagattggcgcgatcgccctcgactttaagcccggcacgagcggcagcccaatcattaacagggaaggcaaggttgtggggctatacggcaacggggtcgtgaccaagaacggcgggtacgtgtccggcatcgctcagacaaacgccgagccggacggccccacgcccgagcttgaggaggagatgttcaagaagcggaacctcacgatcatggacctgcaccccgggagcggcaagacccggaaatacttaccggcgatagttcgagaggccatcaagcgcaggctccgcaccctgatcctggcccccaccagggtggttgccgcagagatggaagaagcgctcaagggcctgcccatcaggtaccagacgaccgcaaccaagtccgagcacaccggccgggagatcgtcgacctcatgtgccacgccaccttcacgatgcgactcctttccccggtgcgggtaccaaactacaatctgataatcatggacgaagcccacttcaccgaccccgccagtatcgcagcccgcgggtatatcagcacccgggtcggcatgggtgaggcggccgcgatctttatgacggccactccgccagggaccgctgacgccttcccacagtccaacgcgcccatccaggacgaggagcgggacatccccgagcgcagctggaactccggtaatgagtggatcactgacttcgcggggaagacggtgtggttcgtacctagcataaaggcaggcaacgacatcgccaactgcctcagaaagaacgggaaaaaagtcatccagctgagtcgcaaaaccttcgataccgagtaccagaaaaccaagctgaacgactgggacttcgttgtgacgaccgacatctcagagatgggagccaatttcaaggccgaccgggtcatcgacccacgccgctgccttaagcccgtgattctgacggacggccccgaaagggtgatcctggcggggcccatgccggtcaccgccgccagtgccgcacagagacggggccgggtgggccgcaatccccagaaggagaacgaccagtacatcttcactggccagcccttgaacaacgacgaggaccacgcgcactggacggaggctaaaatgctcctggacaacatcaacacacccgaggggatcattccggcactctttgagccagagcgcgagaagtccgcggcgattgacggcgagtaccgcctaaagggcgagtccagaaagacattcgtggaactgatgaggcggggggacctcccagtctggctcgcccacaaagtggcctccgagggcattaagtacaccgaccgcaagtggtgcttcgacgggcaaagaaacaaccagatactggaagagaacatggacgtcgaaatttggacgaaggagggcgagaagcgtaagctcagaccacgctggctggacgcccgcacctactccgaccctctggccctaaaggagttcaaggatttcgcggcgggtcgcaagtcgatcgcccttgacttggtgaccgagatcgggcgcgtgccctcccacctcgcgcaccggacaaggaacgccttagacaatctggtcatgctccacacaagcgagcatggcgggcgggcgtaccgccacgccgtggaggaactgccagagaccatggagaccctgctactcctgggcctcatgatcctgctgaccggtggcgccatgttgttcctgatcagcggcaaggggatcggcaagacgtccattggtctgatctgcgtgatcgccagctctggaatgctctggatggccgagattccgctacaatggatcgcgagtgccatcgtcctggagttcttcatgatggtcctgctgatccccgagcccgagaaacagcggacgccacaagacaatcagctggcctacgtagtcattgggatcctaaccctagcggcaatcattgctgccaatgagatgggcttactcgagaccacgaagcgagacctgggcatgtccaaggagcctggggtggtatcccccacctcttatctcgacgtcgacttgcaccccgccagcgcctggaccctctacgcggtggcaactacagtgatcacaccgatgctgaggcataccatcgagaactccactgctaacgtcagcctcgccgccatcgcgaaccaggccgtggttctgatgggcctggacaaagggtggcctatatccaagatggacctcggggtcccactgctggcactcgggtgctacagccaggttaaccctctgactttgaccgccgccgtgttgctgttaatcacccactacgcgatcattggtccgggcctccaagccaaggcgaccagggaagcccagaaacggaccgcagctgggatcatgaagaatccgaccgtagatggcatcatcaccatcgacctggatcccgtgatatacgactccaaatttgagaaacagctggggcaagtgatgctattggtcctgtgtgccgtacagctgctgcttatgagaaccagctgggccctctgcgaagccttaacgttggcgactggccctattaccactctctgggagggctcccccgggaagttctggaatactacgatcgccgttagcatggccaacatcttccggggcagttacttggctggggccgggctggcattcagcatcatgaagtccgtcggtacaggcaagcggggcaccgggagccagggcgagacccttggtgagaagtggaagaagaagctgaaccagctgagcaggaaggagttcgacctttacaaaaagagcggcataacggaggtggatcgcacagaggcgaaggaagggctgaaacggggcgaaactacccaccacgccgtaagcagaggcagcgcgaagttacagtggttcgtcgaaaggaacatggtgatcccggaaggcagagtcattgacctcgggtgcgggaggggcggttggagctactactgcgccggcctgaagaaggtcacggaggttcgcggctacacaaaaggcgggcccggacatgaggagcccgtgcccatgtccacctacggctggaacatcgtaaagctgatgagcggtaaagacgtgttctatttgccgcccgagaagtgcgacactctgctgtgcgacataggcgagagttcaccgagccccactgtggaggagagccgcaccatccgagtactgaagatggtggagccgtggctcaagaacaatcagttctgcataaaggtgttaaacccctacatgcccgcagtcatcgagcatctggagcgcctccagcggaaacacggcgggatgctggttcgcaatcccctgtcccggaactccacccatgagatgtactggatctccaacggaaccgggaatatcgtgagctctgtcaatatggtcagccgcctcctgctgaaccgtttcaagatgacgcaccgccgtccgaccatcgagaaggacgttgacctgggtgccggcacccgccacgtcaacgccgagcccgaaacccccaacatggacgtgatcggggagcggatcaagcgcatcaaggaggagcacaactccacgtggcactacgacgacgagaacccctataagacatgggcctaccacggcagctacgaggtgaaagccaccgggtcagcgagcagcatgatcaatggcgtcgtgaagttactgaccaaaccttgggacgtcgtacccatggtgacgcaaatggccatgaccgacaccaccccgttcgggcagcaacgggtctttaaggagaaggttgacacgagaaccccgcggcccatgccgggcacccgaaaggtgatggagatcaccgccgagtggctctggcggacgctggggcgcaataagcggccccgcctgtgcacccgcgaagaattcaccaagaaagtcagaaccaacgccgccatgggggccgtgttcacggaggagaatcagtgggactccgctaaggctgccgtcgaagacgaggaattctggaagctcgtggaccgcgaacgggagctccataaactgggtaagtgcggaagctgcgtatacaacatgatgggcaaacgtgagaagaagctcggtgaattcggcaaggcgaagggctcccgggctatctggtacatgtggctgggcgcccgctatctagagttcgaggccctaggcttcctgaacgaggaccactggtttagccgggagaacagctactcaggggtggagggcgaggggctgcacaagctcggctacatattgcgcgatatctcaaagattccgggtggggccatgtacgcggacgacaccgccgggtgggacacacggatcacggaagatgacctgcataacgaggagaagatcacgcagcaaatggacccagagcaccgccttttggccaacgccatcttcaagctgacctaccagaacaaggtggtaaaagtgcagcggcccacccccaccgggacagttatggacattatcagccgaaaggaccagcggggctccggccaggtggggacgtatggcctcaacaccttcaccaacatggaggcccagctggtacgccagatggagggcgagggcgtgctgtctaaggcggacttggaaaacccgcacctccccgaaaagaagataacccagtggctcgaaacaaagggggtggagcgactcaagagaatggccatctccggcgacgactgcgttgtcaaacctatagacgaccggttcgctaacgccctcctggccctgaacgacatgggcaaggttcgcaaagacatcccccagtggcaaccgagcaaggggtggcacgactggcagcaggtccccttctgctctcaccactttcacgagctgatcatgaaggatggccggaagctggtagtgccatgccgcccccaggacgagctcatcggtcgggcgcgcatctcacaaggcgccgggtggtccctgcgcgagacggcctgcctgggcaaggcctacgcgcagatgtggagcctcatgtacttccacagaagagacctgcggctggcatccaacgccatctgcagcgccgtgccagttcactgggtccccacctcccgcaccacctggtccattcacgcccaccaccagtggatgaccaccgaggacatgctaaccgtgtggaaccgggtatggatcgaggacaacccttggatggaggacaagacgccagtgacaacgtgggagaacgtgccgtacctgggcaaacgcgaggaccagtggtgcgggagcttgatcggattgacctctcgtgcgacgtgggctcagaatatccccaccgctatccagcaggtacggagcctgatcgggaacgaggagtttctggactatatgccctccatgaagcggttccgcaaggaagaggaactcgaaggcgccatatggtga

SEQ ID NO: 25658 - RNA, 9873 nt, synthetic construct
  misc_feature 1..9873: note = derived and/or modified CDS sequence (opt11) from DENV-3__KF041256__SS-prME
  source 1..9873: mol_type = other RNA
acttctctctgccttatgatgatcctcccggccgctctcgccttccatttaacgtcccgcgatggcgaaccccgcatgatcgtcgggaagaatgaacgcggcaaatccttgctctttaaaaccgcgagcgggatcaatatgtgtacgctgatcgcaatggacctaggggaaatgtgcgacgacacggtgacctacaaatgcccccacataaccgaagtggaaccagaagacatcgattgttggtgcaacttaacaagcacctgggtaacgtacggcacgtgcaaccaagcgggagaacaccggcgggacaagaggagcgtagcacttgcacctcatgtaggcatgggcctggacacgcgcacgcaaacgtggatgagcgccgaaggagcttggcgccaagtcgaaaaagtagaaacatgggcactgcgccatcccggtttcaccatacttgctttgttccttgcgcattacattgggacctctctcactcaaaaagtggtaatcttcattttactgatgttagtcaccccatccatgaccatgcgttgtgtcggagtcggcaatcgagacttcgtagaaggcctgtccggtgcaacgtgggtcgatgtggtgctggaacacgggggatgcgtgaccacaatggccaagaacaagcccaccttggacatcgagctccaaaagaccgaggctacccaactggcgacgctcagaaaactatgcatagaaggaaaaatcaccaacataaccacagattccagatgcccaacacaaggagaggcggtgctgccggaagaacaggatcaaaactacgtctgtaaacacacatatgtggaccgcggctggggcaatggctgtggactcttcggcaaaggatccttagtaacgtgcgccaagttccaatgcctagaacctattgaggggaaagtagtacagtatgagaacttgaagtacaccgtgatcataacggtacataccggtgaccaacatcaagtgggcaacgaaacacaaggagtaacagcagaaataaccccgcaagcctcgacaacggaagccatactaccagagtatgggaccttaggcctcgagtgttcccctcgaacgggactcgacttcaatgaaatgatactcctcaccatgaaaaacaaagcgtggatggtccacagacaatggtttttcgacttaccgctgccctggaccagcggagcaaccacagaaacaccgacgtggaatagaaaagagctcttagtaacgtttaaaaacgctcacgccaaaaagcaggaggtagtcgtactcgggtcacaagagggagccatgcacacagcgctaacgggggctacagagatccaaaactcgggcggcaccagcatattcgccggccatctaaaatgccgcctaaaaatggataagctcgagttaaaaggcatgtcctacgccatgtgtaccaacaccttcgtactgaaaaaggaggtatccgaaacccaacatggtaccatcttaattaaagtagagtacaagggggaagacgcgccatgcaaaatacctttcagcacggaagatggacagggcaaagcgcacaacggtagacttatcacggccaacccagtcgttacaaagaaggaagaacctgtcaacatagaggccgaaccacccttcggtgagtccaacatagtcataggcataggtgataacgcattaaaaatcaactggtataagaaagggtcttcaatcgggaagatgtttgaggccacagcaagaggagctagacgcatggccatattaggcgataccgcgtgggacttcggtagtgtaggcggagttctcaactccctaggaaaaatggtccatcaaattttcggatccgcatacacagccctatttagcggagtatcctgggtcatgaagatcggaataggagtactcctgacctggattggcttaaactcgaaaaatacgtcaatgagcttctcctgcatcgctattggaattatcacattgtacttaggggccgtagtccaggctgacatgggttgcgtaatcaactggaagggcaaagagctgaaatgcggctccgggatattcgttacgaacgaagtacacacttggacagaacaatacaagtttcaagccgacagcccgaagcgactagcaacagctatagctggcgcatgggaaaacggcgtctgtggtatccgaagcacaacccggatggaaaacctcctttggaagcaaattgcaaacgagctaaactatatactatgggagaacaacattaagctcaccgtggtggtaggggatactataggcgtcttagaacaaggaaagagaaccctgacgccacaacccatggagctgaagtacagctggaaaacatggggtaaagcaaaaatagtaaccgcggagacccaaaactcctccttcataatagatgggcccaacacacccgagtgcccctccgcaagccgcgcctggaatgtatgggaagtagaagactacggctttggtgtcttcacgaccaatatatggctaaaactccgcgaagtatatacccaaatgtgcgaccacaggctcatgtccgcggctgtaaaagatgagcgggctgtccacgctgatatggggtactggatcgagagccagaaaaacggatcctggaaactggagaaagcatctcttattgaagtcaaaacgtgtacctggccgaaaagccacaccctctggtccaatggcgtactagagagcgacatgatcatccccaagtcactcgccggcccaatcagccaacataactacagaccaggataccatactcagacggccgggccatggcacttgggtaaactggaactcgacttcaactactgcgaaggcacgaccgtggtaatcacagagaactgcgggaccagaggtcctagcctgaggactactactgtctcaggaaaacttatacacgagtggtgctgtcgatcctgcacactacccccgctcagatacatgggggaagacggatgttggtacgggatggaaatcaggccgataagtgaaaaagaggagaacatggtcaagagcttagtgagtgctggaagcggcaaagttgacaatttcaccatgggcgtgctgtgcctcgcaatcctattcgaagaagtaatgcgcggcaagttcggaaagaagcacatgattgcgggagtattcttcaccttcgtcttactattgagtggacagattacctggcgggatatggcacatacactgattatgatagggagtaatgcatcggaccggatgggaatgggagtaacctacctcgcgctgatagccacgttcaaaatccaaccgttcctagcacttgggtttttcctccgaaaactcacttcccgagaaaatctactcctaggagtcggcctggcaatggcaacaacgctgcagctacctgaggacattgaacagatggcaaatggcatcgcattggggctgatggcattaaaactcatcacccaattcgaaacgtaccaactatggacagccctcataagcctcacatgttcaaacaccatcttcacgttgacagtcgcatggagaaccgccaccttaatactagccggggtaagcctattgcctgtctgccagtccagctcaatgagaaaaactgattggctcccaatgaccgtggctgcgatgggagtaccacccctgccgctttttatattcagtcttaaagacacactcaaacgccgatcgtggcccctcaatgaaggtgtgatggcggtcggattggtgtctatcctggcaagttccctgttgagaaacgatgtccctatggcaggaccgctagtcgccggaggccttctgattgcctgctatgtaatcaccggaacatcagccgacctgactgtagagaaggcggcggacgtcacgtgggaagaagaagcggaacaaaccggcgtgtcacacaatcttatgattactgttgacgacgacgggaccatgcgaataaaggatgacgaaacagagaacatcctcaccgttctgctcaaaacagccctcctgatagtaagcggaatattcccttactcgataccagcgacgctccttgtgtggcacacatggcaaaaacaaacgcaaagatcaggagtcctatgggacgtacccagcccaccggagacacagaaggcggagctagaagagggcgtataccgaataaagcaacaaggtatcctaggaaaaacacaggtgggggtgggggtacagaaagaaggggtattccataccatgtggcatgtgaccagaggtgcagtactaacacacaatggcaaaaggctggaacccaactgggcatccgtcaagaaagacctgatctcgtacggcggagggtggcggcttagcgcgcagtggcagaagggggaggaggtccaagtcatcgccgtcgagcctggcaaaaacccaaagaacttccagactatgcccggcacgttccaaacgacgactggggagatcggagcaatagcgctggactttaagccaggaacgtctggctcccccatcataaacagagagggtaaagttgtaggactctacggcaacggggtggtcacgaaaaatggcgggtacgttagtggaatcgcgcagacgaacgcagaaccggatggcccaacaccagaactcgaagaggaaatgttcaagaaacgtaatctcactatcatggatctacacccggggtcaggcaaaacacgtaagtacctccccgcgatagtgcgagaagcgataaaacggagactgaggactttaattctggcaccaacaagggtcgtcgcggcggaaatggaagaagcactaaaaggcctcccgatcagatatcaaacaactgcaactaaatcagaacacacgggccgtgaaattgtcgacctgatgtgtcacgcgacgctgacaatgcgcctcctctcgcccgtacgagtacccaactataacctcataataatggatgaggcgcatttcaccgaccctgcctctatagcggcacgggggtatatctcgacgagagtcgggatgggcgaagcagcagcaatatttatgaccgccaccccgccgggcaccgccgacgcgttcccacagtcgaatgcaccgatacaagacgaagaaagagatatcccagaaaggtcatggaactcaggaaatgaatggataacagacttcgccggtaagactgtgtggttcgtcccgagcatcaaggccggcaacgacatagcaaactgtctgaggaaaaacggaaagaaagtaatccagcttagcagaaaaacgtttgacaccgaataccaaaagaccaaacttaatgactgggactttgttgtaacgaccgatatatcggaaatgggcgcaaacttcaaagcggacagagtgatcgacccccgacggtgcctcaagccagtgatactgacggacggccctgagcgagtgattctcgcggggccgatgccagttacagcggcatcagcagcccaaaggcgagggagggtcggcagaaatccccaaaaggaaaacgaccaatacatattcacagggcaacccctcaacaatgacgaagaccacgcccattggacagaagcgaagatgctattagacaacataaacaccccagaaggaataatacccgccctatttgaacccgaaagagagaaatcagctgccatagacggggaataccgtttaaagggcgagagccggaagaccttcgtggaactaatgcgacgcggcgacttgccggtttggctcgcacacaaagtcgcgagcgaaggaattaaatatactgataggaaatggtgcttcgatggccagagaaacaaccagatactagaagagaacatggacgtagagatttggacgaaagaaggcgaaaaacgtaaactccgaccaagatggctggacgccaggacttacagtgatcctctcgcgctaaaagagttcaaagacttcgcagccggacgtaaatccatcgccctggatctagtaactgaaatagggagggtcccgtcacatctcgctcacagaacgcgcaacgccctcgacaacctagtcatgctgcacacatcagaacacggcggccgggcataccgacatgccgtggaagaattaccagaaacaatggaaaccctactcctcctcggcctcatgattctactaacaggaggggcaatgctatttctaattagcggaaaaggcataggaaaaacaagtattggactcatctgcgtcatcgccagctccggaatgctatggatggcagaaatcccactgcaatggatcgccagcgccatagtacttgagttctttatgatggtcctgctcattccggaacccgaaaaacaacgcaccccacaagataaccaactcgcatacgtagttatcggaatactcaccctggcagccataatagccgccaacgaaatgggattgctggaaacaaccaaacgcgacctcggtatgagtaaagagccaggagtagtaagcccaacaagctacctagacgtagatctacatccggcaagcgcctggacactctacgcggtagccaccacggtaatcacgccaatgctacggcacaccatagaaaactcaaccgctaacgtgtccctggcagctatagccaatcaagccgtcgtattgatggggctggataaggggtggcccatctcgaaaatggacttaggcgttccccttcttgcgctcggttgttatagccaagtgaacccactcacgctgaccgcagcagtattactactaatcacgcattacgcgatcattgggccagggctccaggcaaaggcgaccagagaggcacagaaaagaaccgctgcaggcattatgaaaaatccaacagtcgacggcatcattaccattgacttggatccagtgatctacgactccaaatttgagaaacaactaggacaagttatgttactcgtcttatgcgcagtgcaactgctgctaatgcgaactagctgggccctctgcgaggctctcaccctagcaacggggccaataacaaccctctgggaagggagcccgggtaaattctggaataccaccatagctgtcagcatggccaacatcttccgaggaagttacttggcaggagccggcctggccttcagcattatgaagtccgtagggacggggaaaagaggaacagggtcgcaaggggaaacattaggagagaaatggaaaaagaagctcaaccaactctcgcgcaaggagttcgacttatacaagaaatcgggcataaccgaagtggatcgcacagaagcaaaggagggactcaaaagaggggaaacaacacaccatgcggttagccgcggcagcgccaaacttcagtggtttgtagaaagaaacatggttataccggaaggacgagtaattgatctgggatgtggccgcggcggctggtcatactattgcgccgggctcaaaaaggtaaccgaggtcaggggatacacgaaaggagggcccggccatgagaaaccggtgcccatgtccacgtacggctggaacatagttaaactcatgtccggcaaggatgtgttctacctcccacctgagaaatgcgacacacttctctgcgacattggagaatcatccccgagccccacagtggaggaatcccgcaccataagggtgcttaaaatggtcgaaccatggctcaagaacaaccagttctgtataaaggtcctaaacccatacatgcctgccgtgatcgaacacctcgaaaggctgcaacggaagcatggaggaatgctagtaagaaatcctctcagcaggaacagcacgcatgaaatgtactggataagtaacggtacgggtaacatcgtaagtagcgttaacatggtcagccgactcctactgaaccgatttaaaatgacacacaggagaccaaccatcgaaaaagatgtagacctaggcgcggggacccgacatgtcaacgcggagccagagacgccaaacatggacgtcatcggtgaaaggatcaagcgtataaaagaggagcataactccacctggcattacgacgatgaaaacccatacaaaacctgggcctaccacggctcgtacgaggtaaaggcgacgggaagtgcaagctctatgatcaacggggtagtcaagctactcaccaagccatgggacgtggttcccatggtcactcaaatggcaatgacagacaccactccatttggacaacagagagttttcaaggaaaaggtcgatacaagaacgccacgcccgatgcccgggacacgaaaagttatggaaatcacagccgaatggttatggcggacactagggcgaaacaaacgcccacgtctctgcaccagagaggagttcaccaagaaagtcaggacaaacgccgcgatgggcgcagtgttcaccgaagagaaccaatgggactccgcaaaagcggccgtcgaagatgaagagttctggaaattagtcgacagggagcgggaacttcataaactgggaaaatgcggtagctgcgtatacaatatgatgggaaaaagagagaagaaactaggcgagttcgggaaagccaaagggtcccgcgccatctggtatatgtggctcggggcacgatatctggagttcgaggcactgggcttcttaaacgaagaccattggttcagcagagaaaactcctactcaggagtagaaggagagggcctgcacaaacttggttacattctacgggacataagcaaaattcctggcggcgccatgtacgccgacgacacagccgggtgggacaccagaataacggaggacgacctccacaatgaagaaaagataacacaacaaatggaccccgaacatcgattactcgcaaatgcgatcttcaaactcacttaccagaacaaagtggtaaaggtccaaagaccgaccccgactggcacagttatggatataatctcacgaaaagaccaaaggggatccggtcaagtaggcacgtacggcctaaatacgtttaccaatatggaggcccagctcgtacgccagatggagggtgaaggagttctatcaaaggcggacctagagaatccacacctcccagaaaagaagataacacagtggctagagacaaaaggagtcgaacgtcttaagaggatggcgatatcaggagatgactgcgttgtcaagcccatagacgatagattcgccaacgcccttctcgcgctaaacgacatgggcaaagtaaggaaagacattccccaatggcaaccatccaaaggctggcatgactggcaacaagttcccttctgcagccaccatttccacgaactaattatgaaggacggacgaaaacttgtggtcccatgccgtccgcaagacgaactgatcgggagagcaagaatatcccagggtgccggctggtccttaagagaaaccgcctgcctaggcaaggcgtatgcacaaatgtggagcctcatgtactttcacagacgcgatctccgcctggcgtcgaatgcgatctgctcagccgtgcctatacattgggtgcccacaagccgtacgacctggtcgatacatgcacaccaccaatggatgactacggaggatatgctaacagtgtggaacagagtttggatagaagacaatccctggatggaagacaagacgcccgtcaccacctgggagaacgttccgtaccttggcaaaagagaagaccagtggtgcggcagcttgatcggtctaacatcacgcgcgacttgggcacaaaacattcccacagccatccagcaagtaaggagcttgatcgggaacgaagagttcctagactacatgccatcaatgaagcggtttcgcaaagaagaggagttggaaggggccatctggtaa

SEQ ID NO: 25659 - RNA, 9873 nt, synthetic construct
  misc_feature 1..9873: note = derived and/or modified CDS sequence (opt11) from DENV-3__KF041254__SS-prME
  source 1..9873: mol_type = other RNA
accagcctgtgtctcatgatgattctacccgctgccctagccttccacctcaccagccgggatggggagccacggatgatcgttgggaagaacgagcgaggcaagtcattattattcaagaccgcctccgggatcaatatgtgcacgctcatcgccatggacctgggcgagatgtgtgacgataccgtaacctacaagtgcccccacatcaccgaggtcgagcccgaggacatagactgttggtgcaacctgaccagcacctgggtgacctatggaacgtgcaaccaggctggcgagcaccggcgcgataaacggtccgttgctctcgcaccccacgtaggcatggggctggacacccgaacgcagacctggatgagcgccgagggagcctggaggcaggttgagaaggtggaaacttgggccctgcgccatccgggattcaccatcctcgccctgttcttggctcattacatcggaacctccctcacccaaaaagtggtgattttcattctgctgatgctggtcacgcccagcatgaccatgcggtgcgtgggggtgggaaaccgcgatttcgttgagggcctgtccggggcgacctgggtggacgtggtactggagcacggcggatgcgtgaccactatggctaagaacaaacccaccctggacatcgagttacagaagaccgaagccacgcagctggctacgctccggaagctgtgcatcgaaggcaagatcaccaacatcaccacggacagccgttgcccaacgcaaggcgaggctgtgctgccggaggagcaggatcagaactacgtctgcaagcacacttacgtagaccgggggtggggcaatgggtgcggcctcttcggaaagggctccctggtgacctgcgccaagttccagtgcttggaacctatcgagggcaaagtagtgcagtacgagaacctcaagtacaccgtgatcatcacagtccacacaggggaccagcatcaggtgggcaacgagacccagggcgtcaccgcggagatcacgcctcaggccagcaccacggaagcgatcctgcccgaatacggcacgctggggctcgagtgctccccgcgcacgggtctggactttaatgagatgatcctcttaacgatgaagaacaaggcctggatggtgcatcgccaatggttcttcgacctgccattaccgtggacctccggtgccactaccgaaactcctacctggaatagaaaggaactcttggttacgttcaagaacgcccacgccaagaagcaagaggtcgttgtgctgggctcccaggagggcgcgatgcacaccgccctaacgggggccaccgagatacaaaattctggcggcacctccatatttgcaggtcacctcaagtgccggctcaaaatggacaagctcgagcttaaaggtatgagctacgccatgtgcaccaacactttcgtgctgaaaaaggaggtgtccgagacccagcatgggaccatcctcatcaaggttgagtacaaaggcgaggacgcgccgtgcaagatcccattctcaacggaggacgggcagggcaaggcccacaatggccgcctgatcacggccaaccccgtcgtgaccaagaaagaggagcccgtcaatatagaagccgagcctcccttcggcgagagcaacatcgtcattggcatcggggataatgcgctgaagattaattggtacaaaaagggctccagcatcggtaagatgttcgaggccaccgcacggggcgctcgccggatggcgattttgggcgacacggcgtgggacttcgggtccgttgggggggtcctcaacagcttaggcaaaatggtccatcagatcttcggaagtgcttacacggccctgtttagcggtgtgagttgggtgatgaagatcggcattggggtcctcctgacatggatcggcctgaattcaaagaacacctccatgagcttctcctgcatagccatagggatcatcaccctctacctgggggtggtggtccaggcggatatggggtgcgtgattaattggaagggtaaggagctcaaatgcggcagcgggatctttgtgactaacgaggtacacacctggactgagcagtacaaatttcaagcggactctcccaagcgcttagccaccgcaattgccggtgcctgggaaaatggcgtctgcggcattcgtagcacgacccggatggagaatctactgtggaagcagatcgcgaacgaattaaattacatactgtgggagaacaacatcaagctgacggttgtggtgggagacaccataggcgtgctcgagcagggtaaacgcacgctgacgccccagcccatggaactgaagtacagctggaggacctgggggaaggccaaaatcgtaaccgctgaaacacagaacagctccttcataatcgacggccccaatacccctgagtgcccaagcgcttcccgcgcatggaacgtgtgggaggttgaagattacgggttcggcgtattcactactaacatctggctcaagctgcgggaaatgtacacccagatgtgcgaccaccgcctaatgagcgccgccgttaaggacgagagagccgtgcatgcggacatgggctattggatcgaaagccagaagaacggttcctggaagctggagaaagcgagcctgatcgaggtcaagacgtgcacctggccgaaatctcacactctgtggagcaatggcgtactcgaatccgacatgatcatccctaagtcgttggcagggcccatctcccagcacaattaccgccccggatatcacacccagacggccgggccctggcacctcggcaagctggagctagactttaactactgcgaaggcaccaccgtcgtaatcaccgagaactgcggcacgcggggccccagcctacgcaccacgactgtgtccgggaagcttatccacgagtggtgctgccggagctgcacgttgccccctctgcgatacatgggggaggacgggtgctggtacggcatggaaatccggcccatctccgaaaaggaggaaaacatggtcaagagtctggtgtccgccggtagcggtaaggtggacaacttcactatgggcgtcctgtgccttgccatcttgttcgaagaggtcatgcgcgggaaattcggcaagaagcacatgatcgcgggggtgttcttcacgttcgtgctgcttctctcaggccagatcacttggcgggacatggcccacacactgatcatgataggctcaaatgcttcagaccgcatggggatgggggtgacctacctggcattgattgccacattcaaaatccagcccttcttagcgctgggtttcttcctccggaagctgaccagccgcgagaacctgctcctgggggttggcctggcaatggccacgaccctgcagctgcccgaggacatcgagcaaatggccaacgggatcgctctcggcctcatggccctgaagttaatcacccagttcgagacgtaccaactctggacagccctgatcagcctgacatgctccaacacgatcttcaccctcacggttgcgtggcggacggccactctaatcctcgcaggggtttcgctgctccccgtgtgccagtccagctccatgcgcaagaccgattggctccccatgacggtcgccgccatgggcgtgccgccgctgcctctctttattttcagtttaaaggatacgctcaagcgccggtcgtggcccctaaacgagggggtgatggccgtgggactggtgagcatactcgcctcctctctgctgcgtaacgacgtgcccatggcgggacccctcgttgccggggggctactaatcgcatgttacgtgataaccgggacctccgccgatctcacggttgagaaggccgcggacgtaacctgggaggaggaagctgaacagacgggcgtgagccacaacctcatgatcactgtcgatgacgacgggaccatgaggatcaaggacgacgaaacggagaacatcctgaccgtcctcctgaagacagcccttttaatcgtttccggtatcttcccgtacagcatcccggccacccttctggtgtggcacacgtggcagaagcagacacaacggtccggcgtcttgtgggacgtgcctagcccgccggagacgcagaaggcggagctggaggagggggtgtaccgaatcaagcagcagggcatcctgggcaagacgcaagtcggcgtaggggtacagaaagagggggtcttccacactatgtggcacgtcacccgtggggcggttctcacacacaacggaaagcggctggagcccaactgggcctctgtgaagaaagaccttattagctatggcggggggtggcgcctctccgcgcagtggcagaagggggaagaggtacaggtgatcgccgtagagcccggcaagaatcccaagaacttccaaacaatgccgggcaccttccagaccacgaccggggagattggcgcgatcgccctggatttcaagcccggtacgagcggaagccccatcatcaaccgagagggcaaggtggtgggtctgtacggcaatggagttgtgaccaaaaacggcgggtacgtgagtggcatagcccaaacgaatgctgaaccagacggcccgacccccgaactggaggaagagatgttcaagaagcgtaacctcacgatcatggatctacacccaggcagcggcaagacccggaagtacctcccggccatcgtccgcgaggccatcaagcgtcgactccggaccctgattctcgctcccacccgagtggtggccgccgaaatggaagaggcactgaaggggctgcccatacggtaccagactaccgcgaccaagtccgagcatactggtcgcgaaatcgtcgacctgatgtgccacgcaacgttcacaatgcggctcctgtctcccgtgcgcgtaccgaactataacctgatcatcatggacgaggcacacttcacagatcccgcgtcaatcgccgcacgcgggtatatcagcacccgcgttggcatgggcgaggctgccgccatcttcatgactgcgactccgcccggtaccgccgacgccttcccgcaatctaacgccccaatacaggacgaggaacgcgacatccccgagcggtcgtggaactccggcaatgagtggatcaccgatttcgctggcaagacagtgtggttcgtgccgagtatcaaggcgggcaatgacatcgccaactgcctccgcaagaacgggaagaaggtcattcagctgtcccggaagaccttcgatactgagtatcagaagactaaactgaatgattgggacttcgtggtgacgactgacatcagcgagatgggcgccaacttcaaggcggaccgcgtcatcgacccccggcggtgcctcaaacctgtcatactaaccgacggcccagagcgggtgatcctggccgggcccatgcctgtcaccgcggcttcggctgcccagcgccgagggcgcgtgggacggaatccccagaaggagaacgaccaatatatcttcaccggtcaacccctcaacaacgatgaggatcacgcgcactggacggaggcaaagatgctgctcgacaacataaacacccccgaggggatcatcccggccctcttcgagcccgagcgtgagaagagcgctgcgattgatggagagtaccggctgaagggcgagtcacgaaaaaccttcgtggagctgatgcggcgcggggacctgcccgtttggctagcgcataaggtggccagcgaggggattaaatacaccgaccggaagtggtgcttcgatgggcagcggaacaatcagatcctagaggagaacatggacgtcgagatatggaccaaggagggcgaaaagagaaagttgcgcccacgttggttggacgcccggacctactccgacccgcttgccctcaaagagttcaaggacttcgcggcgggcaggaagagcatagccctggacctggtgaccgagatcgggagagtaccctcccaccttgcccaccgcacacggaatgcacttgacaacctggtgatgctccacacaagcgagcacggcggccgggcataccggcacgcagtggaggagctgcccgagaccatggagaccctgctcctgctgggcctgatgatcctgttaaccgggggtgccaccctcttcctgatatcaggaaaaggaatcgggaagacctcgatagggcttatatgcgtgatagcctcttccggcatgctctggatggctgagatcccgctgcagtggatcgccagcgcgatcgtcctggagttcttcatgatggtattgcttatccccgagcccgaaaagcagcggactccacaggacaaccagctggcctacgtggtcattgggatcctcactctggcagccatcatagcggcgaatgagatgggcctgttagagacgaccaagcgggacctaggaatgagcaaagagcctggagtagtcagccccacctcatacctggacgtcgacctacaccccgccagcgcctggaccttgtacgccgtggctacgaccgtgatcacccctatgctgcgccacaccatagaaaactccacggccaacgtttctctggccgccatcgcaaatcaggcggtggtgctgatgggccttgacaaggggtggccgatctccaaaatggacttgggggtccccctactggccctcggctgctacagccaggttaaccccttgaccctgacagccgccgtgctattgttgataacacactacgccatcataggcccgggcttacaggctaaggcgacgagagaggcccagaagcgcaccgccgccgggatcatgaagaacccgaccgtcgacggcatcatcaccatcgacctggaccccgtgatctacgactccaagttcgagaagcagttgggccaggtgatgttgctggtcttatgcgcggtgcagctgctgctgatgcggacgtcctgggcgctatgcgaggccttgactttggcgacagggcccatcaccacgctttgggagggatcccccggaaagttctggaacaccaccatagcggtgagcatggccaacatattccggggctcctacctggcgcgcgctgggttagcttttagcataatgaagtccgtcgggaccgggaagagaggaaccggcagccagggggaaacactcggagagaaatggaagaaaaagctgaaccagctgagcagaaaggaattcgacctatataagaagtccgggatcaccgaggttgatcgaaccgaggcgaaggaggggttgaaacgtggggaaacgacccatcacgccgtcagccgcggcagcgccaagctgcagtggtttgttgagcggaacatggtaataccggagggcagggtgattgacctcgggtgcgggcgcggcggctggagctactactgcgccgggctgaagaaagtcactgaggtgcgggggtacactaagggaggtcccgggcacgaggagcccgtaccgatgtcaacctacgggtggaacatcgtcaagctgatgagcggcaaggacgtgttctacctcccacccgaaaagtgcgacacgttgctgtgtgatataggggaatcatccccctcccccaccgtggaggagagccgtaccataagagtactaaagatggtggagccttggctcaagaacaaccagttttgcattaaggtcttaaacccttatatgcccgccgtcatcgagcacctggagcgcttgcagcgcaagcacggtggcatgctagtgcggaaccccttatcccggaacagcacacacgagatgtactggatcagcaacgggactgggaacatcgtttcatccgtcaatatggtgtcaaagcttctgctaaaccggtttaccatgacccatcggcgcccgaccattgagaaggacgtggatttaggggcgggcactcggcacgtcaacgccgaaccggaaacccccaacatggacgtaatcggagagcggattaagcgcatcaaggaggagcacaactccacctggcattacgacgacgagaacccgtacaagacctgggcttaccacgggtcatacgaggtgaaggccacggggtccgcgagcagcatgatcaatggtgtcgtgaagctgctgacgaaaccctgggacgtcgtgccgatggtgacccaaatggctatgaccgacacgacccccttcggccagcaacgcgtcttcaaggagaaggtggacacccggaccccgcgccccatgccaggcacgcggaaggttatggagatcaccgctgaatggctatggcgcaccctgggcagaaacaaacgcccccgcctttgcacgcgggaggagttcaccaaaaaggtcaggaccaacgccgccatgggggctgttttcaccgaggagaaccagtgggactccgctaaggcggccgttgaggatgaggagttctggaagctcgtcgatcgggagcgagaactgcataagctggggaaatgtgggagttgcgtgtacaacatgatgggaaagagggaaaaaaagctgggagaatttgggaaggccaagggctcccgagcgatctggtacatgtggttaggagcgcggtacctcgaatttgaggccctcgggttcctgaacgaggaccactggttctctcgcgaaaattcctactcaggcgtcgagggggagggcctgcacaagctcggctacatcctgagggacatttccaagatcccgggcggcgccatgtatgccgacgacaccgcggggtgggatacgcgaataaccgaagacgacctgcacaacgaggagaaaatcacccaacagatggaccccgagcatcggctcctggccaacgccatctttaagttaacctaccagaataaggtcgtgaaggtgcagcggcccacccccacgggaaccgtcatggacatcatctcaagaaaggatcagcgcgggtccggccaagtgggcacctatgggctaaacacgtttacgaacatggaggcccagctagttcgccagatggaaggtgagggggtcctgagcaaagccgacctcgaaaaccctcatcttccagagaagaagatcacccagtggctggaaaccaaaggcgtggagcgcttgaagcggatggcgatctccggtgacgactgtgtcgtcaaaccgatcgacgatcggttcgccaacgccctgctggccttgaatgatatgggcaaggtcaggaaggacatcccccagtggcagccgtcaaagggttggcacgactggcagcaggtccccttctgcagccaccactttcacgaactgatcatgaaggacgggcgcaagctcgtcgtgccgtgcaggccacaggacgaactcatcggacgtgcgcgcatcagccagggggcgggctggtcgctgcgggagaccgcctgtctagggaaggcctatgctcaaatgtggagcctcatgtactttcatcgccgcgacctgcgcctggcgtctaacgccatctgcagcgcagtgccggtccactgggtgcctacttccaggacgacctggagcatccacgcccaccaccagtggatgactacagaagatatgctcaccgtttggaatcgcgtttggatcgaggataatccatggatggaggataagacccctgtgacaacgtgggagaatgtgccgtatttgggcaagcgggaagatcagtggtgcggcagtctgatcgggctaacatcccgcgctacctgggcgcaaaacattcccacggccatccagcaagtccgaagcctcatcggcaacgaggaattcctagactatatgccgagtatgaagcgtttccggaaggaagaggagttagaaggagccatctggtga

SEQ ID NO: 25660 - RNA, 9873 nt, synthetic construct
  misc_feature 1..9873: note = derived and/or modified CDS sequence (opt11) from DENV-3__KX380841__SS-prME
  source 1..9873: mol_type = other RNA
acctccctttgtctcatgatgatattacccgcagcactagcctttcatctgacgtctcgagatggtgaaccccgcatgatcgtaggcaaaaacgaacgaggtaaaagcctgctatttaaaacagcttcaggaatcaacatgtgcacattaatagcaatggatttgggagaaatgtgcgacgacacggttacttacaaatgcccacatataacagaagtggaacccgaagatatcgactgctggtgcaatttgaccagtacatgggtcacctacgggacatgtaaccaggccggtgaacacaggagggacaagagatccgtcgcactggctccccacgtgggtatgggcctagacacccgtacgcagacgtggatgagtgcagaaggggcctggaggcaagtagaaaaagtagaaacgtgggcactccgccacccaggatttacaatactggccttgttcctggcccactacatagggacctccctaacgcagaaagtagtcatattcatattactcatgctggtcacaccaagtatgacaatgagatgtgtaggagtaggaaaccgagactttgtagaaggactttcaggagcaacctgggttgacgtcgtgctggaacacgggggatgtgttactaccatggccaaaaacaaacccaccctggatatagaactacagaaaacggaagctacccaactcgcgacgctgcgcaaactttgcatagagggaaaaataaccaatataaccacagatagcagatgcccgacccagggtgaagcagtgctcccggaagaacaggaccaaaattacgtctgtaaacacacatacgtagacagaggatggggaaacggctgcggcctcttcggtaaagggtccctcgtaacatgcgccaaattccagtgtctcgaaccaattgaggggaaagtagtccagtacgaaaacctgaaatacacggtcatcatcacagtgcacaccggggaccaacaccaagttgggaacgagacacaaggcataacagccgaaataacaccacaggcatccaccacagaggcgatcctgccagaatacggcacacttgggctagaatgctctccacgcacaggattagacttcaatgaaatgattctactaacaatgaaaaacaaagcgtggatggtgcaccgacagtggtttttcgaccttcccctcccatggacctcgggcgcaaccacggaaactccgacatggaaccgaaaagagctgttggtaacgttcaaaaacgcacacgctaagaaacaagaagtcgtggtcttgggttcacaggaaggagctatgcacacagcgctaacaggagccacggaaatacaaaacagcggcgggacgagtatcttcgccggacacctaaaatgcaggttaaaaatggacaagctggagctcaaggggatgagctacgcgatgtgcaccaacacctttgttctaaagaaagaggtaagcgagactcaacacgggacgatcctaataaaggtggagtacaaaggggaagacgccccttgtaaaatcccgttttcgactgaagacggacaagggaaggcgcacaacgggagactaatcactgcaaatccggtggtcaccaagaaagaggagccggtaaacatagaggcagagccaccgtttggggaaagcaacatcgtaatcggcatcggcgacaacgccctcaagataaactggtacaagaaagggtcctcgatcggaaagatgttcgaggcaactgcgcgcggcgcccgcagaatggccatcctaggagatacagcatgggacttcggtagcgtgggaggggtactaaactcgttgggcaaaatggtacatcaaatattcggtagtgcatatacggccctcttcagtggcgtgtcatgggtaatgaagatcgggattggagtgttgctcacgtggatcggcctcaactcaaagaatacatccatgtcattctcatgtatcgcaatcggaatcatcacattgtacttaggggcagtagtacaagcggacatgggctgcgtaataaactggaaaggaaaggagcttaaatgtggaagcgggattttcgttacgaacgaagtacacacgtggactgagcagtacaagtttcaagcagattcgccgaaaagactcgcgacggcaatcgcaggagcttgggagaacggagtctgcgggattcgatccactaccagaatggaaaacctactgtggaagcaaatagcaaacgaactaaactacatcctttgggagaacaatataaagctgactgtcgtcgtaggagataccatcggcgtcctcgaacaaggcaaacgaacactcactcctcaaccgatggagctaaagtacagctggaagacgtgggggaaagctaagatcgtcacggccgaaacccagaactcttccttcataatcgatggcccaaacacacctgagtgcccgtctgcatccagagcttggaacgtatgggaggtggaggactatggcttcggtgttttcactacaaacatatggctcaaactccgggaagtatatacgcagatgtgcgaccacaggctaatgagcgcagcagtcaaggacgaaagggcagtacacgccgacatgggctactggattgagtcacagaaaaacgggagctggaaactagaaaaagcgagcctcatagaagtaaaaacatgcacatggccgaaaagccacacgttatggtcaaacggggtcttagaaagcgatatgataatccccaaaagtctagccggcccaatctcacaacacaactaccgccccggctatcacacacaaacagcagggccatggcacctagggaaactagaacttgacttcaactactgcgaagggaccactgtcgtgatcacagaaaactgcggaacacgcggacccagcttgcgcaccacaactgtctcagggaaacttatacatgaatggtgctgtcggagctgcacacttccacccctaagatacatgggcgaagacggatgctggtacgggatggaaatccgcccgatctccgaaaaggaagaaaacatggtcaaaagcctggtatccgcgggatcaggaaaagtcgacaactttaccatgggagtactctgcctagccatactattcgaggaagtaatgcgaggcaagtttggcaagaaacacatgatcgcgggggtattctttacctttgtcctgctgctatccggtcagatcacctggcgtgacatggcgcacacgctcatcatgataggcagcaatgcctcagaccgcatgggtatgggagtaacctacctcgccctaatagcgacattcaaaatacagcccttcttagcgttgggctttttcctacgaaagctgacgagccgcgagaacctactactaggcgtcggcttggctatggcaactacactacagctgcccgaggacatcgagcaaatggccaacggaatagccctcggattaatggcattgaagttaataactcagttcgaaacgtaccaattatggactgcacttatcagcctgacctgcagcaacactatcttcacgctgacggtcgcctggagaaccgcaacgctcatcctcgcaggcgtctcattgctaccggtatgccaatcgtcatccatgagaaaaacagactggctccccatgaccgtcgcggcaatgggagttccgccgctccccctgtttatatttagtctcaaagacaccctcaaacgccggagctggccactgaacgaaggggtaatggcagtcggattagtatccattctcgcatccagcctactccgtaacgacgtacccatggccggacctttggtcgctgggggtctactcatagcgtgctatgtcataacaggcacgtcagcggatctaacggtagaaaaggctgcagacgtgacatgggaggaagaagccgaacaaacaggcgtctctcacaaccttatgattacagtcgacgacgacggaaccatgcggataaaggacgacgagactgaaaacatcctaaccgtcctgcttaaaaccgccctgctgatcgtatccggaatattcccgtactctatccccgctacactcttggtgtggcatacttggcagaaacagactcaacgatcaggtgtactctgggatgtaccatcgcctccggagacacagaaggccgaactggaggaaggcgtctacagaataaagcagcagggaatcctcggaaagacacaggtgggagtgggagtacagaaagacggcgtcttccacaccatgtggcacgtgaccagaggagcggttctgacgcataacggcaagagattagagccgaactgggcatcagtcaagaaagacttgatttcatatggcggaggttggcgcctctccgcccaatggcagaagggagaagaagtccaagtcatagccgtagaacccggcaaaaatccgaagaacttccagacgatgccgggaaccttccaaacgacaacgggagaaatcggtgctatagccctagacttcaaacccggcacctcgggaagccccatcataaaccgggaaggaaaagtcgtcggactatacggtaacggggtggtaaccaaaaacggagggtacgtcagtggcatagcccaaacgaatgccgagcctgacggtccaacaccagaactcgaagaagagatgttcaagaaacgaaaccttacaatcatggatcttcatccgggatcaggcaagacccgtaaatatttgcctgccatcgtgagggaagcgatcaagcgccggctacgcactctgatcctagctccaacacgcgtggtcgcagcggaaatggaggaggcgctcaaaggactgcccattagataccaaaccacagcaacgaagtcggaacacacagggagagagatagtagatttaatgtgccacgcgacattcacgatgcgactcctctcgccagtcagggtgccgaactacaatttgatcatcatggacgaggctcacttcacagacccagcatcaatagcggcacgcggctatataagcacccgagtcgggatgggcgaggctgcggccatctttatgaccgcaaccccgccaggcactgcggacgcatttcctcaaagcaatgcccctattcaggacgaggagcgagacattcccgagcgatcatggaatagcggaaacgaatggatcaccgacttcgccggcaagaccgtctggttcgtcccaagtataaaggcggggaacgacatcgcaaattgcctgcggaaaaacggcaaaaaggtaatacaactatccagaaaaaccttcgataccgaatatcagaaaacaaaactaaacgactgggacttcgtggtcacaaccgatattagcgaaatgggagctaatttcaaagcggacagggtaatagatcccaggcgctgtctcaaaccggtcatattgacggacggacccgaacgggtgatactagcggggcctatgccagtaacagccgcgtctgccgctcaacgccgcggacgagtcggacgtaatccacagaaggagaacgaccagtacatattcaccggacaacccctcaacaacgacgaagaccacgcccactggaccgaggcgaaaatgctgctggacaatatcaatacaccagagggtataataccggccttatttgagccagaacgcgaaaagagtgccgcaatagacggagagtatcggttgaaaggagaatcgaggaagacgtttgtagaactaatgcgacgaggggacctccctgtgtggctggcccacaaggtcgcatccgaaggaataaaatatactgaccgcaagtggtgctttgatggccaaaggaacaaccagatactagaagagaatatggacgtcgaaatctggacaaaggagggagagaagaagaaactcagaccccggtggctggatgccaggacctattccgacccactcgcgctcaaggaatttaaggactttgctgccggacgcaaaagcatagcgctagacctagtaacggaaatcgggagagtccctagtcatctagcacatagaacacggaacgctttggacaacctggtaatgctgcacacttcagagcacggtggacgtgcctatcgccacgcagtcgaagaattaccggagacgatggaaaccctactactactcggcctaatgatcctgctaaccggtggcgcgatgctattcttgatctccggaaaaggaatcgggaagaccagtatcggtttgatatgtgtgatagcgtcctcgggtatgctgtggatggctgagataccacttcagtggattgcatccgctatcgtgttggagttcttcatgatggtcctgctaataccggaaccggagaaacaaaggacaccccaggacaatcaactggcgtatgtggtcatcggcattctaaccatggcagcaatcattgctgcgaatgaaatggggctactagaaactacaaaaagggatctcggaatgtctaaggaacctggggtggtgagccctacatcatatctggacgtggacctccacccagcaagcgcctggaccctctacgcggtggcaaccacagtcataacccccatgctcaggcacacaatagaaaacagcaccgcaaacgtatccttggctgcaatagcgaaccaagccgtcgtcctgatggggttagacaagggatggccgatctcgaagatggacctgggcgtgccactattagcgctaggatgttactcgcaggtaaatcctctaaccctcaccgccgccgtgctacttttagtgacgcactacgccatcataggcccaggactgcaagcgaaggctaccagggaggcacagaagcgaaccgccgcaggcattatgaaaaacccaaccgtcgacgggatcatcacaatagacctggaccccgtcatttacgacagtaaatttgaaaagcaactcggccaagtaatgctcctcgttttatgcgctgtccaactgctcctaatgcgaacaagctgggcattatgcgaggcattgactctagccacagggccgatcacaacactatgggaaggcagcccggggaaattttggaacacaacgatcgcagtatcgatggctaacatcttcagggggagctaccttgccggcgccggcctggccttcagcatcatgaaaagcgttgggaccggcaagagggggacgggcagccaaggggaaacattaggagagaagtggaagaagaaactaaaccaactcagcaggaaagagttcgacctctacaagaaatcaggcataactgaagtcgataggaccgaggcaaaggagggactcaagaggggcgaaaccacgcaccatgccgtctccagaggaagcgccaagctccaatggttcgtcgaacgcaatatggtgatcccagaaggacgggtcatagaccttggatgcggacgcgggggatggagttactattgtgcagggctcaaaaaggtgacagaagttcgtgggtacactaaaggcggtccaggacacgaggaacccgtgccaatgagcacgtacggatggaacatagtaaagctaatgagcggtaaagatgtattctacttaccacccgagaagtgcgatacattactttgtgacataggagagagctcaccgtcgccgacggtagaagagagccgcactatcagggtattgaaaatggtggaaccatggctcaaaaacaaccaattctgcatcaaagtcctaaatccgtacatgccggcggtaatcgaacatctagagaggctgcaaaggaagcacggaggcatgctcgtcagaaaccccctcagtcgcaattccactcacgaaatgtattggatctcaaacgggacgggtaatatagtaagcagcgtaaacatggtatccagactactcttaaatcgctttaccatgacgcaccgccggcccacgatagaaaaagatgtggacctaggcgcaggcacaagacacgtcaacgccgaaccagagacacccaacatggatgtaatcggtgaacgaatcaaacgaataaaggaagaacataacagcacctggcattatgacgatgagaacccatacaagacctgggcctaccatggctcctacgaagtaaaagcaactgggtccgcctcgtcaatgataaatggagttgtaaagctcttaacgaagccgtgggacgtggtccccatggtgacacagatggcgatgaccgataccacgccattcggacaacagcgtgtattcaaagaaaaggtggacacaaggaccccacgacctatgccaggcacccgaaaggtcatggaaatcactgccgagtggctctggagaactctaggtagaaataaacgcccccgattgtgcacgcgagaagaatttacgaagaaagttaggacaaatgctgccatgggcgccgtgttcacagaggaaaaccagtgggatagcgcaaaagcagccgtcgaagacgaagaattttggaaattggttgaccgtgaacgagagctccacaaactagggaaatgtgggtcgtgcgtatacaacatgatgggtaaaagagagaagaaacttggtgagttcggcaaggccaagggctcaagggcgatctggtacatgtggctcggagcgcgctatctggaatttgaagccctcgggttcctcaacgaagaccactggttcagccgggaaaactcctacagtggtgtggagggggagggactccacaaactcggttacatcctcagagacattagcaagatcccagggggcgccatgtacgcggacgacacagccggctgggacaccaggatcaccgaggacgacctacacaacgaagagaaaatcacgcagcagatggacccggaacaccgattgcttgcaaacgcaattttcaagctcacgtaccaaaacaaagtcgtgaaagtacaaaggccgactcccaccggaactgtcatggatataatctcgcgtaaggaccagcgaggcagcggacaagtgggaacttatggattaaacacgttcacgaacatggaggcgcaacttgtgcgtcagatggaaggcgaaggcgtcctaagcaagacagacctcgagaatccacatttacccgagaagaagatcacgcaatggctcgaaacaaagggagtggaaagactcaagcgaatggccatatcgggcgacgactgcgtggtcaaaccgattgacgataggttcgccaacgcattactggcgctaaacgacatgggcaaggttcgtaaagacatacctcaatggcaacccagcaagggctggcacgactggcagcaagtccccttctgctctcatcattttcacgaactgataatgaaagacggacggaagctcgtcgtcccatgccgaccccaggacgaactaatcggacgagccagaatttctcagggagctggttggagtttgcgcgaaacagcctgcttaggtaaggcttacgcgcagatgtggtccctgatgtacttccacagacgcgatctcagactcgcgtcaaacgccatttgcagtgccgtgccagtacactgggtacctacatcgagaacaacatggagtatacatgcacaccatcaatggatgacaacagaagatatgctcacggtctggaatagggtatggatcgaagataatccatggatggaagacaaaacacccataaccacttgggaaaacgtgccgtatctggggaagcgggaagaccagtggtgcggcagcctcatagggctcacatcgcgcgcgacctgggcacaaaacattccgacagcaatccaacaggtgagaagtctaatcggaaatgaagagttcctagactacatgccctcaatgaaacgcttcagaaaagaggaggaaagcgagggagccatatggtga

SEQ ID NO: 25661 - RNA, 9873 nt, synthetic construct
  misc_feature 1..9873: note = derived and/or modified CDS sequence (opt11) from DENV-3__KX380842__SS-prME
  source 1..9873: mol_type = other RNA
accagcctctgcctcatgatgatcctgccagccgcactcgcgttccacctcacgagccgagacggcgagcctaggatgatcgttgggaagaacgagcgtggcaagagcttactgttcaagaccgcctcagggatcaacatgtgcaccctgatcgctatggacctgggcgagatgtgcgacgacacggtgacctacaagtgcccccacatcaccgaggttgagccagaggacatcgactgctggtgtaacctgacaagcacctgggtgacctacgggacctgcaaccaggctggcgaacaccggcgtgacaagcggtccgttgccctcgcgccccacgtgggcatggggctggacacgcgaacccagacctggatgtctgccgagggcgcatggcgtcaggtggagaaggttgagacgtgggccttacgccacccgggattcaccatcctcgcactgttcctggcacactacatcggaaccagtctgacccagaaagtggtgatctttatcctgctaatgctcgtcacgcccagtatgaccatgcggtgcgtgggggtgggtaaccgcgacttcgtcgagggccttagcggggccacctgggtagatgtggtgctggagcacgggggctgcgtgactacgatggccaagaataagcccaccctcgacatcgagctgcagaagaccgaggccacccagctggcgactctccggaagctgtgcatcgaggggaagatcaccaacatcaccaccgactctcgctgccccacgcagggcgaggcagtgctgccggaggagcaggaccagaactacgtctgcaaacacacctacgtggacagggggtggggcaacggttgcggcctcttcgggaaaggaagtctggtgacctgtgccaagttccagtgcctggagcccatcgagggcaaggtcgtgcaatacgagaacttaaagtacaccgtgatcatcacggtccacaccggggaccagcaccaggtgggcaatgagacgcaggggatcacagccgagatcacgccccaggccagcaccaccgaggcgatcttacccgagtacggcaccctggggctcgagtgctccccgcgcaccggcctggacttcaacgagatgatcctgttgacgatgaagaacaaggcctggatggtccaccgacagtggttcttcgacctgcccctgccctggaccagtggcgccacaaccgagacgcccacgtggaaccgcaaagagctcctcgtgaccttcaagaacgctcacgccaagaagcaggaggttgttgtgctggggtcccaggagggggcgatgcacacggcccttacaggggccacggagatccagaattcaggcgggaccagtatattcgccggacaccttaagtgccggctgaagatggacaagctcgagctgaagggcatgagctacgccatgtgcaccaacacgtttgtgctgaaaaaggaggtttccgagacccagcatgggaccatcctcatcaaagtggagtacaagggcgaggacgcgccatgtaagatccccttcagcactgaggatgggcagggaaaggcccacaacggccggctgatcacggccaaccccgtggtcaccaagaaggaggagcccgtgaacattgaggccgagcctcccttcggggagagcaacatcgtgatcggcataggggataacgcgctgaagatcaactggtacaaaaagggctccagcatcgggaagatgttcgaggccaccgcccggggcgccaggcgaatggccatcctgggtgacaccgcgtgggacttcgggtcggtcggcggggtgctcaacagcctgggcaagatggttcaccagatcttcgggtccgcctatacggccctgttcagtggcgtcagctgggtgatgaagatcggcatcggggtgttactgacctggatcggcctgaacagcaagaacacttccatgagcttctcctgcatcgccatcgggatcatcaccctctacctgggcgccgtcgtgcaagcggacatgggatgcgtgatcaactggaagggcaaggagctgaagtgcggctctgggatcttcgttacgaacgaggtgcacacctggaccgagcagtacaaattccaagccgactctcccaagcgcctcgccaccgccatcgtgggcgcctgggagaacggggtatgcggcatcagaagcacgacccggatggagaacctgctgtggaagcagatcgcaaacgaactcaactacatcctgtgggagaacaacatcaagctgaccgtggtggttggcgacaccatcggcgtgctcgagcagggcaagcggactctgacgccacagccgatggagctaaagtactcatggaaaacctgggggaaggccaagatcgtgaccgccgagacgcagaactcgtcctttataatcgacggcccgaacacccccgagtgccccagcgcatcccgagcgtggaacgtatgggaggtcgaggactacgggttcggcgtgttcaccaccaatatctggctcaagctgcgcgaggtctacacacagatgtgcgaccaccggttaatgagcgccgccgtgaaggatgagcgcgccgttcacgctgacatgggctactggatcgagagccagaagaatgggtcctggaagctcgagaaggcgtcgttaatcgaggtgaagacgtgcacttggccgaagtcccacacattgtggagcaacggggtgctcgagtccgacatgatcatccccaagtcactggctgggcccatctcccagcacaactaccggccgggctaccacacccagacggccgggccctggcacctgggcaagctcgagctggacttcaactattgcgagggcaccaccgtggtcatcaccgaaaactgtgggacgcgcggcccctctttacggaccaccaccgtgtccgggaagctcatccacgagtggtgctgtcgcagctgcacgctgcccccgctgcggtatatgggagaggacggatgctggtacggcatggagatccgcccaatctccgagaaggaagagaacatggtaaagagcctcgtctcagcgggcagcgggaaggtggacaattttactatgggcgtgctgtgcctggcaatactcttcgaggaggtcatgcgtgggaagttcggtaagaagcacatgatcgcgggcgtgttctttaccttcgtgctgctgctctccggacagatcacttggcgcgatatggcccatacgctgatcatgatcggctcaaacgcctccgacagaatgggtatgggcgtcacctacctggccctcattgccaccttcaagatccagccatttctcgcgctggggttcttcctccgcaagctgacaagccgggagaatctactcctgggtgtgggcctggccatggccactaccttacaactgcccgaagacatcgagcagatggccaacgggatcgcactgggactcatggccctgaagctgataacccagttcgagacctaccagctctggacggccctgatcagcctgacttgctccaataccatcttcactctcactgtggcctggcgcaccgccaccctgatcctggcgggagtcagtctcctgccggtgtgccaatccagctccatgcggaagaccgactggctgcctatgacggtcgccgccatgggcgtgccgcccctcccgctgttcatcttctccctcaaggacaccctcaagcgccgctcctggccccttaacgagggggttatggccgtcggcctggtctccatgctcgcctccagcctgctgcggaacgacgtgcccatggcgggcccactcgtcgccgggggcctgctgatcgcctgctacgtgatcaccggtacctccgccgatctcactgtggagaaggcggcggacgtcacctgggaggaagaggccgagcagaccggcgtgagccacaacctgatgatcaccgtggacgacgacgggacaatgcgcataaaggacgacgagacggagaacatcctgaccgtcctcctgaagaccgctctgctcatcgtttctggcatctttccgtacagcatccccgccaccttactagtttggcacacgtggcagaagcagacccagcggtccggcgtactctgggacgtgccctcaccccccgagacgcagaaggccgagctggaggagggagtataccgcatcaaacagcagggcatcctggggaagactcaggtcggcgtcggggtgcagaaggacggcgtctttcacacgatgtggcacgtgacccgaggcgccgtcctcactcacaacgggaagcgcctggagcccaactgggcgtccgtcaagaaggacctgatcagctacggcggggggtggagactctccgcccagtggcagaaaggggaggaggtccaggtgattgccgtcgagcctggcaagaaccccaagaactttcagactatgcccggcactttccagaccaccacgggggagatcggcgcgatcgccttggacttcaagcccgggacgagcggcagccccataatcaaccgtgaggggaaggtggtcggactgtacggcaacggggtcgtaaccaagaacggcgggtacgtgtccggcatcgcccaaacgaacgcagagccggacggccccacccccgagctggaggaggagatgttcaaaaagcggaacctcacgattatggacctgcaccccgggagcggtaagacccgcaagtacctgccggctattgtcagagaagcgatcaagcgccggctccgcaccctgatccttgcccccacccgggtggtggccgccgagatggaggaggccctcaagggactacccatccgctatcagacgacggcgaccaagtccgagcataccggccgtgagatcgtcgatctgatgtgccacgccacgtttaccatgcgcctcctgagcccggtgagggtgccgaactacaacttgatcatcatggacgaggcccatttcaccgaccccgcttccatcgccgcgcgcgggtacatttcgacccgggtaggcatgggtgaggccgccgccatcttcatgacggcgacgccgcccgggaccgccgacgccttcccgcagtccaacgccccaatccaggacgaggagcgcgacatccccgagcgcagctggaactccggcaacgagtggatcaccgacttcgccgggaagacggtatggttcgtgcccagcatcaaggcgggcaacgacatagccaactgcctccggaagaatggtaagaaggtcatccaactgtcccgcaagaccttcgacacggagtaccagaagaccaagctgaacgactgggacttcgtggtgacgaccgacatcagcgagatgggcgccaacttcaaggccgaccgggtcatcgacccgcgccggtgcctcaagcccgtaatcctgaccgatggacccgagcgcgtgatcctggccgggcccatgccggtcaccgccgcctccgccgcccagcggcgcggccgggtggggcggaatccccagaaggagaatgaccaatacatcttcactggccagcccctcaacaacgacgaggaccacgcccactggacggaggcgaagatgctgctggataacatcaacacccccgaggggatcatcccggccctctttgagcccgaacgggaaaagtccgccgcgatcgacggcgagtaccgcctgaagggcgagtcccgtaagaccttcgtagaactgatgcgcagaggggacctccccgtctggctggcgcacaaggtggccagcgagggcatcaagtacacagaccgcaaatggtgctttgacgggcagcggaacaatcagatcttagaggagaacatggatgttgagatctggactaaggaaggcgaaaagaagaaattgcgcccccgttggctggacgcccgcacctattccgacccgttggccttgaaggagttcaaggacttcgcggcgggccgcaagagcatagccctggatctggtgacagagatcgggcgggtcccctcccatctcgcccaccgcacccggaacgccctggacaacttagtcatgctccacacaagcgaacacgggggtcgcgcctaccgccacgcggtggaggagctgcccgagaccatggagaccctgcttctgctcggcctcatgatcctgctgaccgggggagccatgctctttctgatcagcggcaaggggatcggcaagacctccatcgggctgatatgcgtcatcgccagctccggcatgctctggatggccgaaatcccgctgcagtggatcgcctccgccatagtcctggagttcttcatgatggtgctactgatccccgagcccgagaaacagcgcacgccccaggacaaccagttagcctacgtcgtcattgggatcctcaccatggccgccatcatagccgcgaacgaaatgggtctgttagagaccacgaagcgggacctcggcatgtccaaggagccgggggtggttagccccacatcctacctggacgtcgaccttcaccccgccagcgcctggacgctctacgccgtagcgaccacggtgatcacccccatgctgcgacatacaatcgagaactccaccgccaacgtcagcctagccgccatcgcgaaccaggcggtggtgctcatgggcctcgacaaggggtggccaatctcgaagatggatctgggcgtccccctcctggccctggggtgctacagccaggtgaaccccctcacgctgaccgccgccgtcctgctccttgtcacccattacgccatcattggccccggcctgcaggcgaaggccacccgggaggcccagaagcgcacggccgcggggatcatgaagaacccgaccgtggatggcattatcaccatagacctcgacccagtcatctacgactccaagtttgagaagcagctggggcaggtcatgctgctcgtgctgtgcgcggtgcagctgctcctgatgcggaccagctgggccctgtgcgaggccctcacgctggccaccggccccatcacaacgctgtgggagggctcccccgggaagttctggaacacaaccatcgcggtcagcatggccaacatcttccgcggctcgtaccttgccggggccggcctggcctttagcatcatgaagtccgtggggaccggcaaacggggcacaggaagccagggcgagaccttgggggagaagtggaagaagaagctcaaccagctgagccgcaaggagttcgacctgtacaagaagtctggcatcacggaggtggaccggacggaggccaaggaggggctcaagcgcggcgaaaccacccaccacgccgtcagccggggctccgccaagttacagtggttcgtggagcgtaatatggtgataccggaagggcgtgtcatcgacctgggctgcgggcggggcgggtggtcctactactgcgccggcctaaaaaaggttactgaagtgaggggctacaccaagggcgggcccgggcacgaggagcccgtccccatgtccacttacggctggaacatcgtgaagttaatgagcgggaaggacgtgttctacctgccgcccgaaaaatgcgatacccttctgtgcgacatcggcgaatccagcccctcccccacggtcgaggagtcccgtacaatcagggtgctgaagatggtagagccctggctcaagaacaaccagttctgcatcaaggtcctcaacccatacatgcccgctgttatcgagcacctggagcggctccagcgaaagcacggcgggatgctcgtacggaaccccctgtcccgtaactcgacccatgagatgtactggatcagtaacggcaccggtaatatcgtatcctccgtgaacatggtcagccggctgctcttaaaccgcttcacgatgacgcatcggcgcccgaccatcgagaaagacgtcgacctaggtgctgggacccgacacgtgaacgccgagcccgagacgcccaacatggatgtgatcggggagcgcatcaagcgaatcaaggaggaacacaactccacctggcattatgacgacgagaacccgtacaagacctgggcctaccatggtagctatgaagtcaaggccaccggatccgctagcagcatgatcaacggcgtagttaagctcctgacgaagccgtgggacgtggtgccaatggtcacccagatggcgatgaccgacaccacgccctttggtcagcagcgcgtgttcaaagaaaaggtggacacccggaccccgcgcccaatgcccggcacgcggaaggtcatggagataacggccgagtggttgtggcgcaccctcggccggaacaagcgcccccggctgtgcacccgcgaggaattcaccaagaaggtacgcactaacgccgccatgggcgcggtgtttaccgaggagaaccagtgggactccgccaaggccgccgtagaggacgaggaattctggaagctggtggaccgagagcgcgagctccacaagctaggcaaatgcgggagctgcgtgtataacatgatgggcaagcgggagaagaagctgggagagttcggaaaggccaaaggctcgcgcgcgatttggtacatgtggctcggggcccggtacctggagttcgaggccctgggcttcctcaacgaggaccactggttcagccgcgagaactcctacagcggggtcgaaggcgaggggctgcacaagcttggctacatcctccgggatatctccaagatccctggcggggccatgtacgccgacgacaccgcgggctgggacacccgcatcacggaggacgacctgcacaacgaggagaagatcacccaacagatggatcccgagcaccggctactcgccaacgccatcttcaagctgacatatcagaacaaagtggtgaaggtccaacgccccacacccaccgggactgtgatggacatcattagcagaaaggaccagcgaggctccgggcaagtgggaacttatggcctgaacaccttcaccaatatggaggcccagctggttcgccagatggagggggagggcgtgctgagcaagacggacctggagaacccccacctcccggagaagaagattacccagtggctcgagacaaagggggtagaacgcctgaagcggatggccatctccggcgacgactgcgtcgtaaagcccatcgacgaccgcttcgcgaacgccctcctggccctgaacgacatggggaaggtgcggaaagatatcccccagtggcagccaagcaaggggtggcacgactggcaacaggtccccttctgctcccaccacttccacgagctcattatgaaggacggccgcaagctggtggtgccttgccggccccaggacgagctaataggacgcgcccggatcagccagggcgcagggtggtccctccgcgagaccgcgtgcttaggcaaggcctacgcccagatgtggagcctgatgtatttccacagacgcgacctccgcttggcctccaacgcgatctgcagcgccatcccggtccactgggtccccacgtcccgcacaacctggtctatccacgcccaccaccagtggatgaccacggaggacatgctgacagtgtggaaccgcgtctggatcgaggacaacccctggatggaggacaagacccccatcaccacgtgggagaacgtgccgtacctaggcaagcgggaggaccagtggtgcgggtcgctaatcggccttacctccagagccacctgggcccagaatatccccaccgcgattcagcaggttagaagcctcatcggtaatgaggagttcctggactacatgccctcaatgaagcgcttccggaaggaggaagagagcgagggcgccatctggtga

SEQ ID NO: 25662 - RNA, 9873 nt, synthetic construct
  misc_feature 1..9873: note = derived and/or modified CDS sequence (opt11) from DENV-3__KX380839__SS-prME
  source 1..9873: mol_type = other RNA
acttccttatgcctcatgatgatgctgcccgccaccctggccttccacctcaccagccgggacggagagccccggatgatcgtggggaagaacgagcggggcaagtcgttgctgttcaagaccgccagcgggattaacatgtgcaccctcatcgccatggacctgggcgagatgtgcgacgacaccatcacgtataagtgccccctaatcaccgaggtggagcccgaggacatcgactgttggtgcaacctcacgagcacctgggttacgtacgggacctgcaaccaggccggcgagcaccgacgcgacaagcggtcagtggccctggcgccccacgtgggcatgggcttagacaccagggcacagacctggatgtccgccgagggcgcttggcgccaagtagagaaggtggagacgtgggcctttcgccaccccgggttcaccatcctcgcgctgttcctggcccactacatcggcacaagcctgacccagaaggtcgtgatcttcatcctgttgatgctcgtgactcccagcatgaccatgcggtgcgtcggggtaggcaaccgggactttgtggaggggctgtctggggccacttgggtggacgtggtgctggagcacggcgggtgcgtcaccacgatggctaagaacaagcccaccttggacatcgaactgcagaagaccgaggccacccagctcgccacgctccggaagctgtgcatagaggggaagatcaccaacgtcaccaccgacagccgctgccctacacagggcgaggcgaccttgccggaggagcaggaccagaattacgtgtgtaagcacacctatgtcgacagggggtggggcaacgggtgcggcctcttcgggaagggctccctggttacctgcgccaagttccagtgcctggaactcactgagggcaaggtcgtccagcacgaaaacctgaagtacaccgtgatcatcaccgtgcacaccggggaccagcaccaggtcggcaatgagacgcagggggtgaccgccgagattacgccccaggccagcaccgtcgaggcgatcttcaggtcgtacggcaccctggggctcgagtgcagcccccggacgggactggacttcaacgagatgattctgctaaccatgaagaacaaggcctggatggttcaccgccagtggttcttcgatctgcccctcccgtggacctccggcgccaccactgagacacccacctggaacaagaaggagctcctggtgacgttcaagaacgcgcacgccaagaagcaggaggtcgtggtgctggggagccaggagggcgcgatgcacacggccctaaccggtgccaccgagatccagacctccggcgggactagcatctttgccggacacctcaaatgccggctgaagatggacaagctcgagctgaaaggcatgagctatgccatgtgcagcaatgcgttcgtcctgaagaaggaggtgagcgagacccaacacgggaccatactcatcaaggtggaatacaagggcgaggacgccccctgcaagatccctttctccaccgaggacggacaaggcaaggcacacaatggccgcctgataacggccaacccggtcgtgaccaagaaggaggagcctgtgaacatcgaagcggaaccgcccttcggggagagcaacattatcattggcatcggggacaaggccctgaagatcaactggtacaagaagggctccagcatcgggaagatgttcgaggccaccgctcggggtgcacgcaggatggcgatcctgggcgataccgcctgggacttcgggtccgtcggcggggtgctcaacagcctgggcaagatggtgcatcagatcttcggaagtgcctacacggccctgttcagcggtgtttcctggataatgaagatcggcatcggggtgctgctgacctggatcggcctgaacagcaagaatacctccatgtcgttctcctgcatcgtgatcgggatcatcaccctctacctgggcgccgtagtgcaggcggacatggggtgcgtgatcaattggaagggaaaggagcttaagtgcggaagcgggattttcgtcaccaacgaggtgcacacctggaccgagcagtacaagttccaggccgacagtcctaaacgcctcgccaccgccattgccggcgcgtgggagaacggggtgtgcggcattcgcagcacgacccggatggagaacctactgtggaagcagatcgccaacgagctcaactacatcctgtgggagaacaacatcaagcttaccgtcgtggtgggggacatcatcggcatcctcgagcagggcaagcgcaccctgacgccccagcccatggagctcaagtactcctggaagacttgggggaaagcaaagatcgtcaccgccgaaacccagaacagctccttcatcatcgacggccccaacacgcccgagtgtcccaacgcgagccgggcttggaacgtgtgggaggtcgaggactacgggttcggagtcttcaccaccaacatttggctcaaactgcgcgagatgtacacccagctgtgcgaccaccgtctcatgtcggcggccgtcaaggacgagagagccgtgcacgcggacatgggctactggatcgagtcccagaagaacgggagctggaagctcgagaaggcctcccttatcgaggtcaagacctgcacgtggccaaaaagccacacactctggtccaacggcgtgctggagtcggacatgatcatacccaagtccttagccgggccgatcagccagcacaactaccgacccggctatcacacccagaccgccgggccctggcacctcggcaagctggagctggacttcaactactgcgagggcacgaccgtggtcatcaccgagaactgtggcacccgaggcccgagcctccggacgaccaccgtgagcgggaagctgatccacgaatggtgctgccgctcctgtaccctgccgcccctccggtacatgggtgaggacgggtgctggtatggcatggagatccgcccaatcaacgagaaggaagagaatatggtcaagagcctcgtctccgccggtagcggaaaggtggacaacttcacgatgggcgtgctgtgcctcgcaatcttattcgaggaggtcatgcgggggaagttcggcaagaagcacatgatcgccggggtgctgttcaccttcgtgttgctgctgtccgggcagattacgtggcgtgacatggccagaaccctcatcatgatcggcagcaacgcctccgaccgcatgggaatgggcgtcacgtacctggccctgatcgcgaccttcaaaatccagccatttctcgcccttgggttcttcctgcggaagctcacaagccgcgagaaccttctgttaggggtgggcctggccatggcgaccacgctgcagctccccgaggacatagagcagatggcgaacgggatcgccctgggactgatggccctcaaactaatcacccagttcgagacctaccagctgtgggccgccctcgtcagcctgatgtgctccaacaccatattcacgctgaccgtcgcgtggaggaccgccaccttgatcctggccgggatcagcttactccccatgtgccagtctagctccatgcgcaaaacggactggctccccatgactgtggcggccatgggcgtgccgccccttcccctcttcatcttcagtctgaaggacaccctgaagcgccggtcctggcccctcaacgagggggtcatggcggtgggcctggtcagcatcctggcctccagcctcctgcgaaacgacgtgccaatggccggccccttagtagccggggggttgctgatcgcctgttacgtcatcaccgggacgtccgcagatctgaccgtggagaaggccgccgacgtcacgtgggaggaggaggctgaacagacgggcgtcagccacaacctcatgataacggtcgacgacgacgggaccatgaggatcaaggacgacgagaccgaaaacatcctgaccgtactgttaaagaccgccctgctaatcgtctccggcatcttcccgtactcgatcccagcgacgttgctcgtgtggcacacctggcagaagcagacgcagcgctccggcgtgttgtgggacgtcccgtccccacctgagacccagaaggccgagctcgaggagggagtataccggatcaagcagcagggcatatttggtaagacgcaggtgggcgttggggtgcagaaggaaggcgtatttcacacaatgtggcacgtcacacgcggcgccgtcctgacccacaacgggaagcggctggagcccaactgggcctccgtgaagaaggacctcatcagctacggcgggggctggcgcctgtccgcacagtggcagaagggggaggaggtccaggtgatcgccgtggaaccggggaagaaccccaagaacttccaaactatgcccggcatattccagaccaccaccggggagatcggcgccatcgccctggacttcaagcccgggacgagcggcagcccgatcatcaaccgggagggcaaggtcgtggggttgtacgggaacggggtggtcaccaagaacggcgggtacgtgtccggcatcgcccaaaccaacgctgagcccgacggcccaaccccggagctcgaggaggagatgttcaagaagcgaaacttaacaattatggacctgcaccccgggagcggtaagacccggaaatatttacccgccatcgtgagggaggccataaagcgccgcctgaggaccctgatcctcgcccccacccgtgtcgtggccgcggagatggaggaggccctgaaggggctgccgattaggtaccagacgaccgcgaccaagtccgagcataccggcaaggaaatcgtagacctcatgtgccacgccacgttcaccatgcgcctgctgagccctgtccgggttccaaactacaacctgatcatcatggacgaggcccactttaccgaccccgcttccattgccgcccgcggttacatcagcacccgggtgggcatgggcgaggccgcggccatcttcatgacggccaccccgcccgggaccgcggaggccttcccccaatccaacgcgcccatccaggacgaggagcgcgacatcccggagcgcagctggaactccggcaacgactggatcaccgacttcgccgggaaaacggtttggtttgtgcccagcattaaagccggcaacgacatcgccaactgccttcggaagaacgggaagaaggtgatacaactgtcacgcaagacctttgacaccgagtaccagaagaccaagctcaacgattgggatttcgtcgtgacgactgatatcagcgaaatgggcgccaacttcaaggcggaccgggtgatagacccccgccggtgcctaaaaccagtgatcctgactgacggcccggagcgcgttatcctcgccgggcccatgccagtgaccgtcgcatccgcggcccagcggcgcggccgggtggggcgcaacccccagaaggagaacgaccagtacatctttacgggccaaccgctgaacaacgacgaggaccacgcgcactggaccgaggccaagatgctgctcgacaacatcaacacccccgaggggatcatccccgccctgttcgagcccgaacgggagaagtccgccgcgatcgacggcgagtaccgcctgaagggcgagtcccggaagaccttcgtggaactcatgcgtcgcggtgatctgccggtctggctggcacacaaggtggccagcgaaggcatcaagtacaccgaccgtaagtggtgctttgacggggaacggaacaaccagatcctggaggagaacatggacgtggagatctggactaaggagggagagaagaagaagctgcgcccccggtggctcgacgcccgcacctactccgaccccctcgccttgaaggagttcaaggacttcgcggccggcaggaaaagcatcgccctggatctggtcacggagatcgggcgggtgccgccgcacctggctcaccgcacccggaacgccctggacaacctcgttatgctacacacgtccgagtacggggggcgtgcctaccggcacgcagtggaggagctgcccgaaaccatggagaccctcctgctgctcggcctgatgatcctcctgacggggggcgtcatgttgttcctgatcagcggcaagggggtcggcaagacgagcatcgggctcatctgcgtggtggcctccagcggcatgctatggatggccgacatccccctgcagtggatagcctccgcgatcgtcctcgagttcttcatgatggtgctgctgatccctgagcccgagaagcagcgcaccccccaggacaaccagctcgcgtacgtggtcattgggatactgaccctggccgccatcgtggctgcgaacgagatgggcctcctggagaccactaagcgggatctgggcatgagcaaggagcccggcgtcgtctccccaaccagctacctcgacgtggacctgcaccccgcctccgcctggaccctgtacgccgtggcgaccacggtaatcacccccatgctccgccacaccatcgagaacagcaccgccaacgtgtccctggccgccatcgccaaccaggctgtggtcctgatgggcctcgacaaggggtggcccatcagcaagatggacctgggcgtgccgctgctagccctggggtgctactcccaggtgaacccgctcaccctcaccgccgcagtcctgctgctggtgacccactacgccatcatcggccccggcctgcaggcgaaggccacccgggaggcccagaagcgcacagccgccggcatcatgaagaaccccaccgtggacggcatcatgacgattgacctggacccggtcatctacgacagcaagttcgagaagcagctcggccaggtgatgctgctggtgctctgcgcagtccagctgttactcatgcgtacatcctgggccttctgcgaggcgctgacgcttgccaccggtcccatcaccactctatgggagggtagccccgggaagttctggaacactaccatcgcggtgtccatggccaacatctttcgcggcagttacttagcaggtgccggcctagccttcagcatcatgaagtccgtggggaccggcaagcgcggcaccgggagtcagggcgagacgctcggggagaagtggaagaagaaactgaaccagctcagccgtaaggagttcgacctctacaagaagagcggaatcaccgaggtcgatcggaccgaggccaaggaggggctgaagcgaggcgaaatcacccaccacgccgtgtcccggggcagcgcaaagctgcagtggttcgtggaacggaacatggtgatccccgaggggcgggtgatcgacctcggctgcgggcgcggcgggtggtcgtactactgcgccggcctgaagaaagtaaccgaggtcagaggctacacgaagggagggccggggcacgaagagcccgttcccatgagcacctacggctggaacatcgtgaagctgatctccgggaaagacgtcttttacctcccgcctgagaagtgcgacaccctgttatgcgacatcggcgagagctcccccagccccaccgttgaggagtcccgcacaatccgtgttctgaagatggtcgagccctggctcaaaaacaaccagttctgcatcaaggtgctgaacccctacatgccggccgtgatcgagcacctggagcggctccagcgcaagcacggagggatgctagtccggaatcccctgagccgcaactccacccatgagatgtactggatcagcaacggaaccgggaacatcgtgtctagcgtgaacatgatctcccggctcttgttaaaccgcttcactatgacgtaccggcgccccaccatcgaaaaagacgtcgacctcggcgcgggcaccagacacgtgaacgccgagccggagactccgaacatggacgtgatcggggagcgcatccggcgcatcaaagaagagcatagcagtacgtggcactacgacgacgagaacccctacaaaacctgggcctatcacggcagctacgaggtaaaggccacagggtccgcctcaagcatgatcaacggcgtggtcaagcttctgacgaaaccgtgggatgtggtgcccacggtcacccaaatggcgatgactgacaccacccccttcgggcagcaacgtgtgtttaaggagaaggtggacacccgcacacccaagccgatgcccgggacgcggaaggttatggagataacggccgagtggctttggcgcacgctggggcggaacaaacgcccccggttatgcacccgcgaggagttcaccaagaaggtgcgcacgaacgccgccatgggggcggtgttcaccgaggagaatcagtgggactccgcccgggccgccgtcgaggacgaggagttctggaagctagtagaccgcgagcgggagctgcacaagctgggcaagtgcgggagttgcgtgtacaatatgatgggcaagcgcgagaagaagctcggggagttcgggaaggccaagggttcccgggcgatctggtacatgtggctgggggcccgctacctggagttcgaggccctcggcttcctaaacgaggaccactggttcagcagggagaactcctacagcggggtcgagggcgagggtctccataagctcgggtacattctgcgcgacatctccaagatacctggcggagccatgtatgctgacgacaccgcgggctgggacacacggatcacggaggacgacctgcacaacgaggagaagatcacgcagcaaatggatccggagcaccgccagctcgcaaacgcaatcttcaagctgacctaccagaacaaagtggtgaaagtgcaacgacccacccccaaggggactgtgatggacatcatcagccgcaaggaccagagaggctccggccaggtgggaacctacggcctgaacaccttcaccaacatggaggcgcagctcatccgccagatggagggggaaggcgtcctgagcaagaccgacctggagaacccccacctcttagagaagaagatcacgcaatggctggaaaccaagggggtggagcggctcaagcgcatggcaatctccggggacgactgcgtagtcaagccgattgacgatcgcttcgcgaacgccctgctggcgctcaacgacatgggcaaggtgcgcaaagacatcccccagtggcagccgagcaaggggtggcacgactggcaacaggtgcccttctgctcccaccacttccacgagctgatcatgaaggacggccggaagctggtcgtgccgtgcaggccccaggacgagctcatcgggcgggcccgcatcagccaaggcgccggatggagtctgaaagagaccgcgtgcctgggcaaggcatacgcacagatgtgggccctcatgtacttccaccgccgggacctgcgcctggcgagcaacgccatctgctctgccgtgcccgtccactgggtgcccaccagccggaccacctggtccatccacgcccaccaccagtggatgaccaccgaggacatgctaacggtgtggaaccgcgtatggatagaggacaatccgtggatggaggacaagactcccgtgaccacctgggaggacgtgccctacctgggcaagcgagaggaccagtggtgcgggagcctcatcggcctcacaagccgcgcgacctgggcgcaaaacatcctgactgccatccaacaggtccggtccctgatcgggaacgaggagtttcttgactacatgccaagcatgaagaggttcagaaaagaggaggagagtgagggcgccatctggtga

SEQ ID NO: 25663 - RNA, 9873 nt, synthetic construct
  misc_feature 1..9873: note = derived and/or modified CDS sequence (opt11) from DENV-3__KX380840__SS-prME
  source 1..9873: mol_type = other RNA
acgagtctgtgtctcatgatgatgctgcctgcgaccctcgcattccacctcacctctcgggacggggaaccaagaatgatcgtcggcaaaaatgaacgggggaaaagtttgctgttcaaaacagcttcgggaataaacatgtgcacactgattgctatggacttaggagaaatgtgcgatgacacgataacgtacaaatgcccgctcataacagaagtcgaacctgaagacatagactgctggtgtaacttaacatcgacatgggtcacatatggtacttgcaatcaagcaggggaacacagaagagacaaaagatcagtcgcccttgcaccccacgtcggaatggggcttgacacgcgcgcccagacgtggatgagcgctgaaggcgcatggcggcaggtagaaaaggtagaaacgtgggccttcagacaccccgggttcacaatactggcgctgtttctagcgcactatatcggaacatccctcacgcagaaagtggtcatctttatcctcctgatgctggtgacgcccagcatgacaatgcggtgcgtgggggtaggaaacagggactttgtagagggcctgtccggcgccacgtgggtcgacgtagtgctagaacacggcggctgcgtcacgacgatggcaaagaacaaaccaacactcgacatcgagcttcaaaagacagaggccacccagctagccacgctaagaaaactatgcatcgaaggcaagataacgaacgttaccactgactcccgatgcccaacccaaggcgaagcaacgctaccagaggagcaggaccagaattacgtgtgtaaacatacctatgtagaccgtggctgggggaacggttgcgggctattcggaaaaggcagtctggtcacatgcgcgaaattccaatgcttggaactaaccgaaggaaaagtcgtacaacatgagaatctaaagtacacggtaattatcacagtacacaccggcgatcaacaccaggtgggaaacgagacccagggagtgacggcagaaataacaccccaggcctcaaccgtcgaggcaatattccgatcatacgggacactcggactggagtgctcccctcgcacgggactggacttcaatgagatgatcctgcttaccatgaagaacaaagcctggatggtgcaccgccagtggttcttcgacctcccactaccctggacgagtggagccaccaccgagacgcccacctggaataaaaaggaactgttagttacgttcaagaacgcgcacgccaaaaagcaagaagtagtggtactagggagccaagaaggcgccatgcacactgcgcttaccggggcgactgaaatacagacatcgggcgggacaagcatattcgctgggcacctcaaatgtcgtttaaaaatggataaacttgaactaaaggggatgtcttacgcaatgtgttcaaacgccttcgtgctgaagaaagaggtcagcgagactcagcatggcaccatactaatcaaagtcgaatacaagggcgaggacgcaccctgcaaaataccattctcaacagaagacgggcaggggaaggcacacaacgggcgactgatcaccgcaaaccccgtagtaacaaagaaagaagaacctgtaaacatcgaggctgaaccaccgttcggggagtcgaatataataatcggaataggagataaggcgctaaaaatcaattggtacaagaaagggagttcaataggcaagatgtttgaggccacagcacggggagcccgtagaatggcaatactgggcgacaccgcgtgggacttcgggtctgtaggaggggtactcaatagtctaggaaagatggtacaccagatattcggatcagcgtatacagcattattctcgggcgtctcttggataatgaaaataggcattggcgtattactcacgtggatagggctaaattcgaagaatacatctatgagcttctcatgcatcgtaatcgggataatcacgctatatttaggcgcagtagtgcaggcagacatggggtgcgtcattaattggaaggggaaagaactgaaatgtggatcggggatcttcgtgaccaacgaggtacacacctggacagagcaatacaagttccaagcagactcgccaaagcgactcgcaactgcgatcgctggcgcgtgggaaaatggggtctgtggcataaggtcaacaacaaggatggagaacctattatggaagcaaatagccaatgaactcaattacatactatgggaaaataatatcaaacttaccgtagtcgtcggagatattataggcatcctagaacaagggaaaagaaccttaacaccccagccgatggagctaaagtatagctggaaaacctggggaaaagcgaagatagtcacggcagagactcagaactccagcttcattattgacgggccaaatacccctgaatgtccaaacgcactccgggcctggaacgtatgggaggtagaggactacgggttcggtgtgttcacaacaaacatctggctaaagctccgtgaaatgtacacacaactgtgcgaccaccgactcatgagtgcggcagttaaagacgaacgggcggtgcacgctgatatgggatactggatcgaatcacagaaaaacggatcatggaaattagagaaagcgtccctgatagaagtcaaaacctgcacatggcccaaatcccacacactgtggagcaatggggtactagaaagcgatatgattatcccaaaaagcctcgcaggaccaatttcacagcacaactatcgccccggctaccacacccagacggcaggcccatggcacctaggcaaactggaactagattttaactactgtgaaggtacaactgttgtaattacagaaaattgcgggacccgaggcccaagtctgagaaccacaacagtatcgggcaagctcatccacgagtggtgctgtcgaagctgcaccctaccacccctgcggtatatgggcgaagacggctgctggtacggaatggaaataagaccaataaacgaaaaggaggaaaatatggtgaaatcgctggtctccgccggctcgggtaaagtagacaatttcacaatgggggtcttgtgtctagcaatcctattcgaggaggtgatgcgaggcaagttcggaaagaaacatatgattgccggagtcctattcacattcgtgttactcctgtcagggcaaataacttggagggacatggctagaacgctcataatgatcggtagtaacgcttcagaccgtatggggatgggagtcacctacctggcactcatcgccacttttaagatccagcccttccttgccctcgggttctttctacgaaaactaacctcaagggagaaccttcttctgggcgtcgggctagccatggcaacgaccctacaattaccggaagacatagagcaaatggcgaacggaattgccctgggcctcatggcactaaaattaatcactcagttcgaaacctatcaactgtgggctgcgctcgttagtctaatgtgctcaaacacaatattcacactgacggtagcatggcgaacagccactctaatattagccggaatatcgctgctccccatgtgtcaatccagttcgatgcgtaaaacggactggctccctatgaccgtcgcggctatgggtgtgccacccctacccctattcatattctcattgaaggacacactgaaacgaaggtcctggccgcttaacgagggagtgatggcagtaggactcgtaagcattctagcttcatcgttgcttcgcaatgatgttccaatggccggccccctggttgcaggaggtctcttgattgcgtgctacgttataacggggacctccgctgacctaacagtcgaaaaagccgccgacgtcacatgggaagaagaagcagaacaaacgggagtaagtcacaatttgatgataacggttgacgacgatggaacgatgaggatcaaagatgacgaaaccgagaatatattaaccgttctactcaaaaccgccctgttgatagttagcgggatattcccatactcaattccagctaccctcctagtatggcacacttggcagaaacagacgcagagaagcggggtcctttgggatgtaccgtcccctccagaaacacaaaaagcggagctggaggaaggcgtatatcgaataaaacagcaaggcatctttggaaagacacaagtcggcgtcggggtccaaaaggaaggagtctttcacacgatgtggcatgtcaccagaggggcggtactaacgcacaatggaaagagactcgagccaaactgggccagcgtaaagaaggacctaatttcatatggaggaggctggagactcagtgcacaatggcaaaaaggcgaagaagtccaagtcatagccgtagaaccgggcaaaaaccctaaaaacttccaaactatgccgggtatcttccaaacaacgaccggggaaatcggagccatagcgctggacttcaaaccaggcaccagcgggagcccaataatcaaccgggaagggaaagtggtagggctttacggcaacggagtggtgaccaaaaacggcgggtacgtctcgggcatagctcagaccaacgcggaaccagatggaccgacaccagaactcgaagaagagatgttcaagaaacggaacctgaccatcatggacctccacccaggcagcggcaaaacacgcaaatatctaccggccatcgttcgcgaagcgatcaagagacgcctaaggacactcatactagcacccacccgagtggtagcagccgagatggaagaggccttaaaaggactccctattcgataccaaaccacagcgaccaaatccgaacataccgggaaggagatcgtagatctcatgtgccacgccacattcaccatgagactcctatctccagtcagggttcccaattacaacttaataatcatggacgaggcgcattttaccgacccagcgtcaatcgcagcaagaggttatataagcacaagggtaggcatgggggaggccgcagcaatattcatgaccgccactcccccaggcaccgccgaagccttcccacagagcaacgccccaatccaagacgaggaacgagacattcctgaacgctcatggaactccggtaatgattggatcacagacttcgcaggaaaaacagtctggtttgtccccagtattaaagcgggtaatgacatcgccaactgtttacgaaagaatgggaaaaaggtcattcagttgtccagaaagacctttgatactgagtaccagaaaacaaaattaaacgattgggatttcgtcgtaaccacagacatatccgaaatgggcgccaacttcaaagccgatcgagtcattgacccacgccgctgtttgaagccagtaatacttacagatggccctgagagggtaatactcgcaggacccatgccagttactgtcgcgtcggcggcccaacggcggggccgcgttggacggaatccacaaaaggaaaacgaccagtacatcttcactggacagccgctgaacaatgacgaggaccacgctcattggacggaagccaagatgctattagataacataaacacccccgaagggatcatcccagcactcttcgaaccggaacgcgagaagtcggctgcaatcgacggagaatatcgattaaaaggggaatccagaaaaacgttcgtagaacttatgcggcgcggagacctaccagtatggctagcgcacaaagtcgccagcgaagggatcaaatatacggacagaaagtggtgcttcgacggggaacggaacaaccaaatactagaagaaaacatggatgtagagatttggaccaaggagggcgaaaagaagaaactacgcccgcgttggctcgacgcacggacttactccgacccgctcgcgctcaaagagttcaaagactttgccgccggacgtaaatcaatcgcgctagacctcgtcacagagatcggaagggttcccccgcatttagcacatcggacacgaaatgccctcgacaacttggtcatgcttcatacaagcgaatatggaggacgggcgtatagacacgccgtcgaggaactgccagaaacaatggagacactccttttgctcggactcatgatcctcctcaccgggggagtgatgctattcctaatctcgggaaaaggtgtgggcaagacgagcatcggactaatatgcgtagttgcaagcagcggcatgctttggatggccgacataccacttcagtggatcgcctcagccatcgtcctcgagttctttatgatggtactactcatcccagaaccagaaaagcaaagaacaccccaggataaccagttagcctatgtagtgataggaatcctaaccttagcggccatagtggcagcaaacgagatgggtctgttagagaccacaaagagagacctggggatgagcaaagagcccggggtagtgagccccactagctacctagacgtggacctccacccagcgagtgcatggacactttatgccgttgcaacgaccgtcatcacacctatgctaaggcacacaatagaaaacagtacggcaaacgtgagcttagctgcaatcgctaaccaagcggtcgtcttgatgggactagacaaggggtggcctatcagcaaaatggacttaggagtacccctgctagcccttggttgctactcacaagttaacccgctgacgctaacagctgctgtactgttacttgttacacactacgcaattataggcccaggcctacaagctaaagcaacgagagaggctcagaagagaacggcagccgggattatgaaaaaccccacggtcgacggaataatgacgatagacctagatcccgtaatatacgacagcaaattcgaaaaacaactaggtcaagtaatgctgttggtactatgcgccgtacaattgctactaatgagaacaagctgggcgttctgcgaggccctaacgcttgcgactgggcctatcactaccctgtgggagggttcaccaggcaaattctggaacaccacaatagccgtgtcgatggccaacatctttagaggctcatacctcgcaggcgccgggcttgccttttccataatgaaaagcgtcggcacgggcaagagaggaacgggcagccagggggagactctaggcgaaaaatggaagaaaaagctaaaccaactatctcgcaaagagttcgacctatataagaaaagcggcataacggaagtagacagaacagaagccaaagagggcctgaaaaggggcgaaattactcaccacgccgtaagccgcggatcagcaaaactacaatggttcgtggaacggaacatggttataccagaaggccgcgtcatagacctcggctgcggacgtggaggatggtcctattactgcgcaggcctcaagaaagtgaccgaggtgcgagggtatacaaaaggtggacccggtcacgaagaaccggtccccatgagcacctacggctggaacatcgtgaagttgatctccgggaaagacgtgttttatctgccgcccgagaagtgcgacacgctgctttgcgatataggtgaaagctcaccaagccccacagttgaagagagccgcacgatcagagtactaaagatggtcgagccatggctcaagaacaaccagttctgcattaaagtactaaatccatacatgccagcggtcatagaacacctggaaagactgcagcgcaaacacggaggcatgttagtacgaaatcccctctcgcgcaactccacacatgaaatgtattggatcagcaatggaacgggcaacatagtaagctcggtcaacatgatatcaagactcctattgaacaggttcacaatgacttaccgccgtccaaccatagaaaaggacgtagacctgggcgcggggacgaggcatgtcaatgcggaacctgagacccccaacatggacgtgataggagagcggatacggcgaattaaagaagaacatagctccacatggcactacgacgatgagaacccctacaaaacatgggcttaccacggcagttacgaggtcaaggccacaggttctgcgtcctcgatgatcaatggcgtagtaaaactactcacaaaaccatgggacgttgtcccaaccgtaacccaaatggccatgacagacacaacgccatttggacaacaaagagtcttcaaagaaaaagtagacacccgaaccccaaaaccaatgcccggtaccaggaaagtaatggagataacagcggaatggctctggaggaccctcggacgaaacaagcgaccgagactctgtacgcgagaggagttcaccaagaaagttagaacaaacgcggcgatgggtgctgtatttacagaggaaaaccaatgggattccgcccgcgcggcagtagaagatgaggagttttggaaacttgtcgaccgggaacgtgagctacacaagctaggtaaatgcgggagttgcgtgtacaatatgatgggaaaacgtgagaagaaactgggggaatttggcaaagccaaaggcagccgagccatatggtatatgtggctgggtgcaaggtacctcgagttcgaggctctaggatttttaaatgaggaccactggttctcacgagaaaactcctacagcggggtcgagggtgaaggactccacaagctagggtacatactaagagacataagcaaaatacctggcggggcgatgtatgcagacgatacagccggatgggacacccgcatcaccgaggacgacctccacaacgaagaaaagataacccaacaaatggaccccgagcataggcaactagccaatgccatcttcaaactaacctatcaaaataaggtcgtcaaagttcagaggcccaccccaaaaggcaccgtgatggacatcatatctcggaaggaccagcgtggtagtggacaagtgggcacatatgggctcaacacctttaccaatatggaagcccaactcatacgacagatggagggagaaggggtcctcagcaaaacggacctggagaacccgcacctattagaaaagaagatcacccaatggctcgagacaaaaggggtagaaagactaaaacgaatggctataagcggagacgactgcgtagtcaagccgatagacgacagattcgcaaacgcacttcttgctctaaacgatatggggaaagtgcgaaaagacataccccaatggcagcctagtaagggatggcatgattggcaacaggttccgttctgtagccaccacttccacgaactaatcatgaaagatggcaggaagctagtggtcccctgtagaccacaagacgaactaatagggcgagctcgtataagtcagggggcagggtggagccttaaggaaacagcatgccttggcaaagcgtacgcccagatgtgggcactaatgtactttcacagaagagacctcagactcgctagcaacgcaatttgcagcgcagtccctgtacactgggttccgacatcccgaaccacatggagtatccatgcccaccaccagtggatgaccacagaggatatgctcacggtctggaacagagtgtggatagaagataatccctggatggaagacaagacacccgtcaccacatgggaagatgtgccttacctagggaagagagaagaccagtggtgcgggagcttgatcggattgacatccagagcgacatgggcgcagaacatattaacggctatacaacaagtaaggtcactcatcgggaacgaagagttcctggactacatgccttcgatgaagcgattccgaaaagaagaggaatcggagggcgccatttggtga

SEQ ID NO: 25664 - RNA, 9873 nt, synthetic construct
  misc_feature 1..9873: note = derived and/or modified CDS sequence (opt11) from DENV-3__JF808121__SS-prME
  source 1..9873: mol_type = other RNA
acctcgctgtgcctcatgatgatcctgcctgcggccctcgcgtttcacctcacctcccgcgacggcgagccccggatgatcgtggggaagaatgagcgcggcaagagccttctgtttaagaccgcctctgggacgaacatgtgtaccctcattgccatggaccttggggagatgtgcgacgacaccgtaacctataagtgcccccacatcaccgaagtggaacccgaggacatagattgctggtgcaacctgaccagcacctgggtgacttatgggacctgcaaccaggcaggcgagcggcgccgggacaagcgctccgtggccttggcaccccatgtgggcatggggcttgacacccgtacccagacttggatgagcgccgagggcgcatggagacaggttgagaaggtggaaacctgggcgctgcgacaccccggtttcaccattctcgcgctgttcttggcgcactacatcggcacctccttgacccagaaagtcgtcatctttatcttactgatgttggtcacgccctcaatgaccatgcgctgcgtgggggtcggcaaccgtgacttcgtcgagggcctcagtggggccacttgggtggacgtggtgctggagcatggagggtgcgtgacgaccatggctaagaacaagcctaccctcgatatcgaactgcagaagaccgaggccacgcagcttgcgaccctaaggaagctgtgcatcgagggcaagattactaacatcactaccgactcgcgttgtcccactcagggcgaggccgtgttgccggaggaacaggaccagaactacgtttgcaaacacacatacgtggacagagggtggggcaatggttgcgggttattcgggaagggctccctggtaacatgcgctaagttccagtgccttgagttgatcgagggcaaagttgtacaatacgagaacctgaaatacacggtgatcataaccgtccataccggggatcagcaccaggtggggaatgagacccagggcgtcacagccgagattacgccccaggccagcaccaccgaggcgatcctgccagagtacggcacattaggtttggagtgcagcccccggacgggcctggatttcaacgagatgatcctcttgactatgaagaacaaggcgtggatggtgcacaggcaatggttcttcgacctgccgctcccctggacctccggggccaccacggagacccccacctggaaccggaaggagctactggtcaccttcaaaaacgcccacgcgaagaaacaggaggtcgtggtgctcgggtcccaggaaggcgcgatgcacacggcactgaccggcgccaccgagatccagaacagcggcggaacatcaatctttagcggccacctgaagtgccgtctcaagatggataagctggagctgaagggtatgtcgtacgccatgtgcacgaacacattcgtcctcaagaaggaagtgagcgagacccagcacggtacgatcctgattaaggtagagtataagggtgaggacgccccgtgcaaaatcccgttcagcaccgaggacggtcaaggcaaagcgcacaacgggcggctgatcaccgctaatccagtcgtcacaaagaaggaggagcccgtgaacatagaggccgaacccccattcggggagtcgaatatagttatcggcaccggggataatgcccttaagatcaattggtataaaaagggcagctccatagggaaaatgtttgaggcgacggcccgcggcgcccgtcgcatggcgatcctcggtgacacggcctgggacttcgggagcgtgggcggcgtgctgaactctctgggcaaaatggtccaccagatcttcgggagcgcttacactgccctcttctcaggcgtaagctgggtaatgaaaatcggcatcggtgtcctgctgacctggattggactcaactccaagaacactagcatgtccttctcgtgcatagcgattggaatcatcaccctttatctgggggccgttgttcaggccgacatggggtgcgtcatcaactggaaaggtaaagagttaaagtgtggctccgggatatttgtaacgaacgaggtccacacctggacggagcagtacaaatttcaggctgacagcccaaagcgcctggcgacggcaatcgccggcgcctgggagaatggcgtctgcgggatccggtctacaacccgcatggagaacctgctctggaagcagatcgccaatgagctgaattatattctttgggagaataacatcaagttaacggtagtggtaggcgacataatcggcgtattggagcagggcaaacggaccttaacgccccaacccatggagctcaagtatagctggaagacctgggggaaggcgaagatcgtgacggctgagacacagaactccagctttatcatagacggaccgaatacgccagagtgtccctccgcctctcgcgcctggaacgtctgggaggtggaagactacgggttcggggtgttcaccactaacatctggctgaaactgcgggaggtatacacgcaactctgcgaccacagactgatgagcgccgccgtaaaagatgagagggccgtgcacgccgacatgggatactggatcgagtcccagaaaaacgggtcgtggaaactggaaaaagcgtcccttatcgaggtcaaaacctgcacctggcccaagagccacactctgtggtccaatggcgtgctggagtccgacatgattatccctaagtccctcgcagggcctatcagccagcacaaccaccgccccggctaccacacgcagaccgccgggccgtggcacctgggcaaactagagctcgatttcaattactgcgaaggtaccaccgtcgtgattacagagaactgcggtacaagaggcccgtccctgagaaccaccacggtgtcagggaagctgattcacgaatggtgctgccggtcttgcaccctgccgcccctccggtacatgggtgaggacgggtgctggtacggcatggaaattaggccaattagcgagaaggaggagaacatggtcaagtccctcgtatctgccggctccgggaaggtagacaactttactatgggggtgctatgcctggctatcctgttcgaggaggtcatgcgtgggaaattcggtaagaagcacatgatcgcgggggtgttctttaccttcgtgctcctgctgagcggccagatcacgtggcgggacatggcccacaccctaaccatgatcggctccaacgcctcggaccgcatggggatgggtgtcacctaccttgccctgatcgccacgttcaagatccagcctttcctcgctcttgggtttttcctacgcaaactcaccagccgcgagaatttgctgttgggcgtgggcttagctatggccaccacactgcagctacccgaggatatcgagcagatggccaacggcatcgcgctgggtctgatggcattaaagctgatcacgcaattcgaaacataccagctgtggatcgccctcatctccctgacatgcagtaacaccatgttcacgctgacagtggcttggaggaccgccacgctcatcctggcgggggtctccctgctcccggtgtgtcagtcaagcagcatgcgcaagaccgactggctgccgatggcagtggccgccatgggagtgccgcccttacccctcttcatcttctccctgaaagataccctcaagcgccggagctggccgctcaacgagggggtgatggccgtgggcctggtgtccatattggcgtcgtcgttactgcgcaacgacgtgcccatggctggccccttggtcgctggtggcttgcttatcgcctgttacgtcatcaccgggactagcgccgatctgacggtggagaaggcggccgacattacctgggaggaggaagccgaacagaccggtgtcagtcacaacttaatgatcacggtcgatgacgatggtaccatgcggatcaaagacgacgagacggagaacattctcaccgtgttactcaaaaccgccctgctgatcgtctctggcgtgttcccctactccatcccggccaccctcctggtttggcacacgtggcagaaacagacccagagaagcggcgtcttgtgggacgtccccagcccacccgagacccagaaagcagagctcgaggagggggtctaccggatcaagcagcagggcatcttcggaaagactcaggtcggcgtgggggtgcagaaggagggcgtcttccacacgatgtggcacgtcaccaggggcgccgtgctgacatataacggcaagcggcttgagccgaactgggcctctgtgaagaaggaccttatctcctacggcggcggctggcgcctaagcgcccagtggcagaagggggaggaggtccaagtcattgctgtcgaaccgggcaagaaccctaagaattttcagaccatgcccgggacgttccagacgaccacgggggagatcggcgccatcgccctggactttaagccggggacgagcggcagccccattatcaaccgggaaggcaaggttgtggggctttatggcaacggggtagtgacaaagaacggcgggtacgtgtctggcatcgcccagaccaacgccgaacctgacggaccgaccccggagttagaggaagagatgttcaaaaagagaaacctgaccatcatggacctgcatccgggttccggaaagacccgtaagtacttacccgccattgtccgagaggccatcaagcggcgtctgcgcaccttgattttggccccgacccgcgtagtggccgccgagatggaggaggctctgaaggggctgcccattcggtaccagacaaccgccaccaagagcgaacacacaggccgggaaatcgtcgacctaatgtgccacgccactttcactatgagactgctgagtccggtgcgcgttcccaactacaacctcatcatcatggacgaggcccactttaccgacccggctagcatagcggctcgggggtacatttccacccgcgtcggtatgggcgaggccgccgcgatcttcatgacagccacaccacccgggaccgccgacgccttcccacagagcaatgcaccgatacaggacgaggagcgtgatatacccgaacggagttggaactcgggcaatgagtggatcaccgacttcgctgggaaaacggtgtggtttgtgccatccattaaagctggcaacgacatagctaactgtctgaggaagaacgggaaaaaggtcatccagctgtctcggaagacctttgataccgagtatcaaaagaccaaattaaacgattgggactttgtggtgaccaccgatatctccgagatgggcgcgaacttcaaggccgaccgggtaatcgacccacggcgctgcctgaagccggtgattctgaccgacggtcccgaacgggtgattctcgcaggcccaatgcccgtcaccgccgccagtgccgcccagcgcagaggccgcgtggggcgcaatccgcagaaggagaacgaccagtacatcttcaccgggcaaccgctcaacaacgacgaggaccacgcccactggacagaggccaagatgttattagataacatcaacaccccagaggggatcatccccgcgttatttgagccggaacgcgagaagtccgccgcgatcgacggggaataccggttgaaaggcgagagccgcaagaccttcgtggagctcatgaggcgcggggaccttcccgtatggctggcacataaggtagcctctgagggcataaagtacacggataggaagtggtgcttcgacgggcagcgcaacaaccagatactagaggagaacatggacgtcgagatttggacgaaggagggcgagaagaagaagctgagaccccgctggctggatgcccgcacctacagcgaccccctcgccctgaaagagttcaaggacttcgcggctgggcggaagtccattgcattagacctcgtaaccgagatcggccgcgtcccgagccacctggcccatcggacccgcaacgccttagacaacctcgtcatgcttcacacgagcgagcacggagggcgggcgtaccgacacgccgtggaagaactgcccgagacgatggagaccctccttctgctcggcttgatgattctgctcactgggggcgcaatgctgtttctgatctcaggcaaggggataggcaagacgagcatcgggctcatctgtgtgatcgcgtcaagcggcatgctgtggatggccgagatccctctgcaatggatcgcgtccgccatcgtcctcgagttcttcatgatggtgctcctgatcccagagcccgagaagcagcggacgccgcaggacaaccagctcgcgtacgtggtcatcggaatcctcaccctagccgccatcatcgcggccaacgagatgggcctcttagaaactacgaagcgcgacctgggtatgagcaaagagccaggggttgtgtccccgaccagctacctcgacgttgacctacaccccgcgtccgcttggaccctgtacgcggtggccaccacggtgataacccccatgctcaggcacacaatcgaaaactccactgccaacgtgagcctggccgccatcgcgaatcaggccgtggtgctgatgggcctagacaagggatggcccatcagcaagatggacctaggcgtaccgctcctcgcccttgggtgctattcccaggtgaaccccctgacgctcaccgccgccgtgctgctgttaattacacactacgcgatcatcggccccggcctccaagccaaggccacccgcgaggcccagaagcggacggcggcagggatcatgaagaaccctaccgtcgacgggatcatgacaatcgatttagatcctgtgatctatgacagcaagttcgagaagcagctcggccaagtaatgctactggtcctctgcgccgtgcagctgctgctcatgcgcacctcatgggcactgtgcgaggccctgacgttagccactggtcccatcacaactctgtgggagggcagcccagggaaattctggaacacgaccatcgccgtgtccatggccaatatcttcagaggcagctacttggccggcgccggcctggctttctccattatgaaatccgtcggaaccggtaagcgcggcacggggagccaaggggagactctgggggagaagtggaagaaaaagttaaatcagctatcacgaaaagagttcgacttatacaaaaagtccgggataactgaggtggaccgaacggaggccaaggaagggctgaagcggggcgaaatcacgcaccacgccgtgagccgcggcagtgccaaactccagtggtttgtcgagcggaacatggtgatccccgagggcagagtgatcgaccttggctgcggacgtggcgggtggagttactattgcgccggcctgaagaaggtcaccgaggtccgcggctacacgaagggcgggcccgggcacgaggaaccggtgcccatgagcacgtacggttggaacatcgtcaaactcatgtccgggaaggacgtgttctaccttcctcccgaaaagtgcgacaccctgctgtgcgacatcggcgagagctccccctcacccaccgtggaggagagccgcaccatcagggtattgaagatggtcgagccctggttgaagaacaaccagttctgcataaaagtgctgaacccgtacatgcccaccgtcatagaacacttggagcgcttacagcggaagcacggcggcatgctggtgcgcaatcccctctcccgaaactccacccatgaaatgtattggattagcaatgggaccggcaatatcgtggcgagcgtcaacatggtgagccgcttgctgctcaaccggttcacgatgaagcaccgccggcccaccatcgagaaggacgtggatctgggtgccggcacccgccacgtcaatgctgaaccggagacacccaatatggatgtgatcggggaacggatcaagcgcatcaaagaagaacacaacagtacgtggcactacgatgacgagaatccctacaagacatgggcctaccacggcagctacgaggtaaaagccaccggatccgcgagtagcatgatcaacggagtggttaagctgctcacgaaaccttgggatgttgtcccgatggtgacgcaaatggcgatgaccgacaccaccccattcgggcagcagcgggtcttcaaagagaaggtggatacgcgcacgccccgttcaatgccgggcacacgcagggttatgggaatcactgccgagtggctgtggaagacactgggtcgcaacaagaagccccggctgtgtccccgcgaggagttcaccaagaaggtgcgcactaacgctgcgatgggcgccgtctttaccgaggagaaccaatgggactctgctaaggccgcagtggaggatgaggacttctggaaattagtcgaccgagagcgggagctgcacaagctcgggaagtgtggctcctgcgtgtacaacatgatgggaaagcgggagaaaaagctgggcgagttcggtaaggcaaagggcagccgcgccatttggtacatgtggctgggcgcccggtacttagagttcgaagccctgggattcctgaacgaggaccactggttctcccgcgagaacagctactccggcgtcgagggggagggcctccacaagctggggtatatcctgcgggacatcagcaagatacccgggggcgccatgtatgcagatgacactgcagggtgggacacccgcataaccgaggacgacctgcacaacgaggagaagatcacgcagcagatggacccggagcataggcagctggccaacgccatattcaaactgacgtaccaaaataaggtcgtgaaggtgcagcgccccacccccaccggtacagtcatggatatcatctcccgaaaggaccagcgcggtagcggccaggtgggcacctacgggttaaacacattcacaaacatggaggcccagctgatccggcagatggagggagagggtgtgctgtctaaagcagacctcgagaacccgcacctccccgaaaagaagatcacccagtggctcgaaaccaaaggggtcgagcgcctgaagagaatggccattagcggcgatgactgcgtggtgaaacccatagatgaccgcttcgccaacgcgctgctggccctcaacgacatggggaaggtccgaaaggacatcccgcagtggcagccttccaagggctggcacgactggcaacaggttcctttttgttctcatcacttccacgagctgatcatgaaggacgggcgcaagctagtcgtcccctgccggcctcaggatgagctcatcggtcgcgcgcggatctctcaggggtcggggtggtcgctccgcgagacggcctgtctgggtaaggcctacgcacagatgtggagtctcatgtacttccaccgaagggatctgcggcttgcctccaacgcgatttgctcggccgtcccagtacattgggtccctacctcgcgcatgacgtggtccatccacgcccaccaccagtggatgaccacggaggacatgctgaccgtgtggaaccgcgtgtggatagaggacaacccctggatggaggacaagaccccagttacaacgtgggagaacgtgccttacctggggaagcgggaggaccagtggtgtggcagcctgatcgggctcaccagccgcgccacctgggcgcaaaacatcccaacggcaatacaacaggtccggagcttgatcggcaatgaggagtttctcgactacatgccctccatgaagcgcttcagaaaggaggaagagtctgagggggcaatatggtga

SEQ ID NO: 25665 - RNA, 9873 nt, synthetic construct
  misc_feature 1..9873: note = derived and/or modified CDS sequence (opt11) from DENV-3__JF808120__SS-prME
  source 1..9873: mol_type = other RNA
accagcctgtgcctaatgatgatacttccggcagcccttgcatttcacttgacaagccgagacggagaaccccggatgatagtggggaaaaacgaaaggggaaaatctctactgttcaaaacagcatcgggaataaatatgtgcacgctcattgcaatggatctgggtgaaatgtgcgacgacaccgtcacatataaatgcccccacatcacagaagttgaacccgaagacatagattgctggtgcaacctaacatccacttgggtcacttacggaacgtgcaatcaagcgggagaacgacgtcgagacaaacgaagcgttgctctagcaccgcacgtaggaatgggtttggacacacgcacacaaacctggatgagcgcggaaggcgcctggcggcaagtcgagaaagtggaaacgtgggcgctgaggcacccgggattcacaatactagcgcttttcctagcccattatataggtacaagcctaacccaaaaagtcgttattttcatactgctgatgctcgtgacaccctcgatgaccatgaggtgcgtgggggtgggaaacagggacttcgttgaaggactaagcggggctacttgggtggatgtcgtgctcgagcatggagggtgcgtaactacaatggcgaaaaacaaacccacactagatattgagcttcagaaaacagaagccacccaattggcaacgctccgaaaactgtgcattgaaggtaaaataaccaacataacgactgacagcagatgccccacacaaggtgaggccgttctaccagaggagcaagaccaaaactacgtctgtaaacacacgtatgtagatcgcggctggggaaacgggtgcgggttatttgggaaagggagcttggtaacatgcgcaaagttccaatgcctagaactaatcgaagggaaagttgtacaatacgagaacctgaagtatacagtaatcatcacagtccacaccggcgatcagcaccaggtaggcaatgaaacacaaggcgtcaccgcagaaataaccccgcaagcctcgactacagaggcgatcctccctgagtacggtacactaggattagaatgctctcccagaacgggcctcgacttcaacgaaatgatactcttaacaatgaagaacaaggcatggatggtacaccgccaatggttcttcgaccttcccctgccgtggacgagcggagccacgacggagacgcctacgtggaaccgcaaagagctattggtcacatttaagaacgcacatgccaagaaacaggaggtagtggtcctaggaagtcaagaaggtgcaatgcacactgcactcaccggggccacggagatacagaactcaggcggcaccagcatattcgccggtcacctcaaatgtcgtctcaagatggataagttagaacttaaggggatgagttatgcaatgtgcacgaacacattcgtcctcaagaaagaggtcagcgagacccaacatgggaccatactaatcaaggtcgagtacaaaggtgaggacgcaccctgcaaaatcccctttagcaccgaagacgggcagggcaaggcacataacggacgcttaatcacagccaatccggtggtaaccaagaaagaggagcccgtgaacatagaagccgagcccccgtttggtgaatcgaacatcgtaatcggcaccggcgacaacgcattaaaaataaactggtacaagaaaggatcaagcatcggaaagatgttcgaagcaaccgctcgaggggcccgacgcatggccattctaggcgacacagcctgggactttgggtcagtgggcggggtcctcaactcgctaggcaaaatggtccaccagatatttgggtcagcatacaccgcactattctcaggagtgtcatgggttatgaagattggaattggagtgctcttgacttggattggcctcaactccaaaaacacctccatgtccttctcctgcatcgcgatagggataataacgctgtatttgggagccgttgttcaagcggacatgggatgcgttataaactggaaaggtaaagagttaaagtgtgggagcggaatattcgtgaccaacgaagtacacacgtggacagaacagtacaaattccaagcagacagcccaaaaaggcttgcaaccgcaattgcaggcgcatgggaaaacggagtctgtggaattagaagcaccacaagaatggaaaatctgctctggaaacagatcgccaacgagctcaactacatcctctgggagaacaatataaaattaacggtagtagttggcgatataatcggtgtactaaagcaaggcaaacgaactctcacgccgcaacccatggagctcaaatatagctggaagacatgggggaaggccaaaatagtgacagcagaaacgcaaaactcctcctttatcatcgacggtcctaatacccctgaatgcccgtccgcatcacgagcctggaatgtgtgggaagtcgaggactacggtttcggtgtgttcaccacgaacatttggctaaagttgcgagaagtctatacccaactttgtgaccacagactcatgagcgcggctgtgaaggacgaacgtgcagtccacgcggacatgggatactggatagaaagccaaaagaacgggagctggaaacttgaaaaggcttcattaatagaagtcaagacgtgcacctggccgaaaagccacacgctgtggtccaacggcgtcttggagtcagacatgatcataccaaaatccctggccggaccaatcagtcaacacaaccaccgccccggataccacacacaaacagcaggaccctggcatctaggaaaactagagctggatttcaactactgcgaaggtaccaccgtcgtgatcacagaaaactgcggcacaaggggaccgtctctccgtacgacaactgtttccgggaagctaatacatgaatggtgttgccgatcatgcacgctgccgccccttcggtacatgggcgaagacgggtgctggtacggcatggaaataaggccaatttcggagaaagaggaaaatatggtgaaatcgcttgtaagcgccggctccggtaaagtggataactttaccatgggggtgctgtgcctggcgatactcttcgaggaagtgatgcgcggcaaattcggcaagaaacacatgattgcaggggtattcttcaccttcgtactattactctcgggacagataacctggcgggacatggcccacacactgattatgataggatcaaacgcaagcgacaggatgggaatgggggtcacgtacttagcgctcatcgcaaccttcaaaatccagccattcctggccctgggcttcttcctacgcaaattgacatcaagagaaaacctgctactcggggtgggcctggcaatggcgaccacccttcagctacccgaggatattgaacagatggcaaacggaatcgcgctgggcctaatggccctaaaattaataacgcaattcgaaacgtaccagttgtggacagcactcatcagcttgacgtgctccaacaccatgtttactttaacagtagcctggcgcacagcaaccctgatactagcaggagttagcctactacctgtatgccaatcaagcagtatgcgcaagaccgactggcttcccatggcagtggcggccatgggtgtcccgccgctgccactattcatattcaatcttaaagacacactcaagcgccggagctggcccctgaacgaaggggtcatggcggtaggcctagttagtatactggcaagcagtcttctgcgcaacgacgtgcctatggcaggaccgctagtagccgggggactactaatcgcctgctacgtaatcactggtacatctgccgacctaacggtcgagaaggcggctgatataacgtgggaagaggaggccgaacagactggggtgagccacaatctaatgattacggtcgacgacgacgggacgatgcgaataaaagatgatgagaccgaaaacatcctaaccgtcttattaaaaacagccctactgatagtcagtggagtcttcccgtattccatacccgcaactctcctcgtctggcacacctggcagaagcagacacaaagaagcggcgtgctatgggatgtcccgagtccacccgaaacgcagaaagccgaactagaagaaggcgtataccgcataaagcagcagggtatcctaggcaagacgcaagtcggagttggagtccagaaagagggagtgtttcatacaatgtggcacgtaactagaggagcggtgctcacctacaatgggaagaggttggagccaaactgggcgagcgtgaagaaagacctaatctcatacggaggcggatggagactatcggcgcagtggcagaagggggaagaagtccaggtcatcgcggtcgaaccgggtaaaaacccgaaaaactttcaaacaatgccgggaacattccagaccaccacgggcgagattggcgcgatagcactagatttcaaaccgggcacgagtgggagcccaataataaaccgagagggcaaagtagtcgggttgtacggcaatggagttgtaaccaaaaatggcgggtacgtatcaggtatagcacagaccaatgctgaaccagacggccctacgccagaattagaagaggagatgttcaagaaacgcaaccttaccataatggacctgcatccgggatcaggaaaaactcgaaaatacctcccagcaatagttcgcgaagccataaagagaagactaaggacgctcatactggccccaacacgagtagtagccgcagaaatggaagaagccttgaaaggactacccatacgataccaaacaaccgctacgaaatcagaacatacgggccgagagatcattgacttaatgtgccacgctacattcaccatgagactgctatctccggttcgcgtcccgaactacaacctcataataatggatgaggcccattttactgacccggccagcatcgcagcacgcggctacatcagcacgcgagtaggaatgggggaggccgcagcaatttttatgacggcaaccccaccaggcacagcagacgccttcccacaatccaatgcacccatccaagacgaagaacgagacattccagaaagaagctggaacagcgggaacgagtggatcaccgacttcgccggcaagaccgtatggttcgtcccctccataaaagccggtaatgatatagcgaactgcttaaggaaaaacggcaagaaagtaatacaactcagtaggaaaactttcgacactgaataccagaaaacaaaacttaacgattgggacttcgtagtaaccaccgatatctcagagatgggagccaattttaaagcggaccgggtaatagacccaaggaggtgcctaaaacccgtcattctgacggacggacccgaaagagttatattagccgggccgatgccagtcacagccgcctcggctgcgcaacgacgcggccgcgtaggacgaaaccctcaaaaagagaacgaccaatacattttcacggggcaaccattgaacaacgacgaagatcatgcccattggacggaggcaaaaatgctattggacaatatcaacacgcccgaaggtataattcccgctctgtttgaacccgaaagggagaaaagcgctgcaatcgacggtgagtaccgcctgaaaggcgagtcccgcaaaacttttgtggagttaatgcgacgaggcgacctgccggtttggttagcgcacaaggtagcaagcgaaggtatcaaatacaccgatcgtaagtggtgcttcgatggacagcgaaataaccaaattctcgaagagaacatggacgtagaaatctggacaaaagagggtgagaagaagaaactcagaccgcgctggctcgacgcgagaacctacagcgatcctcttgccctaaaagagtttaaagactttgctgcagggcgcaaaagcatagctctcgatctcgtgaccgaaattgggcgagtcccttcgcacctcgcccaccgaacaagaaatgcactagacaacctagtaatgctacatacgagcgaacatggaggtagggcgtaccgccacgcggtagaggaactacctgaaaccatggaaaccctccttcttcttggcctcatgatactactcacagggggagccatgctattcctcataagtggcaaaggtatcgggaaaacgtctataggcctaatctgtgttatagcatcctcgggtatgctatggatggcggaaatcccactccagtggatagccagcgccatagtcctagagtttttcatgatggttctgctgataccagaaccggagaaacaaagaaccccacaagacaatcaactagcatacgttgtcattggcattctaaccctagcagcgataatcgcggcaaatgaaatgggcctgctggaaacaacaaagagggacctaggcatgtccaaagaacccggtgtagtaagcccaacaagctacttggacgtagatctacacccagcgtcagcctggaccctctacgcagtagccacaacagtaataacaccaatgctccgccacacaatagaaaatagcaccgccaacgtaagcctagccgcaattgcaaaccaagctgtagtattaatgggcttagacaaaggctggcccataagtaaaatggacctaggagtgccactactcgccctagggtgttacagccaagtgaaccccctgaccctaacggcagcagtcctactcctaataacacactatgctataataggcccggggctgcaggcgaaagcaacgcgggaagcgcaaaaacgcacggcggcaggaataatgaaaaatcccacagtagacgggatcatgaccatcgacctagaccccgtaatctacgactctaaatttgaaaaacaactggggcaagtgatgctgcttgttctatgtgcagtccagctgctattgatgcgcacatcgtgggctctatgcgaagctctaacgctggcaacagggcctataacaacactgtgggaagggagccccggcaagttctggaacaccacaatagccgtaagtatggccaacatctttcgaggtagttacctagcgggcgcaggcttagcgttcagcataatgaaaagcgtgggaaccggaaagcgcggaacaggcagccagggtgaaaccctaggcgaaaagtggaagaagaaactgaatcaactctcgcgaaaagagttcgacctatacaaaaagagtggcattacagaagtcgataggacagaagctaaagaaggactgaaaagaggcgaaatcacccaccatgcagtctctcgtggctccgccaagctccaatggttcgtcgaaaggaacatggtgatccctgaaggtagagtcatagacctggggtgcgggagagggggatggtcgtactactgcgctgggctcaagaaagtaacggaagtacgcggatacacaaaaggtgggccaggacatgaggaacctgtccctatgaccacgtacgggtggaatatagtgaaactcatgagcggcaaagatgtattctacttaccccctgagaagtgcgacaccctactttgcgacatcggcgagtcctccccaagcccaaccgttgaggagagccgcaccatcagggtcctaaaaatggtcgagccctggctaaagaacaaccagttttgcatcaaagttttgaacccctatatgccaaccgtcatcgaacacctggaacgacttcaaagaaaacacggtggcatgctagttcggaaccccctatcacgaaattcgacacacgaaatgtactggatttcgaacggaacggggaacatcgtcgcttctgtcaacatggtgtctcgactgttattaaaccgtttcaccatgacgcacaggcgtccaactatcgaaaaagacgtggatctaggagccggcacccgacacgtgaacgcggagcccgaaacccccaacatggacgtgatcggcgaacgtataaaacgaatcaaagaggagcacaatagcacatggcactatgacgacgaaaatccctacaagacatgggcctaccacggttcatacgaggtcaaggcaacagggagcgcatcttcgatgattaatggagtagtcaagttgctaacgaaaccgtgggacgttgtacccatggtcacgcaaatggcaatgacggacacaacaccatttggacaacaaagggtattcaaagaaaaagtggacacacgaactccgagatctatgccgggtactaggcgagtcatgggcattacagctgaatggctgtggagaaccctgggaaggaacaagaaacccagactctgcacccgagaagagttcacaaagaaagttagaaccaacgccgcaatgggcgcagtcttcacagaagagaaccagtgggacagcgccaaggcagccgtagaagacgaagacttctggaaactcgttgaccgcgagcgggaactgcacaaacttggcaagtgcgggagttgcgtatacaacatgatggggaagcgcgaaaagaagctaggcgagttcggcaaagcgaagggcagtagggcaatctggtacatgtggctcggggcacgatacctcgaatttgaagcactgggcttccttaacgaggatcactggtttagccgggaaaattcttactcaggcgtagaaggcgaaggactgcacaaacttgggtatatactacgagacatttccaagataccgggaggagcgatgtacgccgacgacacagcgggatgggataccagaatcacagaagacgatttacacaatgaagagaagatcacgcaacagatggaccccgagcacagacaattagccaacgccatcttcaaacttacataccaaaacaaagtagtgaaggtccagcgaccaaccccgacggggacagtcatggacattatatctcgcaaagaccaacgcggcagcggacaggtgggaacttacgggcttaatacatttaccaacatggaagcacagctcatcaggcagatggaaggagagggagtgctatccaaagcagacctggaaaacccgcacctcccagagaagaaaataactcagtggctggaaacgaaaggtgtagaacgcctgaagcggatggcaatctcaggcgacgactgcgtcgttaaacccatagacgatcggttcgccaatgccctacttgcattaaatgacatgggaaaagtgcggaaagacatcccacagtggcagccttcaaaagggtggcatgactggcagcaagtccccttctgtagtcaccacttccatgaactcatcatgaaggacggccgaaaactggtagtaccctgtaggccgcaagatgagctcatcggccgagccagaatatcgcaagggagcggttggtcactacgtgaaaccgcctgcctcggcaaggcctacgcacagatgtggtccctgatgtacttccaccgacgagaccttcggttagcgagcaacgcgatatgctcagccgtaccagtacactgggtaccaacatcgcggaccacatggagcatacatgcgcaccatcagtggatgacaacagaggacatgctcacggtatggaacagagtctggatcgaggataacccttggatggaagacaaaaccccggtcacgacctgggagaacgtgccgtatctaggcaaaagagaagaccaatggtgcgggtcactcataggtcttacaagtcgagccacatgggcacaaaacattccaactgccatacaacaagtacgaagcctaatcgggaacgaggagttcctagactacatgccctcgatgaagagattccgcaaggaggaagagagcgagggggccatctggtaa

SEQ ID NO: 25666 - RNA, 9873 nt, synthetic construct
  misc_feature 1..9873: note = derived and/or modified CDS sequence (opt11) from DENV-3__JF808119__SS-prME
  source 1..9873: mol_type = other RNA
accagcctgtgcctcatgatgatcctgcccaccgccctggccttccacctcaccagccgggacggggagccacggatgatcgtgggtaagaacgagcgtggcaagtcgctcctatttaagaccgcgtccggcatcaacatgtgtaccttaatcgccatggaccttggcgagatgtgcgatgacaccgtgacctataagtgtccacacatcaccgaagtggagccagaggacatagactgctggtgcaacctgacgagcacatgggtgacctacggaacctgcaaccaagccggcgagcacagacgcgacaagcggagcgtcgcgctcgcgccccacgtcggcatggggctcgacacccgaacccagacctggatgagcgcggagggcgcctggcgacaggtagagaaggtcgagacctgggccctgcgccacccgggattcactatactcgccctcttcctagcgcactatataggtacctcactcacgcagaaggtggtgatattcatcttactgatgttagtcacccccagcatgacaatgcgctgcgtgggcgtgggcaatagggacttcgttgagggcttgtctggcgccacctgggtcgacgtcgtcctggaacatggagggtgtgtgacgactatggccaaaaacaagcctaccctcgacatagagctgcagaagaccgaggccacgcagctggcaaccttgcggaagctttgtatcgagggtaagatcaccaatatcaccacggacagccgctgccccacccaaggcgaggcggtgctgcccgaagagcaagaccagaactatgtgtgcaagcacacgtacgtcgacagagggtggggcaacgggtgcggcctcttcggaaaagggtccttagttacctgcgcgaagttccagtgcctggagcccatagagggcaaggtcgtgcagtacgagaacctaaagtataccgtaataatcactgtccacaccggggaccagcaccaggtgggcaacgagacccagggagtcaccgccgagatcacgccacaggccagcactaccgaggccattctgcccgagtacggcacactgggtctcgagtgctcgccgcgtacgggactggacttcaacgagatgatactgctcaccatgaagaacaaggcgtggatggttcaccggcagtggttcttcgatttacccttgccttggaccagcggagcaaccacggagaccccgacctggaaccgcaaggaattactggtgactttcaaaaacgcccacgctaaaaagcaggaggtcgtcgtgcttgggtcccaggagggcgctatgcacaccgcgcttaccggcgccaccgagatccagaacagcggcgggacatccatcttcgcgggccatctgaagtgcaggctgaagatggacaaactcgagctgaagggcatgtcgtacgccatgtgtacgaacacgttcgtgctgaaaaaggaggttagtgagacccagcatggcaccattctgatcaaggtggagtacaagggggaggacgccccatgcaagatacccttctcaacggaggatgggcaaggtaaggcccataacggtcgtctgatcacagccaaccctgtcgtgaccaaaaaagatgagccggtgaacattgaggcggagccgcccttcggagagagcaacattgtcatcgggatcggggacaacgccctcaagattaactggtataagaagggctcctcaatcgggaaaatgttcgaggctaccgccagaggggcacgccggatggcaattctgggcgacacggcatgggacttcgggtcagtgggcggggtgctgaacagcctggggaaaatggtccaccagatttttgggtccgcctacaccgccctgtttagtggagtgtcctgggtgatgaagatcgggatcggggtcctcctgacctggataggactgaatagcaaaaatacctcgatgagcttctcctgcatcgccatcggaatcatcacgctttacctgggggccgtcgtgcaagccgacatggggtgcgtaatcaactggaaagggaaggagcttaaatgcggtagcgggatattcgtgaccaacgaggttcacacttggaccgagcagtacaagttccaggcggactccccaaagcgccttgccacagccatcgcaggggcctgggagaacggtgtttgcggaatacgcagcaccacccggatggaaaatctgctgtggaagcaggtagcgaatgaactcaactacatcctctgggagaacaacatcaagctaaccgtggtagttggtgacatcatcggggtactcgagcagggcaagcgcacgctgacaccgcaaccgatggagctgaagtacagttggaagacctgggggaaagcaaagatcgtcacggccgaaacccagaatagcagcttcatcatcgatggccccaacaccccggaatgcccctcggcctcgcgcgcgtggaatgtgtgggaagtggaggactacgggtttggcgttttcacaaccaacatctggctcaagcttcgcgaggtgtacacccagctgtgcgatcataggttgatgagcgccgccgtcaaggacgagagggcggtccacgccgacatggggtactggatcgagagtcagaagaacgggtcctggaagctggaaaaagcgagcctgatcgaggttaagacgtgtacatggccgaagtcacacacgctctggtccaacggcgttctggagtcggacatgataatccccaagagcttggccgggccgatctcccagcacaaccaccgaccgggctaccacacccaaaccgccgggccctggcacctcggcaagctggaattggatttcaattactgcgagggaaccaccgttgtgatcaccgaaaactgcggtacaagaggcccgagcctacgaaccaccaccgtgagtggaaagctgatccacgagtggtgctgtcgcagctgtacgttgcccccgctccggtatatgggcgaggacgggtgctggtacggaatggagataaggcccatctccgagaaggaggagaacatggtcaaatcactagtgtcagcgggctcaggtaaagttgacaacttcacaatgggcgtcctgtgcctggccatcttgttcgaggaggtgatgagggggaagttcggtaagaagcacatgatagcgggagttttctttatgttcgtccttttgctctccggccagataacctggcgcgacatggcccacaccctgatcatgatcggcagcaatgcctccgatcggatggggatgggcgtaacgtacctagcactaatcgccaccttcaaaatccagcccttcctggcgttaggattcttcctgcggaagctgaccagccgggagaaccttctcttaggcgtgggactcgccatggccaccaccctgcagctgcctgaggacattgagcagatggccaacgggatcgcgctaggtctgatggccctgaaattaataacacagtttgagacgtatcagctctggaccgcgctgataagccttacgtgctccaacaccatgttcaccctaacagtcgcatggcgcaccgccaccctgattctcgctggagtaagcctgctgccggtctgtcaatcgagctccatgcggaagaccgattggttaccgatggccgtagccgccatgggcgtgccgccccttccactcttcatcttcagcttaaaggataccttaaagcgccgctcctggcccctcaatgagggggtcatggcagtgggcctcgtgagcattctggcatccagcctgctcagaaacgacgtaccaatggccggccccctggtggcgggtggactgctcatcgcttgttacgtgatcacgggtacctccgccgatttaaccgtggagaaagcagctgacatcacctgggaggaggaggctgagcaaacgggggtttcgcataatctcatgattaccgtggacgacgacgggaccatgcgcatcaaggacgacgagaccgagaatatcctgaccgtactcctgaagacggcactactgatagtttcgggcgttttcccgtacagcatccccgcaaccttactcgtctggcacacctggcaaaagcaaacccagcgctccggcgtgctgtgggacgtgcctagccctcctgaaactcagaaggcagaactagaagagggcgtctaccgcataaagcagcagggaatattcggaaagacccaggttggcgtgggcgtccagaaggagggagtgttccacactatgtggcatgttacacggggagcagtactcacatacaacgggaaaagactggagcctaattgggcatccgtcaaaaaggacctcatcagttacggtgggggctggcggctatccgcccagtggcagaaaggggaggaggtacaggtcatagcagtggagcccggcaagaaccccaaaaacttccagacgatgccgggcaccttccaaaccacgaccggggagataggagccatcgccctggactttaagcctgggaccagcggcagtcccataatcaacagagagggaaaagtggtcgggctatacggcaacggggtggttactaagaatggcgggtacgtctctggaatagcgcagacaaatgcggagccggacggccccacccccgagctggaggaagagatgtttaaaaagcggaatctcaccatcatggacctgcaccctgggagcgggaagacccgcaagtatctacccgccatcgttcgggaggccatcaagaggagactgcgcacgttaattctggcacccactcgggtagttgcggccgagatggaggaggcgttgaaggggctgcccatcaggtaccagaccaccgcaacgaagtccgagcataccggacgggagatcgtggatcttatgtgtcacgctaccttcacgatgcgcctgttaagccccgtgcgggtcccaaactacaatctgatcataatggacgaggcccacttcacggacccagccagtatcgcggcccgcgggtacatctcaacccgggtcggcatgggcgaggccgcagccatctttatgaccgccacgccgccagggaccgccgatgcctttccgcagtccaacgctccaatccaggatgaggaacgcgacatcccggagcggagctggaactcaggaaatgaatggattaccgatttcgcggggaaaaccgtgtggttcgtgcccagcattaaagctggcaatgacatagccaactgcctccggaagaacgggaaaaaggtcatccagctgtcccgaaagaccttcgacacagagtaccagaagacaaagttgaacgactgggacttcgtggtaaccaccgacatatctgaaatgggggccaattttaaggccgaccgagttatagacccgcgccggtgcttaaagcctgtaatccttaccgacggccctgagcgcgtcatcctagcgggtcccatgccggtgactgcagcgagcgccgcgcaacgaagaggtcgggtcgggaggaatccccaaaaggagaatgaccagtacatctttaccggccagcctctcaacaatgacgaggaccatgcgcactggacagaggccaagatgctcctcgacaacataaacacccccgaggggataatcccggccttgttcgaacccgagcgggagaaatccgccgcgatcgacggagagtaccgactgaagggcgagtcccggaaaacgtttgtggagctgatgcgtcgcggggacctacccgtgtggctggcccacaaggtcgcctcggaaggcattaagtacacagatcggaagtggtgctttgacgggcagcgcaacaaccaaatcctcgaggaaaacatggacgtggagatatggacaaaggagggggaaaagaagaagctccgccccaggtggctggacgccagaacctattccgacccgctggccttaaaggagttcaaggatttcgccgccggccgcaagagcatagctctggacctggtaacggaaatcggacgggtgccatcccacctcgcccatcgcaccagaaacgcactagacaatctggtgatgctccacaccagcgagcacggaggccgcgcttaccgtcacgcagtggaagagctgcccgagactatggaaactctgctcctcttgggtttaatgatcctactgaccgggggagccatgctgttcctgatcagtggcaaggggatcggcaagactagtatcggcctgatctgcgtgatcgccagcagtgggatgctctggatggcggagataccgttacaatggattgcgagcgcgatcgtgctggagtttttcatgatggtactgctgatccccgagcccgagaagcagcgaacgccccaggacaaccaactggcctacgtcgtaatagggatactaacgctggcagcgattatcgcggccaatgagatgggcctgctcgagacgacgaagcgggatctgggcatgtccaaggaaccgggagtggtctcacccacctcgtacctcgatgtggatctccatcccgcgagcgcctggacgctgtatgcggtggccacaacggttattacaccaatgctccgtcacacgattgagaattcaacagctaacgtgagtctcgccgccatcgcgaaccaggccgtggtcctaatgggcctagataaggggtggcccatctccaagatggacctcggcgtgcccttgctggccctcgggtgctattctcaggttaaccccttaactttgacggctgccgtgctccttctgataacgcactatgcgatcatcggacctggcctccaagccaaggcaacgcgggaggcccagaaacggaccgcagcgggtatcatgaagaacccgactgtggacggcataatgacgatcgatctggatcccgtgatttacgactccaagttcgagaaacagctggggcaagttatgctcctagtgctgtgcgccgttcagcttttattgatgagaaccagctgggcgttgtgcgaggccctgaccctggcgaccggcccaatcacgaccctttgggaagggtcccccgggaaattctggaacaccactatcgccgtaagcatggcgaacatcttccgtggttcctatctggccggggccgggctggcgttctcgatcatgaagtccgtcgggactggcaagaggggcaccggttcgcaaggcgagaccctcggggaaaaatggaagaaaaaacttaaccagctgagccggaaggagttcgacctctacaagaagtccggcattacggaggtggaccggacagaggcaaaggaggggcttaagcgcggcgagacgacccaccatgccgtaagcagaggcagcgccaaactgcagtggttcgtggagcgcaatatggtgattccggaggggcgggtaattgacctgggttgcggccgcggcgggtggtcctattactgcgccggactgaaaaaggttacggaggtgcggggctatacgaagggtgggcccgggcacgaagagcccgtgcccatgtcaacatacggctggaacatcatcaaacttatgagcggtaaggacgtgttttacctccctcccgagaaatgcgataccctgctttgcgatataggcgagagcagcccctcccctactgtggaggagtcccgcaccatccgcgtcctgaagatggtggagccatggctgaagaacaatcagttctgtatcaaaatcctgaatccctacatgccgacggtgatcgagcatctggagcgtctccaacgcaagcatggcgggatgctggtccggaatcccctgtcccgcaacagtacccacgagatgtattggatctccaacggcaccgggaatatcgtggcaagcgtgaacatggtgagccggttattgcttaaccgctttactatgacgcaccgacgcccgaccatcgagaaggacgtggacctgggggccggaacccggcacgtgaacgctgagcccgaaacccccaacatggacgtcattggggaacgcatcaagaggatcaaggaggagcacaactctacttggcactacgatgacgagaatccgtataaaacctgggcctatcacgggtcctacgaggtgaaggccacaggaagcgcgtccagcatgatcaacggtgtggtgaaactgctgaccaagccctgggacgtggtccccatggtgactcagatggcaatgactgatacgacccccttcggacaacagagggtatttaaggagaaggtagacacgcgaaccccgcgctcaatgcccggcacgcggcgcgtgatgggaatcaccgccgagtggctgtggcgcacgctggggcgcaacaaaaagcccaggttgtgtaccagagaagagttcaccaagaaggtcagaacaaacgccgcgatgggtgccgtgttcacggaggagaaccagtgggattctgccaaggccgccgtggaagacgaggatttctggaagctcgtggatcgcgagagggaactgcacaagctgggcaagtgcgggagctgcgtctacaacatgatggggaagagggagaagaagctaggtgagttcggcaaggcgaaggggtcccgcgccatctggtacatgtggctgggcgctaggtaccttgagtttgaggcgctagggtttttaaacgaagaccattggttcagccgcgagaattcttactcgggggtcgagggcgagggactacacaagctcggctatatcctgagggatatctccaagattcccggaggggctatgtacgcggacgacaccgcagggtgggacacccgaatcaccgaggacgacctgcacaacgaggagaagatcacgcagcaaatggacccggagcatcggcaactagccaacgccattttcaaactgacctatcagaacaaggtggtaaaggtgcaaagacccacccccaccggcaccgtgatggatatcatatctcgcaaggaccagcgtggttccgggcaagtggggacgtacgggctgaacaccttcaccaacatggaggcccagttaatccggcagatggagggcgagggggtattgagcaaggcggacctggagaaccctcacctccctgagaagaagatcacccagtggctggagacaaagggcgtggagcgcctgaaacgtatggctatctcgggcgaggactgtgtcttaaagccaatcgatgaccgctttgacaacgcactgctggcactaaacgatatgggcaaggtgaggaaggacattccgcagtggcaacccagcaagggctggcacgactggcagcaggtcccgttctgctcccatcacttccacgaattaatcatgaaggacggccgcaaactggtcgtgccctgtcggccacaggatgagctcatcggaagagcacgtatttctcaaggggctggctggtcactgcgcgagaccgcttgccttggaaaggcgtatgcccagatgtggagcctcatgtacttccaccgccgggacttgcgcttggcttcaaacgcaatatgtagcgccgtacctgtacactgggtgccgacctcccggaccacatggagtatccacgcattgcaccagtggatgacaacagaggacatgatcaccgtgtggaaccgtgtctggattgaggacaacccctggatggaggacaagactcccgtcaccacctgggaggatgtgccttatctaggcaagcgggaggaccagtggtgcggctcactgattgggctcacctcccgggccacgtgggcgcagaacattccgaccgccatccaacaggtccgatcgcttataggcaacgaggagttccttgattacatgccctccatgaagcgcttccgtaaggaggaggagtctgagggggctatctggtaa

SEQ ID NO: 25667 - RNA, 9873 nt, synthetic construct
  misc_feature 1..9873: note = derived and/or modified CDS sequence (opt11) from DENV-3__JF808118__SS-prME
  source 1..9873: mol_type = other RNA
accagcctctgcctgatgatgatccttcccgccgctctggcgttccacttaaccagccgggacggggagccacggatgatcgtgggtaagaacgagcgcggcaagtcgctgctgttcaagaccgcctccggcataaacatgtgcacactcatcgccatggacctgggcgagatgtgcgacgataccgtgacgtacaagtgcccccacataaccgaggtggagccggaggacatcgactgctggtgcaacctgaccagcacctgggtaacttacgggacctgtaaccaagcgggcgagcggcgccgggacaagcgctccgttgccctggcgccccacgtgggcatggggctggacacccggactcaaacctggatgagcgccgaaggggcctggcgccaggtcgaaaaggtggagacgtgggccttgaggcacccggggttcaccatcctcgcgctgttcctggcccactacattggcacctccctcacgcagaaggttgtgatctttatactgttgatgcttgtgacgcccagcatgacgatgcgctgcgttggggtgggcaaccgggacttcgtcgagggcctctcaggggccacctgggtcgacgtggtcctagagcacggtgggtgcgtgactaccatggccaaaaacaagcccaccctagacatcgagctgcagaagaccgaggctacccagctggcgatattaaggaagttatgcatcgagggcaagatcacgaacatcaccaccgacagccgctgcccaacccagggcgaggctgtgctgccggaggagcaggaccagaattacgtctgcaaacacacctacgttgaccgcgggtggggcaacggttgcggcctcttcgggaagggatccctggtgacctgcgccaagttccaatgtctggagcccatcgagggcaaggtcgtacagtacgagaacctcaaatataccgtgatcatcaccgtgcacacgggggaccagcaccaagtggggaatgagacccagggtgtcaccgcggagattacaccacaggccagcacgaccgaagcgatactgcccgaatacggcaccctggggttggagtgctcccctcggaccggactagacttcaacgagatgatcctgctcactatgaagaataaggcctggatggtgcaccgtcagtggttctttgacctgcctctgccctggacgagcggcgccaccacggagacccccacgtggaacaggaaggagctcctggtgacctttaagaacgcccacgcaaagaagcaggaggtcgtggtgctgggctcccaggagggcgcgatgcacactgccctcaccggggctaccgagatacagaacagcggagggacctccattttcgccggccacctgaagtgccgcctgaaaatggacaagctcgagctcaagggcatgagctacgccatgtgcaccaataccttcgtcctcaagaaagaggtgtccgagacgcagcacgggaccatcctcataaaagtggaatataaaggcgaggatgcgccgtgcaaaatacccttcagcaccgaggacgggcaaggcaaggcccacaacgggcggctgataacggccaaccccgtcgtgacgaagaaggaggagcccgtgaacatcgaggctgagccgccttttggtgagagcaatatcgtcataggcatcggtgacaacgcgctcaagatcaactggtacaagaagggctccagcatcgggaagatgttcgaggccaccgcccgcggcgcccggcgcatggccatcctgggcgacaccgcgtgggacttcgggagtgtgggcggggtgctcaacagcctgggcaagatggtccaccagatcttcgggtccgcctacacggccctgttcagcggggtgtcctgggtgatgaaaattggcataggggttcttcttacgtggatcggcctgaacagcaagaatacctccatgagcttctcctgcatagccattgggatcatcacactctacctgggcgccgtggtgcaggccgacatgggctgcgtcataaactggaagggtaaggagctgaagtgtggctctgggatcttcgtgaccaacgaggtgcacacgtggaccgagcagtacaagttccaggccgattcccccaagcgcctcgccactgccattgccggcgcatgggagaacggggtgtgtggcatcaggtcgacgacgcgtatggagaacctgctgtggaaacagatcgccaacgagctgaactacatcctgtgggagaacaatatcaagctgaccgtggtggtaggggacatcatcggcgtgctcgagcagggcaagcgaaccctgacgccccagccgatggagctgaagtactcctggaagacgtgggggaaggccaagatcgttaccgccgagacccagaacagctctttcatcatcgacgggcccaacacaccagagtgcccctctgcctcccgcgcctggaacgtctgggaagtcgaggactacgggttcggcgtgttcacgaccaatatatggctcaaactgcgggaggtatatacacagctgtgcgaccacagactcatgagcgcggccgtgaaggacgagcgggccgtgcacgctgacatgggctactggatcgagagccagaagaatgggtcctggaagctggaaaaggccagtctgatcgaggtaaaaacctgcacctggccgaaatcccatacactctggagcaacggagtgctggagtccgacatgataatccccaagagcctggccgggcccatctcccagcataaccaccgccctggctaccacactcagaccgccgggccctggcacctcggcaagctagagctcgacttcaactactgcgagggcacgacagtggtcatcaccgagaactgcgggactcggggaccgagcctccgcaccacgaccgtgtccgggaagctgatccatgagtggtgctgtcggtcatgtaccttgcccccactcagatacatgggcgaggacgggtgctggtatggtatggagatccgccccatttccgagaaggaggagaacatggttaaaagcctggtctccgcgggcagcgggaaggtggacaacttcaccatgggagtcttgtgtttggcgatcctgttcgaagaggtcatgcgcgggaagtttggcaagaagcacatgatcgccggggtgttcttcaccttcgtgctgctgctgtccggccagatcacttggcgggatatggcccataccctgatcatgatcggcagcaacgcctccgaccggatggggatgggtgtcacctacctcgccctgatcgcgacgttcaagatccagcctttcctagccctcggatttttcctgcggaaactgaccagcagagagaatctcctgctgggagtggggctcgccatggccacaaccctgcaactgcccgaggacatcgagcagatggcgaacgggatcgccctcgggctgatggctctcaagctcatcacgcagttcgaaacctatcaactgtggactgccctgatcagcctaacctgctccaacaccatgttcacgttaaccgtggcctggcggacagcgacgctgatactcgccggggtgagcctgctgccggtgtgccagtccagctcgatgcgcaaaacagactggctccccatggccgtcgccgccatgggcgtgcctcctcttccgctgttcatcttcagcctcaaggataccctgaagcgtcggtcttggccccttaacgagggtgtaatggcggtcggcctcgtgagcatcctggcgtcctcactgctacgcaatgacgtaccgatggccggacccctggtcgccgggggactgctcatagcctgctatgtaatcaccgggacgtccgcggacctgaccgtggagaaagccgcagacattacttgggaggaggaggccgagcagaccggcgtctcacataacctgatgatcacggtggacgacgacgggaccatgcggatcaaggacgacgagaccgagaacatcctcaccgtgctgctgaagacggccctcctgatcgtatccggcgtgttcccgtactctatccccgcgacgctcctcgtgtggcacacctggcagaagcagacccaacgctccggcgtcctgtgggatgtgcccagcccgcctgagacccagaaagcagagctagaggagggggtgtaccgaatcaagcagcagggcatcttcgggaagacgcaggtaggcgtcggagtgcagaaggagggtgtctttcacaccatgtggcacgtgacccgcggcgccgtgctcacctacaacgggaagcggctggagcccaactgggcctcggtcaagaaagacctgattagttatggcggtggttggcggctcagtgcgcagtggcagaagggagaggaggtccaggtgatcgcggtcgagcccggcaagaacccaaagaacttccagacgatgcccggcaccttccagactaccactggggagattggcgccatcgccctggatttcaaacccgggacctccggctcacccataatcaaccgggagggcaaagtggtggggctgtacggcaatggggtcgtgaccaagaatggcgggtacgtgtccggcatagcgcagacaaacgcggagccggacggcccgacgcccgagctggaggaggagatgttcaagaagcgcaacctcaccattatggacctgcaccccgggagcggcaaaacccggaagtacctgccggctatcgtccgcgaggccattaagcggcgtcttcgcaccttaatcctggccccgacgcgcgtggtggccgcggagatggaggaggccctcaaggggctgcccatccggtaccagaccaccgccacgaagtcagaacacacgggccgcgaaatcgtggacctgatgtgccacgccactttcaccatgcggctgctgagccccgtgcgtgtcccgaattacaatcttattatcatggacgaggcccatttcacagaccccgcttccatcgccgcgcgggggtacatcagcacgcgcgtcggtatgggcgaggccgccgccatcttcatgaccgccacgccacccggtaccgccgacgccttcccgcagtccaacgcacccatccaggacgaggagcgcgacatcccggagcggagctggaactccggcaacgagtggatcacggactttgccgggaagaccgtgtggttcgtgccctctatcaaggccggcaacgacatagccaactgcctcagaaagaacggtaagaaggtcatccagctgtcccgtaagaccttcgacaccgagtaccagaagacgaagctgaacgactgggacttcgtggtaaccaccgacatcagcgagatgggagccaactttaaggcggatagggtcattgacccgcggcgctgcctcaagcccgtcatcctgaccgatggccccgaacgggtgatcctggccgggcctatgccggtcactgccgcctccgccgcgcagcgccgaggccgcgtagggcggaacccccagaaggaaaacgaccagtacatctttaccggccagcccctaaacaacgacgaggaccacgcccactggaccgaggccaagatgctgctagacaacattaatacccccgaggggatcatacctgcgctattcgagcccgaacgcgagaagtccgcggccatcgacggcgagtaccggctgaagggggaatcccgcaaaaccttcgtggagctgatgcgacgtggggatctcccagtctggctggcccacaaggtggccagcgagggcatcaagtacacggacaggaagtggtgcttcgacgggcagcgcaacaaccaaatccttgaggagaacatggacgtcgagatatggaccaaggagggcgagaagaagaagctcagaccccgctggctagatgcacgcacctactccgacccgctggcgctcaaggagtttaaggacttcgccgccggtcgcaagagcatcgcgctggacctggtgaccgagatcgggcgcgtgccctcccacctcgcccaccgtactcgcaacgctcttgacaacctggtcatgcttcacaccagcgagcacggcgggcgggcctaccgccacgccgtggaggagctgcccgagaccatggaaaccctgctcctcctgggcctcatgatactgctgaccggcggggccatgttgttcctgatcagcgggaaaggaatcggcaagacctccatcgggctgatctgcgtaatcgccagctccggcatgctctggatggcggaaataccgctgcagtggattgccagcgccatagtcttagagttcttcatgatggtgctcttaattcccgaaccagaaaagcagcgtacgccccaagacaaccagctggcctacgtggtgatcgggatcctcacactggccgcaatcatcgccgccaacgagatggggctcctcgaaactaccaagcgcgacttgggaatgtccaaggagccgggcgtcgtgagccctacatcctacctggacgtcgatctccaccccgcgagcgcgtggaccctttacgccgtggccacgaccgtgatcacccccatgctgagacacaccatagagaactccactgccaacgttagcctcgccgcaatcgcgaatcaggccgtggtgctgatgggactggacaaagggtggccgatctccaagatggacctcggtgtccccctgcttgccctcggttgctacagccaggtgaacccccttaccctaacggctgcggtgctcctgctgatcacccactacgccattattggccctggcctccaggcgaaagccacgcgcgaggcccagaagcggacagcggccgggatcatgaagaacccgaccgtcgacggcatcatgaccattgaccttgacccggttatttacgattcaaaatttgagaagcagttgggccaagtgatgctcctggttctgtgcgccgtgcagctgctgttaatgaggacgagctgggccctctgcgaagcgttaaccctggccactgggcccatcaccacgctctgggagggctccccagggaagttctggaacaccaccatagcagtcagcatggccaacatcttccgggggtcctacctagccggagcgggactggccttcagcataatgaaatccgtcggaaccggcaagaggggcacggggagccagggagagacgctcggggagaagtggaagaagaagctgaaccagctaagccggaaggagttcgatctctacaagaagtccggcatcaccgaggtggacaggaccgaggctaaggaagggctcaagcggggagagaccacgcaccacgcggtgagccgcggctccgcgaaactgcaatggttcgtcgaacggaacatggtgatcccggaggggcgcgtgatcgacctaggctgcgggagaggcgggtggagctactactgcgccgggttgaagaaggtcactgaggtgaggggatacaccaagggtggacccgggcacgaggagcccgttcccatgagtacctacggctggaacatcgttaagctgatgagtgggaaagacgtgttttaccttccgcccgagaaatgtgacacgcttctatgcgacatcggtgagtcctcaccctctcccaccgtggaggagtcgaggacgatacgggtccttaagatggtggaaccgtggctaaagaacaaccagttctgcatcaaggtcctgaacccctacatgcctacagttattgagcacttggaacgcctccagcggaagcacggaggcatgttggtgaggaaccccctatccagaaacagcacgcacgagatgtactggatctccaacggcacaggcaacatagtcgcctccgtcaacatggtttcccgcctcttgttgaaccgcttcaccatgacccacaggcggccgacgatcgagaaggacgtggacctcggcgccggcaccaggcatgtgaacgccgagcccgagaccccaaacatggacgtgatcggggagcggatcaagagaattaaggaggagcacaatagcacctggcattatgacgacgagaacccgtacaaaacgtgggcctaccacggatcctacgaggtgaaggcgacagggtccgcctccagcatgatcaatggcgtcgtgaaactgctgaccaaaccttgggacgtcgtgcccatggtgactcaaatggccatgacggacacaactcctttcgggcagcagcgggtctttaaggagaaggttgacacccgcacgccgcggtctatgcccggaacccgtcgggtgatgggcatcaccgctgagtggctctggcgcacgctagggcggaacaagaagccccgcctgtgcacgcgcgaggagttcaccaagaaggtccggaccaacgcggcaatgggtgccgtgttcacggaggaaaaccagtgggactccgccaaggccgcggttgaggacgaggacttctggaagttagtcgaccgggagcgggaactgcacaagctggggaagtgcggcagctgcgtgtacaatatgatggggaagcgcgagaagaagctcggcgagttcggcaaggccaaagggtcccgggccatctggtacatgtggctgggcgcccgctatctggagttcgaagcgctcgggttcctgaacgaggatcactggtttagccgggagaactcctacagcggcgttgagggggagggtctgcacaagctcggctacatactgcgcgacatctccaagatccccgggggcgcgatgtacgccgacgatacggccggttgggacacccggatcaccgaggatgacctacacaacgaagagaaaatcacccagcagatggacccggaacaccgccaactcgccaacgccatcttcaagctaacataccagaataaggtagtgaaagtgcagcggcccacgcccaccggcaccgtcatggacatcatctcacgcaaggaccagcggggcagcggccaggtaggcacgtacggtctgaacacgttcaccaacatggaggcacagctcatccgccagatggagggggagggggtactgagcaaggccgacctggagaacccgcatctgccggagaagaaaatcacccagtggttagaaaccaaaggcgtcgagcggctaaagcgcatggctatatccggcgacgactgcgtggtgaagcccatagacgaccggttcgccaacgccctcctggcgctgaacgacatggggaaggtccgcaaggacatcccccaatggcagcccagcaagggttggcacgattggcagcaagtcccgttctgctcccaccacttccacgagctcatcatgaaggacgggcggaagctggtggtcccctgccgcccccaggacgagctgatcggccgggcccgcatcagccagggggccggctggtccctccgggagacggcatgcttaggcaaggcatacgcccagatgtggagcttaatgtacttccaccggcgggacctccgactggcctctaacgccatctgctcggccgttcccgttcactgggtcccgacctcgcgcaccacctggagcatccacgcgcaccaccaatggatgacgaccgaggacatgctgaccgtgtggaacagagtgtggattgaggacaatccttggatggaggacaaaacccccgtcacgacctgggagaacgtgccctacctcgggaagcgcgaggatcagtggtgcggcagcctgatcgggctaacttcccgggccacctgggcccaaaacatacccaccgcaatccagcaagtccgcagcctcatcggaaacgaggaatttctggactacatgccctctatgaagcggttcaggaaggaggaggaatccgagggcgcaatttggtga

SEQ ID NO: 25668 - RNA, 9873 nt, synthetic construct
  misc_feature 1..9873: note = derived and/or modified CDS sequence (opt11) from DENV-3__JF808127__SS-prME
  source 1..9873: mol_type = other RNA
acttcgctgtgtctcatgatgatcctgcccgctgccctggcgttccacctcaccagccgggatggtgagccgcggatgatcgtggggaagaatgagcggggcaagagtctgctgttcaagaccgccagcgggatcaatatgtgcactctgatcgctatggacctgggcgagatgtgcgacgacaccgtgacctataagtgcccccacattacggaggtggagccagaagatatcgactgctggtgcaacctgacaagcacctgggtgacctacggcacgtgcaaccaggccggcgagcggcggagagataagcgctcagtggccctcgcaccccacgtaggcatgggcttagatacgcggacccagacgtggatgagtgccgagggtgcctggcgccaggtggagaaagtcgagacgtgggccctgcgtcacccgggtttcaccatcctagcgctgttcttggcccattacatcggaacctcgctgacgcagaaggtagtcatctttatactgctgatgctcgtgacgcccagcctgaccatgcgctgtgtaggggtggggaatcgggacttcgtcgagggcttatcaggcgcgacctgggtggacgtcgtgttagaacacggcggatgtgtcaccacgatggccaagaacaagcccacactggacatcgaactacaaaagactgaagcgacgcagctcgccacgctgaggaagctgtgcatcgaggggaagataaccaacatcacgactgacagccggtgccccacgcaaggcgaggccgtcctaccggaggaacaggaccagaactacgtctgcaagcacacctacgtggaccgcgggtgggggaacggatgcggcctgttcggaaagggctccctggtaacctgtgccaagttccagtgtctcgagcctatcgagggcaaggtcgttcagtacgagaacctaaagtacaccgtgatcatcacggtccacactggggaccaacatcaggtgggcaacgagacccagggggtcaccgcagagatcacgccccaggccagcaccaccgaggcaatcctgccagagtacggcaccttagggcttgagtgctcgccgcggacgggcctggacttcaacgaaatgatcctcttaaccatgaagaacaaggcttggatggtgcaccgccagtggttcttcgacctgcctctcccctggacatcgggcgccaccaccgagacgcccacctggaaccggaaggaactattagtaacattcaagaacgcccatgctaaaaagcaggaggtcgtggtgctcggctcccaggagggcgctatgcacaccgccctgaccggagccaccgagatccagaacagcggcgggacatccatttttgccggccaccttaagtgccgcctcaagatggacaagcttgagctcaaaggaatgagctacgccatgtgcacgaatacgtttgtgctcaaaaaggaggtgtccgagacccagcacggaaccatccttatcaaggtggagtataagggagaggatgcgccgtgtaagatcccgttcagcaccgaggacgggcagggcaaggcccacaacggcaggctgatcacggctaaccccgtcgtgaccaagaaagaagagccggttaacatcgaggccgagccgccctttggggagtctaatatcgtcatcgggaccggggacaacgctctgaagattaactggtacaaaaagggctcttcaatcgggaagatgtttgaggccacggcccgaggcgcacggcgcatggccattctcggagatacggcgtgggacttcgggtctgtgggtggggtgctgaacagcctgggcaagatggtacaccagatctttgggtccgcctacactgccctcttcagcggcgtgtcgtgggtgatgaagataggcatcggggtcctactgacctggatcggcctcaacagcaagaacacctcaatgtcattttcctgcatcgcgatcgggattatcacactgtatctcggcgcagtggttcaggcggacatgggttgcgttatcaactggaagggcaaggagctgaagtgcggcagcggaatctttgtgaccaatgaggttcacacatggaccgagcagtacaaattccaggccgattctcccaaacgtctggccacggctatcgccggcgcgtgggagaatggggtgtgcggcatccggagcaccacccgcatggagaaccttctatggaagcagatcgccaacgagctgaactatatcttgtgggaaaacaacatcaagctcaccgttgtggtcggggacataatcggcgtgctggagcaaggaaagcggacgctgactccacagccgatggagctcaaatattcctggaaaacctgggggaaggccaagattgtaaccgccgagacgcagaacagcagcttcatcatcgacggccccaatacccccgaatgcccctccgcgagtcgcgcctggaacgtatgggaagtagaggattacgggttcggcgtctttactaccaatatctggctgaagctgcgggaggtctacacccagttgtgcgaccaccgcctgatgagtgccgccgtgaaggacgagcgggccgtgcatgcagacatgggctactggatcgagagccagaagaacgggtcctggaagctggagaaggccagcctcatcgaggtcaagacgtgcacctggcctaagagtcataccctgtggtcaaatggtgttcttgaaagtgatatgatcatccccaagagcttggctgggcccatatcccagcataaccatcgaccgggttaccacacccaaacggccggcccctggcacctgggtaaactggaactcgacttcaattactgcgagggcacaactgtggttatcacagagaactgcgggacccggggccccagcctccgaacgaccaccgtgtctgggaaactaatccacgagtggtgctgccggagctgcacgctgccgcccctgcgctacatgggcgaagacggatgctggtacggcatggagatacgccccatctccgagaaggaggagaacatggtcaagagcctggtttccgccggctcggggaaggttgacaactttaccatgggcgtgctgtgcctggccatattatttgaggaggtcatgcgaggcaagttcgggaagaagcacatgatcgccggggtattctttaccttcgttctcctgctgtcaggacagatcacatggcgcgacatggcccatacgctgatcatgatcggatcgaatgctagcgatcgcatgggtatgggggtaacctacctggccctgatcgcgacctttaagatccagccttttctcgccttgggcttctttttacgaaagctcaccagccgtgagaacctgctgctcggcgtgggcttggccatggccacgaccctccaactccccgaggacatcgaacagatggcgaatgggatcgccttaggactcatggccttgaaactcataacccagtttgagacttaccaactgtggacggccctcatcagcctgacgtgctccaacaccatgtttaccctgacggtagcctggcgtacggcgaccctcatactggccggcgtcagcctgctccccgtgtgccagtccagcagcatgcgtaagactgactggctacccatggccgtcgccgcgatgggggtgccacccctccccctcttcatcttttcactgaaggacaccttgaagcgtcggtcttggcccctcaacgaaggggttatggcggtcggcctggtgtcgatcctggcctctagcctcctgaggaacgacgtgcccatggccggaccactggtcgccgggggtctcctgatagcttgctacgtgatcaccggaacatccgccgacctcaccgtggagaaggccgcagatatcacgtgggaggaggaggccgagcagaccggggtatcacataacctcatgatcaccgtcgacgacgatgggaccatgcgaatcaaggacgatgagaccgagaacatcctgacggtgctgctcaagaccgcgcttttaattgtgtcaggtgtgttcccgtacagtatccccgcgaccttgttagtatggcacacctggcagaagcagacacagcgctctggtgtcttatgggacgtaccctccccgcccgaaactcagaaagccgagctcgaagagggggtttaccggatcaagcagcaaggcatcttcggcaagacgcaggtaggcgtgggtgtgcagaaagagggcgtctttcacaccatgtggcatgtgactcggggcgcagtgctgacctacaacggaaagcgtctggagcccaactgggcgtctgtaaagaaagacctcatcagctacggggggggttggcgcctgtccgcgcagtggcaaaagggcgaggaggtccaggtcatcgccgtcgagcccggcaaaaacccgaaaaatttccaaaccatgccgggcaccttccagacgaccaccggtgagatcggcgcgatagcgttagacttcaagccggggaccagcggcagccccatcatcaaccgggagggcaaggtggtggggctatacggcaacggtgtagtgacgaagaacggtgggtacgtgtcaggcatcgcccagaccaacgcggagccggacggaccgacccctgagttagaggaagaaatgttcaagaagcgcaatctgacaatcatggacctacaccccgggagcggcaagacccgaaaatacctcccggccatcgtccgcgaggccataaagcgacgcttacgcaccctgatcctcgcccccactcgcgttgtggcggcagaaatggaggaggccctgaaggggctgccgatccggtaccagactacggccaccaagtcagagcatactggacgcgaaattgtagatctcatgtgccacgcgacattcacgatgcggttactgagccctgtgcgcgtgcccaactacaacctcatcattatggatgaagcccacttcacggaccccgcgtccattgcagcccggggttacatttccacccgcgtgggcatgggcgaggccgcggccatcttcatgaccgcgactccgcccggaaccgcggacgctttccctcagtcgaatgcgcccatccaggatgaggagcgcgacattcccgagcggagctggaactccggcaatgagtggataaccgacttcgccggtaagaccgtgtggtttgttcccagcatcaaggccgggaacgacatagcaaactgcctgcggaagaacggtaagaaggttattcagctgtcccggaaaacgttcgacaccgagtaccagaaaaccaagctcaacgactgggatttcgtggtgaccaccgacatcagcgagatgggcgcgaacttcaaagcggaccgcgtaattgacccacgacgctgcttgaagcccgtaatcctgaccgacggccccgagcgggtgatcctcgccgaacccatgccggtcactgccgcctccgcggcgcagcgcaggggacgcgtggggagaaacccccaaaaggaaaacgatcagtacatcttcacggggcagcccctcaacaatgatgaggaccacgcccactggaccgaggccaagatgctgctcgataacataaatacgcctgagggcattatcccagctctgtttgagcccgaacgcgagaagtccgcggcgatcgatggggagtaccggctaaagggggagtcccgcaagacctttgtagagctcatgcggcgcggggaccttccggtttggctggcccacaaggtggccagcgagggtattaaatacaccgaccggaagtggtgcttcgacgggcagcgcaacaaccagattttagaggagaacatggacgtcgagatctggactaaggaaggagagaagaagaagctgcggccgaggtggttagacgcgcgcacgtacagcgacccgttagcgctgaaagaatttaaggacttcgccgctggccgcaaaagcatagcgctggacctcgtcaccgagatcggtagagtcccctcccacctcgctcaccgaacgcgcaatgcactggacaacctcgtcatgctgcacacgagcgagcatgggggaagggcctacaggcacgcagtggaggagttacccgagacgatggagacgctcctactgctcgggctgatgatcctgctcaccggcggggccatgctgttccttatttccggcaagggcatcgggaagacttccatcggccttatctgcgtgatcgcgagctccgggatgctgtggatggcggagatccctctgcagtggatcgcaagtgccatcgtcttagagttctttatgatggtgttgctaatccccgagcccgagaagcaacgaacaccccaagacaaccagttggcctacgtggtcatcggcatactcaccttagccgcgatcatcgccgccaacgagatgggactcctggaaaccaccaagcgcgatcttggcatgtccaaagagccgggagtggtaagcccaacgtcctacctcgatgtagacctgcatcccgcttctgcgtggaccctgtacgcggtcgcgacaacagtaattacacccatgctccggcacaccatagagaactccaccgctaacgtcagccttgccgcgatcgcgaaccaggccgtggtgctgatggggctcgacaaaggctggccgatttcgaaaatggatctcggagttcccctgctcgccctgggctgttacagccaagtgaaccccctgaccttaaccgctgcggtacttctgctcattacccattacgccatcatcgggcccggactgcaagcgaaggccaccagagaggctcagaagcggacagccgccggcatcatgaagaacccgactgtcgacggaataatgaccatagacctggatcccgtgatatacgactccaagttcgaaaaacagcttggccaagtgatgctgttggtcctctgtgccgtgcaactgctgctcatgcgcaccagctgggccctgtgtgaggctctgactctggccacaggtcccataacgaccctttgggagggctcccccggaaagttctggaataccacgatagccgtaagcatggccaatatcttccgcgggagctatctggccggcgccggactagcgttcagcatcatgaagtcagtcggcaccggcaagcgcggtaccggcagccaaggggaaaccttaggcgagaagtggaaaaagaagctgaatcagctcagccggaaggagttcgatctgaacaagaaatccggcatcacagaggtggatcgcaccgaggccaaggaggggctgaaaagaggggaaatcactcaccacgccgttagccgcggctccgccaagttgcaatggttcgtcgaaaggaacatggttatcccggaggggcgcgtaattgacctgggatgcggccgcggaggctggtcttactactgtgcggggctaaagaaggttaccgaggtgcgcggctacaccaagggcggtccaggtcatgaggagcccgtgccaatgtccacgtacggctggaacatcgtcaagctcatgtctggcaaggatgtattctacctgccgcccgagaaatgcgatacgctgctgtgcgacatcggggaatcctctccctcccctaccgtggaggagagccgcaccatacgcgtcctcaaaatggtggagccgtggctgaagaacaatcaattctgcatcaaggtgctgaatccttacatgcccactgtaatcgagcacctggaacgcctgcagcggaagcacggcggaatgttagtacgcaacccactcagtcggaacagcacccacgaaatgtactggatctccaacgggaccggcaacatagttgccagcgtcaaaatggtgtcccgcctgctgctcaaccggttcacaatgacgcaccgccggccgaccatagaaaaggacgtcgacctgggggccgggacgcgccatgtcaatgcggagcctgaaaccccaaacatggacgtaatcggagagcggattaagcgaatcaaggaggaacataacagcacgtggcattacgacgacgagaatccgtataagacctgggcttaccacgggtcctatgaggtgaaggctaccggctccgcctcaagcatgatcaacggggtcgtgaaactcctcaccaaaccctgggacgttgtgcccatggtgacgcagatggccatgaccgacaccacgccattcggccagcagagagtcttcaaagagaaggtggacacgcggaccccccgatctatgcccgggaccaggcgtgtgatgggtatcacggccgagtggctgtggcggacattaggccggaacaagaagcccaagctgtgtacccgagaggagttcaccaagaaggtccgcaccaacgcggccatgggggccgtatttacggaggagaatcagtgggactccgccaaggccgcggtggaggacgaggacttctggaagcttgttgatcgggaaagagagttgcacaagctcggcaagtgcgggagctgcgtgtacaacatgatgggcaagcgggaaaaaaaattaggggaattcggcaaggccaagggctcacgcgctatctggtacatgtggctgggggcccggtatctcgagtttgaggccctgggcttcctgaacgaggaccactggttcagcagagagaactcctattccggggtggaaggggaagggctccacaagctgggctacatcctgagggacataagtaagatccccggcggggcaatgtacgctgacgacaccgccggctgggacacgcgcatcaccgaggatgacctccataatgaggaaaaaatcacgcagcagatggacccggagcaccggcagctagcgaatgccatcttcaagctgacctaccagaacaaggtcgttaaggttcagcgacccacccccaccggtaccgtcatggacatcatcagccggaaggaccaacgcggctccggccaggtgggcacctacggcctgaatactttcacgaacatggaggctcagctgatccggcagatggagggagagggcgtgctgagcaaggccgacctcgagaacccacacctcccggagaagaagatcacccaatggctagaaacgaaaggggttgagcgccttaagcggatggcgatatccggggacgactgcgtagtaaaacccatcgatgaccggttcgcaaatgcgttactcgcgctcaatgatatgggcaaggtacggaaggacatccctcagtggcagccctcgaagggatggcacgactggcaacaagtcccattttgctcccaccatttccacgaattgatcatgaaggacggtcggaagctggtggtcccctgccgaccccaggatgagctcatcggacgggcgcggatctcccagggagccgggtggtcactcagagaaaccgcgtgtttgggtaaggcctatgcacagatgtggagcctcatgtacttccatcgcagggacctgagactggccagtaacgccatttgcagcgccgtacctgtgcactgggtccccacctcccggaccacttggagcatccacgcgcaccaccagtggatgaccaccgaggacatgctaaccgtgtggaaccgcgtgtggatcgaggacaacccctggatggaggacaagacgcccgtcacgacctgggagaacgtgccttacctgggcaagcgggaggatcaatggtgcgggagtttgatcggtttgacctcccgagccacgtgggcccagaatattccaaccgccatccaacaggtccggtccctgattgggaacgaggagttcttagactacatgccctccatgaaacgcttccggaaggaggaggaaagcgagggcgcaatctggtga

SEQ ID NO: 25669 - RNA, 9873 nt, synthetic construct
  misc_feature 1..9873: note = derived and/or modified CDS sequence (opt11) from DENV-3__JF808124__SS-prME
  source 1..9873: mol_type = other RNA
acctccctgtgcctcatgatgatcctgcctgcagccctggcgttccacctcacatctcgcgacggggagccgcggatgatcgtcgggaaaaacgagcggggcaagagcttgctgtttaagacggcttccgggatcaacatgtgtacccttatcgcgatggatttaggcgagatgtgtgacgacactgtgacctataagtgcccccacatcacggaggtagagcccgaagacatcgactgttggtgcaacctgaccagcacctgggtgacctacgggacttgcaaccaggccggtgagaggcgccgggataagcgctccgtagctctcgcaccccacgtggggatgggtttagacacccgcacgcagacctggatgagcgcagagggggcctggcgccaggtggagaaggtcgagacgtgggccctacggcacccggggtttaccatcctcgcgctgttcctggcccattatatcggcacctcactcacgcagaaggtcgtgatcttcatcctgttgatgctcgtaacgcccagcatgaccatgaggtgcgtcggggtgggcaaccgggactttgtcgaagggctgtccggggccacctgggtagacgtggtgctagaacacggagggtgcgtcaccacgatggccaagaacaagcctaccctcgacatcgagctgcaaaagaccgaggctacccaacttgcgacgctccggaaactgtgcatcgagggcaagataaccaacatcaccacagactccaggtgccctacacagggcgaggccgtcctgcccgaggagcaagaccagaactacgtttgcaagcatacctatgtggatcgcgggtggggcaacggttgcggcctcttcgggaagggctcgctggtgacgtgcgctaagttccaatgtctggagccaatcgaggggaaggtcgtgcagtacgagaaccttaagtacaccgtgatcataacggttcacaccggcgatcagcaccaagtggggaacgagacgcaaggtgtcaccgccgaaatcacgccccaagcatcaaccacggaggcaatcctgccagagtacggcaccttcgggctggagtgcagcccccggacaggcctcgacttcaacgagatgatcctattaacgatgaagaacaaggcttggatggtgcatcgccagtggttcttcgaccttccactgccctggaccagcggcgccaccaccgagacgcccacctggaaccgcaaggagctgctcgtgaccttcaagaatgcccacgcgaagaagcaagaggtcgttgtgctggggtcccaggagggcgcaatgcacacggcactgaccggggccaccgaaatccagaacagcggcgggaccagtatattcgccgggcacttaaagtgccgtctgaagatggacaaactggagctgaagggaatgtcttacgccatgtgcaccaatacctttgtcctcaagaaagaggtaagtgagacgcagcatgggaccatacttatcaaagttgagtacaagggcgaggacgcgccgtgtaaaatccccttctccactgaggacggccagggtaaggcccacaacgggcggttgattacggccaaccccgtagtaacgaagaaggaggagctagtcaacatcgaggcagaacccccgttcggcgagagcaacatcgtcatcggcatcggggataatgcgctgaagattaactggtacaagaagggctcctcaatcggtaaaatgttcgaggccacagcccgcggcgcacggcgcatggcgatcctaggcgataccgcgtgggatttcgggtccgttggcggggtgctcaatagcctgggtaagatggttcaccaaatcttcgggtccgcttacaccgccctgttcagcggtgtctcgtgggtgatgaaaatcggcatcggggtcctcctgacctggatcggcctgaacagcaagaacacctctatgagcttctcctgtatagcaatcgggatcatcactctctatctgggcgccgtggtgcaagcggacatggggtgcgtaatcaactggaagggcaaggagctcaagtgtggcagcgggatcttcgtgacgaacgaggtgcacacatggaccgagcagtacaagtttcaagccgactctcctaaacgcctcgccactgctatcgccggtgcttgggagaatggggtctgtggcattaggtcgacgacccgaatggagaacttattgtggaaacaggtggccaacgaactcaactacatcctgtgggagaacaacatcaagctgaccgtggtagtgggagacatcatcggcgtgctcgagcagggaaagcggaccttgacgccacagcccatggagctgaaatactcgtggaagacctgggggaaggccaagatcgtcaccgcggagacccagaacagctccttcataatcgatggcccgaacacgcccgagtgccccagcgcctcccgcgcctggaacgtgtgggaggtcgaggactacgggttcggtgtattcaccaccaacatctggctcaagctgcgggaggtctatacccagctgtgcgaccatcgcttgatgagcgctgccgtaaaggatgagcgggccgtccacgcggacatggggtactggatcgagagccagaagaacgggtcgtggaagctggagaaggctagtcttatagaggtgaagacctgcacttggcccaagtcccacaccctctggagcaacggtgtcctggagagtgacatgatcattcccaagagcctggccgggccgatctcccagcacaaccatcgccccggctaccacacccagaccgccggaccgtggcacttgggcaagctagagttggattttaattactgcgagggtaccacggtcgtgatcaccgagaactgcgggacgcgtggccccagcctccgcacgacaaccgtttccgggaaacttatccatgagtggtgctgccggtcatgcaccctgccacccctccgctacatgggcgaggacggctgctggtacggcatggagatccggccaatctccgagaaggaggaaaacatggtcaagagcctggtgtccgcaggctcaggcaaggtagacaacttcacgatgggggtcctgtgcctcgctatcctgttcgaagaggtgatgcgcgggaagttcgggaagaaacacatgattgcgggagtgttattcacatgcgtcctcctgctgagtggtcagattacctggcgggacatggctcacactctcatcatgatagggagcaacgcatctgacagaatggggatgggcgtaacgtacctcgccctgatagcgacctttaagatccaaccctttctcgcgctcggattcttccttcggaagctcacgtcccgcgagaatcttttactaggcgtaggtctggccatggctaccacgctgcagctccccgaggatatcgagcaaatgggcaacggcatcgcgctggggctgatggccctcaaactgatcacccagttcgaaacctaccagctgtggaccgctcttatcagcctgacgtgctccaataccatgttcaccttgaccgtcgcctggcggacggccactctaatactggccggcgtgagcctgcttcccgtctgtcaatccagctccatgaggaaaaccgactggttaccaatggccgtggccgccatgggggtaccaccccttcctctcttcatattcagcctgaaggatacccttaaacgccggtcctggccgctaaacgaaggtgtcatggcggtgggattggtgtcaatcctggcatccagcctcctgcgcaacgacgtccccatggccgggcccctggtggctggagggctcctgatcgcctgctacgtaatcaccggcacctccgcggatttgaccgtcgagaaggcggcggacatcacttgggaggaagaggcggagcagactggggtgtcgcacaaccttatgatcaccgtggacgacgacggcaccatgaggatcaaggacgacgaaaccgagaacatcttaacagtgctgctcaagacggccctgctgatcctgtccggcgtgtttccctatagcatccccgccaccctcttggtgtggcacacctggcagaaacaaacccagaggagtggggtcctctgggacgtgccctcgccacccgagacgcagaaggcagagttagaggagggcgtgtaccgcattaagcagcaggggatcttcggcaagacgcaagtcggtgtcggtgttcaaaaggaaggcgtattccacaccatgtggcatgtgacccgcggggccgtgctcacatacaacggcaagcgactcgagccgaactgggcctccgtcaagaaagacctgatcagctacggagggggttggcgcctctccgcccagtggcagaaaggcgaggaggtgcaggttatagcggtagagcccggtaagaaccccaagaacttccaaaccatgcccggaacctttcagaccacgaccggcgagattggggccatcgccttagactttaaaccgggcacctcagggagccccatcatcaaccgggagggaaaggtcgtgggcctatacgggaacggcgtcgtgaccaaaaacggagggtacgtgtccggcattgctcagacgaacgccgagccagacgggccgacccctgagctggaggaggagatgttcaaaaagcgcaatcttaccatcatggacctgcaccccggcagcgggaagacccgaaagtacctgcccgccatcgtccgggaggccatcaagcgaagactcagaacgctcatattggccccgacaagggtcgtggccgccgagatggaggaagcgctgaaggggttgcccatcagatatcagactaccgccacgaagtccgagcacaccgggcgcgagatcgtggacctgatgtgccacgccacctttaccatgcggttactcagccccgtacgcgtgcccaactacaacctgataatcatggatgaggctcacttcacggacccggcctccattggcgcccggggctatatcagcaccagggtcgggatgggcgaggccgccgccatcttcatgaccgcgacaccgcccgggacggccgatgcctttccccagtccaatgcccccatacaggatgaggaacgcgacatcccggagcggtcatggaactccggtaatgaatggataacggatttcgcagggaagaccgtgtggttcgtgcccagtatcaaagcaggcaacgacattgcaaactgccttaggaaaaatgggaagaaagtcatccagctctcccggaaaacgttcgacacggaataccaaaagacgaaactgaacgactgggacttcgttgtgaccaccgacataagcgagatgggcgccaacttcaaggcagatcgcgttatcgacccccggaggtgcttgaagccggtgatcctcacggatggtccagagcgcgtgatcctcgccgggcccatgcccgtcacggcggcctccgccgcccagcgccgtgggagagtggggaggaacccgcagaaggagaacgaccagtacatcttcaccggccagcccctgaataatgacgaagaccacgcccactggaccgaagcaaagatgttactagacaacatcaacacccccgagggcataatacccgccctgttcgaacctgaacgcgagaaaagcgccgccatagacggagagtaccggctcaagggggaatcccgcaagacgttcgtagagttgatgcggagaggggacctgcccgtatggcttgcgcacaaagtggccagcgagggcatcatctacaccgaccggaaatggtgcttcgacggccagcgcaacaatcagatcttggaagagaacatggacgtcgagatctggaccaaggagggggagaagaagaagctgcggccccgctggctcgacgcccgcacctacagcgacccgctggctctgaaggagttcaaggattttgccgcgggccggaagtccatcgccctcgacctggtgacggagatcgggcgcgttccgtcgcacctggcgcaccggacgcgcaatgcattggacaacctggttatgctgcacaccagtgagcacggcgggcgggcctaccgccacgcggtggaagaattacccgagaccatggagacactgttactactaggcctgatgatcctgttaaccggcggagccatgctgttcctgatcagcggcaaggggatagggaagacctccatcgggctgatctgtgtgatcgctagctccggcatgtcctggatggccgagatcccgcttcaatggatagcctccgccatagtacttgagttcttcatgatggtattgctgataccggagccagagaagcagaggacccctcaggacaatcagctcgcctacgtagttatcggcatcctgaccctggccgccatcatagccgcgaacgagatggggctcctggagactacaaaacgggacctgggtatgtcaaaggagcccggggtcgtgagtccgaccagttacctagacgtcgatctgcatccggcctccgcctggacgctgtacgccgtggcgaccaccgtgatcacccccatgcttcggcacacgattgaaaacagcaccgccaacgtctccctggccgccattgccaaccaggctgtggttctgatgggcttggacaaggggtggcccataagcaagatggacttaggcgtccccctgctcgccctgggatgctactcccaggtgaacccgctgacgttaaccgccgccgtgctgttgctcataacgcactacgccatcatagggcccggactgcaggcgaaggccacacgcgaggcccagaagcgtacggccgccggcattatgaagaaccccacagtggacggcatcatgacgattgatctggaccctgtaatatatgactccaaattcgagaagcagctgggccaggtgatgctgctggtcctgtgcgccgtgcagctgcttctcatgcgaacttcctgggccctgtgcgaggctctgaccctcgctaccgggccaatcactaccctgtgggaaggcagccccggtaagttttggaacacaaccatagcggtgtcaatggccaacatcttccgtgggagctatctggccggtgctggcctcgcgttttccataatgaagtcggtgggaacggggaagcgtggcaccgggagccagggtgagacactgggggagaagtggaagaagaagctgaaccaactctcccggaaggaatttgatctgtacaaaaagagcggtatcacagaggtggaccgaaccgaggctaaggagggcctaaagagaggggaaatcacgcaccacgccgtttcccgtggctctgccaaacttcagtggtttgtcgagcggaacatggtgatccccgagggccgcgtgatagacctgggatgcggacggggcggatggtcctactattgcgccgggctgaagaaagtcactgaggtgagaggctacaccaagggtggtccggggcatgaggagcccgtgcccatgagcacctacggctggaacatagtcaagttaatgtccggcaaggacgttttctacctgccgccggagaagtgtgacacgctgctgtgtgacatcggtgagagctcccccagccctactgtggaggagagtcgcacgatcagagtgctcaagatggtggagccctggcttaaaaacaaccaattctgcatcaaggtgctaaacccatacatgcccaccgtcattgagcacctcgagcggctgcagcggaagcacggcggaatgctggtccgcaaccccctcagcagaaattcaacgcacgagatgtactggattagcaatggtaccggcaacatcgtggcaagtgtcaatatggtctcacgcttactactcaaccgctttaccatgacccaccgccgacccaccatagagaaggacgtggacctgggagccggtacccgccacgtcaacgccgaaccggagacgcctaacatggacgtaatcggggaacggatcaaacgcataaaggaggaacacaacagtacctggcactacgacgatgagaacccttacaagacgtgggcctaccatggcagctatgaagtgaaagccaccggcagcgccagcagcatgataaacggcgtcgtgaaactgctcaccaagccgtgggacgtcgtgccgatggtgacccagatggcaatgacggacaccacccccttcggccagcagcgggttttcaaggagaaagtggacacgcgcacgccccgatccatgccgggaacgcggcgggtgatgggcatcaccgccgagtggctgtggcgcactctgggacggaacaagaagccgcgcctctgcacacgcgaggagtttaccaagaaggttcggaccaacgccgctatgggcgcggtgtttaccgaggaaaaccagtgggactcagctaaagccgccgtagaggatgaggacttctggaagttggttgaccgcgaaagggaattgcacaaactcggtaagtgcggctcctgcgtatacaacatgatggggaagcgtgagaagaaattaggagagtttggcaaggccaaaggttcaagagcgatctggtacatgtggttgggcgcccgctacctggagtttgaggccttgggattcctgaacgaggaccattggttttcccgggaaaacagctactccggcgtagagggtgaggggcttcacaagctggggtatatcctacgtgacatctcaaaaattcctgggggcgcaatgtatgccgatgacacggcgggctgggatactcgtatcaccgaagacgatctccataacgaggagaaaatcactcagcagatggaccccgagcaccgacaacttgctaacgccatctttaagttgacgtaccaaaacaaagtcgtaaaggtgcagcggcctacacccacaggaaccgtcatggacattatctcccgtaaagaccaacgtggcagcgggcaagtgggcacctacgggctaaacacgttcaccaatatggaagcccagctgatacgccagatggagggggaaggggtgttatccaaggccgacctagagaacccccacctcccggagaagaaaataacccaatggctagagaccaagggggtagagcgccttaagcgcatggctatcagcggcgacgactgcgtagtgaagcctatcgacgaccgcttcgccaacgccctgcttgccctcaatgacatgggtaaggtcagaaaagacatcccccaatggcagccctccaaaggttggcacgattggcaacaggtgcccttttgcagtcaccatttccacgagctgattatgaaggacgggcgcaagctagtggtcccctgcaggccacaggacgaacttatcggccgggcccgcatttcccagggcgcggggtggagcctgcgtgagacggcctgcctgggcaaggcatatgcccagatgtggtcccttatgtacttccaccggcgcgacctgaggctggcttcgaacgctatctgctcagctgtgcccgtacactgggtccccaccagtcgcaccacctggagcatccatgcccatcaccagtggatgaccaccgaggacatgctcaccgtgtggaaccgggtttggatcgaggacaacccctggatggaggacaagacccccgtcacgacgtgggagaatgtgccttacctggggaaacgcgaggaccagtggtgcggctccctgatcgggctcacttctcgtgccacctgggcgcagaacatcccaacggccatccaacaggtgcgctccctcatcggcaacgaggagttcttagattatatgccgtctatgaaacggttccgaaaggaagaggagtccgaaggcgccatctggtga

SEQ ID NO: 25670 - RNA, 9873 nt, synthetic construct
  misc_feature 1..9873: note = derived and/or modified CDS sequence (opt11) from DENV-3__JF808126__SS-prME
  source 1..9873: mol_type = other RNA
accagcctgtgcctgatgatgatcctgccggccgcccttgcgttccaccttacaagtcgggacggggaaccgaggatgatcgtggggaagaacgagcggggaaagtcactgctgttcaagacagccagcgggattaacatgtgcacactcatagccatggatctgggggagatgtgtgatgacaccgtgacctacaagtgcccccacattaccgaggtcgagcccgaggacatcgactgttggtgtaacctgaccagcacctgggtcacctacggaacatgcaatcaggctggggaacaccggcgtgataagaggagcgtggctctggcgccccacgtaggtatggggctggacacacgcacccagacctggatgagcgccgaaggcgcctggcgccaagtggagaaggtcgaaacatgggctctgcgccatccgggattcaccatcctcgcactcttcctggcccactacatcggcacctccctgacccagaaggtggtgattttcacgctgctgatgctcgtcactccatccatgaccatgcgatgtgtgggagtgggtaaccgtgacttcgtcgaaggtttgagcggtgcgacctgggtggacgtggttttggagcacggcgggtgcgtgacaaccatggctaagaacaagccaacgctcgacatagaactacagaagactgaagccacacagctagcgaccctccggaagctgtgcatcgagggaaagatcaccaacatcaccacggatagccgttgccccactcaaggcgaagccgtgctgccggaggagcaggaccagaactatgtctgtaagcacacgtacgtggaccggggatggggcaacggatgcggcctcttcgggaagggctcactggtaacttgtgctaagttccagtgcctggagcccatcgaaggtaaggtggtgcagtatgaaaacctaaagtacacggtgatcatcaccgtgcacaccggagaccaacaccaggtgggcaatgaaacccagggtgtaacggccgagataacgccacaggcctcgaccaccgaggcgatcctgccagagtacggcaccctggggctcgagtgctccccacgcacgggtttagacttcaatgagatgatcctgctcacaatgaagaacaaggcctggatggtgcaccgccagtggttcctcgacctcccccttccctggactagcggggccaccacggagactcctacctggaatcgcaaggagttactggtgacctttaagaacgcccacgccaagaagcaggaggtcgtggttcttgggtcccaggagggagctatgcacacggccctaaccggcgccactgagattcagaacagcggcgggacctccatcttcgccggccacctgaagtgccggttaaagatggacaagctcgaattaaagggcatgagctacgccatgtgtacgaataccttcgtcctcaagaaggaggtgtcagagacccagcacggcacaattttaatcaaggttgaatataagggcgaagacgcgccgtgtaagatcccattcagtacggaggacgggcaaggcaaggcccacaacggtcgactcatcacagccaaccccgtcgtgaccaagaaggaggagcccgtgaatatcgaggctgaacctcctttcggtgagagcaacattgtcattggcatcggggacaacgcgctgaagatcaattggtacaagaagggttcctctatcgggaagatgttcgaggctacagctcggggcgctcgccggatggcgatcctcggcgacacggcgtgggacttcggatccgtgggtggggttcttaattcgctgggcaagatggtccaccagatcttcgggagcgcctataccgccctcttctccggcgtgtcctgggtgatgaagattgggatcggggtcttactgacctggatcggcttaaacagcaagaacacctctatgagcttcagctgcatcgcaatcggaatcatcacactctacctgggcgccgtcgtgcaggctgacatggggtgcgtcataaactggaagggcaaggaactcaagtgcgggagtgggatcttcgtgacgaatgaggtgcacacttggacggagcagtacaagttccaggccgactcaccgaagcgtctagccacggccatcgccggtgcgtgggagaatggggtctgtggcattcgcagcaccacgcggatggagaatctactatggaaacagatcgcgaacgaactgaactacatactttgggagaataacatcaagctgactgttgttgtcggtgacatcatcggcgtgctggagcagggcaagcgcacactgacgccccagcctatggaactgaagtactcatggaagacctggggcaagagcaagatcgtgaccgccgagacgcagaactccagcttcatcatcgacggcccaaatacccccgagtgtccctccgcctcacgggcctggaacgtctgggaggtcgaggattacgggtttggtgtgttcacaacgaacatttggcttaagctgcgcgaagtttatacccaactctgtgaccaccggcttatgagcgccgcagtgaaggacgaacgggccgtgcacgccgacatgggctactggatcgagtcccagaagaatggaagttggaagctagagaaggcgtccctcatcgaggtcaagacgtgcacttggcccaagagccatacgttgtggtcgaatggcgtgctggagagcgatatgattattcccaagtccctagccgggcccatcagccagcataaccaccggccggggtaccacacccaaacggccgggccatggcacctagggaaacttgagttagacttcaactactgcgagggcaccacagttgtcatcaccgagaactgcggtacgcgtggccctgccctacggacaacaaccgtctcagggaaactgatccacgaatggtgctgccggtcgtgtacgctgccacctcttcggtacatgggcgaggacgggtgctggtacgggatggaaattcgcccaatctccgagaaggaggagaatatggtcaagagcttagtgtccgccggtagcgggaaggtggacaacttcacgatgggcgtgttatgtctggccatattgttcgaagaggtcatgcgggggaagttcgggaagaaacacatgatcgctggcgtgttcttcactttcgtgctcctgctgtcaggtcagatcacttggcgcgatatggcgcacaccctcattatgatcggctcgaacgcctccgaccggatggggatgggagtcacctacctagccctcatcgcgactttcaagatccagccctttctcgccctggggttcttcttacgcaagctcacgagccgggagaacctgctgctaggcgtgggcctcgctatggccaccaccctgcagctccccgaggacatcgagcagatggcgaacgggatagccctaggcctcatggccctcaaactgattacgcagttcgagacgtaccagctgtggacggccctcatcagcctgacctgttctaacacaatgtttacattaacggtcgcctggcgcaccgcaaccctcatcctggccggagttagcctgctccccgtgtgtcaatccagctcaatgaggaaaaccgattggctgcccatggccgtcgccgcaatgggtgtaccgcccctccccctgttcatcttctctctgaaggatacactgaaacgcaggtcctgccctctgaacgagggggtcatggctgttggcctcgtgagtatcctggccagtagcctcctgcggaacgacgtgcccatggcgggccctctggtggccgggggcctgctgattgcctgctatgtgatcaccgggacctctgcggacctgaccgttgagaaagccgccgacatcacgtgggaggaggaggccgagcagactggcgtcagccacaatcttatgatcactgtagacgacgacgggaccatgcggatcaaggacgacgagaccgagaacatattgacggtgctgcttaaaaccgcactgctgattgtctctggcgtctttccgtactcaatacccgcgaccctccttgtgtggcacacctggcaaaaacagacgcagcggagcggcgtcctgtgggacgtgccctcgccgcccgaaacccagaaggccgagctcgaggagggggtctaccgcattaagcagcaggggatcttcggaaagacccaggttggcgtgggggtgcagaaggagggcgtcttccataccatgtggcacgtgacgcggggcgccgtgctgacctataacggaaagagactagagccaaattgggcgtccgtcaagaaggacttggtgagctacggcgggggctggcgtctgtccgcgcaatggcagaagggtgaagaagttcaggtcatcgccgtcgaacccggcaaaaatcccaagaatttccagaccatgccgggcacctttcaaacgactaccggggagatcggcgccatcgctttagactttaagccgggtaccagcggctcccccatcatcaacagggagggcaaggtggtcgggctgtacggcaacggggtggtgacgaagaacggcgggtacgtctctggcatcgcccaaaccaatgcggagccggacggccctacgcctgagctcgaggaggagatgttcaaaaagagaaacctgactatcatggacctgcacccagggagcggcaaaacgcgcaagtatctcccggccatcgtgcgggaagcaataaagcgcagactgcgtacactgatcctcgcccctacccgagtggtcgctgcggaaatggaggaggcccttaagggactgcccatccgctaccagacgacggctaccaagtccgaacacaccggccgggagattgtggacttaatgtgccacgccaccttcacgatgcggctgctaagccccgtgcgggtccagaactacaacctcatcatcatggatgaagcccacttcacggacccggcttccattgccgcccgcgggtacatcagcacaagggtgggcatgggagaagcggcggcgatcttcatgacggccaccccgccggggactgcggacgcgtttccgcagtccaacgcgcctattcaggacgaggaacgcgacatccccgaaagaagctggaactcaggcaatgaatggatcaccgacttcgccgggaaaaccgtctggttcgtacccagcataaaggccggcaatgatattgccaattgcctgagaaagaacgggaagaaggtcatccagctatcccgcaagactttcgacacagagtaccaaaagaccaaactcaacgactgggacttcgtggtgaccacagatatctcagagatgggcgccaacttcaaagcggaccgggtaatcgatccgagaagatgtctgaagccggtcattctgaccgatggccccgagcgcgtgattctcgctggccctatgcccgtgacggcggcctccgccgcccagcggcgcggcagagtggggcgcaacccgcagaaggagaacgaccagtatatcttcaccggtcagcccctcaataatgacgaggaccatgcacactggacagaggcgaaaatgcttcttgacaacatcaatacgcccgaggggatcatccccgccctattcgagccggagcgagagaaatccgcggccatcgacggcgaataccgcctgaagggggagtcccggaagaccttcgtcgagctcatgcgcagaggggacctgccagtgtggctagcccacaaggtcgcctccgagggcatcaagtacaccgaccgccggtggtgcttcgatggccaacgcaacaaccagatcctcgaggagaacatggatgtggagatttggaccaaggagggtgagaagaagaaactgcggccccgctggctggatgctcgcacgtactccgaccccttagctctgaaggagttcaaggacttcgccgccggcaggaagtcgattgccctagacttggtgaccgagatcgggagagtgccgtcccacctggcccatcggacccgcaacgcgctggacaacttggtaatgttacataccagcgagcacggcgggagggcctaccgccacgccgtggaggagctgccagagacgatggagaccttactcctgctcggacttatgatcttactcaccgggggcgccatgctgttcctgatcagcggcaaggggatcggaaaaacatccatcgggttaatctgcgtcatcgccagctccggcatgctgtggatggcggagataccgttaccgtggattgcctctgccatagtgctcgagttcttcatgatggtgctcctaatccccgagcctgagaaacagagaacgccccaggacaaccaactagcctacgtcgtgattggtatccttaccctggcagccataattgccgccaacgagatgggccttctggagacgactaagcgcgacctgggcatgagcaaggagcccggggtcgttagccccacctcctacctcgacgtggacctgcaccccgctagcgcatggaccctgtacgctgtggccacgacagtcatcacgcccatgctgcggcacaccatcgagaacagtaccgcaaacgtgagcctggccgcgattgctaaccaagccgtggtcctgatgggcctcgacaaaggatggccgatctccaagatggacttaggcgtgcccctgctagccctggggtgctacagccaagtgaaccccctgaccctcaccgccgcggtccttttactcataacccattatgccatcatcggccccggcctacaagcaaaagccacacgcgaggctcagaagcgcacagcagccgggatcatgaagaacccgaccgtcgatggcatcatgaccatagacctcgaccccgtgatctacgactccaagtttgagaagcagctcgggcaagttatgctgctcgtgttgtgtgccgtacagttactgctcatgcgcacctcttgggcgttatgcgaagcgctgactctcgccacggggcctatcacaaccctgtgggaaggctcccccgggaagttctggaacaccacaatcgccgttagcatggccaacatctttcggggctcttatctggcgggggcgggcctcgcctttagcatcatgaagtcagtagggacaggcaagcgcggcaccgggagccagggcgagaccctaggggagaagtggaagaagaagctgaaccaattaagccggaaggagttcgacctgtacaaaaagtccggcatcaccgaggtggaccgcacggaggccaaggaggggcttaagcgcggagaaatcactcaccacgccgtcagccgcgggtccgccaagctccagtggttcgtggagcggaacatggtgatcccagaagggcgcgtcatcgacctcggctgtggtcgaggcggctggtcctactactgcgcgggcttgaagaaggtgacagaggtacggggctacaccaagggcgggcccgggcacgaggagcccgtgcccatgtcgacgtatgggtggaacatcgtgaagctcatgagcggaaaagacgtcttttatctcccgccggagaaatgcgacaccctgctgtgcgacatcggcgaaagcagcccctcccctaccgtggaggagagccgcaccatccgggtacttaagatggtggagccgtggttgaagaacaaccagttttgtatcaaggtcttaaacccgtacatgcctacggtgattgagcatctcgagcgcctgcagcggaagcacggcgggatgttggtccgcaaccctctctcgcggaacagcacccatgagatgtattggatatcaaacggcaccgggaacatcgttgcctcggtcaacatggtgtcgcgcctgctgctcaaccggttcaccatgacgcaccgtcggcccaccatcgagaaggacgttgacctgggcgccggaacccgccacgtgaatgccgagcccgagacccccaacatggacgtgataggggagcgcataaagaggatcaaggaggagcacaacagcacgtggcactatgacgatgagaacccgtacaagacgtgggcttaccacggatcctatgaggtcaaggcgaccgggagcgcttccagcatgataaatggagttgtcaaacttctcaccaagccgtgggacgtggttcccatggttacgcagatggccatgactgacaccacccccttcggccagcagcgagtattcaaggaaaaggtcgatacgcgcacacctcggagcatgcctggcacccgccgggtcatgggcatcaccgccgagtggctgtggcgcacgttgggacggaacaagaagccccgcttatgcactcgcgaggagttcaccaagaaagtccgaacaaacgcggctatgggagccgtgttcaccgaggaaaatcagtgggactccgccaaggccgcagtagaggacgaggacttctggaaactggtggaccgagagagggagctacacaagctcgggaagtgtggaagctgcgtgtacaacatgatggggaagcgagagaagaaacttggcgagtttggcaaagccaaagggtcccgtgccatctggtacatgtggctcggggcccgctacttagagttcgaggctttaggctttctgaacgaggatcattggttcagccgggagaatagctatagcggcgtcgagggagagggtctccacaagttgggctacatcctgcgcgacatctccaagatccccgggggcgcgatgtacgccgacgataccgcaggctgggacacccgcatcaccgaggacgacctccacaacgaggagaaaatcacgcaacagatggatccggaacaccgtcagctagccaacgccatctttaagctcacctatcaaaataaggtggtgaaggtccagcggcccaccccaacaggcaccgtaatggacatcatcagccgcaaggaccagcgaggctccggccaggtggggacatatgggctcaacacatttaccaacatggaggcgcaactgatccgccagatggagggcgagggggtcctgagcaaggcggacctagagaacccccacctcccggagaagaagataacccaatggctggagacgaagggggtagagcggctcaagcgcatggccatcagcggcgacgactgtgtggtcaagcccatcgacgaccggttcgccaacgcgctgctggcgctcaacgatatggggaaggtacgtaaggatatcccccagtggcagccctccaaaggctggcacgactggcagcaggtcccgttctgctcccaccacttccacgagctgattatgaaggatggtcggaaacttgtcgtgccttgccgcccccaagacgagctcattgggcgggcccgcatctcccaaggagccggttggagcctgcgcgagaccgcatgcttgggaaaggcgtacgcacagatgtggagcctaatgtacttccaccggcgtgacttgaggctggccagtaatgcaatctgcagcgccgtgcctgtacactgggtgccgacctctcgcaccacgtggagcatccacgcgcatcaccagtggatgaccaccgaggacatgctcaccgtatggaaccgagtatggatcgaggacaacccctggatggaggacaagacgcctgtcaccacctgggagaacgtgccctaccttgggaaacgcgaggaccagtggtgtggcagcctgattggtctcacctcccgggccacctgggcccaaaacattccgactgcgatccaacaggtccgaagcctgatcggaaacgaggagttcctggactatatgcccagcatgaagcgttttcgcaaggaagaggagagtgagggggccatctggtga

SEQ ID NO: 25671 - RNA, 9873 nt, synthetic construct
  misc_feature 1..9873: note = derived and/or modified CDS sequence (opt11) from DENV-3__JF808125__SS-prME
  source 1..9873: mol_type = other RNA
accagcctctgtctcatgatgatcctgcctgcggcattagctttccacctcaccagccgcgacggcgagcctcggatgatagtgggggagaacgagcgcggcaagagcctgctgttcaagaccgcctcagggatcaaccggaggaccttaatcgccatggacctgggcgagatgtgcgaagagaccgagacatataagtgcccccacatcaccgaggtggaacctgaggacatcgactgctggtgcaacctcaccagcacctgggtcacctacgggacatgcaatcaggcaggcgagcggcgccgggataagcgctccgtggccctcgcgccccacgtcggcatgggcctagatacaagaacccagacctggatgtcggccgagggcgcctggagacaggtcgagaaggtggaaacgtgggcgctgcggcaccctggttttaccattctggcgctgttcctggcccactacatcgggacctcgttaacccagaaggtggtgatatttatcctgctgatgcttgtgactcccagtatgaccatgcgctgtgtcggggtgggcaaccgggatttcgtagaaggcctgagcggggccacctgggtagacgtggtcctggaacatggagggtgcgtcaccacgatggccaagaataagccgaccctcgacattgagctgcagaagaccgaggcgacacagctggccactctccgcaagctatgtatcgagggtaaaataaccaacatcacgaccgactctcggtgccccacgcagggcgaggcagtgctgccggaggagcaagaccagaactacgtctgcaagcacacgtacgtcgatcgcggttggggcaacgggtgtggcctcttcgggaagggctccctagtaacctgcgccaaattccagtgtttagagcccatagaggggaaagtcgtccagtacgagaacctcaagtacaccgtgatcatcacggtgcacaccggggatcagcaccaagtcggcaacgagacccagggtgtgactgccgagatcacgccccaggcaagcaccaccgaagcgatattgcccgaatacggcacgctggggctcgagtgctccccacgcactggcttagacttcaacgagatgattttgctcacaatgaagaataaagcctggatggtccaccgccagtggttcttcgacctgccactaccgtggaccagcggtgccaccgccgagacgcccacgtggaatcggaaggagcttctggtgacgttcaagaacgcacacgcgaagaagcaagaggtggtcgtgctggggtcccaggagggtgcaatgcacacggccctaaccggggccacggagatccaaaattcaggcgggaccagtatctttgccggccatctgaagtgccgcctcaagatggacaagttagaattgaagggcatgagctacgctatgtgcacaaataccttcgtgctgaagaaagaggtgagcgagactcagcatgggaccatcctcattaaggtggaatataagggcgaggatgccccgtgcaagatccccttctcaacagaagacgggcaaggcaaggcccataacgggcgcctgatcactgccaacccagtggtcacgaagaaggaggagcccgtgaacatcgaggcggagccgcccttcggggagagcaacatcgtgattggcataggcgacaatgccctgaagataaactggtacaagaagggttccagtattgggaagatgttcgaggccaccgcccgcggcgcacgccggatggcgatcctcggcgacaccgcctgggacttcggatccgtcggaggggtgctaaacagcctgggcaagatggttcatcaaatcttcggctccgcctacactgcactgtttagcggcgtctcgtgggtaatgaagatcggcatcggggtactacttacatggataggccttaacagcaagaatacgtccatgtcgttttcctgcattgctatcgggatcattacgctctacctgggcgcggtagtgcaggccgacatggggtgcgtgatcaactggaagggaaaggagctgaaatgtggcagcgggatcttcgtaaccaacgaggtgcacacgtggacagagcagtacaaattccaggccgacagtcccaagcgcctcgccaccgccatcgcgggcgcctgggagaacggggtatgcggcattcggtctaccacgagaatggagaacctgctgtggaagcagatcgccaacgagctaaattacatcctctgggagaacaacatcaagctaaccgtcgtagtcggggacattattggcgtcctcgagcaggggaagcgcaccctgacgcctcagccgatggagctgaagtacagttggaaaacgtgggggaaggccaaaatcgtgaccgcggagacccagaacagctcgttcataatcgatgggcccaacaccccagagtgtcccagtgcctcccgcgcctggaacgtgtgggaggtcgaggactacgggttcggagtgttcacgacgaacatctggctcaagttgcgggaagtgtacactcagttgtgcgaccatcggcttatgagcgcggccgtcaaggacgagcgggcagtacacgctgacatgggttactggatagagtctcagaaaaatgggtcctggaaactggaaaaggccagcctcatcgaggtgaaaacctgcacctggccgaagtcccacactctctggtctaacggcgtcctggagtcagacatgatcatccccaagagccttgccgggccgatctcacaacacaaccaccggccgggctaccacacccagaccgcgggtccctggcacctgggcaaactggagctggacttcaactactgcgagggaaccactgtcgtgatcacagaaaactgcggcacccggggaccctctctcagaaccactacagtctccgggaaactgatccacgagtggtgctgcaggagttgcaccctgcccccgctccgctacatgggtgaagacggatgctggtacggaatggagatacggcccatctccgagaaggaagagaacatggtcaagagcctggtgtctgcgggcagcgggaaagtcgacaacttcaccatgggcgtgctgtgtctcgccatcctgttcgaggaggtgatgagagggaagttcggcaaaaagcacatgatagccggggttttcttcacattcgtgctattactatccggccagatcacctggcgggacatggcccacaccctgataatgatcggcagtaacgcgtccgatagaatggggatgggcgtgacgtacttggcactgatcgccacttttaagatccagcctttcctggctctagggtttttcctgcggaagttaacttcgcgcgagaacctccttttgggcgtcggactcgccatggcgaccaccctgcaactgcccgaggacatcgagcagatggccaacgggatagccctcggactaatggcactgaagctaatcacacagttcgagacctatcaactgtggaccgccctgatcagccttacctgctccaatacgatgttcaccctcactgtcgcctggagaaccgccaccctgatcctcgccggcgtgagcctgctgccggtctgccaatcctcatctatgcggaagaccgactggctacccatggccgtggcagcgatgggggttccgccgctgccgctgttcattttcagcctcaaggacaccctcaagcgccggtcctggcccctaaatgagggggttatggcggtgggcctcgtctctatcctggccagcagcctgctacgcaatgacgtgcccatggcgggaccactggtggccgggggccttctcattgcgtgctatgtcataaccgggacaagtgccgaccttaccgtggagaaagccgccgacataacctgggaggaagaggctgagcaaactggcgtgagccacaacctgatgatcacagtggatgacgacgggaccatgcgaataaaggacgacgagaccgaaaacatattaaccgtgctgttgaagacggcgcttctgatcgtgtctggcgtattcccatacagcatccccgctacgctcctcgtgtggcatacgtggcaaaagcagacccagcgctctggcgtcctgtgggacgtcccgagcccgccagagacccaaaaggcggagctcgaggagggtgtgtacagaatcaagcagcagggcatcttcgggaagacccaggtaggggtgggtgtgcagaaagagggcgtgtttcataccatgtggcacgtcacccgcggcgcagtcctcacctacaacggaaaacggctggagcccaactgggcgtcggtgaagaaggacctgatctcctccggcgggggttggcgactctccgcccagtggcagaagggcgaggaggtccaggtaatagccgtggagcccggtaagaaccccaagaactttcagacgatgccaggcaccttccaaaccactacgggggaaatcggcgctatcgccctggactttaaacccgggacgagtggatcccccatcatcaaccgtgagggcaaggtcgtgggcctatacggcaacggtgtcgttactaagaacggagggtatgtgagcggcattgcgcagaccaacgccgaacctgatggccccacgccggagctggaggaagagatgttcaagaagcgcaacctcaccatcatggaccttcatccgggcagcggcaagacgcgtaagtacctgcctgctatcgtgcgcgaagccattaaacggcggctccgcacactgattttagcccccacgcgcgtcgtggcggccgagatggaggaggcccttaagggcttacctatacgttatcagaccaccgcaaccaagagtgagcacacgggccgcgaaatcgtggacttaatgtgccacgcgaccttcaccatgcggctgctgagtcccgtccgcgtcccgaattataacctgatcattatggacgaagcacatttcacggaccccgccagcatcgcagcccgcgggtacatctccacgcgtgtgggtatgggagaagctgcggcaatcttcatgactgccacgccaccaggcacggcggacgcgttcccgcagtcgaacgcgcccatccaggacgaggagagggatattcccgagcggagctggaatagcggcaacgagtggatcacggactttgccgggaagaccgtatggttcgtgccctcaatcaaggccggcaacgacatcgcgaactgcctgcgcaagaacggcaagaaggtgatccagctgagcagaaaaacgttcgacaccgagtaccagaagacgaagctgaacgattgggacttcgtcgtgaccactgacatttccgagatgggcgcgaattttaaggccgaccgcgtgatcgatccgcggagatgcctcaaacccgttatactgaccgacggcccagagagagtcatcctggctgggcccatgccagtgactgcggcgagcgcagcccagcgcaggggacgcgtcggacgaaaccctcagaaagagaacgaccagtacatctttacgggccagcccctcaacaatgacgaggaccacgctcactggacggaagcgaaaatgctcctcgataatattaacacccccgagggcatcatcccggctctcttcgagccagaacgcgagaagtccgccgccatagatggagagtatcgtctgaaaggcgagagcagaaagacattcgtggagctaatgcggcgcggggatctcccggtgtggcttgcccataaggtcgcctccgaaggtatcaagtacaccgaccggaaatggtgcttcgacgggcagcgaaacaaccagatcctggaagagaacatggatgtcgaaatctggaccaaggagggcgagaagaagaaacttaggccccggtggctggacgcccgaacctactcggatccgctggccttaaaggagttcaaggacttcgccgccggacggaagtccatcgccctggacttggtgaccgagattgggcgcgtgcccagccacttggcgcaccggacgcgaaacgcgcttgacaatctggtgatgctccacaccagcgagcacggcgggcgggcctatcgccacgcggtggaggaactgcccgagaccatggagaccctacttctgctacgtctcatgatcctgctgacgggcggcgcgatgctgttcctgatctccggcaagggcatcggtaaaacaagcatcggactgatctgcgttatcgcgagtagcgggatgctctggatggccgagatccccctgcagtggatcgccagtgcaatcgtactggagtttttcatgatggtactcctgatccccgagcccgagaaacagcgcacgccccaggataaccaactggcctacgtggtcattggcattttgaccctggctgccataatcgccgccaacgagatggggctgctcgagaccaccaagcgggatctgggcatgtcgaaggagcctggcgtcgtgtccccaaccagctaccttgacgtggatctccaccccgcgtccgcctggacactgtacgcagtagccacgaccgtgatcacccccatgctgagacacaccatagagaactcgacggcgaacgtgtccctcgcggccatcgccaatcaggctgtcgtgctgatggggctggataagggatggcctattagcaagatggatctcggggtgcccctgctggccctcggctgctactcccaggtgaacccactgacccttacggccgccgtcctcttgctgatcacccactacgctatcatagggccgggcctccaggcaaaggcaacgcgggaggcacagaagcgcaccgccgctggcatcatgaagaatccaaccgtggacggaattatgacgatagacctggatcccgtaatctacgactcgaaatttgagaagcaactgggacaggtgatgctcctagtgctgtgcgccgtccagttgctgctgatgcggacgtcctgggcgctctgcgaagcccttaccttggccacggggcccatcactacgctctgggaaggaagcccgggtaagttctggaatacaaccatcgccgtgtccatggccaacatcttccgcggaagctacctggcgggcgctgggttagcattctccatcatgaagtctgtgggcacagggaagcggggcacgggatcgcagggggagaccctaggagagaagtggaagaagaagctgaaccagctgtcccgcaaggagttcgacctatacaaaaagagcgggatcaccgaagtcgatcggaccgaagcaaaggagggcctaaaacgtggggagatcacgcaccacgcagtgtcccggggcagcgcgaagctgcagtggttcgtggaacgaaacatggtgatcccggaggggcgcgtgatcgacctcggctgcggccgcgggggttggtcttattactgcgccggtttaaagaaggtgacggaggtccgcggctacaccaaaggaggacccggacacgaggaacccgtccccatgagtacttacgggtggaacatcgtgaagctgatgtccggtaaagacgtcttctacctaccacccgagaagtgcgataccctactgtgtgacatcggggaaagctccccgagccccacggtggaggagtcccgaacgatccgcgtgctgaagatggtcgagccatggctgaagaacaaccagttctgcatcaaggtgttaaacccctatatgccgaccgtaatcgaacacctggaaaggttgcaacgcaagcacgggggtatgctggtacggaatcccctcagccggaactccacacacgagatgtactggattagcaacggtacaggcaacatagttgcctctgtgaatatggtcagccggctcctcctgaaccgcttcaccatgacccacagacggcctacaatagagaaggacgtagatctcggggccggcacgcgccatgtgaacgccgagcccgagacccccaacatggacgtaatcggcgagcgcatcaagcggatcaaagaggaacataactccacctggcactacgatgacgagaatccgtacaagacctgggcgtatcacgggagctacgaagtgaaggccacgggctccgccagctcgatgattaacggggtggtgaagctgttgaccaagccatgggacgtggtccccatggttactcagatggcaatgaccgacacgacccccttcggccagcaacgcgtgttcaaagagaaagtagacacccggaccccacgttcgatgcccggtacgcggcgcgtgatgggcatcaccgcagagtggctctggcgcacccttgggcggaataagaaacctcgcctgtgcacccgggaggagttcacgaagaaggttcgtaccaatgccgccatgggggccgtcttcaccgaagagaaccagtgggactctgctaaagccgccgtagaagacgaggacttctggaagctcgtggaccgtgaacgcgagctccacaaactcggcaaatgcgggtcctgcgtttataacatgatgggcaagcgggagaagaaacttggggagttcggcaaagcgaaaggcagcagggcgatctggtacatgtggctgggtgctcggtacctcgagttcgaagcgctcggtttcctgaacgaggaccactggttttcccgtgagaatagctactccggggtggaaggcgagggcctgcacaagctcggctacatcctgcgggacatcagcaaaatccccggaggggccatgtacgcagacgacaccgccggctgggatacgcgcatcaccgaggacgacctacacaatgaggagaaaatcactcagcagatggatccagaacaccgccagctcgccaacgccatatttaaacttacctaccagaacaaggtggttaaggtgcagcgacccacgcccaccggaaccgtaatggacatcatctcccgtaaggaccagcgcggcagcggccaggtcggtacttacggtctgaacactttcacgaacatggaggctcagctcattcggcagatggagggcgaaggtgtactgtcgaaggcagacctggaaaacccccacttgcccgagaagaagatcacccagtggctcgagaccaaaggcgtggaacgtctgaagcggatggctatcagcggcgacgactgcgttgtaaaacccatagacgaccgcttcgccaacgcgctcctggccctgaacgacatgggcaaagtccggaaggacattcctcagtggcagccctccaaagggtggcacgactggcagcaggtaccgttctgcagccaccactttcacgagctaataatgaaggacggccgcaagctggtggtgccttgtcgaccccaggacgagctgatcggccgggcccgtatttcacagggtgccggttggagcttacgggagaccgcctgcttagggaaggcatatgcccagatgtggtccctgatgtacttccaccgccgggacctccgcctggctagcaacgccatctgctctgcggtacccgtgcattgggtgcctacgagccgcactacctggagcatccatgcccaccaccagtggatgaccacggaggacatgcttacggtttggaaccgcgtgtggatcgaagacaacccctggatggaggataagacgccagtgactacttgggagaacgtaccctacctcggcaaacgggaggaccaatggtgcgggtccctgatcggtctgacctcgcgcgccacctgggcccaaaacatccctacagccatccagcaggttcggtcactcatcggcaacgaggagttcctggactacatgccctcaatgaagcgctttcggaaggaggaggagtccgagggcgcaatctggtag

SEQ ID NO: 25672 - RNA, 9873 nt, synthetic construct
  misc_feature 1..9873: note = derived and/or modified CDS sequence (opt11) from DENV-3__JF808129__SS-prME
  source 1..9873: mol_type = other RNA
accagcctgtgcctcatgatgatactgcccgccgccttggcattccacctaacaagtcgggacggggagccgcggatgatcgtgggaaagaacgagcgtggcaagagcttactcttcaagaccgcctccgggataaacatgtgcaccctaatcgccatggatctgggggagatgtgcgatgacactgtgacctacaagtgcccccacattacggaagtggagcccgaggatattgactgctggtgcaaccttaccagcacttgggttacctatggcacctgcaaccaagccggcgaacacagacgcgataagcggtcagtagccttggcgccccacgtcggtatggggctggatacccgcacacaaacttggatgagcgccgagggcgcgtggagacaggtggagaaagtcgagacgtgggccctgagacacccggggttcaccattctcgcgctattcctggcccattatatcggcacgtccctcactcagaaagtcgtgatattcattcttctgatgctcgttacaccgagcatgacgatgcggtgcgtgggtgtgggcaatcgcgacttcgtagagggcctctccggggccacctgggtggacgtggtcctggagcacggggggtgcgtaaccacgatggcaaagaataaacccacgttggacatcgagctgcagaagaccgaggccacgcagctggcgacattgcgtaagctgtgcatcgagggcaagatcacaaacatcaccaccgacagccgctgccccacgcagggggaagccgtgctaccggaggagcaggaccagaactacgtgtgtaagcacacctacgtggatcgggggtggggcaacggttgcgggctgttcgggaagggctcgcttgtgacatgcgctaagttccagtgcctggaacccatcgagggcaaagtcgtccagtacgagaaccttaaatacaccgtcattataacggtccacacgggggaccagcaccaagtggggaacgagacccagggggtcacggcggagattacgccccaagcgtccaccaccgaggccattctccccgagtatggcaccttaggactcgagtgttcaccgcgaacaggcctggactttaacgagatgatcctactcaccatgaagaacaaggcctggatggtgcaccggcagtggttcttcgacctgccgctaccctggactagcggtgccactaccgagacgccaacttggaaccgaaaggagcttctggtgaccttcaagaacgcccatgccaagaagcaagaggtcgtggtactcgggtcccaggagggcgccatgcacaccgccctcacgggtgccaccgagatccaaaacagcggcgggacatccatctttgccggccacctcaaatgtaggctgaagatggacaagctggagctcaaaggcatgagctatgccatgtgtaccaacaccttcgtcctaaagaaggaggtgtcggagacccagcacggaacaatccttatcaaagtcgagtacaagggggaggatgcgccctgtaagatccccttctccaccgaggacgggcaaggcaaggctcacaacgggcgcctgatcacagcgaaccccgtcgtcaccaagaaggaagagcccgtgaacattgaggccgagccgcctttcggagagtccaacatcgttatcggcattggggacaatgcgctgaagattaactggtacaagaagggttccagcatcggtaagatgtttgaggctactgcccggggagctcggcggatggcgatccttggggatacagcctgggatttcgggtccgtgggcggggtactcaatagcctgggtaaaatggtacaccagatcttcgggtccgcgtacacggcactgttcagcggagtgtcctgggtcatgaagatcggcataggagtactcctgacgtggatcggcctgaacagcaagaataccagcatgagcttctcctgcatcgcgatcggtatcataactctctacctgggcgccgtggttcaggccgacatggggtgtgtgattaactggaaggggaaggagctaaagtgcggcagcgggatctttgtgacgaacgaagtgcatacctggaccgagcagtacaagtttcaggccgactcccccaaacgcctcgccacagccatagctggcgcctgggagaacggtgtctgcggaatccgctctacgacccggatggagaacctgttgtggaagcagatcgcgaacgagctcaattatatcctgtgggagaataacatcaagttgacagtggtggtcggggacatcacaggcgtgctcgagcaaggcaagcgcacgttgacaccccagccgatggagctgaagtattcctggaagacctggggcaaggccaaaatagtgaccgctgagacgcagaacagcagcttcataatcgacggccccaacacccctgagtgccccagcgcgtcacgggcctggaacgtatgggaggtggaggactacggctttggcgtcttcacgactaacatctggttgaaactgcgtgaggtctatactcaactgtgcgaccaccggctcatgagcgccgcggtgaaggatgagagagccgtacacgccgacatgggctattggatagagagccagaaaaatggatcttggaaactggagaaggcctcactgattgaggtgaagacgtgtacgtggccgaaatcccacaccttatggagcaatggagtgctggagtccgatatgatcatacccaagagcctcgctgggcccatctcacagcacaaccacaggcccggataccacacacagacggctggcccctggcatctcggcaaactagagttagacttcaactactgcgagggcacgactgtggtcatcaccgagaactgcgggacgcgcggacccagccttcggaccaccacggtgtccgggaaactgatccacgagtggtgctgccgcagctgcacgctgcccccgctccggtacatgggggaggatgggtgctggtacggcatggaaatccggcccatcagcgaaaaggaggagaacatggtcaagtcgctggtctccgcgggcagcggtaaggtcgacaactgcaccatgggcgtgctgtgcttagctatcctgttcgaggacgtcatgcgggggaagttcggcaaaaagcacatgatcgccggagtattcttcacattcgttctgctcctgtccggccagatcacctggcgcgacatggcacacacgctgattatgatcggcagcaacgcttctgaccggatgggtatgggcgtaacgtacctcgccctgatcgctaccttcaagatccagcccttcctagcactcgggttctttcttcgcaaattaaccagcagagaaaacctattgctgggcgtcggcctcgccatggccacgaccctgcaacttccggaggacatcgagcagatggcgaacgggattgccctcggcctgatggcattgaagctcattacccagttcgagacgtaccagctctggacggctcttatcagcctgacctgctccaacaccatgttcaccctcacggtggcctggcgcaccgcgaccctgatcctcgccggtgtaagcctgcttccggtgtgtcaatccagctccatgcggaagaccgactggctgcccatggctgtagccgccatgggcgtgccgccactcccgctgttcattttcagccttaaagacacgctgaaacgccgctcatggccgctgaacgagggggtgatggcggtggggttagtgagcatcctggcctcgagcctgctgcgcaacgacgtacctatggcaggccccctggtggctgggggcctgctaatcgcctgctacgttattaccgggacctctgccgaccttaccgtggagaaagctgccgatatcacgtgggaagaggaagctgaacagaccggcgtctcacacaatctgatgaccaccgtggatgacgatggtaccatgcgcatcaaggacgatgaaacggagaatatactaaccgtccttctaaaaactgccctcaccattgtgtccggcgtattcccatatagcatccccgctactcttctggtgtggcacacttggcagaagcagacccagcggtccggcgtcctctgggacgtgcccagcccccccgagacgcagaaggccgagcaagaggaaggagtgtaccgcattaagcagcagggcatcttcggcaaaacgcaggtcggcgtgggggtgcagaaagagggtgtcttccacaccatgtggcacgtcacccggggcgccgtcctgacctataacggtaaacggctagagcccaactgggcctccgtcaaaaaggacctcatcagctacggcgggggctggcggctgtccgcgcaatggcagaaaggggaggaggtccaagtgatcgccgttgagcccggcaagaaccccaagaacttccagacaatgcccggcaccttccagacaaccacgggtgagatcggcgccatcgcactagacttcaagcccgggactagcggcagccctatcatcaaccgagagggcaaggttgtggggttgtacggcaacggtgtcgtaaccaagaacggcgggtacgtatcagggatcgcccaaaccaatgctgagccggacggccccacgcccgagctggaggaggagatgttcaagaagcggaacctgaccatcatggatctgcacccagggagcgggaagacaaggaaatatcttccggccatcgtccgagaggccatcaaacgccggctccgcactctgatcctcgcccccacgcgagtggtggccgccgagatggaggaggccctgaagggtctgcccattcgctaccagacaaccgccactaagtccgagcacacgggccgtgagatcgtcgacctaatgtgccacgccaccttcacgatgcgcctactgagccccgtacgggtgccgacatacaacctcatcatcatggacgaggcccacttcactgaccccgcgtccatcgccgcccgcggatacatcagcactagggtcggcatgggtgaggccgcggccatctttatgactgcaacgccacccgggacggccgacgccttcccacagtcgaacgcgcccatccaggatgaggagcgggatatccccgagcgatcctggaactccggcaacgagtggatcaccgacttcgccgggaagacggtgtggttcgtccctagcattaaggccggcaatgacatcgcgaattgtttgcgaaagaacggtaagaaggtcatacagctgagcagaaaaaccttcgacacggagtatcagaagaccaagttaaacgattgggacttcgtggtaaccaccgacattagcgagatgggcgctaacttcaaggcggaccgggtaatcgaccctcggcgatgtttgaagccggtaatcctgaccgatggtccagaacgagtgatcctcgccggacccatgccagtcactgccgcctccgccgcgcagcggcgcgggagggtggggcgcaacccgcagaaagagaacgaccagtacatcttcacaggccaaccccttaacaacgatgaggaccacgcccactggaccgaggccaaaatgctgttggacaacatcaacacccccgaggggatcatccctgccctgttcgagcccgagcgggagaaatcggctgccatagacggggagtaccgcctgaaaggggagtctaggaagacgtttgtagagctcatgcgtagaggggacctgcccgtctggctggcccacaaggtggccagcgagggcatcaagtacactgaccgtaaatggtgctttgacggacagcgaaataaccagattctcgaggagaacatggacgtggaaatctggaccaaggagggcgagaagaagaagctgcgccccaggtggctggacgcccgaacctactccgacccgcttgcgctgaaggaatttaaggacttcgccgccggccgcaagagcatcgccctagacctggtaacggagatcggacgggtcccttctcacctggcccatcgcacgcggaacgcgctggacaacctcgtaatgctacacaccagcgaacacggcgggcgggcttatcgccacgccgtggaagagctgcccgaaaccatggagacgcttctcttgctcgggctgatgatcctgttaaccgggggagccatgctgtttctgattagcggcaaggggatcgggaagacctccatcggcctcatctgcgtgatcgcctcgtcgggcatgctgtggatggctgagattccgctccagtggatcgcctcagccatagttctggagttcttcatgatggtgctgctgattcccgagcccgagaagcagagaacaccccaggacaatcagctcgcgtacgtggttatcgggatcttaacgctggccgctatcatcgcagccaacgagatgggcctcctggaaaccactaagcgggacttaggcatgagtaaggagcccggggtcgtgagccccacctcctaccttgacgtcgacctgcaccctgccagcgcgtggacgctgtacgccgtggcaaccacggtcatcacccccatgctgagacacacgatcgagaactccaccgcgaacgtctctctggccgcgatcgcgaaccaagccgttgtcctgatggggcttgacaagggatggccgataagtaaaatggacctgggcgtccccctgctcgccctggggtgctacagccaggtaaatcccctgaccctcaccgccgcggtgctcctgctcataacacactacgccatcatcggccctggactgcaggcgaaggccacccgcgaagcccagaaacgtacagcggccggcattatgaagaacccgacggtagatggcatcatgacgatcgatctagaccccgtcatctatgactccaaattcgagaagcaactcggccaggtgatgctgttagtcttgtgtgccgtgcagctcctgttaatgcgtacttcatgggccctgtgtgaagcgcttaccctcgccaccggacccatcaccacactgtgggagggttcccccgggaaattctggaacacgaccatcgcagtgagcatggcgaacatcttccggggttcctacctagctggtgcaggcttggcattcagcataatgaagtccgtcggaaccggcaagcgcggcacgggttcccaaggggagactctgggggagaaatggaagaagaagctgaaccagctcagccgcaaggagttcgatctgtacaaaaagtccggcatcaccgaagtcgaccggaccgaggccaaggaggggctgaaacgcggcgagatcacgcaccatgcagtgagccggggatccgcgaagctccagtggttcgtcgaacgcaacatggttataccagagggccgcgtgatcgacctgggatgcggtcgcggcgggtggagctactactgcgcgggcctgaaaaaggttaccgaagtgcggggctatactaagggtgggcctgggcacgaggagcccgtgcccatgtccacctacggatggaacatcgtcaaactaatgagcgggaaggacgtgttctacctgccacccgagaaatgcgacacgctgctctgcgacataggggagtccagcccctcccccaccgtggaagagagcagaactatccgcgtactgaagatggtcgagccttggctaaagaacaaccagttctgcatcaaagtgcttaacccctacatgcccacggtcatagagcatttggaacggctgcagcgtaagcacggcggaatgcttgtacggaaccctctctcacgaaacagcacgcacgaaatgtactggatcagcaacgggaccgggaacatcgtggcgagcgtcaatatggtgtccaggctgctgctcaatcggtttactatgacccaccggcgcccgacgatcgagaaagatgtggacctgggcgccgggacgcggcacgtcaacgcggagcccgagacgcccaacatggacgtgatcggggagcgcataaagagaaccaaggaggagcacaacagcacctggcattacgacgacgagaacccgtacaagacctgggcctatcatggttcatacgaggtaaaagcaaccggttcggcctccagcatgataaatggcgtagtaaagctgttaaccaagccttgggatgtcgtgcccatggtgacgcaaatggcaatgaccgacaccacccccttcggccaacagcgagtcttcaaggagaaggtggacacgcggacccctcgctcgatgcccggtacccggagggtgatggggatcaccgccgagtggctctggcggacgctcgggagaaataagaagccccggctctgtacgcgcgaagaattcaccaagaaggtccgcaccaatgcggctatgggcgcagtgttcacggaggagaaccagtgggactccgctaaagccgcggtggaggatgaggatttttggaagctggtcgaccgggagcgcgagctgcacaagctagggaagtgcggctcgtgcgtgtataatatgatgggtaagcgcgagaagaagctgggcgagtttggaaaggccaaagggtcccgcgccatctggtacatgtggttgggcgcccggtacctggagttcgaggcactggggttccttaacgaggaccactggttcagccgcgaaaactcctacagcggtgtcgagggggagggtctccacaagctgggctacatattacgggatatttccaagatcccgggcggcgcgatgtacgccgacgacactgccgggtgggatacccgaataaccgaggacgacctccacaacgaggagaagataacccagcagatggatccggagcaccggcaactggcgaatgccatctttaagctgacgtaccaaaacaaagtcgtgaaggtgcagagacccacccctactggcaccgtcatggacatcatcagcagaaaggatcagcgaggcagcggccaggtcggcacgtacgggctcaacaccttcaccaacatggaggctcagctgatcagacaaatggagggcgagggggtgctgagcaaggcagacctcgagaacccccacctgcccgagaagaagataactcagtggctggagacaaagggcgtcgaacgtttgaagcggatggccatctccggagacgactgcgtggttaagcctatcgatgaccgctttgccaacgcactactggcgcttaacgacatggggaaggtccggaaagacatcccccaatggcagccctctaagggctggcacgactggcagcaggtcccgttctgtagtcaccatttccacgagttgatcatgaaggacggcaggaagctggtcgtcccctgccgtccacaggatgagctcatcggcagagccagaatcagccagggggcgggctggtccctgcgcgagaccgcctgtttgggcaaggcttacgcgcagatgtggtcgctcatgtacttccaccggcgggacctccgacttgcctccaacgctatctgtagcgccgtgccagtgcactgggtcccaacctcccggacgacgtggagcatccacgcacaccaccaatggatgaccaccgaggacatgctcaccgtttggaaccgcgtttggatagaggacaacccctggatggaggataagaccccggtcaccacctgggaaaacgttccctacctggggaagcgagaggatcagtggtgcggcagcctgatcgggctcacatctcgcgccacgtgggcccagaacattccgactgctattcagcaggtccggagcctcatcggcaacgaagagttcctagactacatgccctccatgaaaagatttcggaaggaggaggagagcgagggggctatatggtga

SEQ ID NO: 25673 - RNA, 9873 nt, synthetic construct
  misc_feature 1..9873: note = derived and/or modified CDS sequence (opt11) from DENV-3__JF808123__SS-prME
  source 1..9873: mol_type = other RNA
acgagcctctgcttgatgatgattttgcctgcagccctcgccttccacctaacgagcagagacggggaacctcgaatgatcgtcggcaaaaatgaaaggggaaaaagcctactgtttaaaacagctagtggaattaatatgtgcacgctaattgccatggacctaggagaaatgtgcgacgatacagtcacatacaaatgcccccacataacagaagtggaacctgaagacatagactgctggtgtaatttgaccagcacgtgggtaacctacggtacatgcaaccaagcaggagaacggcggagggacaagagaagcgtggccctggctccgcacgtcggaatgggcctcgacacacgaacgcaaacgtggatgagcgctgaaggcgcctggcggcaagtagaaaaagtagaaacttgggccctgcggcaccctgggtttaccatcctagccctatttctagcccactatatcggcacttctctgacacaaaaagtggtgatatttatactgctcatgttagtaaccccgtcaatgacgatgcgctgtgtgggtgttggaaaccgagacttcgtcgagggtttaagcggagcaacctgggtagacgttgtgttagaacacggagggtgcgtcaccacaatggcgaaaaataagccaacgctggacatcgaattacagaaaaccgaggcaactcatctggcgacgttaaggaaattatgcatcgaggggaaaatcacaaacatcactacggactcgcgctgcccgacgcaaggggaagccgttctacctgaagaacaagaccaaaattatgtttgtaaacacacgtatgtcgaccgcggctggggtaacggttgcggactgttcggaaaagggtcgctcgtaacctgcgcaaagtttcaatgtctcgggccaattgagggaaaagtcgtgcaatatgagaacctaaagtacacggtaatcataacggtccatacgggcgatcagcaccaagtgggcaatgagacacaaggggtaaccgccgaaatcaccccacaagcgtcgaccacggaagcaattttgcccgagtacggaactcttggactcgagtgctcccccaggacaggcctggatttcaacgagatgattctattaaccatgaagaacaaggcatggatggttcaccgccagtggtttttcgacctgccactaccttggacctcaggggcaaccacggaaacgcccacctggaaccgtaaggagcttctggtgaccttcaagaatgcgcacgctaagaaacaagaagtggtggttctgggatcccaggaaggggcgatgcacaccgccttaacaggcgccacggaaatacagaactccggagggacttcaatcttcgccggacatctgaaatgccgtctaaagatggacaaacttgagctaaaaggcatgtcatacgcaatgtgcaccaacaccttcgtgctcaaaaaggaagtgtcagagacgcagcatggcacaatcctgatcaaagtcgagtacaaaggcgaagacgcgccctgcaaaataccgttcagcaccgaagacggacaaggaaaggcacataacgggaggctaataacagcgaaccccgtggtcactaagaaagaagaaccagtgaacatcgaagcggaaccgccgttcggcgagagcaatattgttattggcacaggtgacaatgcgcttaaaatcaactggtacaagaaggggtccagcatcggcaagatgtttgaagccacagcaagaggagctcgacgcatggccatactaggggacaccgcctgggatttcgggtctgtagggggagtactaaacagtctaggcaagatggtccaccagatattcgggtccgcgtacacggcccttttctcaggagtcagctgggtgatgaagataggaataggagtattactgacatggatcggcctaaatagcaagaatacatccatgtcgttcagctgcatcgctattggcataataacactatacctaggagcggtcgtgcaggcggacatgggctgcgtgataaactggaagggaaaagagcttaagtgcggcagcggaatattcgttacaaacgaggtacacacatggacggagcaatataagtttcaagcggactccccgaagcgactagctaccgcaatcgcgggcgcatgggagaatggcgtctgcggaatcagaagcaccacgcggatggaaaatttgctctggaaacaaatagccaatgaactcaactatatactctgggaaaacaacatcaaactaacagtcgtagtaggcgacattatcggggtgctcgagcagggaaaacgcacgttgaccccgcagcccatggaactcaaatacagctggaagacgtggggcaaagcaaaaatagtgactgctgagacccaaaactcatccttcatcatagacggcccaaacacgcccgagtgtcctagtgcctcaagggcttggaacgtctgggaggtggaagactacggatttggcgtgttcaccacgaacatatggctaaaacttagggaagtatacacccaactatgcgatcatcgtctaatgtccgccgcagttaaggatgaacgagcagtgcatgcggacatgggctactggatagaaagtcagaagaacgggagctggaaactggagaaagcatccctgatcgaagtgaaaacctgtacttggcctaagtcccacacactgtggagcaatggtgtactcgagagtgatatgataataccaaaatcactagctggcccgatatcgcaacacaaccaccgtccggggtaccacacccaaaccgctggaccctggcatctaggaaagctagaactcgacttcaattactgcgagggaaccacagtagtgattacggagaactgcggcacaagaggcccatcactcagaaccactaccgtaagcggcaaactaattcacgaatggtgttgccggagctgcacgctacccccactccgatatatgggggaagatgggtgctggtacggaatggaaattcgcccaatcagcgagaaggaagagaacatggtaaagtcgctagtaagtgccggcagcggtaaagtcgacaacttcaccatgggagtactatgcctagcaatccttttcgaggaagtcatgagaggtaaattcggtaagaaacacatgatagcgggagtatttttcacctttgtactcttattgagcggccagattacatggcgagacatggcccacacactgatcatgatagggtcgaacgcaagtgatagaatgggcatgggcgtgacctatctggcgctgattgccacattcaagattcaaccattccttgcacttggattctttttacgaaaattgacatcacgcgaaaacctcctattgggcgtagggctcgccatggcaaccacgctccagcttcccgaggacatagagcaaatggcgaacggcatagcgttggggctaatggcgctgaaattaataacgcagttcgaaacatatcaactttggacagccctaataagtctaacttgcagcaacacaatgttcaccctgaccgtcgcgtggagaacagcgacactaatactcgcgggggtcagtctactaccggtctgccaaagctcatcgatgagaaaaacagactggctccctatggcagttgccgctatgggtgtaccacccttgccgttgtttatattctcgttgaaagacactctaaagagaagaagctggccactgaacgagggtgttatggcggtcggtttagtcagcattctcgcgagtagcctactccgaaacgacgtaccgatggccggaccattagttgcaggcggcttattaatagcatgctacgtaattacaggcacgtcggccgacttgactgtagaaaaagcggccgacatcacctgggaggaggaagctgaacaaacgggagtgtcccataacctgatgataaccgtcgacgatgacggaaccatgcgaataaaagatgacgaaacagaaaacatactcacggtcctcctgaagaccgccctactaatagtaagcggggtcttcccgtacagcattccagcaacgttgctagtgtggcacacctggcaaaaacagacacagagatctggagtactgtgggacgtccccagcccaccagaaacgcagaaagcagagctagaggaaggcgtgtaccgtataaaacagcaggggatcttcggaaaaacccaggtcggcgtgggagtgcagaaggaaggagtattccacaccatgtggcacgtcacccgaggagcagtgcttacatacaacgggaagagactagaaccaaattgggcctccgtcaaaaaggacctcataagctacggcggagggtggcggttatccgcccaatggcagaaaggggaagaagtacaggtgatcgcagtagaaccggggaagaaccccaaaaatttccaaacgatgcccgggacgttccaaacgactaccggggaaattggggccatcgcgctcgacttcaaaccaggcacaagtgggagtccgattatcaacagggagggcaaagtcgtcggattatacgggaatggcgtcgtcacgaaaaacggaggttacgtaagtggcatagcacaaacgaatgccgaaccagacgggccgacaccagagctcgaggaagaaatgtttaagaagagaaatctaaccataatggacctgcatccaggctcagggaaaacgagaaaataccttccagcaatagtaagagaggcgatcaagaggagattgaggacactgatactcgcgccgacgagagtcgtagccgctgaaatggaagaagccctgaaaggactaccaatacgatatcaaacaacagcgaccaagtcggaacacaccgggagagaaatagttgacctcatgtgccacgcaaccttcacgatgcggcttctatccccagtacgtgtgcccaactacaatctaatcataatggacgaagcacactttaccgaccccgcctccatagccgcgagaggctacatcagtacgagagtcggcatgggagaggccgcagcgatcttcatgactgcaacacccccagggacagctgacgctttcccccaaagtaacgcacctatacaagacgaggagcgagatataccagaacgaagctggaacagcggcaacgagtggataacagacttcgccggcaaaaccgtttggttcgttccgagcataaaagcgggcaacgacatagccaactgcctgcgcaagaacggtaagaaagtaattcaactcagcagaaaaacttttgacacagaatatcagaaaaccaagttaaatgactgggacttcgtggtaacaacagacattagcgagatgggcgctaacttcaaagcagaccgggttatagacccgagaaggtgcttaaagccagtgatcctcaccgacggaccagaacgagtcattctagcgggacccatgcccgttaccgcagccagcgccgcacagaggcggggacgcgtcggccgcaatccacaaaaagagaacgatcagtacatattcacaggccaaccactaaacaatgacgaagaccatgcccactggacagaagctaaaatgctcttggataacataaacacgcccgaagggatcatccctgccctattcgagccggaacgggaaaagtccgcggcaatagacggtgaataccgactcaaaggggaaagtagaaagacattcgtggagctgatgcgcagaggagaccttccagtgtggctcgcgcataaggttgcgtccgaaggaatcaagtacacagacagaaaatggtgctttgacggccagcggaacaatcaaatcctggaggaaaatatggacgtcgaaatatggacgaaggaaggcgagaagaagaagctaagaccgcggtggctggacgccagaacctactcagaccccctagccctcaaagagtttaaagattttgctgcaggcagaaagtctatcgccctagatctcgtgaccgagatcggacgtgtcccctcacacctcgcgcaccgtacgcgaaatgcacttgacaatctcgtaatgctccatacttcagaacatggtggcagagcataccgtcacgcagtagaagaactcccagaaacgatggagacactactactccttggactaatgatcctccttacgggaggtgcaatgctattcctaataagcgggaaaggaattggaaagaccagcatagggttaatctgcgttatagcatcgagcggtatgctttggatggctgaaatcccactccaatggatagcctcagcgatcgtcctcgagttcttcatgatggttttactcataccagagcccgaaaagcaaaggaccccacaggacaaccaattagcatacgtagtcattggaatcctaacgctagctgccataatagccgcaaacgagatggggttactagaaacgacgaagcgagaccttggaatgagtaaagaaccaggagtggtgtccccaacaagctacttggacgtcgacttacacccagcaagtgcttggaccttgtacgccgtcgcgacaaccgtaataacgccaatgctcagacatacaatagaaaactcgaccgccaacgtcagccttgcagcgatagccaaccaggctgttgtcctaatgggactcgataaaggatggccaatatcgaaaatggacctaggggtccccctgttagcactaggctgctactcacaagtaaacccgctaacccttacagcagcggtactcctactgataacacactacgccataatcggccccggcctccaggcaaaagccacccgagaggcccagaaaagaacagccgcagggataatgaaaaacccgacagtcgatgggataatgacgatcgacctggatccggttatctatgatagcaaattcgaaaagcagttggggcaagtgatgttactcgttctgtgtgcggtccaactactgctaatgcgaacgagctgggcactttgcgaggcccttaccctggctacggggccaataaccacactttgggaaggtagcccgggcaagttctggaacactactatcgcagtgagcatggcaaacatattcaggggttcctacctggcgggggccggcctggcattcagcataatgaaaagtgtgggcacaggcaaacgcgggactggtagccaaggagaaactctgggagaaaaatggaaaaagaaactaaaccaactcagccgtaaagagttcgatttatacaagaaaagcgggatcacggaagtggaccgcacggaggcaaaggaaggcttgaagcgcggagagataacccaccatgccgtatcacgaggaagcgcaaaactgcagtggttcgtcgaacgtaacatggtaatcccggaagggcgcgtgattgatctcggatgtggcaggggagggtggagctactattgcgccggactaaagaaagtaaccgaagttcgcggatacacaaagggcgggcctgggcacgaggagccggtacctatgtccacctacggctggaacattgtcaaactaatgagcggcaaggacgtcttctatttgcctcccgaaaaatgcgacactctactttgcgacataggagaatcctcgccgagcccaacggtcgaggaatccagaacaatacgagtactcaagatggtagaaccctggctcaagaataaccaattttgcataaaagtactaaacccatacatgccaacggtgatcgaacatctggaacggctacaaagaaaacacgggggaatgctggtccgtaacccgttaagcagaaacagtacacatgaaatgtactggatttcaaacggcacggggaatatagtagcgagcgtgaacatggtcagcagattactcctaaaccgattcaccatgacccacaggcgcccaactatcgagaaagatgtagatttaggcgcaggcacgcgccacgtgaacgcagaacccgagacgcctaacatggatgtcataggcgaaaggatcaagcgtatcaaggaagaacacaactccacgtggcactatgacgacgaaaacccgtacaaaacatgggcataccacggctcatatgaagtaaaggccacaggttcagcaagtagcatgataaatggcgtagtcaagctactcaccaaaccgtgggatgtcgtccccatggtgacacagatggcaatgacggacacaacccccttcggccaacaacgagttttcaaagaaaaagtagacacacgcaccccaaggagcatgcccggcacgcggcgcgtcatgggaataacagccgagtggctgtggaggacactcgggcgcaacaagaaaccacgcctatgtaccagagaagagttcacaaagaaagttcgcacgaatgccgcgatgggagccgtcttcacagaagagaaccagtgggactcagcgaaagcagccgtggaagatgaagatttctggaagctcgtcgaccgcgaacgggaacttcacaaactagggaagtgcggttcatgcgtttataacatgatgggcaagagagaaaagaaactcggagagttcggcaaagcgaagggcagtagagcgatatggtacatgtggctcggagccagatacctcgagttcgaggcattgggctttctgaacgaagaccactggtttagccgagaaaattcctatagcggagtcgagggcgaaggcctacataaactcggctatatactgcgagacatcagcaaaatcccaggaggggcaatgtatgccgacgacactgccggctgggacacccggatcactgaagacgacctacacaacgaagagaaaattacacagcagatggaccccgaacataggcagctagccaacgcaatattcaagctcacctaccaaaacaaggtggtaaaggtccagcgtccaacaccaacgggcaccgtcatggatataatatcccgaaaagaccaacgcggtagcggacaggtaggaacatacgggctcaacacattcactaacatggaagcccaactcattcgtcaaatggagggggaaggcgtactctcaaaagctgatctcgagaacccgcatctgcctgagaagaaaatcacgcagtggctggaaacgaagggggtcgagcggttaaagcgcatggccatctcaggagacgattgcgtcgttaaaccaatcgacgatcggtttgcaaatgcactcctcgccctgaacgacatgggaaaagtaaggaaagatataccacagtggcaaccaagcaagggatggcatgactggcaacaagtccccttttgctcacaccacttccacgaactgataatgaaagacggtcgaaaactcgtagtgccctgtcgaccccaagacgaacttataggccgcgctagaatatcgcaaggggccgggtggagccttagagaaaccgcatgcctcgggaaggcatacgcccaaatgtggtcactcatgtacttccaccgacgagacctacgcctagcttccaatgctatttgcagtgcggtccccgttcactgggtaccaactagcagaaccacatggagtatccacgcccatcaccaatggatgacaaccgaagacatgttgaccgtttggaaccgggtctggatcgaggataacccctggatggaggataaaacaccagtcacgacctgggaaaacgtaccatacttgggaaagcgcgaagatcagtggtgcggatcactcatcgggctaacatctcgagcgacttgggcgcaaaacataccaacagcaatacaacaagtgcggagtttaattggaaatgaggagttcttggactatatgccgtcgatgaagcgattcagaaaagaggaagaatcagagggagcgatctggtga

SEQ ID NO: 25674 - RNA, 9873 nt, synthetic construct
  misc_feature 1..9873: note = derived and/or modified CDS sequence (opt11) from DENV-3__JF808128__SS-prME
  source 1..9873: mol_type = other RNA
accagcctgtgcttgatgatgatcctgccagccgcattagcattccatctaacctcgcgggatggggagcccaggatgatcgtggggaagaacgagcgcggaaagtctcttctgttcaaaaccgcgagcgggattaacatgtgcacattaatcgccatggacctgggcgagatgtgcgatgacaccgtgacatacaaatgcccccacataaccgaggtggagcccgaagatatcgactgctggtgcaatctgacatcgacatgggttacgtatgggacgtgcaaccaagccggcgagcaccggcgtgacaagcggagcgttgcactcgcgccacacgtgggcatggggctagacacgcgcacgcagacttggatgagcgccgagggcgcctggcgccaggttgagaaggtcgagacgtgggcactgcgtcacccgggcttcacgattcttgccctgttcctggcacactacatcgggaccagcctcactcagaaggtggtgatattcatcctgcttatgctcgtcacgcccagcatgaccatgcgttgcgtcggggttggcaaccgagatttcgtagaggggttatcaggtgcgacctgggtggatgtggtgttagagcacgggggctgcgtgaccacgatggcgaagaataagcccaccctcgacatcgagctacagcggacagaggccacccagctggcgactttacgcaagctgtgcatcgaggggaagatcacaaacatcactaccgattcgcgatgccccacacagggcgaggctgtcctgcccgaagagcaagatcagaattacgtctgcaaacatacctacgttgaccgcgggtggggcaatgggtgcggcttgttcgggaagggcagtttagtgacctgtgctaagtttcagtgcctggagcccatcgagggcaaggtcgtgcagtatgaaaacctcaagtacacagtgatcataacggtccacaccggggatcagcaccaggtaggcaatgagacccagggagtgaccgccgaaataaccccacaagccagcaccaccgaggcgatactgccggagtacggcacccttggcctcgaatgttccccccggaccggcttggatttcaacgagatgatactgctgacgatgaagaataaagcttggatggtgcaccgacaatggttcctcgacttgccactcccctggaccagcggagccaccaccgaaacacccacctggaacagaaaggagctgctggtgacctttaagaacgcgcatgcaaaaaagcaggaggtcgtggtgctcgggagccaggagggggcaatgcataccgctctgacgggggcaacggagatacaaaactcaggtgggacctccatcttcgccgggcacctgaaatgccgcttgaagatggacaaactcgaactcaagggcatgtcttacgcaatgtgcactaacacttttgtgctgaagaaggaagtgtccgaaacccagcatgggaccatattaatcaaggttgaatacaagggcgaggacgcgccgtgcaaaatcccatttagcacggaggacgggcaggggaaagcccacaatggccggcttattacggccaaccctgtcgtgaccaagaaggaggaaccagtgaacatagaggccgagccgcccttcggggagagcaacattgtcatcggcattggggacaatgcgctcaagatcaactggtacaagaagggcagtagcatcggaaaaatgttcgaagccaccgcccgcggggcccgtaggatggcaatccttggtgacacggcctgggacttcggttccgtcggcggtgttctgaacagcctgggcaagatggtccatcagatcttcggcagcgcatacacggccctcttttcgggtgtgtcctgggtgatgaagattggcatcggggtcttactgacctggattggcctcaacagcaagaacaccagtatgtcattttcatgcatcgcgatagggataatcaccttgtacctcggcgccgtggtgcaggcagatatgggatgtgttatcaactggaagggcaaggagctcaagtgtggtagcgggatcttcgtgaccaatgaggtgcacacttggaccgagcagtacaagtttcaggctgactcgcctaagcgactggccacggcaattgccggtgcctgggagaacggggtctgcggcatccggagtacgacccgcatggagaacctgctctggaaacagatcgccaacgagcttaactacatcctgtgggaaaataacatcaagttaaccgtcgtggtgggggacataatcggcgtgctggagcagggcaagcggaccttgaccccccaacccatggaactcaagtactcctggaagacttggggcaaatctaagattgtgaccgccgagacgcagaatagcagtttcatcatcgatggccctaacacacccgaatgcccgtccgccagccgcgcgtggaacgtatgggaggtggaggactatggcttcggcgtgttcaccaccaacatatggctgaagcttcgggaggtctacactcagctctgtgaccatcgcctgatgagcgccgccgtgaaagacgagcgggcggtgcatgctgatatgggctattggatcgagtcccaaaagaatggaagctggaagctggaaaaggcttcgctcatcgaggtcaagacctgcacgtggccgaagagccacaccttgtggtccaacggcgtgctggagtctgacatgataatccccaagtccttagcggggcccattagccagcataaccaccgcccgggttaccacacccagaccgccgggccttggcacctgggcaaactggagctagacttcaactactgcgaaggcacaaccgtggtcatcactgagaattgcgggacccggggccccgccctgcgcacgaccaccgtgtccgggaagctgatccacgagtggtgctgccgctcttgcaccctgccgcccctgcgatatatgggcgaggacggatgttggtacggtatggagatccggcccatctccgagaaagaagagaatatggtcaaaagcctggtctccgccgggagcggcaaggtggacaacttcacaatgggcgtgctctgtctcgctatactgttcgaagaggtcatgcgcgggaaatttggcaagaagcacatgattgccggggtgttttttaccttcgtgctgctgctgtccgggcagatcacttggagggatatggcgcacaccctcatcatgatcggctcgaacgcatccgaccgcatggggatgggcgttacttatttggccctaattgcgaccttcaagatccagcccttccttgccctcggtttcttcctccgaaaactcacatctcgcgagaacctattgctaggcgtgggcctggcgatggccactactctgcagctcccggaggacatcgaacagatggcgaacggcatcgccctgggcctgatggccctcaaattaattacccagtttgaaacatatcagctgtggaccgccctcatcagtcttacgtgcagcaatactatgttcaccctgactgtggcttggagaacggcgaccctcatactagccggggtcagtctgctccccgtctgtcagtctagctcaatgcgcaagaccgactggcttcccatggccgttgccgccatgggcgtgccacccctccccctatttatattcagcctgaaggacacactaaagagacgttcctggccccttaacgagggggtgatggcagtcgggctggttagcatcctggcgtcctctctcctaagaaatgatgtcccaatggccggcccgctggtggccggtggactcctgatcgcatgctatgtgataacggggacatctgctgacttgaccgtagagaaggccgccgacatcacctgggaggaggaagccgagcagaccggcgtctctcacaacctcatgatcacggtggatgacgacgggaccatgcgaattaaggacgacgaaaccgagaatatcctgaccgtgctgcttaagacggcgctactaatcgtctccggcgtcttcccttacagcatccccgctaccctcctggtatggcacacctggcagaagcagacccagcgctccggcgtcctatgggacgtgcccagtccgcccgagactcagaaggccgaattagaagagggcgtgtatcggataaagcaacagggcatcttcgggaagacacaggtaggcgtgggggtgcaaaaggagggcgtctttcataccatgtggcacgtgacccgcggagcagtcctgacgtacaacgggaagcgtctcgagcccaactgggcgtccgttaagaaggatctcgtaagctacggggggggctggcgcctgtcggcgcagtggcagaagggggaggaagtgcaggtcattgccgtggagccaggaaagaaccctaagaacttccaaaccatgccgggcacgtttcagacaacgaccggggaaataggcgccatcgccttagacttcaagcccgggacctccggtagccctatcatcaaccgggagggcaaggtggtagggctgtatgggaatggtgtggtgactaagaacggaggctacgtctccggtatcgcccaaaccaacgcggagccggacggtcccacccctgagctcgaggaggaaatgttcaagaagcgaaacctgaccattatggacttgcaccccgggtcgggaaaaactcggaagtatttgccggccattgtgcgcgaggcaatcaagcggcggctgagaactctgattctcgctcccactcgcgtggtcgccgcggagatggaggaggccctgaaggggctacccatacggtaccaaaccactgccacgaagtccgaacatacagggcgggagatcgtggatctcatgtgccacgccaccttcactatgcggttactgagcccagttcgcgtgccgaactacaatctcatcatcatggacgaagcccacttcacggaccccgcgtccatcgccgcgcgggggtacatcagcacccgcgtgggcatgggcgaggcagccgccatcttcatgaccgccacgccccccggtacggctgacgccttcccgcagagtaacgcgcccatccaggatgaggagagagacatcccagagaggagctggaactccggcaacgagtggatcacagatttcgcggggaagactgtgtggttcgtccccagcatcaaggccgggaacgacatcgcaaactgcttacgcaagaacgggaagaaggtgatccaactgtcccggaagactttcgacacagagtaccagaagaccaagctcaatgactgggacttcgtcgtcactaccgacatctcggaaatgggcgccaatttcaaggcggatcgcgtcatcgacccacggcgctgcctgaagccggtgatcctcacggacggacctgagcgggtcatcctcgccgggcccatgccggttaccgccgcctcagccgcgcagcgccggggcagggtggggagaaacccccagaaggaaaacgaccagtacatctttaccggccagcccctaaacaacgacgaggaccacgcccactggaccgaggcgaagatgttgctcgacaacatcaatacccccgaggggataatcccggccctgttcgagccggaacgcgagaagtccgcggccatcgacggtgaatacaggctgaagggtgagtcccgtaagacgttcgtcgagctaatgcggcgcggcgaccttcccgtgtggctggctcacaaggtcgcctccgaaggaatcaaatacaccgaccggcgatggtgcttcgacggtcagcggaacaaccagatcctcgaggaaaacatggacgtggagatctggactaaagagggcgagaaaaagaagctccgaccacgctggctggacgcccggacgtattccgatcctctcgctctgaaggaattcaaggactttgctgccgggcgcaagagcattgcactggatctagtgacggagatcgggagagtgccctcccacctcgcccaccgcaccaggaacgcgctggacaaccttgtgatgttacacaccagtgaacacggcgggagagcgtaccgtcacgcggtagaggaactgcccgagaccatggaaacgctcctgctactcggcttaatgatcctactaaccgggggcgccatgctgttccttatctccggcaagggtattggtaaaacctcgattgggcttatctgcgtcatcgcttctcggagcatgagctggatggcagagatcccactacaatggattgccagtgcgatagtattagagttcttcatgatggtgctcctgattccggaaccggaaaagcaacgtacgccccaggacaaccagctggcctacgtcgtgataggcatactgacgctcgcggcgattatcgccgccaacgagatgggcctgttagaaacaaccaagcgagacctaggtatgagcaaggagccgggggttgtctcccccacctcatatctcgatgtggatctccaccccgcgagtgcttggacgttgtacgccgtggccaccaccgtcatcacccccatgttacggcacacgatcgagaacagcaccgccaacgtctcacttgcggcgatcgcgaaccaggccgtggtcctgatggggctggacaagggctggccgatcagcaaaatggacctcggtgtacccttgctggccttaggatgttactcgcaagtcaaccccctaaccctcaccgccgcggtcctgttgttaatcacgcactacgcgatcatcgggcccggactccaagccaaggcgacacgcgaggcccagaagcggaccgcggccggcatcatgaaaaacccgaccgtagatgggatcatgacgatcgacctcgaccccgtgatctacgacagcaagttcgaaaagcagctgggccaggtgatgctcctcgtgctctgcgccgtgcagctcctgctgatgcgcacctcctgggccctctgcgaggcgctgacactcgccacaggtccgatcacaaccctctgggagggctctcccggcaaattttggaacaccaccatcgctgtctccatggccaatatcttcagggggtcatacctggcaggcgcaggcttggctttctccatcatgaagtctgtgggcacgggtaagcgcggcaccggctcacaaggcgaaacactcggcgagaagtggaagaagaagctgaaccagctgtctcggaaggagttcgacctatataaaaaatcagggatcaccgaagtcgatcgcaccgaagccaaggaaggattaaaaagaggggagataacgcatcacgcagtaagtcgcggatccgcaaaactgcagtggttcgtcgagcggaacatggtcatcccggagggcagggtcatcgacctcggatgcggtcgcgggggctggtcctactactgtgccggtctcaagaaggtgaccgaggtgcggggctataccaaggggggtcccgggcatgaggagcccgtccccatgagcacctacgggtggaatatcgtgaagctgatgtccggtaaggatgtgttctacctcccgcctgagaagtgcgatacccttttatgcgacatcggtgagagctcccccagccccaccgtcgaagagtcccgcactatccgtgtgttgaagatggttgagccgtggttaaagaacaaccagttctgcatcaaagtactgaacccctacatgcccaccgtgatagaacacctggagcgtcttcaacggaagcacggcggcatgctagtgcgcaaccccctgagccggaacagcacgcacgagatgtactggatctcaaatgggaccggcaacatagtcgcttccgtgaacatggtaagccgcctgctcctgaaccggtttaccatgacccaccgccggcccacgatcgaaaaagacgtcgacctcggggctggcacccgccacgtgaacgccgagcccgaaaccccaaatatggacgtgatcggcgagcgaataaaacgcataaaggaagagcacaactccacctggcactatgacgatgaaaacccgtataagacgtgggcttaccacgggagctacgaggtcaaagccacggggtccgccagcagcatgatcaacggggtagttaagctgctgaccaagccgtgggacgtagttcccatggtgactcagatggctatgacggacactacccccttcggccagcagcgagtgttcaaggagaaggttgacacgcgcacgccgcggtccatgcccggcacccgccgggtcatgggtataaccgccgagtggctctggcgcaccctcggccgcaataagaaaccgcggctgtgcacccgcgaggagtttactaagaaggtaaggacaaacgcggccatgggcgcagtgttcacggaggagaaccagtgggatagcgccaaggccgcggtcgaagacgaggacttctggaagctggtagaccgtgagcgtgaactgcacaaactcgggaagtgtgggtcatgcgtatacaacatgatgggcaaacgcgagaagaaactcggggagtttggaaaggcgaagggcagccgggccatctggtacatgtggctgggagcccgttaccttgagttcgaggccctcggtttcctgaacgaggaccactggttctctcgcgagaacagctactccggagtagagggcgaaggcctgcacaagctgggatacatactgagggacatcagcaagattcctggcggggcgatgtacgccgacgacaccgccggatgggacacccggatcaccgaggatgacttgcacaacgaggagaagatcacacagcagatggacccggagcaccgccagttggctaacgccatattcaagctgacgtatcagaacaaggtggttaaggtccagcggcctacccccaccggcacagtaatggacatcattagccgaaaggatcagcgcgggagcggccaggtcgggacctatggcctgaatacgttcaccaacatggaagcgcagctcataagacagatggagggggagggagttctttcgaaggcggacctggagaacccccacctcccggagaagaagattacccagtggttggagaccaagggggtggagcgcctgaagcgcatggccatcagcggcgacgattgcgtggtcaagcccatcgacgaccgtttcgccaacgccctcttggcgctgaacgatatgggcaaggtgaggaaagacatcccccagtggcaaccctctaaggggtggcacgactggcagcaggtcccgttttgtagccatcacttccacgagctcatcatgaaggacggccgcaaactggtcgtaccctgtcgcccccaggacgagttaatagggcgcgcccggatctcccagggcgccggttggagcctccgagagacggcctgtctgggaaaggcgtatgcacaaatgtggtccctgatgtactttcaccggcgggacttacggctggcaagtaacgccatctgctccgccgttcccgtccactgggtgcctaccagcagaactacatggtcgatacacgcgcaccaccagtggatgacaaccgaggacatgttaaccgtgtggaaccgagtctggatagaggataacccctggatggaagacaagacacccgtgactacatgggagaacgtgccctacctcggcaaacgcgaagaccagtggtgcggaagcctgatcggtctgaccagcagagccacctgggcccagaacatcccgaccgccatccagcaggtccgatccctcataggtaacgaggagttcctcgactatatgccatcaatgaagaggttccgcaaggaagaagagagcgaaggcgccatctggtga

SEQ ID NO: 25675 - RNA, 9873 nt, synthetic construct
  misc_feature 1..9873: note = derived and/or modified CDS sequence (opt11) from DENV-3__JF808122__SS-prME
  source 1..9873: mol_type = other RNA
acctctctctgtttgatgatgatcctgcccgccgctctggcctttcatctcaccagtcgggacggcgaaccgcggatgatcgtggggaaaaacgaaaggggcaagagcctgctgttcaagaccgccagcgggatcatcaaatgcaccctcatcgccatggacctaggtgagatgtgcgacgacaccgtgacctacaagtgtccgcacattaccgaggtggagccggaggacatagactgctggtgcaatttaacgtccacctgggtgacttacggcacttgcaaccaggcgggtgaacggcggcgggataagcggtccgtcgctttggcaccccacgtcggtatgggactggacacccggacccagacgtggatgagcgctgaaggcgcatggcgtcaggttgagaaggtggagacatgggccctccggcatccgggtttcaccatcctcgcgctattcctggcccactacatcgggacctccctcacgcagaaggtggtgattttcatcttactaatgctcgtgacgcccagcatgactatgcgttgcgtgggggtgggcaaccgagatttcgtcgaaggcctgtccggcgccacctgggtggacgtggtcctggaacatggcgggtgcgtaaccacgatggccaaaaacaagcccaccctcgacatcgagctgcagaagaccgaggcgcctcacctggcgacactccgcaagctgtgtatcgaaggcaaaatcacgaacatcactaccgacagccggtgtcccacccaaggcgaggccgtgctgcccgaggagcaggaccagaattacgtgtgcaagcacacatatgtagatagggggtggggaaatgggtgcggcctcttcggtaagggctccctagtgacctgtgccaaatttcagtgcctggaacccatagaggggaaggtcgttcagtatgagaatctcaagtataccgtaatcatcaccgtgcacacgggggaccagcaccaggtgggtaacgagacccagggggtcaccgcagagattacacctcaggccagcacgaccgaggcaatcctaccggaatacggtaccctggggctcgagtgttcgccccggaccggcttagactttaacgagatgatcctgctcacaatgaaaaacaaggcatggatggtgcatcggcagtggttcttcgacctgcccctgccttggacaagcggcgccaccaccgaaaccccgacctggaaccggaaggagctcctggtgaccttcaagaacgcccatgccaagaagcaagaagtcgtggtgttagggtcccaggagggcgcgatgcataccgccctgaccggggccacggaaatccaaaatagcggtgggacctccatattcgccggccacctgaaatgtcgccttaagatggacaagctcgagttgaagggcatgagctacgccatgtgcaccaacacgttcgtcctgaagaaggaagtatcagaaacgcagcacgggaccatcctgatcaaagtggagtacaagggcgaggacgcgccctgcaaaattcccttcagcaccgaggatgggcaaggcaaggctcacaacggccggctcatcaccgccaaccccgtggtgacgaagaaggaggaaccggtgaacatcgaggccgagccgccctttggcgagtcaaacattgtcatcggcactggtgacaacgcgctcaagatcaactggtacaagaaagggtccagcataggaaagatgttcgaggccaccgcccgcggagcccgtcgcatggccatcctcggcgataccgcttgggacttcgggtccgtgggcggggtgcttaacagcctgggcaagatggtccaccagatctttggatccgcctacacggctctgttcagcggcgtgtcgtgggtaatgaagatcggaataggcgtactcctgacctggatcggccttaacagcaaaaacacctccatgagcttctcctgcatcgccattggtattatcaccttatacctgggcgccgtggtgcaagcggacatggggtgtgtcatcaactggaaaggcaaggagctaaaatgtggcagcggtatttttgtgacgaatgaggtccatacctggactgaacaatacaagtttcaggccgactcccccaagcgcctcgcgacggccatcgccggcgcgtgggaaaacggtgtctgtggcatccgtagcacgacacgaatggagaacctgctgtggaagcagatcgccaacgaactcaattacattctgtgggagaacaatatcaagctgactgtcgtggttggagatatcatcggtgtcctagagcagggcaaacggaccctgacgccgcagcccatggagttgaagtactcctggaagacctgggggaaggcaaaaattgtgaccgccgagacccagaacagctccttcatcattgacggccccaacacaccggagtgcccgagcgcgtcccgagcctggaacgtctgggaggtggaggactatgggttcggcgtgttcaccaccaacatctggctcaagctgcgtgaggtctacacacagctgtgcgaccatcgccttatgagcgctgccgtgaaggatgagcgggccgtgcacgcggacatggggtactggatcgagagccagaagaacgggtcctggaagctggagaaggccagcctgatcgaggtcaagacctgtacgtggcccaagtcccacaccctgtggagcaacggcgtgcttgagtccgacatgatcatacctaagagcctcgccgggccgatttcccagcataaccaccgcccaggttaccacactcagacagccgggccctggcacttgggcaaacttgagctggacttcaactactgcgagggtaccacggttgttataaccgagaactgcgggacacggggccctagcctccgcacgaccaccgtatccgggaagttaatccacgaatggtgctgtcggagttgcaccctgccgcccctccgctacatgggcgaggacggctgctggtacggcatggagattcggcccatctccgagaaggaagagaacatggtcaagagcctggtttcagccggcagcgggaaggtggataacttcacgatgggcgtgctgtgcttggcgatacttttcgaggaagtaatgcgcgggaagtttggcaagaagcacatgatcgcaggagtgttcttcacgttcgtcctgctgctgagcggtcagatcacgtggagagacatggcacacacactgataatgatcggctccaacgcgtccgacagaatggggatgggcgtcacgtacttggccctaatcgcgaccttcaaaattcaaccgttcctggctttggggttcttcctgcggaagttgactagccgcgagaacttattgctaggcgtgggactcgctatggccaccacgctgcagctgcccgaagacatagagcagatggcgaacgggatcgctctgggcctgatggcccttaagctcatcacccaattcgagacctaccagctgtggaccgccctaataagcctcacgtgttccaacactatgttcacgctgaccgtggcctggcggacggcgaccttaattctcgccggcgtcagcttattgcccgtgtgccagtcgagctccatgcgtaagaccgactggctgccaatggctgtcgcggccatgggcgtacccccgctgcccctgtttatcttcagcctcaaggacacactgaagcgccggtcctggcccctaaacgagggagtcatggccgtaggcctcgtgagcattctggcctcctctttccttcgcaacgatgtgcccatggccggccctctcgttgcagggggcctgctgatcgcctgttacgtgatcacagggacctccgcggacctcaccgtggagaaggcggctgacattacctgggaagaagaggctgagcagacgggcgttagccacaacctgatgattaccgtggacgacgacgggaccatgagaatcaaggatgacgagaccgaaaacatcctgaccgtgctcctgaagactgcactattgatcgtatccggggtgttcccctacagcatccccgcgaccctgttagtttggcatacctggcagaagcaaacgcagcggtccggggtcctctgggacgtgcccagcccgcccgagacccagaaggcagagcttgaggagggggtgtaccggataaagcagcaaggcattttcggcaagacccaggtcggcgtgggggtgcagaaagagggggtcttccacacgatgtggcatgtcaccagaggcgccgtgctgacgtacaacggcaagagactggagcccaattgggcatcagtcaagaaggacttaatcagctacggcgggggatggcgactttccgcgcagtggcagaagggggaagaggtacaggtgatcgctgtcgagccaggaaagaacccgaagaactttcagaccatgcccggcacgttccagaccactaccggggaaatcggcgccatcgcactcgatttcaagcccggtactagcggcagcccgatcattaatcgggagggcaaggtggtggggctgtatggcaacggcgtcgtgaccaaaaacggtggatacgtttccggcatagctcagacgaacgcggagcccgacggcccaacccccgaacttgaggaagagatgttcaagaaacggaacctgacgatcatggacctccacccgggaagcggcaagactcggaagtacctcccggctatcgtcagagaagcaattaagcgtcgcctgcggacgcttatcctcgcacccacacgcgtggtggccgccgaaatggaggaggccctgaaagggctcccaatcaggtaccagaccaccgcgacaaagtcagagcacaccggcagggagatagtagaccttatgtgccacgccacctttacgatgcggctgctctcacctgtgcgggttcccaactacaacttgatcataatggacgaggcccatttcaccgaccccgcgagcatcgcagcccgggggtacatctccacgcgcgttggcatgggtgaagccgcggccatcttcatgaccgcgacacctcccgggacagcggacgccttcccccaatccaacgcgcccatccaagacgaggagcgcgacatccccgagaggagctggaactccggcaacgagtggataaccgactttgctgggaagactgtgtggtttgtgcccagcatcaaggccggcaacgatatcgccaactgcctgaggaagaatgggaagaaagtaatccagctcagccggaagaccttcgacacggagtaccagaaaaccaaactgaacgactgggacttcgtagtgaccaccgacattagcgagatgggcgccaactttaaggcggaccgcgtaatcgacccccgacggtgcctgaagcccgtgatactcacggacggccccgaacgggtaatactggcgggtccgatgcccgtcaccgccgcgtccgccgctcagcggcggggcagagtggggcggaatcctcagaaggaaaatgaccagtacatcttcaccggtcagcctctgaataacgatgaggatcatgcccattggactgaggctaagatgcttcttgacaacattaacaccccggaaggtatcattcccgcattattcgagcccgaacgcgaaaagtccgcggcaattgacggtgaataccggctcaagggcgaatcccgcaagacgttcgtagagctgatgcgtcggggcgacctgcccgtctggctcgcccacaaggtggccagcgagggcatcaagtataccgaccggaagtggtgtttcgacgggcaacgcaataatcagatcctggaggagaacatggacgtggagatctggactaaagagggcgagaagaagaagctgcgaccgcggtggctcgacgcacgcacgtacagcgaccccctggccctcaaggagtttaaagacttcgccgccggccgcaaaagcatagccttagaccttgtgacggagattgggcgggttccctcccacctggcccaccggacacgcaacgccctcgacaacctcgtcatgctgcacaccagcgagcacggcgggcgggcctaccgccatgcggtggaggagctcccggaaacaatggagacgctgctgttgctagggctcatgatcctcctgactggaggggcgatgctattcctgatcagcggaaaggggatcggcaagacatccatcgggcttatctgcgtaatcgccagctccggcatgagctggatggcggagatccccttgcagtggatagcctccgccattgtcctcgagttcttcatgatggtgcttctgatacccgagcccgagaaacagcgtaccccgcaggacaaccagctagcctatgtggtcatcggcatactgacgttagccgcgataattgccgccaacgagatgggactcctggagaccacaaagcgcgacctaggcatgagcaaagagcccggcgtggtttctcccaccagctacttggatgtcgacctgcaccccgcctccgcgtggacgctgtatgcggtggccaccaccgtgatcaccccgatgcttaggcatacgatcgagaacagtaccgccaacgtatccctggctgcgatcgccaaccaagccgtagtgctcatgggcctcgacaaggggtggcctatcagcaagatggaccttggcgttcccctgctcgcactaggatgttattcccaagtgaatcccttaacactaactgctgcggtgctgctgttaataacgcactatgccattatcggccccggcctacaggcaaaagcgacccgggaagcccagaaaagaaccgcagccgggatcatgaagaaccccaccgtcgacggcattatgacgattgacctggacccggtgatctacgactcaaaattcgagaagcagctcggacaggtgatgctgctggtcctctgcgccgttcaactgctgctgatgcgcacctcctgggctctttgcgaagcactaaccttagccaccggccccatcacgaccctatgggaggggagccccggaaagttctggaacacaaccatcgccgtgtccatggcaaacatctttcgaggttcctacctggccggggcgggcctcgcttttagtatcatgaagtcagtggggacgggcaaacgcgggaccgggagccagggcgagaccctgggggagaagtggaagaaaaagctgaaccagctctcccggaaagagttcgacttatacaagaagtccggcattaccgaagtagaccgcaccgaggccaaagaaggcctgaagcgcggtgagatcactcaccacgccgtttccaggggcagtgccaagctgcagtggttcgtcgagcggaatatggtgatccccgaggggcgtgtgatcgacctcggctgcgggcggggcgggtggtcctactactgcgcggggctgaaaaaggtcaccgaggttaggggatacaccaagggcgggccaggtcacgaggagcctgtcccgatgtctacctacggctggaacatcgttaagctcatgtcagggaaggatgtgttctatctgccacccgagaagtgtgatacgctgctctgcgacatcggcgagtcatccccctcgccgaccgtggaggaaagtcgaaccatccgggtcctgaagatggtggagccttggctgaaaaataaccagttctgcatcaaggtgctgaatccctacatgcccaccgtcatcgagcacctcgagcgcctgcagcggaagcacggcgggatgttagttcgcaatcctctcagcagaaattccacgcacgagatgtactggattagcaacggcaccgggaacatcgtcgcatccgtcaacatggtgagcagactcctactcaatcggttcacaatgacccaccgccggcccaccattgaaaaggacgtcgaccttggcgcaggcacccgccacgtcaacgcggagcccgaaaccccgaatatggacgtgatcggggaacggattaaacgcatcaaagaggagcataattccacctggcattacgacgacgagaatccctataagacatgggcttaccacggcagctacgaagtgaaggccacaggaagtgccagctccatgatcaacggagtggttaagctgcttaccaaaccctgggacgtcgtgcccatggttacccagatggccatgaccgacaccaccccgttcgggcagcagcgggtattcaaggagaaggtagacacccgcacgccccggtctatgcccggcacccgccgggtgatgggcataacagccgagtggctatggcgcaccctggggcggaacaagaagcccagactgtgcactcgcgaggagttcaccaaaaaggtccgtaccaacgctgcgatgggcgctgtgttcaccgaagagaaccaatgggactcagccaaggccgcggtcgaagatgaagatttttggaagctggtggatcgcgagcgtgaactgcataagctagggaagtgcggcagctgcgtttacaacatgatggggaagcgggaaaagaagctgggagagttcggcaaggccaacgggagccgtgctatctggtatatgtggctgggagcacgctacctcgagttcgaggccctgggattcctgaaggaataccattggttcagtagagaaaactcctactccggcgtggagggggagggcctccacaagctaggctacattctgagggatataagcaagattcccggaggggcgatgtacgccgacgacacggccgggtgggacacacggattaccgaagacgacctccacaacgaggagaagatcacccagcagatggatccggaacaccgccagcttgccaatgccatcttcaagctgacgtatcagaacaaggtagtgaaagttcaacggcccacccccaccggaaccgtcatggacatcatctccaggaaggaccaaagggggtcgggccaggtgggcacctacggcctcaacacgtttacgaacatggaggcgcagctgatccgccagatggagggcgagggagtgttgagcaaggccgacctcgaaaaccctcatctccccgaaaagaagatcacccagtggctggagaccaagggggtcgagcggctcaagcgcatggccatctcaggcgacgactgcgtcgtgaagcccatcgacgaccggttcgccaatgccctgctggcgctcaacgatacggggaaagtacgcaaggacatcccccagtggcagccttctaagggttggcatgactggcagcaagtgccgttctgcagccaccactttcacgagctgatcatgaaggatgggcggaagctggtggtcccctgccgcccgcaagacgaactcatcggccgcgctagaatctcccagggggcaggctggagcctgcgcgaaaccgcctgtctcgggaaggcatacgcccagatgtggtcactcatgtacttccaccggcgcgacctgcggttagcctctaacgccatctgtagtgccgtccctgtgcactgggtcccgacgagccgaaccacgtggagcattcacgcgcaccaccaatggatgacaacggaggatatgctcaccgtctggaaccgggtgtggatcgaagacaatccctggatggaggataagaccccagtcaccacctgggaaaacgtgccgtaccttgggaagcgcgaggaccagtggtgcggctcactgatcggacttactagccgggccacgtgggcccagaatattccaaccgccattcagcaagtccgcagtctgatcggaaacgaggagttccttgactacatgccgagcatgaagcgattccgcaaggaggaggagtccgagggcgctatctggtga

SEQ ID NO: 25676 - RNA, 9873 nt, synthetic construct
  misc_feature 1..9873: note = derived and/or modified CDS sequence (opt11) from DENV-3__GQ466079__SS-prME
  source 1..9873: mol_type = other RNA
accagcctctgtctaatgatgatcctgccagccgcgctggctttccacctcaccagccgtgacggagaaccacggatgattgtgggcaaaaatgaacgcggtaagtcgctcctgttcaagactgcaagtgggataaacatgtgcacgctaatcgcaatggacttgggcgaaatgtgcgacgatacggtgacctacaagtgtccacacatcacagaagtcgaaccagaagacatcgactgctggtgcaacctgacctccacgtgggtgacctacggaacgtgcaaccaggccggcgagcaccggcgcgacaagcgtagcgtcgccctggcgccccatgtgggcatggggctggacacccgcacacagacctggatgtctgccgagggcgcgtggaggcaagtcgagaaagtcgagacctgggcccttcggcacccgggcttcaccatcctcgcgctgttcctggcacactacatcggcacatccctgacccagaaagtggtgatctttatccttctgatgctcgtaacgcccagcatgaccatgaggtgcgtgggggtcggcaatagggacttcgtagagggcctcagtggggccacctgggtggacgtggttctggagcacggcggatgtgtaactacaatggccaagaataaacccaccttagatatagagctgcaaaagaccgaggccacgcagctagcgacgttaagaaagctatgcatcgaaggaaagattacaaacatcaccaccgacagccgctgccccacgcagggtgaggccgtgctgccggaggaacaggaccagaactacgtctgcaagcacacctacgtagaccgggggtggggtaatgggtgtggcctatttgggaagggatccctggtgacgtgtgcaaagtttcagtgtcttgagccgattgagggcaaagtcgtgcaatacgagaacttgaagtacacagtgataattacggtccacacgggcgatcagcaccaggtgggcaacgagacccagggggtgaccgccgagataacgccgcaggccagcaccaccgaggccatccttcccgagtatggcacccttgggctcgaatgcagtccgcgcaccggcctggacttcaatgaaatgattctcctcacgatgaagaacaaggcgtggatggttcaccggcaatggttctttgacctccccctgccctggacaagcggcgccaccacagaaacgcccacttggaatagaaaagagctcctggttacgttcaaaaacgcccatgccaaaaagcaggaggtcgtggtactcgggtcccaggagggtgctatgcacaccgcgctgactggggccactgagatccagaacagcggcgggacaagcatattcgcaggccacctaaagtgccggttaaagatggacaagctagaactgaaagggatgagctacgccatgtgtaccaatacgtttgtcctgaagaaagaggtgtccgaaacccaacacgggaccatcctcatcaaggtggagtacaagggcgaagacgcaccgtgcaagattcccttcagcaccgaggacgggcaagggaaggcccacaacggccgcttaatcaccgccaatcccgtagtgaccaagaaggaggagccggtgaacatcgaggcagagccgcccttcggtgaaagcaatatcgtcataggcattggagataacgcgcttaagatcaattggtacaagaaaggctcaagtataggcaagatgttcgaggcgacggccaggggcgcccggcggatggccattctcggggataccgcgtgggacttcgggagcgttggtggtgtgttgaacagcctggggaagatggtacaccagatatttgggtcagcctacacggctctcttctcgggcgtgagttgggttatgaagatcggtatcggggtcctcctgacctggatcggactgaatagtaagaacacctccatgagcttctcctgcatcgcgatcgggatcatcacgttgtacctgggagccgtcgtgcaagccgacatggggtgcgttattaattggaagggtaaggagctgaagtgtggcagcgggatcttcgtcactaacgaggtacacacctggaccgagcagtataagttccaggccgattcgcccaagcgcctagctaccgcaatcgccggggcgtgggagaatggggtctgcggcatccgcagcacgacccggatggagaatctgctatggaagcagatcgcgaacgaactaaactacatcctgtgggagaataacatcaagttgaccgtggtggttggggataccattggcgtgctcgagcagggcaagcgcacactgacgccccagcctatggaactgaagtacagctggaaaacctggggaaaagccaagatcgtgaccgctgagacgcaaaactccttcttcataatcgacggccccaacactccggagtgtccgtccgcgagccgggcctggaacgtctgggaggtcgaggactacggtttcggcgtgttcactacgaacatatggctcaagctgcgcgaggtttacacccagctgtgcgaccaccggttgatgtccgctgccgtaaaggacgaacgcgccgtgcacgcggacatgggctactggattgaatctcagaagaacggcagctggaaactggagaaagccagtttgatagaggtcaagacgtgcacctggcccaaatctcataccctttggtcaaatggcgttctggaatccgacatgataatcccaaagtcgttggccgggcccatctctcagcacaatcaccgcccgggctatcatacccagacggcaggcccctggcacctggagaatctcgaattagacttcacatactgcgagggcaccactgtagtgatcacggaaaactgtggcactcgcgggcccagcttgcgcacgaccactgtgagcggcaaactgatccatgaatggtgctgtcgatcctgcactttacctccgttgcggtacatgggggaagacgggtgttggtatggcatggaaatccgccctatcagcgagaaggaagagaatatggtgaagtccttggtgagcgccggctccggcaaggtggacaacttcaccatggggatcctgtgccttgcgatactgtttgaggaggtgatgcggggaaagtttggcaaaaagcatatgatcgcgggcgtcttcttcacgttcgtgctactcctgtctgggcagataacttggagagacatggcgcataccctgatcatgatcggcagcaatgcctctgaccggatgggcatgggagtgacatacctagccctaatcgcgacatttaagatccagccgtttctggccctcggcttcttcctgcgcaaattaacgtcccgggaaaatctgttattgggggtcggcctggccatggcaacgactctacagcttcccgaagatatcgaacagatggcgaacggcatcgcactcgggctgatggccctgaagctcatcactcaatttgagacttaccaactgtggacagccctgatttcgctaacatgcagcaacaccatattcacgctgacagtagcctggcgcaccgcgaccttaatcctagctggtgttagccttctgccggtttgccagtcatcttcaatgcggaagacggactggctcccgatgactgtggctgcgatgggggtaccgccccttccactttttattttctccctcaaggacaccctgaagagacgcagctggcccctcaacgagggcgtgatggctgtggggctagtctccattctggcctcgtccctgctccgcaacgacgtaccgatggccggccccttagtggccggagggcttttaatcgcctgttacgtaatcaccggaacatccgccgacctcaccgtggagaaggcggcggatgtgacttgggaggaagaggcggagcaaaccggggtctcccacaacttaatgatcaccgtcgacgacgacggcacaatgaggatcaaggatgacgagaccgaaaacatcctcaccgtgttactgaaaaccgccctcctgatcgtcagtgggattttcccatactccattcccgccacgctcctcgtgtggcacacctggcaaaagcagacccaacggagcggcgtgctgtgggacgtcccgagcccgcctgagacgcagaaagccgaactcgaggagggtgtgtaccgcataaaacaacaggggatcttgggcaagacccaggtgggggtaggcgtccagaaggagggggtgtttcacaccatgtggcacgtaacccgcggcgccgtgcttactcacaacggtaagcgtctagagcctaactgggccagcgtgaagaaggacctcatatcgtacgggggagggtggcgacttagcgcccagtggcaaaagggcgaggaggtacaggtgatagctgtagagcccggcaaaaaccccaaaaacttccagacgatgcccggcaccttccagaccaccacaggggagatcggggccatcgcccttgacttcaagcccggcacgtccgggtcccccatcatcaaccgcgagggtaaagttgtcggcctgtacgggaatggggttgtcaccaagaatgggggctacgtgagtggaatcgcccagaccaacgcagagccggacggccccacacccgaattagaggaggagatgttcaagaagcggaacctaactatcatggacttgcaccccggctcagggaaaacgcgcaagtacctcccggccatcgtacgggaagcaatcaagagacggctgcgcacgttaatcttagcgcccacgcgggtcgtggccgcggagatggaggaggcgctaaagggcttacccatccggtaccagaccaccgccaccaagagcgagcacaccggtcgggaaatcgttgacttgatgtgccacgccaccttcaccatgcgcctgctttcgcccgtccgggtcccaaactacaacctcatcatcatggacgaggcccattttacggaccctgcctccatagccgcacgcggatacatttccacgcgggttggtatgggcgaggcggccgctatcttcatgtctgccacgcctccaggcacagcggatgcctttccgcagtctaacgcccccatccaggacgaggagcgcgacattcccgagcgcagctggaactcggggaacgagtggattaccgactttgcgggcaagacagtctggttcgttcccagcatcaaggcagggaacgacatcgccaactgcctgcggaagaatggcaagaaggtgattcagctgtcacgcaagaccttcgacaccgagtatcagaagaccaaactcaatgattgggactttgtcgtgacaaccgacatcagcgagatgggggccaacttcaaggcggaccgggtgatagacccgcgacggtgcctgaagcccgtcatcttgactgacggccccgagcgcgttatccttgcgggccccatgccggtgaccgccgcctccgcggcccaacggcgcggacgggtcggccgaaacccgcaaaaagagaacgaccagtacatcttcacgggacagcccctaaacaatgacgaagaccatgcgcactggactgaggccaagatgttacttgacaacatcaacacgccggagggcattatcccagccctgttcgaacccgaaagggagaagtccgccgccatcgatggggaatacagactgaagggcgagtcccgaaaaacctttgtggagctcatgaggcggggtgacctgcctgtatggctggcccacaaagtcgcatccgaaggcataaagtatacggacaggaagtggtgctttgacggccaacggaacaaccagatcctcgaggagaatatggatgtggaaatttggacgaaggaaggggagaaaaagaaactgcgcccccgctggctggacgcgcgcacgtactcagacccactcgccctcaaagagtttaaggatttcgcggcgggcaggaaatccatcgcgctagacttggtcacagaaatcggccgggtgccctcccacctggcacataggactaggaacgccctcgacaatctagtgatgctgcacacgagcgagcacggtggccgcgcctatcggcacgccgtagaggaactgccggagaccatggagaccctcctcctgctcggactgatgatcctgctcacaggtggggcaatgctgttcctgattagcggcaaagggatcggaaagacgagtatcggtctcatctgcgtgatagccagtagcgggatgctctggatggcggagatccccttacagtggatcgcctctgcgatcgtgctcgagttcttcatgatggtactgctgatccccgaacccgaaaaacagcgcacgccccaggataaccaactcgcatacgtggtgatcggcatactaacgctggccgctattattgcggccaatgaaatgggtctccttgaaacgacgaagcgggacctgggcatgtccaaggagcctggcgtagtgtcacccacctcctacctcgatgtggacctgcaccccgcaagcgcctggacattgtatgcggttgcaacgacggtgataacccccatgttacgccacacaatcgagaactcgaccgctaacgtgagcctggccgccatcgcgaaccaggctgttgtgttgatgggcctggacaagggctggccgatttcaaaaatggacctaggtgtgcccttactcgccctagggtgttatagccaggtcaacccgctgacgctcaccgccgctgtgctgctgctcatcacccactacgcgatcatcgggcctggcctgcaggccaaggcaacccgagaggcccagaagcgaacggccgcgggtatcatgaagaatccgaccgttgacggtatcatcaccatcgacctagaccccgtcatctacgactccaaattcgagaagcagttaggtcaggtaatgttgctcgtgctatgtgcagtacagttattgctgatgcggaccagctgggccctgtgcgaagccttaactctcgccaccggtcccattacgacattgtgggaaggctctccaggaaagttctggaacactactatcgctgtgagcatggcgaacatcttccgggggagttatctagccggcgctgggctcgcgttcagcatcatgaagtccgtggggacggggaagcggggcaccggcagccagggggaaacccttggggagaagtggaagaagaaactgaaccagctcagccgcaaagagttcgatctgtacaagaagtccggcattacagaggtggaccggacagaagccaaggagggcctgaaacgcggtgagaccacccaccacgcagttagccggggctccgccaaattgcagtggctggtggaacgcaatatggtcatccccgagggccgggtgatcgacctgggctgcggacgcggtggctggagctactattgtgctgggttgaagaaagtgactgaggtccggggctacacaaagggcggacccggacacgaggaaccggtgcccatgagtacctatgggtggaacatcgttaaactgatgtcgggtaaggatgtcttctacctcccgcctgagaaatgcgacaccttgctatgcgacatcggtgagtctagcccctcccctacggtggaggagagccgcaccatccgcgtgctgaaaatggttgagccgtggctgaagaacaatcaattttgtatcaaggttttgaacccctacatgccagcggtaatagagcatctggagcggctgcaacgaaagcacggcggcatgctcgtccggaaccccctcagccgaaactcgacccacgaaatgtactggatctccaatgggacaggtaacattgtgtcttccgttaatatggttagccggctgctcctgaaccgtttcaccatgacccatcgacgtccaaccattgagaaggatgtggacctaggggccggcacccggcacgtgaacgctgagcctgagacccccaacatggacgtcatcggtgaacgcatcaagcgtatcaaggaggaacacaactccacgtggcactacgacgacgagaacccgtacaagacctgggcttaccatggaagctacgaagtgaaggctacgggctcagcgagctcgatgatcaacggggtcgtaaagctccttacgaagccctgggacgtagtccccatggtgacccaaatggccatgaccgacaccacgccattcggccagcagcgtgtgttcaaggaaaaggtcgatacccggacaccacgccccatgcccgggacgcggaaagtcatggagatcacggccgagtggttgtggcgtacactgggccgtaataagcgcccacgactgtgcacgcgcgaggaatttaccaaaaaggtgcgaacgaacgctgcgatgggcgccgtcttcacagaggaaaaccaatgggactccgccaaggctgccgtcgaggacgaagagttctggaagctggtcgaccgtgaacgcgagctccataagctgggtaagtgtggctcgtgcgtctacaacatgatggggaaacgggagaagaaactgggcgagttcgggaaggcgaagggctcgcgcgccatctggtacatgtggctcgggagcagataccttgagtttgaagccctgggcttcctcaacgaggaccactggttctcccgtgaaaattcctattccggggtggaaggggagggactgcacaaattggggtacatcctccgggacataagcaaaataccgggcggcgccatgtatgcggacgatacggctggttgggacacccgtatcacggaggacgacctgcacaacgaggagaagatcactcaacagatggatcccgaacaccggttgctcgcgaacgccatcttcaagctaacataccagaacaaggtggtcaaagtgcagcgcccgacccccaccggcaccgtaatggatatcataagtaggaaggatcagcgcgggagcggccaggtcggcacatacgggttaaacacgttcaccaacatggaggcccaactcgtgagacagatggaaggcgagggagtgttatcaaaagccgaccttgagaacccacatctgccggaaaagaagatcacgcagtggctcgaaaccaagggcgtcgagaggttaaagcggatggcgataagcggggacgattgcgttgttaagccgatagacgacagattcgccaacgccctgctagcccttaacgacatgggcaaggtcaggaaggacatcccacagtggcagccctccaagggttggcacgactggcaacaagtcccgttctgcagccaccacttccacgagctcattatgaaggacgggaggaagctggtggtaccctgccgaccacaggacgagctgatcggacgcgctcgaatcagtcagggggcgggctggagtctccgcgagactgcttgcctcgggaaggcctatgcccagatgtggtccttaatgtacttccaccgtcgggacctccgactggcgtctaacgccatctgctcggccgtgccggttcactgggtccccaccagccgtactacttggagcattcacgcccaccaccagtggatgaccaccgaggacatgctgacggtgtggaaccgcgtgtggatcgaggacaacccttggatggaggataagaccccggtcacgacgtgggagaacgtcccctacctgggcaagcgagaggaccagtggtgtggcagtctgatcgggctgaccagccgcgcaacctgggcgcagaacatccccaccgctatacagcaggtacgctcccttatcggcaacgaagagttcctggactacatgccaagcatgaaacggttccggaaagaagaggaatccgaaggggccatctggtaa

SEQ ID NO: 25677 - RNA, 9873 nt, synthetic construct
  misc_feature 1..9873: note = derived and/or modified CDS sequence (opt11) from DENV-3__FJ898462__SS-prME
  source 1..9873: mol_type = other RNA
accagcctgtgcctgatgatgatcctgcccgccgccctggcgttccatcttacctcacgggacggggagccccggatgatcgtggggaaaaatgagcggggaaagagtctgctgtttaaaaccgcatccgggatcaacatgtgtaccctcatcgccatggacctgggggagatgtgcgacgacacagtgacatataaatgcccacacatcaccgaggtggagccggaggacatcgattgctggtgcaacctgaccagcacttgggtgacttacgggacgtgtaaccaagcaggcgagcaccgccgcgacaagcggtccgtggccctcgccccccacgtcgggatggggctggacacccgaactcagacctggatgagcgcggagggcgcttggcgacaggtggagaaagtggagacgtgggccctgcgccaccctggattcacaatactcgcgctgttcctggcccactacatcggcacctccctcacccagaaggtggtgatcttcattctgttaatgttagtaacacccagcatgaccatgcgatgcgtgggggtgggcaaccgcgatttcgtcgaggggttgtccggggccacctgggtggacgtggtcctggaacatggcggttgcgtcactaccatggcgaagaacaagcccaccctcgacatcgagctgcaaaagaccgaagccacccagttagcgacgctccggaaactgtgcatcgagggcaagataaccaacatcacgaccgacagccgctgccccacgcaaggcgaggctgtgctgccggaggagcaggaccagaactacgtctgcaagcacacgtacgtcgaccggggatggggcaacgggtgcggcctctttgggaagggctccctcgttacctgtgccaaattccagtgcctggagcccatcgagggcaaggtagtgcagtacgagaacctcaaatacaccgttattatcacggtccacacaggggaccaacatcaggttggcaacgaaacccagggtgtcaccgccgagatcacgccccaggcgagcaccactgaagcgatcctgcccgagtacggcaccctggggctcgagtgctctccgagaactggccttgacttcaacgagatgatcctactcacgatgaagaacaaggcctggatggtgcaccggcagtggttcttcgatctgcccttaccatggaccagcggagcaaccaccgagacacccacctggaatcgcaaggaactcctggtgacgttcaagaacgcccacgccaagaaacaggaagtcgtggtgctggggagccaggagggtgctatgcacaccgccttgacgggggccaccgagattcaaaacagcggcgggacgtccatcttcgccggccacctgaaatgccggctgaagatggacaagctcgagctgaagggcatgtcctacgccatgtgcaccaacacgttcgtcctgaagaaggaagtgtccgagacccagcacgggacaattcttatcaaggtggagtacaagggcgaagatgcgccctgcaagatcccgttcagcaccgaggatgggcaaggcaaagcccataacggtcgcctgatcacagccaaccccgtagtgaccaagaaggaggagccggtaaacatcgaggccgaaccgcccttcggggagagcaacatagtaataggcatcggagacaacgccctgaaaattaactggtacaagaaggggtccagcattgggaaaatgttcgaggccaccgcgcggggcgcccgccggatggcaatcctgggggacaccgcgtgggacttcgggtcggtaggcggggtgctcaactcactggggaagatggtccaccagatcttcgggtccgcctacactgccctcttcagcggcgtgtcctgggtaatgaagatcgggatcggggtcttgctcacctggatcggcttaaacagcaagaacacctccatgtcattcagctgcatcgccatcgggattatcacattatacttgggcgccgtggtccaggcggacatggggtgcgtgatcaactggaagggtaaggagctgaagtgcggcagcggtatctttgtgacgaatgaagtccacacctggacggagcagtacaagttccaggccgattcccctaagcgccttgccacagccatcgccggggcgtgggagaacggggtgtgcggaatccgcagcaccacccggatggagaacctgttgtggaagcaaatcgccaacgagctcaactacatcctgtgggagaacaacatcaagctgaccgtggtggtgggggacataatcggcgttttggagcaaggcaagcgcactttgacgccacagccaatggagctgaaatactcctggaaaacctgggggaaggccaagattgtgaccgccgagacacagaatagctctttcattatcgacggccccaacacgcccgagtgcccgagcgcgtcccgagcctggaacgtttgggaggtggaggactacggctttggcgtgttcacaaccaacatatggttaaagctgcgggaggtctacactcagctgtgcgaccaccggctcatgagtgccgccgtgaaggacgagcgcgccgttcacgcggacatgggctactggatcgagagccagaagaacgggtcctggaagttagaaaaggcgtcgttgatcgaggtcaagacttgcacgtggccgaagtcccacacgctctggagcaacggcgtgttggagtccgacatgatcatccctaaaagcctggccggacctatcagtcagcataaccatcggccgggctaccatacccagactgccggtccctggcacctgggcaagttagagctggacttcaactattgcgaggggacgacagtggtcataacggagaactgcgggacccgaggacctagcctccggacgaccaccgtgtccggaaagctgattcacgagtggtgctgccgcagctgcaccctgccgcccctccggtacatgggcgaggacgggtgctggtacggcatggagatccgcccgatctccgaaaaggaagaaaacatggtcaagtccctggtcagtgccggctccgggaaagtggacaacttcactatgggcgtgctgtgcctcgcaatactgtttgaagaggtcatgagagggaagttcggcaaaaagcacatgatcgccggggtgttcttcaccttcgtgctgctcctttccggccagattacctggcgcgacatggcccacaccctgatcatgatcggaagcaacgccagcgacagaatggggatgggtgttacgtacctcgccctgatcgcgaccttcaagatacagcccttcctggccctcgggtttttcctgcgcaagctgacttcgcgggagaacctcctgctgggcgtcggcctcgccatggcaaccacactgcaactgcccgaagatatcgaacaaatggctaacgggatcgccctcggcctaatggccctgaagctcatcacccagttcgagacctaccagctgtggaccgccctgataagcctcacgtgcagcaataccatgttcaccctgaccgtggcctggcgcacggcgacccttattttagctggggtatccctgctgccggtctgccagtccagctcgatgcggaagaccgactggctccctatggcagtcgccgcaatgggcgtgccgcccctcccgctgtttatcttcagcctcaaggacacccttaagcgccgctcctggcccctgaacgaaggggtcatggccgtcggcctcgtgagcatattagccagttctctgctgcggaacgacgtgcccatggccggtcccctcgtcgcggggggcctgctcattgcctgctacgtgatcacggggacatccgcggacttgacggtggagaaagccgccgacatcacctgggaggaggaggccgagcagaccggggtcagccacaatctgatgatcacagtggacgacgacggcaccatgagaatcaaggacgacgagaccgagaacatcctcactgtcctgctgaagacggccctcctgatcgtctccggggtgtttccgtactcgatccccgctaccttattagtgtggcacacctggcagaagcagacccagcggtccggagtcctgtgggacgtgccaagcccgcccgagacgcagaaggccgagctggaagaaggagtgtacaggatcaaacagcaaggcatcttcggtaagacccaggtcggtgtgggggtgcaaaaggagggagtcttccacaccatgtggcatgtgaccagaggggccgttctcacgtacaacgggaagagactggagcccaactgggcctcagtcaagaaggacttgatctcttacggcgggggctggcggctcagtgcgcaatggcagcgcggtgaggaggtgcaggtgattgcagtggagcccggcaaaaaccccaagaatttccagaccatgcccggcaccttccagaccacgaccggcgagatcggcgccatcgccctggatttcaagcccgggaccagcggcagcccgatcattaaccgggagggcaaggtggtggggctgtacggcaatggggtagtgaccaagaacggagggtacgtgtcaggcatcgcccaaacgaacgcggagccggacggcccgacccccgagctggaggaggagatgttcaagaagcgcaacttgacaattatggacctgcatcccgggagcggcaagactcggaaatacctgccagccatcgtacgagaggccatcaagcggcgcctccggacgctgatcctggcccccacccgcgtggtggccgcggagatggaggaagcccttaagggcctgcccatccggtaccagaccaccgcgacgaagtccgagcacaccggccgcgagatcgtcgacctaatgtgccacgccacattcaccatgcggctcctgagccccgtgcgcgtgccgaattacaacctgatcatcatggacgaggcccacttcacggaccccgcgtccatcgcagcccggggctatatctcgaccagggtcggtatgggcgaggccgcggccatattcatgaccgctacgccgcctggtacggccgacgccttcccccagtccaacgcgcctatccaggacgaggagcgcgacatccccgagcggagctggaacagtgggaacgagtggatcaccgactttgccgggaagaccgtgtggttcgtgccaagtatcaaagccggcaacgacatcgccaactgtctccggaagaacgggaagaaggttatccagctgtcacgtaagaccttcgacacagagtaccagaagaccaagctgaacgactgggacttcgtggtgaccaccgacatcagcgagatgggcgcaaactttaaggcggatcgcgtcatcgacccgcggcgctgcctcaagcccgtgatcttaacggacggccccgagcgggtgatcctggcggggcccatgccggtgactgccgcctccgccgcgcaacggagagggcgcgtgggacggaacccccaaaaggagaacgaccagtatatcttcaccggccagcccctcaacaacgacgaagaccacgcccactggaccgaggcgaagatgctgcttgacaacatcaatacccccgaggggatcatcccggctctcttcgagccagaacgcgagaagtccgccgccatcgacggagagtaccggctgaagggcgaatcccgcaagacgttcgtcgaattaatgcggcgaggggacctgccggtctggctcgcccacaaggtggccagcgagggcatcaagtacacagacaggaagtggtgctttgacgggcagcgcaacaaccagatcctggaggagaacatggacgtcgagatttggaccaaggagggcgagaagaagaagctccggccccgctggctagacgcccgcacctactcggacccgctggcgctcaaggagttcaaggacttcgcagccggccgcaagagcatcgcgctggacctggtgactgagatcgggcgggtgccctcccacctcgcccatcggacccgcaacgcgcttgacaacttggtaatgctccacaccagcgagcacggcggtagagcctaccgccatgccgtggaggagctgcccgagacaatggagacgctgcttctgctgggcctcatgatcctgctcaccgggggcgccatgcttttcctgatcagcggcaagggtatcggcaagacctccatagggctgatctgcgtgatagcaagctccggaatgctttggatggcggagataccgctgcagtggatcgccagcgccattgtcctggagttcttcatgatggtgctcttaatccccgagcccgagaagcagcggacgccccaggacaaccagttggcttacgtggtcatcgggatcctcacgctggccgccatcatcgccgccaacgagatgggcctactcgagaccactaagcgggacctcggcatgtccaaagagccgggggtggtgagcccaacctcctacctggacgtcgacctccaccccgcctcggcgtggacgctgtacgccgtagcgaccaccgtcatcacccccatgctgcggcacaccatcgaaaactctacagccaacgtcagcctcgccgctatagcaaaccaggccgtggttctaatgggcctggacaaagggtggccgatctcgaagatggacctcggcgtccctctactcgccctcgggtgctacagccaggtgaacccgctgaccctgaccgccgcggtgctcctgctgataacgcactacgccatcatcgggcccgggctccaggccaaggccactcgcgaggcccagaaacggaccgcggccgggatcatgaagaaccctaccgtcgatggcattatgacgatagacttggaccccgtgatctacgactcgaagttcgaaaagcagcttggccaggtaatgctcttggtcctgtgcgccgtacagctcctgctgatgcgcaccagctgggccttatgcgaagcgctgaccctggccactggccccatcacaacactctgggagggctcccccgggaagttctggaacactaccatcgccgtgagcatggccaacatcttccgtggctcctacctggcgggagctggcctggccttctcaatcatgaagtccgtcgggacgggcaagcgaggtaccgggtctcagggcgagaccttgggggagaaatggaagaaaaagctgaaccagctgagccggaaggagttcgacctctacaaaaagtccggcatcaccgaggtggaccgcaccgaggccaaggaggggctgaagcggggggagactacccaccacgcggtctcgcgcggctccgccaagctgcagtggttcgtcgagcggaacatggttatcccggaggggcgcgtgatcgatctcggctgcgggcgaggtgggtggagctactactgtgcgggcctgaagaaggtcaccgaggtgcgcggttacaccaagggcgggcccgggcacgaagagccagtgccgatgtccacgtacggctggaacattgtcaagttaatgagcggtaaggacgtgttctacttgccgcccgagaagtgcgacaccctattatgtgatatcggcgagtccagcccttcccccattgtggaggagagccgcaccatccgggtcctgaagatggtggagccgtggctcaagaacaaccagttctgcatcaaggtgttgaacccttacatgcccaccgtcattgagcacttagagcgcctccagcggaagcacggcgggatgctggtgcgcaatcccctgtcccggaacagcacgcacgagatgtactggatcagcaacggcaccgggaacatcgtcgctagcgtaaacatggtgtcccgcctcctgctgaataggttcaccatgacccaccgacggccgacaatcgaaaaggacgtggacttaggcgccggcacccgccatgtgaacgcggagcccgagacccccaacatggatgtgataggggagcggatcaaacgcatcaaggaagagcacaatagcacctggcactacgatgacgagaacccttacaagacgtgggcttaccacggctcctacgaagtgaaggcaaccgggagcgcctccagcatgatcaacggcgtcgtgaagctcctgaccaaaccgtgggacgtcgtgcccatggtgacccagatggcaatgacggacacgacccctttcgggcagcagcgggtcttcaaggagaaggtggacacccgcacaccgcggagcatgcccggcacaagacgggtgatgggcatcacagccgagtggctctggcgaacgttagggcgcaacaagaagccgcgcttgtgcacgcgcgaagagttcaccaaaaaggtccggaccaacgcggccatgggcgccgtgtttaccgaggagaaccagtgggactccgccaaggccgcggtggaagacgaggacttctggaagctcgtcgatcgcgagagggagctgcacaagctgggcaagtgcggcagctgcgtctacaacatgatggggaagcgcgagaagaagctcggtgagttcggaaaggcgaaggggtcccgggccatctggtacatgtggctaggcgcccgctacctggagttcgaagccctcggtttcctgaacgaggaccactggttcagccgggaaaactcctacagcggcgtggagggggaaggcctgcacaagttaggctacatactgcgcgacatctccaagatccccgggggcgcgatgtacgccgacgacacggccgggtgggacacccggattacagaggatgacctgcataacgaggagaagatcacccaacagatggacccggagcaccgccagctcgccaacgccatcttcaagcttacgtaccagaacaaggtcgtgaaggtacagcggcccacccccacaggcacggtcatggacattatcagtcgcaaggaccagcggggctctggccaggtcggcacatacgggttaaacacgttcaccaacatggaggcgcagctcattcgccagatggagggtgagggggtgctgagcaaggcggatctagagaacccgcacctcccggagaagaaaatcacccagtggttggaaaccaagggcgtcgagcggctgaagcgcatggccatctccggggatgactgcgtagtgaagcccatcgatgaccgattcgcaaatgccctcctggcgctgaacgacatggggaaggtccgcaaagacatcccccagtggcagcccagcaagggctggcacgactggcagcaagtcccgttctgctcccaccacttccacgaactcattatgaaggacgggcgtaagttggtggtcccctgtcgcccccaggacgagttgatcggccgggcccgcatcagccaaggggccggctggtccttgagggagaccgcctgcttggggaaggcctacgcccaaatgtggagcctgatgtattttcaccgtcgtgacctccggctggcctccaacgccatctgcagcgccgtgcccgtgcactgggtcccgactagtcgtaccacctggtcgatccacgcccaccaccagtggatgacgaccgaggatatgctaaccgtgtggaaccgggtatggatcgaggacaacccctggatggaggacaagacccctgtgacgacctgggaaaatgtgccctatctcgggaagcgagaagaccagtggtgcggtagcctgatcggtctgacatcccgggccacctgggcccaaaacatccccacagccatccagcaggtgcgcagcctcatcggcaacgaggaattcctggactacatgccctccatgaaacggtttcgcaaagaagaggaaagcgagggggccatttggtga

SEQ ID NO: 25678 - RNA, 9873 nt, synthetic construct
  misc_feature 1..9873: note = derived and/or modified CDS sequence (opt11) from DENV-3__KF955473__SS-prME
  source 1..9873: mol_type = other RNA
acgagcctctgcctcatgatgatcctgcccgccgcacttgcattccacctcacctctcgggatggggagccccggatgatcgtggggaagaacgagcggggcaagtcgctgttgttcaagaccgcatctgggatcaacatgtgcacactcatcgccatggacctaggcgagatgtgcgacgacacagtgacgtacaagtgcccccacatcactgaggttgagccggaggacatcgactgctggtgcaacttgacctctacctgggtgacctacgggacctgcaaccaagccggcgagcatcggcgcgacaaacggtccgtggccctcgctccccacgtgggcatggggctcgacacccgcacgcagacctggatgtctgccgagggcgcgtggcgtcaggtggagaaggtagagacgtgggccctgcgtcaccccggcttcaccatcctcgcgctcttcttggcccactacatcggcacctccctaacccagaaggtggtgatctttattctgctgatgctcgtgacgcccagcatgactatgcgctgcgtgggggtgggaaacagagacttcgtggagggcctgtccggggccacttgggtggacgtggtcctggagcacggcgggtgtgtgacaacgatggcaaagaacaagcccaccctcgacatcgaactgcagaaaacagaggccacacagctcgcgatcctccggaagctgtgcattgagggcaaaatcacgaacatcacaactgatagccgctgccccacccaaggcgaggccgtgctgccggaggaacaggaccagaactacgtgtgcaagcacacctacgtggaccggggctggggcaacgggtgcggcttattcgggaaggggtcactggtgacctgcgccaaatttcagtgcctggagcccatagagggcaaggtcgtgcagtacgagaacttaaagtacaccgttatcattaccgtacacacgggggatcagcaccaggttgggaatgagacccaaggggtgacagctgagatcacgcctcaggctagcaccaccgaggcgatccttcctgagtacggcacgctggggctcgagtgctccccgcgcaccgggctggactttaacgaaatgatcctgcttaccatgaagaataaggcctggatggtgcaccggcaatggttcttcgacctgcccctgccctggacgagtggggccacgacggaaaccccaacgtggaaccgcaaggagctcctggtgaccttcaaaaacgcccacgccaagaagcaggaagttgtagttctggggtcccaggagggcgcgatgcacaccgccctcaccggagccacggaaatccagaactctggagggacctccatcttcgcaggccacctgaagtgccgcctgaagatggacaagctcgagctgaagggcatgagttacgccatgtgcaccaacacctttgtcctgaagaaagaggtgtcagaaacgcagcacgggactattctcatcaaagtggagtacaagggcgaggacgcgccgtgtaagatcccctttagcaccgaggacgggcagggcaaggcacacaacggccgtctgataaccgcgaatccggtcgtcacgaagaaggaggagcccgtgaacatcgaagctgagccgccgttcggggagagcaacatcgtcatcggtatcggggacaacgccttgaagatcaactggtataaaaaggggtcgagcatcgggaaaatgtttgaagcaaccgctcggggcgcccggcggatggccatactgggcgacacggcgtgggacttcggttcggtaggcggggtgctcaacagcctggggaaaatggtccaccagatattcggctccgcatataccgccctgttcagcggcgtctcctgggtgatgaagatcggcatcggtgtcctactaacgtggatcggactcaacagcaagaacacctccatgtcgttctcctgcattgccatcggtatcataaccttgtacctgggcgccgtggtgcaggcggacatggggtgcgttatcaattggaagggcaaggagctgaaatgcggcagcgggatttttgtcaccaatgaggtgcacacgtggaccgaacagtacaagtttcaggccgacagcccgaagcgtcttgccaccgctatcgctggcgcttgggagaacggcgtctgtggcatccgcagcactacgcggatggagaacctgctgtggaagcagatcgccaacgaactcaattacatcctgtgggagaacaatatcaagctgacagtggtggtcggggacatcatcggcgtgctcgagcagggcaaaaggaccctgacgccacaaccgatggaactgaagtactcctggaagacgtgggggaaggccaagatcgtgaccgccgagacccagaactcgagcttcattatcgatggccccaacacccccgagtgccccagcgcgtcccgggcctggaatgtctgggaggtggaggattacgggttcggcgtgttcacaaccaacatctggctcaagttgcgcgaggtatacactcaactctgcgaccatcggctcatgagcgccgctgtcaaggacgagcgcgccgtgcacgcggacatgggatattggatagagtctcagaagaacgggagttggaagctggaaaaggcgtccctcatcgaggtcaagacatgcacctggccgaagtcccacacgctctggagcaacggcgttttagagagcgacatgatcattcccaagagcctggccgggcccatctcacagcataaccaccgaccgggatatcacactcaaacagccggaccatggcacctcgggaagctggagttagacttcaactactgcgagggcacaacggttgtaataacggaaaactgcggtacgcgcgggccgagcctcaggactacgaccgtgtcggggaagttaatacacgaatggtgttgccgcagctgcaccctgccgcctctccggtatatgggcgaagacgggtgctggtacggcatggagatccgcccgatctccgagaaggaagaaaacatggtcaagagcctggtatccgcaggaagcggtaaagtagacaactttactatgggagtcctgtgcttggcgatcctgttcgaggaagtcatgcggggcaagtttggcaagaagcacatgatcgccggcgttttttttacgttcgtcctgctcttgtccggccagattacctggcgcgacatggcacacaccttaataatgattggctctaacgcctccgaccggatgggaatgggcgtcacctacctggccttaatcgcgacgttcaagatccagcccttcctggccctcggcttcttcctgcgcaagctaacttcacgggagaacctcctgctgggcgtagggctcgccatggctactacgttacagctgcccgaggacatagagcaaatggcgaacggcattgccctcggcctgatggccctgaagctcatcacgcagttcgagacctatcaactgtggacggcgctgataagcctgacctgctccaacacgatgtttaccctgaccgtcgcctggcggaccgcgacgctcatcctcgccggcgtaagcctgctgccggtatgtcaatcgtcgtccatgcgtaagactgactggctccccatggccgtggccgccatgggtgtgccgcccctccctctgttcatctttagcctcaaggacacactgaaacgccgctcatggcccctgaatgagggggttatggcggttggcctcgttagcattctggcctccagccttctgcggaacgacgtccccatggccggccccctggtcgccgggggcctgctcatagcctgctatgtgatcaccgggacttccgccgatctgaccgtggagaaagccgcggacattacctgggaggaggaggccgagcagacgggcgtcagccacaacctgatgatcacggtcgacgacgacgggaccatgcgcatcaaggacgacgaaaccgagaacattctcaccgttctgttaaagaccgccctccttatcgtatccggcgtcttcccgtacagcatacccgccacgctgctcgtttggcacacctggcagaagcagacccagcggtcgggcgttctgtgggacgtcccgagcccgcccgagacccagaaggccgaactggaggagggagtttaccgcatcaagcagcagggcattttcgggaagacgcaagtcggcgtgggggtgcagaaggaaggcgtctttcacaccatgtggcatgtgacccggggcgccgtgctaacctataacggcaaacgcctggagcccaattgggcctccgtcaagaaggacctgataagctacggcgggggctggcggctctccgcgcaatggcagaagggggaggaggtccaggtgattgctgtcgagcccggcaagaaccccaagaacttccagactatgcccggcaccttccagaccaccacgggggagatcggggccatcgccctggacttcaagccagggaccagcggctcccccatcattaatcgtgagggcaaggtagtcggtctatatggcaacggggtggtgaccaagaacggtggttacgtgtccggcatcgcccaaaccaacgcggagccggacggccccacgccagaactggaggaggagatgttcaagaaacgaaacctgaccatcatggacctgcatcccgggagcggcaagacccgcaagtacctgcccgcaattgttcgggaggccattaagcgccggctccgcacccttatcttggcccccacgcgtgtcgtggccgcagagatggaggaggccctcaaggggctgccgatccgctaccagaccaccgccactaagtccgagcacacgggccgggagatcgtggatttaatgtgccatgccacctttacgatgagactactgagcccggtgcgggtgccgaactacaacttgatcattatggacgaggcccacttcaccgaccccgcgtcaatcgcggccaggggatacatatcgacgcgggtcggcatgggcgaggccgcggccatcttcatgaccgccacgcctcctgggaccgccgacgccttcccgcagtcgaacgcgccgatccaggacgaggaacgcgacatccccgagcgcagctggaattccggcaacgagtggatcacggacttcgccgggaagacggtgtggttcgtgcctagcataaaggcgggcaacgacatcgctaattgcctccggaaaaacgggaagaaagtcatccagttatcccgcaagaccttcgatacagagtaccaaaagacgaagctaaacgactgggacttcgtagtgaccaccgacatcagcgagatgggcgccaacttcaaggcggatcgggtgatagacccgcgacggtgcctcaagcccgtgatcctgaccgatggccccgagcgcgtgatcttggcgggcccgatgccggtgacggccgcaagcgctgcgcagcggaggggccgagtcgggcgcaacccccagaaggagaacgaccagtacattttcaccggccaaccgttgaacaacgacgaggaccacgcacattggacggaggccaagatgcttctggacaacatcaacacccccgagggcatcatcccggccctattcgagcccgagcgtgagaagtccgcggccatcgatggcgaataccgactgaagggcgagtcccggaagacattcgtggagctgatgcggcgcggggatttacccgtatggctggcccacaaggtggccagcgaaggcatcaagtatacggaccgtaagtggtgcttcgacgggcagcggaacaaccagatcctggaggagaacatggacgtcgagatctggactaaggagggcgagaagaagaagctcagaccccggtggctggacgcacgcacctactccgacccgctggcgttaaaggagttcaaggatttcgcagccggccgcaaatctatcgccttagacctggtaaccgagatcgggcgggtgccttcccacctcgcccaccggacgaggaatgctctggacaatctggtcatgctccatacttccgagcatggcgggcgggcctaccggcacgcagttgaagaactccccgagacaatggagacacttctcttactcggtctcatgatcctcctaaccggcggggctatgctgttcctgatcagcggcaaggggatcggcaagacctccatcggactcatctgcgttatcgccagctccggcatgctctggatggcggagatcccgctccagtggatcgcctcagctatcgtcctggagttcttcatgatggtactcctgatccccgaacccgaaaaacagcgcacgcctcaggacaaccagctggcctacgtagtgatcggcatactcaccctggcagccatcatcgccgccaacgagatgggcctgctcgaaacgaccaagcgagacctgggcatgtccaaggagccgggagtcgtgagccccacgtcctacctggacgtggaccttcaccccgccagcgcatggaccctgtacgcggtggccacgaccgtgataacccccatgctgcgtcacaccatcgaaaactccacggccaacgtcagcctcgcggcgattgccaatcaggccgtggttcttatgggcctggacaaggggtggccaatctcaaagatggacctgggcgtccccctgctggctctcggctgctacagccaggtgaacccgctgactttaactgccgcggtgctcctactcatcacccactacgcgatcatcggcccaggcttacaggccaaggccacgcgggaggcccagaagcgcacagccgccggtatcatgaagaatccgacagtcgacggcatcatgaccatcgacctggacccagtgatctatgattccaaattcgagaaacaactcggccaggtaatgttgctggtcctgtgcgccgtgcagctcctgctgatgcggaccagctgggcgctctgcgaggcgctgacactggccactggtcccatcaccacgctttgggagggctcccccggaaagttctggaacaccaccatagctgtgtccatggctaatatcttccgcggatcatacctggcaggggctggcttggcgttcagcattatgaagtccgtagggaccggcaaacggggcacggggagccagggcgagaccctcggggagaagtggaaaaagaaactgaaccagctgagccgcaaggaattcgacctctacaagaagagcggcatcacggaggtagaccggaccgaagccaaggaagggctgaagcgcggggagaccacacaccacgccgtgagccggggctccgccaagttgcagtggttcgtggagcgcaacatggtgatccctgaggggcgggtgatcgacctcggctgtgggcgcggcgggtggagctactattgcgcggggttaaagaaggtcaccgaagtgcggggctacacaaagggcgggccggggcacgaggagcccgtcccaatgtccacctatggctggaacatcgtcaaactgatgagcgggaaagacgtgttctacctgccgcccgagaagtgcgacacgctgctgtgcgacatcggcgagagcagcccctcccccacggtggaggagagccggaccatcagagttttgaagatggttgagccttggctcaagaacaaccaattctgtatcaaggtgctgaacccatacatgccaaccgtcatcgaacacctcgagcggctccagcgcaagcacggcgggatgctggtgcggaacccgctgagtaggaacagcacgcacgagatgtactggatctccaacggcaccgggaacatagtggccagcgtcaatatggtgtcccgcctgctgcttaaccgcttcacgatgacccaccgtcgtccgacgatagagaaggacgtggacctcggtgccggcacccggcacgtgaacgccgagcccgagacccccaacatggatgtgatcggcgagcgcatcaagcgaatcaaggaggagcacaactctacctggcactacgacgacgagaacccgtacaagacttgggcctaccatggctcctatgaggtgaaggccacggggagcgcctcgagcatgatcaacggcgtcgtgaagttactaaccaagccgtgggacgtggtgcccatggtgacccaaatggccatgacggacaccacccccttcgggcagcagcgtgtctttaaagaaaaggttgacacccgcacaccaaggtccatgcccggcaccagacgggtgatgggcatcaccgccgagtggctatggcggaccctggggcgcaacaagaaaccccggctgtgcacccgcgaggaattcacaaagaaggtccgcaccaatgcggccatgggtgccgtgttcacggaagagaaccagtgggattccgccaaggctgcggttgaagacgaagatttctggaaactcgtggaccgggagcgcgagttgcacaagctggggaagtgtggctcgtgcgtgtacaacatgatgggtaagcgggagaagaagctgggcgagttcggaaaggccaaggggtcccgcgccatctggtacatgtggttgggggcccggtacctggagttcgaagccctcggtttcctaaacgaggaccactggttcagccgcgagaactcctacagcggcgtcgaaggggagggcctgcacaagctcggctacatcttgagggacatctcgaagattccagggggcgcgatgtacgccgatgacactgccgggtgggatacacgcatcaccgaggacgacctgcacaacgaggagaagattacccagcagatggacccggagcaccggcagctcgccaatgccatcttcaagctgacgtaccagaataaggtcgtgaaggtgcagaggcccacccccaccggcactgtcatggacatcatcagccggaaggaccagcgcggctccggccaagttggcacatatgggctcaacacattcaccaacatggaagcgcagctcattaggcaaatggagggtgagggtgtcctgtctaaggctgacctggaaaacccccacctcccggagaagaagattacccagtggcttgagaccaaaggcgtcgagcgactcaagcggatggctatcagcggtgatgactgcgtggtcaagcccatcgacgaccgctttgccaacgccttgctggcgttgaacgatatggggaaggtccggaaggacatcccgcagtggcagcccagcaagggttggcacgactggcagcaagtacccttctgctcccaccacttccacgagctcattatgaaggacgggcgcaagctggtagtcccttgccgtccccaggacgagctgatcggccgcgcccggatctcgcagggggccggctggtccctccgcgagacggcttgcctgggcaaagcgtacgcacagatgtggagcttgatgtacttccatcgacgggacctccgcctggcctccaacgcaatctgcagcgccgtacccgtgcactgggttccgacctcccggaccacctggtccatccacgcgcaccaccaatggatgacgaccgaggacatgctgaccgtgtggaaccgagtatggattgaggataacccatggatggaagacaagaccccggttacgacttgggagaacgttccttacctcgggaagcgggaagaccagtggtgcggcagcctgatcggtcttacctcccgcgccacctgggcacagaacatcccgacggccatccagcaggtccgtagcctaatcggcaacgaggaattcctggattacatgccctccatgaagcggttccgtaaggaggaggagtcagagggggcgatctggtga

SEQ ID NO: 25679 - RNA, 9873 nt, synthetic construct
  misc_feature 1..9873: note = derived and/or modified CDS sequence (opt11) from DENV-3__FJ850079__SS-prME
  source 1..9873: mol_type = other RNA
accagcttgtgtctgatgatgattctcccagctgcactggcgttccacctgacatcaagggacggtgaaccccgaatgatagtagggaaaaacgagcggggaaaaagcctcctgtttaaaacggctagcggaataaatatgtgcacactgatagcaatggatttaggggaaatgtgtgatgataccgtaacctacaaatgcccccacattacggaagtagaaccggaagacatagactgctggtgcaacctgaccagtacctgggtaacgtatgggacgtgcaatcaagcgggagagcaccggagagacaaaaggtcggtggctcttgcaccccacgttggaatgggattagacacacgaacccaaacgtggatgagcgcggagggagcttggcgccaagttgaaaaagtcgaaacgtgggcgttacgtcatcccgggttcacaatactagcgctttttctcgcacactacatcggtacatcactaactcagaaagtagtaatcttcatactactcatgctagtcaccccctccatgaccatgcgatgcgtcggtgtaggcaacagagatttcgtggaaggattgtctggcgcgacgtgggtcgatgtcgtactcgaacatggaggatgcgtcacgaccatggcgaaaaacaaacccaccctagacatagagctgcagaaaacagaggcaacccaactagcaacccttcgaaagctctgcatcgaaggcaagataacgaacataaccacagatagccgatgccccacacaaggcgaggcggtcctacctgaggaacaagatcaaaactacgtatgcaaacacacctacgtcgacagaggttggggaaacggatgcggactgttcggaaaggggtcactcgtaacgtgcgcaaaattccagtgcctcgaacccatagagggcaaagtagtccaatacgagaacttgaaatatactgtgataatcaccgtacacacgggggatcagcaccaagtaggtaatgaaacccaaggagtgacagccgagataacgccccaagcgagcacgaccgaagcgatcttaccagagtacggcacactcggactggaatgctccccacgcacaggactagactttaacgaaatgatacttctgaccatgaagaacaaagcatggatggttcatcggcaatggtttttcgacctgccgctaccgtggacttcaggggcgaccacggagacacccacgtggaaccgtaaggagctcttagtgacattcaaaaacgctcacgccaagaaacaagaagtcgtcgtgttgggaagccaagagggagccatgcacacggccttaaccggcgcaacggaaatacaaaacagcggtggcacatcaatcttcgccggccacctcaaatgcaggctaaaaatggacaaactagagttaaaagggatgtcatacgcgatgtgtacgaacactttcgtcctaaagaaggaagtcagcgaaacacaacatggcacgatcttaataaaggtagaatataaaggcgaggacgtaccctgtaaaataccatttagtacggaagacgggcaggggaaggcgcacaacggcaggctaatcacggctaacccagttgtgaccaagaaagaggaacctgtcaatgtcgaggccgaacccccgttcggcgagagtaacatagtcatcggaataggtgacaacgcactaaagatcaactggtacaagaaagggtcgtcaattggcaaaatgttcgaggccacagcgcggggagcacgtcgcatggctatcctaggagacaccgcttgggacttcggaagcgtcggcggagtattgaactccttaggaaagatggttcaccagatattcggatccgcttacacggccctattctccggcgtctcatgggtaatgaaaatcggcattggggtgctcctgacatggataggcctcaactcgaaaaatacgagcatgagtttctcctgcattgccatcgggattataacactctacctgggcgcagtggtccaagccgatatgggctgcgtcatcaattggaagggaaaggagctgaaatgcggctccggaatatttgtcactaacgaagtacacacctggactgagcaatataagtttcaagccgactcaccaaaaagacttgcaacagcgatcgccggggcatgggaaaacggagtatgtggaatacgatccaccacaaggatggaaaacctactatggaagcaaatagccaacgaacttaactatatcctttgggagaacaacataaagctgacggtcgtcgtgggagacatcactggggtgctagagcaaggtaaaagaacattaacgccacagcccatggaactaaagtacagctggaagacctggggaaaagcaaagatagtgacagctgaaacgcaaaactcctccttcatcattgatggacctaatacccctgaatgcccatcagctagccgagcatggaacgtctgggaggtcgaagattacggcttcggagtgttcaccactaatatctggcttaagttgcgtgaagtctatacccaactctgcgaccaccgactcatgagcgccgctgtcaaagacgaacgagcagtgcacgcagacatgggctattggatcgaatcacagaaaaacggcagctggaaactcgaaaaggcaagtctcattgaggtaaaaacatgcacctggccgaaaagccacacactttggagcaatggggttctagaatcagacatgattatcccgaaatcccttgcaggtcccataagccagcacaactaccgcccaggatatcacactcagacggctgggccctggcacttgggaaaactagaactagacttcaactattgcgagggaaccacagtcgtcataacagagaactgcggcacacgagggccatctctgcgtaccacgacagtttccggcaaacttatccacgagtggtgttgcagatcctgtacccttccgccgctacgatacatgggcgaagacgggtgctggtacgggatggagatacgaccgatctcggaaaaggaggaaaacatggtcaagagcctagtatccgcggggtccggtgaggtggacaacttcacaatgggggtgctctgccttgcaatcctgttcgaagaggtgatgcgaggcaagttcggcaagaaacacatgatagcaggagtcttctttaccttcgtgttattgctaagcggtcaaataacgtggcgggatatggcgcataccttaataatgatcggcagcaatgcgtcagacaggatggggatgggggtcacatacctcgctctgatagcgacctttaaaatccagccgttccttgcactaggctttttcctaagaaagctgacgtctagagagaacctactactgggcgtagggctagccatggccaccaccttgcagttaccagaagatatcgagcaaatggcaaacggtatcgccctcggactgatggcgctgaaactcattacccaattcgaaacgtaccaattatggaccgcactcatctcgttaacatgcagcaacacaatattcaccctaaccgtggcttggaggaccgccactctgatcctggccggtgtaagcctcctgccggtgtgccagtccagcagcatgagaaaaacggactggctgccaatgacagtcgcagcgatgggtgtgccgccgttaccgttatttattttcagtctaaaggacaccctgaagcgaaggagttggcctctgaatgaaggcgtaatggcagtcggtcttgtgtcgatattagcaagctcactacttagaaacgacgtaccaatggcaggacccctcgtcgcgggcggcttgctaatagcatgctacgtaataaccggcacaagcgcggacctcactgtagaaaaagcagccgacgtcacttgggaagaggaggcagaacagaccggtgtctcccacaacttaatgatcactgttgacgacgacggtaccatgcgaatcaaggacgatgaaacggaaaatatcctcacggtccttttgaaaaccgcactgcttattgtatctggtatattcccatatagcataccagcgacacttctggtctggcacacctggcaaaaacagacgcaacgctccggagtgctgtgggatgtacccagtccacccgagacccagaaagcagagctcgaggagggggtataccgcataaagcaacaaggaatcttcggaaaaacccaagtaggggtcggagttcagaaagaaggggtttttcataccatgtggcacgttaccagaggggcggtccttacatataacgggaagcgactggaaccaaactgggcatctgtgaaaaaggaccttatatcgtacggtggtggttggcggttatcggcacagtggcaaaagggcgaagaggtgcaagtaattgccgtagagcccggcaaaaaccccaaaaacttccaaaccatgccaggaacgttccaaaccaccaccggagagatcggcgccatagcactagacttcaagcccgggacaagcggcagtccaatcattaaccgggagggcaaagtggtcgggttatacggcaacggagtcgtaaccaaaaacgggggatacgtctcaggcattgcccaaacaaacgccgagcccgacgggcctacccccgaactagaggaggaaatgttcaagaaacgtaacctcactatcatggacctccacccgggctcagggaagacccgaaaatacctacccgcgatagtacgcgaagcaataaaacgacgtctgcgcacgctaatactagcgccgacccgtgtcgttgccgcagaaatggaagaagcattgaagggtctgccaatccgataccaaactaccgcaacaaaaagtgagcatacgggacgagaaatcgtcgatctcatgtgccatgccacttttaccatgcgactcctaagcccagtaagggtgccgaattacaacctgattataatggatgaggcccacttcacagatccagcgtccatagcagcaagagggtacataagcacgagggtcgggatgggcgaggcggcggccatattcatgacagcaacgcccccgggcacagccgacgcatttcctcagagcaacgctccgatacaagacgaggaacgagacataccagagcgatcatggaacagcggcaacgaatggataacggatttcgcgggcaagacagtatggtttgtcccctcaatcaaggcgggaaatgacattgcaaattgtcttcgaaagaacggcaaaaaggtcatccagctctccaggaagacattcgacacggaatatcagaagaccaagctgaacgactgggacttcgtagtcactactgacatctcggaaatgggagccaacttcaaggcggaccgagtgatagacccacggcgatgcctgaaaccagtgatcctcactgacggacctgaacgagtcatcctagcaggacccatgcctgtcaccgcggcgtccgcggcacagcgccgaggaagggttggtcgcaacccccagaaagagaacgaccaatacatatttacaggtcagccactaaacaacgatgaagaccacgcgcactggaccgaagcgaaaatgttactagataacatcaacacgccagagggcataataccagcacttttcgagcccgaaagagagaaatccgcagctatcgacggagaatacaggttaaaaggcgaaagcaggaagactttcgttgagctcatgcgaaggggagacttaccggtgtggttagcacacaaagtcgcatcagaaggcataaaatacaccgaccgaaaatggtgcttcgacggacaacgaaacaatcaaatattagaggaaaacatggacgtcgagatttggactaaagagggagagaagaagaaattgcgtccaagatggctagacgcgcgaacctatagcgacccgctcgcgctcaaagaatttaaagattttgccgcaggaagaaaaagtatcgcgctggacctagtgaccgaaattggccgtgtaccaactcatcttgcgcataggacacgcaatgccctggataatctggtaatgctccacacgtccgaacatggagggaaggcgtacagacatgcagtagaggaactgccagaaacgatggaaactttattgttactcggactcatgatacttttgacgggaggcgcgatgcttttcctcatctccgggaagggcattggcaagacctccataggactaatctgtgtaatagcttccagcgggatgctgtggatggcagaaatacccctccagtggatagcgagcgccatagtattagagttcttcatgatggtattgctaattccggagcccgaaaagcaaaggacaccgcaggataaccaactggcgtacgtcgtgattgggatcctgaccctcgcggcgattatagcagctaacgaaatggggctcctagagacgaccaaacgggacctgggaatgtccaaagaaccaggcgtagtcagtccaacctcctacctcgacgtcgacctgcatccagcttcggcctggacactatatgccgtagcaaccactgtcattacgccaatgctacggcacacaatagaaaactcaacggctaacgtctccctagccgctatcgcgaaccaagccgtggtactcatggggctcgacaagggttggccaatctcaaaaatggatctcggcgtccccttattggcgctgggctgctactcacaagtaaaccccctcacgcttaccgcggccgtcttgctactgataacacattacgccatcatagggcctggactgcaggccaaggcaaccagagaggcccagaaacgcacggcagcaggcatcatgaagaaccccaccgtagacggaattatgaccatagatctggacccggtgatctacgactcaaagttcgagaaacaactgggacaggtaatgctcctcgtcttatgcgcggttcaactgctattaatgaggacgtcatgggcactctgcgaggccctgacgctagcaacggggccaataaccactctttgggaggggagccccggcaaattctggaatacaacaatcgcggtcagtatggccaacattttccggggaagctatcttgcgggggccggacttgccttctcaataatgaagtcggtgggaactggtaaacggggtaccggctcgcagggtgagacattaggtgagaaatggaagaagaaactaaaccaactaagtcggaaagagtttgacctgtacaagaagtcagggattaccgaggttgaccgcacagaggcgaaggaggggctgaaacgaggcgaaataacccaccacgcggtctcgcgaggatcagcgaaactccaatggtttgtagaaaggaacatggtcataccggaaggccgcgtaatagacctggggtgcgggcggggagggtggtcctactactgcgcaggcctgaagaaagtcacagaggtaagaggttacacaaagggcggaccaggccacgaagaaccggtaccgatgtcgacttacgggtggaacatagtgaaactaatgagcggtaaagacgtcttctacctaccaccagaaaagtgcgatacacttctatgcgatatcggcgaatccagcccctcgcccaccgtagaggagtcccgaacaattcgtgtgctaaaaatggttgagccttggctcaaaaataaccaattctgcattaaagtcctaaacccatacatgcctacagtaatcgaacacttagagagactacaacgcaagcacggaggcatgctagtccgcaacccccttagccggaatagcacacatgaaatgtactggataagtaacgggacgggcaacattgtagccagcgtgaacatggtcagccggctgctcctaaaccgattcactatgacacaccgccggcccactatcgagaaggatgtagacctaggtgcaggaactcgccacgtaaacgccgaacctgaaaccccgaacatggacgtaataggtgaaagaatcaagcggataaaggaagaacacgacagtacatggcactacgacgacgagaacccgtacaagacttgggcgtatcatgggtcgtacgaagtcaaggcaactggaagcgcatcgtctatgatcaacggcgtagtcaagctgctaaccaagccttgggacgtcgtcccgatggtaacacagatggcaatgacagacacgacacccttcgggcaacagcgagtcttcaaagaaaaagtcgacacaaggacaccccgctcaatgcctgggacgagaagagtgatgggaataactgcggagtggctatggcgaacactaggacgaaacaagaaaccacgattgtgcacgcgtgaagagttcacgaaaaaggtgagaaccaacgccgcgatgggcgccgttttcacggaagaaaaccaatgggacagtgcaaaggcagccgtcgaagacgaagatttctggaagttggtggaccgagaacgagagctccacaagttaggaaaatgcggaagctgtgtatacaacatgatgggaaaacgggagaagaaactgggggagttcggaaaggcaaagggaagcagggccatctggtacatgtggctgggagctagatatctagaatttgaagcgttagggttcctaaatgaggaccactggttctccagggaaaacagctacagtggtgtcgagggggaagggctacacaaattgggttacatcctaagagatatctcaaaaataccgggaggcgcaatgtatgcggatgacacagcggggtgggacacacgaataacagaagatgatctacacaacgaggagaaaataacccaacaaatggaccccgaacaccgccaactagcaaatgcaatcttcaaacttacctaccaaaacaaggtagtcaaggtgcaacgacccacgccgaccggcacggtaatggacataatcagccgaaaagaccaaagaggcagcgggcaggtaggaacgtacggcctaaataccttcacgaacatggaagctcaactgatcaggcagatggaaggagaaggggtcctctcaaaagccgacttggagaacccacatctacccgaaaagaagataacgcaatggctagaaacaaagggggtagagcgcttgaagcgaatggccatatcgggagacgactgcgtagtgaagccgatagacgatcgattcgcaaacgcacttctggccttgaatgacatgggtaaagtacggaaagacataccccaatggcaacccagcaaaggatggcacgattggcaacaagtaccattctgctcgcaccactttcatgaactcataatgaaagacggtcggaaactggtagtcccctgccgcccccaagatgaactaataggccgtgcccggatctcccaaggcgcgggttggtcactacgagaaacagcatgcctgggaaaagcctacgcacaaatgtggtcgctgatgtatttccatcgaagagatctgcggttggcaagcaacgcgatctgctccgcggtcccagtacactgggtacccacgtcgcgcacaacatggagcatacacgcacaccaccagtggatgacaaccgaagacatgttaacggtgtggaatagagtctggatcgaagacaacccctggatggaggacaaaacccccgtcacaacatgggagaatgtaccctacctaggcaagcgagaggaccagtggtgcggatcattaataggattgaccagccgggccacgtgggcacaaaacatcccgactgctatccaacaagtaaggtctctcatagggaatgaagagttcctggactacatgccatctatgaaaaggtttcgaaaggaggaagaatccgaaggcgctatctggtga

SEQ ID NO: 25680 - RNA, 9873 nt, synthetic construct
  misc_feature 1..9873: note = derived and/or modified CDS sequence (opt11) from DENV-3__FJ850080__SS-prME
  source 1..9873: mol_type = other RNA
accagcctctgtctcatgatgatcctgcccgccgctttggcgttccacctcacaagtcgggatggcgagccacgaatgatagtgggcaagaacgagcggggcaagagcctgctctttaagacggcctcaggcatcaatatgtgcacactcattgcgatggacctgggcgagatgtgcgatgatacggtaacctataagtgcccccacatcaccgaagtggagcctgaagacatcgactgctggtgcaatctgaccagcacctgggtcacctacggcacgtgcaaccaagccggggagcaccggcgcgacaagcggtccgtcgccctcgccccacacgtgggcatggggctggacacccggacccagacctggatgagtgctgaaggcgcctggcgccaggtagagaaggttgagacttgggccctgcgccacccggggttcactatcctcgcgttgttcttggcccactacattggcacctccctcacccagaaggtagtgatcttcatcctgcttatgctcgtgacgccttccatgacaatgcggtgcgtgggggtgggcaaccgcgacttcgttgagggcttatccggggccacctgggtggatgtcgtattggagcacggtgggtgtgtgactactatggccaagaacaagcccacactagacatcgagttgcagaagaccgaagcaacccagcttgcgaccctccgcaagctgtgcatcgaggggaagatcactaacatcaccaccgacagccgctgtcccacgcagggcgaggccgtgttaccggaagaacaggaccaaaactacgtctgcaagcacacctacgttgaccgggggtggggcaacgggtgcggtctcttcgggaagggctcactcgtaacgtgcgcaaagttccagtgcctcgagcctatcgaaggcaaagtcgtgcagtacgagaacctcaagtataccgtgattataacggtccacaccggggaccagcatcaggtgggcaacgagactcaaggggtcaccgccgagatcacaccccaggccagcaccaccgaggcgatcctgccagagtatggtaccctggggctcgagtgctccccgcggaccggcctggacttcaacgagatgatcctgcttacaatgaagaataaggcctggatggtgcatcggcaatggttcttcgatctgcccctgccctggaccagcggcgccaccaccgaaactcccacctggaataggaaggagttactggtgaccttcaagaacgcgcacgctaagaagcaggaggtcgtggtcctggggtcccaggagggcgccatgcatacggccttaacgggagcaacggagatccagaatagcggcgggacatccatcttcgccggccacctaaaatgcaggttgaagatggacaagttagagttaaagggcatgagctacgcgatgtgcacaaacacgtttgtcctcaagaaggaggtgtccgaaacacagcatgggaccatcctcataaaggtggagtataagggggaggatgcgccctgcaagattcccttcagcaccgaggacgggcagggcaaggcccacaatggacgcctcataactgcaaatcccgtcgtaaccaaaaaggacgagccggtaaacatagaggccgaaccgcccttcggagagtcaaatatcgtcattggcattggggacaacgccctcaagataaactggtacaaaaagggttccagcatcgggaagatgtttgaggcaaccgctcggggtgcccgacggatggccatactgggcgataccgcatgggatttcgggtccgtcggcggggtgctcaacagcctgggcaagatggttcaccaaatctttgggtcagcttacactgccctgttcagcggcgtgtcctgggtcatgaagatcgggatcggggttttacttacctggatcggcctgaacagcaaaaatacctccatgagcttctcctgcatcgctatcggtatcatcaccctctacctgggcgccgtggtgcaggcggacatgggctgcgtgatcaactggaaaggcaaagaactgaaatgcggctccgggatcttcgtgaccaatgaagtgcacacctggaccgaacaatataagttccaggcggactcgcccaagcgcctcgccaccgccattgccggagcgtgggagaacggggtctgtggcattcgcagcacgactcggatggagaatttactgtggaagcaggtcgccaacgagctcaactacatcctatgggaaaacaatatcaagttaaccgtagtcgtaggggacataatcggcgtcttagagcagggtaagcgcactctgacgccccaaccgatggagctgaagtactcttggaagacctgggggaaagcgaagattgtcaccgccgaaactcagaacagctctttcatcatcgatggacccaatacgccagagtgccctagcgcttcccgagcttggaacgtgtgggaagtggaggactacgggttcggcgtatttaccacaaacatttggctcaaattgcgcgaggtttatacccagctgtgcgaccaccggttgatgagcgcagccgtcaaagacgaacgtgccgtgcacgcagatatgggctactggatcgagagccagaagaatgggtcctggaaactggaaaaggcctctctgatagaggttaagacgtgcacgtggccgaagtcccacacactctggagtaacggcgtgcttgaatccgacatgatcattcccaagtcactggccgggcccatttcccagcataatcaccgcccgggctaccacacccagacggccgggccgtggcacctcggcaagctggagctagacttcaactattgcgaaggcacgaccgtggttatcaccgagaattgcgggacccgcggccccagcctcaggacgacaaccgtgagtgggaaattaatccacgagtggtgctgtcgcagctgcaccctacccccgcttcggtacatgggcgaggatggatgctggtacgggatggagatccgccccatctccgaaaaggaggagaacatggtgaagtcgctcgtgagtgccggcagcgggaaggtagataacttcacgatgggcgtcctgtgcctcgcgatcctgttcgaagaggttatgcggggcaagttcggcaagaaacacatgatcgccggggtgttcttcatgttcgtgctgctcctgtcgggacagataacgtggcgcgacatggcccacaccctgataatgatcgggagcaacgcctccgaccggatgggcatgggcgtcacgtacctcgccttaatagcgacgttcaaaatccagcccttcctggccctaggatttttcctgaggaaacttaccagccgcgagaaccttctgttaggagtaggccttgccatggccaccaccctgcaattgcccgaggatatcgaacagatggcaaacggcatagccctcggcctgatggccctgaaactcataacgcagtttgagacctaccaactgtggaccgctctgatcagcctgacctgttccaatacaatgttcactctgactgtcgcatggcgtacagcgacgctaatcctggccggggtaagcctgctgccggtctgtcagtccagctccatgcgtaagaccgattggctccccatggcggtggccgccatgggcgtgcccccgctccctcttttcattttcagtttaaaggacaccctaaagaggcgctcctggccgcttaatgaaggggtcatggcggtaggcttagtgagcattctggcctccagcctactaagaaacgacgtccccatggccggcccattagttgccggaggcctgctcatcgcctgctacgtgattacagggacttcggcggacctaacagtggagaaggccgccgacatcacctgggaggaggaggccgagcagaccggcgtgagccacaatctgatgatcacggtcgacgacgacgggactatgagaatcaaggatgatgagaccgagaacatcctcaccgtactgcttaagaccgctctcctcatcgtgtccggcgtgttcccgtacagtatccccgcaacccttctcgtctggcacacgtggcagaaacagacccaacggtcgggagtgctgtgggacgtgcctagcccgccagagacccagaaggccgagctggaggagggtgtctatcggatcaagcagcaagggatcttcgggaagacgcaagtgggcgtgggggtccagaaggagggcgtcttccacaccatgtggcatgttaccagaggggcggtcctcacctacaacggcaagcgactggagcccaactgggcctctgtcaagaaggatcttatctcttatggtgggggctggcggctctcagctcaatggcagaagggggaggaggtgcaggtcatcgccgtggagcctggcaagaaccccaagaattttcagaccatgccgggcacattccaaaccactactggggagatcggcgccatcgccctggatttcaagccagggaccagcggtagccctatcatcaaccgcgaaggaaaagttgtcggtctgtacggcaatggggtggtgaccaaaaacggaggatatgtatccggcattgcccagaccaacgcggaaccggacggccccacgccagagctggaggaagagatgttcaagaagcgaaacttaaccataatggacctgcatcccgggagcggtaagaccagaaagtacttacctgccatcgtgagagaggccatcaagagacggctccgcacactgattctggcccccacgcgggtagtcgccgcggagatggaggaggccctcaaggggttgccgataagataccaaaccaccgccacgaagagtgaacatacgggccgggaaatcgtagacctgatgtgccacgccactttcaccatgagactcctaagccccgtgcgggtgccgaattataatctgattatcatggatgaggcccacttcacggaccccgcttctatcgccgcccgcgggtacatcagtacgcgggtgggcatgggcgaggcggccgccatcttcatgaccgccacgcctcccggaaccgcggacgcattcccgcagtctaacgcgccaatccaagacgaggagcgagacattcccgaaagaagctggaactccgggaacgagtggataaccgatttcgccggtaagacagtgtggttcgttccctcaattaaggccggcaatgatatcgccaactgtctgagaaagaacgggaagaaggtgatccagctgtcccgaaagaccttcgacaccgaataccagaagacgaagttaaacgactgggacttcgtggtaaccaccgacatcagcgaaatgggcgcgaatttcaaggcggaccgggtgatcgatccccgacggtgtctcaagcccgtgatcctgaccgacggccccgagcgcgtcattctggccgggccaatgccggtaacggccgcctccgccgctcagcggcgcggtcgagttgggcgcaatcctcagaaggaaaacgaccagtatatatttaccggccagccattgaacaacgatgaggaccacgctcattggacagaggccaaaatgttgctggacaacatcaacacccccgaggggatcatcccggctttattcgagccagagcgcgaaaagagtgccgccatagatggcgagtaccgcctgaagggcgagtcccgaaagacgttcgtcgagctgatgcgccgcggggacctgcccgtttggctggcgcataaggttgctagcgaaggcattaagtatacggaccggaagtggtgctttgacgggcagaggaacaaccagatcctggaggagaacatggacgttgagatctggaccaaggagggggagaagaagaagttgcgccctcgttggctggacgcccgcacatactccgatccgctggcgctcaaggagttcaaggatttcgcggcggggcgcaagagcatcgctctggacctagtgaccgagatcggccgagtacccagtcatctcgcccaccgcactcggaatgcgctggacaacctagtgatgctccacacaagcgagcacggcgggcgcgcttaccggcacgccgtggaggagctgcccgagaccatggaaaccctgctcctgctgggcctcatgattttgctcaccggcggggccatgctgttcctaatcagcggcaaagggatcggcaagacatccatcgggctgatctgtgtgatcgccagcagcggcatgctctggatggcagagatcccgcttcaatggatagcctccgcgatcgtgctggagttcttcatgatggtgctcctgattccagaacccgagaagcagcgcacgccgcaggacaaccagctggcctacgtcgttatcggcatcctcaccttggccgcgatcatcgccgccaacgagatgggtctgcttgaaaccacaaaacgagacttgggtatgtccaaggagcccggggtggtatctccgaccagttatttggacgtcgacctccaccccgcctctgcgtggactctgtatgccgttgcaacgaccgtcattacccccatgttgaggcacaccatcgagaactccactgccaatgtcagcttagccgcgatcgccaaccaagccgtagtcctcatgggcctggacaaggggtggcctatatccaaaatggacctcggcgtgcctctactggcgctcgggtgctactcacaggtgaacccccttaccctaacagccgcggtccttctgctgatcactcattacgccataattggccccgggctgcaagcgaaagcgacgagagaggcgcagaagcgcaccgcggcaggaatcatgaaaaacccgacagtggacggcataatgacaatcgacttagaccccgtgatatacgactctaagtttgagaagcaactgggacaggtaatgctcctggtgctgtgtgccgtgcagctccttctgatgcggacaagctgggccctctgcgaggcgctgaccctggccacaggccccatcaccactctctgggagggcagccccgggaagttctggaacaccaccatcgccgttagcatggcgaatattttccgcgggtcctacctggccggggctggcctggcctttagcatcatgaagtccgtcggaaccggcaaacgcggcaccgggagccagggggagaccctcggggagaagtggaagaagaagctgaaccagttgagccgcaaagagttcgacctctacaaaaagtcagggatcaccgaggtcgaccggacggaggcgaaggagggactgaagcgcggcgagaccacgcaccacgctgtcagccgtggctccgcgaagctgcaatggttcgtggagcggaacatggtaatccccgaggggagagtcatcgatctcggctgcggacgcgggggatggagctactattgtgcgggattaaagaaagtgaccgaggtgcgaggctatacgaaaggagggccggggcatgaggagcccgtccccatgagcacttacggatggaacatcattaagctgatgagcggtaaggacgtgttttacttaccgcccgagaagtgtgacacgctgctgtgcgatataggcgagtcctcaccgtcccccaccgtggaggagagccggactataagggtcctgaaaatggtggagccgtggttaaagaacaaccagttctgcatcaaaatattgaatccctacatgccgaccgtgattgagcacctggaacggcttcagcgcaagcatggcgggatgctggtgcggaaccccctgtcccgaaacagcacacatgagatgtactggatcagcaacggcacaggcaacattgtggcatcggtaaatatggtatcccggctcctgctgaacaggttcacgatgacccaccggcgcccgacgatcgagaaggacgtagaccttggcgccggcacccggcatgtcaacgccgagccggagacccccaacatggacgtaatcggggagcgcattaagagaatcaaggaggaacacaacagcacctggcattacgacgacgagaacccctataagacttgggcgtaccacggttcgtatgaggtgaaggcgacgggaagcgcctccagcatgatcaacggcgtggtcaagctgctgaccaagccatgggacgtcgtccccatggttacccagatggcaatgacggataccacccccttcgggcagcagcgcgtgttcaaggagaaagtcgacacccgcacgccgcgtagcatgcctggaacacgcagggtcatgggtatcaccgccgaatggctttggcgtactctgggacgcaacaagaagccacgcctgtgcacgcgcgaggagttcaccaaaaaggtcaggaccaacgcggccatgggcgccgtatttaccgaggagaaccagtgggattccgccaaggccgctgtcgaagatgaagacttctggaaactcgtggaccgcgagcgcgagctgcataagctggggaagtgcggctcctgcgtctacaacatgatggggaagcgggagaagaagctaggcgagtttggcaaggcaaagggctcccgcgccatttggtacatgtggctgggggccagatatctggagttcgaggccctagggttcctgaatgaggaccactggttcagtcgcgaaaactcctacagcggtgtggagggggagggcctacacaaactcggctacatcctgcgggacatctcgaagatacccgggggcgcgatgtatgcagacgacacggcaggatgggacactcgcattactgaagacgacctgcataacgaagagaagatcacccaacagatggacccggagcatagacagttggccaatgccatctttaagctgacctaccaaaacaaggtggtgaaggtgcagcgccctacgcccaccggcaccgtgatggacataatcagccggaaggaccagcgcgggtccggtcaggtcggcacctacggtttaaatacgttcactaacatggaggctcagctcatacggcagatggagggcgagggggtgttaagcaaggccgacctggaaaatccacacctcccggagaaaaagatcacccagtggctggagaccaagggcgtggagcgacttaagcgaatggccatctccggggacgactgcgtcgtgaagcccatcgacgaccgctttgccaacgccctcctggcgctgaatgacatgggcaaggtgcgtaaggacatcccccagtggcagcctagcaaaggctggcacgactggcagcaggtcccgttctgcagccaccactttcacgaactcataatgaaagacgggcgcaagctggtggtgccttgccggccccaggacgagttaatagggcgggcgaggatcagccagggggccgggtggtccctccgcgagactgcctgtctgggcaaggcgtacgcccagatgtggagcctgatgtacttccaccgccgggacctccgccttgcctccaatgcgatctgcagcgcggtccccgttcactgggtgccgacctcccggaccacctggagcatccacgcgcaccaccaatggatgacaaccgaagacatgctgaccgtctggaaccgcgtgtggatcgaggacaacccctggatggaggacaagacccccgtaacgacctgggaggacgtcccctacctcgggaagcgggaggaccagtggtgcggtagcctgatcggcctaacctcacgcgcaacctgggcacagaacatcccgaccgccatccaacaggtcaggagcctcatcggcaacgaggagtttctggactacatgccctccatgaagagattccgaaaggaggaagagtcggagggggcaatatggtga

SEQ ID NO: 25681 - RNA, 9873 nt, synthetic construct
  misc_feature 1..9873: note = derived and/or modified CDS sequence (opt11) from DENV-3__FJ850083__SS-prME
  source 1..9873: mol_type = other RNA
accagcctatgcctcatgatgatactgcccgcggccctggcgttccacctcaccagccgggatggggaaccccgcatgatcgtgggaaaaaacgagcggggcaaaagcctcctgttcaagaccgccagtggcatcaacatgtgcaccctcatcgccatggacctgggcgaaatgtgcgatgacacagtgacctacaagtgcccccacatcacggaggtggagcccgaagacattgactgctggtgcaatctgacaagcacctgggtgacctacgggacgtgcaaccaggccggcgagcaccggcgcgataaacggtccgtggcgctcgcgccccatgttggcatggggctggacacccgcacccagacatggatgagcgccgagggcgcctggcgtcaggtggagaaggttgagacatgggctttgcgccacccggggttcactatcctcgcactgttccttgcccactacatcggcacctccctgacccaaaaggttgtgatattcatcctactaatgctcgtcacgcctagcatgaccatgcggtgcgtaggtgtgggtaacagagatttcgtcgagggcttgtccggggcgacctgggtggacgtggtcctggagcacggaggatgcgtgaccacgatggccaagaacaagccaacactcgacatcgagcttcagaagaccgaagccacccagctggcgacgctccggaaactgtgcattgagggcaagataaccaacatcaccaccgacagccgctgccccacgcaaggcgaggcggtgcttccggaggagcaggaccagaactacgtctgcaagcatacttatgtggaccgcggatggggcaacgggtgcggcttattcgggaagggctccttagtgacttgcgccaaattccagtgcctggagcccatcgaaggcaaggtcgtgcagcacgagaacctcaagtacaccgttatcattacggtccacaccggggaccagcaccaggtgggtaacgagacccagggggtcacggctgagatcacgccacaagccagcaccaccgaagcgatcctgcccgagtatggcaccctggggctcgagtgttccccgcgcaccggcctggactttaacgagatgatcctcctcacgatgaagaacaaagcctggatggttcaccggcaatggttcttcgacctgccgctgccctggaccagcggcgccaccacggagacgcccacctggaaccgcaaggaacttctggtgaccttcaagaacgcacacgccaagaaacaggaggtcgtggtgctggggtcccaggaaggcgcgatgcacaccgccctcaccggtgccaccgaaatccagaacagcggcgggacctccatcttcgccggtcacctgaagtgccgactgaaaatggataagctagagctgaagggcatgagctacgccatgtgcaccaacacatttgtcctgaagcgcgaagtgtctgaaacccagcacgggaccatcctcatcaaggtagagtacaagggcgaggacgcgccgtgcaagatccccttcagcaccgaggacggacagggcaaagcccacaacggtcggctgatcactgcgaatcccgtcgtgaccaagaaggacgagcccgtgaacatcgaggctgagccgcccttcggtgagagcaacatcgtcatcggcatcggtgacaacgcgctgaagatcaattggtataagaagggttccagcatcgggaaaatgttcgaggccaccgcccgcggcgcccggcgcatggccatcctgggcgataccgcgtgggacttcggctccgttggcggtgttctgaacagcctgggcaagatggtccaccagatcttcgggtcagcctacacggccctgttcagcggcgtgtcctgggtgatgaaaatcggcatcggggtcctgctgacctggatcggcctgaactctaaaaacacctccatgagcttctcctgcatcgctatcggtaccatcacgctctacctgggcgccgtagtgcaagctgacatggggtgcgtcatcaactggaagggcaaggaactaaaatgtggaagtgggatcttcgtaaccaacgaggtgcacacctggaccgagcagtacaagttccaggccgactcccccaagcgccttgccacggctatcgccggcgcgtgggagaacggggtttgcggcatcagaagcactaccaggatggaaaacttgctgtggaagcagatcgccaatgagctcaactacattctctgggaaaacaacataaagctgacggtagtggtcggagacatcatcggagtgctcgagcagggcaaacggacgcttacgccccagccgatggaactgaagtattcctggaagacctgggggaaggctaagatcgtgaccgctgagacgcagaacagctccttcattatcgacggcccgaacacccccgagtgccccagcgcctccagggcctggaacgtctgggaggtggaggactacgggttcggcgtgtttactaccaatatctggctgaagcttcgggaggtctacacccaactgtgcgaccaccgcctcatgagcgccgctgtgaaggatgagcgggccgtccacgcggacatgggctactggattgagagccagaagaatggatcctggaagctggagaaggccagcctgattgaggtgaagacgtgcacctggccgaagtcccacaccctctggagcaacggcgtgctggagagcgacatgatcatccccaagagcctggccgggcctatctctcagcacaaccacaggccgggctaccacacccagacggccggcccctggcacctaggcaagctggagctggacttcaactactgcgagggcaccaccgtcgtcatcactgaaaactgcgggacgagggggcctagcctcaggaccaccaccgtgtcgggtaagttgatccacgagtggtgctgcagaagctgtacgctgcccccgttacgctacatgggtgaggatgggtgctggtacggtatggagatccgtcccatcagcgagaaagaggagaacatggtcaagagcctggtttccgccggcagcgggaaggtggacaacttcaccatgggcgtgctatgcctcgcgatactgtttgaggaggtgatgcgcgggaagttcggcaaaaagcacatgattgccggagtgttcttcaccttcgtgctgctcctttccggccagatcacctggcgcgatatggctcatacgctcatcatgatcggctcaaacgcctccgacaggatggggatgggcgtgacctatctcgccctgatcgcgaccttcaagatccaacccttccttgcccttgggttctttttacgtaagttgacaagcagagagaacctcctgctgggcgtgggcctagccatggccacgaccctgcagctgcctgaggacatagaacagatggcgaacgggatagccctcggcctaatggccctgaaacttatcacccagttcgaaacttaccagctatggacggccctgatcagtctgacctgctccaacacaatgttcaccttaaccgtggcctggcgtaccgcgacactgatacttgccggtgttagcctcctgccggtgtgccaatccagctccatgcgcaaaaccgactggctccccatggccgtcgctgccatgggcgtgccccccttgccgctgttcatcttcagcttaaaggacacgctgaagcgccggtcctggcccttaaatgaaggggtgatggcggtcggcctcgtgtctatcctggcctcctccctgttgcgcaacgacgtgcccatggccggccccctggtcgccgggggcctgcttatagcgtgctatgttatcaccgggacctccgcggacttaacagtggagaaggcagccgacatcacgtgggaggaagaggccgagcaaaccggcgtcagccacaacttgatgatcaccgtggacgacgacggaaccatgcggattaaggacgacgagaccgagaacatcctcacggtgctcctgaagaccgccctcctgatagtctccggcgtgttcccgtacagcatccctgcgaccctgctcgtctggcacacctggcagaagcaaactcagcgctctggcgtcctgtgggacgtgcccagcccgccagagacccagaaagcggagctagaggaaggcgtgtacagaatcaaacagcagggtatcttcgggaaaacccaggtcggcgtgggggtgcagaaagagggcgtattccataccatgtggcacgtgacgcgaggcgccgtgctcacctacaacgggaagaggctggaacccaactgggcatccgttaagaaggacctgatcagctacggcgggggctggcgcctctccgcgcagtggcagaagggagaggaggtacaggtgatcgccgttgagcccggcaagaaccccaagaactttcagaccatgcccggcaccttccagacgaccaccggggagatcggcgcgatcgccctggacttcaagcccgggacaagcggcagccccataatcaaccgggagggcaaggtagttgggctgtacggcaacggggttgtgactaagaacggcgggtacgtgtccggcatcgcccaaaccaatgcggaaccggacggccccacccccgagctggaggaggagatgttcaaaaagcgcaacctcaccatcatggacttgcatcccggaagcggcaagacgagaaagtacctgccggccatcgtccgtgaggccatcaagcggcgcctccggaccctgatcttggcccccacgcgcgtggtggccgcggagatggaggaggcccttaaaggcctgcccatccggtaccaaaccacggctaccaagtccgagcataccggccgcgagatcgttgacctgatgtgtcacgccacgttcaccatgaggctgctgagccccgtgagggtgcctaactacaacctgatcatcatggatgaggcccacttcactgaccccgcatccattgccgcacggggatacatcagcactcgcgtcggcatgggcgaggccgctgctatcttcatgaccgccacgccgcccggtaccgccgatgccttccctcaatccaacgcgcccatccaggacgaggagcgcgacatccccgagcggagctggaactccggcaacgagtggatcactgacttcgcgggtaagaccgtgtggttcgtacccagcatcaaggccggcaacgacatcgccaactgcctccgcaagaacgggaagaaggtcatacagctgtcccgcaagacgttcgataccgagtaccagaagactaagctgaacgactgggacttcgtggtgactacagacatcagcgagatgggcgccaacttcaaggctgaccgcgtcatcgacccgcggcgctgcctcaagcctgtaatcctgaccgacggccccgagagggtgatcctggccgggccgatgccggtcaccgccgccagtgccgcgcagcgccggggccgcgtggggcggaaccctcagaaggaaaacgaccagtacatcttcactggccagcctctcaacaacgacgaggaccatgcccactggacagaggccaaaatgctgctggacaacattaacacgcccgagggcatcattccagccttattcgagcctgagcgcgaaaaatccgcggccattgacggtgagtaccggctgaagggtgagtcccgcaagaccttcgtggaactgatgcggcgcggggatctccctgtctggctggcccacaaggtggccagcgagggcataaagtacaccgatcggaagtggtgttttgacgggcagcgcaacaaccagatcctggaagagaacatggacgtcgagatctggaccaaggagggcgagaagaagaagctccggccccgctggctggacgctcgcacgtattccgacccgctagcgctcaaggagtttaaggatttcgccgccggccgcaaaagcatcgctctggacctggtgaccgagatcgggcgcgtgccctcgcacctagcccatcggacacgcaacgcgctggataaccttgtgatgctccacacctcagagcacggggggcgggcctaccgccacgcagtggaggaactgcccgagactatggagaccttacttctgctgggcctcatgatcctgctgactgggggtgccatgctttttttaatcagcgggaaagggatcggcaagacgtccatcgggctgatatgtgttatcgccagctccggcatgctctggatggcggagatcccgctacagtggatcgccagcgccatagtactggaattcttcatgatggtgctcctgatcccggagcccgagaagcagcggacgccccaggacaaccagctggcttacgtagtaatcgggatactcaccctggccgctatcatcgccgccaatgagatgggtctgctcgagaccaccaagcgcgacctgggcatgtccaaggagccgggggtggtgagcccgacgagctatcttgacgtggacctccaccccgcaagcgcgtggacattgtacgcggtggccaccaccgtcatcacccccatgctgcggcacaccatcgagaactcaaccgctaacgttagcctcgccgcgatcgccaaccaagcagtggtacttatgggcctagacaaagggtggcccatctccaaaatggacttaggcgtgcccctgctggccctcgggtgctacagccaggttaaccccctgacgctgactgcagcggtgctactgctgatcacccactacgccatcatcggccccggcctccaagccaaggcaacacgcgaagcccagaagcggaccgcggccgggatcatgaaaaatccaacggtagacggcatcatgaccatcgacttagacccagtgatctacgattccaagttcgagaaacagctgggacaggtgatgctcctggtcctatgtgccgtgcagctcctgctgatgcgtaccagttgggccctctgcgaagccctgacattagccacaggacccatcaccaccctctgggaggggtcccccgggaagttctggaacactacgatcgccgtgagcatggcaaacattttccggggcagttacctggccggggctggcctggccttcagcatcatgaagtctgtcggaaccggcaagcgcggcaccgggagccagggcgagaccctcggggagaagtggaagaaaaagctgaaccagctgagccggaaggagttcgatctctacaagaagtccggcatcaccgaagtggaccgcacggaggccaaagaggggctgaagcggggcgagaccacccaccacgcagtgtcacgaggcagtgcgaagcttcaatggttcgtcgaacggaatatggtgatcccggagggacgcgtgatcgacctcggttgcggtcggggcggttggtcgtactactgcgcaggcctcaagaaggtcaccgaggtacgcgggtacacaaaaggcgggcccgggcacgaggagcctgtgcccatgtcgacttacggctggaacattgtcaagcttatgagtgggaaggacgtcttctacctcccgcccgagaagtgtgacaccttactgtgcgacatcggcgagtccagcccctcccccaccgtggaggagagcaggacgattcgcgttctgaagatggtggagccgtggctcaagaacaaccagttctgcattaaaatcttaaacccgtacatgcccaccgtgatcgagcacctagaacgcttgcagcggaagcacggcgggatgctggtccggaatcccctgtcccggaacagcacccacgagatgtactggatctccaacggaaccgggaacatcgtggcctccgtgaacatggtctcccgcctcctactgaaccggttcacgatgacgcatcgccggccgactatcgaaaaggacgtggacctcggcgccggtacccgccacgtgaacgccgagcccgaaacgcccaacatggatgtcataggggaacggatcaagcgcatcaaggaagagcacaatagcacttggcattacgacgatgaaaatccgtacaagacctgggcctaccacggctcctacgaggtgaaggcgaccgggagcgcctccagcatgatcaatggcgtggtcaagttactcactaagccctgggacgtggtccctatggtgacccagatggccatgaccgacaccacgcccttcgggcagcagcgcgtgtttaaagagaaggtagacacccgcactccgcggagcatgcccggcacacgccgggtgatgggcatcactgccgagtggctctggcgaaccttagggcggaacaagaagccccgcttgtgcacccgcgaggaattcaccaaaaaggtgagaacgaacgcggccatgggggctgttttcaccgaagagaaccagtgggactccgcaaaggccgcggtggaggacgaggacttctggaagcttgtggatcgggagcgggagctgcacaagctaggaaagtgcggctcatgcgtctacaatatgatggggaagcgcgagaagaagctgggcgagttcggcaaggccaagggtagtcgggccatctggtacatgtggctgggcgcccgctatctggaatttgaggccctcgggttcttaaatgaggatcactggttcagcagagagaactcctacagcggggtggagggggagggtctgcacaagctcggatacatcctgcgcgacatatcaaaaatccctgggggcgcgatgtacgccgacgacaccgctggctgggacacccggattacggaagatgatctgcacaatgaagagaagattacccagcagatggacccggagcatcgccagctcgccaacgccatcttcaagctgacctaccagaacaaggttgtcaaggtgcagcggcccaccccaacgggcacggtgatggacatcataagccgcaaggaccaacggggctcgggtcaggtaggcacttacgggttaaacaccttcaccaacatggaggcgcagctcatccgccagatggaaggagagggggtgctgagcaaagcagacttggagaacccacacctcccggagaagaagataacgcagtggctagagaccaagggagtcgagaggctaaagcgcatggccatctcgggcgacgactgcgtcgtgaagccaatcgacgaccgtttcgccaacgccctcctggcgctgaatgacatggggaaggttcgcaaggacatcccccaatggcagccgagtaagggctggcacgactggcagcaggtccccttctgctcccaccacttccacgagctcatcatgaaggacgggcggaaactggtggtgccctgccgaccgcaggacgagctgattggccgagccagaatcagccagggcgccggctggtccctccgcgaaaccgcctgcctcggcaaggcatatgcccaaatgtggagtctgatgtacttccacagacgagatctccggttagcctcgaacgccatttgcagcgcggtccccgtgcactgggtgccgacctcccgtactacctggagcatccacgcacaccatcagtggatgaccacagaagacatgctgacggtctggaacagggtgtggatagaggacaacccctggatggaggacaagacccccgtgaccacctgggaggacgtgccgtacctcgggaagagagaggaccagtggtgcggctcactgatcgggctgacgtcccgggctacgtgggcccagaacatcccgactgccatccagcaggtccgcagtctcatcggcaacgaggagtttctagactacatgccctccatgaaacggttccgcaaggaggaggagagcgaaggggccatttggtga

SEQ ID NO: 25682 - RNA, 9873 nt, synthetic construct
  misc_feature 1..9873: note = derived and/or modified CDS sequence (opt11) from DENV-3__FJ850086__SS-prME
  source 1..9873: mol_type = other RNA
accagtctctgcctcatgatgatcctgcccgcggcactggcgttccacctcaccagccgagacggcgaaccccggatgatcgtgggaaagaacgagcggggcaagagcctgctattcaagaccgcgtccggcatcaacatgtgcacccttatcgccatggacctgggggagatgtgcgacgacaccgtgacctacaagtgcccccacatcacggaggtggagcccgaggacatagactgctggtgcaacctaacaagcacctgggtgacctatgggacctgcaaccaggctggcgagcaccggcgcgacaaacggtccgtggccctcgcaccgcatgtcggcatggggctcgacacacgcacgcaaacctggatgagcgcggagggagcctggaggcaggtggagaaggtcgagacgtgggccctgcgccacccgggtttcaccatcctcgcgctgttcctcgcccactacatcggcacgtccctcacccaaaaggtggttatcttcatcctgcttatgctcgtcacgccaagcatgaccatgcgttgtgtgggagtgggcaaccgcgacttcgtcgaggggctgagtggagccacctgggtggacgttgtcctggagcacggcggttgcgtgaccaccatggcgaagaacaagcccaccctcgacatcgagctgcaaaagacggaggccacacagttggcgacgctcagaaaactgtgcatcgagggcaagattaccaatataacaacagactctcgctgtcctacgcagggcgaggccgtgctgccggaggagcaggaccagaactacgtctgcaagcacacctacgttgaccggggctggggcaacgggtgcggactcttcgggaagggctccctggtgacgtgcgccaaatttcagtgcctcgagcccatcgagggcaaagtcgtgcaatacgagaacctcaagtatactgtaatcattacagtgcacacaggcgaccagcatcaggtgggcaacgagacccagggggtaaccgctgagatcacgccccaggcaagcaccaccgaagcgatcctgcctgagtatggcaccctggggctagagtgcagcccgagggctggccttgacttcaacgaaatgattctgctcaccatgaagaacaaggcctggatggtgcaccggcagtggttcttcgatttgcccctgccctggacgagcggcgccacgaccgagacccccacttggaatcgcaaagagcttttggtcactttcaagaacgcacatgcgaaaaagcaggaggttgtggtgttggggtcccaggagggcgcgatgcacaccgccctcaccggggccacggagatccagaatagcggcgggacgtccatattcgcgggccacctgaagtgtcggctgaagatggacaagctcgagctgaagggcatgtcatacgcgatgtgcaccaacacgttcgtcctgaagaaggaggtgtccgagacgcaacacgggactatcctcatcaaggtggagtacaagggcgaggacgccccgtgcaagatccccttctccactgaagacggacagggcaaggcacacaacggccgcttgatcaccgccaaccctgttgtgacgaagaaggacgagcccgtgaacatcgaggcggagccgccattcggggaaagcaacattgtcatcggcatcggtgataatgcccttaagatcaactggtacaagaagggcagcagcatcggaaagatgttcgaggccaccgcccggggcgcccgtcggatggcgatcttgggagacacggcatgggattttgggtccgttggcggggtgctcaacagcctgggcaaaaccgtccatcagattttcgggtctgcctacacggccctgttctctggcgtgtcctgggtgatgaagatcggcattggggtccttctaacctggattggcctgaacagcaagaacacgtccatgtctttctcttgcattgccatcgggatcatcaccctatacctgggggcggtggtgcaggcggatatggggtgcgtgataaattggaaaggcaaggagctgaaatgcggcagcgggatcttcgtgactaacgaggtacacacctggaccgagcagtataagtttcaggcggactcccccaagcgtctcgcgaccgccatcgccggcgcctgggagaacggggtctgcggcatccgctctacaacccggatggagaacctgctgtggaagcaggtcgccaacgagctgaattacatcctatgggagaacaacattaagctgaccgtggtcgtgggggatatcatcggcgtgctcgagcagggcaagcgcaccctgacgccccaaccgatggaactgaagtactcctggaagacttgggggaaggccaagatcgtcaccgcggagacacagaacagcagtttcatcatcgacggccctaacacgcccgagtgcccctcagccagtcgggcatggaatgtgtgggaggtagaggactacgggttcggcgtcttcaccactaacatctggcttaagttacgcgaggtgtacacccaactgtgcgatcaccggctcatgagcgccgcagtgaaggacgagcgcgcggtccacgccgacatgggttactggatcgagagccaaaagaacgggtcttggaagttagagaaggcctccctgattgaggtgaagacttgcacctggccgaagagtcacaccctctggagcaacggcgtgctggagtctgatatgatcatacccaagtccctggctgggcccatctctcagcataaccatcggcccggctaccatacacagaccgccgggccttggcacctcggcaagctggagctggattttaactattgcgagggcacgaccgtagtgattacagagaactgcgggacccgtggacccagcttacggactaccaccgtgtccggcaaactaatccacgaatggtgctgccgcagctgcacgctgcctcccttacggtacatgggcgaggacggatgctggtatggcatggagatacgccccatctccgagaaggaggagaacatggtcaagtcactcgtgtccgcgggcagcggtaaagtagacaactttacgatgggagtcttatgcctcgccatcctgttcgaagaggtgatgcgggggaagttcggcaagaagcacatgatcgccggagtattctttatgttcgtcctgctcctgtccgggcagatcacctggcgggacatggcccataccctgatcatgattggcagcaacgcctccgaccggatggggatgggtgtgacctacttagcgctgattgccaccttcaagatccagcccttcctggctcttgggtttttcctacgcaaactcacatcgcgagagaacctcctcctgggcgtgggtctcgcaatggcgactaccctgcagcttcccgaggacatcgaacaaatggccaacgggattgccttgggccttatggccctgaagctgatcacgcagttcgagacgtaccagctatggacagcactcataagcctgacctgctccaacacaatgttcaccctgaccgttgcgtggcgcacggccacgctcatcttagccggggttagcttgttgcccgtatgtcagtccagttccatgcggaagaccgattggctcccgatggccgtggccgcgatgggcgtgccgcccctccctttgtttattttttcgctcaaagacaccctgaaacgccgctcctggcccctgaatgagggggtgatggccgtgggcttagtgagcatcctggccagttcgctgttaaggaacgacgtacccatggcgggccccctggtggccgggggactgctcatcgcgtgctacgtgatcactgggacgtccgccgatctgaccgtcgagaaggccgccgacatcacctgggaggaagaggcggagcagaccggcgtgagccacaatctgatgatcactgtggacgacgacggcacaatgcgcatcaaggacgacgagacagagaacatcctcaccgttctgctgaagacggcgctcctgattgtgtctggggtgttcccgtacagcatccccgccacactgctcgtctggcacacctggcagaagcagacccagcggtccggcgtgctgtgggacgtccccagcccccctgagacccagaaggccgaattagaggaaggggtctaccgcatcaagcagcagggcatcttcgggaagacccaggtgggggtaggggtgcaaaaggagggcgtattccacaccatgtggcacgtgacacggggcgccgtcctaacctacaacgggaagcgcctggagcccaattgggcgtccgtgaaaaaagacctgatcagctacgggggaggctggcggctctccgcccagtggcagaagggcgaagaggtgcaggtcatcgccgtggagcccggaaagaaccccaaaaacttccagacgatgcccggcacgttccagaccaccaccggcgagatcggcgccattgccctcgacttcaagcctggcactagcggcagccccatcataaaccgcgagggaaaggtggtcggactttacggcaacggggtggtgaccaaaaacggcggttatgtctcggggatcgcgcagaccaacgccgagccagacggccccacgcccgagcttgaggaggagatgttcaagaagagaaatctcactatcatggatctgcaccccgggagcggcaaaacccggaagtacctacctgccatcgtgcgcgaagccattaaacgccggctccgcaccctgatactggctcccacgcgggtggtcgcggcggagatggaggaggccctaaaggggctgcccatccgctaccagacgaccgcgaccaagtccgagcacacgggccgggagattgtggaccttatgtgccacgccaccttcaccatgcgcctcctgagccccgtccgggtgcccaactataacctgatcatcatggacgaggcgcacttcaccgatcccgcctccatcgccgcccgcgggtatattagcacgcgtgtcggtatgggtgaggcggccgccatcttcatgaccgccacgccgccggggaccgccgacgcgttcccgcagtccaacgcccccatacaggacgaggagcgcgacattccggagcgcagttggaacagtggcaatgagtggattacggacttcgccgggaagaccgtgtggttcgtccccagcatcaaggccggcaacgacattgccaactgcctccgtaagaatggaaagaaggtgatccaactgtcccggaagaccttcgataccgagtaccagaagacaaaactgaacgactgggacttcgtggtcaccaccgacatcagcgagatgggcgcgaacttcaaggccgaccgggtaatcgacccgcgtaggtgtctaaagcccgtgattctgaccgacggcccagagcgcgttatattggccggtcccatgccggtgacagccgcctccgcggcacagcggcgcggtcgagttgggaggaatccccagaaagaaaacgaccagtacatcttcaccggccagcccctcaataacgacgaggaccatgcccattggaccgaggccaaaatgctgctggacaacatcaatacccccgagggcatcattcccgccctcttcgagcccgagcgagagaagtccgctgccatcgacggcgaatatcgccttaagggagagtcccggaagaccttcgtcgagctgatgcgccgaggggacctccctgtgtggctggcccacaaagtggccagcgagggcatcaaatacacagacagaaaatggtgtttcgatgggcagcggaacaaccagatcctggaggagaacatggacgtggagatctggacgaaggagggcgagaagaagaagctccgcccccgatggctggacgctaggacgtactccgacccgctagccctcaaggagtttaaggacttcgcagccggccggaagagcatcgccctggacctggtgacggagatcgggagggtcccctcccacctggcgcatcgcacgcgtaacgccctggataacctggtcatgctccataccagcgagcacggcggccgcgcctacaggcacgccgtggaagagctgcccgagaccatggagaccctgctcctgctgggcctgatgatcctgcttactggcggggccatgctgttcctgatatccggcaaggggataggcaagacatccatcgggctgatctgcgtcatcgccagttccggaatgctttggatggccgaaatcccgctgcagtggatcgccagtgcaatcgtgctggagttctttatgatggtcctgttaatccccgaaccggaaaaacagcgcaccccccaggataaccagctggcctacgtagtgatagggatcctcactctcgcggccatcatcgccgccaacgagatgggcctgctcgaaacgaccaagcgagacctaggcatgtctaaggagccgggcgtagtgagccccacctcctatcttgacgtggatctgcaccctgcgtccgcctggaccctgtatgccgtggccacaaccgtaatcacccccatgctgcgtcacacgatcgagaacagcacggccaacgtgagccttgcggccatcgcaaaccaagccgtggtgctaatgggcctggataaagggtggccgatctccaagatggatctaggcgtgcccctactggcgctcgggtgctacagccaggtgaaccccttaaccctgaccgcagccgtcctcctgctgatcacgcattacgccatcatcggtcccggcctccaggccaaggccaccagagaggcgcagaaacgtaccgccgccggcatcatgaagaacccgacggtggatgggatcatgactatcgacctggaccccgtgatctacgactcaaagttcgagaaacagttagggcaggttatgcttcttgtgctatgcgctgtgcagctcctgctgatgcgaacaagctgggcactctgcgaggccctgactctggccaccggcccgatcacgacgctctgggagggctcccccgggaagttctggaacaccaccatcgccgtcagcatggcgaacatattccgcggctcctacttagcgggggccggcctggccttcagcatcatgaaaagcgttgggaccggcaagcgaggcacggggagccagggcgagacccttggggagaaatggaaaaagaagttaaaccaactgagcaggaaagagttcgacctctacaagaaatccggcatcaccgaggtagaccggaccgaggccaaggaggggctgaaacgcggcgagaccacgcaccacgccgttagccggggcagtgcaaaactgcaatggtttgtggagcgcaacatggtgatccctgagggacgggtgatcgacctcggttgcggacgcggcgggtggtcatactactgtgccgggctgaagaaggtgaccgaagtccggggctataccaagggcggccccgggcatgaggagcccgtgcccatgtccacgtacggctggaacataatcaaactgatgtctggaaaggatgtattttacttaccgcccgagaaatgcgatacgctgctctgcgacatcggcgagagtagcccctccccaaccgtagaggaaagccggacgatccgcgtcctgaagatggtggaaccgtggctcaagaacaatcaattttgcatcaagatcctgaacccttacatgcccactgtcatcgagcacctggagcgactacagcgcaagcacggcgggatgctggtcaggaatcccctgtcccgcaacagcacgcacgagatgtactggatctctaacggcacggggaacatagttgcctctgttaacatggtctcccgactcctgcttaaccgcttcaccatgacccatcggcggccgacgatcgagaaggacgtggaccttggtgccggcacccggcacgtgaacgccgagcccgaaacccccaacatggacgtcatcggagagcgcatcaaacggatcaaggaggagcacaactcgacgtggcactacgacgacgagaatccgtacaagacgtgggcataccacggctcctacgaggtcaaggccactggttcagcctccagcatgatcaacggagtggtcaagctcctgacaaagccctgggacgtggtccctatggtgacccagatggccatgaccgataccactcccttcggccagcagagagtgtttaaggagaaggtcgacacccggacgccccgcagtatgccgggcacacggcgtgtaatggggatcaccgcggagtggctctggcggacgttggggcgcaataagaagcctcggttatgcacgcgcgaggaattcaccaagaaggtgcgtactaatgccgccatgggcgcagtctttaccgaggagaaccagtgggactccgccaaggcggccgtggaagacgaggacttctggaagctcgtcgaccgggaacgcgaactccacaagctggggaaatgcggctcttgcgtctacaacatgatggggaaacgggagaagaagctcggcgagttcggcaaggcgaaggggagcagggccatatggtacatgtggttaggcgcccggtacctggaattcgaagcgctcgggttcctgaacgaggaccactggttcagccgcgagaactcctacagcggcgttgagggggaaggattacacaagctcgggtacattctgcgggacatatccaagatccccggtggcgccatgtatgcggacgatacggccggctgggacacccgcatcaccgaggatgacctgcacaacgaggaaaagatcacccagcagatggacccggagcaccggcagctcgccaacgcgatttttaagcttacgtatcagaacaaggtcgtcaaagtgcagcgccccaccccaaccggcactgtcatggacatcatctcacggaaggaccagcgcggctctgggcaggtcggcacctatggactcaacacattcactaacatggaagcccagctcatccgccagatggagggcgaaggggtgctaagcaaggccgacctggagaacccgcacctcccagagaaaaagatcacacagtggctggaaactaaaggcgttgagcggctgaagcggatggccatctccggcgatgactgcgtggtgaaacccattgacgaccgcttcgccaacgcgctattagcgttaaatgacatggggaaggtgcggaaggacataccccagtggcagccgagcaaggggtggcacgattggcagcaggtcccgttctgctcacatcactttcatgagctcatcatgaaggacgggcgcaagctggtggttccctgtcggccccaggatgaactaatcggccgcgcccgaatcagccaaggcgcgggatggtccctccgcgagacggcatgcctaggcaaggcctacgcccagatgtggtctttgatgtactttcaccgccgggacctccgcctcgcctccaacgccatctgcagcgcggtccccgttcattgggtgccgacctcccgcaccacctggagcatccacgcacaccaccaatggatgactaccgaggacatgctgaccgtctggaaccgtgtgtggatagaggacaatccttggatggaggataagacccccgtgacgacctgggaggacgtaccctacttggggaaacgggaagaccagtggtgcggatctctgatcgggctgacctcccgcgccacctgggcccagaacatcccaacagccatccaacaggtgcggagcctaatcggcaacgaggagttcctggactacatgccctccatgaaacggttccgaaaggaagaagagagcgagggggcgatatggtga

SEQ ID NO: 25683 - RNA, 9873 nt, synthetic construct
  misc_feature 1..9873: note = derived and/or modified CDS sequence (opt11) from DENV-3__FJ850089__SS-prME
  source 1..9873: mol_type = other RNA
accagcctctgcctcatgatgatactgcctgccgccctggcgttccacctaaccagcagggacggggagccgagaatgatcgtggggaaaaacgagcgcggcaagtcactgctgtttaagaccgcatccggcattaacatgtgcactctcatcgccatggatctgggcgagatgtgcgacgacaccgttacctacaagtgcccccacataaccgaggtggagcccgaagacatcgactgctggtgcaacctgaccagcacatgggttacctacgggacctgtaaccaagccggcgagcaccggcgcgataagcggtcagttgccttggcgccccatgtgggcatggggctggacaccagaactcaaacatggatgagtgccgagggtgcctggcggcaggtcgagaaggtggagacgtgggccttgcgccacccagggttcaccatcctcgcactgttcctggcccactatatcggaacctccctcacccagaaggtggtgatatttatcttgctgatgctcgtcacgccctccatgaccatgcggtgcgtaggggtgggaaaccgagatttcgttgagggcctgtccggggccacatgggtagacgtggtcctggagcacggcggttgcgtgacgaccatggccaagaacaagcccaccctcgacatcgagctgcaaaagaccgaggccacgcagctggcgacgctccgaaagctgtgcatagagggcaagatcaccaatatcaccaccgatagccgctgccccacgcagggtgaggccgtgctgccggaggagcaggaccaaaactacgtctgcaaacacacctacgttgaccgggggtggggcaacgggtgcggcttattcgggaaggggagcctggtgacctgcgccaagttccagtgcctggaacccatcgagggaaaggtagtgcagcacgagaacctaaagtacaccgtgatcataacagtccacaccggggaccagcatcaggtgggcaacgaaacccagggggtcaccgccgagatcacgccccaagccagcaccaccgaggtgatactgcccgagtacggcacgctggggttggagtgctctccgcgcaccggcctggatttcaatgagatgatcctgctcacgatgaagaataaggcgtggatggtgcacaggcagtggttctttgacctgcccctgccctggacaagcggcgccaccaccgagacgcccacctggaatcgcaaggaactcctggtcaccttcaagaacgcccacgccaagaagcaggaggttgtggtcctgggctcccaggagggcgccatgcataccgcactcacgggcgctaccgagatccaaaacagtggcgggacctccatctttgccggtcacctgaagtgccggctgaagatggacaagctcgagctgaagggcatgagctatgccatgtgcactaacacgttcgtgctgaagaaggaggtctccgagacccagcacgggacgatactcattaaggtcgagtacaagggggaggatgcgccctgcaagattccattcagcaccgaggacgggcagggcaaggcgcataacggtcgccttatcacggccaatccagtggtaaccaagaaggacgagcccgtcaacatcgaggccgagccgccctttggggaatcgaacatcgtgatcggcatcggagacaacgctctgaagatcaactggtacaagaagggctcctcaatcgggaagatgttcgaggcgaccgcccggggcgcccgacggatggccatactaggcgacaccgcttgggacttcgggtctgtcggcggggtcctcaacagcctgggcaagatggtgcaccagatcttcgggtccgcgtacactgccctgttttccggtgtcagctgggtcatgaaggtgggcatcggggtgctgctgacctggatcggcctgaacagcaagaatacctcgatgagcttctcctgcatcgccatagggatcattaccctctacctgggcgcggtggtgcaggccgacatggggtgcgtgattaactggaagggcaaggagttaaagtgcggcagcgggatcttcgtcacgaacgaggtgcacacctggaccgagcagtataaattccaggcggactcgcccaagcgcctcgccaccgcgatcgccggcgcctgggagaacggagtgtgtggcatcaggagcacgacccggatggagaacttgctgtggaagcagatcgcgaatgaactcaactacatcctgtgggagaacaacatcaagttaaccgtcgtggtgggggatatcatcggcgtcctcgagcagggcaagcgcaccctgacgccccagccgatggagctgaagtactcgtggaagacctgggggaaggccaaaatcgtgaccgccgagacccagaacagcagcttcattatcgacggccccaacacgcccgagtgtccttctgcctcgcgcgcgtggaacgtgtgggaggtcgaagactacgggttcggcgtattcaccaccaacatctggctcaaactgcgcgaggtgtacactcagctgtgcgaccatcggctcatgagcgccgccgtcaaggacgagcgcgccgtgcacgctgacatgggctactggattgagagccaaaagaacgggtcctggaagctggagaaggcgtccctgatcgaggtgaagacctgcacgtggccgaaaagtcataccctgtggagcaacggtgtcctggagtccgacatgatcatccccaagagcctggccggtcccatctcccagcacaaccaccggccggggtatcacacccagaccgccgggccttggcacttaggaaagctggaactggacttcaactactgcgaaggcacgaccgtggtaatcaccgaaaactgcggtacccgcggtccctccctccggacgacaaccgtctccggtaagctaatccatgagtggtgctgccgcagctgcaccctgcccccgctccggtacatgggtgaagacgggtgctggtacgggatggagatccgccccatctccgagaaggaggagaacatggtcaagagcctggtgtccgccggcagcggaaaggtcgacaacttcacgatgggcgtgctgtgcctcgcgatcctgttcgaggaagtcatgcgggggaaatttggcaaaaagcacatgatcgccggggtcttcttcacattcgtgctgctcctgtccggccagatcacctggcgcgacatggcccacaccttaattatgataggcagcaatgcctccgacagaatggggatgggcgtgacgtacctcgcacttatagccacgtttaagattcagcccttcctggcgctcgggttcttcctgcgcaagctgacgtctcgggagaacctcctgctgggtgtcggcctcgccatggccaccactctgcagctgccggaggacatcgagcagatggccaacggcatagcgctcggtctgatggcccttaaactcatcacccagttcgaaacctaccagctgtggacagccctgatcagcctcacatgctccaacacaatgttcaccctgaccgtcgcctggcgtacggccacactgatcctcgcgggagtaagcctgttgccagtgtgccagtcgtcttccatgcggaagaccgactggctacccatggctgtggcagccatgggtgtgccgcccctcccgttgttcatcttcagccttaaggacacactgaagcgccgctcctggcccctgaacgagggggtgatggccgtgggcctcgtcagcatcctggcgtcaagccttctccggaacgacgtgcccatggcgggccccctagtcgccgggggccttctgatcgcctgctacgtcatcacggggacaagtgccgacctgacggtggaaaaggcggccgacatcacctgggaggaagaggccgagcaaacgggtgtgagccacaacctgatgatcaccgtcgacgacgacgggaccatgcgcatcaaggacgacgaaaccgagaacatcctgaccgtgttattaaagacggcgctcctgatcgtgtccggagtcttcccgtacagcatcccagccactctgctcgtgtggcacacttggcagaagcagacacaacggtcgggcgtgctgtgggacgttcccagcccgcccgagacacagaaggcggagctggaggagggggtgtaccgcataaagcaacagggcatcttcgggaagacccaggtgggcgtcggggtgcagaaggagggcgtgttccacacgatgtggcacgtgaccagaggcgccgtgctcacgtacaacgggaagcgcctggagcccaactgggcctccgtcaagaaggacctgatttcgtacggcggtggttggcggctctccgcccagtggcagaagggggaggaggtccagataattgcggtagagcctggcaagaaccccaagaacttccagaccatgcccggcaccttccagacaacgaccggtgagatcggcgccattgccctggacttcaaacccgggacctctggcagccccatcatcaaccgcgagggcaaggtggtcgggctgtacggaaacggggtggtgactaagaacggcgggtatgtctccggcatcgctcagacgaatgccgagccggacggacccacacccgaactggaggaggaaatgttcaagaagcggaacctcaccatcatggacctgcatcccgggagcggcaagacgcgcaaatacctgccggcgatcgtgcgggaagcgatcaaacgccggctacgcaccctgatcctggctcccaccagagtggtcgccgcggagatggaggaggcgctcaaggggctgcctatacggtaccagaccaccgccacgaaatccgagcacaccggacgggagatcgtcgacctgatgtgtcacgccaccttcacaatgcgcctcttgagccccgtaagggttccgaattacaatctgatcatcatggacgaggcccacttcacggaccccgcttccatcgcggcccgcggttacataagcacgcgggttggaatgggcgaggcagccgcgatctttatgaccgccacgccgcccggtacggcggacgcgttcccgcagtcaaacgcacccatacaggacgaggagcgcgacatccccgagagatcctggaactccggcaatgagtggataaccgacttcgcggggaagaccgtgtggttcgtcccctcaataaaagccggcaacgacatcgccaactgcctccggaagaacgggaagaaggtgattcaactgagtcggaagacattcgatacggagtaccagaagaccaagcttaacgattgggacttcgtggttaccaccgacattagcgagatgggcgctaatttcaaggctgaccgggtaatcgacccgcgcagatgcctaaagcccgtgatcctgacggacggccccgagcgcgtcatcctggcgggccccatgccggtgaccgcggcatccgccgcccagcgccgcggccgggtggggcgcaacccccagaaggagaacgaccagtatatcttcaccggccaacccctcaacaatgacgaggaccacgcgcactggaccgaggcgaagatgctgcttgacaacatcaacacacccgagggcatcatcccggccctcttcgagcccgagcgggagaagtccgcagccatcgacggcgagtaccgactgaaaggcgagtctcggaagacgttcgtcgagctgatgcgcaggggggacctccccgtctggctggcccacaaggtcgccagcgagggcatcaagtacacggaccgcaagtggtgcttcgacgggcagcgcaacaaccaaatccttgaggagaatatggatgtggagatctggactaaggagggggaaaagaagaagttacgcccccggtggctggatgcccgcacatatagcgacccgcttgccctgaaagagttcaaggacttcgcggccggccgtaagagcatcgcccttgacctggtgacggagatcgggcgggtcccttcccacctggcccaccgcacccggaacgcgctcgataatctggttatgctccacaccagcgagcacggaggtcgcgcgtaccggcacgccgttgaggagctgcccgagacgatggagaccctgctcctgctgggactcatgatcctgctgacagggggcgccatgctgttcttaatcagcgggaagggcatcggcaaaaccagcatcgggctgatatgcgtcattgcttccagcggcatgctgtggatggccgaaatcccgctccaatggatcgcgagcgccatcgtgctggaatttttcatgatggtgctcctgatcccggagcccgagaagcagcgcacgccccaggacaaccagctggcctacgtggtgatcgggatccttactttagccgccatcatcgcggccaacgagatggggctgctagaaaccaccaagcgggacctgggcatgtccaaggagccgggggtggtcagccccacctcctacctggacgtggacctccaccctgccagcgcctggacgttatacgcggtggccaccaccgtcatcaccccaatgttacgccacacaatcgagaacagtaccgcaaacgtgagcttggccgccatcgcgaaccaggccgtcgtactgatgggcttagacaaggggtggccgatctcaaagatggacctcggcgtacccctgctggccttagggtgctactcccaggtgaaccccttaactctgactgccgccgtcctcttgctgataacgcactacgcgatcatcggccccggactccaggccaaagccacacgtgaggcccagaagcgcaccgccgcggggatcatgaagaatccgaccgtggacggcatcatgacgatcgacctggaccccgtgatctacgactcaaaattcgagaagcagcttgggcaggttatgctgctagtgctgtgcgccgtacagctcttgctgatgcgaacctcttgggcactctgcgaggcactaaccttggctaccggccccatcacgaccctatgggagggttcccccgggaagttctggaatacaaccatcgccgtcagcatggccaacatcttccgcggctcctacctggccggggccggcttggccttcagtatcatgaagtccgtgggtacaggcaagcgggggaccgggtcacagggcgagaccctcggggagaagtggaagaaaaagctgaatcaactgtcccgcaaggagttcgacctatacaagaagtccggcatcaccgaggtggaccggaccgaggccaaggagggtttgaagcgcggcgagacgacccaccacgccgtcagccggggctccgccaagctgcagtggttcgtggagaggaacatggtgatcccggaggggcgggtcatcgacctcggctgcggacgcggcgggtggagctactactgcgccggcctaaagaaggtcaccgaggtgcggggctacacgaagggcgggcccggccacgaggagcccgtaccaatgtccacgtacgggtggaacatagttaagttgatgagcgggaaggacgtgttctacctaccgcccgagaagtgtgataccttgctgtgcgacatcggcgagtcctcaccgtcccccaccgtcgaggagagccggaccatccgcgtgctgaagatggtagagccgtggttgaagaataaccaattctgcatcaagatcctgaacccctacatgcccacggtcatcgagcacttggagcggctccagcgcaagcacggcggaatgctggttcggaaccccctgtctcgcaacagtacccacgagatgtattggatttccaacggaacagggaacatcgtggcgagcgtcaacatggtgtcccgactcttgctgaaccgcttcaccatgacgcaccgacgcccgactatcgagaaagacgtggacctcggcgccggcacccggcacgtcaacgccgagcccgagacccccaacatggacgtgatcggtgagcgcatcaagcgcattaaggaggagcacaatagtacttggcactacgacgatgagaacccgtacaagacctgggcttaccacggctcctacgaggttaaggccaccgggagcgctagtagcatgataaatggcgtcgtgaagctgctgaccaagccatgggacgtcgtacccatggtgacgcaaatggctatgacggatactacccccttcgggcagcagcgcgtctttaaggaaaaggttgacacgcggaccccacgcagcatgcccggcaccagacgcgtgatgggcatcaccgccgagtggctctggcggacgctaggacgcaacaagaagccacggctgtgcacaagggaggaattcacgaagaaggtccgcaccaacgcggcgatgggcgccgtgttcacggaggaaaatcagtgggactccgccaaggccgccgtggaggacgaggacttctggaagctagttgatcgggaaagagagctacacaagctggggaagtgcgggagctgcgtgtacaatatgatgggcaagcgggagaagaaactcggcgagtttgggaaagcgaaggggtcgcgtgcaatctggtacatgtggctgggcgccagatatctggagttcgaggccctcgggttcctgaacgaggaccattggttctcgcgcgagaactcctacagcggcgtggagggggagggcctgcacaagctcggttacatcctgcgggatatctccaagatccccgggggcgcaatgtacgcggacgacaccgccgggtgggacacccgcatcacagaggacgacttgcacaacgaagagaaaataacgcagcagatggacccggaacaccggcagctcgctaatgccatcttcaagctgacctaccagaacaaggtcgtgaaggttcaacgccccacccccaccggtaccgtgatggacatcatctcgcggaaagaccagcgcggctccgggcaggtcggaacgtacgggctgaacaccttcaccaacatggaggcacagctcatccggcagatggagggagagggagtgctgagcaaagccgacctggagaacccgcacttgccggaaaagaaaatcacccagtggctggagacgaagggcgtcgagcgcctgaagcggatggcaatctccggcgacgactgtgtggtaaagccgatcgacgaccgcttcgccaacgccctcttagcacttaacgacatggggaaagttcggaaggacatcccacagtggcagcccagcaagggctggcacgactggcagcaggtcccgttctgctcccatcacttccacgagctcatcatgaaagacggccgcaagctagtggtcccctgccggccccaggacgagctgatcggccgcgcgcggataagccagggggccggctggtccctccgcgagaccgcctgcctgggcaaagcctacgcgcagatgtggagcttgatgtacttccaccgccgagacctacgcctggcttccaacgccatttgtagcgctgtgcccgtgcactgggtcccgacctcccggaccacgtggagcatccacgcccaccaccagtggatgacgactgaagacatgctgacagtgtggaaccgcgtgtggattgaggacaacccctggatggaggataaaacgcccgtcacaacgtgggaggacgtgccgtacctggggaagcgggaggaccagtggtgcggcagtttgatcgggctgacttcccgcgctacgtgggcccagaacatccccaccgccatccagcaggtccggagcctcattggaaacgaggagttcctagactatatgccctccatgaaacgcttccgcaaggaggaggagagcgagggggccatctggtga

SEQ ID NO: 25684 - RNA, 9873 nt, synthetic construct
  misc_feature 1..9873: note = derived and/or modified CDS sequence (opt11) from DENV-3__FJ850092__SS-prME
  source 1..9873: mol_type = other RNA
accagcctgtgcctcatgatgatcctacccgccgcactggcgttccaccttacctcccgggacggagagcccaggatgatcgtggggaagaacgagcggggcaagagcctgctgttcaagaccgccagtgggatcaacatgtgtactctgattgccatggacctgggcgagatgtgtgacgatacagtgacctataagtgccctcacatcacggaggtagaacccgaggacatcgattgctggtgtaacctgacaagcacttgggtcacctacgggacatgcaaccaagccggcgagcaccggcgcgacaagaggtccgtggccttggcaccccacgtgggcatggggctcgacacccgcacacagacatggatgtctgcagagggcgcctggcgccaggtggagaaggtggagacgtgggctctgcgccacccgggcttcacaatcttggcgttgttccttgcgcactacatcggaacctccttgacccagaaggtggtgattttcatcttgttaatgctcgtgacgcccagcatgacgatgcgatgtgtgggggtaggcaaccgcgacttcgtcgagggcctgtccggggcgacttgggtggatgtggtgctggagcacggaggttgcgtgaccaccatggcaaagaataagcccaccctcgatatagagctgcagaaaactgaagcaacccagctggcgacactccggaagctgtgcatagaaggcaagatcactaacatcactaccgattcgagatgcccaacgcagggggaagcagtgctgccggaggagcaggaccagaactatgtgtgcaagcacacctatgtagacagaggttgggggaacgggtgcgggttgttcgggaaaggatcgctggtgacctgtgccaagtttcagtgcctggagcctatcgagggcaaagtcgtgcagcacgagaacctcaaatacacagtaataatcactgttcataccggggaccaacaccaggtgggcaacgaaacccaaggggttaccgcagagatcacgccccaggctagcaccaccgaggtaattctgcccgagtatgggactctggggctcgagtgttccccgcgcaccggcctggacttcaatgagatgatattactgacaatgaagaataaggcgtggatggttcaccgccagtggtttttcgaccttcctttgccctggacgagcggcgttaccacagaaacccccacctggaatcggaaggagttactagtgacctttaagaatgcacacgccaagaagcaggaagtggtcgttttggggtcccaggagggcgcgatgcacactgccctaacgggtgccacagagattcagaactcaggcgggacgtccatcttcgccggccacctgaagtgtcgcttaaagatggacaagctcgagcttaaagggatgtcgtacgcaatgtgcaccaacacgttcgtattaaagaaggaggtctccgaaacccaacacgggactatcctaatcaaagttgaatataagggcgaagacgcgccgtgcaagatcccctttagcactgaggatgggcagggtaaggcccacaacggccgcttaatcacggcgaaccccgtcgtcaccaagaaggacgagcccgtaaatatagaggcagagccaccctttggcgagagcaacatcgtgatcggtatcggtgacaacgccctgaagatcaattggtacaagaagggatcgagcatcgggaagatgtttgaggccactgccagaggagcacggcggatggccatactgggcgacaccgcctgggacttcggttccgtcgggggggtgcttaacagcctgggcaagatggtgcaccaaatcttcgggtccgcctacactgccctattcagcggtgtcagttgggtgatgaaggtcggaatcggcgttctcttgacctggatcggcctgaacagcaagaatacatccatgagcttctcctgcatcgcaatcgggataattacgttatacctgggtgcagtggtgcaagcggatatgggttgcgtcatcaactggaaaggcaaggagcttaagtgcggcagcggcatttttgtgaccaacgaggtgcacacctggactgagcagtacaagtttcaggcagactccccaaagcgccttgcaaccgctattgccggagcttgggagaacggggtttgcggcatacgctccacgactaggatggagaacctactgtggaagcaaatcgctaacgaactcaattacatcctgtgggaaaacaatattaagctgacagtagtggtcggggacatcatcggcgtgttagaacagggcaagcgcaccctcacgccccagccgatggagttgaagtactcgtggaaaacgtgggggaaggctaaaatcgtgacggccgagacccagaactcatccttcataatcgacggaccaaatacgcccgagtgccccagcgctagccgggcatggaatgtctgggaagtggaagattacgggttcggcgtcttcaccaccaacatctggttgaagctccgcgaagtctatactcagctgtgcgaccaccggctgatgagcgcggcggtgaaagacgaacgggccgtccacgccgacatgggctactggatcgaaagtcagaagaacgggtcctggaagctggaaaaagccagcctaatcgaggttaagacctgcacgtggccgaaatcccatacgctctggtctaacggggtgctggagtccgatatgatcatccccaagagcctggcggggcctatttcgcagcacaaccaccggccgggctaccatacccagaccgcagggccctggcacttaggcaagctggaactggattttaactactgcgagggcacgaccgtggttatcacggagaattgtgggacccgcggcccaagcctacggaccacgaccgtcagtggcaaactgatccacgaatggtgctgccgctcttgcacacttccgcctttacggtacatgggcgaggacggttgctggtacggcatggaaatccgccccatcagtgagaaagaggaaaacatggtcaaaagcctggtcagtgcaggcagcgggaaagtcgacaatttcacgatgggcgtgctgtgtctcgccatccttttcgaagaggttatgaggggcaagtttggcaagaagcacatgattgccggggtgttcttcactttcgtactgttactgtcaggacagatcacctggcgcgacatggcgcacaccctcatcatgatcggctcgaacgcgtcggatcggatggggatgggtgtcacgtacctcgctttaatcgccacgttcaagatacagccgtttctggccctcggatttttcctgcgaaagctgactagcagagagaacctcttgctgggtgtcgggctggcgatggcaaccactctgcagttgcccgaggacatcgaacagatggccaacggtatcgcacttggtctgatggcgcttaagctcatcacccagttcgagacctaccagctttggaccgccctgatcagcctcacctgctccaacaccatgttcaccttaaccgtagcttggcgcacggccaccctgatcctcgccggggtgagtttactgccggtgtgtcagtcatcctccatgcgtaagacggattggctacctatggcggtcgccgcaatgggcgttccgcccctcccgctgttcatcttcagcctcaaggataccctcaagcgccgtagttggcccctgaacgagggggtgatggccgtcgggctcgtaagcattctggcctccagcctgctccggaacgacgtacctatggcgggccctctggtcgccggggggctgctaatcgcgtgctacgtgattacggggacctccgctgatcttatcgtggagaaggcggcggacatcacctgggaggaggaggccgagcagaccggggttagccataaccttatgatcacggtggatgatgatgggacaatgcggatcaaggatgacgaaacagagaacatcctcaccgttctgctgaagaccgcgcttctgatcgtttccggcgtgttcccgtattctatccccgctacgctgctcgtgtggcacacctggcaaaaacaaacgcagcggtccggagttttgtgggacgtgccctcgccccccgagacgcaaaaagcggagctggaagaaggggtgtaccgcatcaagcagcagggcatcttcgggaagactcaggttggcgtgggcgtgcagaaggagggcgtttttcacaccatgtggcacgtgacccgtggcgcggtgctcacctacaatggcaagcgactagaacctaactgggcttcagtcaaaaaggacctaattagctacggcggtggctggcggctctccgcccagtggcagaagggtgaggaggttcaagtgatagccgtcgagccaggcaaaaatccgaagaactttcagacaatgcccggaacgttccagaccaccacgggggagatcggggcgatcgccttggacttcaaacccgggaccagcgggtcccccatcataaaccgcgagggcaaggttgtcggactgtatggcaacggcgtcgtgactaagaatggcgggtacgtttctggcattgcccagacgaacgccgaaccggacggacccacgccagagcttgaggaggagatgttcaagaaacgcaatcttaccatcatggacctgcatcccggaagcgggaagacacgcaagtacttaccagccattgtgcgggaggcgataaaacgccggctccgcacgctcatcctggcccccacgcgggttgtggccgccgagatggaggaagccctgaaagggctccccatccgctatcagaccacagcgaccaagtccgagcacacgggcagagagatcgtcgacttgatgtgtcacgccaccttcaccatgcgtctcttaagccccgtccgggtgcccaactacaacctgataattatggacgaggcccatttcaccgaccctgcatccatcgccgcccgcgggtacatctcgacgagagtcggcatgggcgaggccgcagcaatctttatgaccgctactccacccgggaccgccgacgccttccctcagtcaaatgcaccaatacaggacgaggaacgcgatatacccgagcgcagctggaatagcggcaacgagtggattacggactttgccggaaagacggtatggtttgtgcccagcatcaaggctggcaacgacatcgccaactgcctgcggaaaaacgggaagaaagttatccagttatctcgcaagacttttgacaccgagtaccagaagaccaagctgaacgactgggacttcgtcgtgaccactgatatcagtgagatgggcgccaacttcaaggccgaccgtgttatcgacccacgccggtgccttaagcccgtgattttaaccgacggccccgagcgcgtcattttagccgggccaatgccagtcacagcggcctccgccgctcagcgacgcggacgcgtgggtcgtaacccacaaaaggagaatgaccagtacatcttcacgggacagcccctcaacaacgacgaagaccacgcacactggaccgaggcaaagatgctcctggacaacatcaatacccccgaagggataataccggctctcttcgagccagagagagagaagtctgccgccattgacggggagtatcgccttaaaggtgagtcccggaaaaccttcgtcgagctgatgcgccgcggtgacctgcccgtgtggctggcacacaaggtcgcgtcagagggcatcaagtacacagaccgcaaatggtgctttgacggtcagcggaacaaccagatcctggaggaaaacatggacgtcgagatctggactaaagagggggagaagaagaagttgcgccctcgctggctggacgcccgaacctactccgaccccctggccctcaaggagttcaaggactttgccgcaggccgaaagagtatcgcactggatctggtgaccgagatcgggcgagtgccttcacaccttgctcaccgcacgcggaatgcactggataacctagttatgctccatacatcggaacatggtgggcgggcctaccggcacgcggtggaagaactgcccgagaccatggagaccctgctactgctgggcctcatgatcttactgaccggcggggccatgcttttcctgataagcggtaagggcatcggcaagacctcgatcgggttgatctgtgtgatcgcctcctccggtatgctctggatggctgagattccgctccagtggatcgccagcgcgatagttttggagtttttcatgatggttctcctaatccccgagcccgagaagcagcgcacccctcaagataatcaactggcctacgtggtcatcgggatcctcacgttggcagccatcattgccgcgaacgagatgggactgctagagacgaccaagagagacctcggcatgagtaaggagccgggggttgtgagtcccacctcctacctggacgtagacctccaccccgctagcgcgtggaccttgtacgcggtcgcgaccaccgttatcactcccatgcttcgccatacgatcgaaaactccacggcaaacgtgtctttggccgccatagccaaccaggccgtggtgctgatgggcctggacaaggggtggccgatcagcaagatggacctgggtgtgcccctcctggccttggggtgctacagtcaagtcaatccccttacactaactgccgccgtgctactgttgattactcactatgccatcattggaccaggactccaggcaaaggcaacacgggaggcccagaagcgaactgccgcaggaatcatgaagaatccaacggttgacggcatcatgaccatcgaccttgaccccgtgatctatgactccaagttcgagaaacagctgggacaggtgatgctcctggtactttgcgcggtccagttactgctgatgcggacgagctgggccctatgtgaggctctgactcttgccacgggtcccataaccaccctctgggagggctccccagggaagttctggaacacgactatcgcggtgagcatggccaacatcttccgtggctcgtacctggcaggggctggcctagccttcagcatcatgaagtctgtagggaccggcaaacgaggcacgggaagccagggcgagacgctgggagagaagtggaagaagaagctaaaccagctgtcccgcaaggagttcgacctctacaagaagtccggcattaccgaggtagaccggaccgaagctaaggaggggttgaaacggggtgaaacgacgcaccacgcagtgagtagaggcagtgcgaaactccagtggtttgtcgagagaaacatggtgatcccggagggacgggtgatcgacctcggttgcggtcgcggcggttggagttactattgcgccgggttgaagaaggtaaccgaggtgaggggatacactaagggcggtcctggacacgaggagcccgtgcccatgtcaacctacggatggaatatagtcaagcttatgagcgggaaggacgtattctacctcccgccggaaaagtgcgacacgctcctatgcgacatcggcgagtcatcgccttcccccaccgtggaggagagccgcacgatcagggtcctgaagatggtggagccctggctcaagaacaaccaattctgcatcaagatccttaacccctacatgccgaccgtgatcgaacacctggagcggctccagcggaagcatggtggaatgctggtccgtaacccgctatcccgcaactctacgcacgagatgtactggatcagcaacggcaccgggaacattgtggccagtgttaacatggtaagtcggctcttgttaaaccggttcaccatgacacaccgacgccctacaatcgagaaggacgtggacctcggcgcgggcaccagacacgtgaacgccgagccggaaacccccaacatggacgtcatcggggagcgcataaagcggatcaaggaggagcacaatagcacatggcattacgatgacgagaacccgtacaagacgtgggcctaccacggctcctacgaggtcaaggcaacgggaagtgcgtcaagcatgatcaacggcgtagtgaaactcctgaccaagccttgggacgtagtccccatggttactcaaatggcgatgaccgataccaccccatttggccagcagcgggtgttcaaagaaaaggtcgacaccagaactccgagatcgatgccaggcactcgtcgggtaatgggcataaccgccgaatggctttggcgtaccctagggcgcaacaaaaagccccggctgtgcacgcgcgaggagttcaccaagaaggttagaactaacgccgccatgggcgcggtctttactgaggagaaccagtgggactccgcaaaggctgctgtggaggacgaggatttctggaagctcgtagacagggagcgcgagctccacaagctggggaagtgcggaagctgcgtatacaacatgatggggaaacgggaaaaaaaactcggcgagttcggaaaggccaagggatcccgcgcgatatggtacatgtggcttggagcccggtacctggagttcgaagccctcgggttcctgaacgaggaccactggttcagccgcgagaattcctacagcggggtggaaggggagggcttgcacaagctaggctatatcctgcgggacatatccaaaatacccgggggcgctatgtacgccgatgatacagcggggtgggatacccgcatcacagaggatgacttgcacaacgaggagaagataacccagcaaatggaccctgagcaccggcagctcgccaacgcaatcttcaagctgacgtaccagaacaaggtggtaaaggtgcagcgcccaacccccaccggcaccgtgatggacatcatcagccggaaggatcagcgcggctccgggcaggtcggtacctacgggcttaacacgttcacgaacatggaggcccagctcatcagacaaatggagggcgagggcgtgctatcaaaggccgatctggagaacccccacctccctgagaagaaaatcacgcagtggctggagaccaaaggcgtggaacgacttaaacggatggccatatccggcgacgactgcgtcgtaaagcccattgacgaccgcttcgccaacgcgctcttggcactgaacgatatggggaaggtgcgaaaggacatcccgcagtggcagccgagcaagggttggcacgattggcagcaggttcccttctgtagtcaccacttccacgagctcatcatgaaggatgggaggaagctggtggtgccctgtcggccgcaggacgagttgatagggcgcgccaggatcagccagggggcgggctggtccctccgagagactgcctgcttgggcaaggcctatgcccaaatgtggagcctgatgtacttccacaggcgtgacctccgtctggctagtaacgccatatgtagcgccgtccccgtgcactgggtaccgacctcccggaccacctggagcatacacgcgcaccaccaatggatgacgaccgaggacatgctgaccgtctggaatcgagtatggatagaagacaacccctggatggaggacaagactccggtgacgacctgggaagacgtcccctatctagggaagcgcgaggaccagtggtgcggcagcctgattgggttgacctcccgcgcgacatgggcgcaaaacatccctacggccattcagcaggtccgatcactcatcggcaacgaagaattcctagattacatgccctccatgaagcgcttccggaaagaagaagagagcgagggtgcaatctggtga

SEQ ID NO: 25685 - RNA, 9873 nt, synthetic construct
  misc_feature 1..9873: note = derived and/or modified CDS sequence (opt11) from DENV-3__FJ850094__SS-prME
  source 1..9873: mol_type = other RNA
acaagcctgtgcttgatgatgatactgcccgccgccctggcgttccacttaaccagccgggacggcgaaccgcgcatgatcgtggggaaaaacgaacgaggcaagtcactgctgttcaagaccgcctccggcatcaacatgtgcaccctcatcgctatggacctgggggaaatgtgcgacgacaccgtaacctacaagtgtccacacatcacggaagtggaaccggaagacatcgactgctggtgtaacctgacttcgacctgggtgacctacgggacctgcaaccaggccggcgagcaccggcgggacaaaaggtccgtggccctcgcaccccacgtgggcatgggactggataccaggacccagacctggatgagcgctgagggcgcttggagacaggtggagaaggtggagacgtgggccctgaggcatcctggtttcacaattctcgcgctgtttctggcccactacatcggcacctcgctcacccagaaggtggtaatctttatcctgttaatgcttgttacccccagcatgaccatgcggtgtgtgggggtgggcaaccgggacttcgtcgaaggtctcagcggggccacctgggtcgacgtcgtcctggagcacggtgggtgcgtgactacgatggccaagaacaagcccaccctcgacatcgagctgcagaagaccgaggctacccagctggcgacgctccgtaagctgtgcatcgagggcaagataaccaacatcaccaccgacagtaggtgccccactcagggcgaggccgttctaccggaggaacaggaccagaattatgtctgcaagcacacctacgtggatcgggggtggggcaatggttgcggcctgttcgggaaggggtccctggtgacctgcgccaagttccagtgtctggagcccatcgagggcaaagtcgtgcagtacgagaacctcaagtacactgtgatcatcacagtccacaccggggatcagcaccaagtgggcaacgagacacagggagtcacagccgaaataacgccacaggccagcaccaccgaggcgatcctcccggagtacgggaccctggggctcgagtgttctccgcgcaccggcctggatttcaacgagatgatcctcctcacaatgaagaacaaggcatggatggtgcaccggcaatggttcttcgaccttcccctaccctggaccagcggcgccaccaccggaacgcccacttggaaccgcaaggagctcctggtgaccttcaaaaacgcccacgccaagaaacaggaggtcgttgtactgggttcccaggaaggggcgatgcacacggcactcacgggtgctacggaaatccagaatagcggaggcacctccattttcgccggccacctgaaatgcaggctgaaaatggataagctcgagctgaaagggatgagttatgccatgtgtaccaacacgttcgtcctgaagaaggaggtgtcagagacccagcacgggaccatcctcatcaaagtggagtacaagggggaggacgcaccgtgcaagatcccctttagcaccgaggacggacagggcaaggcccacaacggccgtctgatcacagctaaccccgtcgtgaccaagaaggacgagcccgtgaacatcgaagcggaaccgccattcggcgagtccaacatcgtaatcggtatcggcgataacgcgctgaagataaactggtataagaaggggtccagtatcggcaagatgttcgaagccacagcgcggggcgcccgcaggatggcgatcctcggagacaccgcgtgggacttcggatccgtcggcggggtactcaacagcctggggaagatggtccaccagatcttcgggtccgcctacacggccctgttcagcggcgtgagctgggtgatgaagatcgggatcggggtactactgacatggatagggctcaacagcaagaatacctccatgagcttctcctgcatcgccatcggcatcatcaccctctatctgggggcggtggtacaagcggacatgggctgcgtcgtaaattggaaggggaaggagttgaagtgtgggtcaggcatcttcgttacaaacgaggtccacacctggaccgagcaatacaaatttcaggcggattccccgaagcgccttgccaccgccatcgccggggcttgggagaacggagtgtgcgggatcagaagcacaacccggatggagaacctgttatggaagcagattgccaacgagctcaactacatcttgtgggagaataatatcaagctcaccgtggtggtaggggacaccattggcgtgttggagcaggggaagaggaccctaacgccccaaccgatggagctcaagtactcctggaaaacctgggggaaggccaagatcgtcaccgccgagacgcagaacagctcctttattatagacgggcccaacacacccgagtgcccctccgcgtccagggcctggaacgtgtgggaggtggaggactacggcttcggcgtgttcaccactaacatttggctgaagctgcgcgaggtgtacacccagctatgcgaccaccggctcatgagcgccgccgtgaaggacgagagggccgtccacgcagacatggggtactggattgagagccagaaaaacggctcctggaagctggaaaaggccagcctcattgaggtgaagacatgtacctggccgaagtcacacaccctttggagcaacggtgtgctggagtccgacatgatcatcccaaagagcctggccggccccatctcccaacacaactaccggccggggtatcacacacagacagccggaccatggcacctcggcaagctggagctggacttcaactattgcgaaggtacgaccgtcgttataaccgaaaactgcggcacgcgcgggcccagcctccggaccaccaccgtgtccggcaagctcatccacgagtggtgttgccgctcctgcaccctacccccgctgcggtatatgggagaggacggctgctggtatggcatggagatccgccctatctccgagaaggaggagaacatggtcaagtctcttgtcagtgccgggagcggtaaggtggacaacttcacgatgggcgtcctgtgcctcgcgatactgttcgaggaggttatgcgtggcaagttcggtaaaaagcacatgatcgccggcgtgttcttcaccttcgtcctgctcctgtcaggccagatcacctggcgcgacatggcccatacgctcatcatgatcgggagcaatgcctccgaccggatgggcatgggagtcacttacctggccctgatcgcgaccttcaagatacagcccttcttggcgcttgggtttttcctccgcaagctgaccagcagagagaacctcctgctgggcgtaggtctcgccatggccacgactctgcagctgcccgaggacatcgagcagatggccaacggcatcgccttagggctgatggccctgaaattaataacacaatttgagacctatcagctgtggacggccctgatcagccttacctgctcgaacaccatgttcacccttacggtcgcctggcgcaccgcgaccctgatactcgccggtgtgtctctgctaccagtctgccagtccagcagtatgcggaagaccgactggctccccatggccgtggccgcgatgggggtgccgcccctcccgctgttcatattcagcctcaaagacacgtttaagaggcgctcctggccattaaacgagggcgtaatggcggtgggcctggtcagcatcctcgcctccagcttactacggaacgacgtaccgatggccgggccactcgtggccggcggactgctgatcgcctgctatgtgatcaccggcacctcagcggacctcaccgtcgagaaggccgcagacattacgtgggaggaagaggccgagcagacgggggtgagtcacaacctgatgatcacagtggacgacgatggcaccatgaggattaaggacgacgagaccgagaacatcctgacggtcttgctgaagaccgccctgctcatcgtgtcgggcgtgttcccgtacagcatcccggccaccctactggtgtggcacacctggcagaaacagacgcagcgatccggagtgttatgggatgtgcccagcccgcccgagacccaaaaggccgagctggaggaaggcgtctaccgaatcaaacaacaagggatctttgggaagacccaggtgggggtgggggtccagaaagagggcgtgtttcacaccatgtggcatgttacgcgcggggccgtcctgacctacaatggcaagcgcctcgagcccaattgggcctccgtgaagaaagacctcatcagctacgggggcggctggcgattgtccgcgcagtggcagaaaggcgaggaggtgcaggtcatcgccgtggaaccggggaagaatcccaaaaacttccagaccatgcccgggactttccagacgaccaccggcgagatcggggccatcgccctcgacttcaagcccggcaccagcggttcacccatcatcaaccgcgaggggaaggtggtaggactctacgggaacggcgtggtaacgaaaaacgggggttacgtgtctggaatagcccagaccaacgcggagccggacggccccaccccggagctggaggaggagatgttcaagaagcggaatctgaccatcatggacctccaccccggcagcggtaagacacgtaagtacctcccggccatcgtgagggaggccatcaagcgccggctgcgcactctcatcctggcccccacccgggtggtagccgcggaaatggaggaggcactgaaaggccttcccatcaggtaccaaaccacggcaacgaagagtgagcacacagggcgagaaatcgtggacctgatgtgccacgctaccttcacgatgcgcctgttgtcacccgtacgagtcccgaattacaatctgatcatcatggacgaggcccacttcaccgatcccgcgtccatcgccgcccgaggctatatctcgacccgggtgggcatgggcgaggccgcggccatctttatgaccgccacgcccccgggcaccgccgacgcttttccccagtccaatgcgcccatccaggatgaggagcgcgacatccccgagcgctcctggaactccgggaacgagtggatcaccgacttcgccggcaagaccgtctggttcgtccccagcattaaggccgggaacggtatcgctaactgcttacggaagaacggcaaaaaggtcatccagttaagccggaagacgtttgataccgagtaccagaagacgaaattaaatgactgggacttcgtggtaaccacagatatcagtgagatgggggccaacttcaaagcagatcgggtgatagacccccgccggtgcctgaagcccgtcatccttaccgacggccccgaacgagtcatcctggcagggccgatgccggtaaccgccgcctcggccgcgcagcggagaggccgggtcggaagaaacccccagaaggagaacgaccagtacatattcaccggccagcccctgaataacgacgaggaccacgcccattggaccgaggccaaaatgctcctggacaacatcaacacccccgagggcatcatcccggctctgtttgaacccgagcgggaaaagtccgcggccatcgacggggagtaccgcctaaagggcgagtcacggaagaccttcgtcgaactgatgcgcagaggggacttacccgtgtggctcgcgcataaggtcgccagcgaagggatcaaatacaccgatcgcaagtggtgcttcgacggccagcggaacaaccagatcctggaggagaatatggacgtggaaatctggaccaaagagggggagaagaagaaactgcgcccccgctggctcgatgcccgcacgtactccgacccgctggccctgaaagagttcaaagactttgccgccgggcgcaaaagcattgcactagacctggtgacggaaatcggccgggtccccagtcatctggcgcaccgcacccggaacgccctggacaacctcgtgatgctgcataccagcgagcacggcgggcgcgcctacaggcacgccgtggaggaattgcccgagacgatggagacccttctgctccttggcctgatgatcctcctgacagggggtgcgatgttatttttaatcagcggcaaggggataggaaagacatctatcgggctgatctgcgtcatcgccagctccggcatgctgtggatggcggagatcccgctccagtggatagcctcagctatagttctggagttcttcatgatggtcctactcatccctgagcccgagaagcagcgcacgccccaagataaccaattagcctacgtggtaatcggtattttaacactcgccgccatcatcgccgcgaacgagatggggctgctcgagaccaccaagcgggacctcggcatgtccaaggagccaggagtggttagccccacgtcatacctggacgtagacctgcaccccgcgagcgcgtggaccctctacgccgtggccaccaccgtcattacgcctatgctgcgccacaccatcgaaaattccaccgcaaacgtgagcctagcggcgattgcgaaccaggccgtggtattgatgggcctggacaaaggatggccgatctcaaagatggacctgggtgttcccctcctagctctcggctgttacagccaggtgaaccccctcaccctgacggccgcggtgctgctcctgatcacccactacgccatcatcgggcccggcctgcaagccaaagccacccgggaggcccagaagcgcactgcggcaggcatcatgaagaatccgacggtggacggcatcatgactatcgatctcgaccccgtgatctacgactccaagttcgagaaacagctgggtcaggtcatgctgctcgttttgtgcgcggtgcagctgctactaatgagaaccagctgggccctatgcgaagcgttgaccctggccacagggcccatcaccaccttatgggagggctcacccggcaagttttggaacaccactatcgcagtcagcatggccaacatctttcggggctcctacctcgcaggggcgggcctagccttctcgatcatgaagtccgtgggcaccgggaagcgcggcactgggagccagggcgagaccttgggggagaagtggaaaaagaagctcaaccaactgagccgcaaggagttcgacctgtacaagaaatccgggataaccgaggtggaccggacggaggccaaggagggtctgaagcgcggggagaccacccaccacgccgtcagtcggggctccgctaagctgcagtggttcgtagagcgaaacatggtcatcccggaggggcgggtcatcgacttaggatgcggtcgcggcggctggagctactactgcgcgggcctcaaaaaggtgaccgaggtccggggttacacgaagggcgggcccgggcatgaggagcccgtgccaatgtcgacctacggatggaacatagtgaagctgatgagcggaaaggatgtgttctacctcccgcccgaaaaatgcgacaccttgctctgcgatatcggggaatccagcccctcccccaccgtcgaagagagccgcacgatacgcgtactgaagatggtggaaccgtggctgaaaaacaatcagttctgcatcaaaattctcaacccctacatgcccaccgtcatcgaacacttggagcggcttcagcgtaagcacggcgggatgctcgtccggaatcccctgtcccgcaacagcacacacgagatgtactggatctccaacggcaccggcaacatcgtggcgtcggtaaacatggtctccaggctgctcctgaacagattcacgatgacccaccggcgaccgaccatagagaaggatgtggacctgggtgcaggcacccgacatgtcaacgccgaacctgagacgcccaacatggacgtgatcggggagcgcatcaagcggatcaaggaggagcacaatagcacctggcattacgatgatgagaatccgtacaagacctgggcctaccacggctcgtacgaggtgaaagcgacagggagcgcgagtagcatgattaacggcgtcgtgaagctactgacgaagccctgggacgtggtccccatggtgacccaaatggccatgaccgacaccactcccttcggccaacagcgagtcttcaaggaaaaggtggacacccgaactccgcgcagcatgcctgggaccaggcgcgtgatgggcattacggccgaatggctgtggcggaccctcgggcggaacaagaagcccagactgtgtacccgcgaggagttcaccaagaaagtcagaaccaacgcggccatgggcgccgtattcaccgaggagaaccagtgggactcggccaaggccgcggtagaggacgaggacttctggaaactggtcgacagggagcgcgaactccacaaactgggtaaatgcggcagctgcgtgtacaacatgatgggtaagcgggagaaaaagctgggggagttcggcaaggccaaggggtcccgcgccatctggtacatgtggttgggcgctcgatacctggagttcgaggccctggggttcctcaatgaggaccattggtttagccgcgaaaattcctatagcggcgttgagggcgaggggctgcataagctgggctacatcctccgagacatctccaagatccccgggggcgctatgtatgccgacgacaccgccggctgggacacacgcatcacggaggacgacctgcataatgaggagaaaatcacccagcagatggaccccgagcaccggcaattggccaacgccatctttaagctcacctaccagaataaggtcgttaaggtgcaacgccctacccccaccgggacggtgatggacatcatcagccggaaggatcagcgcggctccggccaagtgggcacctatgggctgaacaccttcaccaacatggaggctcaactgatccggcagatggaaggcgagggcgtgctcagcaaagccgatctggagaacccccacctccccgagaagaagataacgcaatggctggagaccaagggagtcgagcgcttaaagcgaatggccatcagcggcgacgattgcgttgtgaagccgatagatgacagatttgccaatgccctgctcgcgcttaacgacatggggaaggtccggaaggacatcccccagtggcagcccagtaagggctggcacgactggcaacaggtcccgttctgctctcaccactttcacgagctcatcatgaaggatgggcgcaagctcgtggtcccttgcaggccgcaggatgagttaatcggcagggcccggataagtcagggagctggttggtccctgcgcgaaaccgcctgcctcggcaaggcgtacgcccagatgtggtctctcatgtatttccaccgccgggatctgcgcctcgcctccaacgcaatctgctctgccgttccggtgcactgggtcccgacctcccggacgacctggagcatccacgcgcaccaccagtggatgacaaccgaggacatgttaaccgtgtggaaccgcgtgtggatcgaagacaacccgtggatggaggacaaaactcctgtcaccacctgggaagatgtgccctacctgggtaaacgagaggaccagtggtgcggctctctcatcgggctgacgagccgcgccacctgggcacagaatatccctaccgccatccagcaagtccggtcactgatcggcaatgaggaatttctggactacatgccctccatgaagcgcttccggaaagaggaggagagtgagggcgcgatatggtga

SEQ ID NO: 25686 - RNA, 9873 nt, synthetic construct
  misc_feature 1..9873: note = derived and/or modified CDS sequence (opt11) from DENV-3__FJ898446__SS-prME
  source 1..9873: mol_type = other RNA
acctccttgtgcctcatgatgatactgcccgcagcgctggcgttccatctcacctcacgggacggggagccacggatgatcgtggggaaaaacgaacgcggaaaaagcctgctgttcaaaaccgcctcagggattaacatgtgcaccctgattgccatggatctgggcgagatgtgcgatgataccgtgacgtataagtgcccacacattaccgaggtggaacccgaggacatcgactgctggtgcaatttaacaagtacctgggtaacttatgggacctgcaaccaagccggagagcggcgccgagacaagcggtccgtggccctcgcgccccacgtgggcatggggctcgacacccggacacagacctggatgtcggccgagggcgcatggagacaggtggaaaaggtcgagacgtgggccctgcgacatccggggtttaccattctcgctctttttctggctcactatataggcacctctctgacacagaaggttgttatcttcatcttacttatgcttgtgacgcccagcatgacaatgcgctgtgtgggggtgggaaatcgtgacttcgtcgagggcctgtccggggccacctgggttgacgtggtcctggagcacggcgggtgcgtgacgacgatggccaagaacaagccgaccctcgacatagaactgcaaaagaccgaggcgacccagctggcgacgctccgcaagctatgcatcgagggcaagatcaccaacatcacaaccgacagccggtgtcccacgcaaggcgaggctgtgctgccggaagaacaggatcagaactacgtgtgtaaacatacctacgtcgaccgcgggtggggcaacgggtgcggcctcttcggaaaaggatccttagtaacctgtgccaagtttcagtgcctagaaccgatcgagggcaaagtagtgcaatacgaaaacctcaagtacaccgtgatcataacggtccataccggtgaccagcaccaggtgggcaacgagacacaaggggtcaccgccgagatcacgccccaggcctccaccactgaagcgatacttcccgagtacggcacccttgggttggagtgctccccgcggaccggtctggacttcaacgagatgatcctgctcacgatgaagaacaaggcctggatggtgcatcgccagtggttcttcgatctgcccctgccctggaccagcggggccacgaccgagacaccaacctggaaccggaaggagctcctggtgaccttcaagaacgcccatgccaagaagcaggaggtcgttgtattaggatcccaagagggtgcgatgcacacagcgctcaccggggccaccgagatccagaactcaggcggcacctccatcttcgcggggcacctgaagtgccgcttgaagatggacaagctcgagctgaagggcatgtcgtacgccatgtgcaccaacacgttcgtcttaaagaaagaggtgagcgagacccagcacgggaccatcctcatcaaggtggagtataagggcgaggacgcgccgtgcaagatccctttcagcaccgaggacggccagggaaaggcccacaacggccgacttatcacagccaaccccgtcgtgacaaagaaggaggaacccgtgaacatcgaggccgagcccccttttggggagagtaacattgtcatcggcaccggtgataacgctctgaaaatcaactggtacaagaaaggctccagcatcgggaagatgttcgagacaacggcgcgtggcgcccggcgcatggccatcctgggtgacaccgcctgggacttcgggtccgtgggcggcgttcttaactcgctgggcaagatggtccaccagatcttcgggtcagcgtacaccgccctgttctctggggtgtcctgggtgatgaaaatcggaatcggtgtcttgctgacctggatcggcctgaacagcaagaacacttccatgagcttctcatgcatcgccattggaatcatcaccctctacttaggcgccgtggtgcaggccgacatgggatgtgtcataaactggaaaggcaaggaactgaaatgcggcagcgggatcttcgtgaccaacgaagtgcacacctggacggagcagtacaagttccaagcggactccccaaagcgcctagccaccgcgatcgccggcgcatgggagaacggtgtctgcggtatccggagcaccacccgtatggagaacctgctgtggaagcagatcgcaaacgagttgaactacatattgtgggagaacaacataaagttgacggtggtggttggggacatcatcggtgtcttagagcagggcaagcgtaccttgacaccccaacctatggaacttaaatacagctggaaaacctgggggaaggctaagatcgttacggccgagacccagaacagctccttcatcatcgacggccccaacacgcccgagtgcccctccgcctcccgagcctggaatgtctgggaggtggaggactacgggttcggggtgttcaccaccaacatctggctcaaactgcgggaggtctacacgcagctgtgcgatcacagattaatgagcgccgccgtgaaggacgagcgggccgtgcacgccgacatgggctactggatagagagccagaaaaacgggtcctggaagctagagaaggcgagcctgatcgaggtgaagacctgcacctggccgaagtctcacacactctggagcaacggcgttctggagtcagacatgatcatccccaagagcttagccggccctatctcacagcacaatcaccgaccgggctaccacacgcagaccgccgggccttggcacctcgggaagctggaattggacttcaactactgtgagggaacgaccgtagtgatcactgagaactgcgggacccggggacccagcctccgcaccacaacggtctccgggaagctgatccacgagtggtgctgcaggtcgtgcaccctacctccgctccgatacatgggtgaggatgggtgctggtacgggatggagatccggcccatctccgagaaagaggagaacatggtcaagagcttggtgtccgccgggagcgggaaggttgacaacttcacaatgggcgtcctttgcctcgcaatactgttcgaggaggtcatgcgggggaagttcggcaagaaacacatgatagccggggtgttctttaccttcgtgctgctcctaagtggccagatcacgtggagggacatggcgcataccctgatcatgatcggcagcaacgcatcagatcgcatgggtatgggcgtcacctacttagctctgatcgccacctttaaaatccagccattcctggcgctcggcttcttcctgcggaaactgacaagccgtgagaacctcctgctgggcgtgggcctcgccatggccactaccctgcagttacccgaggacatcgagcagatggcgaatggaatcgctctcggcctaatggccctgaaactcattacccagttcgagacgtaccagctgtggaccgccctcatcagcttgacctgctccaataccatgtttactctgaccgtcgcctggagaacagctacactgatactcgcgggggtcagcctgctgccggtgtgccagtccagttccatgcgcaaaacggattggctcccaatggccgtggccgccatgggcgtgccgcccctcccgttattcatcttctctttgaaggacaccctgaagcgccggtcctggcccctgaacgaaggggtgatggcagtgggcctcgtgagcatcctagcgtctagccttctccgcaacgacgtcccaatggcaggcccccttgtcgccgggggactgctcatcgcgtgctacgtgataaccgggacctccgccgatcttacggtagagaaggcggccgatatcacctgggaggaggaggccgagcaaacaggcgtgtcgcacaacctgatgatcaccgtcgacgatgatggtactatgcggattaaggacgatgagacggagaacatcctcaccgtgctactgaagaccgctctcctgatagttagcggtgtattcccgtactctatccccgctaccctgctcgtgtggcacacatggcagaagcagacccagcgctctggcgtcctgtgggacgtgccctcgccgcccgaaacccagaaggccgagctggaggagggggtttatcggatcaagcaacaagggatatttggcaagacacaagtcggcgtaggggtgcagaaggagggcgtgttccacacgatgtggcatgtgacccgcggcgccgtgctcacctataacgggaaacggctggagcccaactgggcgtctgtcaagaaggacctcatctcctatggcgggggctggcggctctccgctcagtggcagaagggggaggaggttcaggtgatagcggtcgagccaggcaagaaccctaagaacttccagacgatgcccggcacctttcagaccacgaccggcgagataggcgctatagccctagacttcaaacccggaacgtcaggctcgcccattatcaaccgggagggtaaggtggtggggctgtatggcaacggggtcgtgaccaagaacggtgggtatgtgtccggcatcgcccagaccaatgccgagccggacggccctacccctgaactcgaggaggagatgttcaagaaacgcaacctcacaatcatggacctgcaccccggatctggaaagacccgaaagtacctgccggcgatcgtccgcgaggccatcaagcggcgactccggaccctgatcctcgcccccacccgagtggttgcggctgagatggaagaagcgctcaagggactgcccatacgctaccaaaccaccgccaccaagtccgagcacactggtagagagattgtagacctgatgtgccacgccacgttcacaatgcggcttctgagtcccgttcgcgtaccgaactacaacctaattatcatggatgaggcacacttcaccgaccccgccagcattgcggctcggggatacatctccacccgcgtcggcatgggggaggccgccgctatctttatgactgcgacgccgcccgggaccgccgacgccttcccgcagtccaatgcccccattcaggacgaggagagagatatccccgagcggtcatggaactccggcaacgagtggatcaccgacttcgcgggcaagacggtctggttcgtgccctcgatcaaggcaggaaacgacatcgcgaactgcctcaggaaaaacgggaagaaggtcatccaattatcccgaaagactttcgataccgagtaccagaagaccaagctgaatgattgggacttcgtggtcacgacagacattagtgagatgggcgccaacttcaaggcggacagagtgatcgacccgcggcgctgcctcaagccggtgatcctgaccgacgggcccgaacgggtgatactggctgggccaatgccggtgaccgccgcctccgccgcacagcgacggggccgcgttggtcggaatccacagaaggaaaacgaccagtacatcttcacaggacagcccctcaataatgacgaagaccacgcgcactggactgaggccaagatgttactggataacattaacacacctgaggggatcatcccggccctcttcgaaccagaacgcgagaagtcagcggcgatcgacggcgagtaccgactgaagggagagtcacgcaaaaccttcgtggagctgatgcgccgcggggaccttcccgtctggctagcccacaaggtggccagcgagggcatcaagtacaccgacagaaaatggtgcttcgacgggcagcgcaacaatcagatcctggaagagaacatggacgtcgagatatggactaaagagggcgagaaaaagaagctcagaccccgctggctggatgcccgtacatactccgacccactggccctcaaggagttcaaagactttgcggcaggccggaaaagcatcgccctggatctggtcaccgaaatcgggcgcgtgccctcgcacctcgcacatcgtaccaggaacgccttggacaacctggtcatgctccacactagcgaacacggcggtcgtgcgtaccgccacgcggtggaggagctgcccgagacaatggaaaccctgctcctgcttggcctcatgattctgctgaccggaggtgctatgctgttcttgatcagcggcaaggggattggcaaaacgtccatcgggctgatctgcgttattgccagctcaggaatgctctggatggccgagattccgttacagtggatcgcgagcgccatcgtccttgagtttttcatgatggtgttacttatcccagagcccgaaaagcagcgtacgccccaagacaaccaactggcctacgtggtcattggtatcctcacactggccgcgataattgccgccaacgagatgggcttgctcgagaccacaaaacgcgatcttggcatgagcaaagagcccggggtggttagccccacctcctacctggacgtcgatctacatcccgccagcgcctggaccttatacgcggtggccacgacggtgatcacccccatgctgaggcataccatcgaaaattccaccgccaacgtctcgctagcagccattgccaaccaggccgtggtgctgatgggtctggataagggatggcccatctcaaaaatggaccttggcgtccctctgctggccctggggtgttacagccaggtgaacccgctgacgctgacggccgccgtgctcctgctcatcacccactacgcgataatcggcccgggcttacaggccaaggcgacccgagaagcccagaagagaacagcagctggcatcatgaagaaccctaccgtagacgggatcatgaccatcgacctggaccctgtaatctacgactccaagttcgagaaacagcttggccaggtaatgctactggttctgtgcgccgtgcagctcctgctgatgcgcaccagttgggccctctgcgaggccttaacgcttgctacaggcccaatcaccaccctatgggagggcagccccgggaagttctggaacacgaccatagcggtaagtatggctaacatattccggggctcctatttagccggtgcaggcctggcgttcagcatcatgaagtccgtcgggacgggcaagcgaggcaccgggagccagggcgaaaccctgggggaaaaatggaaaaagaagctcaaccagttgtcacgaaaggagttcgacctctacaagaagtccgggataacggaggtggacagaaccgaggcaaaggaaggtctcaagcggggcgagatcacacaccacgccgtgagccgcggatccgccaagctgcagtggtttgtcgagcggaacatggtgatccctgaggggcgcgttatcgacctcggctgcggcaggggcgggtggagctactactgcgccggattaaagaaagtcaccgaggtgcgcggctacactaagggcgggccggggcacgaggagcccgtccctatgtccacatacggctggaacattgtcaagctgatgagcgggaaggacgtgttttacctcccgccggagaaatgcgacacactgctttgtgacatcggcgaatccagcccttccccgaccgtggaagagtcgcgcacaatccgggtcctgaaaatggtggagccctggctcaagaataaccagttctgcattaaggtgttgaacccctacatgcccaccgtcatagaacatctggaacgcctccagcggaagcatggcggaatgctggtgcgtaatccactgagtcgtaacagcacccacgaaatgtactggattagcaacgggacaggaaacattgtcgcgagcgtaaacatggtgtcccgtctcttgttaaaccggttcacgatgacccaccgccggccgaccatcgagaaggacgtggacctaggcgctggcactcgccacgtcaacgccgagccagagacgcccaacatggacgtgatcggggagcggatcaaacgaatcaaggaggaacataattcaacctggcactatgacgatgagaacccatacaaaacctgggcctaccacggctcctacgaagtaaaggccactggatcagcgagtagcatgatcaacggtgtcgttaagctcctgacgaagccgtgggacgtcgtgccgatggtgacacagatggctatgaccgataccaccccctttgggcagcagagggtcttcaaagagaaggtagacacaagaactccgaggtcaatgcccggcaccaggcgagtgatgggcatcaccgcggagtggctctggcgcacattagggcggaacaagaaaccccgcctgtgcaccagagaggagttcaccaagaaggtccgtacgaatgcggcgatgggggctgtcttcaccgaggaaaaccaatgggactccgccaaagccgcggtggaagacgaggacttctggaagctcgtcgatcgcgagagggagctgcataaactgggcaagtgcggaagctgcgtatacaacatgatggggaagcgcgaaaagaagctgggcgagttcggcaaggcgaagggttccagagccatctggtatatgtggttaggcgcacgataccttgagtttgaggccctagggttcttgaacgaggaccactggttcagccgggaaaattcctatagcggcgtagagggggagggcctgcataagctcgggtatatcctgcgcgatatctccaagatccctgggggcgcgatgtatgcggacgacaccgccgggtgggatacccggatcacggaggacgacctgcacaacgaggagaagatcacccagcagatggaccctgagcatcgtcaactcgcgaatgcgatcttcaagttgacctaccagaataaggtcgtgaaggtgcagcggcccacccccactgggacggtaatggacattatctcccgtaaggaccagcggggctccggccaggtgggcacctacggcctgaacaccttcacgaacatggaggctcagcttatccgccaaatggagggcgaaggagtgctgagtaaagcggacctggagaaccctcacctcccggaaaagaagatcacgcagtggctcgagacaaagggagtcgagcgtctgaaacgtatggcaatctccggcgacgattgcgtagtgaagcccatcgacgaccgctttgccaacgccctcctggccctgaacgacatggggaaagtccgcaaagacataccgcagtggcagcccagcaagggttggcacgactggcagcaggtaccgttctgctcccaccacttccacgagctcatcatgaaggatgggcggaagctggttgtcccctgcagaccccaggacgagctgatcgggcgggcgcgcatcagccaaggggccggctggtccctgcgcgagacggcatgcctgggcaaggcttacgcgcagatgtggagcctgatgtacttccaccggcgcgacttgcgtctggcgtccaacgccatctgcagcgccgtgccagtgcattgggttcctacatcccgcaccacgtggagcatacacgcccaccatcagtggatgaccacagaggatatgttgacggtttggaatcgggtgtggatcgaagacaacccctggatggaggacaagacacccgtcaccacgtgggagaacgtgccatacttagggaagcgcgaggaccagtggtgcggcagccttatcgggctgacgtcccgggctacctgggcccagaacatccccacagccatccagcaggtacggagcttaatcggcaacgaggagttcctggactacatgccctccatgaagaggttcagaaaagaggaggaatctgagggggccatctggtga

SEQ ID NO: 25687 - RNA, 9873 nt, synthetic construct
  misc_feature 1..9873: note = derived and/or modified CDS sequence (opt11) from DENV-3__GU131844__SS-prME
  source 1..9873: mol_type = other RNA
acttcgctctgccttatgatgatcctgcccgccgccttggcgttccacctcacgtcgcgggatggagagccccggatgatcgtgggcaaaaacgaaaggggaaagtctctgctgttcaaaaccgccagcgggataaacatgtgcaccctcatcgcaatggacttaggggaaatgtgtgacgacaccgtgacttacaagtgcccccacatcacggaggttgaacccgaggatatcgactgctggtgcaacctgaccagcacctgggtgacctacgggacgtgcaaccaggccggagagcggcgccgggacaaacgcagcgtggccttagctccccacgtgggcatggggctggacacccggacccaaacctggatgagcgcagaaggcgcctggcgccaagtggagaaggtcgaaacttgggccctgcggcacccgggattcaccatactcgcccttttcctcgcacactacatcgggacctcactcacccaaaaggtagtgatattcatcctactgatgctcgttacgccaagcatgaccatgcgctgcgtgggggtgggcaacagggatttcgtggaaggcctgtccggggctacctgggtcgacgtggtactcgagcacggtgggtgcgtgaccactatggccaaaaacaagccgaccctagacattgagttacagaagaccgaagccacacagctggccacgctccgcaagctgtgcatcgagggcaagataaccaatatcaccaccgattcacggtgtcccacccagggggaagccgtcctgcccgaggagcaggatcagaactacgtctgcaaacacacgtacgtggacagggggtggggtaacgggtgcggtctcttcgggaaggggtccctggtgacctgtgcaaagttccaatgcctggagctcattgagggtaaggtcgttcagtacgagaatctgaagtacaccgttatcataaccgtgcacactggggaccaacatcaggtgggcaacgagacccaaggcgtaactgccgagataacaccccaagccagcaccacagaggcgatcctgcccgagtacggtaccctcgggctggagtgctcgcccaggacaggattggacttcaacgagatgatcctcctgacgatgaagaacaaagcctggatggtacataggcagtggttcttcgacttgccgctcccctggacctctggcgccaccaccgagacgccgacctggaatcgcaaggaactactggtaacattcaagaacgcccatgcaaagaagcaggaggtcgtggtcttgggaagtcaggagggcgcgatgcatactgccctaaccggcgctaccgagatacagaacagcggcgggacctccatcttcgccggtcacctgaagtgccgtctcaagatggacaagctggagttaaagggcatgagctacgccatgtgtacgaacacgtttgtactcaagaaagaggtgtcagagacccagcacgggaccatcctgatcaaggtcgagtataaaggcgaagatgcgccttgcaagatcccgttcagcacggaggacgggcagggcaaagcccataacggcaggctgatcacggcaaaccccgtcgtcacaaagaaggaagaacccgtgaacatcgaggccgagcccccgttcggggaatccaacatcgtaatcgggacgggggacaacgcgctgaagatcaactggtacaagaagggctcctcaatcggtaagatgttcgaggctaccgcgcgaggcgcgcggcgcatggccattctcggcgacacggcgtgggactttgggtccgttggcggcgtgctgaacagcttaggcaagatggtccaccagatattcggttccgcctacactgccctcttctcgggcgtttcctgggtgatgaagataggcataggggtcctgctgacctggatcggccttaactccaagaacacctccatgagtttcagttgcatcgccataggcatcatcacgctatatcttggtgcggtcgtgcaggccgacatggggtgcgtcataaactggaagggcaaagagctcaagtgtggcagcgggattttcgtgaccaacgaggtgcacacctggacagagcaatacaagttccaagcggacagcccaaagcgcctggccacggccatagcgggggcgtgggaaaacggggtctgcggcattcgtagcaccacccgcatggagaacctgctatggaagcagatcgcaaacgaactgaactacatcctgtgggagaataacgtgaagctcaccgtggtcgtgggggacatcatcggcgtgctggagcagggcaaacgcacgctaacaccccagccaatggagctcaagtactcctggaaaacctgggggaaggcgaagatcgtaacagccgaaacgcagaactcgagcttcattatcgacggccccaacacccccgaatgtccttcggcttcccgcgcctggaatgtgtgggaggttgaggattacgggttcggcgtgttcaccacaaacatttggctcaagctgcgagaggtctacacccagctctgcgaccaccggctgatgagcgcagccgtgaaagacgaacgagcagtacacgcggatatgggatactggattgagagccagaaaaacggttcctggaaactggagaaggccagcctcatcgaggtgaagacgtgtacctggccaaagtcccacaccctgtggagcaacggagtgttagagtccgacatgatcatccccaagtctctcgctgggcccatctcgcagcacaaccaccgccccggttaccatactcagacagccgggccgtggcacttaggcaagctggaactcgacttcaactactgcgagggcacaaccgtcgttataaccgagaactgtgggacgcggggtccgagcctgcgcaccaccaccgtgtctgggaaacttatccacgagtggtgctgtcggagctgtacgctgccgcccctccgctatatgggcgaagatgggtgctggtacggcatggaaatacggccgatcagcgagaaggaggaaaacatggtcaagagcctggtgtccgctggcagcgggaaggtcgataacttcacaatgggcgtcttatgcctggcgatcctgttcgaggaagtgatgcgcgggaagttcggcaagaagcacatgatagcgggcgtgttcttcacatttgtactcctcctgtccggccagataacctggcgggacatggcccacacgctcataatgatcgggagcaatgcgtccgatcgcatggggatgggcgttacatacctggccctgatcgcgacattcaagattcagcctttcctcgccctcgggttcttcctacggaagctcaccagccgagagaacctgctgctaggcgtgggcctggccatggccacgacactgcagctccccgaggacatagagcaaatggcgaacggaattgccctggggctgatggccctcaaactaatcacccagttcgagacctaccagctgtggacggccctcataagcctgacctgttcgaacacgatgttcactctaacggtcgcctggcggaccgcgaccctcattctcgctggtgtgtctctgctccctgtgtgccagtccagctccatgcgcaagaccgactggctgccgatggctgtggccgccatgggagtgccacccctgccgcttttcatcttcagtttgaaggacacgctgaagcgccggtcctggccgttgaacgagggggtcatggcggtgggtctggtgagtatcctggcctccagcctcctgcgcaacgacgtgccaatggctggccccctggtagctgggggcctcctgattgcgtgctatgttatcactgggacgagtgcggacctcaccgtcgaaaaggccgcagacatcacgtgggaagaggaggcggaacagaccggcgtcagccacaacctcatgatcacagttgatgacgacgggaccatgcggatcaaggacgacgaaaccgagaacatcctcaccgtcctgctgaaaactgctctgctgattgtgagcggggtgttcccctatagcattccggctacactcctggtctggcacacatggcagaagcaaacgcagcgctcaggcgtattatgggacgtgccctccccgcctgagacccagaaagccgagctcgaagagggagtctatcggataaagcagcagggcatattcggaaagactcaggtgggtgtcggggtccaaaaggaaggcgtgttccacaccatgtggcacgtgacgcgcggcgccgtcctaacctacaacggcaagcggctggagccgaactgggctagcgtcaagaaagatctcatctcttacggcgggggttggcgcctctccgcgcagtggcagaaaggggaggaggtgcaggtcatcgccgtggagccaggtaagaatcctaaaaatttccagaccatgcccggcacatttcagacgaccaccggtgaaataggagccatcgccctggacttcaagcctggaaccagcggctccccaatcatcaaccgggagggcaaagtcgtcgggctgtacggaaacggcgtggtgaccaagaacggcggttatgtctccgggatcgcccagacgaacgcagaacccgacggcccgacccccgagttggaggaggagatgttcaaaaagcggaacctgacgatcatggacctccaccccggtagcggtaagacgaggaagtatcttccagccattgtgcgcgaggccatcaagcggaggctacggacccttatcttagcaccgacgcgcgttgtcgccgcggagatggaggaggccctgaaggggctgcccatccgttaccaaaccacggccaccaaatccgaacacaccggtcgcgagatcgtggatttgatgtgccacgccacgttcacgatgcggttgctaagccccgttcgcgtccccaactacaacttaatcatcatggatgaggcccactttaccgacccggcgtctatcgccgcccgggggtacatcagcacacgcgtcggaatgggcgaggccgccgctatctttatgaccgctacgcctcccggaaccgcagatgccttcccccaatccaacgcgccgatccaggatgaggagcgcgatatccccgaacggagttggaactccgggaacgaatggataaccgactttgccgggaagactgtgtggttcgtaccttccatcaaggccggcaacgacatcgccaactgcttacgcaagaacggtaagaaagtgatccagctgtccaggaagacgttcgacacagagtaccaaaagaccaagctcaatgactgggatttcgtggtgacgacagacatcagcgagatgggcgccaacttcaaagcagaccgcgtgatcgacccccgcagatgcctgaagccagtgattctcacggacggccccgagcgggttattctcgccgggccgatgcccgtgactgccgcgtccgcggcgcagcggcggggccgcgtcgggcggaacccgcagaaggagaacgaccaatacatcttcaccggacagcccttgaataacgatgaagaccacgcccactggaccgaggccaagatgctgctcgacaacattaatacgcccgaggggatcatcccagctcttttcgagcctgagcgcgagaagtccgcggcgatcgacggagagtaccggctgaagggggagtcccgcaagaccttcgtggaactcatgcgcagaggggatctgcccgtgtggctagctcacaaggtcgccagcgagggcatcaaatacaccgaccggaagtggtgctttgatgggcagaggaacaaccaaatcttggaggagaacatggatgttgagatctggaccaaagagggcgagaagaagaaactgcggccccgctggctcgacgcccgaacgtactccgacccccttgcgcttaaggagttcaaggacttcgcagccggcagaaaatccattgctctggacttggtaaccgagatcggacgcgtcccgtcccacctagcccaccggacccgcaacgcgctagacaacctcgtgatgctgcataccagcgagcacggtgggcgggcttatcgccacgccgtcgaggaactgcccgagacgatggagaccctactgcttctagggctgatgatacttctcaccggcggcgcaatgctgttcctgatcagtggtaaggggattggcaagacctcgattgggcttatatgcgtgatagccagcagcggcatgctgtggatggcggagatccccctgcagtggatagccagcgccatcgttctggagttcttcatgatggtgcttcttatcccggagccagaaaagcagcggacgccccaggacaaccagctcgcatacgtcgtgatcgggatcctaaccctggccgcgatcatcgctgccaacgaaatgggcttgctggagacaaccaagcgcgacctgggaatgtccaaggagcccggggtggtaagccccacttcctacttggacgtcgacctgcatcccgcgagtgcgtggactctgtacgccgtggccaccaccgtcatcacgcccatgctccggcacaccattgagaacagcacagccaacgtgtctctggccgcgattgccaaccaagccgtcgtcttaatgggcctcgacaaggggtggcccatttccaagatggacctgggagtgcccctgcttgcactggggtgttacagccaggtgaatcccttgaccctcactgccgcggtcctgctcctcattacacactacgccattatagggcccggccttcaggccaaggctacccgcgaagcccaaaagcggactgcggcgggtataatgaagaaccccacggtggacggtatcatgacgatcgacttggatccggtgatctacgactccaagttcgagaagcagctcgggcaggtaatgctgctggtgctctgcgccgcgcaacttctcctcatgcgaaccagctgggcactgtgtgaggccctgaccctagctacgggccccatcacaacgctgtgggaggggtctcccgggaagttctggaataccacgatcgccgttagcatggccaatatattccggggttcgtacctggcgggggccggcctcgccttctcgatcatgaagtccgtcgggactggcaaacgcggaaccgggagtcagggcgagaccttaggggagaaatggaagaagaaacttaaccagctctcccgcaaggagtttgacctgtataaaaagagtggcatcactgaggtcgaccgcaccgaggcgaaggagggtctgaagcgcggcgagatcacacaccatgccgtaagtcgcggctccgcgaaactccagtggttcgtcgagcggaatatggtgatccccgaggggcgcgtgatcgacctgggctgcgggcgcggtgggtggagctactattgcgccggcctgaagaaggtaacagaggtgcgcggctacactaagggcgggccgggacacgaagaaccagtgcccatgtcaacttatggctggaatatagttaagttgatgtccggtaaggatgttttctacctgcccccggagaagtgcgataccttactctgcgacatcggcgagtccagcccctcccccaccgtggaggaaagtcgcacaatccgggtcctcaaaatggtggagccctggctaaagaacaaccaattctgcatcaaggtgctgaacccttacatgcccactgtgatcgagcacctcgagcgcctgcagcggaagcacggcggaatgctggtgcggaacccgctctcccggaatagcactcatgaaatgtattggatttcgaacggaaccgggaacatcgtggcctccgtgaatatggtgtccaggctgctgctcaatcggtttacaatgacgcaccgccggcctaccatcgagaaggacgttgacctgggtgctggcactcgtcacgtcaatgcggagccggagacccccaatatggacgtaatcggggagcggatcaagcgtatcaaggaggagcacaactcaacgtggcattacgacgacgagaacccctacaagacctgggcgtaccacggttcctacgaagtgaaagcgacagggtccgcctctagcatgatcaacggggtcgtgaaactgttgaccaagccgtgggacgttgtgccaatggtgacgcagatggctatgaccgataccacccccttcgggcagcaacgcgtctttaaggagaaagtggacacgcggacaccgcggtcgatgccgggcacccgccgggtgatgggcatcaccgcggagtggctgtggaggaccctcgggcggaacaaaaagcccaggctgtgcacacgcgaggagttcactaagaaagtccgcaccaacgccgccatgggggccgtttttactgaggagaaccaatgggacagcgccaaggcggccgtggaggatgaggatttctggaagctagtagaccgcgagagagagctgcacaaactgggtaaatgcggcagctgcgtgtacaacatgatggggaagcgcgagaagaagctgggagagtttggcaaagccaaggggtctcgggctatctggtacatgtggctcggagcgcgctacctcgagtttgaggcactgggcttcctgaacgaagatcactggttcagccgggagaactcctacagcggtgtggagggggagggcctccacaagttaggctacatactgcgcgacatatccaagatccccggaggcgctatgtatgccgacgacaccgccggctgggacacgaggatcaccgaagacgacctccacaacgaggagaaaattactcagcagatggaccccgagcatcgccagctggccaacgcgatcttcaagctgacgtatcagaacaaagtcgtgaaggtgcagcggccgactccgaccgggaccgtcatggatatcatctctagaaaggaccagcgtggatccggccaggtgggcacttacggtcttaataccttcaccaacatggaggcccagctgatccgccaaatggagggcgagggggtgctgagcaaggcagacttagagaacccacacctccccgagaagaaaatcgcccagtggctggagaccaagggtgttgaacgcctcaagcgcatggccatctccggagacgattgcgtggtgaagccgatagacgaccggttcgcgaacgccctgttggcactgaacgacatggggaaagtccgcaaagacatcccccagtggcagcccagcaagggctggcacgactggcagcaagtccccttctgctcccaccattttcacgaactaatcatgaaggatgggcggaagctggttgtaccatgccgcccccaggatgaactaatcggccgggcccgcatcagtcaggggtccggatggtctctgcgcgagacggcttgcctgggcaaagcctatgcccaaatgtggtccctcatgtacttccaccgccgcgatctgcggctggctagcaacgccatctgctccgcggtccccgtgcattgggtccccacaagtcgcaccacctggagcattcacgcccaccaccagtggatgacgaccgaggacatgctcgccgtctggaaccgagtgtggatcgaggacaacccctggatggaggacaagacacccgttaccacgtgggagaacgtcccctatctcggtaagcgcgaggaccagtggtgtggctccctgatcggactcaccagtcgggccacatgggcccagaacatccccaccgctatccaacaggtccggtccctgatcggcaacgaggagttcctggactacatgccgagtatgaagcggtttcgcaaggaagaggagtccgagggagcaatatggtga

SEQ ID NO: 25688 - RNA, 9873 nt, synthetic construct
  misc_feature 1..9873: note = derived and/or modified CDS sequence (opt11) from DENV-3__GU131849__SS-prME
  source 1..9873: mol_type = other RNA
actagcctctgtctcgtgatgatcctaccagcagccctggccttccacctgactagccgggacggggagccacggatgatagtaggtaagaacgagagaggcaagtcgctgctattcaagacagccagcgggatcaacatgtgcacgctcatcgccatggaccttggcgagatgtgcgacgacaccgtgacctacaagtgcccccatattaccgaagtggagcccgaggacatcgactgctggtgcaacttaacctctacatgggtgacatacggtacctgcaaccaggccggcgagcggcgccgggacaagcgctcggttgctctcgctccccacgtcggaatgggtttagacactcggacacagacctggatgtcggccgagggtgcctggcgccaggtcgagaaggtggagacgtgggccctgcggcatccggggtttaccatactcgctctgttcctggcccactacatcggcacctcccttacccagaaagtagttatctttatcctgctgatgctcgtgactcccagcatgaccatgcgctgcgtgggggtcggcaaccgcgatttcgttgagggtctgtccggggccacctgggtggacgtcgtgttagagcacggcggctgcgtgacgacaatggcgaagaacaaacccaccctagacatcgaactgcagaagaccgaggccacgcagctggctacgttacgcaagctctgcattgagggcaagatcactaacataaccaccgatagccgttgccccacgcagggtgaagccgtcctgccggaggagcaggaccagaactacgtgtgcaagcacacctacgtcgatagaggatggggcaacggctgcggcctcttcggaaaagggtccctggtgacctgtgcaaagttccagtgccttgagcctatagaggggaaggtggtgcaatacgaaaacctcaaatacaccgtcatcatcaccgtgcacacgggggaccagcaccaggttggcaacgagacccaaggggtgaccgccgagatcacgccccaggcaagcaccatcgaggcgatacttcccgagtacggcacattaggtctcgagtgctcccctcggacagggctggacttcaacgagatgatcttgttgacaatgaaaaacaaggcatggatggtgcaccgccagtggtttttcgatctgcctctgccctggacgagcggcgccacaacggagacccctacgtggaatcggaaggagctcctggttaccttcaagaacgcacacgcaaagaaacaggaggtggtggtcctggggtcccaagagggtgcaatgcacacggccctcacaggggccactgaaatccagaacagcggcgggacatccatcttcgccggccacctgaaatgccgcttaaagatggacaaactcgagcttaaggggatgtcgtacgcgatgtgcaccaataccttcgttctgaagaaggaggtgtcagagacgcaacacgggaccatcctcatcaaggtggagtaccgtggtgaggacgccccttgcaagattcccttctcaacagaggacgggcagggcaaggcgcacaatggccgcctgatcaccgcgaaccccgtagttacgaagaaggaggagcccgtcaacatcgaggccgaaccgccgttcggagagagcaacatagtgatcggcataggggataacgctctcaagattaactggtataagaagggttcaagcatcgggaagatgttcgaagcgactgcccggggcgcccgccggatggccatcttgggggacaccgcgtgggatttcgggtctgtcggcggggtgctcaactcactgggtaagatggtgcaccagatcttcggctccgcctacaccgcactgtttagcggcgtaagctgggttatgaagatcggcatcgggattctactgacgtggatcggcctgaactctaagaacacctccatgtctttcagttgcatcgccattgggatcatcaccctatacctgggcgccgtggtacaggcggatatgggctgcgtcatcaattggaagggcaaggagctcaagtgtggctcggggatcttcgtgaccaacgaggttcacacgtggaccgagcagtacaagttccaggcagactccccaaagcggctcgccaccgcaatcgcgggggcgtgggagaacggggtttgtggcatacgttctaccacgcggatggagaacctgttgtggaaacagattgccaatgagctcaactacatcctgtgggagaacaacatcaagttaacagttgtggtaggggacatcatcggcgtgctcgagcagggtaagcgcaccctgaccccccaaccgatggagctcaagtactcctggaaaacatgggggaaggccaagatcgtgaccgctgaaacccagaatagctccttcatcatcgacggccccaacacacccgaatgcccctcagcgtcccgcgcctggaatgtctgggaggtggaggactacgggttcggcgtgttcacgaccaacatctggttgaagctacgcgaggtttacacacagctgtgcgatcaccggctcatgagcgccgctgtgaaggacgagcgcgccgtccacgcggacatgggctactggatagagtcacagaagaacgggagttggaagctggagaaggccagcctcatcgaggtcaaaacctgtacctggccaaagagccacacactttggagcaatggcgtgctggaatccgacatgataatccccaaaagcctggccgggcccatctcccagcacaaccaccggccgggctaccacactcagactgccggtccgtggcacttaggcaaactggagctggacttcaattactgcgaaggcaccacggtagttatcacagagaactgcgggacccgcggcccgtccctccggaccacgaccgtatccgggaagctgatccacgaatggtgctgccgctcatgcacgctgcccccgctccggtacatgggcgaagacgggtgctggtacggcatggagataaggcccatctccgagaaggaagagaacatggtaaagagcctggtttccgcgggctcgggaaaggtcgacaactttaccatgggcgtgctttgcctcgcgatcctgttcgaggaggtgatgcgtgggaaattcggcaagaagcacatgatcgccggggtgttcttcacgtttgtgctgcttctttccggacaaatcacctggcgcgacatgactcataccctgatcatgatcggtagcaacgcttccgaccggatggggatgggcgtcacttacctggccttgattgccacctttaagatccagcccttcttagcactcgggtttttcctgagaaagttgacctctagggagaacctcctgctgggggtgggcctggccatggccaccatgctgcagctacctgaggacatcgagcagatggccaacgggatagcgctcggcctgatggccctgaagctgatcacgcagttcgagacctaccagctatggaccgctctgatcagcctgacctgctccaatacgatgttcaccctgaccgtggcctggcgcaccgccacgctcatcctcgcgggggtcagtctgctgccggtgtgccagagcagcagtatgcgtaagacggactggctccccatggccgtcgcggccatgggggtgccgcctttaccgctgttcatattcagcctcaaggacaccctgaagagaaggtcctggcccctgaacgagggggttatggccgtcggcctcgtgtctatcctggcatccagtcttctccgaaacgacgtgcccatggccggcccgcttgtcgccgggggtctgctcatcgcctgctacgtgattaccgggacgtccgccgacctcaccgtggagaaggcggccgacataacctgggaggaagaggccgagcagaccggcgtcagccacaacttgatgatcacggtggacgacgacggcaccatgagaatcaaagacgacgagaccgagaatatcctcaccgtcctcctaaaaaccgccctcctgatcgtctccggcgttttcccctatagcatccccgccacgctgctcgtgtggcacacatggcagaaacagacccagagatctggcgtactgtgggacgtacccagcccaccggagacccagaaggctgagctagaggagggggtgtatcgcatcaagcagcagggtattttcggcaagacgcaggttggcgtgggggtgcagaaggagggcgttttccacacgatgtggcacgtgacccggggcgccgtattaacatacaacgggaagcggttagagcccaactgggcctccgtaaagaaggacctgatcagctacggcgggggctggcggctatccgcccagtggcagaagggggaggaggtgcaggtgatcgcagttgagcccgggaagaaccccaagaacttccagacgacacccggcacgttccagactaccaccggagaaatcggggctatcgctctggacttcaaacctgggacctctggcagccccatcatcaaccgcgagggcaaggtagtggggctgtatggcaacggagtcgtgaccaagaatggcgggtacgtctccggcatcgcccagacaaacgccgagccggacgggccgacgccagaactggaggaggagatgttcaaaaagcgtaacctcacgatcatggacctgcaccccgggagcggcaaaacgcgcaagtatctgccagcgattatccgggaggccatcaagaggcgactccgcacactgatcctcgcccccacccgggtcgtagcagcagagatggaggaggcgctcaaggggctgcccatccgataccagactaccgctacaaagtccgagcacaccggccgggagatcgtggacctgatgtgccacgccaccttcaccatgcggctcttatcccccgtgcgggtgcctaattacaatctgataatcatggatgaggctcactttacggaccccgccagcatcgcggcccgcgggtacatcagcacccgcgtgggcatgggcgaggccgccgcgatcttcatgaccgccacgccgccaggtacggcggacgcattcccgcagtccaacgcccccatccaggacgaggagcgggatattcccgagcgctcgtggaactccgggaacgaatggatcaccgactttgcagggaagactgtctggttcgtacccagcataaaggccggcaatgacatcgccaactgcctccggaagaacgggaagaaggtgatacagctttcacggaagactttcgacacggagtaccagaagaccaagctgaacgactgggacttcgtggtgactaccgacatcagcgagatgggagcaaatttcaaggccgaccgggtgatcgacccccgccggtgcttgaagcccgtgatcctgaccgacggccccgagcgcgtgatcctcgccgggcccatgccggtgaccgccgcctccgccgcccagagacgcggacgggtcggtcgaaaccctcagaaagagaacgaccagtacatattcaccggccagcccctaaacaacgacgaggaccacgcgcattggaccgaggccaagatgctgctggacaacatcaacacccccgagggaattatcccggccctcttcgagcccgagcgggagaagtccgccgcgatcgacggcgagtaccggttaaagggcgagtcccggaagacgttcgtggagctcatgcgccgcggggacctacccgtatggctggcccacaaagtcgccagcgagggcatcaagtacacagaccggaagtggtgcttcgacgggcagcggaacaatcaaatcctggaagagaacatggacgtggaaatctggaccaaggagggcgagaagaagaaactccgcccacgctggctggacgcccggacctactccgacccgctggccctgaaggaattcaaggacttcgccgccggcaggaagagcattgcccttgacctggtcacggagatcgggcgggtgccctcccacctcgcccatagaaccagaaacgccctggataacttggtgatgcttcacaccagtgagcacggcgggcgagcgtaccgacacgccgtcgaggaactacctgagacaatggagacgctgctcctactcggcttaatgatcctgttaactgggggcgccatgctcttcctcatcagtgggaagggaattggcaagacatccattgggctgatctgcgtgatcgccagctcgggcatgctctggatggcagagatcccgctccaatggatcgcaagcgccatcgtgctggaattcttcatgatggtcctcctgatcccggagccagagaagcagcgcacgccccaggacaaccaactggcctacgtggtgataggaatcctcacgctggcggccatcatcgcagccaacgagatgggcctgctcgagaccacgaagcgtgacttaggcatgtccaaggagcctggcgttgtaagccccacgtcgtacctggatgtcgacctacaccccgccagcgcgtggactctgtatgcggttgcgaccaccgtgatcactcccatgttgcgacacaccatcgagaactctaccgccaacgtgtccttggccgctatcgctaaccaggcggtcgtacttatgggcctggataaggggtggccgattagcaagatggacctcggcgtacccctgcttgctctcgggtgctacagccaggtcaaccccctgaccctgaccgccgctgtgttactgctgatcacacactacgcgatcatcggccccggcctccaggccaaagctacccgggaggcccagaaacgaaccgccgcagggatcatgaagaaccctaccgtggacggcatcatgacgattgacctggatcccgtcatctatgactccaagttcgaaaagcaattaggccaggtgatgctcctggtgttatgcgccgtccagctcctgctgatgcggacgtcttgggcactctgcgaggctctaacccttgcgaccggccccatcacgacactctgggaaggcagtcccgggaagttctggaataccaccatagccgtgagtatggccaacatcttccgcggatcgtacctggcaggggccggcctggcgttcagcatcatgaagtccgtgggcacgggcaaacggggcaccgggtctcagggggagaccctcggagagaagtggaaaaaaaaacttaaccagctctcccgaaaggagttcgacctctacaagaagtccggcatcaccgaagtcgaccggactgaggccaaggaagggctgaagcgcggcgagataacgcaccacgcagtcagccgtggctccgccaagctgcagtggttcgtggagcgcaatatggtcatcccggagggacgggtaatagatcttggttgcggtcgcggcggctggagctactactgcgccggtttgaagaaagtgaccgaggtgcgcggctacaccaagggagggcccgggcacgaggagcccgtgcccatgagtacgtacggctggaacatcgtgaagctgatgagcggtaaggatgtattttacctcccgccagagaagtgcgacacgctgttatgcgatatcggagagtccagtccctcccccaccgtggaagaaagccggacaattcgcgtgctgaaaatggtcgaaccgtggctgaagaataaccagttctgcatcaaggtattaaacccgtacatgcccaccgttattgagcacctggagcggctccagagaaagcacggtgggatgcttgtacggaaccccctgtcccgtaacagcacccacgagatgtactggatctccaacggcacggggaacatagtggcaagcgtgaacatggtgtctcggctcctgctaaaccgcttcaccatgactcaccggcgcccgactattgagaaggacgttgacttaggcgccggcacccggcacgtgaatgctgagcccgagactccgaacatggacgtcatcggggagcgcatcaagcggatcaaagaggagcacaactctacctggcactacgacgacgagaacccgtacaaaacgtgggcctaccacggctcctatgaggtgaaggccaccggaagcgcgtcctcgatgatcaacggagtggtcaagctgttgaccaagccctgggacgtggtgcccatggtgacccaaatggcaatgactgacaccacgccgttcgggcagcagcgcgtgtttaaggagaaggtcgacacacgaacgccgcggagcatgcccggcactcggagagtgatggagatcaccgccgaatggctctggcggaccttaggccgcaacaaaaagccccgcctatgtacacgggaggagtttaccaagaaagtgcgcaccaatgcagcgatgggggctgtcttcaccgaggagaaccagtgggattcagcgaaggccgccgtagaggacgaagatttctggaagttagttgaccgcgagagagagctgcacaagctcggcaagtgcggaagctgcgtgtacaatatgatgggcaagcgggagaagaagctcggggagttcgggaaggcaaaaggctcccgcgccatctggtacatgtggctgggagcgcgttacctcgagtttgaggccctcggttttctgaatgaggatcactggttttcccgcgagaactcctacagcggggtggagggcgaagggctgcacaaactcgggtacatactgcgggacatctccaagatacccggcggggcgatgtacgcggatgacactgccggatgggacacccgcatcacagaagacgacttacacaacgaggagaagatcacccagcagatggacccggagcaccggcagctggccaacgccatctttaagctgacgtaccagaacaaggtggtcaaggtgcagcgtcccacccctactggcaccgtgatggacatcatcagccgcaaagaccaaagaggctcgggccaagtcgggacctacggacttaacaccttcacgaatatggaggcccaactcatccggcagatggagggtgagggcgtgctgtcaaaagcggacctggagaactcccacctcccagagaaaaagatcacccagtggctggagaccaagggagtggaacgcctgaagcggatggccatcagcggcgacgactgtgtcgtaaagccgatcgacgatcgctttgccaacgcccttcttgcgctgaacgacatgggcaaggtccggaaggacatcccccagtggcagccctcaaaggggtggcacgactggcagcaagtccccttctgctcacaccacttccacgagctcattatgaaagacggccgaaagctcgtggtgccgtgcagaccccaggacgaactgatagggcgggcgcgcatcagccagggcgccgggtggtctctacgggagaccgcctgcctgggtaaggcgtacgcgcagatgtggagcctgatgtatttccaccgtcgtgacctccgcttagcaagtaacgccatctgctccgccgtccccgtgcactgggtgcccaccagcagaactacgtggagcatacacgcacaccatcagtggatgactaccgaggacatgctgaccgtctggaaccgcgtgtggatcgaggacaacccgtggatggaggacaagacccccgtgacaacctgggagaacgtcccctacctcggaaagcgggaggatcagtggtgcgggtccctgatcggcctgaccagcagggcgacctgggcgcagaacatacccacggccatccagcaggtccggtccctcatcgggaacgaggagttcctggactatatgccgagtatgaagcggttccgtaaagaggaagaatccgagggggccatctggtga

SEQ ID NO: 25689 - RNA, 9873 nt, synthetic construct
  misc_feature 1..9873: note = derived and/or modified CDS sequence (opt11) from DENV-3__GQ868546__SS-prME
  source 1..9873: mol_type = other RNA
accagcctctgcttggtgatgatcctgcccgcagccttggcattccacttaaccagccgggacggcgaaccccggatgatcgtggggaaaaacgagcgtggcaagagcctgctgttcaagaccgcctctgggatcaacatgtgtaccctcatcgccatggacctgggggagatgtgtgacgacaccgtgacttacaaatgcccccacatcacagaggtagagcccgaggacatcgactgctggtgtaacctcaccagcacttgggtgacctacgggacgtgcaaccaggccggggagcggcgccgggacaagcgctctgtggccctggcgccccacgtgggcatggggctagacacccggacccaaacatggatgagcgcagagggcgcctggcgacaagtcgagaaggtggagacgtgggccctgcggcacccaggattcaccatcctcgcgctgttcctagcccactacatcggcacgtccctcactcaaaaggtggtcatcttcattcttctgatgctcgtgacgcccagcatgaccatgcgctgcgtgggggtcggcaaccgggacttcgtggaaggcctgtccggggccacctgggtagacgtagtactggagcacggagggtgcgtgacgacgatggcgaagaacaagcccacgctcgacatcgagctccagaaaacagaggcaacccagttagctacgctccgcaagttgtgtatcgaggggaagattactaacatcacgaccgacagccggtgccccacacagggcgaagctgttctgcctgaggagcaggaccagaactatgtgtgcaagcacacctatgtggaccgcgggtggggcaacggctgcggcctcttcgggaagggctcccttgttacgtgcgcgaagttccaatgcctggagcccatcgagggcaaggtggtgcagtacgagaacctcaaatataccgtaattattacggtccatacaggtgatcagcaccaggtcggtaacgagacccaaggcgtgaccgccgagatcacgccccaggccagcaccaccgaggcgatattgcccgaatacggcacactagggctcgagtgcagcccgaggactggcctggactttaatgagatgattcttctcaccatgaagaacaaggcctggatggtccaccgccaatggttcttcgacctgcccctgccctggacctctggcgcgaccaccgagacgcccacctggaaccgtaaggagcttctggtcaccttcaaaaacgcccacgctaaaaagcaggaggtggtggttctagggtcccaggagggtgcgatgcacaccgccctcactggcgccaccgagatccaaaacagcggcggaacgtccatcttcgccggccatctgaagtgccggctaaagatggacaagctagagctgaagggcatgagctacgccatgtgtactaacaccttcgtgttaaagaaggaggtgtcagagacgcagcacgggaccatcctcattaaggtcgagtacagaggcgaggacgcgccttgcaagatcccctttagcaccgaggacgggcagggtaaagcacataacggccgcctgatcacggccaaccccgtagtgaccaagaaagaggaacccgtcaacatcgaggccgagccgcccttcggggagagcaatatcgtcatcggaataggggacaatgcactgaagatcaactggtacaagaaggggtcctccatagggaagatgtttgaggcgaccgctagaggggcccgccgcatggcgatcttgggggacaccgcgtgggatttcgggagcgtgggcggggtcctcaattcacttgggaaaatggtgcaccaaatatttgggtccgcctatacggccctattcagcggagtgagctgggtcatgaaaataggcatcgggatccttctgacctggatcggacttaacagcaaaaacacctccatgagcttttcatgcatcgccatagggatcatcaccctctatctgggcgcagtggttcaagcggatatggggtgcgtcataaattggaagggaaaggagcttaaatgcgggagcggtatctttgtaacgaacgaggtgcacacgtggaccgagcagtacaagttccaagccgactctcccaagcgtctcgctaccgccatcgccggcgcgtgggaaaacggggtctgcgggatccgcagcaccaccagaatggaaaacctgctttggaaacagatcgccaacgaactcaattacatcctgtgggagaacaacatcaagctgacggtggtggtcggggacatcatcggcgtgctcgagcagggcaaacgcaccctgacgccccagccgatggagctgaagtactcctggaagacgtgggggaaggccaagatcgtaactgccgagacccaaaacagctcattcattatagacggccccaatacgcccgagtgccccagcgcgtcccgggcctggaacgtctgggaggtcgaggactacggcttcggcgtgttcaccaccaatatttggctgaagctccgtgaggtctatacccagctatgcgaccatcgcctcatgtctgctgcggtgaaggatgagcgcgcagtgcacgctgatatgggctactggatcgagagccagaagaacgggtcctggaaattagagaaggcttcgctgattgaagtcaaaacctgcacgtggccgaagtcccatacgctctggtcaaacggcgtgctggagtcagacatgattatccccaagagcctggccgggcccatcagccagcacaaccatcggccgggctaccacacccagaccgcggggccttggcacctcggcaaactggagctggacttcaactactgcgagggcacgaccgtggtaataacagagaactgcgggactcgaggcccaagtctccggacgaccactgtttccggcaagttgatccacgagtggtgctgtcgcagctgcaccctgcccccgcttcggtacatgggcgaggacgggtgctggtacggcatggagatccgcccgatatccgagaaggaagagaacatggtcaaaagtctcgtttctgccggatccgggaaggtggacaacttcacgatgggcgttctgtgtctcgcgatcctgtttgaggaggtcatgcgggggaaattcggtaagaagcacatgattgccggggtgttcttcacattcgtgcttctcctgtccggccagataacctggcgagacatgacgcacacgctcattatgatcggcagcaacgcatccgaccggatggggatgggtgtcacgtacctcgccttaatcgccactttcaagatccagcccttcctggcgttggggtttttcctgcgcaagttgacctccagggaaaacctcttgcttggtgtgggcctcgccatggcgacgacgctgcagttacccgaggacatcgagcaaatggccaacgggatcgcgttgggcctgatggccctgaagctcataactcagttcgagacttaccagctctggacggcgctgatcagcctgacatgcagcaacaccatgttcaccttaacggtggcctggcgcaccgccaccttaatcctcgctggggtcagcttgctgccggtgtgccagtccagctccatgcgcaaaaccgactggctccccatggccgtggccgccatgggtgtgcctccccttcctctgttcatcttcagcctcaaggacacgctgaagcggcgctcctggcccctgaatgaaggtgtgatggccgtcggtcttgtgagcattctggcgtcttccctcttgcggaatgatgtgcccatggccggccccctggtcgccgggggtttgctgatcgcctgctacgtgatcactgggacgtccgccgacctgaccgtcgaaaaggcggctgacatcacgtgggaggaggaggccgaacagaccggcgtcagtcacaacctgatgattaccgtggacgacgacgggacgatgcgcatcaaagacgacgagacagaaaatatccttacggttctgctcaagaccgccctcctgatagtctccggggtgtttccgtactcaatcccagctaccctgctcgtgtggcacacctggcagaaacaaacgcagcggtccggcgtactttgggacgtgcccagcccgcccgagacacaaaaggcggagctggaggagggggtgtatcgcatcaagcagcagggcatcttcgggaagacccaagtgggggtgggggtgcagaaggaaggcgtcttccacaccatgtggcacgtgacgcggggcgccgtgctaacctataatgggaagcgcctggaacccaattgggcctccgtaaagaaggatctgatcagctacggtgggggctggcgcctctccgcccagtggcaaaagggggaggaggtccaggtgatcgcggtcgagcccggcaagaaccccaagaatttccagacaacccccggtactttccagaccaccaccggggagatcggcgccatcgccttggactttaaacccgggacgagcggcagccccatcatcaaccgcgagggcaaggtggttgggctatacggaaacggggtcgtaaccaagaacggtgggtacgtgtccggcatagctcagaccaacgccgagccggacggccccacccccgagttagaggaggagatgttcaagaaacggaaccttacgatcatggacttacacccagggagcggtaaaactcgcaagtacctgccagcgatcatccgggaagccatcaagaggcggctccgcaccctgatcctggccccgacgcgggtcgttgccgccgagatggaggaggccctcaagggtctgcccatccgctaccagacgaccgctaccaaatccgagcacacaggccgggagatcgtcgacctgatgtgccacgccacgttcaccatgcgcctcctgagcccggtccgggtgccgaactacaatctaataataatggacgaggcccacttcaccgacccagcatcaatagcggcccgcgggtacatcagcactcgcgtgggcatgggcgaggcagccgcgatcttcatgacggccactccacctgggaccgccgacgcgtttccgcaatccaatgctcccatccaagacgaagaaagggacatccccgagcgctcttggaactccggcaatgagtggattaccgacttcgcaggcaaaacggtctggttcgtacccagcatcaaggcaggcaacgatatcgccaattgcctccggaagaacgggaagaaggttatccaattatcacgaaagacattcgacaccgagtatcagaagacgaaacttaacgactgggacttcgtcgtgacaactgacatcagcgagatgggcgccaacttcaaggccgatcgggtgatcgacccgcgccggtgcttgaagcccgtcatcctgaccgatggccccgagcgcgtgatcctggcgggtcccatgccggttaccgccgcctccgccgcccagcggcgcggccgggtcggtcgaaacccccagaaggagaacgatcaatacatattcaccggtcagcccctcaacaatgacgaggaccacgcgcactggacggaggctaagatgctcctggacaatattaacacccccgaggggatcatcccagccctcttcgagcccgagcgggagaagtccgccgcaatagacggcgaataccgactgaagggcgagagcagaaagaccttcgttgagctcatgcgccgcggggacctccccgtgtggctggcccacaaagtcgccagcgagggcatcaagtacacagaccgtaagtggtgctttgatgggcagcggaacaaccaaatcctggaggaaaacatggatgtcgagatctggactaaggagggcgagaagaagaaactccgcccccgctggctggatgcccggacctactccgatccgctggccctcaaagagttcaaggattttgcggccggccgcaagagcatcgcactggatctggtgacagagatagggcgggtgccctcccacctagcccatcgcacccggaatgccctggataatctggtgatgttacatacctctgagcacggagggcgcgcgtaccggcacgccgtcgaggagctgcccgaaaccatggagaccctgctcctactgggcttaatgatcctactgaccgggggcgcgatgctgtttctgatcagcggcaaggggatcggcaagacatccatcgggctgatatgcgtgatcgcctcttcaggtatgctctggatggccgaaatacctctgcagtggatcgcatccgcgatcgtgctggagttcttcatgatggtcttactgattcccgaacccgagaaacagcgcactccccaagacaatcagctggcctacgtggtaatcggtatcctcaccctagccgccatcatagcagccaacgagatgggcctgctcgagactacgaaacgggacctgggtatgtcgaaggagcccggtgtcgtgtcgcccacctcctacctggacgtggacctccaccccgccagcgcctggactctgtacgccgtggctaccacggtaatcacgcctatgttgcgccacacgatcgagaactccaccgccaacgttagcctcgcggccatcgctaaccaggccgtcgtactgatggggctggacaagggatggccgatctccaagatggacctcggcgtgccactgctggccctcgggtgctacagccaggtcaaccccttaacgctgaccgctgcggtgctcctgctgatcactcactacgcgatcattggccccggtctgcaggccaaagccacccgggaggcccagaagcgcactgcagcggggatcatgaaaaatccaacggtcgacggcatcatgaccatcgacctggaccccgtcatctacgactccaagttcgagaaacagctgggccaggtaatgctcttggtgctgtgcgccgtgcagcttctcctgatgcggaccagctgggctctctgtgaggccctgacgctggcgactggcccgatcaccaccctctgggagggctcccctgggaagttctggaacactaccatcgccgtgagcatggccaacattttccgaggcagctacctggctggggccggcctggcgttcagcatcatgaagtcggtggggaccggcaagcggggcacagggagtcagggcgaaaccctcggcgaaaagtggaagaagaaacttaaccaactgagccgcaaggagttcgatctctataaaaagtccggcatcacggaggtagaccggactgaagcgaaggaagggctgaagcgcggcgagatcacccaccacgctgtgtcacggggctccgccaagctgcagtggttcgtggagcgtaacatggtcatcccggagggacgggtcatcgacctcggctgcgggcgcggcgggtggagctactactgcgcagggctgaagaaggtcaccgaagtacgcggctacacgaaaggcgggcccggccacgaggagcccgtacccatgtccacctacggttggaacatcgtgaaactcatgagcgggaaggacgtcttttacctaccgcccgagaagtgcgacaccctcttatgcgacattggcgagtcgagcccctcccccaccgtggaggaaagccggaccatccgcgtgctgaagatggtagagccgtggctcaagaacaaccagttctgtatcaaggtgctgaacccatacatgcctaccgtgatagagcacctggagcggttacagcgaaagcacggcgggatgctggtccggaatcccctgtcccgcaacagcacacacgagatgtactggatctcgaatggcacagggaacatcgtggcgtctgtgaacatggtcagccggctcttactgaaccgcttcacgatgacccaccggagaccgacgatcgagaaggacgtggacctcggcgctgggacccggcacgtaaacgccgagcccgagacgcccaatatggacgtcataggggagagaatcaagcggatcaaggaggaacataacagcacctggcactacgatgacgaaaacccctataagacctgggcctaccacggctcctacgaggtgaaagccaccgggagcgcatcctctatgatcaacggtgtggtcaaactgctgacgaaaccatgggacgtagtcccaatggtgacccagatggccatgaccgacacgaccccattcgggcagcagcgcgtgttcaaggaaaaggtcgacactcggacgccgcgcagcatgccgggaacccggcgcgtaatggagataacggcagagtggctatggcggaccctgggccgcaacaagaagccccgcctgtgcacccgggaagagtttaccaagaaggtgagaacgaacgccgcgatgggggcggtgttcaccgaggagaaccagtgggactccgcgaaggccgccgtggaggacgaggacttctggaagctcgtggatcgggagcgcgagctgcacaagctgggcaagtgcggaagctgtgtctacaacatgatgggcaagagagagaagaagctcggggaatttggcaaggcgaagggttcccgcgctatctggtacatgtggcttggagcccggtacctagagttcgaagccttgggtttcctgaacgaggaccattggttcagccgtgaaaacagctatagcggagtcgagggcgaggggttgcacaagctcggctacatcctccgcgacatttccaaaatcccgggaggtgccatgtatgcggacgacactgcgggctgggacacccgcatcacggaagacgatctgcacaacgaggagaagatcacacagcagatggacccggagcaccggcagctcgcaaacgccatcttcaaattgacctatcagaacaaggtcgttaaggtgcagcgcccaacccctacagggacggttatggacatcatcagccggaaggaccagcgcggctccggccaggtcgggacctacggcctaaacacattcaccaacatggaggcacagctcatacggcagatggagggggaaggcgtgctgagcaaggcggacctggagaacccccacctccctgagaagaaaataacacagtggctggagaccaaaggtgtcgaacgcttgaaacggatggccattagtggcgacgactgcgtcgtgaagcccatcgacgaccgatttgccaacgccttactggccctgaacgacatgggcaaggttcgcaaagatatcccccagtggcagccgagcaagggttggcacgactggcaacaggtccctttctgctcgcatcacttccacgagctcataatgaaggacggccgcaagctggtggtgccttgccggccccaggacgagctgatcgggcgagcgcgtatctctcagggcgccgggtggagcctcagagagacggcctgcctgggcaaggcctacgcccagatgtggtccctgatgtacttccaccgccgggatctgcgcctggcctccaacgccatttgcagcgccgtccccgtccactgggtgcccacctcccggacgacctggagcatccacgctcaccaccaatggatgacgaccgaggacatgctgacggtctggaaccgagtgtggatcgaagataacccctggatggaggacaagacacccgtcactacctgggagaacgttccctacctaggcaagcgggaagaccaatggtgcgggagcctgatcgggctaacgtctcgggcaacctgggcacaaaacatcccgacggccatccagcaggtccggtctctcatcgggaacgaggagttcctggactacatgccctcgatgaagcgcttccggaaggaggaggaaagcgagggcgccatctggtga

SEQ ID NO: 25690 - RNA, 9873 nt, synthetic construct
  misc_feature 1..9873: note = derived and/or modified CDS sequence (opt11) from DENV-3__GU131850__SS-prME
  source 1..9873: mol_type = other RNA
accagcctgtgtctcgtcatgatcttacccgccgccctggcgttccacctcacgagccgtgacggcgagccccggatgatcgtgggcaaaaacgagcgcggcaagagcctactcttcaagaccgcctccgggatcaacatgtgcacgctcatagccatggatctaggggagatgtgcgacgacactgtgacctataagtgcccccacatcactgaggttgagcccgaggacattgattgctggtgtaacctaacaagcacctgggtaacgtacgggacctgcaaccaggcaggcgagcgccggagggacaagcgctcagtagccttggcgccgcacgtgggcatggggctggacacgcgtactcagacctggatgtcagccgagggcgcatggcgtcaagtggaaaaggtggagacgtgggcgctgcggcacccggggttcactatcctcgcgctattcttggcccattacattggaacctcccttacccagaaggttgtcatcttcatcctgctgatgctcgttacacctagcatgaccatgcgctgcgtgggggtcggcaaccgggatttcgtggaaggcctatccggggccacatgggtggacgtagtgctggagcacggcgggtgcgtaacaacgatggccaagaacaagcccacgctcgacatcgaactgcagaagaccgaggccactcagctcgccactctccgcaagctgtgtatcgagggtaagatcaccaatattacgaccgatagtcgttgccccacgcagggtgaggcagtcctgccggaggaacaggaccaaaactacgtgtgcaagcacacctacgtggaccgaggatggggaaacggttgcggcttattcggtaagggctccctggtgacctgcgcaaagttccagtgccttgagcccatagagggaaaggtggtacagtacgagaacctcaagtatacggtcatcatcacggtacacaccggggatcagcaccaggtcggcaatgagacccagggggtaaccgcagagataacgccgcaagccagcacgacagaggcgattctgcccgagtacggcactctgggactcgagtgctccccgcggaccggcttagacttcaacgagatgatccttctcacgatgaagaacaaagcctggatggtgcaccgacaatggttcttcgatctgcccctgccctggacatctggcgccaccacagaaacgcccacgtggaacaggaaggagttattggtcacctttaagaacgcccacgccaaaaagcaagaagtcgtggttctgggatcccaagagggagccatgcacactgctctaacaggggcgactgagatccaaaactcaggcggtacttcgatcttcgctggacaccttaagtgccgcctgaagatggacaagttagagttgaaaggcatgtcatacgccatgtgtacgaacacgtttgttctcaagaaggaggtatccgagacccagcacgggaccatcctcatcaaggtcgagtaccggggcgaggacgcgccgtgcaagatccctttctcgaccgaagacgggcagggtaaggcccacaatggtcgcttaatcacggccaaccctgtggtgatcaagaaggaggagccagtcaatatcgaggctgagcctccattcggggagagcaacatagtcattggcatcggggacaacgcgctgaaaattaattggtacaagaaaggatcctcgattgggaaaatgtttgaggctacagcccggggcgcccgccgcatggccatcctgggagacaccgcgtgggacttcggctccgtgggcggggtcttgaacagcctgggcaagatggtgcatcagatcttcggatccgcgtatacggccttgttcagcggcgtgagttgggtcatgaaaatcggcatcgggatcctcctgacgtggatcggcctgaactccaagaacacatccatgagcttctcctgtatcgccatcgggataattacactctatttaggtgcggtagttcaggcggacataggctgcgtgatcaactggaaaggaaaggagttaaagtgcggcagcgggatctttgtgacaaacgaggtgcacacgtggaccgagcagtacaagttccaagccgactctcccaagcggctcgccacagccatcgctggggcatgggagaatggggtttgcggcattcgctcaaccacgcggatggagaatctgctgtggaaacagatcgccaacgagttaaactacatcctgtgggagaacaacattaagctgaccgtggtagtcggggacataatcggggtgctcgaacaaggcaagcgcaccctgacaccccagccgatggagctcaagtactcctggaagacgtgggggaaggccaagatcgtgaccgccgaaacccagaactcgtccttcatcatcgacggtcctaacacccctgaatgccccagcgcgtcacgggcctggaacgtctgggaggtagaggactacgggttcggcgtattcacgaccaacatctggctaaaattgcgcgaagtatacacacagctatgcgaccaccggttgatgtcggcagcggtgaaggacgaacgcgcagtgcacgcggacatgggttactggatcgagagccagaaaaacggctcctggaagctggaaaaggcgagcctgatagaggtcaaaacctgcacatggccgaagtctcacacgctctggagcaacggcgtgctggagtcggatatgattatccccaagtcgctggccgggcccatctcccagcacaatcaccggccgggctaccacacccagaccgccgggccctggcacctgggaaagctcgagctggacttcaactactgtgaggggaccacagtggtcatcaccgagaactgcggtacccgcgggccaagcctccggaccaccacggtgtccgggaagctaatccacgagtggtgctgccgcagttgtacgctacccccgctccggtatatgggcgaggacggatgctggtatggcatggagatacgccctatttccgaaaaggaggagaatatggtcaagagcctagtctccgcgggcagcgggaaggtggacaacttcaccatgggcgtactatgcctagcgatcttgttcgaggaggtcatgcgaggaaagttcggaaagaaacacatgatcgccggggtgtttttcacgttcgtcctgctcctgtcaggccagatcacctggcgcgacatgacccacaccctgatcatgatcggaagcaacgcgagtgaccggatgggtatgggcgtcacttacctagccctgatcgcaactttcaaaatacagccctttctggcgctggggttcttcctgcgcaaactgaccagccgggagaatctcttactgggcgtaggcctagccatggccaccacgctgcaactgcccgaggatatcgagcaaatggccaacgggatcgcgcttgggttgatggccctcaaactcatcactcagttcgagacctaccagctatggacggctctgattagcttaacgtgctccaacaccatgttcacgttaaccgtggcctggcgcaccgccaccttgatcctcgcgggtgtcagtctgcttccggtgtgccagtccagctccatgcgcaagaccgactggctacccatggcggtcgccgccatgggcgtgcctcctttaccgctttttatattcagcttgaaggacaccctgaagcggcggtcctggccgctgaacgagggagtgatggccgtcggccttgtgtcgatactggcgtcctcgctgctccgcaacgacgtgcccatggccggaccgttggtagctgggggcctccttatcgcatgctacgtgataacgggcacgtctgcagacttgaccgttgagaaggcggccgacatcacctgggaggaagaagccgaacagacgggcgtatcacacaacctaatgatcacagtggacgacgacgggaccatgcgcatcaaagacgacgaaactgaaaacatcctcaccgtgctactgaagacagccctcctgattgtctccggcgtgtttccttacagcatccctgcgaccttactcgtgtggcatacctggcagaaacagacacaacggtccggcgttctgtgggacgtacccagccctcccgagacacagaaggcggagctggaagagggggtgtaccgcataaagcagcagggaatcttcgggaagacccaggtcggtgtgggggtgcagaaggagggcgtcttccacactatgtggcacgtgacccggggcgccgtcctcacgtacaacggaaagcgcttggagcccaactgggcatccgtcaagaaggacctaatcagctatggtggtgggtggcggttatcagcacagtggcagaagggggaggaggttcaggtgatcgcggtcgagcccggaaagaaccccaagaatttccagaccatgccgggcaccttccagacaacgacgggggagattggagcgatcgcattggattttaaacccgggacgagcggcagcccgatcatcaacagagaaggaaaggtggttgggttgtacggaaatggggtggtgacgaagaacggcggctatgtgagtggtatcgctcagacgaatgccgagccggacggacccacccccgagctagaagaggaaatgttcaagaagcgaaacttaaccatcatggatttgcacccggggagtggcaagaccagaaaatacctgcctgctatcatccgggaggccataaagcgccggctccgcacgcttatcctggctcccacccgggtcgtggccgccgagatggaggaagcgctgaagggtctccccatccgctaccagacaaccgcaacgaaatccgaacacacaggccgggaaatcgtcgacttaatgtgtcacgctaccttcaccatgcggctcctcagccccgtccgggtgccgaattacaacctgatcattatggatgaagcccacttcacagatcccgcctccatcgcggcacgcgggtacatcagcacccgcgtgggaatgggcgaagccgctgcaatcttcatgacggccacgccgcccggcacggccgacgccttcccgcagtccaacgccccgatccaggacgaggagcgggatatccccgagcgcagctggaactccggcaacgaatggattactgacttcgtcggaaagaccgtatggtttgtccccagcataaaggctggcaacgacatcgcaaactgcctccggaaaaacggaaagaaggtaattcagctgtctaggaagaccttcgatacggagtaccaaaagactaagctcaacgactgggatttcgtggtgaccaccgatatctctgagatgggcgccaacttcaaggccgaccgcgttatcgaccctagaaggtgcttgaaacccgtaatcctgacggatgggcccgagcgtgtgatcctggcggggccaatgccggttacggcggcctccgccgcgcagaggaggggcagggtgggacgcaatccccaaaaggaaaacgaccagtacattttcacggggcaacccctcaacaacgacgaggaccacgctcactggaccgaggcgaagatgctgctggacaacatcaacacccccgaggggatcatccccgccctcttcgaacccgagcgagagaagtccgccgccatcgacggcgaataccgcctgaagggagagtcacggaagacgttcgttgagctgatgcgccgcggagacctcccagtctggctagctcataaggttgcctccgagggcattaaatacacagaccgtaagtggtgtttcgacggacagcggaacaaccagattctggaagagaacatggacgtcgaaatctggaccaaggagggcgagaagaagaaattgcgcccccgctggcttgacgcccggacatactccgatcctttagccctcaaagagttcaaagacttcgccgcgggccgaaagagcatcgcactggacctggtcacagagatcgggcgggtccccagtcacctcgcccacaggacccggaacgccctggataacctggtcatgttacacactagcgagcatggcgggcgagcctaccggcacgctgtggaggagctgccagagaccatggagacgctgctcctcctcggactcatgatcctgctgaccgggggagccatgctgtttctgatcagtggcaaagggatcgggaagacgtcgatcgggctgatatgcgtgatagccagctcaggcatgctatggatggcagaaatcccgctgcagtggatcgcgagcgcgatcgtactcgaatttttcatgatggtgctcttgatccccgagcccgagaagcaacgcacgccacaggacaaccagttagcgtacgtggtgattggaatcctaacgctcgctgccatcattgccgcgaacgagatgggtctgctcgagaccaccaagcgggatctgggcatgtccaaggagccgggtgtggttagccccaactcctacctggacgttgacctccaccccgccagcgcctggaccctatatgcagtggcgacgaccgtgatcacgcccatgctgcgccacacaatcgagaacagcacggccaacgtctctctcgcagccatcgccaaccaggccgtggtgctaatgggcctggataaagggtggcctatcagcaagatggatctcggcgtcccactgttagccctcggatgctacagccaagtgaacccactgactctgacggccgccgtgctcctgttgatcacccactacgccatcattggccccggtctccaggcaaaagctacgcgggaggcccagaagagaaccgcagcagggataatgaagaacccgaccgtcgacggcatcatgaccatcgacctggatccagtgatttatgacagtaagtttgaaaagcagctaggacaggttatgctcctggtactgtgtgcggtgcagctcctgctgatgcggacgagctgggccctgtgcgaggctctgaccctggccacgggccctatcacaacgttgtgggagggctccccagggaagttctggaacacgaccatcgcggtaagcatggccaatatcttccgcgggtcctacctggccggggccggcttggccttctcaattatgaagtccgtcgggactggcaagaggggaacgggatctcagggggaaaccctcggggagaagtggaaaaagaagctgaaccagctgagccggaaggagttcgacctctacaaaaagtccggcatcaccgaggtggaccggaccgaggcgaaggagggtttaaagaaaggtgagatcacccatcatgccgtgagccgcggctccgccaagctgcaatggttcgtagagcggaatatggtcatcccggaggggcgcgtgatcgacctagggtgcgggaggggcgggtggagctactactgcgcaggcctaaagaaagtgacggaggtgaggggctacacgaaaggcgggccagggcacgaggagcccgtgcccatgtccacctacggctggaacatagtcaaacttatgagcgggaaagacgtgttctatctccctccggagaagtgtgacactttactgtgtgacatcggggagtccagcccatcacccacggtggaggagagccgcaccatccgggtcctgaaaatggtggagccgtggctcaagaataaccagttctgtatcaaagttcttaacccgtacatgcccaccgtcatcgagcacctcgagcgcctccaacggaagcatggcgggatgttagtccgcaaccccctgtctcggaactccactcacgagatgtattggatcagcaacggcaccgggaacatcgttgcctcagtcaacatggtgtctcgcctcctgctgaaccggttcaccatgacccaccgccgcccgaccattgaaaaagacgtcgatctcggggcgggcacgcgccacgtcaacgccgaaccagaaacccccaacatggacgtgattggggagcggattaagcgcatcaaggaggagcataacagcacatggcattatgacgatgagaacccgtataagacctgggcttaccacgggtcttacgaggtgaaggccacggggtcagccagctctatgattaacggcgtcgtgaaactgctcacaaagccctgggacgtagtgccgatggtgacgcaaatggcgatgaccgatacgacccccttcgggcagcaacgggttttcaaggagaaggtggacacccgcaccccgcggtccatgcctggcaccagacgtgttatgggcatcaccgccgaatggctctggcgcactctggggcggaacaagaaacctcggctgtgcactcgggaggagttcacaaagaaggtacgaaccaacgcggcgatgggcgcggttttcaccgaggagaaccagtgggacagcgcgaaggccgccgtggaggatgaggacttctggaagctcgtcgaccgcgagcgtgagctgcacaagctagggaagtgcggctcatgcgtgtacaacatgatggggaagcgcgaaaagaagctcggcgagttcggtaaggccaaagggtcccgtgcgatctggtacatgtggctcggtgctcgctaccttgaatttgaagctctcgggtttttgaacgaggaccactggtttagccgggagaactcgtactcaggcgtggagggggagggcctgcataagttggggtacatcctccgcgatatctccaagatccccgggggagccatgtatgccgacgacaccgccgggtgggacacccggatcacggaggacgacctgcacaatgaggagaaaatcacccagcagatggatccggaacaccgccaactcgccaacgccatctttaaactgacttaccagaataaggtcgtgaaggtgcagcgacccacgcccacaggcacggtcatggacatcatcagtcgcaaagaccaacgggggtcgggccaggtaggcacctacgggctgaatactttcacaaacatggaggcacagctcatccgccagatggagggcgagggggtcctaagcaaggcggacctggagaaccctcatctcccggagaagaagatcacccagtggctggagaccaagggcgtcgaaagactgaaaaggatggccataagcggcgatgactgcgttgtgaagccaattgatgacaggttcgccaacgccttactggctctgaatgacatggggaaggttcgcaaagacataccccagtggcagcccagcaagggctggcacgattggcagcaggtcccgttctgctcacatcacttccacgagctcatcatgaaggacggtcggaagctggtagtcccgtgccgcccccaggatgagctgatcggccgggccaggatctcccagggggccggctggtcgctccgcgagacagcctgcctgggcaaggcctacgcccagatgtggagcctgatgtatttccaccggcgcgacttgaggctggcatccaacgccatctgcagcgctgtgcccgtccattgggttcctacgtcccgcacgacctggtcaatccacgctcaccaccagtggatgaccactgaggacatgctcacggtgtggaaccgggtgtggatcgaagacaacccatggatggaggacaaaacacccgtcaccacatgggaaaacgtgccctacctcgggaaacgcgaggaccaatggtgtggaagcctcattgggctgacttcccgcgccacctgggcacaaaacatcccgaccgccatccagcaggtccgcagcctcatcggcaacgaggagttcctggactatatgccctccatgaagaggttccggaaggaggaggagagcgaaggcgccatctggtag

SEQ ID NO: 25691 - RNA, 9873 nt, synthetic construct
  misc_feature 1..9873: note = derived and/or modified CDS sequence (opt11) from DENV-3__GU131851__SS-prME
  source 1..9873: mol_type = other RNA
acaagcctgtgcctcgtgatgatcctgcccgccgccctggcgttccacctgacgtcacgggacggtgagccgcacatgatcgtcggtaagaacgagcggggcaagagtctgttgttcaagaccgccagcgggattaacatgtgcacgctcatcgccatggacctgggcgagatgtgcgacgacaccgtaacctacaagtgtccccatatcaccgaggtggagcccgaggacatcgactgctggtgcaacctgaccagcacctgggttacctacggaacgtgcaatcaagccggggagcgccggcgcgacaagcgctcagttgcgctcgcgccccacgtgggcatggggctggacacccgtacccagacctggatgagcgccgagggagcctggcgtcaggtcgagaaggtggagacgtgggccctgcgtcacccggggttcaccatactcgcgctgttcctggcccactacatcggcacatctctcacccaaaaggtcgtcatcttcatcctgctgatgctcgtgacgcccagcatgaccatgcggtgcgtgggggtcggcaaccgcgacttcgtggagggcctgtccggggcaacttgggtggatgtcgtgctggagcacggtggctgcgttaccactatggccaagaacaagcccaccctcgatatcgagctgcagaagaccgaggctacccaactggcgacgctccggaaactgtgcattgagggcaagataacaaatataactaccgacagccgctgcccaacgcagggcgaggccgtcctgccggaggagcaggaccaaaactacgtgtgcaagcacacctacgtggaccgggggtggggtaacgggtgcggactcttcggcaagggctccctggtgacctgcgccaagtttcagtgcttggagcccatcgagggcaaggtggttcagtacgagaacctcaagtacaccgtcatcatcacggtgcataccggggaccagcatcaggtcggcaatgaaactcaaggggtgaccgcagagatcacgccccaggccagcaccaccgaggcgatcctgccagagtacggcaccctggggctcgagtgctcccctcgcaccggcctggacttcaatgagatgatcttactcacgatgaagaataaagcctggatggtgcaccggcagtggctgttcgacttacccttaccctggaccagcggcgccactacggagactcccacttggaacaggaaagagctgctggtcacctttaagaacgcccacgccaagaagcaagaggtagtggttctagggtcccaggagggagcaatgcacaccgccctcacgggggccaccgagatccagaactcaggtgggacctccatcttcgccggccaccttaagtgccggctcaagatggacaagctggaactgaagggcatgagctacgcaatgtgcaccaacacgttcgtactgaaaaaggaggtgtccgagacccaacacgggaccattctcatcaaggtcgagtaccgcggcgaagacgccccgtgtaagattccgttcagcacggaggatggccagggcaaggcacacaacggccggctgatcacggccaaccccgtggtaaccaaaaaggaggagcccgtcaacatcgaggcagagccgcccttcggcgagtccaacattgtgatcggcattggggacaacgcgctgaagattaattggtacaaaaagggttcaagcatcgggaaaatgttcgaggctaccgcccgcggcgcccggagaatggctatcctaggtgataccgcgtgggacttcgggtccgtgggcggggtcttgaacagcctgggcaagatggtgcaccagatcttcgggtcggcctacacggccctcttcagcggcgtttcatgggtcatgaagatcggcatcgggatcctgctgacctggattggtctcaatagcaagaacacctccatgagcttctcctgcatcgccatcggtatcatcaccctgtacctaggcgccgtggtacaggcggatatgggctgcgtaatcaactggaagggcaaggagctcaaatgcggcagcgggatcttcgtgacgaacgaagtgcacacgtggactgagcagtacaagtttcaagccgatagtcccaaacgcctggccactgccatcgcgggcgcgtgggaaaacggtgtctgtggcatccggtcaactacccgcatggagaacctgctctggaagcagatcgccaacgagctgaactacatcctgtgggagaacaatataaagctaaccgtggtggtcggggacataataggcgttctggaacagggcaagcgcaccctgacaccccagccgatggagctcaagtactcctggaaaacttggggtaaggccaagatcgtgaccgccgagacgcagaactcatccttcatcattgatggccccaatacgcccgaatgccccagcgcgtcacgcgcgtggaacgtctgggaggtggaggactacgggttcggcgtgttcacgaccaacatctggttaaagctgagagaagtctacacccagctctgcgaccaccgactgatgagcgccgcagtgaaggacgagcgggccgtacacgcggacatgggctactggattgaaagccagaagaatgggtcctggaagctggaaaaagcatccctcatcgaggtcaagacatgcacgtggccgaagagtcacaccctgtggagcaacggcgtgttagagtccgacatgatcatccccaagtctcttgccgggcccattagtcaacataatcaccgcccaggctaccacacccagaccgcagggccctggcacctggggaagcttgagctcgactttaactactgcgaggggacgaccgtggtaatcaccgagaattgcgggacaaggggccccagcctgcgcacgaccacggtatcgggaaagctcattcacgagtggtgctgccggagctgcaccctgccacccctgcgttacatgggcgaggacgggtgctggtacggcatggagatccggcccatctccgaaaaggaggagaacatggtaaagtccctggtaagcgccggcagcgggaaggttgacaacttcaccatgggggtgctctgcctggcgatactgtttgaggaggtcatgcgcggaaagttcggcaagaagcacatgatcgctggggtgttcttcactttcgtgctcttgctgtccgggcagatcacctggagagacatgacgcacaccctcataatgatcggcagcaacgcgtccgaccgcatggggatgggcgtcacctacctggcgctgatcgccaccttcaaaatccagcccttcctagccctggggttcttcctgcggaagctcacctcgcgcgagaacctactgctcggcgtgggcctagccatggccacgaccctgcagttgcccgaggacatcgagcagatggcaaatggtatcgcgctgggcctgatggccctcaagctgatcacccagttcgaaacctaccaactgtggacggcccttattagcctgacctgcagcaacaccatgtttaccttgacggtggcctggcggaccgccacgctcatcctggcgggggtaagcctgctccccgtttgtcagtccagctccatgcgcaagaccgattggctgccgatggccgtcgccgccatgggcgtgccacccctccccctcttcatcttcagcctgaaagacactttaaagcgccgttcctggcccctaaacgaaggggtgatggccgtcggcctggtcagcatcctggcgtctagcctcctgcggaacgacgtccccatggccggccccctggtcgcgggagggctcctgatagcctgctatgtgatcaccgggacgtccgccgacctgacggtggagaaggcggccgacattacgtgggaggaggaggcagagcagaccggcgtctcgcacaacctaatgatcaccgttgacgacgacggtaccatgcggatcaaggacgacgagaccgagaacatactgaccgtgctgctcaaaaccgccctgctcatcgtctcgggcgtgttcccgtacagcatacccgctaccctcctggtgtggcatacctggcagaagcagacgcagcgcagtggcgtcttgtgggacgtcccctccccacccgagacccagaaggcggagctcgaggaaggggtttaccggatcaagcagcagggcatcttcgggaaaacccaggtcggcgtgggggtgcaaaaagaaggcgtcttccacaccatgtggcatgtgacgcgcggcgccgttctgacctacaatgggaagcggctggagcccaactgggcctccgtcaagaaggaccttattagctacggcggtggctggcgcctgtccgcccagtggcagaagggggaggaggttcaggtgatcgcggtcgagcccggcaagaaccccaagaacttccagaccaccccgggcacgttccagaccaccaccggcgagatcggagccattgccctggacttcaagcccgggacgagcggcagccctataatcaaccgggaggggaaggtggtggggctgtacggcaacggtgtcgtgactaagaacggcgggtacgtgtccggcatcgcccaaaccaacgccgagccggacggccccacccccgagctcgaagaggaaatgttcaagaaacgcaacctgacgatcatggatctgcaccccggtagcggcaagaccaggaagtacttaccggccatcatcagagaagctatcaaacggcgcctgcggaccctgatcctcgctcccacacgcgtggtcgccgccgagatggaggaagccctgaaagggctgccaatcagatatcagacaaccgccaccaagtccgaacacaccggcagggagatcgtggatctcatgtgccacgctacgttcaccatgcgtctgctcagcccggtacgagtgccgaactacaacctcattatcatggacgaagcccacttcaccgatccggcctccattgcggcacggggctacatcagcaccagagtggggatgggcgaggccgccgcgatcttcatgacggccacgccgcccgggaccgcagatgctttcccgcagtccaacgcccccatccaagacgaggagcgagatatccccgaacggagctggaactccggcaacgagtggatcaccgacttcgcaggaaagacggtctggttcgtgcccagcatcaaggccggtaacgacatcgccaattgcctgcgcaagaacgggaagaaggtcatccagctttcccggaagaccttcgacactgagtatcaaaagaccaagctgaacgactgggacttcgtcgtgacgaccgacatcagcgagatgggggccaacttcaaggccgaccgcgtgatcgacccgcggcgctgcctgaaacccgtcatcctgaccgacggtcccgagcgggtgatcctcgctgggccgatgccggtgaccgctgccagcgccgcccagcgccggggccgcgtcgggcggaatccgcagaaggagaacgaccagtacatctttacgggccagcccctgaataacgacgaggaccacgcgcactggacggaggccaagatgctgctcgataacatcaacacccccgaagggatcataccggccctgttcgagcccgagcgcgagaagtccgccgcgatcgacggcgagtaccggttgaagggcgagtcccgcaagacgttcgtggagctcatgcggcgcggggacctgcccgtgtggctggcccacaaagtcgctagcgagggcatcaagtacacagatcggaagtggtgtttcgacgggcagcgcaacaaccagattttggaggagaacatggacgtggagatttggacgaaagaaggcgagaaaaaaaagttacgtccccgctggctggacgctcgcacctactccgacccgctcgcactgaaggagttcaaggacttcgcagccggtcgcaaatccatcgctctcgacctcgtcacggagattggacgcgtgccctcccacctggcccaccggactcgcaacgccttggataacctcgtgatgctgcacacgagcgagcacggcgggcgggcgtaccgccacgccgtcgaggagttacccgaaacaatggagactctcctgttgctcggtttgatgatactgctcaccgggggcgcgatgctgttcctgatcagcggcaaggggatcggcaagaccagtatcggtctcatatgcgtgatagcgagctccggtatgctgtggatggccgaaatcccgttacagtggatcgcgagcgccatcgtccttgagttcttcatgatggtacttctgatccccgaacccgagaagcagcggacgccccaggacaaccagctcgcctacgtggttatcgggatcctcaccctggccgccatcatagcggccaacgagatgggtttgttagagactacgaagcgcgacctgggcatgtctaaggagccgggggtcgtgagccccacatcctacctcgacgtggacttacaccccgccagcgcctggaccctgtatgcggtcgcgaccacggtgataacacccatgctccggcacactatagaaaactccaccgccaacgtgagcctggccgccatcgcgaaccaggccgtcgtgctgatgggactcgacaagggatggccgatttccaagatggacctgggcgtgcccctgctcgctctggggtgctacagccaagtgaacccactgacgctcaccgccgccgtcttactgctcatcactcactacgcgatcatcggccccggcctgcaggccaaagccaccagagaggcccagaagcgaacggcagcggggatcatgaaaaacccgaccgtggacggcatcatgaccatcgacctggacccggtcatatacgactccaagttcgagaagcagctcggccaggttatgctgttggtgctctgcgccgtccagctgctgctcatgcgcaccagctgggccctctgcgaggctctgaccctggcgaccggccccataaccacactctgggagggctccccggggaaattctggaatacaacaatcgccgtgagcatggccaacatcttccggggctcctacctggcgggagccggcctcgcattctcaatcatgaagtccgtggggaccggcaagcgcggcaccgggagccagggggagaccctgggggagaagtggaaaaagaagttgaatcagctaagccggaaggagttcgacctgtacaagaagtccggcatcacggaggtagaccgcactgaggctaaggaagggctgaagcggggcgagatcacccaccacgccgtgtcccggggctcggccaagctccagtggttcgtggagcggaacatggtcatcccggaggggcgtgtgatcgaccttggctgcggacggggcggatggtcctactattgcgccggcctgaagaaggtgaccgaggtgcgcggctacacgaagggcggacccggacacgaggagcccgtgcccatgtccacctacggctggaacatagtgaagctcatgtccgggaaagacgtcttctatctgccgcccgagaaatgcgacaccctgctgtgcgacatcggcgagtccagcccctcccccacggttgaggagagccgcacgatccgggtgctcaaaatggtcgagccgtggctgaagaacaatcagttttgcatcaaggtgctgaacccctacatgcccaccgtcatcgaacacctcgagagactgcagcggaagcacggcggtatgcttgtccgcaaccccctctcccggaactctacccatgagatgtattggatcagtaacggaacagggaacatcgtggcgtcggttaacatggtctcacgcctgttactcaaccgcttcacgatgacccaccgcaggccgacgatcgagaaggatgtggatctgggcgctggcacccgccacgtaaacgccgagcccgagacgcccaacatggatgtgatcggcgagcggataaagcgcatcaaggaggagcataacagcacttggcattacgacgacgagaacccatataagacatgggcctaccacggctcctatgaagtgaaggccactgggtctgcgagtagcatgatcaacggcgtggtcaagctgctcacgaagccctgggacgttgtccccatggtcacacaaatggccatgaccgacactacgcccttcgggcagcagcgggtttttaaggagaaggtcgacacccgcaccccgcggagcatgcccggcacccgccgggtgatggagataacggctgagtggctgtggcgcacccttggacgcaacaaaaagcccaggctatgcacacgcgaggaattcactaagaaggtgcggacgaacgccgcgatgggggctgtattcaccgaggagaaccaatgggacagtgccaaagccgccgtggaggacgaggacttctggaagttagtggaccgcgaacgggagctgcacaagctcggaaaatgcgggagctgcgtctacaacatgatgggcaagcgcgagaagaagctgggggagttcggcaaggcgaaaggctcccgggccatctggtacatgtggctgggggcccgctacctcgagttcgaggcactgggcttcctgaacgaggaccactggttcagcagggagaacagctacagcggggtggagggcgaggggctccacaagttaggctacatccttcgcgatatctccaagatacccggcggggccatgtatgccgacgacaccgcaggttgggacacccggatcacggaggacgacctacacaacgaagagaaaatcacccagcagatggacccggagcaccgccagttggccaacgccatattcaagttgacataccagaacaaggttgtcaaggtgcagcggcccacccccaccggcacggtgatggacatcattagccgcaaggaccagagaggctccggccaggtggggacctatggcctcaacactttcaccaacatggaggcacagctgatccgccagatggagggggagggtgtgctgagcaaagctgacctcgagaacccgcacctcccggagaagaagataacgcaatggctggagaccaagggagtggagcggctcaaacgcatggcaatatccggcgacgactgcgtcgtgaagcccatcgacgacaggttcgccaatgcccttctggccctcaacgacatgggcaaggttcgcaaggacatcccccagtggcagcccagcaaggggtggcacgactggcaacaggtcccgttctgctcccaccacttccacgagctgatcatgaaggacggccggaagctggtggtgccttgccgcccccaggacgagctcatcgggcgggcgaggatctctcagggcgccggttggtccctgcgcgagaccgcttgccttggcaaggcatatgcacagatgtggtcgctcatgtacttccaccggcgggacctgcggctggcctccaacgccatctgcagcgccgtcccagtgcactgggtaccgacctcgcgcacgacctggagtatccacgcccaccaccagtggatgaccaccgaagacatgctcacggtctggaaccgggtgtggatcgaggataacccctggatggaggacaagacccccgtgaccacctgggagaacgtcccctacctggggaagcgcgaggaccagtggtgtgggagcttgatcggcctcacttcccgggcgacctgggcccagaacatcccgactgctatccagcaggtccgcagcctgatcggaaacgaggaatttctggattacatgcccagcatgaagcggttccgcaaggaggaagagagcgagggcgccatttggtag

SEQ ID NO: 25692 - RNA, 9873 nt, synthetic construct
  misc_feature 1..9873: note = derived and/or modified CDS sequence (opt11) from DENV-3__GQ868547__SS-prME
  source 1..9873: mol_type = other RNA
actagcctttgcctggtgatgattttgcccgccgcgttagccttccacctcacgtcccgggacggggaaccgcggatgatcgtgggcaagaatgagcgaggcaaatcacttttgttcaagaccgcctccggtattaacatgtgtacgctcatagccatggaccttggcgagatgtgcgatgacacggttacctataagtgcccacacatcacagaggtggagcccgaggacatcgactgctggtgcaacctgaccagcacctgggtgacctacgggacttgcaaccaggccggcgagcggcgacgagacaagcggtccgtggcactcgcaccccacgtgggcatgggattagatacccggacccagacctggatgagcgccgagggggcgtggcggcaagtcgagaaagtggagacttgggccttacgacacccagggttcaccatactagcactcttcctggcccattacatcggcacatccctcacccagaaggtggtcatcttcatcctgctgatgctggtgacgcccagcatgacaatgcggtgtgtgggcgtcggcaatagagacttcgtggagggactgagtggagcaacctgggtggacgttgtgctggaacacggcggctgtgtgaccaccatggccaaaaacaagcctacactcgatatcgaactgcagaagacagaagcgactcagctggcaacgctccgtaagctgtgtatcgagggcaagatcacgaacatcaccaccgactcgcgatgtccaacgcagggcgaagccgtcttaccggaggaacaggaccaaaactacgtttgcaagcatacctacgtggaccgggggtgggggaacgggtgtggcctcttcgggaaaggcagcttagtgacatgcgccaagtttcagtgtttggagcccattgagggcaaggtggtccaatacgaaaacctcaagtacacagtaatcatcacggtgcacacaggggaccagcaccaggtcgggaacgagacccaaggcgttaccgccgagatcactccccaggccagtactaccgaggcgatcctcccagagtacggcaccctggggctagagtgcagccccaggaccggtctggacttcaacgagatgatcttgctgacgatgaagaacaaggcttggatggttcaccgccagtggttcttcgacctgcccctgccctggaccagcggggccaccaccgagacacctacctggaaccgtaaggagctcctggttaccttcaagaacgctcacgcgaagaagcaggaggtcgtggtcctcggttcccaggagggcgctatgcacaccgcgctcaccggggccaccgagatccagaacagcggagggacatctattttcgccggacacctgaagtgtcgcctgaagatggacaagctggagctcaaggggatgtcctacgccatgtgcaccaacacgttcgtgctgaagaaggaagtgtccgaaacccaacacgggaccattctaatcaaggtcgagtaccggggcgaggacgcgccgtgtaagattccgttctcaacagaggatggccagggcaaggcccataacggccgcctgatcacagccaaccccgtggtgaccaagaaagaggagcccgttaacatcgaggccgaaccacccttcggggaaagcaacatcgtgataggcatcggagataacgccctcaagataaactggtacaagaagggctccagcatagggaagatgttcgaggccaccgcccggggcgcccggagaatggccatcctaggcgacaccgcgtgggacttcgggtccgtgggcggggtattaaatagcctgggcaaaatggtgcatcaaatctttggctcggcctacaccgccctgttcagtggtgtttcctgggttatgaagatcggtatagggatcctcctgacctggatcggcctgaacagcaagaacaccagcatgagcttctcctgcatagccatcggcatcatcaccctctatctgggagcagttgtacaggcggatatggggtgcgtcatcaactggaagggcaaagagctgaagtgcggcagcgggattttcgttacgaacgaggtccacacctggaccgagcagtacaagttccaggccgactcccctaagcggctcgctacagccatagccggcgcatgggagaacggagtctgcggcatccgcagtacaacgcggatggagaacctcctgtggaagcagatcgccaatgaactaaattatatcctttgggagaacaacataaagctgaccgtggtggtcggggacataatcggcgtgctagagcaaggcaagcgaacccttacgccccagccgatggagctgaagtactcctggaagacttggggtaaagccaagatggtgactgccgagacccagaacagctccttcatcatcgatggtcccaacacgcccgaatgccccagcgcatctcgcgcgtggaatgtctgggaggtggaggactacgggttcggcgtgttcaccactaacatctggctcaagctgcgcgaggtccacacacagctgtgtgaccaccggctcatgtcagccgccgtcaaggatgagcgcgccgtgcacgcggacatgggctactggatcgagagccagaagaacggttcctggaagttagaaaaggccagcctgatcgaggtcaagacgtgcacgtggccgaagtcccacaccctgtggtctaacggggtcttagaatctgacatgattatacccaagtcactcgccggaccgatctcccagcacaatcaccggccgggctaccacactcagacagccgggccctggcaccttggcaaactggagctagacttcaactactgcgagggcactaccgtggtcattaccgagaactgcgggacacgcggtcccagcctcaggacgacaacagtgtccggcaaactgatccacgaatggtgctgccgcagctgcacccttccacccctccggtacatgggcgaagacgggtgctggtacgggatggagatccgacctatttccgagaaggaggagaatatggtcaagagtctggtctcagctggcagcgggaaggtggacaacttcaccatgggcgtgctgtgcctggcgatcctgttcgaagaggtaatgaggggtaagttcggcaaaaagcatatgatcgccggggtgttcttcaccttcgtgctactactgtcaggccaaatcacctggcgcgacatgacacataccctgatcatgatcggtagcaatgcctccgaccggatggggatgggtgtcacgtacctcgccctgattgccacctttaagatccaaccctttctggcgctcgggtttttcctcagaaagctgaccagtagagagaacctcctgctgggtgtgggcctcgccatggctacaaccttacaattgcccgaggacatcgaacagatggccaacggaatcgcgctcggcctgatggcactgaaacttatcacgcagtttgagacttaccaactgtggactgcacttatctccctcacatgctccaacaccatgtttaccctgacagtggcctggcgcaccgccaccctaatcctcgcgggcgtatccctgctgcccgtgtgccagtcaagctccatgcggaagaccgattggctcccgatggccgtcgccgccatgggcgtgccgcccttaccgctgttcatctttagcctcaaggatacgctgaagcgacgctcctggcccctgaacgagggtgtaatggccgtgggccttgtgagcatcctggcctccagcctgctccgaaacgacgtgccgatggctggccccctcgtcgctggaggactgctcatcgcctgctacgttatcaccggaacctccgcagatctgaccgtcgaaaaggcggccgatataacttgggaggaagaggccgagcagaccggcgtctcccacaacttaatgatcacagtagacgacgacgggaccatgcgcatcaaggacgacgaaactgagaatatacttacggtgctgctgaagaccgccctcctgattgtgtccggcgtgttcccgtacagcatccccgccactctgctcgtgtggcacacctggcagaagcagacgcagcggagcggcgtcctgtgggacgtccccagtccgcccgaaacccaaaaggctgagctggaggaaggtgtctaccgcattaagcagcagggcatcttcgggaagacacaggtcggggtgggggtgcagaaggagggagtcttccacactatgtggcacgtgacgcggggcgccgttctgacctacaacggaaagaggctggagcccaactgggccagcgtcaagaaggacctcatctcctacggcgggggctggcggctctccgcccagtggcagaagggcgaggaggtacaggtgatagcggtcgagccgggcaagaaccctaagaacttccagaccacccccggcacgttccagaccactaccggggaaattggcgccattgccctggacttcaagcccggaacgagcggcagccctattatcaaccgcgaaggcaaggtggtgggtctttatgggaacggggtggtgactaaaaacggagggtacgtgtccggcatcgcgcagaccaacgccgagccggacggccccaccccggagcttgaggaggagatgttcaagaagcggaacctgacgattatggacctgcaccctggcagtggcaagacccgcaagtacctgccggccattattcgagaggccattaaacgccggctacgcacccttatcctggcgcccactcgggtcgtggccgccgagatggaggaagcgctcaagggtttacccatacgatatcagaccaccgccaccaagagtgagcacacagggcgggagatcgtggacctgatgtgccacgcgacgtttaccatgaggcttctaagcccagtccgggttcccaactacaacctgatcatcatggacgaggctcacttcaccgaccctgcctccatcgcagcccgtgggtacatctcaaccagggtgggcatgggcgaggccgccgcgattttcatgacggcgactcctcccgggaccgcagacgccttccctcagtccaacgcccccattcaggacgaggaacgtgacatccctgagcgcagctggaactccgggaacgagtggatcaccgacttcgcaggcaagacggtctggtttgttccttcaattaaggccggcaacgacattgccaactgcctccggaagaacggtaagaaggtgatccagctgtcccgcaagacctttgacaccgaataccagaagacaaagctgaacgattgggacttcgtcgttactaccgacatcagcgagatgggcgcgaacttcaaggcagaccgggtcatcgacccgcgccggtgcttaaagcccgttatcctgaccgatggccccgagcgtgtgatcctggcggggcccatgccggttacagccgcctcagccgcccagagacgcggacgggtcgggaggaacccccagaaggagaacgaccagtacatattcaccggacagccgctcaacaatgacgaagaccatgctcactggacggaagccaaaatgctgctggataacatcaacacccccgaggggatcatcccggcattattcgagcccgagagagagaagtccgccgccatcgacggcgagtaccgcctgaagggcgaaagccggaagacctttgttgagctgatgcgccgcggggaccttcccgtttggttggctcacaaggttgccagcgagggaatcaaatacaccgaccgcaagtggtgcttcgacgggcagcgcaacaaccagatactggaggagaacatggacgtcgagatctggacgaaagagggagagaagaagaagctccgccccagatggctggacgcccggacgtacagtgacccactggccctcaaggagttcaaggacttcgccgcgggccgcaagtccatcgccctggacctggtcacagagatcggtcgggtgccatcccacctcgcgcaccgcacccgtaacgccttagacaacctggtgatgctccacacgagcgagcacggcggccgcgcataccggcacgccgttgaggagctgccagagaccatggagacgctgttactgctgggcctaatgattctgctgaccggcggcgcgatgctgttcctcataagcggcaagggcatcggcaaaacgtccatcgggctcatctgcgtaattgccagctccggaatgttatggatggccgagatcccgctgcagtggatcgcaagtgccatcgtgctggagttcttcatgatggtcctcctgatacctgaacctgagaaacaacgcacaccccaggacaaccagctggcctacgtcgtgatcgggattctcaccctcgccgccatcattgcggccaacgagatgggtctgctcgagaccactaagcgtgacctgggcatgtcgaaggagccgggggtcgtttctcccaccagttacttggacgtggaccttcaccccgccagtgcctggaccttatacgcggttgccacaaccgtgatcacgcccatgctaagacacaccatcgagaactccaccgccaacgtaagcctcgccgccatcgctaaccaggcggtggtgctgatgggtctggacaaagggtggccgatttccaagatggacctcggcgtacccctactagccttggggtgctattcacaggtcaacccgctgactctgaccgccgccgtgcttctacttatcacgcactacgcgatcatcggccctggcctacaggcgaaggccacccgggaggcccagaagcgcacggccgcagggatcatgaagaatccgaccgtggacggcatcatgactatagacctggaccccgtaatctatgactccaagttcgagaagcagcttggccaggtaatgctcctggtgctgtgtgccgtgcaattactcctgatgagaaccagctgggcgctctgcgaggccctcacgctcgcaacaggccccattaccaccctctgggaaggttcgcccggtaagttttggaacaccactatcgccgtgtccatggctaatattttccgcggcagttacctggccggggctgggctggcgttcagtatcatgaaatcggtggggactgggaagcggggcaccgggagccaaggggaaacgctcggggaaaagtggaagaagaagctgaaccagctgagccgcaaggagttcgacttgtataagaagtccggtatcaccgaggtagaccgaacggaagccaaggaggggctgaagcgcggcgagatcacacaccacgccgtgtctcgtggctccgcaaagctgcaatggtttgtggagcgcaacatggtcatcccggagggccgggtgatcgacctgggctgtgggcgcgggggatggtcctattactgcgccggcctgaaaaaggtcaccgaggttcgcggatacacgaagggcgggcccgggcacgaggagcccgtgcccatgtccacgtacggctggaacatagtaaaactaatgagcgggaaggacgtcttctatctcccgcccgagaagtgcgacaccctgctgtgtgacatcggagagagtagcccgtcccccaccgttgaggaaagccggacgatccgcgtgctgaagatggtcgagccgtggctcaagaacaaccagttctgcatcaaggtgctcaacccctatatgcccactgtgatcgagcatctggagcggctccagcgtaagcatggcgggatgctggtccggaaccccctgtcccgcaacagtacccacgaaatgtactggatctccaatggcaccggaaacattgtggcaagcgtcaacatggtcagcaggttattgctgaaccgcttcaccatgactcaccggcgccccactatcgagaaagacgtggacttgggtgctggcacccggcacgtgaacgccgagcccgagacgcccaatatggacgtcatcggcgagaggatcaaacgaataaaggaagaacacaactccacttggcactacgacgacgagaatccgtacaagacctgggcctaccacggctcctacgaggtgaaggccaccggcagcgcgtccagcatgatcaacggcgtggtcaaacttctgaccaagccctgggacgtggtccccatggtgacccagatggccatgacagacaccactccctttgggcagcagcgcgtgtttaaggaaaaggtagacaccagaaccccgagaagcatgcccggcacccggcgcgtaatggaaatcactgccgaatggctctggaggacgctgggacgcaacaagaagccccgcctgtgtaccagggaggagtttacaaagaaggtgcgcactaacgccgcgatgggggcggtcttcaccgaggagaaccagtgggactccgcgaaggccgccgtggaggacgaggatttctggaaacttgtggaccgtgaacgcgagcttcataagctgggcaagtgcgggagctgcgtctacaacatgatgggcaagcgggagaagaagctcggggagtttggcaaggccaagggctcccgcgccatctggtacatgtggctgggggcaaggtatctggagttcgaggcgctcggctttctgaacgaggaccactggtttagccgcgagaactcgtactcaggggtcgaaggcgagggactgcacaaactcgggtatatcctgcgggacatatccaaaataccaggcggggccatgtacgcggacgacaccgcagggtgggacacccgcataacggaagatgatctgcacaacgaggagaagatcacccaacaaatggacccggagcacaggcagctcgcgaacgcaatcttcaagttaacgtaccagaacaaggtggtcaaggttcagcgccccacgccaaccgggacggtaatggacatcatcagccggaaagaccagcgcggctccggccaagtcgggacctatggcctgaacaccttcactaacatggaagcccaactcatccgtcagatggagggggagggtgtgcttagcaaggcggatctcgagaacccccacctcccagagaagaagataacacagtggttagagaccaagggggtggagcgcctgaagcggatggccatctctggtgacgactgcgttgtgaagcctatcgacgaccgcttcgctaacgccttactggccttgaacgacatgggcaaggtgaggaaagacatccctcagtggcagccctctaaaggttggcacgactggcagcaagtcccgttctgttcccaccacttccacgagttgatcatgaaggatggccgaaagctggtggtgccctgccggccgcaagacgagctgatcggccgcgcccgaatctcgcaaggcgccgggtggtctctccgcgaaactgcatgcctgggtaaggcctatgcgcagatgtggagcctgatgtacttccacaggcgggatctccgcctagcctcgaatgctatctgcagtgccgtccccgtccactgggtgccaacgtcccggacgacctggagtatccacgcgcaccaccagtggatgaccaccgaggacatgctgactgtttggaaccgggtgtggatcgaggacaacccgtggatggaggacaagaccccggtcaccacctgggagaacgtgccgtacctcggcaaacgggaggaccagtggtgtgggtccctgattggcctgacgtcccgcgcaacctgggcccagaacataccaaccgccatccagcaagtccgtagcctcatcgggaacgaggagttcctggattacatgccctccatgaagagattccggaaggaggaagaaagcgagggcgccatctggtaa

SEQ ID NO: 25693 - RNA, 9873 nt, synthetic construct
  misc_feature 1..9873: note = derived and/or modified CDS sequence (opt11) from DENV-3__GU131857__SS-prME
  source 1..9873: mol_type = other RNA
accagcctctgcctcgtgatgatcctgccggcggccctggcgtttcacctcacgagccgggacggggagccccggatgattgttgggaaaaacgagcgcggcaagagcctgttatttaagaccgcctccggtatcaacatgtgcaccttgatagcaatggatctgggcgagatgtgcgacgacactgtgacctataagtgtccccacatcaccgaggtggagccggaggatattgactgctggtgcaacctgacatcaacgtgggtgacctacgggacttgcaaccaggccggcgagcggcgccgggacaaacgctccgtagccctcgcgccccacgttggcatgggcctggacacccggacccagacctggatgtcggccgagggcgcttggcgccaggtggagaaggtcgagacgtgggccttgcggcacccaggcttcacgatcctcgcgctgttcctggcacactacatcggcacatccctcacccagaaggtagtcatcttcattctactgatgctcgtgacgccctccatgaccatgcgctgcgtgggggtcggcaaccgggatttcgtggagggcctgagtggggccacctgggtggacgtcgtactggagcacggcggatgcgtgaccacgatggccaagaacaagcccaccctcgacatcgagctgcagaagaccgaggcaacccagctggcgacgttacgcaagctatgtatcgagggtaagataaccaacatcacgacagacagccgttgccccacgcagggcgaggctgtcctgccggaggagcaggaccagaactacgtgtgcaagcacacctatgtggaccgcggttggggcaacgggtgcggccttttcgggaagggatccctggtcacctgcgccaaattccagtgcctggagccgatcgagggcaaagtggtccagtacgagaacctcaagtacaccgtcataatcacggttcataccggggaccaacaccaagtcggcaacgagacccagggggtaaccgccgagatcacgccccaggccagcaccactgaggcaatcctgcctgagtacggcacattagggctcgagtgttcgccccggaccggcctggactttaacgagatgattctgctcacaatgaagaacaaagcctggatggtgcaccgccagtggttcttcgaccttcccctgccctggaccagtggcgccaccaccgagacaccgacttggaaccggaaggagctcctggtgactttcaagaacgcccatgccaagaagcaagaggttgtggtcctagggtcccaggagggcgcgatgcacaccgccctcacgggggccaccgagatccagaatagcggcgggacctccatcttcgccggacaccttaagtgtcgcctgaagatggacaagctcgagctgaaaggcatgagctacgccatgtgcaccaatacgttcgtgctcaaaaaagaggtgagtgagacccagcacggcaccatcctcatcaaggtcgaataccggggcgaggatgcgccgtgcaaaatccccttctcgaccgaggacgggcaaggcaaggcccacaacggccgcctgattacggctaatcccgtggttaccaaaaaggaggagcctgtcaacattgaggccgagccccccttcggcgagagcaatatcgtgatcggcatcggggataacgcgctcaagatcaactggtacaagaaaggcagtagcatcggcaagatgttcgaagcgaccgcccggggcgcccgccgcatggccatcctgggcgacacagcgtgggactttggttccgtgggcggggtccttaacagcctggggaagatggtgcaccagatctttgggtcagcctatacggccctgttcagcggtgtgtcctgggtcatgaagatcggcatcgggatcctcctgacctggatcggcctgaacagcaaaaatacctctatgtccttctcctgcattgccattgggatcatcacactatatcttggcgcggtagtacaggcggacatggggtgcgtcatcaactggaagggcaaggagcttaaatgcggcagcggaatcttcgttacgaacgaggtgcacacgtggaccgagcagtacaagttccaggcagactcacccaagcgtctcgccacagccatcgctggcgcatgggagaacggggtctgcgggatccgcagcacgacccggatggagaatctgctctggaagcagatagccaatgagctcaactacatcctgtgggagaacaacatcaagctgaccgtggtggtcggggacatcataggcgtgctcgagcagggcaagaggaccctgacgccccagccgatggagctgaagtactcctggaaaacgtggggtaaggccaagatagtgaccgccgagacccagaacagcagttttatcatcgacggccccaacactcccgagtgtccctcagcgtcccgggcctggaacgtctgggaggtggaggactacgggttcggcgtgttcaccaccaatatatggctcaagctgcgcgaggtctatacgcagctgtgcgaccaccggctcatgagcgctgccgtaaaagacgagcgcgccgtgcacgctgacatgggctactggatcgagagccagaagaacgggtcctggaagctggagaaggccagcttgattgaggtcaagacctgcacctggccgaagtcccacaccctctggagcaacggcgtgcttgagtccgacatgattatccccaagtccctggccgggcccatctcccagcacaaccacagaccagggtaccacacccagaccgccgggccctggcacctaggcaagctggagctggacttcaactactgcgagggcacgaccgtggtcatcaccgagaattgcgggacccgcggccccagcctccggacgaccacagtgtccggaaagctgatccacgaatggtgctgccgcagctgcaccctgccacccctgcggtacatgggcgaggatgggtgttggtatgggatggaaatccgccccatcagtgaaaaagaggagaacatggttaagtctttggtgtccgccggaagcgggaaggtggacaatttcacgatgggcgtgctatgcctcgcgatcctttttgaggaggtcatgcgtgggaagttcggcaaaaagcatatgatagccggggtgttcttcaccttcgtgctgctcctgtccggccaaatcacatggcgggacatgacccacacgctaatcatgattggcagcaacgcctccgaccggatggggatgggcgtcacctatttagcgttaatcgccaccttcaagattcaacccttccttgcgctcgggtttttcctgaggaaactgaccagccgggaaaacctcctgctcggcgtgggcctcgccatggccacgaccctccagctgcccgaggacatcgagcagatggccaacgggattgcgctcggcctgatggccctcaagctcatcacccagttcgagacctatcagctctggacggccctgatctctctgacctgttccaacaccatgttcaccctgactgtggcctggcggaccgccaccctgatcctcgcgggggttagcttactgccggtttgccaatccagcagtatgcgcaagacagactggctacctatggccgtcgcggccatgggcgtgccgcctctcccgcttttcatcttcagcctcaaggacacgctcaaacggcgcagttggcccctgaacgaaggggttatggccgtcggccttgtgagcatcctggcgtccagcctccttcggaatgacgtgcccatggccggccccctcgtcgccggcggactgttaatagcctgctacgtgatcaccgggacctccgccgacctgaccgtggagaaggcggctgacatcacgtgggaggaagaggccgagcagaccggcgtgagccacaacctgatgattaccgtggatgacgacgggaccatgcgcatcaaggacgatgaaaccgagaacatcttaacggtgctgctcaagacggcccttctgatcgtatcaggcgtgttcccgtactcgatcccggccaccctgctcgtgtggcacacctggcagaagcagacgcagcggtcaggtgtcctgtgggacgtgccgagccctcccgagacacagaaggcggagctggaggagggggtgtaccgcatcaaacagcagggcattttcgggaagacacaggtcggtgtgggggtgcagaaggaaggcgtcttccacaccatgtggcacgtgacccgaggggcagtgctcacatacaacgggaagcgcctggagcccaactgggcctccgtcaagaaggacctaatcagctatggcgggggctggcgtctatctgcccagtggcagaagggggaggaggttcaggtaatagcggtcgagcccggcaaaaaccccaagaacttccagaccacgcccggcacgttccagaccaccaccggggagatcggagccatcgccctggacttcaagcccgggacgagcggcagccccataatcaaccgcgaaggcaaggtagtggggctgtacggcaacggggtcgtgactaagaacggcgggtacgtgtccggcatcgcccagactaacgccgagccggacgggcccaccccagagctggaggaggagatgttcaagaagagaaacctcacgattatggacctgcacccagggtccggaaagaccagaaagtaccttcctgcgataatacgggaggccatcaagcgccggctccgcaccctgatccttgcccccacccgggtcgtggctgccgaaatggaggaggctctcaagggcctgccgatccgctaccagacgaccgccaccaagtccgagcacactggtcgtgagatcgtggacctgatgtgccacgccacgttcaccatgcgcctcttgagccccgtccgggttccgaactacaacctgatcataatggacgaggcccacttcaccgaccccgcctcaatcgcggcccgagggtacatatcaacaagggtgggcatgggtgaggccgctgctatcttcatgacggccacgccgccggggacagccgacgcgttcccacagtctaacgcccccatccaggacgaggagagagacattcccgagcgctcatggaactccggcaacgagtggatcacggacttcgtcgggaagaccgtatggttcgtgccctctatcaaggcgggcaatgacattgcgaactgcctcaggaaaaacggaaagaaggtcatccagctgagccgcaagacctttgacacggagtaccagaagactaaactgaacgactgggacttcgtggttaccaccgatatctcggaaatgggcgccaacttcaaggccgaccgcgtaatcgacccgcgccggtgcctcaagcccgtgatcctgaccgacggccccgagcgcgtgatcctggccgggcccatgccggtcacagcggctagtgccgcccagaggcgcggccgggttggccgcaacccccagaaagaaaacgatcagtacatcttcaccggccagcccctcaacaacgatgaggatcacgcccactggacggaggcgaagatgttactggacaacatcaatacccccgaggggatcatcccggccctattcgagcctgagcgggagaaatcggcagccatcgacggcgagtatcgcctgaagggcgagtcccggaagaccttcgtggagctgatgcgtcgcggggacctccccgtctggctggcgcacaaggtagccagcgagggcatcaagtacaccgacagaaagtggtgcttcgacgggcagcggaacaaccagatactggaggaaaacatggacgtcgagatctggacgaaggaaggcgagaagaagaagctccgcccccgctggctggacgcccggacctactccgacccgctggctctcaaggagtttaaggacttcgccgcgggcagaaaaagcatagccctggacctggtcacagaaatcggacgagtcccctcccatcttgcacatcgcaccaggaacgccctggacaacctggtcatgctccacacgagcgagcacggcggtcgcgcctaccggcacgccgtggaggagctccccgagaccatggagaccctgctcctgttaggcctcatgatactgctgacaggcggcgccatgttattcctgatctcgggcaaggggatcggaaagacctcgatcgggctgatctgcgtgatcgccagcagtggcatgctctggatggccgagatcccgcttcagtggattgccagcgcgatcgtcctggagttcttcatgatggtgcttctgatccccgagcccgagaaacagcgcacgcctcaggacaaccaactggcctacgtggtcatcgggatcctcaccctggccgccataatcgccgcgaatgagatgggcctgctcgagacgacgaagcgggacctgggcatgtccaaagagccgggggtggtgagccccacatcctacctggacgtcgacctccaccccgccagcgcctggactctgtacgccgtggcgaccacggtgatcacccccatgctgcggcacaccatagagaactccaccgccaacgtcagcctcgccgccatcgccaaccaggcggtggtgctgatgggactggacaagggctggccgatctccaaaatggaccttggcgtccccctgctggccctcgggtgctatagccaggtcaaccccttgacgcttaccgccgccgtgctcctgctgatcacccactacgccattatcggacccggcctccaggcgaaggccactcgtgaggcccaaaagcgaacggccgccgggataatgaagaacccgacagtcgacggcatcatgaccattgatcttgaccccgtgatctatgactccaagttcgagaagcagctaggccaagtgatgctcctggttttatgcgccgtgcagctcctgctgatgcggaccagctgggctctctgcgaggctcttacgctggcgaccggccccatcaccactctgtgggagggctcccccgggaagttctggaacacgaccatcgcggtaagcatggccaacatctttcgcggctcatacctggccggagctggcttggccttcagcataatgaaatccgtcgggaccggtaagcggggcacaggttcccagggcgagaccctcggagagaagtggaagaagaagctgaaccagctgagccgcaaggagttcgatctctacaagaagagtggcatcaccgaggtggacaggacggaggcaaaggagggtctgaagcgcggcgagattactcaccacgccgtgagccggggctccgccaagctgcagtggttcgtcgagcgcaacatggtgattcccgaggggcgggtcatcgacctcggatgcgggcgcggcgggtggagctactactgcgccggtctaaagaaggtcacggaggtgcgcggctatacgaagggcgggccaggacacgaagagccggtgcccatgagtacctacggctggaacatcgtcaagctgatgtccgggaaggacgtgttctaccttccgcccgagaagtgcgataccctgctgtgcgacataggggagtccagccccagtcccaccgtcgaggagagccggacgatccgcgtactgaagatggtggagccgtggctcaagaataaccaattctgtatcaaagtgctgaacccttacatgcccaccgtaattgagcacctcgagcggctccagcgcaagcacggcgggatgctggtgagaaaccccctgtcccgcaactccacccacgagatgtactggatctccaacggcaccgggaacatcgtggccagcgtcaacatggtgtcccggctgctactgaaccgcttcacgatgacccaccgacgcccgaccatcgagaaggacgtggacttaggcgcggggacgcggcacgtcaacgccgaacccgagacacccaacatggacgtaattggggagaggatcaaacggatcaaggaggagcacaactcgacgtggcactacgacgacgagaacccgtacaagacctgggcctaccacgggtcctacgaggtgaaggcaaccgggagcgcctcctctatgatcaatggagtggtgaagttgctgacgaaaccctgggatgtcgtgcccatggtgactcagatggcaatgaccgacaccacaccctttgggcagcagcgcgtattcaaagagaaggtcgacacccggacaccgcgcagcatgcccggcacccggcgcgtgatggaaatcacggccgaatggctctggcggaccctgggcaggaataaaaagccccgcctgtgtacacgggaggagttcacgaagaaggtgcgcacgaacgccgccatgggggcggtgttcaccgaggagaaccagtgggactcagccaaggccgcagtggaggacgaggacttttggaagctcgtcgatcgggagcgcgaactgcacaagttgggtaaatgcgggagctgcgtgtacaacatgatgggcaagcgggagaagaagctcggagagtttgggaaggcaaagggctcccgcgcgatctggtacatgtggctcggggccagatacctggagttcgaggccctcggcttcctgaacgaggaccactggttcagccgcgagaacagctacagcggtgtggagggggaggggctgcataaactcggctacatcctgcgggacatctccaagatccccggcggtgccatgtacgccgacgacacggcgggctgggacacacgcatcacggaggacgacctgcacaacgaggagaagattacccagcagatggatcctgagcaccggcagctcgccaacgccatcttcaagctgacgtaccaaaacaaggtcgtaaaggtgcagagacccacccccaccgggacggttatggacatcatcagccggaaggaccaacgcggctccggccaagtgggtacctacggcttaaacaccttcactaacatggaagcccagctcattcggcagatggagggtgagggcgtgctgagcaaggctgacttagaaaacccccacctcccggaaaagaagatcacgcagtggctggagaccaaaggcgtcgaacgcctcaagcgcatggcgatctccggggacgactgcgtggttaagcccatcgatgaccgcttcgccaacgccctcctggcgctgaacgacatgggtaaagtccggaaggatatcccccagtggcagcccagcaaagggtggcacgactggcaacaggtcccgttctgctctcaccatttccacgagctcatcatgaaggacggccgcaagctggtcgtcccctgtcggccccaggacgagctcatcgggcgcgcccgcatcagccaaggggcggggtggtccttacgggaaaccgcctgcctgggcaaggcgtacgctcagatgtggagcctgatgtactttcaccgccgggaccttcgtctggcgtccaacgccatatgtagcgccgtgcccgtacactgggtcccgacctcccggacgacttggagcatccacgcacaccaccagtggatgaccaccgaggacatgctgacggtgtggaaccgcgtgtggatcgaggataatccctggatggaggataaaacccccgtcacaacctgggagaacgtgccgtacctcgggaagcgtgaggaccagtggtgcgggagtctgataggattgacgtccagagccacctgggcgcagaacatcccgaccgccattcagcaggttcggagcctaatcggaaacgaggagttcctggactacatgccctcaatgaaacgatttcggaaggaggaggagagcgagggagcgatctggtga

SEQ ID NO: 25694 - RNA, 9873 nt, synthetic construct
  misc_feature 1..9873: note = derived and/or modified CDS sequence (opt11) from DENV-3__GU131858__SS-prME
  source 1..9873: mol_type = other RNA
accagcctctgcctcgtcatgatcctgcccgccgctctggcgttccatctcaccagccgcgacggggagccccggatgatcgtggggaaaaacgagcgcggaaagagcttactgtttaagaccgcttccgggattaacatgtgtaccctcatcgccatggacctgggcgagatgtgcgacgacaccgtcacatacaagtgcccccacataacggaggtggagcccgaagacatcgactgctggtgcaatcttacctccacttgggtgacctacgggacgtgcaaccaggccggcgagcggcgacgggacaagcgctccgtggcgctcgcgccccacgtggggatggggttagacacacggacacagacctggatgtcagccgagggggcgtggcgccaggtcgagaaggtggaaacgtgggctctgcgccacccggggttcaccatcctcgcgctgttcctggcccactatatcggcacctccctcacccagaaggtggtcatcttcatcctgctgatgcttgtgacgcccagcatgacgatgcgttgcgtgggggttggtaaccgggacttcgtggaaggcctctccggggccacctgggtggacgtcgtcctggagcacggtgggtgcgtgaccacgatggccaagaacaagcccaccctagacatcgagctgcagaagactgaggccactcagctggcgacgctccgcaagctatgcatcgaaggcaagatcaccaatatcacgaccgacagccggtgccctactcagggagaggccgtcctaccggaggagcaggatcagaactacgtgtgcaagcacacctacgtcgaccgcgggtggggcaacgggtgcggccttttcgggaaaggctccctggtgacctgcgccaagttccagtgcctggagcccatcgagggcaaagtggttcagtacgagaacctcaagtacaccgtcatcataacggtgcataccggggatcagcatcaggttggcaacgagacccagggcgtgacagccgagatcacgccccaagccagcaccaccgaagcgatcctgcccgagtacggtaccctcgggttggagtgctcgccgaggaccggtctcgacttcaacgaaatgattctgttaacgatgaagaacaaggcctggatggtgcacagacagtggttctttgacctgcccctgccctggaccagcggcgccacgaccgagactcccacatggaataggaaggagctgctggtcaccttcaagaacgcccatgccaaaaagcaagaggtagtggtactgggatcccaggagggcgcgatgcacaccgccctcacgggggccacagagatccaaaattcgggtggtacctccatcttcgccggccacctgaagtgccgcctgaagatggataagctcgagctgaagggcatgagctacgccatgtgcactaacacgttcgtgctgaaaaaggaggtgtctgaaacccaacacggcaccatcctcatcaaagtcgagtaccggggcgaggacgcgccgtgcaagatccccttcagcaccgaggacgggcagggcaaagcccacaacggtcgcctgatcaccgccaaccccgtggtgatcaagaaggaggagcccgtcaacatcgaagccgagccgccgttcggcgagagtaacatcgtgatcggcatcggagacaacgcgctgaagatcaactggtacaagaagggctcctcaatcgggaaaatgttcgaggccaccgcccggggtgcccgccgcatggccatcctaggcgacaccgcgtgggacttcggaagcgtgggcggggttctcaacagcctgggcaagatggtgcaccaaattttcgggtccgcctacaccgctttgttcagcggcgtatcctgggtcatgaagatcggcatcgggattctcctgacgtggatcggcctgaacagcaagaacacctcgatgtcattctcatgtatcgccatcgggatcatcaccctctacctaggcgcagtggttcaggcggacatcgggtgcgtcatcaactggaagggtaaggaactgaaatgcggcagcgggatcttcgtgaccaacgaggtccacacgtggactgagcagtacaagttccaggccgactcccccaagcggctcgccacggccatcgccggcgcgtgggagaacggggtctgcggcatccggagcaccacgcgcatggagaacctgctctggaagcagatcgccaacgaactcaactacatcctgtgggaaaacaacattaagctgaccgtggtggtcggggatatcattggcgtgctcgagcagggcaagcgcaccctgacgccccagccgatggagctgaaatactcctggaagacgtgggggaaagccaagatcgtgaccgccgagacccagaacagctccttcatcatcgacggccccaacacccccgagtgtcccagcgcgtcccgggcgtggaacgtctgggaggtggaggactacgggttcggcgtgttcacgaccaacatctggttaaagctgcgcgaggtctacacccagctgtgtgaccaccgcctcatgtccgccgccgtgaaggacgagcgagccgttcacgcggatatgggctactggatcgagagccagaaaaacgggtcctggaaactggaaaaggcatcactcatcgaggtcaagacctgcacctggccgaagtcccatacgctctggtctaacggcgtcctggagtccgacatgatcatccccaagagcctagcggggcccatatcccagcacaaccaccggccgggctaccatacccagacagctgggccttggcacctcggcaagctagagcttgacttcaactattgtgagggcaccacggtggtcatcaccgagaactgcgggacctctggcccctccttaaccacgacgacagtcagcgggaaactgatccacgagtggtgctgccgctcctgtaccctgcccccactcaggtacatgggggaagacgggtgctggtacggcatggagatccggcccatcagcgagaaggaagaaaatatggtgaagtccctggtcagcgccggctcagggaaggtggacaacttcacgatgggcgtgctgtgtctagcgatcctgttcgaggaagtgatgcgggggaagttcggcaagaaacacatgatcgccggggtgttcttcacgttcgtgctgctcctgagcggccaaattacgtggcgtgacatgacccacacgcttatcatgataggatccaacgctagtgaccgtatgggaatgggcgtcacatatctggccctaatcgcgaccttcaaaatccagcccttcctcgcgctagggttctttctgcgtaagctgacgagccgggagaacttattgctgggcgtgggcctcgccatggccaccactctgcagcttcccgaggacatcgagcagatggctaacggaatcgcgctcggcctcatggccctgaagctcatcacccagttcgaaacgtaccaactgtggacggccctgatctctctgacctgcagcaacacgatgtttaccttaactgtggcctggcgcacggccaccctgatcctggcgggggtctccctgctgccggtgtgccagagttccagcatgcgcaagaccgactggcttcccatggccgtcgccgcgatgggcgtaccacccttgccgctgttcatcttctccctcaaggacacgctgaagagacgcagctggcccctgaatgagggggtgatggccgtcggactcgtgagcattctggcgtcatccctgctccgcaacgacgtccccatggccggccccctggtcgccgggggtctcctcatcgcctgctacgtgatcaccgggaccagtgccgacctgaccgtggaaaaggcggccgatatcacctgggaggaggaggccgagcagaccggcgtctcccacaaccttatgatcacggttgacgacgacgggaccatgcgcatcaaagacgacgagaccgagaacatcctcacggtgctgctgaagacggcattgctgatcgtcagcggcgtgttcccgtactccatccccgccaccctgctggtgtggcacacctggcagaagcagacgcaacggagcggcgtcctgtgggacgtcccgtctccgcccgagacccagaaagcggagctggaggagggggtttaccgcatcaagcagcagggcatctttgggaagacccaggtcggtgtgggggtgcagaaggagggcgtattccacactatgtggcatgtgacgcggggcgccgttctcacctacaacgggaagcgcctggagcccaactgggccagcgtaaagaaagacctgatatcctacggagggggctggcgcttgagcgcacagtggcagaagggggaggaggtacaggtgatcgcggttgaaccgggaaagaaccccaaaaacttccagaccatgcccggcacgttccagacgaccacaggtgagatcggcgccatagccctggacttcaagcccgggaccagcggttcgcccattatcaatcgcgagggcaaggtcgtggggctgtacggcaacggggtcgtgacgaaaaacggcgggtacgtgagcggcattgcccagaccaacgctgagccggacggccccacacccgagctggaggaggagatgttcaagaagaggaacctcacgatcatggacctgcaccccgggagcggcaagacgcgcaagtacctgccggcgatcatccgggaggccatcaagcgccggctccgcacgcttatcttagcccccacacgggtcgtggccgccgagatggaggaggcgcttaaggggctgcccatccgataccaaaccacggccaccaagtcggagcacaccggccgggagatcgttgacctgatgtgccacgccacctttacgatgcgcctcctgtcccccgtacgggtgccgaattacaacctgatcatcatggacgaggcccacttcaccgaccccgccagcatcgcggcccgcggttacatctccacacgggtgggcatgggggaagccgccgccatcttcatgaccgcgacgcctcccgggaccgccgacgccttcccgcagagcaacgcccctatccaggacgaggagcgcgacatccccgagcgatcgtggaacagtggcaacgagtggatcaccgatttcgtcgggaaaaccgtgtggttcgtgccctccatcaaggcgggcaacgacatcgccaactgcctccgcaagaatgggaagaaggtcatccagttgagccgcaagacgttcgacactgagtaccagaaaaccaagctcaatgactgggacttcgtggtgaccacggacatctccgagatgggcgccaatttcaaggctgacagagtcatcgaccctcgccggtgtctcaagcccgtgatcctcacagacggccccgaacgcgtgatactggccgggcccatgccggtcaccgctgcgagcgccgcccaacgccgcggacgggtgggtcgtaatccacagaaggagaacgaccagtacatattcaccggccagcccctcaacaacgatgaggaccacgcccactggacggaagcaaagatgcttctggacaacatcaatacgcccgaggggatcatccctgccctgttcgagcccgagcgtgagaaatccgccgcgatcgacggtgagtaccgactgaagggcgagagtcgtaagacttttgtggagctgatgcgccgcggggacctccccgtctggctggctcacaaagtagccagcgagggaatcaagtacaccgaccgcaaatggtgcttcgacgggcagcgaaacaaccaaatcctggaggagaacatggatgtcgagatatggacaaaggagggcgaaaagaaaaagctccgcccccgatggctcgacgcccgcacatattcggaccccctggccctcaaggagtttaaggacttcgctgccggccgcaagtccatcgcgctggacctggtgaccgagataggtcgtgtgcccagccaccttgcccatcggacgcgaaacgcgcttgacaacttggtcatgctccacaccagtgaacacggcgggcgcgcctatcggcacgcagtggaggaactgcccgagacgatggaaactctgttacttctgggcctgatgatcctgctgaccggaggcgcgatgcttttcttaatctccggcaaagggatcggaaagaccagcatcggcctaatttgtgtgatcgcctcttcaggcatgctatggatggccgagatcccgttgcagtggatagcttccgctatagtcctagagttcttcatgatggttctcttgattcccgaacccgagaagcagcgcacgccccaggacaaccagctggcatacgtggtcatcgggatcctgacccttgccgccatcatcgcagcaaacgagatgggcctgcttgagaccaccaagcgggacctgggcatgagcaaggagccgggggttgtgtcccccaactcgtatctggacgtagacctccatccagcctccgcctggacgctgtacgccgtggcgaccaccgtgatcacccccatgcttcgccatacgatcgagaacagtaccgccaacgtctccctcgcggccatcgcgaatcaggcagtggtgctgatgggcctcgacaaggggtggcctatcagcaaaatggacctcggagtcccactgctggccctcggttgctacagtcaggtgaatccactcaccttgaccgccgccgtgctcctgttaattacccactacgctatcatcggccccggactccaagctaaggccacccgggaggcccagaagcgcacagccgccgggatcatgaagaacccgaccgtcgacggcatcatgacgatcgacctcgatcccgtgatctacgacagcaagttcgagaagcaactgggccaggtgatgctccttgtactgtgcgcggtgcagctcctgctgatgcggacctcctgggccctctgcgaggccctgaccctggccaccggccccatcacgacactctgggaggggagccccgggaagttctggaatacaaccatcgctgtgtccatggccaacatctttcgcggtagctacctggccggggccggcctggccttctccatcatgaaatccgtcgggacgggcaagcggggaaccggtagccagggagagaccttgggagagaaatggaagaagaagctgaatcagctgtcccgcaaagagttcgacttgtacaagaaatcgggcatcaccgaggtggaccgaaccgaggcgaaggaggggctgaagcgcggcgagatcacgcaccacgccgtgtccagaggcagcgccaaactccagtggtttgtcgagcgtaatatggtgatcccagaggggagggtgatcgacctcggctgcgggcgcggcgggtggtcctactactgcgccggcctgaagaaggtcaccgaggtgcggggctacaccaagggcggacccgggcacgaggagcccgtgcccatgagcacgtacggctggaacatcgtcaagctgatgtccggcaaggacgtgttttatctcccgcccgagaagtgcgatactctgctgtgcgacatcggcgagagctcccccagccccaccgtggaagagtcccgcaccatccgtgtcctgaagatggtggagccttggctcaagaacaaccaattttgcatcaaggtgttgaacccgtacatgcccactgtcattgaacacctggaacggctccagcgcaagcatggcgggatgctggtacgaaacccgctgagccgcaactccacacacgagatgtactggatcagcaacggcacagggaacatagtggcctccgtcaacatggtgagccggctcctgctgaaccgcttcaccatgacccatagacgcccgacgattgagaaggacgtggacctcggcgcggggacccggcacgtgaacgccgagcccgagacaccaaacatggacgtgatcggggagcgcatcaaacggatcaaggaagaacacaactccacatggcactacgacgatgagaacccgtacaagacttgggcctatcacggcagctacgaggtgaaggcaaccggttccgccagcagcatgatcaacggcgtggtgaagctgctgaccaagccctgggacgtcgtgcccatggtgacccagatggcgatgacggacacgacaccattcggtcagcaacgcgttttcaaggaaaaggtagacacccgtacgccccgcagtatgcccggcacccggagagtgatgggcatcaccgccgagtggctctggcggaccctggggcgcaacaagaagccccggttatgcacgcgcgaggagttcaccaagaaggtccgcaccaacgccgccatgggcgcggtcttcaccgaggagaaccaatgggacagcgcaaaggccgctgttgaggacgaggacttctggaagctcgtcgaccgggagcgcgagctgcacaagctggggaagtgtggctcctgtgtgtacaacatgatggggaagcgggagaagaagctcggcgagttcggcaaggctaaggggtcacgcgctatctggtacatgtggctgggcgcacggtacctggagttcgaggccctcggcttcctgaacgaggaccactggttcagccgcgagaacagctattcgggagtggagggggagggcctccataagctaggctatatcttacgggacatatctaagatccccggtggcgctatgtacgccgacgacactgcggggtgggacacacgcatcaccgaggacgacctgcacaacgaggagaagataacccagcaaatggacccggagcaccggcagctcgccaacgccatcttcaagctgacgtaccagaacaaagttgtgaaggtacagcgcccgacccccaccggcacggtcatggacatcatcagtcgaaaggaccagcgcggctcaggacaggttggcacctacgggctgaacacgttcacgaacatggaggcccagctcatcaggcagatggagggcgagggggtgctttctaaggccgacctggagaatccccacctcccggagaagaagatcacccaatggctggagaccaagggcgtcgagagactaaagcgaatggcgatttcaggcgacgactgcgtggtcaaacccatcgacgaccgcttcgccaatgccctcctggcgctgaacgacatgggcaaagtcaggaaggatataccccagtggcagccctccaaaggctggcacgactggcagcaggtcccgttctgcagccaccacttccacgagctcatcatgaaggacgggcgcaagctggtcgtcccatgccggccccaggacgaacttatcggccgcgcccggatctcccagggggcaggctggagcctccgcgagacggcctgtctgggcaaggcttatgcccagatgtggtccctgatgtacttccaccgccgtgacctccgcctggcatccaacgccatctgcagcgcagtgcccgtacactgggtaccgacctcccggaccacctggagcattcacgcccaccaccagtggatgacgaccgaggacatgctgaccgtgtggaacagagtgtggatagaggacaatccctggatggaagacaagaccccggtcacgacctgggagaatgttccctacctcgggaagagggaggaccagtggtgcggctccctaatcgggctgaccagccgggctacgtgggcgcagaatatcccgacggcaatccagcaggtccgcagcctcatcggcaacgaagagttcttagactacatgcccagcatgaagcgcttccgcaaggaggaggagtccgaaggggccatctggtaa

SEQ ID NO: 25695 - RNA, 9873 nt, synthetic construct
  misc_feature 1..9873: note = derived and/or modified CDS sequence (opt11) from DENV-3__GQ868548__SS-prME
  source 1..9873: mol_type = other RNA
acctcgctctgcctcgtgatgatcctgcccgccgctctggcgttccacctcacctcccgcgacggagaaccgcggatgatagtggggaagaacgagcgcggcaagagcctgctgttcaagaccgcttccgggataaatatgtgcaccctaatcgccatggatctgggcgagatgtgcgacgacacagtgacatacaaatgtccgcacatcaccgaggtggagcccgaggacatcgactgctggtgcaacctgaccagcacctgggtgacctacgggacgtgtaaccaggccggcgagcggcgccgcgacaagcgctccgttgcccttgcgccgcatgtgggcatggggctggacacccgtacccagacctggatgagcgccgaaggcgcatggcgccaggtggagaaggtcgagacgtgggcactacggcatccggggtttaccattctggcgctgttccttgcccattacataggcaccagtctcacccagaaggtggtcatcttcatcctgctgatgctcgtgacgccgagtatgaccatgcgctgcgtgggggtaggcaaccgggatttcgtggagggtttgtctggggcaacgtgggtggacgtcgtacttgagcacggcggatgcgtgaccacgatggcgaagaataagccaactctcgacatagaactgcagaagaccgaagccacgcagctggcgaccttgcgcaagctctgcatcgagggtaagatcacgaatatcactaccgatagccggtgccccactcaaggcgaggctgtgttacccgaggagcaggaccagaattacgtgtgtaagcacacctacgtggacagagggtggggcaacggatgcggcctctttgggaagggctcactggtgacgtgcgccaagttccagtgcctcgagcccattgagggcaaggttgtccagcacgagaacctcaagtacacagtcatcatcacggtgcacactggggaccagcaccaggtcggcaacgagacccagggagttactgcagagatcacgccccaggctagcaccaccgaggcgatactgcccgagtatggcaccttgggtctcgagtgttccccgcggaccggcctggactttaacgagatgatcctcctcacgatgaagaacaaggcctggatggtacatcgccagtggttcttcgacctgccgctgccatggaccagcggcgcaactacggaaacgcccacctggaatcgcaaggagctcctcgttaccttcaagaacgcccacgccaaaaagcaggaggtggtggttctgggatcccaggagggcgcgatgcacactgccctcactggggccaccgagatccagaacagcggagggacctccatcttcgcaggccacctgaagtgccgcctgaaaatggacaagctcgagctaaagggcatgagctacgccatgtgcaccaacacgtttgtgctgaagaaagaggtgtccgagacccagcacggcaccatcctcatcaaggtcgagtaccggggggaggacgcaccgtgcaagatccccttctcaacagaggacgggcaaggtaaggcccacaacggccgcctgatcacggcaaaccccgtggtcaccaagaaggaggagcccgtcaacatcgaggccgagccaccctttggcgaaagcaacatcgtgatcggaatcggggacaatgcgctgaagatcaattggtacaagaagggctcctctatcgggaagatgttcgaggccaccgcccgaggcgcccgccgcatggcaatcctgggcgacaccgcctgggattttgggtccgtgggcggtgtcctcaactcgctgggcaagatggtgcaccagattttcgggagcgcctacacggcgctgttctcaggcgtgtcctgggtcatgaagatcggcatcggaattctcctcacctggatcggcttgaatagcaagaacacgtccatgtctttttcctgcatcgccatcgggatcatcaccctctacctgggcgcggtggtacaggccgacatgggatgtgtcatcaattggaaaggcaaagagttgaagtgcggttctgggatcttcgtgacgaatgaggtgcacacctggaccgaacagtacaagttccaggcagactcccccaagcgcctcgcaacagctatcgcgggcgcgtgggagaacggggtttgcggcatcaggtccacaaccagaatggaaaacctgctgtggaagcagatcgccaacgagctgaactacatcctgtgggagaacaacattaagctgaccgtggttgtcggtgacatcatcggcgtgctcgagcagggcaagcgcaccctcactccccagccgatggagttgaaatactcctggaaaacttgggggaaggcgaagatcgtcacagccgagacccaaaactcatcgttcatcatagatgggcccaacacccccgaatgccccagcgcgagccgggcctggaatgtctgggaggtggaggactacgggttcggcgtgttcactactaacatctggctcaagcttcgcgaggtctacacacagctgtgcgatcatcggctcatgagcgccgccgtgaaggacgagcgcgccgtgcacgcggacatgggctactggatcgagagccaaaagaacggttcctggaaacttgagaaggccagcctgatagaagtcaagacctgcacatggccaaagtcccacactctctggagcaatggcgtgttggagtccgacatgatcattcccaagtcacttgcagggccgatttcccagcacaatcaccggccgggatatcacacccagaccgccggaccctggcatctcggcaagctggagcttgatttcaactactgtgagggcaccaccgtggtcatcacggaaaattgcgggacacgagggcccagcctccgtacgaccaccgtgtccgggaagctgatccacgagtggtgctgccgcagctgcacactgcctccactccggtacatgggcgaggacggttgctggtacggcatggagatccgccccatctctgaaaaggaggagaacatggttaagagcctcgtttccgccggaagcggtaaggttgacaatttcacgatgggcgttctgtgtctagctatcctcttcgaagaggtaatgcgggggaagttcggcaagaagcacatgatcgccggggtgttcttcaccttcgtgctactgctgtccggccaaatcacttggcgcgacatgacccatacgctgattatgatcggtagcaacgcatccgaccggatggggatgggcgtaacctacctcgcgctgatagcaaccttcaagatacagcctttcctggcgctcgggttcttcctgcgcaagttaaccagccgggagaacctcctgctgggcgtgggtctcgcaatggcgacgaccctccagctgcccgaggacatcgaacaaatggccaatgggatcgctctgggcctgatggccttgaagctcatcacccagttcgaaacctatcagctgtggacggccctgatcagcctcacctgcagtaacaccatgttcaccctaacggttgcgtggcgaaccgccaccctgatcctggcaggcgtcagcctgctgccggtgtgtcaatcctcgagtatgcgcaagactgactggttacctatggctgtcgccgccatgggcgtgccgcccctcccccttttcatcttcagcttaaaggacacgctgaagcggcgttcctggccgttgaacgagggggtcatggccgtcggcttagtgagcatattggcatccagcctgctccggaacgatgtgcccatggccggccccctggtggccggggggctcctcatcgcctgttacgtgatcaccggcacttccgccgacctgaccgtagagaaggcggccgacatcacgtgggaggaggaagccgagcaaaccggggtgagccataatctgatgatcaccgtggacgacgacgggaccatgagaatcaaggacgacgagacagagaacattctcacggtgctgctgaagaccgcactcctgatcgtgtccggcgtgttcccgtacagcatccccgccactcttttagtttggcacacatggcagaagcaaacgcaacggagtggagtcctgtgggatgtgccaagcccgccggagacccagaaggcggagctggaggagggcgtgtacaggatcaagcaacaaggcatattcggcaagacgcaggtcggggtgggggtacagaaagaaggcgtgttccacaccatgtggcacgtgaccaggggtgccgtcttgacctacaacggaaagcgcttagagcccaactgggccagcgttaagaaggatctaatctcatacggcgggggctggcgtctctccgcccagtggcagaagggcgaggaggtccaggtgatcgcggtcgagccaggcaaaaaccccaagaacttccagaccacgcccggcacgttccagaccacaaccggggagattggcgccatcgccctagacttcaagcccgggacgagcggttcgcccataatcaaccgggagggcaaagtagtcgggctatacggcaacggggttgtgaccaagaacggcgggtacgtctcgggaatcgcgcagaccaatgccgagccagacggacccactccggagctggaggaggaaatgttcaaaaagcggaacctcaccatcatggatctgcatcccgggtccggcaagaccaggaagtacttgcccgccataatcagagaggctatcaagcggaggctccgcacgctgatcctggcgcccacccgggtcgtcgccgccgagatggaagaggcgctcaaggggttacccatccgctaccagacaaccgccaccaagagtgagcacaccggcagagaaatagttgatcttatgtgccacgccacgttcaccatgcgccttctgagtcctgtccgggtgccaaactataacctgatcatcatggacgaggcccacttcaccgaccccgccagtatagcggcccgcgggtacatcagcacccgcgtcggcatgggcgaggctgccgcgatattcatgacggcaacgccgccaggcaccgccgacgccttcccgcagtccaacgcacctatccaggacgaggagcgggacatccccgagcgctcatggaactccggcaatgaatggattacggacttcgtcgggaagacggtgtggtttgtgcccagcatcaaggccggaaacgatatcgcaaactgtctccggaagaacggaaagaaggtcatccagctgtcccgaaagaccttcgacaccgagtatcagaagaccaaactgaacgactgggacttcgtagtcacgaccgacatcagcgagatgggcgctaacttcaaggccgaccgggtcatagatccgaggagatgtttaaagcccgtgatcctgaccgacggtcccgagcgcgtgatcctggcagggccgatgcctgtcaccgcggcctccgccgcgcagcggcggggccgggtggggcgcaatccccagaaggagaacgaccagtacattttcaccggccagcccctcaacaatgacgaggatcacgcccattggacggaggcaaagatgcttcttgacaatatcaacacccccgagggaatcatcccggccttatttgagcccgagcgtgagaagtccgccgccatcgacggcgagtaccgcttaaagggtgaatcgagaaagaccttcgtagagctgatgcgccgcggggacctacccgtttggctggcgcacaaggtggccagcgagggcatcaagtacaccgaccgcaagtggtgctttgacgggcagcggaacaaccagatcctggaggagaatatggacgttgagatttggacgaaggagggcgagaagaagaagctcagaccccgatggctggacgcccggacctactccgacccgctggcactcaaggagttcaaggacttcgccgcggggcgcaagtcgatcgccttagatctggtaaccgagattgggcgggtgccgtcccacctcgcccatcgcacacggaatgccctggacaacctggtcatgctccacacgtcagaacacggcggacgcgcataccggcacgcggttgaggagctccccgagaccatggaaacgctgctgctgctgggcctcatgattctgctgaccggaggcgccatgttgttcttgatcagcggcaaggggatcggcaagacgtccatcgggctgatctgcgtgatcgcttcgtccggcatgctctggatggcagagatacctcttcagtggatcgccagcgcgatcgtcctggagtttttcatgatggtgctcctgatccccgagcccgagaaacagcgcacgccccaggacaaccagctggcctacgtggttatcgggattctcacgttggccgccatcatcgccgcgaacgagatgggcctgctcgagaccacgaaacgggacttgggcatgtcgaaggagccgggggtggtgagccccacctcataccttgacgtcgacctgcacccagcctccgcgtggacactgtacgccgtggccaccaccgtgatcacccccatgctgagacacaccatcgagaactccacagccaacgtcagcctcgccgccatcgcaaaccaggcggtggtgctgatgggtctggacaagggttggccgatctccaagatggacttaggcgtccccctgctggctctcggttgctacagccaggtaaacccgttgacacttaccgcagctgtgctcttgctcatcacccactatgccatcatcgggcccggcctccaggccaaggccacccgtgaagcgcagaagcgcacggccgccgggatcatgaagaacccgacagtcgacgggatcatgaccatcgacttagaccccgtgatttacgactccaaatttgagaagcaactaggccaggtgatgctcctggtactgtgcgcggtgcagctcttgctgatgcgtaccagctgggccctctgcgaggccttaacgctagctaccggccccatcaccaccttgtgggaaggctccccaggaaagttctggaacacgacgatcgcggtgagcatggccaacatcttccgcggctcctacctagccggcgccggcctcgccttcagcataatgaagtccgtcggaaccggcaagcgaggcaccgggagccaaggcgagacccttggggagaagtggaagaagaaactcaaccagctgagtcgaaaggagttcgacctctacaaaaaatccggcatcaccgaggtggaccggaccgaggcgaaggaagggctgaagcgcggcgagataacacatcacgcagtgagccggggctccgccaagttgcagtggtttgtcgagcgcaacatggtgattccggagggtagagtgatcgacctcggatgcggtcgcggcggatggagctattactgtgccggcctgaagaaggtaaccgaggtgcgcggatatacaaagggcgggcccggtcacgaagagcccgtgcccatgtccacttacggctggaacatcgtgaaactaatgagcgggaaggatgtgttctacctcccgcccgagaagtgcgacaccctgctgtgtgacatcggcgaatccagcccctcccccaccgtagaagagagtcggacgattcgcgtcctaaagatggtggagccctggctcaaaaataaccagttctgcattaaagtgctgaacccctacatgccgaccgtaatcgagcatctggagcggctccagaggaagcacggcgggatgttagtacggaatcccctttcccgcaacagcacccacgagatgtactggatctctaatggcaccggaaacattgttgcctccgtcaacatggtgtccaggttattactaaatcgcttcacgatgacgcacagaagaccgaccatcgagaaggacgttgatttaggcgcgggcacccgtcatgttaatgcggagcctgagacgccaaacatggatgtaatcggggagcggattaagcggatcaaagaggagcacaacagcacctggcactacgacgacgagaacccgtacaagacctgggcctaccacggctcctacgaggtgaaggccaccggcagcgcctccagtatgattaacggcgtcgtgaaattgctgaccaagccttgggacgtagtacccatggtgacccagatggcaatgaccgacaccacgcccttcgggcagcagcgcgtgttcaaggagaaagtggacacgcggacaccgcgctccatgcccggcacccggcgcgtgatggagataaccgccgagtggctctggagaactctgggccgcaacaagaagccccgcctctgcacgcgggaggagtttaccaagaaggtccgcacgaatgcagccatgggtgcagtttttaccgaagagaaccagtgggacagtgcaaaggcagcggtcgaggatgaggacttttggaagctcgttgatcgggagagagagctgcacaaactgggcaagtgcgggagttgcgtgtacaacatgatgggcaagcgggagaagaagctcggggagtttggcaaggccaagggctcccgcgcgatatggtacatgtggttgggagcacggtacctggagtttgaggccctgggtttcctgaacgaggaccattggttcagtcgcgagaactcgtactccggagtggaaggcgaggggctgcacaagctcggatacatcctgcgggacatctccaagatccccggcggcgccatgtacgccgacgacaccgcgggctgggatacccgaataaccgaggacgacctgcataacgaggagaagataacccagcagatggaccccgagcaccgacagctcgctaacgccattttcaagctgacctaccaaaacaaggtcgtgaaagtacagcgccccacccccaccgggacggttatggacattatcagcaggaaggaccaacgcggatccggccaggtgggaacctatgggctgaacacgttcaccaacatggaggcccagctcatacggcagatggaaggggaaggggtgctgagcaaggccgacctggagaacccccacctcccggagaagaagatcactcagtggctggaaaccaagggggtcgagcgcctgaagagaatggcgatatccggcgatgactgcgtggtgaagcccatcgacgaccggttcgccaacgctctcctggctctgaacgacatgggcaaggtgcgtaaggatatcccccagtggcaaccctctaaggggtggcacgactggcagcaggtcccgttttgctcccaccacttccacgagttgatcatgaaagacggccgcaagctggtagtcccctgccggccccaggacgagctgatcgggcgcgctcgcatcagccaaggcgcggggtggtccctccgggaaacggcgtgcttgggcaaggcctacgcgcagatgtggtccctcatgtactttcaccgccgggacctccggctggcatccaacgcaatctgcagcgctgtgcccgtgcactgggtccctaccagtcgaacgacctggagcatacacgcccaccatcaatggatgaccactgaggacatgttgacggtgtggaaccgtgtctggatagaggacaatccctggatggaagataaaacacccgtcacaacctgggagaacgtgccctatctcggcaagcgggaagaccagtggtgcgggagcctgattggcctgacgagtcgcgccacctgggcacaaaacataccaaccgccatccagcaggtccggagtctcatcgggaatgaggagttcctggactacatgccttccatgaagcgcttccgaaaggaggaggaaagcgagggcgccatctggtga

SEQ ID NO: 25696 - RNA, 9873 nt, synthetic construct
  misc_feature 1..9873: note = derived and/or modified CDS sequence (opt11) from DENV-3__GU131861__SS-prME
  source 1..9873: mol_type = other RNA
accagcttatgcctcgttatgatcctcccggcagccctggcgttccacctcacctcgcgggacggcgagccccggatgatcgtggggaagaatgagcggggcaagagcctgcttttcaagacagcctccgggatcaacatgtgcactttgatcgcgatggatctaggagagatgtgcgacgacaccgtgacatataagtgtccccatattacggaggtggagcctgaggacatagactgctggtgtaacctgaccagcacctgggtcacctacgggacgtgcaaccaggcgggcgaacgacgccgggataagcgatccgtggccctcgcaccccacgtgggcatgggtctggacacacggactcagacctggatgtcggccgagggcgcctggcgccaggtcgagaaggtggaaacctgggcgctgcggcaccctggcttcactatcctcgcgctgttcctcgcccactacatcggtacctccctcacccaaaaggtagtcatcttcattctgctgatgctcgtgacgccctcgatgaccatgcgctgtgtgggggttggcaaccgggacttcgtggaaggcctgagtggggccacctgggtggacgtcgtgctggagcacggcggctgcgtgaccaccatggctaagaacaagcccacactcgacatcgaactgcagaagaccgaggccacccagctggcaacgctccgcaagctgtgcatcgaaggcaagattaccaacatcaccaccgacagccggtgcccaacgcagggcgaggccgtcctgccggaggagcaggatcagaactacgtctgtaaacatacctacgttgaccgcgggtgggggaacgggtgcggcctcttcggcaagggctcccttgtgacatgcgccaagttccaatgcctggagcctatcgagggcaaggtggtgcagtacgagaaccttaaatacaccgtcatcatcacggtgcacaccggggatcagcatcaagtcgggaacgagacccagggggtgacagccgaaatcacgccccaggcaagcacgactgaagcgatcctgccagagtacggcaccctcgggctcgagtgctctccgcggaccggactggacttcaacgagatgatcctgcttactatgaagaacaaagcctggatggtgcatcgtcagtggttcttcgacctgcccttgccctggaccagcggggcgaccactgagacgcccacctggaaccggaaggagcttctggtcaccttcaagaacgcccacgccaagaagcaggaggtggtggtcctggggagtcaagaaggcgcgatgcacaccgcgctcacgggggccaccgagatccaaaacagcggcgggacaagcatcttcgccggtcacctgaagtgccggctgaagatggacaagcttgagctgaagggcatgtcctacgcaatgtgcaccaacacattcgtgttaaagaaggaagtgtccgagacccagcatgggaccattctcatcaaggtcgagtacaggggcgaggacgctccgtgcaagattccattctcgaccgaggacgggcagggcaaggcccacaatggtcggttgatcacggccaacccagtggtgactaagaaagaagagccagtcaacatcgaggccgaaccgccatttggtgagagcaacatcgtcataggcatcggggataacgcgctgaagattaactggtacaagaagggctcctcgatcgggaagatgttcgaggccacagcccgtggcgcccgccgtatggcgatcctgggcgacaccgcatgggacttcggatcggtgggcggggtcctcaatagcctgggcaaaatggtgcaccaaatcttcggctccgcctacacggccctattctctggcgtatcctgggtaatgaagataggtatcggaatactcctgacgtggatcggactaaactcgaagaacacttccatgagcttctcctgtatcgccatcgggatcatcaccctctacctgggggccgtggtgcaggcggacatgggatgcgtcattaactggaagggcaaggaactgaagtgcggcagcggtatcttcgtcacaaacgaggtgcacacgtggactgagcagtacaaattccaggctgactcacccaaacggctcgctaccgccatcgccggcgcgtgggagaacggtgtctgcggcatccgcagcacgacccggatggaaaacctgctgtggaagcagatcgccaacgaactcaactacatcttgtgggagaacaacatcaagctgaccgtggtggtgggggatatcattggtgtgctcgagcagggcaagcgcaccctgaccccccagcccatggagctgaagtattcctggaagacctggggaaaggcgaagattgtgaccgccgagacacagaacagctccttcatcatcgacggccccaacacgcccgaatgccccagcgcgtcacgcgcatggaacgtatgggaggtggaggactacgggttcggcgtgtttaccaccaacatttggctcaagttacgcgaagtctacacccaactgtgcgaccaccggctcatgagcgccgccgtgaaagacgagcgcgccgtgcacgcggacatgggctactggatcgagagccagaagaacgggagttggaaattggagaaggccagcctgatagaggtgaagacctgcacgtggccgaagtcccacaccttgtggagcaacggtgtgctggagtccgacatgatcatccccaaaagccttgccgggccaatctcccaacataatcacaggccgggataccatacccagaccgccggaccctggcacctcggcaagctggagctggatttcaactactgcgagggcacgaccgtcgtcataactgagaattgtggcacacgcggcccgtctctccggacgaccaccgtgtccgggaagctgatccacgagtggtgttgcagaagctgcaccctgccaccgctccggtacatgggcgaggacgggtgttggtacggcatggagatccgccccatctccgagaaggaggagaacatggtaaaaagcctggtctccgctggctctgggaaggtagacaacttcaccatgggcgtactgtgcctcgcgatcctgttcgaggaggtcatgcgggggaagttcggcaaaaagcatatgatagcgggggtgttcttcaccttcgtcctgttgctgtccggccagattacctggcgcgacatgacacacacgctgatcatgatcggctcgaacgcctccgaccggatggggatgggagtaacctacttagccctgatcgccacatttaagatccagcccttccttgcactcgggttcttcctgcgaaagctgacgagtagggagaatctcctgctgggcgtgggcctcgctatggcaacaaccctgcagctcccggaggacatcgaacagatggccaacgggatcgctcttggactgatggcactgaagctcatcacccagttcgagacctaccagttgtggacggccctgatctcactgacatgttcgaacaccatgttcaccctgacagtggcctggcgcaccgcgaccctgatcttagcgggagtcagtctgctgccggtatgccagagtagctccatgcgcaagaccgactggctcccgatggccgttgccgctatgggcgtgccgcccttaccactgttcatatttagcctaaaggatacgcttaagcggcgctcctggcccttaaatgagggggtgatggcggtcgggctagtgagcatcctggcgtccagcctgctacggaatgacgtgcccatggccggacccctggtcgccggggggctgctcatcgcctgctatgtgatcaccgggacgtctgccgacctgaccgtggagaaagcggctgacatcacgtgggaagaggaggcagagcaaacgggcgttagccacaacctgatgattactgtagacgacgacgggaccatgcgcatcaaggacgacgagaccgagaacatccttacagtgctgctgaagaccgccctactgattgtctcaggcgttttcccgtacagcatcccagccacactgctcgtatggcacacctggcagaaacagactcaacgatccggcgtgctgtgggacgtgccctcgccgcccgagacccaaaaggccgagctggaggagggggtgtataggatcaaacagcagggcatattcgggaagacccaggttggcgtgggggtacagaaggagggcgtattccataccatgtggcacgtaacgcgcggcgccgtgctaacctataacgggaagcgcctggagcccaactgggcctcagttaagaaggatttgatcagctacggcggaggctggcggctctcggcccagtggcagaaaggggaggaagtccaggtgatcgcagtcgagcccggaaaaaaccctaagaacttccagaccacccccggcacgttccagaccaccaccggggagattggcgccatcgccctggacttcaaacccgggacgagcgggagccccatcatcaaccgcgagggcaaggtggtagggctgtacggaaacggggtagtgaccaagaacggcgggtacgtgtccggcatcgcccagaccaatgcggagccggacggccccacacccgagctcgaggaggaaatgttcaagaaacggaacctgacgatcatggacctgcatccgggctcgggcaagacgaggaagtatctgccagcgatcatccgggaggccatcaagcggcgactcaggaccctgatcctggcccccacgagagtcgtggccgccgagatggaggaggccctcaaggggctgcccataaggtaccagactaccgtgacaaaatcggagcataccggccgggagatcgtcgacctgatgtgccacgctacgttcaccatgcgcctcctgagcccggttcgggttccgaactacaatttaatcattatggatgaagctcacttcacggatcctgcctcgatcgcggcgcgcggttacataagcaccagggtcggcatgggcgaggcagccgcgatcttcatgacggcgactccgcccgggaccgccgacgccttcccgcagtccaacgcccccatacaggacgaggagcgggacatcccggagcgcagctggaactccggcaacgagtggattaccgattttgccgggaagacagtttggttcgtgccctcaataaaggccggaaacgacattgccaactgcctccgaaagaacgggaagaaggtcatccagttgtccaggaagaccttcgacacggagtaccaaaagactaagctgaacgactgggactttgtggtcacgaccgatatctcggagatgggcgctaacttcaaggccgacagggtcattgatccgcgcaggtgcctcaagcccgttatactgacggacggcccggaacgcgttatcctggccggacctatgcccgtcacggcggcttccgctgcccagcggcgcggccgggtgggtagaaacccccagaaggagaacgaccaatacatcttcaccggccaacccctcaacaacgatgaggaccacgcccactggacagaggcgaaaatgctgctcgataacatcaacaccccagaggggatcatcccggccctcttcgagcctgaacgggagaagtccgccgccatcgacggcgagtatcgcttaaagggagagtccagaaaaacctttgttgagttgatgcgacgcggggacttgcctgtctggctggcgcacaaggtcgcaagcgagggcatcaaatataccgaccgtaaatggtgctttgacgggcagcggaataaccagatcctggaggagaacatggacgtcgagatctggacgaaggagggcgagaagaagaagctccgcccacgctggctggacgcccggacctactccgacccgctggccctcaaggagttcaaggacttcgccgcggggaggaagagcatcgccctcgacctggtgaccgagatcgggcgcgtgcccagtcacctagcccaccgcacccggaacgccctggacaacctggtcatgctccacacctcagagcatggcgggcgcgcctaccggcacgcggtggaggagctgccggagaccatggagaccctgttgcttctgggcctcatgattctgttaaccgggggcgccatgctgttcctaatcagcggcaaggggattggtaagacgtcgattgggctgatctgcgtgatcgcctcctcaggcatgctctggatggcagagatccccctgcagtggattgcatcggctgttgtgctggagttctttatgatggtgctcctgatccccgagccggagaaacagcgcactccacaggacaaccagcttgcatatgtcgttatcgggatcctaaccctggccgccatcatcgccgcgaatgagatgggtttgctggagaccaccaaacgggacttaggtatgtccaaggaaccgggtgttgtcagccccacgtcctatctcgatgtggatctccaccccgccagcgcctggaccctgtacgccgtggcgaccacggtcatcacccccatgctaagacacaccatagagaattccaccgccaacgtcagcctagccgccatcgctaaccaggctgtggtcctgatgggcttggataaagggtggccgatctcgaagatggacctcggtgtgcccctgctggccctcgggtgctacagccaggttaacccgctcacgctgaccgccgccgtcctcctgctgatcacccactacgcaattataggtcccggcttacaggcaaaagccacccgggaagcccagaagcgcacagccgccgggatcatgaaaaacccgactgtggacggcattatgacaatcgacctggatcccgttatttacgacagtaagttcgagaagcaactggggcaggtcatgttgttggtgctgtgcgctgtgcagctcctgctgatgaggacgagctgggccctctgcgaggcactcacgctagccacaggtcccatcaccacgctgtgggaggggagtcccgggaaattctggaacactacgatcgctgttagcatggccaacatcttccgaggttcctacctggctggggccggtctggccttctcaatcatgaagtccgtggggaccggcaagcggggcacaggtagccaaggcgagaccctaggtgagaagtggaagcgcaagctgaaccagctgagccggaaggaattcgacctctacaagaagtccggcatcaccgaggtggatcgcaccgaggctaaggaaggtctaaaaaggggcgagattacccaccatgccgtcagcaggggctccgccaagctgcagtggttcgtagagcgaaacatggtcatcccggagggtcgcgttatcgacctgggctgcgggcgcggcggctggagctactactgcgccggcctgaagaaagtgaccgaggtgcggggttacacgaaaggtgggccaggtcacgaggagcccgtgcccatgtccacctacggctggaacatcgtgaagctgatgagcgggaaggatgtgttctacctcccgcctgagaagtgcgataccttactgtgcgacatcggggagtccagccccagccccaccgtcgaggagtctagaaccatccgcgtgctgaagatggttgagccttggctcaagaacaaccagttctgtatcaaggtcctgaacccctacatgcccaccgtgattgaacatctggagagactccagagaaagcacggcggtatgctagtgcgaaacccactgtcacggaacagcacccacgagatgtattggatctccaatggcaccgggaacatcgtcgcctctgtgaatatggtctcccgcttactgctgaatcggtttacgatgacccaccgcagaccgaccatagagaaggacgtcgacctcggcgcgggtacccgccacgtgaacgccgagcccgaaacgcccaacatggacgtgataggagagcggatcaagaagatcaaggaggagcacaactcaacctggcactatgacgacgagaacccgtataagacctgggcctatcacggctcctacgaggtaaaggccaccgggagcgcctcaagcatgatcaacggcgtggtgaagctgctgactaagccctgggacgtagtgcccatggttacccagatggcgatgactgacaccacgcccttcgggcagcaacgagtgttcaaggagaaggtggacacccggacgccgaggagcatgcccggtacccggcgcgtcatggagataacggctgaatggctgtggcggaccctgggccgcaacaagaagccacgcttgtgcactcgggaggagttcaccaagaaggtgcgcactaacgccgccatgggggcggtgttcaccgaggagaatcagtgggactctgcgaaggccgcagtcgaggacgaggacttctggaaacttgtagaccgagagcgagaattgcacaagctgggcaaatgcggcagctgcgtgtacaacatgatgggcaagcgggagaagaagctcggggagttcggcaaggccaagggaagtcgcgcgatttggtacatgtggctgggcgcccgttacctggagttcgaggccctcggattccttaacgaggaccactggtttagccgcgaaaacagctacagcggggtcgagggcgaggggctgcacaagctcggctacatactgcgggacatctctaagatccccggcggggccatgtacgccgacgacacggcgggttgggacacccgcatcacggaggacgacctgcacaacgaggagaagatcacacagcagatggacccggagcaccggcaactcgccaacgccatcttcaaactaacataccagaacaaggtggtgaaggtccaacgccctaccccgacagggacggttatggacatcattagccggaaagaccagcggggctccggccaggttgggacttacggcctcaacactttcaccaacatggaggcccagctaattcggcagatggagggggagggcgtgttgtctaaagcagaccttgagaacccccacctcccggagaagaagatcacgcagtggctggagaccaaaggggtggaacgcttaaagcggatggctatctcgggcgatgactgcgtggtcaagcccatcgacgaccggttcgccaacgccttgctggcccttaatgacatgggaaaggtgcggaaggatatcccccagtggcagcccagcaaggggtggcacgactggcagcaggtaccgttttgcagccaccacttccacgaactcattatgaaagacggacgcaagctggtagtgccttgcaggccccaggacgagctgatcgggcgcgccagaatctcccaaggggcagggtggtccttacgggagacagcctgtctgggtaaggcctacgctcagatgtggtcactgatgtatttccaccgcagagacctccgactggcgtccaacgcgatatgctccgccgtgccagtccattgggtgcctacctcccggacaacgtggtcgatccacgcccaccaccaatggatgaccaccgaggacatgctgaccgtgtggaatcgcgtctggatagaggacaacccctggatggaggacaagacccccgtgaccacctgggagaacgtgccctacctcggtaagcgagaggaccagtggtgcgggagcctgatcggcctgacctcccgcgccacctgggcgcaaaacatcccaaccgccattcagcaagttcggagcctcatcgggaacgaggagttcctggactacatgccgtccatgaaacgcttcaggaaggaggaggagtctgagggcgccatctggtga

SEQ ID NO: 25697 - RNA, 9873 nt, synthetic construct
  misc_feature 1..9873: note = derived and/or modified CDS sequence (opt11) from DENV-3__GU131862__SS-prME
  source 1..9873: mol_type = other RNA
acctccctgtgcctcgtgatgatcttgcccgcagcactcgcgttccatctcacgagcagggacggggaaccccggatgattgtgggaaagaatgagcgcggcaagtcgctgttattcaagactgcctcgggtataaacatgtgcaccctcatcgccatggaccttggggagatgtgcgacgacaccgtgacgtacaaatgcccccacatcacggaggtggagccggaggacatcgactgttggtgcaatctaacttccacttgggtcacctatgggacctgcaaccaggcgggcgagcgccgccgggacaaacgctctgtggccctcgcgccccacgtgggcatggggttggacacccggacccagacgtggatgagcgccgagggcgcgtggagacaggtggagaaggtggaaacgtgggctctgcggcacccgggattcacgatcctcgcgctgttcctggcccactacattggaacctccctcacccagaaggtggtcatattcatcctgctgatgcttgtgacgcctagcatgactatgcggtgcgtgggtgttggcaaccgggacttcgtggaaggcctttctggcgccacctgggtggatgtcgtccttgaacacgggggatgcgtgactacaatggccaaaaacaagcccaccctagatatcgagttgcagaagactgaggccacgcagctggcaacattgcgtaagctgtgcatcgaaggcaaaatcacaaacatcacgaccgacagtcggtgcccaacgcagggcgaggccgtcctgcctgaggagcaggaccagaactacgtatgcaagcacacctacgtggacaggggttggggcaacggctgcggcctctttggtaaaggctccctggtgacctgcgccaagttccagtgtctggagcccatcgaggggaaggtggtgcagtacgagaacctgaagtacaccgtcatcatcacagttcacacgggtgaccagcatcaggttgggaacgagactcagggggtgaccgccgaaatcacgccgcaggccagcaccacggaggcgatccttcccgagtacggtacgttggggctcgagtgctccccgcggaccggcctggacttcaacgagatgatactgctcacgatgaagaataaggcgtggatggtccaccgccaatggttcttcgacctgccgctgccttggacaagcggcgccactaccgagacgcccacatggaacaggaaggaactcctggtcactttcaagaacgcacacgccaaaaagcaggaagtggtggtcctgggctcccaggagggcgcgatgcacaccgccctcacaggggccaccgagatccagaacagcggcgggaccagtatattcgccgggcacctgaagtgtcgcttgaagatggacaagctcgaactgaagggcatgagctatgcaatgtgtaccaacactttcgtgcttaagaaagaggtctccgagacccagcacggtactatattaatcaaagtcgaatatcggggcgaggatgctccgtgtaaaattcctttcagtacggaggacgggcaaggaaaggctcataacggccgcctgatcaccgccaaccccgtggttataaagaaagaggagcccgtcaatatcgaggccgagccgcccttcggggagtcaaacatagtgatcggcataggggacaacgcgctcaagataaattggtacaagaagggcagtagcatcgggaagatgttcgaggcgacggccagaggggcaaggaggatggcaattttaggtgataccgcctgggacttcggttctgtcggcggggtccttaatagcttaggcaagatggtgcatcagatattcggctctgcctacaccgccctgttcagcggggtgtcctgggtcatgaagatcggcatcggcatcctcctgacgtggatcggcctaaatagtaagaacacatctatgagcttctcctgcatcgcgatcgggatcataaccctgtacctgggggccgtagtgcaggcggatattggttgtgtcataaactggaaggggaaggagctcaagtgtggcagcgggatcttcgtaaccaacgaggtgcacacatggaccgagcaatacaagttccaagcagacagccctaagcggctcgccaccgctatcgccggggcgtgggaaaatggggtttgcggcattcgcagcactacgcggatggaaaatctattatggaaacagattgcaaacgagctcaactacatactgtgggagaacaacatcaagttgaccgtggtggtcggcgacatcataggcgttctagaacagggaaaacgcaccctgacgccccagccgatggagctgaagtactcctggaagacgtgggggaaggcgaaaatcgtgactgccgagacccaaaacagctccttcatcattgacggtccaaacacccccgagtgccccagcgcatccagagcctggaacgtctgggaagtagaggactacggcttcggcgtgttcacgactaacatctggctcaaactgcgcgaggtctacacccagctgtgtgatcaccgactaatgagcgcagccgttaaggacgagcgcgccgtgcatgcggacatggggtactggatcgagagccagaaaaacgggtcctggaagctggagaaggcctcgctgatcgaggtcaagacctgtacatggccgaagtcccacaccctctggagcaacggcgtccttgagtccgacatgatcatccccaaaagcctggcagggcccatatcccagcataaccacaggccggggtatcacactcagactgctggcccctggcacctcggcaagctggagcttgacttcaattactgcgagggcacgaccgtggtcattactgagaactgcggcacacgcggccccagcttacggaccacgactgtctccgggaagctgatccatgagtggtgctgccgcagctgcactctgcccccgttgcgttatatgggcgaggacggttgctggtacggcatggagattcgccctatctccgagaaggaggagaatatggtcaagagcctggtctccgccggctcggggaaggttgacaacttcaccatgggcgtgctttgcctggccatcctttttgaggaggtcatgcgagggaaattcggcaagaagcacatgatcgccggggtgttctttactttcgtgctgctcctatccggtcagatcacttggcgcgacatgacccacaccctcatcatgattgggagcaacgcctccgaccggatgggcatgggggtcacatacctcgcccttatcgccacctttaagatccagcccttcctggcactcgggttcttcctgagaaagctgacgagccgagagaacctcttgctaggcgtcggcctcgccatggccaccaccctccagttacccgaagacatagaacagatggccaacggaatagcgctcggccttatggccctgaagctcataacccagttcgagacgtaccaactctggaccgccctgatcagcttaacgtgcagtaacaccatgttcaccctgaccgttgcctggcgcacggctaccttgatcctcgcgggggtctccctgctgccggtatgccagtcctcttcaatgcgtaagaccgactggctccccatggcggtcgccgccatgggagtgccgcccctgccgctgttcatcttttccttaaaggacactttgaagaggcgctcctggcccctgaacgagggggtgatggctgtcggtctcgtgagcatccttgcttcctcactgctccgtaatgacgtccccatggctggacccctcgtcgccggaggccttctaatcgcctgctacgtgatcacggggacctctgccgatctgaccgtggagaaggcggccgacattacctgggaagaggaggccgagcagacgggcgtctcacacaacctgatgataacggtggatgacgacgggactatgagaatcaaggatgacgagaccgagaacatcctaacggtgctgctgaagacggccctcttaatcgtctcaggagtatttccgtactccatccccgccaccttactcgtgtggcatacctggcagaaacagacccaacggtctggagtcctgtgggacgttccctcaccgcccgagacgcagaaagccgagctcgaggagggggtgtatcgcattaaacagcagggtatcttcggcaaaactcaggtgggagttggtgtgcagaaagagggcgttttccacacaatgtggcacgtgacaagaggggccgtgctcacgtacaacgggaagaggctggagcccaattgggcctctgtcaagaaggacctgatctcgtacggcgggggctggagattgtcagcgcagtggcagaagggagaggaggtgcaagtgatcgcggtggagcccgggaagaaccccaagaactttcaaactatgcccggcaccttccagaccacgaccggcgagatcggagcaattgccctcgatttcaagcccgggacgagcgggtcacccatcatcaaccgcgaaggtaaggtagttgggttgtacggcaacggggttgtgaccaagaatggcgggtacgtgagcggcatcgctcagaccaatgccgagccggacggcccaacaccagagctggaggaggagatgttcaagaagcgaaacttaaccatcatggacctgcaccctgggagcggcaagaccagaaagtacctaccggcgatcataagagaggcgattaagcgccgtctcaggacgctgatcctagcacccacgcgggtcgtggccgccgagatggaggaagcgctcaaggggctgcccattcgctaccagacaaccgctacgaagtccgagcacaccggcagagagatcgtagatctgatgtgccacgcgacatttaccatgcgcctactgagccccgtccgcgtcccgaactacaacctgatcatcatggacgaggcacacttcacggacccggcttccattgcggcccgcgggtacataagcacccgagttggcatgggcgaggccgccgcgatcttcatgactgccacgccgcccgggacagccgatgcgttcccgcaatcgaacgcccccatacaggacgaggagcgcgacattccggaacggagctggaactccggcaacgaatggataactgatttcgtcggcaagaccgtgtggttcgtgccctcaatcaaggcgggcaacgacatcgccaactgcctgcggaagaacggcaagaaggtaattcagctgtcccgcaagactttcgacacggagtatcagaagaccaaactgaacgactgggactttgtggtgactaccgacatctcggaaatgggagctaacttcaaggccgaccgggtgatcgacccgcgccgatgcttaaaacccgtgatcttgacggacgggccggagcgagttatcttagccgggccaatgccggtcaccgctgcaagcgcagcacagcgccgcggccgggtggggcgcaacccccagaaggagaacgatcaatacattttcaccggacaacccctcaacaacgacgaggaccacgcccactggacagaggcgaaaatgctgctggacaacattaacacccccgaaggcataatcccggcccttttcgaaccagagcgggagaagtccgccgccattgacggcgagtacaggttaaagggcgaatcccggaagacgttcgtggagctgatgcgacgcggtgacctccccgtctggctggcgcacaaggtggcatcggagggcatcaagtacactgaccgcaaatggtgcttcgacgggcagcggaacaatcagatcctggaagagaatatggacgtcgagatttggactaaggagggggagaagaaaaagctgcgaccccgctggctggacgcccggacctattccgatccgctagctttgaaggagttcaaagacttcgccgctggccgtaagtcaattactctggacctggtgaccgaaatcgggcgggtaccctcccatctcgcccaccgcaccagaaacgccctggataacctcgttatgctccacacaagcgagcacggagggcgtgcataccggcatgccgtggaggaactacccgaaacaatggaaacccttctcctgcttggcctcatgatcctcctaacagggggcgcgatgctatttttgatcagcgggaaggggataggtaaaacctcgatcgggttgatctgcgtgatcgcctcttccgggatgctctggatggccgagattccgctgcagtggatcgccagcgccatcgtcctggagttcttcatgatggttctcctcatccccgagcccgagaagcagaggacgccccaggataaccagctggcgtatgtggtcatcgggatcctcacccttgcagcgatcatcgccgcaaacgagatggggctgctggagactacgaagcgggatctgggcatgtccaaggaaccgggtgtggtttcgcccaacagttacctggatgtcgaccttcacccagcaagcgcatggacgctatacgccgttgccaccacagtgatcacccccatgctgcgccacacgattgaaaactccaccgcgaatgtctctctcgcagctatcgccaaccaggctgtcgttttgatgggcctggacaaggggtggccaatttccaagatggacctcggcgtccccctgctggcgctcggatgctactcccaggtgaacccactgaccctgaccgccgccgtactcctgctgattacgcactacgccatcataggacccggcctccaagccaaagcgacccgggaagcccagaagagaacagccgccgggatcatgaagaatcccaccgtggatggcatcatgacgatcgatctggatcccgtgatttacgattcaaagttcgagaagcagttaggacaggtgatgctcctggtgctctgtgccgtgcagcttcttcttatgcggacatcttgggcgctctgtgaggcgctgaccctggccaccggccccataaccacgctctgggagggctcgcccggcaaattctggaacaccaccatcgccgtgagcatggcgaatatattccgcggctcctacctggccggggccggcctggctttcagcataatgaagtccgttgggactggcaaacgggggaccgggagccagggcgagaccctcggggagaagtggaagaagaagctgaaccagctgagccggaaggagttcgacctctacaagaagtccggtataacagaggtggaccggacggaggccaaggaggggctgaagcgcggcgagataacgcaccatgcggtgtcacggggttccgcaaagctgcagtggttcgtagagcgcaacatggtgatccccgaggggcgggtgatcgatctcggatgcggacgcggcggatggagctattactgcgcgggcctgaaaaaggtcaccgaggtgcgcggctataccaagggcggccctggtcacgaggaacccgtgcccatgtccacgtacggctggaacatcgtaaaactgatgagcgggaaggacgtgttctacctaccacccgagaagtgcgacacgttattatgtgatatcggggagtccagcccatcccccacggtagaagaatctcggaccatccgagtcctaaaaatggttgagccgtggctcaaaaacaatcagttttgcatcaaggtgttaaacccctacatgcccaccgtaatcgagcacctcgagcgtctccagcgcaagcacggcggtatgttggtgcggaaccccctctcgcgaaactctacacacgagatgtactggatcagcaacggaaccggaaacatcgtcgcaagcgtcaacatggtatcaaggttattactgaatcgctttaccatgacacaccgtcgcccgaccatcgagaaggacgtggacctcggagccggcactcgacacgtcaacgcggagcccgagacgcccaatatggacgtgatcggggagcggatcaagcgtatcaaagaagaacataacagtacgtggcactacgacgatgagaacccttacaaaacctgggcctaccacggctcttacgaggtgaaggccacaggcagcgcaagcagcatgataaacggagttgtgaagctacttaccaagccgtgggacgtcgtccccatggtgacccagatggccatgactgacacgacccccttcgggcagcaacgcgtattcaaggagaaggtggatacccggaccccgcgaagcatgcccggcaccaggcgcgttatgggcatcacggcagaatggctatggaaaaccctggggcggaataagaaaccccgcctgtgtactcgcgaggagttcactaagaaggtgcggaccaatgccgcgatgggcgctgtattcaccgaggagaaccagtgggactccgcgaaggctgccgtggaggatgaggacttctggaagctcgtcgaccgcgagagagaactccacaagctcgggaagtgcggctcttgcgtctacaacatgatggggaagagagagaagaaattaggcgagttcggcaaagctaaagggtcccgagccatctggtacatgtggttgggcgcgcgctacttggagtttgaggcactcgggttccttaacgaggaccactggtttagccgtgaaaactcctacagcggcgtggaaggcgaggggctgcataagttgggctacatccttcgtgacatcagtaagatccccgggggcgcgatgtacgccgacgacacggccgggtgggacaccaggatcaccgaggatgatttgcacaatgaagagaaaatcacccaacaaatggacccggaacaccgccagctcgcgaacgccatcttcaagctgacgtaccagaacaaagtcgtgaaagtgcaacggcccacaccaaccggcaccgtgatggacatcataagccgcaaggaccagcggggctccggccaagtagggacatacgggctgaacacgttcaccaacatggaggcccaactcatacgccagatggaaggcgagggtgtactgagcaaggccgatctagaaaacccacacctccccgagaagaagatcacacaatggctggaaaccaaaggcgtcgagcggctaaagcgcatggcgatatccggcgacgactgtgtggtgaagcccatcgacgaccggttcgcgaatgccctcctggccttgaatgatatgggtaaggtgcgcaaagacatcccccagtggcaacctagcaagggctggcacgactggcaacaggtgccgttctgttcccaccacttccacgagcttatcatgaaggacgggcggaaattagtggtaccctgccgcccccaggacgagctgatcggccgggccaggatcagccagggggccggctggtccctcagggagacggcttgtctgggcaaggcctatgcccagatgtggtccctgatgtatttccacaggcgagacttacggctggcgtccaacgccatctgctccgcagtgccagtgcactgggtcccgacatcccgcactacctggtcgatccatgcgcaccaccagtggatgacgaccgaggacatgctgaccgtgtggaatagagtgtggatcgaggacaacccctggatggaagacaagacccccgtcacgacgtgggaaaacgtaccctatcttggtaagagggaggaccagtggtgcggctccctgatcggcttgacgtcccgggcaacatgggcccaaaacattccgacggcgattcaacaggttagaagcctaatcggcaacgaggagttcttagactatatgccctccatgaagcggttccgcaaggaagaggagagcgagggggccatctggtaa

SEQ ID NO: 25698 - RNA, 9873 nt, synthetic construct
  misc_feature 1..9873: note = derived and/or modified CDS sequence (opt11) from DENV-3__GU131865__SS-prME
  source 1..9873: mol_type = other RNA
accagcctctgcctcgtgatgatcttacccgcagcattggccttccatttaaccagccgggacggcgagccccggatgatcgtggggaagaatgaaagaggcaaaagcctcctgttcaagactgccagtgggatcaacatgtgcaccctcatcgctatggacctgggcgagatgtgcgatgacacagtgacatacaagtgtccccatatcaccgaggtggagcccgaggacatcgactgctggtgcaacctgactagcacttgggtgacgtacggtacctgcaaccaggccggtgaacgacgcagggacaagcgctccgtggccctcgcgccccacgtgggcatgggcctggacacccgtacacagacatggatgagcgccgagggcgcatggcgtcaggtcgagaaggtagagacgtgggccctgcggcacccgggattcaccatcttagctctgttcctggcccactacatcggcacctccctcacacagaaggtggtcatcttcatactgctgatgctggtaacgcccagcatgaccatgcgctgcgtgggggtgggcaatcgggactttgtggagggcctgtccggggccacctgggtggacgtcgtgctggagcacggcggttgcgtgaccacgatggcaaagaataaacccacgctcgatattgaactgcagaagaccgaggcaacccagctggcgacgctccgcaagctgtgcatcgagggcaagatcaccaacatcaccaccgacagtcggtgccccacgcagggcgaagccgtcttgccggaagaacaggaccagaactatgtgtgcaagcatacatacgtcgaccgagggtggggcaacgggtgcggactcttcgggaagggctcccttgtgacctgcgctaagttccagtgcctagagcccatcgagggaaaggtggtacagtacgagaacctgaagtacaccgtcatcatcacggtgcacaccggggaccagcaccaagtcggcaacgagacccagggcgtgaccgccgagatcacgccccaggccagcaccaccgaggcaatcctgccggagtacggcaccctggggctcgaatgcagcccaagaaccggcctggacttcaacgagatgatcctgctcactatgaagaacaaggcctggatggttcaccgccagtggttcttcgacctgcctctgccctggacgtctggagccaccaccgagacgccaacgtggaaccgaaaggagctcctagtaactttcaagaacgcccacgccaagaagcaggaggttgtggtcctggggagccaggagggtgcgatgcatactgccctgacgggggccaccgagatccagaacagcggcgggacctccatcttcgccggtcacctgaagtgccgcctaaagatggacaagctcgaactgaagggcatgagctacgccatgtgcacgaatacgttcgtgctgaagaaagaggtttccgagactcaacacgggaccatcctcatcaaggtcgagtaccggggcgaggacgcgccgtgcaagatccccttcagcacggaggacgggcaaggcaaagcccataacggcaggttgatcaccgcaaatcccgtcgtgaccaaaaaggaggagcccgtcaatatcgaggcagagccgcccttcggtgagtcgaacatcgtgatcggcatcggggataacgcgctgaaaatcaactggtacaagaaaggcagcagcatcgggaagatgttcgaggccactgcccgtggagccaggcgcatggccatcttgggcgacaccgcatgggacttcgggtcagtaggaggggtcttaaacagcctgggcaagatggtgcaccagatcttcgggtccgcctacactgccctgttctctggcgtttcctgggtcatgaaaatcggcatcggtattctcctgacctggatcgggttgaacagcaaaaatacctccatgagcttctcctgcattgccatcgggataatcacactctacctgggagccgtggtgcaggctgacatggggtgcgtcattaattggaagggcaaggagctgaagtgcggtagcggtatcttcgtgacgaacgaggtccacacctggaccgagcagtacaagttccaggccgactcccccaagcggctcgccaccgccatcgctggcgcgtgggagaacggagtctgcggcattcgctctacgactcggatggagaaccttctgtggaaacagatcgccaacgagctcaactacatcctgtgggagaacaacatcaagctgacggtggtcgtcggggacataatcggcgtcctcgagcagggcaagcgcaccttaacgccccaaccgatggaactgaagtactcctggaagacctgggggaaggccaagatcgtgaccgccgagacccagaacagctccttcatcatcgacggtcccaacacgcccgagtgcccaagcgcgtcgcgggcctggaacgtctgggaggtggaggactacggtttcggcgtgttcactaccaacatctggctcaagctccgcgaggtctacacgcagctgtgtgaccaccggctcatgagcgccgctgtgaaggacgagcgtgcggttcacgcggacatgggctactggatcgagagtcaaaagaacgggagctggaagctggagaaggcaagcttgatagaggtcaagacctgcacttggccgaagtcccatacgctctggtcgaacggcgtactggagtctgacatgatcatcccaaagagcttagcaggtcccatcagccagcacaaccacagaccggggtaccatacccagaccgccgggccctggcacctcggcaaactggaacttgacttcaactattgcgagggcacgaccgtagtcatcacagagaattgtggaacccgcggccccagcctccggacgactacggtgagtgggaagctgatccacgagtggtgctgcagaagctgcaccctgcccccgctccgctacatgggggaggacggctgctggtatggcatggagattagacccatctcagagaaggaggaaaacatggtgaagagcctggtctctgccggcagtgggaaggtcgacaacttcacgatgggcgtgttatgcttagcgatcctgttcgaggaggtcatgcggggaaaattcggcaagaagcacatgatcgccggggtattctttaccttcgtgctgctgctgagtggccaaataacctggcgcgacatgacccacacgctgatcatgatcggaagcaacgcctccgaccggatggggatgggcgtcacctacctcgccctgatcgccaccttcaagatccagccctttctggcgctcgggttcttcctgcgcaagctgaccagcagggagaacctcttgctgggcgtgggcttagcgatggcaaccaccctgcagctacccgaggacatcgagcagatggccaacgggatcgcgctcggcctgatggcgctgaaactcattacccagtttgagacctatcaactgtggacggcgctgattagcctgacctgttccaacaccatgtttaccctcacggtagcctggcgcaccgccaccctgatcctcgccggcgtcagcctgctgccagtttgccagtccagcagcatgcgaaagactgactggctgcccatggccgtcgcagcaatgggcgtgccgcccctaccactgttcatcttcagcctaaaggacacgttaaagcggcgctcctggcccctgaacgaaggggtgatggccgtcggcctcgtgagcatcctggcatccagcctgctccggaacgacgtacccatggccggccccctggtcgccgggggcctgctcattgcctgctacgtgatcaccgggacttccgccgacctgactgtggagaaggcggccgacatcacttgggaggaggaggccgaacagaccggcgtaagccacaatctgatgattaccgtggacgacgacgggaccatgcgcatcaaagacgacgaaactgagaacattctcacggttctgctgaagaccgccctcctgatcgtttccggcgtgttcccgtattctatccctgccaccctcctcgtctggcacacgtggcagaaacagacgcagcgctctggcgtcctgtgggatgtgcccagcccgcccgagacccagaaggcggagctggaggagggggtgtaccgcatcaagcagcagggcatattcgggaagacccaagtgggcgtgggtgtgcagaaggagggcgtcttccataccatgtggcacgtcactcggggcgccgtgctcacctacaacgggaagcgcctggagccgaactgggcgtccgtcaagaaggatttgatttcttacggcggtggctggcgactctccgcccaatggcagaagggggaggaggtccaagtgatcgcggtcgaaccgggaaaaaaccccaagaacttccaaaccacccccggcacgttccagacaaccaccggtgagatcggcgcgatcgccctggacttcaagcccggaacgtccggcagccccattattaaccgtgaaggaaaggtggtagggctgtacggcaacggggtcgtgaccaagaacggcggatacgtgtccggcatcgctcagaccaacgccgaaccggacggccccaccccggagctggaagaggaaatgtttaagaagcggaaccttacgatcatggaccttcaccccgggagcggcaagacgcggaagtacctgccagcgatcatcagagaggcgatcaagcgccggctccgcaccctaatactagccccaacccgggtcgtagccgccgagatggaagaggcgctgaaggggctacctatcagatatcagacgacagtaaccaagtccgagcacaccggacgggagatcgttgacctgatgtgccatgccacattcaccatgcgcctactgagccctgtgcgggtgccgaactacaacctgatcatcatggacgaggctcacttcaccgaccctgccagcatcgccgcgcgagggtacatcagcacgcgggtcggcatgggcgaggcggccgccatcttcatgacggccaccccgccggggaccgccgatgccttcccacagtccaacgcccccatccaggacgaggaacgggacattcccgagcgctcttggaactccggcaacgagtggatcaccgatttcgccggcaagacggtatggttcgtgcctagcatcaaggcgggcaacgacattgccaactgcctccggaaaaatgggaagaaagttatccaactgtctcgcaagaccttcgacaccgagtaccagaaaacgaaactgaacgactgggacttcgtagtcacgaccgacatcagcgagatgggtgccaatttcaaagccgaccgggtcatcgatccccgccggtgcctgaagcccgtgatcctgaccgacggccccgagcgtgtgatcctggcagggcccatgccagtcaccgcggccagtgccgcccagcggcgcgggagagtggggcgcaacccgcagaaggagaacgatcagtacatcttcaccggccagcccctcaacaacgacgaggaccacgcgcattggacggaggcgaagatgctgctggacaacatcaacactcccgaggggatcatcccggccctcttcgagcccgagcgggagaaatccgccgccattgacggcgaataccgcctgaagggcgagtcccggaagacctttgtggagctgatgcgccgcggggacctccccgtctggctggcgcacaaggtcgccagcgagggcatcaagtacaccgaccgcaagtggtgcttcgacgggcagcggaataaccagatccttgaagagaacatggacgtagagatttggacgaaagaaggcgagaaaaagaagcttcgccctcgctggctggacgcacgcacatactccgaccctttagccctcaaggaattcaaagacttcgccgcgggccgcaagagcattgccctggacctggtgaccgagatcgggcgggtgccctcccatctcgcccaccgcactcggaacgccctggacaacctggtgatgctccacacgagcgagcacggcgggcgcgcataccggcacgcggtggaagagctgccagaaaccatggagaccttactcctgctgggcctcatgatcctgctgaccgggggcgcaatgttgttccttattagcggcaaggggattggcaagacatccatagggctgatatgcgtaatcgccagctccggcatgctctggatggccgagatcccgcttcagtggatcgctagcgcggtggtgctagagtttttcatgatggtgctcttaattccggagcccgagaaacagaggacgccgcaggacaaccagctggcctacgtcgtgatcgggatcttgaccctggccgccatcatcgccgcgaacgagatgggattgcttgagacaaccaaacgcgacctgggaatgtcgaaggaacctggagtggtcagccccacctcctacctggacgtggacctccaccccgccagcgcctggaccctgtatgccgtggcgaccacagtcataacccccatgctgcgccacaccatcgaaaattccaccgccaacgtgagccttgccgccatagcgaaccaggccgtggtcctgatgggcctggacaaaggatggccaatctccaagatggatctcggcgtgcctctactggccctagggtgctacagccaggtgaaccccttgacgctgaccgcagccgtcctcctgctgatcacacactacgcgataattggtcccggcctccaggcgaaggccacccgggaggcccagaagcgcacagccgccgggatcatgaagaaccctaccgtggacggcatcatgaccattgacctggaccccgtgatctacgactccaagttcgagaagcagttagggcaggttatgcttctggtactgtgcgcggtgcagctcttactgatgcgtacgagctgggccctctgcgaggccctgacgttagccacaggccccatcaccaccctttgggagggcagcccgggtaagttctggaatacgaccatcgcggtatctatggccaacatctttcgcggctcctacctggccggggcgggattagccttctcgataatgaagtctgtggggacgggcaaacggggcaccgggtcacagggcgagactttaggggagaaatggaagcgtaagctgaaccagctgagcagaaaagagtttgatttatataagaagagtggcatcacggaggtggatcgcaccgaggcgaaggagggcctgaagcggggcgagattacacaccacgccgtcagccgcggctccgccaagctgcagtggttcgtggagcggaatatggttataccggaagggcgcgtcatcgatctcggctgtgggcgcggcgggtggagctactactgtgccggcctgaaaaaggttaccgaggtgcggggctacactaagggggggccaggccacgaggagcccgtccccatgtctacctacggctggaacatcgtgaagctgatgactgggaaggacgtcttctaccttccgcccgagaagtgtgacaccttgctttgcgacatcggggagagctccccaagccccacggtcgaggagtcccgcaccatccgggtcctgaagatggtggagccctggctcaagaataaccagttctgcatcaaggtgctgaacccctacatgccgactgtcatcgagcatctggagcgcctccagcggaagcacggcgggatgctggtgaggaatcccctgagccgcaactccacccacgagatgtactggatcagcaacggaacagggaacatcgtcgcctccgtgaacatggtgagccgcctcctgctgaaccggttcaccatgactcaccgccggccgaccatcgagaaggacgtcgatttaggcgccggcacgagacacgtgaacgctgagcccgagacacccaacatggacgttattggggagcggatcaagcgcattaaggaggagcacaactccacctggcactatgacgacgagaacccgtacaaaacctgggcgtaccacggcagttatgaggtcaaggccactggatccgccagctccatgatcaacggggtggtaaagctgctaacgaagccctgggacgtggtgcccatggtcactcagatggcgatgaccgacaccacgcccttcgggcagcagcgagtgttcaaggagaaggtggacacccggaccccgcggagcatgcccggcacgcgccgggtcatggagattactgccgagtggctatggcgcaccctgggccgcaacaagaagcctcggttgtgcacccgcgaagagttcacgaagaaggttcgtaccaacgcggccatgggggcggtgttcaccgaggagaaccagtgggactctgccaaggccgccgtggaggacgaggacttctggaagcttgtggatcgcgagcgcgagctgcacaagctgggcaagtgcgggtcctgcgtatacaacatgatgggcaagcgcgaaaaaaagctcggggagttcggcaaagccaaagggagccgggcgatttggtacatgtggttaggggcccgctacctggagttcgaggccctcgggttcctgaacgaggaccactggttctcccgggagaacagctattccggggtcgagggcgaggggttacacaagctcggctacatattgcgcgacatcagcaaaatccccggcggggccatgtacgccgacgataccgccggctgggatacgcggatcaccgaggacgacctacacaatgaggagaagatcacccagcagatggaccctgagcaccggcaattggcaaatgccatcttcaagctgacctaccagaacaaggtggttaaggtccagcgccccactcccacggggaccgtgatggacataatctctaggaaggaccagcgaggcagcggccaggtggggacgtacggcctgaacaccttcacgaacatggaagtccagctaatccgccagatggagggggagggcgtgctatccaaggccgatctggagaaccctcatcttccggagaaaaagatcacccaatggctggagaccaagggggttgaacgtctgaagcgcatggccatcagcggcgacgattgcgtcgtgaagcccattgacgacagattcgcgaatgccctcctagccctgaacgacatgggcaaggtacgcaaggacatcccccagtggcaaccctccaaggggtggcacgactggcagcaggtccccttctgcagccaccacttccacgaattgatcatgaaggacggccggaagctggtggtgccctgccgccctcaggacgagctgatcggacgcgcgaggatctcccagggcgccgggtggagcctccgcgagaccgcgtgcctgggtaaggcttacgcacagatgtggtccttaatgtatttccacaggcgcgatctccggctggcaagcaatgcgatttgctccgccgttcccgtgcactgggtgccaacgagccgcacaacctggtccatccacgcccaccaccagtggatgaccacggaggacatgctcaccgtctggaaccgggtgtggatcgaggataacccttggatggaggacaagacccccgtgaccacgtgggagaacgtcccctatttaggcaaacgcgaggaccagtggtgcgggagcctgatcggactgaccagccgggccacctgggcccagaacataccgaccgcgatccagcaggtccgctccttgatcgggaacgaggagttcctggactacatgccctcaatgaagcgtttccgcaaggaggaagagtcagagggcgccatctggtga

SEQ ID NO: 25699 - RNA, 9873 nt, synthetic construct
  misc_feature 1..9873: note = derived and/or modified CDS sequence (opt11) from DENV-3__GU131866__SS-prME
  source 1..9873: mol_type = other RNA
acctccctgtgcctgatgatgattctgcccgcagccctggcattccacctcacgagccgggacggtgaaccccggatgatcgtggggaagaacgaacgcggaaagagcctgctgttcaagaccgcctcagggatcaacatgtgcaccctcatcgccatggatctgggtgaaatgtgcgacgacacggtcacctacaagtgtccccacataaccgaagtggaaccggaggacattgactgctggtgcaacctgaccagcacctgggtgacgtatggaacttgcaaccaggccggcgaaaggcggcgagatcgccggtccgtggcattagcgccgcacgtgggcatggggctggacactaggacccagacttggatgagcgccgagggcgcctggcgccaggtggagaaggttgaaacgtgggcgctccgccatcccggcttcaccatcctggcgctgttccttgcacactacatcggcacctccctcacccagaaggtggtgatcttcatattactgatgctcgtgacacctagcatgaccatgcggtgcgtcggggtgggcaaccgcgatttcgtggagggcctgtccggggcgacgtgggtggacgtggtgctggagcacggcgggtgcgtaaccacgatggccaagaacaagcccacgctcgacatcgagctgcagaagacggaagctacccagcttgcgacgcttcggaagctgtgcatagaggggaagatcaccaacatcacaaccgacagccgctgtccaacccaaggcgaggccgtcctgcccgaagaacaggaccaaaactacgtatgcaagcacacctacgtggacagggggtggggcaatgggtgtggcctcttcgggaagggctccctggtgacctgcgccaagttccaatgcctggagctaatcgagggaaaggtcgttcagtacgagaacctgaagtacacggtcattatcacggtccacaccggggaccaacaccaggtggggaacgagacccaaggcgtcactgccgagatcactccccaggccagcactaccgaagcgatcctgcccgaatacgggacgctcggattggagtgcagcccgaggacgggcctggacttcaatgagatgatacttttgactatgaagaacaaggcctggatggtgcaccggcagtggttcttcgacctgccgctcccctggacaagcggcgcgaccaccgaaacacccacctggaatcgcaaggagcttctggtgacatttaagaacgcccacgctaagaagcaggaggtcgtggtgctcgggtcccaagagggtgccatgcacaccgccttgaccggggctaccgagatccagaacagcggtgggacctccatcttcgccggccacctgaagtgtcggttaaagatggacaagctggagctgaagggaatgagctacgccatgtgcaccaatacgtttgtactcaagaaggaggtgagcgaaacccagcacgggaccatcctgatcaaggtggagtataaaggcgaggacgcgccctgcaagatcccgttcagcacggaagacgggcagggcaaggcccacaatggacgcttaattacggccaaccccgttgtgaccaagaaggaggagcccgtgaacatcgaggccgagccccctttcggggagagcaacatcgtcatcggcattggggacaacgcgttgaagattaactggtacaaaaaggggagtagcatcgggaaaatgttcgaggccacagccagaggggcgcgccgcatggccatattaggtgatacagcttgggacttcggctccgtgggcggggtgttaaacagtctgggtaagatggtacatcaaatcttcgggtccgcatacacagccctctttagcggggtttcttgggtgatgaaaatcggcattggggtcctgctcacctggatcggtctcaacagcaagaatacttccatgtccttctcctgcatagccatagggatcatcaccctctaccttggggccgtggtgcaggcggacatggggtgcgtcatcaactggaagggcaaggagctcaaatgcggctcagggatcttcgtgaccaacgaggtacacgcctggaccgaacaatacaaattccaggccgacagcccaaaacgcctggcgaccgccatcgcgggcgcctgggagaacggggtgtgcggtatccgaagcacgacgcggatggagaacctgctttggaagcagatagccaatgagctaaactacattctgtgggagaacaacataaagctcaccgtggtggtcggcgatatcatcggagtgctggaacaaggcaagcgcacattaacgcctcagcccatggagctcaaatactcttggaagacgtgggggaaagcaaagattgtgaccgctgaaacccaaaatagctccttcataatcgacggcccaaacacccccgagtgccccagcgcctcccgggcttggaatgtttgggaagtagaagactacggcttcggcgtttttaccacgaacatttggctcaagctgcgagaggtctacacccagctctgcgaccaccggttgatgagtgccgctgtgaaagacgagcgagccgtgcacgcggatatgggctactggattgagagccagaaaaatgggtcttggaaactggaaaaggccagcctcatcgaggtaaaaacttgcacctggcctaagtcccacacgctgtggagcaacggcgtgttagagtccgacatgatcataccaaaatccctcgccgggcccatctcccagcataaccatcggcccggctaccacacccaaacggcggggccgtggcacctgggcaagctcgagttagacttcaactattgtgagggcaccacggtggtaatcactgagaactgcgggacccgcggccccagcctgcggaccacaaccgtgagtggaaagctgatccacgagtggtgctgtcgcagttgcaccctgccgccactccgatatatgggcgaagacgggtgttggtacgggatggagattcggccgatctccgagaaagaggagaacatggtgaaaagcctggtttctgcaggcagcgggaaggttgacaactttacaatgggcgttctatgtctagctatactgtttgaggaagtcatgagggggaagttcggcaagaagcacatgattgccggggtgttctttacgttcgtcctcctactgtcaggacagatcacatggcgagacatggcccatactctcatcatgattgggtccaacgccagcgaccggatggggatgggcgtcacctacctggcgctgatcgccacgttcaagatacagcccttcctggcactgggtttcttcctgcgcaaactcacaagccgggagaacctgctgctcggcgtaggcctggccatggcgaccacattgcagctccccgaggacatcgagcagatggccaacgggattgccctgggcctgatggccctgaagttaataacgcaattcgagacctaccagttgtggaccgccctcatcagcttaacctgctcgaacacgatgttcaccttgaccgtggcatggagaacggccacgctcatcctggccggagtctctcttctccccgtttgccagtcaagctccatgcgcaaaaccgactggctaccgatggccgtcgccgcgatgggcgtaccgcccttgccactcttcatattctctttgaaagacacgctgaaacggcgctcctggcctcttaatgagggtgtcatggccgtaggcctggtgagcatcctggcctcctctctccttcggaacgatgtgcccatggccggccccctggtcgccgggggtctcctgatcgcctgctatgtgattacaggaacctccgccgatcttaccgtggagaaggccgcagacataacctgggaagaggaagccgagcagaccggcgtcagccacaacttgatgatcaccgttgacgacgacgggaccatgcgcatcaaggacgatgagacggagaacatcctgactgtgctgctcaaaactgcgctgctgatagtttctggggtgtttccttacagcataccggccacgctcctagtttggcacacatggcagaagcagacccagcggtccggcgtcctgtgggacgttccctccccgcccgagacccaaaaggccgagctcgaggaaggagtgtaccgcatcaagcagcagggcatattcgggaaaactcaggtcggcgtgggggtccagaaggagggggtcttccacaccatgtggcacgtgacccgaggggccgtgttaacatacaacgggaaacgcctagagccgaattgggcgtctgtcaagaaggacctcatcagctacggcggcggctggcggctttcagcccagtggcagaagggtgaagaagtccaagtgatcgccgtcgagcccggcaagaaccccaaaaacttccagacgatgcccggaaccttccagaccaccactggggagatcggcgcaatagccctggacttcaagcccgggaccagcggcagcccaatcataaacagggagggcaaggtggtggggctgtatggcaacggggtcgtaaccaagaacggcgggtacgtctccggtatcgcgcagaccaatgcagagcccgacggcccgacgcccgaactcgaagaggagatgttcaagaaacgtaatctgaccataatggacctgcaccccgggagcgggaagacccgcaagtacctccccgccatagtccgggaggccataaagcgtaggctgaggaccctgatcctcgccccgacgcgggtagtggcggccgagatggaagaggctcttaaggggctgcccatccgttatcagaccactgccaccaaatccgagcacaccggccgagagatcgtcgacctcatgtgccacgcgacattcacgatgcgcctgctgagccctgtgcgagtccccaattacaatctcatcatcatggacgaggcgcattttaccgaccccgcctcaatcgccgctagggggtacataagcacccgcgtagggatgggtgaggcggccgccatctttatgaccgccacgccgccagggacggccgacgcctttccccaatctaacgctccgatccaggacgaggagcgggacatacccgagcgcagctggaactccggtaacgagtggatcaccgacttcgctggtaagaccgtgtggttcgtgcccagcataaaggccggcaacgacatcgccaactgcttacggaagaacggtaaaaaggtcatccagctgtcccgcaagacgttcgacacggaataccagaaaacgaagttaaacgattgggacttcgtggtaaccaccgacatcagcgagatgggcgcaaacttcaaggccgaccgggttatagacccccggcgctgcctgaagccggtgatcctgaccgacggccccgagcgcgtgatcttagccggaccgatgcccgtcacggccgcctctgcggcccaacggcgcggccgggtgggccgtaatccgcagaaggaaaacgaccagtacatcttcactggccagcctctcaacaatgacgaggatcatgcccactggaccgaggccaagatgctgctcgacaacatcaacacgcctgaggggatcatccccgcgctgttcgagccggagcgggagaagtccgctgctatcgacggcgaatatcgcctgaagggcgagtcccggaagactttcgtagagctcatgagaagaggggacctgccagtatggctggcccacaaagtggcctctgagggcatcaagtacacggaccgcaagtggtgctttgacggacaacggaacaatcagatactagaggagaacatggacgtcgagatctggacaaaggagggcgagaagaaaaagctacgcccccgctggctggatgcgcgcacgtactcagaccccctcgcactgaaagagttcaaggacttcgcagccggtcgcaagagcatagccctcgacttggtgaccgagatcgggcgggtacccagccacctggcgcaccgcacgcggaacgccctggataatctcgttatgctgcacaccagcgagcatggagggagagcttaccggcacgccgtggaggaactgcccgagactatggagacccttttactgctaggcttaatgatcctgctcaccggcggggcgatgctttttctgatcagcgggaaagggatcggcaagacctcgattgggctgatctgcgtgatcgcgagctccggtatgctgtggatggccgagatcccgctgcagtggattgcgagcgcgatcgtgctcgagttcttcatgatggtgctgctgatcccggagcccgaaaagcagcgcacgccccaggataaccaactcgcatacgtggtcatcggtatcttaacccttgctgccatcatcgcagccaacgagatgggcctgctggaaacgacgaagcgcgacttaggcatgtccaaggagccaggagttgtgagcccgacctcctatttagacgtcgatctacaccccgcgagcgcatggaccctgtacgccgtcgccacaaccgtgataacgcctatgctccgccataccatcgaaaactccacggctaacgtgagtctggctgccatcgccaaccaagcagtggtcctgatgggcttagacaaagggtggcccatttccaagatggatctgggcgtgccgctcctcgccttagggtgctactcacaggtgaatccactgaccttaaccgcggccgtgcttctgctcattacccactatgcgatcatcgggcccggcctgcaggcaaaagccacgcgcgaggcgcaaaagcgcaccgccgccgggatcatgaagaaccccactgtcgacggcattatgaccattgacctggacccggtgatctacgactcgaagttcgagaagcagctcgggcaagttatgctgctggtcctatgcgccgtgcagctgctgctcatgcggacgagttgggcgctttgcgaggccctgacccttgccaccggacccataaccactctctgggagggctcccccggcaagttctggaacaccaccatcgcggtgagcatggccaatatcttccgcggctcctacttagcgggggccggcctcgccttcagcatcatgaagtccgtcggaaccggtaaacggggcacgggctcccaaggcgagactctgggggagaaatggaaaaagaaactcaaccagctctctcgcaaggagttcgatctctacaagaagtccggcataaccgaggtggataggacagaggcgaaagagggactgaagagaggcgagatcacccatcacgccgtaagccgcgggtccgcgaaactccagtggttcgtcgagcgcaacatggtcatccccgaggggcgcgtgatcgacctgggctgcgggcgcggcgggtggagctattactgcgccggcctgaagaaggtcactgaggtgaggggctacaccaagggcgggccgggtcacgaggagcccgtccccatgagcacgtacggctggaacatcgtaaagctaatgagtggcaaggacgttttctacctacccccggagaaatgtgacaccctcctgtgcgacattggcgagtccagcccctccccgacagtagaagagagccggacgatccgtgtcctcaaaatggtggagccctggcttaagaacaatcaattctgcatcaaggtgctgaacccgtacatgcccacggtcatagagcacctcgagcggctgcagcgcaagcacggcgggatgctggtgaggaatcccctctcccgcaacagcacccacgagatgtattggatctccaacggaaccggaaatatcgtggccagtgtcaacatggtgagcaggctactactcaaccgcttcactatgacccatagacgccccaccatcgagaaggacgtcgacctgggcgccggcacacggcatgttaacgcagagcctgagacccccaatatggacgtgatcggagagcgcataaagaggatcaaggaggaacacaacagcacttggcactacgacgatgaaaacccctacaagacctgggcgtaccacggctcctacgaagtaaaggccacgggaagcgcctccagcatgatcaacggcgtcgtgaagctgttaacgaaaccgtgggacgtcgtgcctatggtgacacagatggccatgacggacacgacccccttcgggcaacaacgggtcttcaaagaaaaggtggacacacggacgccaagaagcatgccgggcacccggcgcgtgatgggcattacggcggagtggctgtggcgaaccctggggcgcaataagaagccccgcctgtgcaccagggaagagttcacgaagaaagtccgcaccaacgcggctatgggggccgtctttaccgaagagaaccagtgggattccgccaaggcggccgtggaggacgaggacttctggaagctagtcgatcgtgagcgcgagctgcacaaacttgggaagtgcggaagctgcgtgtacaatatgatggggaaacgggagaagaaacttggcgagttcggcaaagccaagggctcccgcgccatatggtacatgtggctgggagcccgctacctcgagttcgaggcgctgggtttcctcaacgaggatcactggttcagccgggagaactcctacagcggcgtggagggggaagggttacacaagctgggctacatcctgcgggacatctccaaaatccccggaggcgccatgtacgccgacgacacggcagggtgggacacgcgaattaccgaggacgacctccacaacgaagagaagatcacccaacagatggaccccgagcatcgaaagctcgcaaacgcgattttcaaacttacataccaaaacaaggttgtcaaagtacagcgtccgactcccaccggcaccgtcatggacattatcagcagaaaggaccagaggggctccggacaggtgggcacctacgggttgaacacatttactaacatggaggcgcagctgatccgacagatggaaggggaaggggtgctgagcaaggccgacctcgaaaaccctcacctccccgagaagaagataacccaatggctggagacaaagggcgtagagaggctcaagcggatggccatctccggcgacgactgcgtcgtgaaacctatcgacgaccgcttcgccaacgcacttctagccctaaacgacatggggaaggtccggaaggacatcccgcagtggcagcccagcaagggctggcacgactggcagcaggtccccttctgctcccaccacttccacgagctgatcatgaaggatggtcgcaagctggtggtcccgtgccgaccacaggatgagctcatagggcgcgcgcgcatcagccagggagccggctggtcgctgcgtgagactgcgtgtctggggaaggcctacgcccagatgtggtctctcatgtactttcaccgacgggacctgcgcttagcctccaacgccatatgcagtgcggtgcctgtgcactgggttcccacgtcccggaccacctggagcattcacgcccaccaccagtggatgaccacggaggatatgctcaccgtgtggaaccgcgtgtggatcgaggataacccgtggatggaagacaagacccccgtgaccacgtgggagaacgtgccctacctggggaagcgggaagatcagtggtgtggtagtctgatcgggctcacgtccagggccacctgggctcagaacatcccaacggctatccagcaggtccggagcttgataggcaacgaggagtttcttgactacatgccgtccatgaagcgcttcaggaaggaggaggagagcgaaggggctatctggtga

SEQ ID NO: 25700 - RNA, 9873 nt, synthetic construct
  misc_feature 1..9873: note = derived and/or modified CDS sequence (opt11) from DENV-3__GU131868__SS-prME
  source 1..9873: mol_type = other RNA
acacccctgtgcttgatgatgatcctgccggcggcacttgctttccacctcaccagccgggatggggagccccggatgatcgtggggaaaaacgagcggggcaaaagcctgctgttcaaaactgccagcgggattaacatgtgcacactcatcgccatggacctgggagagatgtgcgatgacaccgtgacctataagtgcccccacatcaccgaagtggagcccgaggacatcgactgctggtgcaacctgacctcaacctgggtgacatacgggacgtgcaaccaggcaggcgagcgacggcgggacaagcgtagcgttgcgctcgcgccgcacgtgggcatggggctggatacccggacccagacctggatgtctgccgagggcgcctggcgccaggtagaaaaagtggagacgtgggccttacggcacccaggcttcactatcctcgcgctgttcctggcccactacatcgggaccagcctcacccagaaggtggtgatattcatcttgctgatgctcgtcacgccctccatgaccatgagatgcgtgggggtgggcaatcgggactttgttgaggggctgagcggggccacctgggtagacgtggttctggagcatggtgggtgcgttaccacgatggccaaaaataaacccaccctcgacatcgaattacagaagaccgaggccacccaactggcgacactccgcaagctgtgcattgagggcaagatcaccaacatcaccaccgactcccggtgccccacgcagggggaggccgtgctgcccgaggagcaggaccagaactacgtctgcaagcacacttacgttgaccgcgggtggggcaacgggtgcggcctatttgggaaaggcagcctggtgacctgcgccaagttccagtgccttgagctcattgagggtaaggtcgtgcaatacgagaatctgaagtacaccgtcatcatcacggtccacaccggggaccagcaccaagtgggcaacgagacgcaaggggtcaccgccgagatcacgccccaggcctccaccaccgaggcgatcctgccagagtacggcaccctggggctggagtgctcaccccggaccggcctggacttcaacgagatgatcctcctgacgatgaagaacaaggcgtggatggttcacaggcagtggtttttcgacctgcccctcccgtggacctccggcgccaccaccgagacgcccacgtggaatcggaaggagttactggtgaccttcaacaatgcccacgcgaagaagcaggaggtcgttgtgctcggtagccaagaaggcgcaatgcacaccgcgctgacgggggccacagagatccagaattccggcgggaccagcattttcgccggccatctcaagtgccgcctcaagatggacaagttggagctgaagggaatgtcctacgccatgtgtaccaacacgttcgtcctaaaaaaggaagtctcggagactcagcacgggaccatcctgatcaaggtagagtataaaggcgaggatgcgccgtgcaagatcccttttagtacagaggatggtcaggggaaggcccacaacggccgactcataacggccaaccccgttgttaccaagaaggaggagcccgtgaacatcgaggccgagccgcccttcggggaaagcaacatcgtcatcggcatcggcgacaacgcgctgaaaatcaactggtataagaagggtagctccatcgggaagatgttcgaagcgaccgccaggggcgcccggcgcatggccattctcggcgacaccgcgtgggacttcggaagcgtgggcggggtgctgaactccctggggaagatggtccaccagatcttcggcagcgcttacacagccctcttctccggagtctcatgggtgatgaagatcggaatcggcgttctcctgacctggatcggcctcaattccaagaacaccagcatgtccttctcatgtatcgccataggaatcatcaccctgtacttaggcgccgttgtgcaggcggacatggggtgcgtcatcaactggaagggcaaagagctcaagtgcggctccgggatcttcgtgacaaacgaggtccacacatggaccgagcagtacaagttccaggcggattcgcccaagcgtctggccaccgctatcgccggcgcctgggagaacggggtctgcggcatacgatccactacccgcatggagaacctgctctggaagcaaatcgctaatgagttgaactacattctgtgggaaaacaatatcaagttgacggtagttgtcggggacatcattggcgtgctggagcaaggcaagcggaccctgacgccccagccgatggagctcaaatacagctggaagacgtgggggaaggccaagatcgtgaccgccgagacccagaactcctcgttcatcatcgatggccccaacacgcccgagtgtccctccgcgagccgtgcatggaatgtatgggaggtggaggactacggattcggagtcttcacaaccaacatctggctaaagctgcgggaggtctacacccagctctgcgaccacagacttatgtccgcagccgtgaaggacgagcgagctgtgcatgcggacatgggctactggattgagagccagaagaacgggtcttggaagctggagaaggcctccctcatcgaggtcaagacgtgcacgtggcccaagagccacaccttgtggtccaatggcgtgttagagagtgacatgatcatccccaaaagcctcgctgggcccatttcgcagcataatcaccgcccgggctaccacacccagacagccgggccctggcacctggggaaactggagctcgatttcaactactgcgagggcacgaccgtggtaatcaccgagaactgcggaacccggggcccttccctgcgcacgaccaccgtgagcgggaagctgatccacgaatggtgctgtcggtcctgcacccttccccctctgcgctatatgggcgaagacgggtgctggtacggcatggagatccggcccatcagcgagaaggaggagaacatggtgaagtccctggtcagcgcaggtagcgggaaggtggacaatttcacgatgggcgtgctctgcctggcgatccttttcgaggaggttatgcgcgggaaattcggaaagaagcacatgatcgctggggtgttcttcacgttcgtgttgcttctcagcggacagatcacctggcgggacatggcccacaccctcatcatgatcggctccaacgcctctgaccggatgggtatgggcgtcacgtatctcgctctgatcgctaccttcaagatccaacctttccttgccctggggttcttcttacggaaactgacctcgcgcgagaacctgctgcttggagtgggcctggccatggccactaccctgcagctccccgaggacatcgagcagatggcgaatgggatcgccttgggcctgatggccctcaagttgatcacccagttcgagacctaccagctgtggactgcccttataagcctgacgtgcagcaacaccatgttcaccctgaccgtggcctggcggacagcgaccctcattttggccggggtctccctgctcccggtttgtcaaagctcctccatgcgcaagacggattggctgcccatggccgtcgccgctatgggcgtgccgcctctccccttattcatcttctcgctgaaggacactctgaagcgccggagctggcccctgaacgagggggtgatggcggtcggcctggtgtccatcctggccagctccctattacgtaatgacgttcccatggctggccctctggtagccgggggtctcctgatcgcctgctacgtcataacgggaaccagcgcagacttgaccgtggagaaggccgcagacataacctgggaggaggaagccgagcagacaggcgtcagtcacaatttaatgatcaccgttgacgatgacgggacgatgcggatcaaggatgatgagaccgagaacattctgacggttctcctcaagacggccctgctgatagtcagcggcgtattcccgtactccatccccgcaacccttctcgtttggcacacctggcagaagcagacacagcgctcaggcgtcctgtgggacgtgcccagccctcccgagacgcagaaagccgagctagaggagggggtgtaccgcattaagcagcagggcattttcgggaagacccaggtcggcgtgggggtgcagaaggagggcgtctttcacaccatgtggcacgtgacccgcggagccgtcctgacgtacaacgggaaacggctggagcccaactgggctagcgtcaagaaggacctcatctcctacggcgggggctggcgcctgagcgcacagtggcagaagggggaggaggtccaagtgatcgccgtcgagcccggcaagaacccgaagaacttccagacaatgccgggcaccttccagaccacgacgggggaaattggcgccatcgccttagatttcaagcccgggacctccggctctccgatcattaaccgggaaggaaaggtggttggactgtacggcaacggagtcgtgaccaaaaacggcgggtacgtaagcggcatcgcccagactaaagcggaaccggatggccccacccctgaactcgaggaggagatgttcaaaaagcgcaacttaacaatcatggacctgcaccccgggtccggaaagacccggaagtacctcccggccatcgttcgcgaggcaatcaagcgacgcttgagaacgcttatcctcgcgcctactcgggtcgtggccgcggagatggaggaggcgctgaaggggctgcccatccggtaccagacgactgccaccaagagcgagcacaccggccgggaaattgtcgaccttatgtgccacgccacgttcaccatgcggctattatcccccgtgcgcgttcctaactacaatctcatcataatggacgaggcacatttcacggacccggccagcatcgcggctcgtggttatatctccacccgcgtgggtatgggagaagcctctgcgatcttcatgacagccactccacccggaacggccgacgccttcccccagagtaacgcccccatccaggacgaggagcgcgacatcccggagcgaagttggaactctggcaacgagtggattaccgacttcgcggggaaaaccgtgtggttcgtgcccagcataaaggccggcaacgacattgccaactgcctgcgcaaaaacggtaagaaggtcatccagctgtcccgtaagaccttcgatacggaataccagaagactaaactcaacgattgggacttcgttgtgacaaccgacatcagcgaaatgggcgccaacttcaaggcagaccgggtaatagacccgcggcgctgtctgaagcctgtgatcctgacggacggccccgagcgggtgattctcgcagggcccatgccggtcaccgcggcctccgcagcccagcgccggggccgcgtagggaggaacccccagaaagagaacgaccagtacatattcaccggccaacccctgaacaatgacgaggaccacgcgcactggaccgaggcgaagatgctgctcgacaatataaacacccccgaggggatcatcccggctctgttcgaacccgagcgtgagaagtcagccgcaatcgatggcgagtacaggctgaagggcgagtctagaaagacattcgttgagctcatgcggaggggcgacctgcctgtctggctggctcacaaggtggccagcgagggcatcaaatacaccgatcggaagtggtgcttcgacggccagcgtaataaccagattctcgaggaaaacatggacgtcgagatctggacgaaggagggcgagaagaaaaagctgcggcccaggtggctggacgcacgcacctacagtgacccactcgccctgaaggagttcaaggacttcgcggccgggcgcaaaagcatcgcgctggatctcgtgacggaaatcgggcgcgttcccagccacctggcccaccggacccgcaacgccctagataacctcgttatgctgcataccagcgagcacggcgggcgggcgtaccgccacgccgtggaggaacttcccgagaccatggagactcttttgctgctcggcctaatgatcctcctcaccgggggcgccatgctgtttctgatcagcggcaaggggatcggcaagacctccataggtctcatctgcgtgatcgcctcttccggcatgctgtggatggcagagatcccgctacagtggatcgcgagtgccattgtcctagagttcttcatgatggtgttactgatccccgagcccgagaagcagcggacgccccaggacaaccagctcgcgtacgtggtcatcgggatcttgacgctggctgccatcatcgcggccaatgagatgggcctcctggagacaaccaagcgcgacctgggcatgtccaaggaaccgagcgtagtgtcccccaccagctatcttgacgtcgacttacatcccgcctctgcctggacgctgtacgccgtggccactaccgtgatcacgcccatgctccggcacacgatcgagaattcaaccgccaacgtctcccttgccgccatcgctaaccaggccgttgtgttaatggggctcgacaagggctggccgatctcaaagatggacctgggggtcccgctgctcgcgctgggctgctactcccaggtgaacccccttacccttaccgcggccgtttttctgctgatcacgcactacgcgataatcgggcccggcctccaggccaaagccacacgcgaggcccagaagcggactgcagcgggcatcatgaagaatccgaccgtcgacgggataatgacgattgacctggaccccgtgatctacgacagcaagttcgagaagcaactggggcaggtgatgctcctggttctttgcgccgtgcagttactgctcatgcgcacctcctgggcgctctgcgaggcattaaccttagcgactggacccatcacgaccctctgggagggcagccccggcaagttttggaatacaaccatcgccgtgtcgatggctaacatcttccggggaagctacctggccggcgccgggctagctttctcaatcatgaagtccgtcggcacggggaagcgcggcaccggctcacagggggagaccctcggcgagaagtggaaaaagaagctaaaccagctgagccggaaggagttcgacctgtacaagaagtccgggatcacagaggtggaccgcaccgaggccaaggagggcctgaagcgaggggagatcacgcaccatgcggtgtcccgcggaagcgcaaagctgcagtggttcgtcgagcggaacatggtaattccggagggccgggtaatcgacctcggttgtggacgcggaggatggtcatactactgcgcagggctgaagaaggtaaccgaggtgcgcggctacaccaagggcgggcccgggcacgaagaacctgtacccatgagcacctacggttggaacattgtaaagctgatgtccggcaaggacgtgttctacctcccgcccgagaagtgcgacacactgctgtgtgacatcggggagagctcacccagtcccaccgtggaggagtcccgcaccatcagggttctgaagatggtggagccgtggcttaagaataaccagttttgcattaaagtgctgaatccctacatgccgaccgtaatcgagcacttagagaggctccaacggaagcacggcggaatgctggtgcgcaaccccctgagccgcaactccacgcacgagatgtactggatcagcaacggaacaggcaacatcgtcgcgtctgttaacatggtgagccggttgctgctaaaccgattcaccatgacccatcgccggccgacgatcgagaaggatgtggacttgggagcgggcaccaggcacgtcaacgcggagcccgagacccccaacatggacgtgatcggcgagcggatcaaacgcatcaaggaggagcacaattcgacctggcactacgatgacgaaaacccgtataagacgtgggcataccacgggagctacgaggtgaaggccacaggctccgctagcagcatgataaatggggtggtgaagctgctgacgaaaccctgggacgtagtgcccatggtgacccagatggcaatgacggacaccacccccttcggccagcagcgggtcttcaaggaaaaggtggacacccgcacgccacgctccatgccagggactcgccgggtgatggggattacagccgagtggctctggcgcaccctggggcggaacaaaaaaccccgcttatgcactcgcgaagagttcaccaagaaggtccggaccaacgccgcaatgggagcggtatttaccgaggagaatcagtgggacagcgcgaaagccgctgtcgaggacgaggacttctggaagcttgtagatcgagaacgggagctgcacaaactgggtaaatgcgggtcctgcgtatacaacatgatgggcaaacgggaaaagaagctcggggagttcgggaaggccaagggctcccgggccatatggtacatgtggctgggcgcccgctacctggaattcgaggccctcggcttcctgaacgaggaccactggttctcccgggagaattcctactccggggttgaaggggaggggttacacaaactcggttacatcctgcgcgacatttctaagatccccgggggggccatgtacgcggatgacactgccggttgggatacgcggatcaccgaggacgacctgcacaacgaggaaaagattacccagcagatggacccggaacaccgccagttagccaacgcgattttcaagctgacgtaccagaacaaggtagtgaaggtgcagcggcccacccccacagggacggtcatggacatcatctcccggaaggaccaacgcggcagcggccaggtggggacctacggcctgaatacgttcaccaacatggaggcccagctcattcgccagatggagggagaaggggtgctgtccaaagcggacttagagaacccccacctccccgagaagaagatcacccaatggctcgaaaccaaaggggtcgaacgcctgaagcgtatggccatcagcggcgacgactgcgtcgtgaagcccattgacgaccggtttgcaaacgccttgctggcgttaaatgacatgggaaaggtccgcaaagatatcccccagtggcagccatccaaggggtggcacgactggcagcaggtcccgttctgcagccaccacttccacgagctgatcatgaaggacggccgcaagctggttgtcccctgccggccccaggacgagctgatcggccgggcgcgcatctcccagggtgcggggtggtctctccgcgagacggcctgcctggggaaggcgtacgcgcagatgtggtcccttatgtatttccaccggcgcgaccttaggctggccagcaacgccatctgcagcgctgtgcccgtgcactgggtcccgaccagccgcaccacatggtctatccacgcccaccaccaatggatgaccaccgaagacatgctgaccgtctggaaccgggtgtggatcgaggataacccatggatggaagacaagaccccggtgacgacctgggagaacgtgccctacttgggaaagcgcgaggatcagtggtgcggttccctgatcggcctgacgagccgcgcgacttgggcccagaacatcccgacggccatacagcaggtccgctccctgatcggaaacgaggagttcctggactacatgcccagcatgaaacggttcagaaaggaggaggagtccgagggagccatctggtga

SEQ ID NO: 25701 - RNA, 9873 nt, synthetic construct
  misc_feature 1..9873: note = derived and/or modified CDS sequence (opt11) from DENV-3__GU131869__SS-prME
  source 1..9873: mol_type = other RNA
acgagcttgtgcctcgtgatgatattgcctgccgcgctggcgttccatttaaccagccgagacggggagccccggatgatcgtgggtaaaaacgagagggggaagtcactgctgtttaaaaccgcatccgggattaatatgtgcactctcatcgccatggacctgggcgaaatgtgcgatgacaccgtcacctacaagtgtccccacatcacggaggtcgaaccagaagacatcgattgctggtgcaacctcaccagcacctgggtgacctacgggacttgcaatcaggccggcgagaggcgccgggataagcgctccgtggctctcgctccccacgtcggcatggggctggacacccgtacccagacatggatgagcgccgagggggcctggcggcaggtcgagaaggtggagacatgggccctgcggcatccagggttcaccatccttgcgctgttcctggctcactatatcgggacttccctcacacagaaggtcgttatctttatccttctgatgctcgtcacgcccagcatgacaatgcgctgtgtcggcgtcggcaatcgggacttcgtggagggcttaagtggggccacgtgggtggacgtggttctggagcacggcggttgcgtgaccacgatggccaaaaacaagccgacactcgatatcgaactgcagaagacggaggccacccaactggcgacattacgcaaattatgcatcgagggcaagatcacgaatatcaccaccgacagccggtgccccacccagggcgaagctgtcctaccggaggagcaggaccagaattacgtgtgcaagcacacctacgtggaccgcgggtggggcaacgggtgtggcctcttcgggaagggctccctggtgacctgcgcgaagttccagtgcctcgagcccatcgaaggcaaggtggtgcagtacgaaaacctaaagtacactgtgatcatcacggtgcacaccggggaccagcaccaggtcggcaatgagacccagggggtaacggccgagatcacgccccaggccagcaccaccgaggcgatcctgcctgagtacggcactcttgggcttgaatgctcaccgaggaccggcctcgactttaatgagatgatcctgctcacgatgaaaaataaggcctggatggttcaccgccagtggttcttcgacctgcccttaccctggacaagcggtgccaccacagagactcctacatggaaccggaaggagctcctggtcaccttcaagaacgcgcacgccaagaagcaagaggtggtggttctggggtcccaagaaggcgccatgcatacagctttgacgggggccaccgagatacagaacagcggcgggacttccatcttcgccggccacctgaagtgccgactgaagatggacaagctcgagctgaagggcatgagctacgctatgtgcaccaacaccttcgttctcaagaaggaagtgtccgagacacagcacggtactatcctcattaaggtcgagtaccgaggcgaggatgcgccatgtaagatcccattctccaccgaggacgggcagggcaaggcccataacggcagactgatcacggccaatcccgtcgtgacgaagaaggaggaacccgtcaacatcgaggcagagccaccattcggagagagcaacatcgttatcggaataggagacaacgcgttgaagatcaactggtacaagaaagggtccagcatcgggaagatgttcgaggccaccgctcggggagcccgccgaatggctatcctgggcgacatcgcgtgggacttcgggtcagtcggcggggtcttgaactcactggggaaaatggtgcaccagatcttcggttccgcttacacagccctgttttcgggggtgtcgtgggtcatgaagatcggcatcgggattctcctcacctggattggcctgaacagcaagaacacctccatgagcttttcatgcatcgcgatcggaatcatcaccctctatttaggcgccgtggtgcaggcggatatggggtgcgtcatcaactggaaaggcaaggagcttaaatgcggcagcgggattttcgtgaccaacgaagtgcacacgtggaccgaacagtacaagtttcaggccgactcaccaaaacggctcgccacagcaatcgcgggtgcatgggagaacggagtctgcggcatacgcagcacaacgcggatggagaacctgttgtggaagcagatcgccaacgagctcaactacatcctgtgggagaacaacatcaagctgaccgtggtagtgggtgacatcatcggcgtgctcgagcagggcaagagaacgcttacgcctcagccgatggaactgaagtactcctggaagacgtggggaaaggccaagatagtgaccgccgagacccagaacagctctttcatcattgatggccccaacacccccgagtgtccctctgcgtcccgggcatggaacgtctgggaggtagaggactatgggttcggcgttttcacgaccaacatatggctcaaacttcgtgaggtctacacccagctgtgcgaccaccggctcatgtcggccgctgtaaaggacgagcgcgccgtacacgcagacatgggctactggatcgagagccagaagaatgggtcctggaagctggagaaggccagcctgatcgaggtgaagacttgtacctggccgaagtcccatactctctggagcaacggcgtgctggagtccgacatgatcatccccaaatctttggccgggcccatctcccagcacaatcaccggccgggataccacacccagacagccgggccctggcacctcggcaagctggagcttgacttcaactattgcgagggcaccacggtggtcatcaccgagaattgcgggacccgaggccccagcctccggaccacaacagtgtccggaaagctgatccacgagtggtgctgccgcagttgcaccctgcccccgttacggtacatgggcgaggacgggtgctggtacggcatggagatccgtcccatctccgagaaagaggagaacatggtcaagagcctggtgtccgccggcagtggtaaggtggacaacttcactatgggcgtcctctgcctagcgatccttttcgaggaggtcatgcgggggaagttcggaaagaagcatatgatcgccggggtgttctttacgttcgtgttactcctgtccggccagatcacctggcgcgatatgacccacacactcatcatgataggcagcaacgcctccgaccggatgggtatgggtgtgacgtaccttgcactaatcgccactttcaagatccagcctttcctcgcgctcgggttcttcctgcgaaagctcacctcgagggagaacctcctcctgggtgtgggactcgccatggctaccaccctgcagctaccagaggacatcgagcagatggcaaatgggatcgcgttaggcctgatggctctgaagctcatcactcagttcgagacctaccagctatggaccgccttaattagcctgacgtgctcgaacaccatgtttaccctgaccgtagcctggcgcacagccaccctgatactcgcaggggtgagcctgctgcctgtgtgccaatccagctccatgcgcaagaccgactggctccccatggccgtcgcagccatgggcgtgccacccttaccgctgttcattttcagcctaaaggataccctgaagcgacgctcgtggcctctgaacgagggggttatggccgtcggactggtgagcatcctggcgtccagcctgctccggaatgacgtgcccatggccggccccttagtagccgggggactgctcattgcctgctacgtcatcacggggacttccgccgacctgaccgttgaaaaagcggccgacatcacgtgggaggaggaagccgaacagaccggtgtatcccacaatctgatgatcaccgtagatgacgacgggaccatgcgcatcaaggatgacgagacagagaatatactcaccgtgttgctgaagactgctctcttgatcgtctcaggcgtgttcccgtattccatcccagccacgctgttggtgtggcacacctggcagaagcagacgcagcggtccggcgtcctatgggacgtgccctctcccccggagacgcagaaagcggagctggaggagggggtataccgaatcaagcagcagggaatcttcgggaaaacccaagtgggcgtgggggtacagaaagagggcgtcttccacacgatgtggcatgtaaccagaggcgccgtccttacctacaacggaaagcgcctggagcccaactgggccagtgtcaagaaagacctgataagctacggcgggggttggcggctttcagctcagtggcagaagggggaggaggtccaggtgatcgcggtcgaacccggcaagaaccccaagaacttccagacgacccctggcactttccaaacgacgactggcgagataggcgccatcgccctggactttaagcccgggaccagcggcagcccgatcatcaaccgagagggcaaggtggtggggctgtacggtaatggggttgtgacgaagaacggagggtacgtatccggtatcgcccagaccaacgccgagccggacggtccgaccccggagcttgaagaggagatgttcaagaaacggaacctaaccatcatggacctgcaccccgggagcggcaagacgagaaagtatcttccggcgataatacgggaggctataaagaggaggctccgtaccctgatcctggcccccacccgggtcgtggccgctgagatggaggaggcgctcaaagggctgcccattcgctaccagacaacggccacgaggtccgagcacaccggccgcgagatcgttgacctgatgtgccacgcgactttcacgatgcggctcctgtctcccgtgcgagtgccaaactacaatctgatcattatggacgaggcccacttcaccgaccccgcctccatcgcggcccgcgggtacattagcactcgggtgggaatgggcgaggccgccgctatcttcatgaccgccacgccgcctggcaccgccgacgccttcccgcagtccaacgcccccatccaggacgaagaaagggacatccccgaacggagttggaactccggcaacgagtggatcacggacttcgcgggtaagacggtctggttcgtccccagcatcaaggccggcaacgacatagccaactgcttacgcaagaacgggaaaaaggtgatccaactatcccggaagacattcgacaccgaataccaaaagaccaagctgaacgactgggattttgtagtgaccacggacatcagcgagatgggcgcgaacttcaaggctgaccgcgtgatcgacccccggcgctgcttgaagcccgtcattctcaccgacggtcctgagcgggtcatcttagccgggccaatgcccgtgaccgccgcatccgcggcccagagacggggccgagtggggagaaacccccagaaggagaacgaccagtacatattcaccggacaaccgctcaacaacgatgaggaccacgcgcactggaccgaggcgaagatgctgctcgacaacatcaacacgcccgaggggatcatccccgcactctttgagcccgaacgcgaaaaatccgccgcgatcgacggagagtaccgactgaaaggcgagtcccgcaagaccttcgtggagctgatgcggcgcggtgacctccccgtttggctggcccacaaggttgccagtgagggcatcaagtacaccgaccggaagtggtgcttcgacgggcagcggaacaatcagattctcgaagagaacatggacgtggagatctggaccaaggaaggagagaagaagaaactccggccacggtggctggacgcccgcacttactccgacccgctagcgctcaaggagttcaaggacttcgccgcgggtcggaaaagcattgctctggacctggtcacggagatcgggcgcgtaccctcccatctggcacatcggacccgcaacgccctggataatcttgtgatgctccacaccagtgaacatggcgggagagcgtaccgccacgcggtggaggaactgccagagacgatggaaacactcctgctgttgggtctcatgattctgctaaccggaggggccatgctgttcctcataagcggcaaggggattggcaagacatccatcgggctgatctgtgtgatcgcgagctccggaatgctctggatggccgagattcccctgcaatggattgcgagcgccatcgtgttagagttcttcatgatggtcttactgatccccgagcccgagaaacagcggacgccccaggataatcagctggcttacgtggtgatcgggatcttgaccctggccgcgatcattgcggccaacgagatgggcctgctcgaaacgaccaagcgagacctgggtatgtccaaagagccgggcgtcgtgtccccaacgtcatatctggacgtggatctccacccggcctccgcctggacactgtatgcagtcgccaccactgtgatcacgcccatgcttcggcacacgatcgagaactccaccgcaaacgtgtctctcgcagccatcgctaatcaagccgtggttctgatgggcctggacaagggttggcctatctctaagatggacctgggcgtgcctttgcttgccctcgggtgctactcacaagtcaacccccttaccttgaccgcagccgttctcttgcttatcacccactacgctatcatcggaccaggcttacaggccaaggcaacccgcgaggcccagaagagaaccgcagcagggatcatgaagaacccgacggtcgacggtatcatgaccatcgacctagaccccgtcatctacgactcgaagttcgagaagcagctgggccaggtgatgctcctggtgctttgcgccgtccagctcctgctgatgcgcacctcatgggccctctgcgaagccctgaccctggccacggggccaatcacgaccctctgggaaggctcccccgggaagttctggaacaccactatcgccgtgtctatggccaacatcttccggggatcctatttggcgggggccggcctagcattcagcatcatgaagtccgtgggtaccggtaagcgcggcaccgggagccagggcgaaaccctcggggagaagtggaagaaaaagctgaatcagctgagtcggaaagagttcgacttgtacaagaagtccggtataaccgaggtcgatcggacggaggccaaggaaggcctgaaaagaggcgagattacccatcacgctgtgagccgcggatccgccaaattgcagtggttcgtggagcggaacatggtcatccctgaggggcgtgtgatcgacctcggctgcgggcgaggagggtggagctactactgcgccgggctgaagaaggtaaccgaggtacgggggtacacgaagggcggcccagggcacgaggaacccgtgcccatgtcgacctacggctggaacatcgtgaagctcatgagcgggaaggacgtgttctaccttccgccggagaagtgcgataccctgctgtgcgacatcggggagtcaagcccctcccctaccgtggaggaaagccgcaccatccgtgtgctgaaaatggtcgaaccgtggctcaagaataatcagttttgcatcaaggtgctcaacccctacatgcccacggtaattgaacacctggagcggctacagagaaagcacggagggatgttggtccgtaaccccttgtccagaaatagcactcacgagatgtactggatttccaacggcactggaaacatcgtggcgtccgttaacatggtctctcgcctcctgctcaaccggttcaccatgacgcaccgccgaccaactatagagaaggacgttgacttaggtgccggcacccgccacgtgaacgcagagcccgagaccccgaacatggacgtcatcggggagaggatcaagagaatcaaggaggagcacaatagcacttggcactacgatgacgagaatccgtacaagacttgggcttaccacggctcctacgaggtcaaagccaccggaagcgcgtcctcaatgattaacggcgtggtcaagctcttgaccaagccgtgggacgtcgtcccaatggttactcagatggccatgaccgataccactcccttcgggcagcagagagtatttaaggagaaggtcgacacgagaacccctcgaagcatgcccggaaccaggcgcgtcatggagatcaccgccgagtggttatggcgaacgctggggagaaacaaaaagccccggctgtgcacccgtgaagagttcacaaagaaagtaagaacaaacgccgctatgggtgccgtattcacggaggagaaccaatgggactccgccaaagcggccgtggaggacgaagacttctggaaacttgtggatcgcgaacgggaactccataagctgggcaagtgcggaagctgcgtctacaatatgatggggaagcgcgagaaaaagctaggggaatttgggaaggcgaaaggctcccgggccatctggtacatgtggttgggggctcgctaccttgagttcgaagccctaggcttcctgaacgaggaccactggttctcacgggagaatagctacagcggggtggagggcgaggggctacacaagctcggctatatactccgcgacatcagcaagatccccggcggcgccatgtacgcggatgacacggccggatgggacactagaatcaccgaggacgacctgcacaatgaggaaaagatcacccagcagatggacccggagcaccgccagctagccaacgccatcttcaagctgacctaccaaaataaggtggtcaaggtccagcgacccacccccaccgggaccgttatggacatcatcagcagaaaagaccagcggggctccggccaagtcgggacgtatggcctgaacacttttaccaacatggaggctcagttgatcagacaaatggaaggtgagggcgtgttaagcaaggcagacctggagaacccacacctcccggagaaaaagataacccaatggctggaaacgaagggggtggaacgcctcaagcgcatggccatttcaggtgacgattgcgtagtcaagccaatcgacgaccggttcgcaaacgccctcctggcactgaacgacatgggtaaggttcgcaaggacatcccccagtggcagccatcgaaggggtggcatgactggcagcaagtcccgttctgttcgcatcacttccacgaactcatcatgaaggacggccgcaagctggtggtcccgtgccgcccccaagacgagctgatcggtcgcgcgcggatctctcagggtgcagggtggagcctcagagagaccgcctgcttaggcaaggcctacgcgcagatgtggtccctgatgtacttccatcggagggacctccggctggcctccaacgccatctgtagcgccgtacccgtacactgggtgccgacgtcccgcacgacttggagcatccacgcccatcaccagtggatgacaaccgaagacatgctgaccgtctggaaccgggtgtggatagaggacaatccctggatggaggataaaacacccgtgaccacctgggagaacgtcccctacctgggcaagcgcgaggaccagtggtgcgggagcctgattggactgacttcgcgcgctacatgggcccagaacatcccgaccgccattcagcaggtccgaagcctcatcgggaatgaagagttcctggactatatgccctccatgaagcgcttcagaaaagaggaagagagcgaaggcgctatttggtga

SEQ ID NO: 25702 - RNA, 9873 nt, synthetic construct
  misc_feature 1..9873: note = derived and/or modified CDS sequence (opt11) from DENV-3__GU131870__SS-prME
  source 1..9873: mol_type = other RNA
acgagcctctgcctcatgatgattctgccagccgccctggcctttcatctcacctcacgggatggggagcccaggatgattgtggggaaaaacgagcgcggcaaaagcctgctgttcaagaccgcctccggtatcaacatgtgcaccctaatcgccatggatctgggagagatgtgtgacgacaccgtgacctacaagtgcccacacatcactgaggtggaacccgaagatatcgactgctggtgcaaccttacctcaacctgggtgacatacgggacttgcaatcaggctggcgaacggcgccgggacaagaggtctgtcgccctagcgccgcacgtgggaatggggctggacacccggacccagacatggatgtcggccgaaggtgcctggcgccaggtggaaaaagtcgagacgtgggctctgcgccaccccgggtttaccatccttgcgctattcctagcccactacatcggcacctccctgacccagaaggtcgtgatcttcatcctactgatgctcgtcacgcccagcatgacaatgcgctgcgtgggggtaggcaatcgagacttcgtcgagggcctgtccggggccacctgggtggacgtcgtcctggagcacggcgggtgcgtcaccacgatggccaaaaacaaacccaccttggacatcgagctgcagaagaccgaggccacccagttagcgacgctccgtaagctgtgcatcgaagggaagataaccaacattaccacagacagcaggtgccccacgcaaggggaggcggtgttacctgaggaacaggaccagaactatgtatgcaagcacacctatgtggaccgcgggtggggcaacgggtgcggcctcttcggtaagggctccctggtaacctgtgccaagttccagtgcctggagcccatcgagggcaaggtcgtgcagtacgagaatctcaagtacacagtgatcatcacggtccacacgggggaccagcaccaggtgggtaacgagacccagggggtcaccgccgagatcacgccccaagccagcaccaccgaggcgatcctgcccgaatatggcactctggggctcgagtgctccccgcggaccggcctggacttcaacgagatgatactgctcacgatgaagaacaaggcctggatggtacatcgtcagtggttcttcgacctgccccttccctggaccagcggcgcaaccaccgagacgcccacctggaaccggaaggagctcctggtgaccttcaagaacgcacatgcgaagaagcaagaggtcgtggtgctgggttcccaggagggagcgatgcacaccgctctcacaggggctaccgagatccagaactccggcgggacctccatctttgccggccatctcaagtgcagactgaaaatggacaagctcgaactgaagggcatgagctacgccatgtgcaccaatacgttcgttttgaagaaggaggtgtccgagacccaacacgggaccatcctcatcaaggtggagtaccggggcgaggacgcgccttgtaagattcccttcagcacagaggacggacagggcaaagcccacaacggcaggctaattacggccaaccccgttgttaccaagaaggaggagcccgtgaacatcgaggctgagccgccctttggggagagcaacatcgttatcggcatcggggacaacgcgctaaagatcaactggtacaagaagggctcgagcatcgggaagatgttcgaggccaccgcccgcggcgcccgccgcatggcgatcctgggcgacactgcgtgggacttcgggtccgtgggcggcgtgttaaacagcctgggaaagatggtccatcaaatcttcgggtcagcctacactgccctgttctcgggcgtgtcatgggtgatgaagataggaattggcatcctcctgacctggatcggcctgaactctaagaatacatcgatgtcgttctcctgcatcgccatcgggatcatcaccctctacctgggagccgttgttcaggcggacatggggtgcgtcataaactggaaaggcaaggagctgaagtgcggcagcgggatcttcgtaacgaacgaggtgcacacctggaccgagcaatacaagtttcaggccgactcccccaagcggctcgctaccgcgatcgccggcgcgtgggagaacggggtttgcgggatcaggagcacgacccggatggagaacctgctgtggaagcagatcgccaacgagctcaaccatatcctgtgggagaacaacataaagctgacagtggtggtcggagacatcatcggcgtcttggagcagggcaagcgcaccctgacaccccagccgatggagctgaaatactcctggaaaacctgggggaaggccaagattgtgactgctgagacccagaactcctcctttatcatcgacggccctaatacgccagagtgcccctccgccagccgggcctggaacgtttgggaggttgaggactacgggtttggcgtgttcacgaccaatatctggctcaagctgcgcgaggtgtacacccaactgtgcgaccaccggctcatgagcgccgccgtcaaggacgagcgcgccgtgcacgcagatatgggctactggatagaatcacagaagaatgggtcatggaagctggagaaagccagcctgatagaggtgaagacatgcacgtggccgaagtcccatactctttggagtaacggcgtcctggagtccgatatgatcatccccaagtcactggctggcccgatctcacagcacaaccaccggccgggctaccacactcagactgcggggccatggcatctcggcaagcttgagctggattttaactactgcgagggcacaaccgttgtgatcaccgagaactgtgggacccgcggccccagcctccggacgaccaccgtttccgggaaactgatccatgagtggtgctgccgcagctgcaccctgccgccactccggtacatgggcgaggacgggtgctggtatggcatggagatccgccctatctccgagaaggaggagaatatggtcaagtcactggtgtctgccggcagcggtaaggtcgacaatttcacgatgggcgtgctgtgcttggcgatcctcttcgaggaggtgatgcgggggaagttcgggaagaaacacatgatcgccggggtcttcttcaccttcgtcctattactgtccggccagataacctggcgcgacatgacccacacactgatcatgatcggcagcaacgcctccgaccgaatgggaatgggagtgacctacctcgccctcatcgccaccttcaaaatccagccctttttagcgctcgggttcttcctccgcaagttaactagcagggagaacttattactgggcgtcggcctcgccatggccacgacactacagctgcccgaggacatagagcagatggccaacgggatcgctctcggcctgatggccctgaagctcatcacgcagttcgagacttaccagctgtggacggcccttataagcctgacctgctccaacactatgttcaccctaacagtggcgtggcgcaccgccaccctgatcctcgctggggtgagcctactgcctgtttgccaatcctcttccatgcgcaagaccgactggctccccatggcagtagccgccatgggcgtgcctcccctccctctgttcatcttcagcctcaaggacacgttaaagcggcgctcctggccgctgaacgagggtgtgatggccgtcggcctggtcagcatcctcgcgtctagcctactccgtaacgacgtgcccatggccggacccctggtggccggtggcctactgatcgcctgctacgttatcacgggcacctccgccgacctcatcgtcgagaaggcggccgacatcacctgggaggaagaggccgagcagacaggtgtgagccacaacctgatgatcaccgtcgatgacgacggcaccatgaggatcaaggacgacgagaccgagaacatcctaaccgtgctgctgaaaacggcattactgatagtgtccggcgtcttcccgtatagcatccccgcaaccctcttggtatggcacacctggcagaagcagacccagcggagcggtgtgctttgggacgtccccagcccgcctgagacgcagaaggctgaactggaggagggggtgtatcgaatcaagcagcagggcatcttcgggaagacccaagttggcgtcggggtgcagaaggagggggtgttccacaccatgtggcacgtcacacggggcgccgtgctcacgtataacgggaagcgcctggagcccaactgggcctccgtgaagaaggacctgatcagctacggcgggggatggagactatctgcccagtggcagaagggggaggaggtccaggtgatcgcggtggagcccggcaagaaccccaagaactttcagaccatgccaggtaccttccagaccacgaccggggagatcggcgccatagccctggacttcaagcccgggaccagcggaagccccatcatcaaccgcgaaggcaaggtagtggggctgtacggtaatggggtggttaccaagaacggcgggtacgtgtctggcattgcgcagacgaacgccgagccagatgggcccaccccagagctggaggaggagatgttcaagaagcggaacctcaccattatggacctgcaccccgggagcggcaaaacccgcaagtacctgccggcgatcatccgggaagccatcaagagacgcctccgcacgctaatcctggcacccacccgggtggtagccgcagagatggaggaggcgctaaaggggctgcccatccgctaccagaccaccgctacgaagagcgagcacactgggcgggagatcgtggacctaatgtgccacgccaccttcaccatgcgtctcctgtctcccgtgcgggtcccgaattacaacctgatcatcatggacgaggcccatttcacggatcccgccagcatcgcggctcgcgggtatatcagcacccgcgtcggcatgggcgaggccgctgcgatcttcatgaccgcgacgccgcccgggacggccgacgccttccctcagtccaacgctcccatccaagatgaggagagagacatccctgagcgaagttggaactccggcaacgagtggatcacggacttcgcggggaagaccgtgtggtttgttcccagcatcaaggccggcaacgacatcgccaactgcctccgaaaaaatgggaagaaggtgatccaactgtcccgcaaaacgttcgacacggagtaccagaagaccaagcttaacgactgggactttgtagtcaccaccgacatctctgagatgggcgccaatttcaaggccgaccgggtgatcgacccgcgccggtgcctcaagcccgtgatactgacggacggccccgagcgcgtcatcctggcgggacccatgccggtcaccgcagcctccgccgcccagcgccgcggccgggtggggcgcaacccccaaaaggagaacgaccagtacatcttcacaggccagcccctcaacaatgacgaagaccacgcgcactggaccgaggccaagatgctgctggacaacatcaacacccccgagggtatcattccggccctcttcgagcccgagcgggagaagtccgccgcgatcgacggcgagtaccgtctgaagggcgagtcccggaagacgttcgtcgaactgatgcgccgcggcgacctccccgtgtggctcgcgcacaaggtcgcgagcgagggcatcaagtacaccgaccgtaagtggtgtttcgacgggcagcggaacaaccagatccttgaggaaaacatggatgtcgagatctggaccaaggaaggcgagaagaagaagctccgcccccgctggctggacgccaggacctactccgacccgctggccctcaaggaattcaaggacttcgcggccggtcgcaaaagcatagcacttgaccttgtgacggagatcggtcgggtcccctcccatcttgcccaccggacccgtaacgccctggacaatctggtgatgctccacactagcgagcacggcggacgcgcgtaccggcacgcagttgaggagctgcccgagaccatggaaacgctgctcctgctgggcctcatgatcctgctgaccgggggggcaatgctgttcctaatcagcggcaaggggattggcaagacctccattgggctgatatgcgtaatagccagctccggtatgctctggatggcagagatcccgttgcagtggatcgcttcggccatagtgctggagttcttcatgatggtgctcctgatcccggagcccgagaagcagcgcacgccccaggacaaccaactggcctatgtggtgatcgggatcctcacgctggccgcgatcattgcagcaaacgagatgggtctgctcgagacgaccaagcgagacctgggcatgtccaaagagccgggggtcgtcagccccacctcctacctggatgtcgacctgcacccagccagcgcctggactctatacgctgtggccaccacggtcatcacccccatgctgcgccacactattgagaactccacagcgaacgtgagcctcgccgccatcgcgaatcaggccgtagtcctgatgggcctggacaaggggtggccgatctccaagatggacctcggcgtacccctactggcgttagggtgttactctcaggtcaaccccctgacactgaccgcagctgtcctactgctgatcacccactacgcgataataggtcccggcctccaggcaaaggccactcgggaggcccagaagcgcacggccgcggggatcatgaagaacccgaccgtggacggcattatgacgatcgatctggaccccgtgatctacgatagcaaattcgagaagcagttgggccaggtcatgctcctggtgttatgcgccgtgcagctcctgctgatgcggaccagctgggccctctgcgaggcgctgacgctggccaccgggcccatcacgaccctctgggagggctcccccggcaagttctggaacaccaccatcgccgtgagcatggccaacatcttccgcggctcctacctggccggggctggcctcgcgttctcgatcatgaaatcggtggggaccggcaagcggggaaccgggagccaaggcgagaccctcggggagaagtggaagaagaagctgaatcagctgagccgcaaggaattcgacttgtacaaaaagtccggcatcacagaggtcgatcggaccgaggcaaaggagggcttgaaacgcggcgagatcacgcaccatgccgtgtcccggggcagtgcaaaactgcaatggttcgtcgagcgtaacatggtgatacccgaggggcgggtcatcgatctcggctgcgggaggggagggtggagctactactgcgccggcctgaagaaggtgaccgaggtgcgcggctacactaagggcggacccggacacgaggagccagtcccgatgtcaacctacggctggaacatcgtgaaactgatgagcgggaaggacgtcttctacctcccgcccgagaagtgtgacacgctgctgtgcgacatcggtgaatccagcccctcccccaccgtcgaggaaagtagaaccatacgcgtgctgaagatggtggagccgtggctcaagaacaatcaattctgtatcaaggtactgaacccctacatgccaaccgtgatcgaacacctggagcggctccagcgcaagcacggcgggatgctggtgagaaaccctctgagccgcaacagtacgcacgaaatgtactggatctccaacggcaccgggaacatcgtcgcgagcgtaaacatggtgtcccggctcctgctgaaccggttcaccatgactcaccgtcgccccacgatcgagaaggacgtagacctcggagctggcacgcggcatgtcaacgccgagcccgagacccctaacatggacgtaatcggggagcgcatcaagcggatcaaagaagagcataactccacctggcactacgacgacgagaacccgtacaagacttgggcctaccacggatcctacgaagtcaaagccaccggttcagcgtccagcatgatcaacggcgtggtgaagcttctgaccaagccctgggacgtcgtgcccatggtcacccagatggccatgacggacacgacccctttcggtcagcaacgcgtattcaaggagaaggtggacacccggaccccgcgctcaatgcctggcacccggcgcgtcatgggcatcaccgccgagtggctctggcgtaccctggggcgcaacaagaagccccgcctgtgcacgcgagaggagttcaccaagaaggtgcgcacgaacgctgcgatgggcgccgtgtttaccgaggagaaccagtgggactccgccaaggccgccgtcgaagatgaagacttctggaagctggtggaccgggaacgcgaactgcacaagctggggaagtgcggtagctgcgtgtacaacatgatggggaagcgggagaaaaagctcggcgagttcggcaaggcgaaggggtcccgcgctatatggtacatgtggctgggcgcccggtacttggagttcgaggccctggggttcttgaacgaggaccactggttcagccgcgagaactcctacagcggcgttgagggggagggcctccacaagttgggatacatactgcgggacatctccaaaatacccgggggcgccatgtacgcggacgacacggccgggtgggacacccgtatcaccgaggacgacctgcataacgaggagaaaatcactcagcagatggaccctgagcaccggcagctcgccaacgctatcttcaagctgacttaccagaacaaggtggtgaaggtccaacggcccacacctacaggcacggttatggacataataagccggaaggaccagcgcggatccggacaggtgggcacctacgggctaaacacgttcaccaacatggaggcccagctcatccggcagatggagggcgaaggggtcctgagcaaggcggacctggaaaacccccacttaccggagaagaaaattacccagtggctggagacaaagggcgtggagcgccttaagcggatggccatatctggggacgactgcgtggtcaaacccatcgacgataggttcgccaatgccctcgtggccctgaacgacatgggtaaggtgcggaaggacattccccagtggcagcctagcaagggctggcacgactggcagcaggtccctttctgcagccaccactttcacgagctgatcatgaaggacgggaggaagctcgtggtgccctgcagaccccaggacgagctgatcggccgcgcgcgcatcagtcagggggccggttggtccctgcgtgagacggcctgcctcggcaaggcctatgcgcagatgtggagcctcatgtactttcatagacgggacctgcgcctcgccagtaacgcaatctgcagcgccgtccccgttcactgggttccgacctcccggaccacctggtccatccacgcccaccaccagtggatgacgaccgaagacatgctaacagtctggaaccgcgtgtggatcgaggataacccttggatggaggacaagacccccgtgacgacctgggagaacgtcccctacctggggaagcgggaggaccaatggtgcggcagcctcattgggctgacctcccgcgcgacctgggcccaaaatatcccgacggccatccaacaagttcgcagtctgataggcaatgaggagttcctcgactatatgccctccatgaaaagattccggaaagaggaagagagcgagggggccatctggtga

SEQ ID NO: 25703 - RNA, 9873 nt, synthetic construct
  misc_feature 1..9873: note = derived and/or modified CDS sequence (opt11) from DENV-3__GU131871__SS-prME
  source 1..9873: mol_type = other RNA
acctctctttgtctcgttatgatcctgcccgcagccctggcgttccatctcaccagccgggacggtgagccgcgtatgattgtggggaagaacgagagaggcaaaagcctgctgttcaagactgccagcgggatcaatatgtgcaccctcatagccatggacttaggcgagatgtgcgacgatactgtcacctacaagtgcccccacattaccgaggtcgagcctgaggacatagactgctggtgcaacctgactagcacatgggtcacctacgggacttgcaaccaggccggcgagcggcgccgggataagcgctccgtggctcttgcgccacatgtcggcatggggctcgacacccggacccaaacctggatgtccgccgagggggcctggcgccaagtcgagaaggttgagacgtgggcgctccgtcacccggggttcacgattctcgcgctattcttggcacactacatcggtacatcactaacccagaaggtggtgatcttcattcttttgatgctcgtgactccaagcatgaccatgcgctgcgtgggcgtcggcaaccgggacttcgttgagggtctgagtggcgccacctgggtggacgtcgtgctggagcacggcgggtgcgttactacgatggccaaaaataagcctaccctcgacatcgagcttcagaagaccgaagccacccagctcgcgacgctccgcaaactttgcatcgaaggcaagatcaccaacataaccaccgacagcaggtgccccactcagggcgaggcagtcctgccagaggagcaggatcagaattatgtgtgtaagcacacctacgtggatcgcgggtggggcaacgggtgcggattgtttgggaagggatccctggtgacatgcgccaagttccagtgtctggagcccatagagggcaaggtggttcagtacgagaacctcaagtacaccgttataatcacggtgcacaccggagaccagcaccaggtcggcaatgagacccaaggggtgacagccgagatcaccccccaggcctcaacaaccgaagcgatcctgcccgagtatggcacccttggactcgagtgctccccgcggacagggctggattttaacgagatgatactgttaacgatgaagaacaaggcctggatggtgcaccgtcaatggttcttcgatctgcccctgccctggaccacaggtgccactacagagacccccacctggaatagaaaggagttgctggttaccttcaagaacgcccacgccaagaagcaagaagtggtggtcctggggagccaggagggcgcaatgcacacggccctcaccggggccaccgagatccagaattccggggggactagcatcttcgccggtcacctgaagtgccgcctaaagatggataagctcgaactgaaaggaatgtcgtacgccatgtgcactaacacttttgttctaaaaaaggaggtgagcgagacccagcatgggacgattctcatcaaggtcgagtaccggggcgaagacgctccgtgcaagatacccttctccactgaggatggacagggcaaggcccacaatgggagactcatcaccgctaaccctgtggtgacaaagaaggaggagcctgttaacatcgaggctgagccgccattcggcgagagcaacatcgttatcggaataggggataatgcactgaagatcaactggtataagaagggcagctcaatcgggaaaatgttcgaggcgaccgctcggggtgcccgccgtatggcgattctgggcgacacggcttgggatttcggcagcgtgggcggtgtcctcaactccctgggcaagatggtgcatcaaatcttcgggagcgcgtacaccgccctgttttccggagtgagttgggtcatgaagattggcatcggaatcctccttacctggatcggccttaatagcaagaacacgagcatgtccttcagctgtatcgccatcgggattatcacgctttacctaggcgcggtggtgcaagctgacatgggatgtgtcatcaactggaaaggcaaagaactgaagtgcggctcaggaatctttgtgaccaacgaggtgcacacatggacggagcagtacaagttccaggccgatagtcccaagagactcgccacggccatcgcaggcgcgtgggagaacggggtctgcgggatccggagtaccacccggatggagaacctcctgtggaagcagatcgccaatgagttgaactacatcctgtgggaaaacaacattaagctgacagtggtggtcggggacatcattggagtgctcgagcagggaaagagaacgctgacgccccagccaatggaactgaagtacagctggaaaacatgggggaaggccaaaatcgtgaccgcagaaacgcagaactccagcttcatcattgacggccccaacacccccgaatgcccctccgctagcagagcctggaatgtctgggaggtggaggactatgggttcggtgtgttcactaccaacatctggctcaagctgcgtgaggtctatacccaactgtgcgaccaccggctgatgtccgccgccgtgaaagacgagagagccgtgcatgcggatatggggtactggatcgagagccagaagaacgggagctggaagctggagaaagcgtccctgatcgaggtcaagacatgcacctggccgaaatcgcacaccctctggtccaacggcgtcctggagtccgacatgatcatacccaagtccctcgccggccccattagccaacacaaccatcggcccggctaccacacgcagacggccggtccctggcacctgggcaagctggagctggacttcaactactgcgagggtaccactgtggtcattactgaaaactgcgggacgcggggcccctccctccggaccacaaccgtgagcgggaagctgatccacgagtggtgttgtcgctcctgcacgctgccccctctaaggtacatgggcgaggatgggtgctggtacggcatggagattcgccccatcagcgagaaggaggagaacatggtcaagtcccttgtcagcgccggctccgggaaggtggacaacttcaccatgggcgtgctgtgcctcgcgatcttgttcgaggaggtcatgcgcgggaagttcggcaaaaagcacatgatcgccggggtgttcttcactttcgtgctgctcctaagcggccagatcacctggcgcgacatgacgcacaccctgatcatgatcggctccaacgcgagcgaccggatgggcatgggcgtgacctacctcgccttaattgccaccttcaagattcagcccttcctagctctcgggttcttcctacgcaagcttacgagccgggagaacctcttgttgggcgtcggcctcgccatggccaccaccctccagctgcccgaagacatcgagcaaatggcgaacgggatcgcactcggactgatggccctgaagttgatcactcaattcgagacgtaccagctctggacggccctaatctcactgacctgctcgaacaccatgttcaccctgaccgttgcctggcgcaccgcaaccctaattttggcgggggtctccctgctgccggtttgccaaagcagcagcatgcgcaagacagactggctccccatggccgtagctgccatgggcgttccgccgctaccgttgttcatcttctcgctgaaggacaccctgaaacggcgctcttggcccctgaacgaaggggtgatggccgttgggctcgtatctatcctggccagctccctgctcagaaacgatgtgcccatggccggccccctggtcgccgggggcctgctcatagcctgttacgtgatcaccgggaccagcgccgatttgaccgttgagaaggcggccgacatcacctgggaggaagaggccgagcagaccggcgtttcacacaacctgatgattaccgtcgatgacgacgggaccatgcgcattaaagatgacgaaaccgagaacatcctcaccgtgctattaaagaccgccctcctaattgtcagcggcgtgttcccgtactccataccggccaccctgctcgtgtggcacacgtggcagaagcagactcagcggtcgggcgtgctgtgggacgtgcccagcccgcccgagacgcagaaggcggagctcgaggaaggagtgtaccgcataaagcaacaaggcatcttcgggaagacgcaggtaggagtgggggtgcaaaaggagggtgtctttcacacgatgtggcatgtgaccagaggcgccgtcctcacctacaacgggaagcgcctagaacctaattgggccagcgtcaagaaggacctgatctcctacggaggaggctggcggctgagcgcacaatggcaaaagggggaggaagtccaggtgatcgcggtcgaacccggaaaaaacccaaagaacttccagaccacgcccggcacctttcagacgaccaccggggagatcggcgccatcgccctcgacttcaaacccgggacaagtggcagccccatcatcaaccgtgagggcaaggtggtggggctgtacggcaacggcgtggtgaccaagaacgggggttacgtaagcggtatcgctcagacgaacgcagagcctgacggcccgacgcccgagctggaagaagaaatgttcaaaaagcggaatctgaccatcatggaccttcaccccgggtcagggaaaacccgcaaatacctgccggcgatcatcagggaagccataaagcgccggctccgtaccttgatcttggctccgactcgggtcgtggctgccgagatggaggaggcgctcaaggggctgcctatccgctaccagacgacggccacaaagtcggagcacacgggccgggagatcgtggacctaatgtgtcacgccacgttcaccatgcgcctcttatcccccgtccgggtaccgaactacaacctgatcatcatggatgaagcccattttaccgatcccgccagcatcgcggcccgcgggtatatctctacgcgcgttggcatgggtgaggctgccgcgatcttcatgaccgcaacgccgccaggtaccgccgacgcctttccgcaaagcaatgcgccgatccaggacgaggagagagacatcccagagcgcagctggaacagcggaaacgagtggatcacggattttgcgggaaagaccgtctggttcgtgcccagcattaaagccggaaacgacatcgccaactgcctgaggaagaacggtaagaaggtaatccagctgagccgcaagaccttcgacaccgagtaccagaaaactaaacttaacgactgggacttcgtcgtgaccacagacatatccgagatgggcgcaaatttcaaggccgaccgggtgatcgacccgcgccggtgcctaaagcccgtcattctgacggacggccccgaacgcgtgatacttgccggtcccatgccggttactgcggcctcggcggcgcaacggcgcggcagggtcgggcggaacccccagaaggaaaacgatcagtatatattcactggtcagcccttaaataacgacgaggatcacgctcactggacagaggccaagatgctgctggacaacatcaacacccccgaggggatcataccggctttatttgagcctgagcgggaaaagtccgcagcaatcgacggcgaatacaggctcaagggtgagtcccggaagaccttcgtggagttgatgcgccgcggggatctccccgtgtggctggcgcacaaggtcgcctccgagggcatcaagtacacggacagaaagtggtgcttcgatgggcagcggaacaatcaaatcctagaggagaacatggacgtggagatctggaccaaagagggcgagaagaagaagctccgcccccgctggctggacgccagaacctacagcgacccgttagccctcaaggagtttaaggacttcgcggctggccgcaagtccatcgccctggacctggtcaccgagattgggcgggtgccaagccacttagcccataggacgcggaacgccttagacaacctggtgatgctccacacctcggagcatggcgggagggcgtaccggcacgccgtcgaggagctgcccgaaacgatggagaccctactcctgctgggccttatgatcctgctgaccggcggggccatgctgttcttgatcagcgggaaggggatcggcaagacgagcatagggctgatctgcgtgatcgcctctagcggcatgctctggatggcagaaatcccgctacagtggatcgcgtccgccatcgtgctggagtttttcatgatggtcctccttatccccgagcccgagaaacagcgaacgccccaggacaaccagctggcctacgttgtgataggaattctcaccttagcggccatcatcgcggccaacgagatgggcctgctcgagacgaccaagcgggacctgggcatgtccaaggagccgggggtcgtgtcacctaccagctacctggacgtggacctccaccccgcctccgcctggaccctttacgccgtcgccacgaccgtgataacccccatgctgcgccatacgatcgagaacagcactgccaatgtgtccctggccgccattgcgaaccaagccgtcgtgctgatgggcctggacaaggggtggcccatttccaagatggacctcggagtgcctctgctggcactgggatgctactcccaggtcaaccccctgaccctgactgccgcagtgctcctgctgattacccattacgcgatcatcggccccggcttgcaggctaaggccacccgggaggcccagaaacgcaccgccgcgggcatcatgaagaaccctaccgtggacgggatcatgacaattgacctggacccggtaatttacgattcaaagttcgagaagcagcttggccaggtaatgctcctggtgctgtgcgcggtccagctcctgttaatgcggacgtcctgggcattgtgcgaggccctgacgttggcgaccggacccatcacgacgctctgggagggctcccccgggaaattctggaacacaaccattgccgtttccatggcaaacatctttcgtggcagctacctggccggggccggcctggcgttctccatcatgaagtccgtggggaccgggaagcgtggcaccgggtcgcagggcgagacgttaggggagaagtggaagcgcaaactgaatcagctgagccggaaggaattcgacttatacaagaaatccggcatcaccgaggtcgaccgcaccgaagctaaagaggggctgaagcggggagagatcacccatcacgccgtgtcccgcggctcagccaagctgcagtggttcgtcgaacggaacatggtaatacccgaagggcgagtgatcgacctcggttgcggccgcggggggtggtcctactactgcgccggtctgaagaaggtgacagaggtccgagggtacactaaaggagggcccgggcatgaggagcccgtgcccatgagcacctatggttggaacatcgtcaagctgatgtccgggaaggacgtcttctaccttccgcccgagaagtgcgataccctgctctgcgatatcggcgagagctccccgagccccacggtggaggaatcccgcaccatccgcgtgcttaagatggttgagccatggctcaagaacaatcaattctgcattaaggtgctgaacccctacatgcccactgtcatcgagcacctggagcgattacagcgcaaacacggcgggatgctggtgcgcaaccccttgtcacggaatagcacccacgagatgtactggattagcaacgggacggggaacatcgtggcgtccgtgaacatggtcagccgcttactcctgaaccggttcactatgacccaccgccggccgaccatcgaaaaagacgtggacctcggtgccggtacacgccacgtgaacgcagagcccgagaccccaaacatggatgtcatcggggagcgcatcaagagaatcaaggaggaacacaactcgacctggcactacgacgacgagaacccgtacaagacgtgggcctaccacggatcatacgaggtgaaggccacggggtctgcgagttccatgatcaatggagtggtcaagctgctgaccaagccctgggacgtggtcccaatggtcacccagatggccatgaccgacacgacccccttcgggcagcagcgggtgttcaaagagaaggtcgacacgagaaccccgcggagcatgcccggcacgcgccgcgtgatggagattaccgccgagtggctctggcgaacactgggccgcaacaaaaagccgcggttatgcacccgcgaggagttcacaaagaaggtgcggaccaacgccgcgatgggggccgttttcaccgaggaaaaccagtgggacagcgcaaaggccgccgttgaagacgaggacttctggaagctcgtggaccgcgagcgggagctgcacaaactgggcaagtgcgggtcctgcgtctataatatgatgggcaagcgcgagaagaagctcggggagttcggcaaggccaagggctcccgggctatatggtacatgtggcttggggcccggtacctggagttcgaggccttgggcttcctgaacgaagatcactggttctctagggagaacagctacagcggcgttgagggcgaggggcttcacaagctcggctacatcttgagagacatatcaaagatccccggcggggcgatgtacgcagacgacaccgcaggctgggacacgcggattaccgaggacgacctgcacaatgaagagaagatcacacagcagatggacccggagcaccgccagctggccaacgctatcttcaaactgacataccaaaacaaagtggtaaaggtgcagaggcccactcccacgggaacagtcatggatatcataagccgcaaggaccagcggggcagcggccaggtcgggacgtatggcctgaacaccttcacgaacatggaggcacagctgatcagacaaatggaaggggagggtgtgctttccaaagcagatctggagaatccccacctcccggagaagaagatcacacagtggctggagaccaaaggggtggaacggctgaagcgcatggccatcagcggagacgactgcgttgtcaagccgatcgacgaccgctttgcgaatgcgctcctggccctgaacgacatggggaaggtgcgcaaggacatcccacagtggcagcccagcaaagggtggcacgattggcagcaggtcccattctgcagccaccactttcatgaattaatcatgaaagacggccggaagctggtggtgccttgccgcccccaggacgagttgatcgggcgggcacggatctcgcaaggcgccgggtggtcgctccgcgagaccgcctgcttaggcaaggcctacgcccagatgtggtccctgatgtacttccaccggcgcgacctacggctggcctctaacgccatctgcagtgccgtgcccgttcattgggtgccgacctctcgcaccacctggtccatacacgcccaccaccagtggatgaccacggaggacatgctgaccgtctggaaccgggtgtggatcgaagacaacccctggatggaggacaaaactccggtgaccacctgggagaacgtaccttacctcggcaagcgcgaagaccaatggtgcgggtcgttgataggcctgacctcgcgggctacctgggcgcagaacatccccacggccatccaacaggtccgctcactcatcgggaacgaggagttcctggactatatgccaagcatgaagaggttccgtaaggaagaggagtcagagggcgccatctggtga

SEQ ID NO: 25704 - RNA, 9873 nt, synthetic construct
  misc_feature 1..9873: note = derived and/or modified CDS sequence (opt11) from DENV-3__GU131872__SS-prME
  source 1..9873: mol_type = other RNA
acgagcctctgcttagtgatgatcctgcccgccgccctggcgttccacctcaccagtcgggacggggagccccggatgatcgtgggcaaaaatgaacgcggaaagagtctgctgttcaaaaccgcgtccgggataaatatgtgtaccctcatcgcaatggatctgggcgagatgtgcgacgacaccgtgacctacaagtgcccacacatcaccgaagtggagcccgaggacatagactgctggtgcaacctaaccagcacctgggtgacctacggtacttgcaaccaggccggggagcggcgtcgggacaagcggtccgtcgccctcgctccccacgttggcatggggctggacacccggacccagacctggatgagcgccgagggcgcctggaggcaggtcgagaaggtggagacgtgggccctgcgtcacccggggttcactatcttggcactgttcctggcccactacatcggcacttccctcacccagaaggtggtaatcttcatcctgctgatgctcgtgacaccctccatgacaatgcgctgcgtgggggtcggcaatagggacttcgtggagggactgtccggggccacctgggtagacgtcgtgctggagcatggaggctgcgtgaccacgatggccaagaacaagcccaccctcgacattgagcttcaaaagaccgaggccacccagctggcgacgctccgcaagctatgcatcgagggcaagatcaccaacatcaccaccgactcccggtgccccactcagggagaggccgttctgccagaggaacaagaccagaactatgtgtgcaagcatacctatgtggaccgtggctggggaaacgggtgcggcctcttcgggaagggttccttggtgacgtgcgccaagttccagtgcctcgagcccatcgagggcaaggtggtgcagtacgaaaatctcaagtacacggttatcatcacggtccacaccggagaccagcaccaggtcggcaacgagacccagggggtcaccgccgagatcacgccccaagccagtactacagaagcgatcctgcccgaatacggcaccctggggctcgaatgctccccacggaccggcttggacttcaatgagatgattctgctcacgatgaagaacaaagcctggatggtgcaccgccagtggttctttgacctgcccctgccttggactagcggcgcgactaccgagacgcccacttggaaccggaaggagctcctggtcaccttcaagaacgcccacgccaaaaagcaggaagtggtggtgctggggtcccaggagggcgccatgcataccgccctcacgggggccaccgagatccagaactcaggcgggacctctatattcgcaggccacctgaaatgccgcctgaagatggacaagctcgaactgaaaggcatgagctatgctatgtgcaccaacacgttcgtgctgaagaaggaggtgtccgagacccagcacgggaccatcctcatcaaggtcgagtaccgtggcgaggacgctccttgcaagatcccttttagcaccgaggacgggcaaggcaaagcccataacggccgactgatcacggccaaccccgtggttacgaaaaaggaggagcctgtaaacatcgaggctgagccgccattcggtgaaagcaacatcgtaatcggcatcggagacaacgcgctgaagatcaattggtacaagaagggctccagcatcgggaagatgttcgaggccacagcccggggcgcacgacgcatggccatcctaggtgacacagcgtgggacttcgggtcggtagggggtgtcctcaacagcctgggcaagatggtgcaccagatcttcgggtccgcctacacggccctgttcagcggcgtgtcatgggttatgaagatcgggatcggaatcttattaacctggatcggccttaactcgaagaatacctccatgagcttcagctgcatcgccatcggtatcatcaccctgtacctgggcgccgtggtacaggcggatatgggatgcgtcatcaactggaaggggaaggagttgaagtgcggaagcgggattttcgtgacgaacgaggtgcacacctggaccgagcagtacaagttccaagccgattcccccaagcggctcgccaccgccatcgcaggcgcgtgggagaacggggtatgcggcatccgtagcacgacccgaatggagaacctgctgtggaagcagatcgccaacgagctcaactacatcctgtgggagaacaacatcaaactgaccgtggttgtcggcgacatcataggggtgctcgagcaaggcaagcgcaccctgacgccccagccgatggagctcaagtactcctggaagacctgggggaaggccaagatggtgaccgccgagacgcagaacagcagcttcatcatagacggccccaacacgcccgagtgccccagcgcgagccgtgcctggaacgtatgggaagttgaggactacgggttcggtgtattcaccaccaacatctggctcaagctgcgcgaggtttacacacagctgtgcgaccaccgactcatgagcgccgccgtcaaggatgagcgggccgtgcatgcggatatgggctactggatcgagagccagaagaacgggtcctggaagttggagaaggcgagcctgatagaggtcaagacgtgcacgtggccgaagtcccacacgctctggagtaacggcgtgctggagtccgacatgatcatccccaagagcctggcagggcccatctcccaacacaaccaccgtccgggctaccacacccagaccgcaggtccgtggcacctcgggaagttggaactggacttcaactattgcgagggcacgactgtggtcatcaccgagaactgcgggacccgcggccccagcctcagaacgaccaccgtgtccgggaagctgatccacgagtggtgctgccgcagctgcaccctgcccccgttacggtatatgggcgaggacgggtgttggtacggcatggagatccgccccatcagtgaaaaggaggagaacatggtcaagtctctggtcagcgccggcagcgggaaggtcgacaactttactatgggcgtgctgtgcctcgcgattctgttcgaggaggtcatgcggggcaagtttggcaagaagcacatgatcgccggggtgttcttcacgttcgtgctgttgctgagtggccagataacctggagggacatgacccatacgctaatcatgatcggcagcaatgcctccgatcggatggggatgggcgtcacctacctcgcactaatcgcgacctttaagatccagcccttcctggcgctcggtttcttcctgcgcaaactgacctcccgagagaatctcctgctcggcgtcggcctcgccatggccacgaccttacagctgcccgaggacattgagcagatggcgaacgggatagcgctcggcttgatggccctgaagctcatcacccagttcgagacctaccagctgtggaccgccctgataagcctgacctgttccaacacaatgttcaccctgacggtggcctggcgtaccgccaccctgattctcgcgggggtcagcttgctgccggtatgccagtccagctccatgaggaaaaccgactggctccccatggccgtcgcagccatgggcgtgccaccgctaccactgttcatcttcagcctcaaggacacgctgaagaggagatcctggcccctgaacgagggtgtgatggccgtcgggctcgtaagcatcctcgcatcgagcctgctccggaacgacgtgcccatggccgggcccctggtcgccgggggcctgctcatcgcctgctacgtgatcaccgggacttccgccgacttgaccgtggagaaggcggccgacatcacgtgggaggaggaggccgagcaaaccggggtcagccataacctgatgataaccgtggacgatgacgggaccatgcggataaaggacgacgagaccgagaacattctcacggtgctgctgaagacggccctcctgatcgtctcgggcgtgttcccgtacagtatcccggcaaccctgctagtgtggcacacctggcagaagcagacgcagcggtccggcgtactgtgggacgtccccagcccgcccgagacccaaaaggcggaactggaggaaggggtgtatcgaatcaagcagcagggcatattcgggaagacccaggtcggcgttggggtacagaaagagggcgtcttccacacaatgtggcacgtgactcggggtgctgtgctgacctataacgggaagaggctcgagcccaactgggcctccgtcaagaaggacctgatctcttacggcgggggctggcggctctccgcccaatggcagaagggcgaagaggtccaggtcatcgcggtcgagcccggcaaaaaccccaagaactttcagaccacccccggcaccttccagacaaccaccggggagatcggcgccatcgccttagacttcaagcctgggacgagcggcagccccatcatcaaccgcgagggcaaggtggtggggctttatggcaacggggtcgtgaccaagaacgggggatacgtgtccggcatcgcccagaccaacgccgagccggacggcccaacccccgaactggaagaggagatgttcaagaagcggaacctcacgatcatggacctccaccccgggagcggcaagaccagaaaatacttaccggcgatcatacgggaggccatcaagcgccggcttcgcacgctgatcctggccccgacccgagtcgtagccgccgagatggaggaggctctcaaggggctgcccatccgctaccagacgaccgccaccaaatccgagcataccggccgggagatcgtggacctcatgtgccacgcaacgtttaccatgcgccttctgtcaccggtccgggttccgaactacaacctgattataatggacgaggctcatttcaccgaccccgcctccatcgcggcccggggttacatctccacccgagtgggcatgggtgaggccgccgcgattttcatgactgccacgccgcccggtactgccgatgccttcccacagtctaacgcccccatccaggacgaggagcgggacatccccgaacgcagctggaactccgggaatgagtggatcaccgacttcgctgggaagacggtctggttcgtgccctccatcaaggccggcaacgacatcgccaattgcttacggaaaaatggaaagaaagtcatacagctctcccgcaagaccttcgacaccgagtaccaaaagaccaagttaaatgactgggacttcgtagtgacgaccgacatcagcgagatgggcgccaactttaaggccgaccgggtgatcgaccctcgccgctgcctcaaacccgtcatcttaaccgacggtcccgagcgcgtgatcttagcgggacccatgcctgtgacagccgcctctgccgcacagcgacgcggccgggtcggaagaaacccccagaaggagaacgaccagtacatcttcaccggtcagcccctcaacaacgatgaagaccacgcgcactggacggaggccaagatgcttctggacaacataaacacccccgaggggatcatcccggcactcttcgagcccgagcgggagaaatccgccgctatcgacggcgagtatcgcctgaaaggcgagtcccggaagaccttcgtggagttaatgcgccgcggggacctccccgtgtggctggcgcacaaggtcgccagcgagggcatcaagtacaccgacagaaagtggtgcttcgacggtcagcgaaacaaccagatcctggaggaaaatatggacgttgaaatttggacgaaagagggcgagaagaagaagctccgccccaggtggctggacgcccggacctacagcgatccgctcgccctcaaggaatttaaggacttcgcggccggccgcaagagcatagccctggacctggtaaccgagatagggcgggtgccctcccacctcgcccaccgcacgcggaacgccctggacaacctggtgatgctccacacttctgagcacggcgggcgcgcataccggcacgccgtcgaggagttacccgagaccatggagaccctgctcctgctgggtctgatgatactgctgaccggaggggcaatgctattcctgatcagcgggaaggggatcggcaagacttccataggcttgatctgcgtgatcgccagctctggcatgctttggatggcagagatcccgttacaatggatcgcaagcgccatcgtgctagagttcttcatgatggtcctcctgatccccgagcccgagaagcagcgcacgccccaggacaaccagctggcctacgtggtgatcgggatcctcaccctggcagccatcatcgcggccaacgagatgggcttactcgagaccacgaagcgggacctgggcatgagcaaggagcccggcgtcgtgagccccacatcctacctggacgttgacctccaccccgcctcagcctggacactgtacgcggtcgccaccacggttatcacccccatgctgaggcacactatcgagaactctaccgccaacgtgagcctcgccgccattgcaaaccaggccgtcgttctgatggggctggacaaggggtggccgatctccaagatggacctcggcgtgcctctcttggccctcggatgctatagccaggtcaaccccctaaccctgaccgcggccgtgttgctgctgataacccactacgccatcatcggccccggacttcaggcgaaggccaccagagaagcccaaaagcgcacggccgcggggatcatgaagaacccgaccgtcgatgggatcatgaccatcgaccttgatcccgtcatctacgattccaagttcgagaaacagctgggccaagtgatgcttctcgtgctgtgcgccgtccaacttctgttaatgcgcaccagctgggccctctgcgaggctctgacgctggcgacgggccccatcacgaccctctgggagggctcccccggaaagttttggaacacgaccatcgccgtgagcatggccaatatcttccgcggctcctacctcgccggggccggattggcgtttagcatcatgaagtcagtcggcacgggtaagcggggaaccgggagccagggcgagaccctcggggagaagtggaagaagaagctgaaccaactgtctcgcaaagagttcgacctctataagaagtccggcatcactgaggtcgaccgaaccgaggccaaggaggggctgaagaggggcgagatcacgcaccacgccgtcagccggggctcggccaagctgcagtggttcgtcgagcgcaacatggtcatcccggagggccgtgtgatcgatctcggctgcggacgaggcggatggagctactactgcgccggactgaagaaggtgactgaggtccgcggatatacgaagggcggccccgggcacgaggaacccgtgcccatgtccacctacggctggaatatcgtgaagttgatgagcggaaaggatgtcttctacttaccgcccgagaagtgcgacaccctgctttgcgacatcggcgagtctagcccttcccccaccgtggaggagagcagaacgatccgagtgcttaagatggtcgagccgtggctcaagaataatcagttctgcataaaggtgctgaacccctacatgccgaccgtgatcgagcacctggagcggctccagagaaagcacggcgggatgctggttcggaaccccctgtcccgcaacagcacgcacgaaatgtactggatctccaacggaactggaaacatcgtggcgagcgtgaacatggtctcccggctgttgctgaaccgcttcacaatgacccatcggcgcccgactattgagaaggacgtggatctcggcgccggcactcggcacgtcaacgcggaacccgagacgcccaacatggacgtcattggggagcggatcaagcggatcaaggaggaacacaactccacatggcactacgacgacgagaacccgtacaagacctgggcctatcacggctcctatgaagtaaaggccaccgggtcggcgtccagcatgatcaacggcgtggtcaagctgctgacgaagccctgggacgtcgtccccatggtgacccagatggccatgaccgataccacgccgttcgggcagcagcgcgtgttcaaggaaaaggtcgacacccggacaccccggagcatgcccggcacccggagggtgatggagatcacggccgagtggctctggcggaccctgggtcgcaacaaaaagccccgcttatgcacccgggaggagttcaccaagaaggtgcgcacgaacgccgcgatgggggccgtcttcaccgaggagaaccagtgggattcggcaaaagccgccgtggaggacgaggatttctggaagctcgtggatcgggagcgcgagttgcacaaactgggaaagtgcgggtcttgcgtctacaatatgatgggcaagagggagaagaagctcggggagttcgggaaagcgaagggttcccgcgccatctggtatatgtggttgggtgccaggtatctggagttcgaagccttaggcttcctgaacgaggaccactggttcagtcgcgagaactcctatagcggcgtggagggagaggggctgcacaagctcggctacatcctgcgggacatctccaagatacctggcggggccatgtatgcggacgacaccgccggctgggacacccgcatcactgaggatgatctgcacaacgaggagaaaatcacccagcagatggacccggagcatcggcaactcgcgaacgccatctttaagctgacataccagaacaaggtggtcaaggtacagcgccccacccccaccggcaccgtgatggacatcatcagccgcaaggatcaacgcggctccggccaggtcgggacatatggactgaacacattcaccaacatggaggcccagctcatccggcagatggaaggagagggcgtcctgagcaaggcagacctggagaacccccacctccccgagaagaagatcactcagtggctggagaccaagggggtggagcgcctgaaacgcatggccatctccggcgatgactgcgtcgtaaagcccatagacgaccgtttcgccaacgccctcctggccctcaacgacatgggaaaggttcggaaggacatcccccagtggcagccctctaagggttggcacgactggcagcaggtcccgttttgctcgcaccacttccacgagctcatcatgaaggacggcagaaagctggtggtgccctgccggccccaggacgaactgatcggtcgcgcaaggatcagtcaaggcgccgggtggtccctccgggagacggcctgcctggggaaggcctacgcgcagatgtggtctctgatgtacttccacagacgagacctccgcctggcatccaacgccatctgctcagctgtcccggtgcactgggtgccgacatcccggacgacctggagcatccacgcccatcaccagtggatgaccaccgaggacatgttaacggtatggaaccgcgtgtggatcgaggacaacccctggatggaggataagaccccggtgaccacctgggagaatgtcccctatctcgggaagagggaagaccagtggtgcgggagcctcatcggccttacgtcccgcgcgacctgggcccagaacatcccgaccgcaatccaacaggtccggagcctcattgggaacgaggagttcctggactacatgccctccatgaaacgcttccgcaaagaggaagagagcgagggcgccatctggtga

SEQ ID NO: 25705 - RNA, 9873 nt, synthetic construct
  misc_feature 1..9873: note = derived and/or modified CDS sequence (opt11) from DENV-3__GU131873__SS-prME
  source 1..9873: mol_type = other RNA
accagcctctgcctcatgatgatcctgcccgcagcactggcgttccacctcaccagccgtgatggcgagccgcggatgatagtggggaagaatgagcggggcaaatccctgctgttcaagaccgccagcgggatcaacatgtgcaccctcattgccatggacctgggtgagatgtgtgatgacacggtgacctacaaatgccctcatatcaccgaagtggagcccgaggacatcgactgttggtgcaacctgaccagcacctgggtgacctacgggacttgtaatcaagccggtgaaaggcgccgggataaaaggtcggtggcactcgcgcctcacgtgggtatggggctggatacccgcacccagacctggatgagcgccgagggcgcctggcgccaggtggaaaaggtagagacttgggctttacgacaccccggttttacgatcttggcgctgttcttagcccattacataggcacatcactcacccagaaggttgttattttcatattattgatgctggttacgcccagcatgacgatgcggtgcgttggggtgggtaatcgggacttcgtcgagggtcttagcggggcgacctgggtggacgtagttctggaacacggcggttgcgtaaccacaatggccaaaaacaaacccaccctcgacatcgagctgcagaagaccgaagccacccagctggctactttgaggaaactgtgcatcgaagggaagataaccaacataaccacggacagccgttgcccgacgcagggcgaagcggtgctgccggaggaacaagaccagaactacgtatgcaagcacacctatgtggaccgcgggtggggcaacggatgcggtctcttcgggaagggcagcctagtgacctgcgcaaaatttcagtgtctggagctaatcgagggcaaagttgttcaatacgagaacctgaagtacaccgtagtcatcacggtgcacaccggtgatcagcatcaggtcggcaacgagacccaggggatcaccgccgagatcacgccccaggcgtcaactaccgaggcgattctgcccgagtacgggacccttggcttagaatgctcccccaggaccggcctggactttaacgagatgatccttttgacgatgaagaacaaggcctggatggtacaccgccaatggtttttcgatcttccgctaccctggaccagcggggcgacgaccgaaacgcccacgtggaaccggaaggagctattagtcacctttaagaacgcccatgcaaagaaacaagaggtcgtggtgctcggatcccaggagggcgcgatgcacaccgctctgacgggggccaccgaaatccaaaacagcggcgggacaagtatcttcgctggccaccttaaatgccgcttaaaaatggacaaattagagctgaagggaatgagctacgccatgtgcacaaacactttcgtactgaagaaggaggtatccgagacgcagcacggtacgatcctcataaaggtggaatacaagggcgaagacgcgccgtgtaagataccgttttcgactgaagacggccagggaaaggcccacaatggccggctcatcacagctaacccggtcgttaccaaaaaggaggagcccgtgaacatcgaggcagaaccgcccttcggcgaaagcaacattgtcatcggcatcggcgataatgcactaaagataaactggtataagaaaggctcgagtatcggtaaaatgttcgaggccaccgcccgcggtgcccggcgaatggccatactcggtgacaccgcatgggacttcgggtccgtgggcggggtcctgaacagcctgggcaagatggtccaccagatttttgggtccgcgtacacagccctcttcagcggagtgtcctgggtgatgaagatcgggattggagtcctgctgacttggataggtctcaacagcaagaatacatccatgtcgttcagctgcattgctatcgggatcataactttatacctgggggccgtcgtccaggcggacatggggtgtgttatcaactggaaagggaaggagctaaagtgcggcagtgggatatttgtgactaatgaggtgcatacttggaccgagcaatacaagttccaggcagacagtcccaaacgcctggctaccgccatcgccggtgcgtgggagaacggggtgtgcggcatcaggagcacaacgcgcatggagaatctgctatggaagcaaatcgcgaacgagctgaactacattttgtgggagaacaacatcaagctcactgtggtagtcggagatatcatcggcgtcctggagcagggaaagagaacgttaacaccccaaccgatggaactcaagtactcatggaagacctggggcaaggccaaaattgtgacggccgaaacgcaaaacagctcctttatcatcgatggcccgaatacacccgaatgcccctcagcatcccgcgcgtggaacgtctgggaggtggaggactatggattcggtgtgttcaccacaaacatctggctgaagttacgcgaggtctacacccagctctgtgaccacaggctgatgagcgccgccgtgaaggacgagcgggccgtccacgctgacatggggtactggatcgagagccagaaaaacgggtcctggaagctggagaaggcgagcctcatcgaggtcaagacctgcacctggcccaaatcccatactctctggagcaatggcgtgctagaatccgatatgatcatcccgaaatcgctcgccgggcccatctcccagcacaaccaccgccccggctatcacacccagaccgccgggccttggcacctggggaaacttgagctagacttcaactactgtgaaggcaccaccgtggtcatcacggaaaactgcgggacccggggccccagcttacgcacgacgactgtatccgggaaactgatccatgagtggtgctgccggagctgcacactgccacccctacgctacatgggggaggatggatgctggtatggaatggagatccgtccgatctccgaaaaggaggaaaatatggtaaagtcgctggttagcgccggctcagggaaggtggacaacttcactatgggcgtattgtgtctggctatcctgttcgaggaggtgatgagggggaagttcgggaagaagcacatgatagcaggggtgttcttcacgttcgttctgctgttatcgggccagataacgtggcgggatatggcccacaccctgatcatgattggcagtaacgcctctgaccgcatgggcatgggggtgacatacctggcgctgatcgctaccttcaaaatccagccgttcctcgctctgggcttcttccttagaaaactcactagccgcgagaaccttctgctcggtgtgggacttgccatggccactacgctgcaacttcccgaggacatcgagcagatggcaaatggtatcgcgctgggccttatggcactaaaattgatcacacagttcgagacctaccagctgtggaccgccctcattagtctgacgtgctcgaataccatgttcacgctcacggtggcatggcggacggcgactcttattctggcaggggtgtccctgctccccgtatgccagagctcctccatgcgtaagaccgactggctgccgatggcagtagccgccatgggagttccgcccctgccactcttcatcttctcattaaaggacaccctaaagcgaagaagctggcccctcaatgagggggttatggctgtcggattagtgagcatcctggcatccagcctactgcgtaacgacgtgcccatggccggccccttggtcgcagggggcctactgattgcttgctacgtaataacgggtaccagtgcggatctgaccgtggaaaaggctgcggacatcacctgggaggaggaagctgagcagaccggggtctcccacaacctcatgataacggtggatgacgatgggaccatgcggattaaggacgacgagactgagaatattttgaccgttcttctgaagacagccctgctaatcgtctccggcgtgttcccctacagcattccggccacgctcttggtgtggcatacctggcagaagcaaacacaacgctccggagtcctgtgggatgtgcctagtccgcctgagacccagaaggccgagttggaggaaggggtataccggatcaaacaacagggcatattcgggaagacccaggtcggcgtgggggtgcagaaggagggtgtgtttcacaccatgtggcacgtgacccgcggagccgtgctgacttacaacggtaaacggttagagccaaattgggcatccgtcaaaaaggacttaatctcttatggcgggggctggagactatccgcccagtggcagaagggggaggaggtccaagtcatagctgtcgaaccgggaaagaaccccaagaacttccagacaatgccggggacctttcagacaacaactggggagattggagccatagccctggactttaaacccgggaccagcgggtcccccatcattaacagagaagggaaagtggtggggctttatggcaatggggtcgtgactaagaacggcgggtacgtgagtgggatcgcccagacaaatgccgagcccgatggcccaaccccagagctcgaagaagagatgtttaagaagagaaaccttactatcatggatctccaccccgggtctggcaagacgcggaagtacttgcctgctatcgtacgcgaggctatcaagcggcgcctgcggacgttgatcctcgctccaactcgtgtggtagctgcggagatggaggaggcactgaaagggctgcccataaggtaccagacaaccgccacgaagtcggaacacaccggccgcgagatcgtcgacctcatgtgccacgctaccttcactatgcggttgctgagccccgtgcgcgttccaaactacaacctcataatcatggacgaggcccacttcacggaccccgcgtccattgccgcccgggggtacatcagcacccgcgtaggcatgggcgaagcagcggccatctttatgacggccactccgccagggacggcggatgccttccctcagtccaatgcgcccatccaggacgaggagcgggacatccccgaacggtcatggaactcaggcaatgagtggataacggacttcgccgggaagaccgtgtggttcgtaccctctatcaaggccggcaacgacatcgcaaactgcctccgcaagaacggcaaaaaggtcatccagctgtcccggaagaccttcgacaccgagtatcagaaaaccaaactcaacgactgggactttgtggtgaccacggacattagcgagatgggtgcgaatttcaaggcggacagagtgattgaccccaggcgctgtctaaagccggtgatcctcactgatggtccggagcgagtgatcctcgctggtccaatgcccgtgacggcagcatccgcggctcagaggaggggccgagtcgggcggaacccgcagaaggaaaacgaccagtacatattcaccgggcagcctctgaataacgacgaggaccacgcccattggaccgaagctaagatgcttttggataatgtgaacacccccgaaggtattatccccgcactgttcgagccggagcgcgagaaatccgctgccatcgacggcgaatatcgtctgaaaggggaaagtaggaagacgttcgtcgagttaatgcggagaggagatctgcccgtatggctggctcacaaagtcgctagcgaggggatcaagtacaccgatcgtaagtggtgcttcgacgggcaacgcaacaaccaaattctagaggagaacatggatgtggaaatctggacgaaggagggtgagaaaaagaaattgcgaccgcgctggctggatgcgcgcacctactccgatcctttagcgctgaaagagttcaaggactttgccgccggcagaaagagcatcgcccttgacttggtaacggagataggccgagtcccgtcccacctggcccacagaacccgcaacgcactggacaacctcgtgatgctgcatacttcagaacatgggggccgagcttacaggcacgcagtggaagagttgccggagaccatggagacgctcctgctgctcggccttatgatcctgctcaccgggggcgccatgttgtttatcatcagcggcaagggtatcggcaagacctccatcggactcatctgcgtcattgccagctcaggtatgctctggatggcggagatcccactgcagtggatagcctctgccattgttctggagttctttatgatggtgctcttaattccggagccagagaagcagcggacgccccaagacaatcagctggcctacgtcgtgatcggaatcctcacgcttgccgctatcatcgccgccaacgagatggggctgctcgagactactaagcgcgacctcggtatgagcaaggagcctggggtggtctctcctacgtcctacctcgacgtcgatctccacccggcaagcgcgtggacgctatacgccgtagccactaccgtgatcacaccgatgttgcggcacaccatcgagaactccaccgcgaacgtgagcctagcggcgatcgcaaaccaagccgtggtcctgatgggtctggacaaagggtggcccatctcgaagatggatctcggagtgccgcttctagcgctagggtgctatagccaggtgaaccccctgacgctgaccgcagcagtgttgttactgattacgcactacgcgatcatcggccccggcctccaagctaaggccacacgtgaggcacagaaaagaaccgcggcggggatcatgaaaaacccaacggtcgatggcattatgaccatcgacctggacccagtgatttacgattccaagttcgaaaaacagctggggcaggtcatgctcctggtgctctgcgccgtgcagcttctgctgatgcgcacgagctgggctttatgtgaggcattgaccctcgcgaccggccccataaccacactatgggagggatctcccgggaagttctggaacaccaccatagccgtaagcatggctaacatctttagagggtcttacctggccggtgcgggcctcgccttctccatcatgaagtcggtgggaacggggaagaggggcacaggctcgcagggcgaaacgctcggggaaaagtggaagaagaagctcaaccaactgagccggaaggagtttgatttatacaagaaatccggcataaccgaagtggaccgcactgaggccaaggaggggttgaagagaggcgagatcacacatcatgctgtttcccgcggctccgccaaattacagtggtttgtcgagcgaaacatggtgatcccggaggggagagttatcgacctcggctgcgggagaggcgggtggtcgtactattgtgcgggtctcaagaaagtgacagaggttcgaggctacaccaagggtgggccaggacacgaggagcccgtcccaatgtccacctacggatggaacatcgttaagctgatgagcgggaaagacgtgttctacctcccgcccgagaagtgcgacacgcttctgtgcgacatcggcgagtcctcaccgtctccaaccgtagaagagtctcgcaccattcgggtccttaagatggtggaaccctggttgaagaacaatcagttctgtatcaaagtcctgaacccctatatgccaaccgtaattgaacacctggagcgtctccagcggaaacacggcggaatgctcgtgcgcaaccccttatcacggaacagcacgcacgaaatgtactggatctccaacggcaccgggaacatcgttgcatctgttaacatggtatcccgcctcctgctgaacagatttaccatgactcaccgccggcccaccatcgagaaggacgtcgacctgggagccgggaccagacatgtgaacgccgagccggagaccccgaacatggacgtgatcggggagcgtatcaagcggatcaaagaggaacataacagcacctggcattacgatgatgagaacccctacaagacgtgggcctaccatgggagctacgaagtcaaagcaacgggctccgcctcttctatgatcaacggagtcgtaaagctgctcaccaagccatgggacgtggtgcccatggtcacccagatggccatgacggacaccaccccgttcgggcaacagcgtgtgttcaaggagaaggtggatacccgcactccccggagcatgcccgggaccagacgggtgatgggcattaccgccgaatggttgtggcgcaccctggggagaaataagaagcctcgtctgtgtactagagaggagttcacgaagaaggtccggaccaacgcggccatgggagccgtgttcaccgaggaaaaccagtgggattccgccaaagcggctgtcgaggatgaggacttctggaagttggtggaccgcgagagggaactgcataaattagggaaatgcggcagctgcgtgtacaatatgatgggtaagcgcgagaagaaactaggtgagttcggcaaagccaaggggtctcgtgccatctggtatatgtggctgggcgcccgctacctggagttcgaggcgctagggttcctcaatgaggatcactggttctctcgcgaaaattcctacagcggcgtggagggggagggcctccataagctcggctatattctgcgagacatctctaaaatccccgggggcgccatgtatgctgacgacaccgccggttgggacacccggattacagaggacgatttacacaacgaggaaaagatcacgcagcaaatggaccccgagcacaggcagttagccaacgctatattcaagctcacttaccagaacaaagtggtgaaggtacaacggccgacccccaccggcactgtgatggacattatctcacggaaggatcagagaggctctgggcaggttgggacctatgggctgaacacgttcacgaatatggaggcacagctcatccggcagatggagggtgagggggtcttaagcaaagccgacttagagaatccgcacttacccgagaagaagatcacccagtggctagagaccaagggggtggagcggcttaagcgtatggccatttccggagacgactgcgtggtcaaaccgattgacgatcgttttgccaatgccctcctcgctcttaacgatatggggaaggttcgcaaggatatcccccagtggcagcccagcaaaggatggcacgactggcaacaagtccccttttgctcccatcacttccacgagttaatcatgaaggatgggcgcaaacttgtagtgccgtgcaggccgcaggatgagctgatcggccgggcccgcatcagccaaggggcgggctggtccctcagggaaactgcttgcctgggcaaagcgtacgcccaaatgtggtcactgatgtacttccaccggcgcgacctccggctcgcgtcgaacgcgatctgctccgccgtgcccgtccactgggtgccgacatcccgcaccacctggagtattcacgcgcatcatcagtggatgacgacagaggatatgctaacagtgtggaaccgggtctggattgaggataatccctggatggaggataagacaccagtaacgacttgggaaaacgtgccctacttagggaaaagagaggaccaatggtgcggcagcttgattggtctgacctcgcgcgctacctgggcccaaaacatacctacagcgattcaacaggtcaggagccttattggaaatgaagagttcctggactacatgccgagcatgaaacgttttaggaaggaggaagaatcagagggtgccatctggtaa

SEQ ID NO: 25706 - RNA, 9873 nt, synthetic construct
  misc_feature 1..9873: note = derived and/or modified CDS sequence (opt11) from DENV-3__GU131874__SS-prME
  source 1..9873: mol_type = other RNA
acctccctgtgccttatgatgatactgcccgccgccctggctttccacctcacctcacgggacggggagcccaggatgatcgtgggaaagaacgagcgcggtaagagcctgctgtttaagactgccagtgggatcaatatgtgcaccctcatcgcaatggatctcggcgagatgtgcgacgacaccgtgacctacaagtgcccccacataaccgaggtggaacctgaggacatagactgctggtgcaacctaaccagcacgtgggtgacctatggaacctgcaatcaggccggcgagcgaaggcgggacaaacgctccgtggccctcgcgccccatgttggcatggggttagacacccggactcaaacgtggatgagcgccgagggcgcctggcgccaggtggagaaagtggagacatgggccttacggcaccccgggtttacgatcctcgcacttttcctggcccactacattggcaccagcctcacccaaaaggtggtgatcttcatcctgctgatgctcgtcacgcccagcatgacaatgcgctgcgtcggggtcggcaaccgggacttcgtcgagggcctgtccggggccacctgggtcgacgtggttctggagcacggggggtgtgtgaccaccatggccaagaacaagcccacactcgacatcgagctgcagaagacagaagccacacagctggcgacgctccgcaagctgtgcatagagggcaagatcaccaacatcaccacggacagccggtgccccacccagggcgaggcagtcctgcccgaggagcaggaccagaactacgtctgcaagcacacttacgttgaccgtgggtggggcaacgggtgcggcctcttcgggaagggctccttggtgacctgcgccaagttccagtgcctagagctgatcgaaggcaaagttgtgcagtacgagaacctgaagtacaccgtgataataacggtacacaccggtgaccagcaccaggtgggtaatgagacccagggggttaccgccgagatcacgccacaggccagcaccacggaggcaatcctgcccgagtacggcaccctcggactggagtgtagtccccggaccggtctggacttcaacgagatgatcctcctgacgatgaagaacaaggcctggatggtgcaccgccagtggttcttcgacctgccgctcccctggactagcggcgccaccaccgaaacgcccacctggaacaggaaggagctgctggtgaccttcaagaacgcgcacgccaagaagcaagaagtcgtggtactcggatcccaagagggcgcgatgcacaccgccctgacgggggccaccgagatccagaactccggcggcacttccatcttcgctggccatctgaagtgccgcctcaaaatggacaagctggagctgaaaggcatgagctacgccatgtgcaccaacacttttgttctcaagaaggaggtgtccgagacccagcatgggaccatcctgatcaaggtggagtacaagggcgaggacgccccctgcaagatcccgttcagcaccgaagacgggcagggtaaggcccataacggccgtctgataacagccaacccagtcgtgaccaagaaggaggagcccgtgaacatcgaggcagagccgcctttcggcgagagcaacatcgtcatcggcaccggggacaacgcgctgaagattaactggtacaagaagggctccagcatcgggaagatgtttgaggccaccgcccgaggcgctcgaaggatggccattctcggcgacacggcttgggactttgggtccgtgggcggggtgctcaactcgctggggaagatggtccaccaaatcttcgggtctgcctacaccgccctcttcagcggggtgtcttgggtgatgaagatcggcatcggggtcctgcttacctggatcggcctcaacagcaagaacacctccatgagcttttcctgcattgccatcggaattatcacgctctatttaggcgcggtggtgcaagcggacatggggtgcgtcatcaactggaagggcaaggagctcaaatgcggcagcgggatctttgtgaccaatgaagtgcacacctggaccgaacagtacaagttccaggccgactcccccaagcgcctggccacggccatcgccggcgcgtgggagaacggggtctgtggcatccggagcaccactcgcatggaaaacctgctctggaagcagatcgccaacgaattgaactacatcctgtgggagaacaacatcaaactcaccgtggtggtcggggacattatcggcgtgctggagcaaggcaagcggacgctgactccccaacccatggagctcaaatattcctggaagacgtgggggaaggccaaaattgtaaccgccgagacgcaaaattcttcctttatcatcgacggcccaaacaccccggagtgcccctccacatcccgcgcgtggaacgtgtgggaagtggaggactacgggttcggcgtattcaccaccaacatatggctgaagctgcgggaggtttatacccaactctgcgaccatcgcttgatgagcgccgccgtgaaggacgagcgggccgtgcacgccgatatgggctactggatcgagagccagaagaacggtagctggaagctggagaaggcgagcctcatcgaggtcaaaacctgcacctggccaaaatcccacaccctgtggtcaaacggcgtacttgagagcgacatgatcatccccaagtccctcgctgggcccatctcccagcacaatcaccgcccgggctatcacacgcagacagccgggccgtggcacctgggcaagctggagctcgacttcaactactgcgagggcaccaccgtggtcataaccgaaaactgcggcacacggggccccagcctgcgcaccacgacggtgagcggtaagctgatccacgagtggtgctgtcggagctgtaccctgccgccgctccgatacatgggggaggacgggtgctggtacggcatggagatccgtcccatctctgaaaaagaggagaatatggtcaagtccctggtgtccgcaggctcggggaaggtggataattttaccatgggcgtgctttgcctagccatactgttcgaggaggtcatgcgcgggaaattcggcaaaaagcatatgatcgcgggcgtgttcttcaccttcgtgctcctgctgtccggccaaataacatggcgggacatggcccacactctcatcatgatcggctcgaacgccagtgaccgcatggggatgggcgtcacctacctggccctgatagccaccttcaagatccagccgttcctcgcgcttgggttcttcttacggaagctcacatcacgcgagaacttgctcttgggcgtcgggctggccatggccaccaccctgcagttacctgaagacatcgagcagatggccaacgggatcgcgctgggcctgatggccctcaaactgatcacccagttcgagacgtaccagctgtggaccgccttaatcagcttaacctgctccaacaccatgttcacgctgactgtggcgtggcggacagccaccctcatcctggcgggggtcagcctgctccccgtgtgccagtccagcagcatgcgcaagacggattggctgccgatggccgtcgcagccatgggcgtcccgccactgcccctctttatcttctccctgaaggacaccctgaagcgccggtcttggccgctcaacgagggtgtgatggccgtcggcctggtgagcatcctggcgtccagcttgctgcgcaacgacgtgcccatggcaggccccctggtcgccgggggcctcctgatcgcttgttacgtcatcacaggtacctccgccgacctgacagtggagaaggcggccgacattacctgggaggaggaggccgaacaaaccggcgttagccacaatctcatgatcaccgtcgatgacgacgggaccatgcggatcaaggacgacgagactgaaaacattctgactgtgcttctcaagactgccctgctgatcgtttccggcgtgttcccctacagcatcccagcaaccctcctagtgtggcacacgtggcagaagcagacccaacgctccggcgttctgtgggacgtaccctccccgcccgagacccagaaggcggaactcgaagagggggtgtaccggatcaagcaacagggcatctttgggaagacccaggttggcgtgggggtacagaaagaaggcgtcttccacacgatgtggcatgtgaccaggggagccgtgctgacctacaacggtaagcggttggagccaaactgggcctcggtaaagaaggacctcatcagctacggcgggggctggaggctgtcggcccagtggcagaagggggaagaggtccaggtaatcgcggtcgagcccggcaagaaccccaagaacttccagaccatgcccgggacgttccagaccacaacaggggagatcggcgctatcgctttggacttcaagccggggaccagcgggtcccccatcatcaaccgggagggcaaagtagtggggctgtacggcaacggagtcgtgaccaagaacggcggctatgtatccggcatcgcccaaaccaacgccgaacccgacggcccgacccccgagctcgaggaggagatgtttaagaagcgcaacctgacgatcatggacctacaccccgggtccggcaagacccggaaatacctccccgcgatagtccgcgaggccataaagcggcgcctgagaaccctgatcctcgccccgacccgcgtggtggccgccgaaatggaggaggcactgaaggggctgcccatccggtaccagacgactgccacaaaatccgagcacaccggcagagagatagtggacctcatgtgtcacgcaacatttactatgcggctgttatcacccgtgcgcgtgccaaactacaacctcatcatcatggacgaggcccacttcactgacccggcctctatcgcggcccggggatacatctcgactcgcgtcggtatgggagaggccgccgcgattttcatgacggcaacgccgcccgggaccgccgacgctttcccccagtccaacgcccccatccaggacgaagagcgagacatcccggagcggagctggaactcgggcaatgaatggatcactgacttcgcggggaagacggtgtggttcgtgcccagcatcaaggccgggaacgacatcgccaactgcttacgcaagaacgggaagaaggtcatacagctgtcccggaagacgttcgacacagagtaccagaagaccaagctcaacgactgggatttcgtagtgacgaccgacatcagcgagatgggcgccaacttcaaggccgaccgtgtcatcgacccccggcgctgcctgaagccggtgattctgacggacgggcccgagcgggtcattctcgcggggccaatgcccgtaaccgccgcctccgcagcccagcgcaggggccgcgtggggagaaacccgcagaaggagaacgatcagtacatattcaccggccagcccctcaataacgacgaggatcacgcgcactggacggaagccaagatgctgctcgataacatcaatacccccgaagggatcatccccgcgttattcgagccagagcgcgagaagtccgccgcgatcgatggcgagtaccggctgaagggcgagtcccgaaaaaccttcgtggagctcatgcggcgcggggacctgccggtatggctggcacacaaggtggccagcgagggcattaagtacaccgatcggaagtggtgtttcgacgggcagcgcaacaaccagatcctcgaggagaacatggacgtcgagatctggactaaagagggcgagaaaaaaaaactgcggccccgctggttggacgcccgcacctacagcgatcccctcgccctgaaggaattcaaggacttcgcggccggccgtaagagcatcgcgctggacctcgtgactgagatcgggcgcgtgccgtcccacctggcccaccggacccgcaacgccctggacaacttagtgatgctgcacaccagcgagcacggcggacgggcgtaccgacacgccgtggaggagctgcccgagacaatggagaccctactgctgctaggcctgatgatcctgcttaccgggggagccatgctgttcctgatatcgggcaaggggatcgggaagacttccatcgggcttatctgcgtcatcgccagctccggcatgctctggatggcggagattccgttgcagtggattgcgagcgcgatcgtcctcgagttcttcatgatggtgctgctgatcccggagcccgaaaagcagcggacgccccaggacaaccagctcgcctacgtcgtcattggcatcctgaccctggccgccatcatcgcggccaatgagatgggcctactggagaccacgaaaagagacctaggcatgtccaaggagcccggggtggtgagcccgacctcctacctcgacgttgacctgcaccccgcctcggcctggactctgtacgcggtggctaccacagtgatcaccccaatgctccggcacaccatcgaaaacagtaccgccaacgtaagccttgccgccatcgcgaaccaggccgttgtgctaatgggcctcgataaagggtggcccatctccaagatggatctgggcgtacccctgctcgccctggggtgctactcccaggtgaacccccttacgctcacagccgccgtgctactgctcatcacccactacgcgatcattggcccgggcctgcaggcaaaggccacccgcgaagcccagaaacggacggccgccggtatcatgaagaaccccaccgtcgacggcatcatgaccatcgacctggacccggtgatatacgattccaagttcgaaaagcagttgggccaggtgatgctactggtattgtgcgccgcgcagctgttattgatgcgcaccagctgggccctgtgcgaggcgctgacgctcgccaccggccccatcaccacactgtgggagggcagtcccgggaagttctggaacacgacaatcgctgttagtatggcaaacatcttccgtggctcctatctggccggggcgggcctcgcgttcagcataatgaagtccgtggggaccggcaagcgcggcacagggagtcagggcgagaccctgggggagaagtggaagaagaagctgaaccaactcagccggaaggagttcgacctgtacaagaagtccggcataacggaagttgaccgcactgaggccaaagaggggttgaagcgcggcgagatcacccatcacgcagtgagccgcggttccgccaagctccagtggtttgtggaacggaacatggtgatacccgaggggcgagtgatcgatcttggctgcgggcggggaggttggagctactactgcgcgggactcaagaaggtgaccgaggtccgcgggtacacgaagggcgggccgggccacgaggagcccgtgcccatgagcacatacggctggaatatcgtgaagctcatgagcgggaaggacgtattctacctgccgccggaaaagtgcgacactctgctgtgcgacatcggcgagtcgtcaccttcccccaccgtggaggagagccgcacgatcagggtgctcaagatggtcgaaccctggctgaagaacaaccaattctgtatcaaggtactgaacccgtacatgcccacggtgattgagcacttggagcgcctccaacggaagcatggcggcatgctggtccgtaaccccctctcccggaacagtacccacgagatgtactggatctccaacgggaccgggaacattgtggccagcgtgaacatggtctcccgcctgctgctcaaccggttcacgatgacccaccgccggcccaccatcgaaaaggacgtggacctaggagctgggacccgccacgtgaacgccgagcctgagacgcctaacatggacgtcataggggagcggatcaagcgcatcaaggaggagcacaacagcacctggcactatgacgacgagaacccctacaagacctgggcctaccacggcagttacgaggtcaaagcgaccgggagcgcctccagcatgataaacggggtggtcaagctcctcacgaagccatgggacgtggtccccatggtcacccaaatggccatgaccgatacaacgcccttcgggcagcagcgggtgttcaaggagaaggtcgacacccgcacgccccggagcatgccagggacacgacgggtcatgggaatcacggccgagtggctatggcgcaccctggggcggaacaagcgcccccgcttatgcactcgggaggaattcacaaagaaggtgcgcacgaacgcggcgatgggcgccgtgttcacggaggaaaaccagtgggactccgccaaggccgcggtggaggacgaggacttctggaagctggtggaccgggagcgcgagttgcacaaactcgggaagtgcggcagctgcgtctacaacatgatgggaaagcgtgagaagaagctgggcgagttcggcaaggccaagggatcccgcgcaatctggtacatgtggcttggcgcccggtacctcgagttcgaggccctggggttcctgaacgaagaccactggttcagccgcgagaactcctactcaggtgtggagggggagggcctccacaagctggggtacatcctgcgggacatctccaagatccccgggggcgctatgtacgccgacgacaccgcggggtgggatacccgcatcacggaggacgacctccacaacgaggagaagattacccagcagatggatcccgagcaccgacagctggcgaatgccatcttcaaactgacctaccaaaataaggtggtcaaggtgcagcgaccgacccctacgggcacggtgatggacatcatcagcagaaaagaccagcgcggctccggacaggtcggcacctacggtctcaacaccttcaccaacatggaggcgcagcttatccgacagatggagggcgagggggtgctaagcaaggccgacttggagaacccgcacctgcccgaaaagaagattgcgcagtggctggagacgaagggcgtggagcgactcaaacggatggccatcagtggcgacgactgtgtcgtgaagccgatcgacgaccgattcgccaacgccctgctggcgctcaacgacatggggaaggtacggaaggacatcccccagtggcagcccagtaagggctggcacgactggcagcaggtccccttctgctcccaccacttccacgagctcatcatgaaagatggtcgcaagctggtggtaccatgccggccccaggacgagctaatcggccgcgcgcgcataagccaagggtccggctggagcctgcgggagaccgcctgcctgggcaaggcgtacgcccagatgtggtccctcatgtactttcaccgccgggaccttcgcctggcaagcaacgccatctgcagtgcagtccctgtgcactgggttccgacctcacgcaccacatggagcatccacgcgcaccaccagtggatgaccaccgaggatatgctcgcggtctggaaccgcgtgtggattgaggacaacccgtggatggaggataagaccccggtgacgacctgggagaatgttccgtacttagggaagcgggaagatcagtggtgcggcagccttatcgggctcaccagccgggccacctgggcccagaacatccctacggccatccaacaggtgcggtccctgatcggcaacgaggagttcctggactacatgccgtcaatgaagcgcttccgcaaggaggaggaatccgagggggcaatatggtga

SEQ ID NO: 25707 - RNA, 9873 nt, synthetic construct
  misc_feature 1..9873: note = derived and/or modified CDS sequence (opt11) from DENV-3__GU131875__SS-prME
  source 1..9873: mol_type = other RNA
accagcctctgcctcgtgatgatcctgcccgccgcactggcgtttcatttgacgagtagagacggggagccccggatgatcgtggggaagaacgagagaggtaagagcctgctgttcaagacggcatccggtatcaatatgtgcaccctcatcgccatggacctgggggagatgtgcgacgacaccgtaacttacaagtgcccccatataacggaggtggagcctgaggacatcgattgctggtgcaacttaacaagcacctgggtcacctacgggacgtgcaaccaagccggggagcggcgccgagacaagcgctcggtggccctcgcgccgcacgtggggatggggctggacacccggacccaaacctggatgtccgctgagggcgcgtggaggcaagtcgagaaagtggagacatgggcactgcggcatccgggcttcaccatcctcgcgctattcctggcacattacattggcacctctctcacccagaaggtggtcatcttcatcctactgatgctcgttacgccctctatgacaatgcggtgcgtgggagtaggcaaccgggactttgtggaggggttatcaggtgccacctgggtcgatgtcgtcctagagcatggtgggtgcgtgaccacgatggccaaaaacaagcctactctcgatatcgagctgcagaagaccgaggcgacacagctggcaacgcttcggaagttatgcatcgaaggaaagataaccaacattaccaccgacagcaggtgccccacgcaaggcgaagcagtcctcccggaggaacaagaccagaactacgtgtgcaagcacacctatgtggaccgtgggtggggcaacggttgtggccttttcgggaaggggagtctggtgacctgcgctaagttccagtgcctggagcccatcgagggtaaagtcgtacagtacgagaacctcaagtacaccgtcatcatcacggtgcacacgggagaccaacaccaggtcggcaatgaaactcagggggtgaccgccgagatcacgccccaggccagcactactgaagcgattctgccggagtacgggaccctggggctcgagtgctccccccggaccgggttagacttcaacgagatgatcctgctcacgatgaagaacaaggcatggatggtgcaccgtcaatggtttttcgacctgcctctgccttggacctcaggcgccacaacagaaacccccacctggaaccggaaagagctactggtcaccttcaagaacgcacacgccaagaagcaagaggtggttgttctggggtcccaggagggggcgatgcatacggccctcacgggggctacggaaatccagaacagtggggggacctcgatcttcgctggtcatctgaaatgccgcctaaagatggacaagctcgagttaaagggcatgtcgtacgccatgtgcacgaacacattcgttctgaagaaggaggtgtccgaaacgcagcatgggaccatactaatcaaggtagagtaccgaggcgaggacgccccgtgtaagatcccgttctcgaccgaggacgggcaggggaaggcccataacggccgccttataacggctaatcccgtggtgaccaagaaggaggagccagtcaacatagaggccgagcccccgttcggtgaaagcaacatagtgatcggaatcggggacaacgcgctaaagattaactggtataaaaagggctccagcatcggtaagatgttcgaggccaccgcccggggcgccaggcggatggccattcttggcgacacggcctgggattttgggtccgtgggcggggtcttaaacagcctaggcaagatggtgcaccagattttcgggagcgcctatactgccttattctcaggcgtttcatgggtcatgaagatcgggatcgggatcttgctaacttggattggactgaactcgaaaaacacaagtatgtctttctcgtgtatcgccattggaatcatcaccctctacctgggggccgtggtgcaggcggacatgggctgcgtcatcaactggaagggcaaggagcttaagtgcggcagcgggatcttcgtgacaaacgaggttcatacctggaccgagcaatacaagttccaggctgactcccccaaaaggttagccaccgccatcgcaggcgcgtgggagaacggggtctgcggcatccgcagcacgactcggatggaaaacctactgtggaagcagatcgccaacgagctcaattacatcctgtgggagaataacatcaagctgaccgtggttgtaggtgacataatcggtgtgctcgagcaggggaaacgcaccctaactccacagccgatggagctgaagtatagttggaagacctgggggaaggctaagatcgttaccgccgagacccaaaactctagcttcataatagatggacctaacaccccagagtgccctagcgcatcccgcgcctggaatgtttgggaggtggaggattacgggttcggcgtgtttaccacaaatatttggcttaagctgagggaagtctacacgcagctgtgcgaccacagactcatgagcgccgcagtgaaggacgagcgcgccgtccatgcggacatgggctactggatcgagagccagaaaaacggaagttggaaactggagaaggcctctttgatcgaggtcaagacctgcacctggccgaagtcccataccctctggagcaatggcgtgcttgaaagtgacatgatcatccccaagtcgctggctggtcccatatcgcagcacaaccaccggccggggtaccacacccaaaccgccgggccatggcacttgggaaagctggagctcgacttcaactattgtgagggtacgaccgtcgtcattaccgagaattgcggaaccaggggcccctcccttcggacaaccaccgtgagtgggaagctgatccatgaatggtgctgcaggtcgtgcacgctgcccccgctccgctacatgggcgaagacgggtgctggtatggcatggaaatcaggcccatctccgagaaggaggagaatatggtcaagtccctggtctccgccggctctggcaaggtcgacaacttcacgatgggcgttctgtgcctcgctatcctgtttgaggaggtcatgcgggggaagttcggcaagaagcacatgatcgccggagtgttctttaccttcgtgctcctcctgtcaggccagataacatggcgcgacatgactcacacgctgatcatgatcggcagcaacgccagtgaccggatggggatgggcgtcacctacttggccttaatcgccacttttaagatccagccattcctggcgttaggtttcttcctgcgcaagctaacgagccgggagaacctcctgttaggcgttggcctcgccatggccacgaccctacagcttcccgaggacatagagcagatggctaacgggatcgcgctcggcctgatggccctcaagctcatcacgcaattcgagacataccagctgtggaccgcactgatctccctgacatgctccaacaccatgttcaccctcacggtggcttggcgcaccgcgaccctgatcctcgcgggggtcagcctgctgcccgtatgccagtcctcttccatgaggaagaccgactggctacccatggccgttgcagccatgggagtgccgcccctccccctgtttatcttctctctcaaggatacccttaagcggagatcctggccccttaatgagggggtgatggctgtcggcctcgtgagcattctggcttccagtttgctacggaatgacgtgcccatggcgggcccacttgtcgccgggggcctgctcatcgcctgctatgtgatcaccgggacctccgccgatctaaccgtcgagaaggctgctgacatcacctgggaggaggaagccgagcaaaccggggtcagtcacaacctgatgataaccgtggacgacgacggaaccatgcgcataaaggatgatgagacggagaatatcctcactgtgctgttaaagaccgcccttctgatcgtatccggcgtcttcccgtacagcatccccgccactttactcgtctggcacacctggcagaagcagacgcagcgctccggcgttctgtgggacgtgcccagtccgcccgagacccagaaagcggagttggaagagggggtgtaccgcattaagcagcagggaatatttgggaaaacgcaggtcggggtgggggttcagaaagagggggtttttcatacgatgtggcacgtcacgcggggcgcggtgctcacctacaacgggaagcgcctggagccgaactgggcatccgtcaagaaagatctgatcagctacggcgggggctggcggctctcagcacagtggcagaagggggaggaggtacaggtgatcgcggtcgagcccggaaaaaaccccaagaacttccaaaccatgcccggcacgttccagacgacgaccggcgaaatcggtgccatagccctggacttcaaaccgggcacctctggaagccccatcatcaacagggagggcaaggtggttgggttatacggcaacggggtcgtgacgaagaacggggggtatgtgtccggcatcgcccagaccaacgccgagcctgatggcccaacccccgagctggaggaggagatgtttaaaaagagaaacctcaccatcatggacctccaccccgggagcggcaagactcgcaaatacctaccagctatcatccgggaggcaataaaaaggcggttacgcaccctaatcctggcccccacccgtgtcgtggccgccgagatggaggaagctctcaagggtctgcctatacgctatcagacaacggcaaccaagtccgagcacaccgggcgggagatcgtggacttaatgtgtcacgcgacctttacgatgcgactcctgagccccgttcgggtcccgaactacaacctgatcatcatggacgaggcccacttcaccgaccccgcatccatcgccgctcgggggtacataagcacccgcgtaggaatgggtgaagctgccgccattttcatgaccgcaacgccgccaggaaccgccgacgccttcccgcagtccaacgcccccatacaggatgaagagcgcgacatccccgagagaagctggaactccggcaacgagtggatcactgactttgcggggaagacagtctggttcgtgcccagcatcaaggccggaaacgacatcgccaactgcctacggaagaatgggaagaaagtgatacagctgtcccgcaaaacgttcgacacagaataccaaaagaccaagctgaatgactgggactttgtcgtaacgacggacatctcggaaatgggtgccaacttcaaggtggaccgggtcatagacccgcgacggtgcctaaagcccgtgatactgaccgacgggcccgagagggtgatcctggcgggacccatgccggtcaccgcggcctccgcagcccagcggcggggccgggtggggcgcaatccccagaaggagaacgaccagtacattttcacaggccagcccctcaacaacgacgaggaccacgcgcactggacagaggcgaagatgctgttagataacatcaacacgcccgagggaataatcccggccctcttcgagcccgagcgagaaaagtccgccgccatcgacggcgaataccgactgaagggcgagtcccggaagaccttcgttgaactgatgcgtcgcggagatctgcccgtttggctggcgcacaaggtcgccagcgagggaatcaagtataccgaccgcaagtggtgcttcgacgggcagcggaacaaccagatcctagaagagaatatggatgtcgagatctggaccaaggagggtgagaagaagaaactgcggccccgctggctagacgccagaacctactctgatccgcttgccctaaaggagttcaaggacttcgccgcgggccgcaagagcatcgccctagacctggtgacagagatcgggcgggtgccaagtcacctcgcccataggacccggaacgcgctggacaatcttgtcatgctccacactagcgagcacggcggtcgcgcttaccgtcacgcggtggaggagctgcccgagacgatggagaccctgctcctgttaggcctcatgatcctgctgaccgggggagccatgctgttcctcataagcgggaaggggatcggcaagacctccatcgggttaatctgcgtgatcgccagcagtggaatgctctggatggccgagatcccgctccagtggatagcctcagcgatcgtcctggaattcttcatgatggtgctgcttattcccgagcccgagaagcagaggactccgcaggataaccaactggcctacgtggtcattgggatcctcaccctggccgccatcatcgccgccaacgagatgggcttacttgagaccaccaagcgggacctgggaatgtcgaaagagccgggggtggttagtcccacgagctacctggatgttgacctccaccccgcgtccgcctggaccttgtacgcagttgcgacaaccgttatcacgcctatgttgagacacaccatcgagaacagtaccgccaacgtgagcctcgccgccatcgccaaccaggctgttgtactgatgggcctagacaagggttggcctatctcaaagatggatcttggcgtccccctcctggctctcggctgctacagccaggttaatcccctgaccttgacggccgcagtgctactgctaatcacccattacgccatcatcggccccgggttacaggcgaaagcgacccgggaggcacagaaacgcaccgcggctgggattatgaagaacccgacggtcgacggcatcatgaccatagacttagaccctgtgatctacgacagtaagtttgagaagcagcttggccaggtgatgctcttagtgctgtgcgctgttcaactcttgctgatgcgaacctcctgggccctctgcgaggccctaacactggcgactggcccgatcaccactctatgggagggctcccccggaaagttctggaacacgacgattgcggtgagcatggccaacatcttccgcggctcctacttggccggggcaggactggcgtttagcatcatgaaatccgtgggtactggcaaacgtggtactgggagccagggcgagaccttgggggaaaagtggaagaagaaactgaaccagctatcccgcaaggagttcgacctctacaaaaagtccgggatcaccgaggtggaccgcacggaggcgaaggaagggctaaagcgcggcgagataacccaccacgccgtcagtcggggctcagcgaagttacaatggtttgttgaacgcaacatggtgatcccagagggccgggtgattgacctcggctgcggacgcggcgggtggagctactactgtgccggcctgaaaaaggtcaccgaagtgcgcggctacaccaagggtgggcccggccacgaggagccagttcccatgtccacatatggctggaacatcgttaagctaatgtccgggaaagacgtgttctacctcccgccggaaaaatgcgacacgctgctgtgcgacatcggtgagtccagcccctcgcccaccgtggaggagagccggaccatccgcgtcctgaagatggtggaaccgtggcttaagaacaatcagttctgcatcaaggtgctcaacccatatatgcccacggtcatcgaacacctggagcgactccagcgcaaacacggggggatgctggtacggaaccccctgagtcggaacagcacgcacgagatgtactggatctccaacggcaccgggaacattgtggctagtgtaaatatggtatcccggctactgttgaaccgcttcacaatgacgcatcggcgcccgaccatcgagaaagacgtggatctcggcgcgggaaccaggcatgtaaacgccgagcccgagacccccaacatggatgtgatcggggagcgaatcaaacgcatcaaggaggagcataacagcacgtggcactatgacgacgagaacccttataagacctgggcttaccacggctcgtacgaggtgaaggccaccgggtctgccagcagcatgatcaacggagtcgtgaagctgctaaccaagccctgggacgtcgtccccatggtgacgcagatggcgatgaccgacaccaccccgttcggacagcaacgggttttcaaagaaaaggtcgacacgcggaccccgaggagcatgcccggcacacgtcgcgtgatgggcatcaccgctgagtggctctggcggacgctggggcgcaacaagaagccccgcctctgcactagggaggagttcacaaaaaaggtccgcaccaacgccgccatgggtgcggtgttcacggaagagaaccagtgggattcagccaaggccgccgtggaggacgaggacttctggaagctcgtcgaccgggaaagagaactgcataaactggggaagtgtggcagctgcgtctacaatatgatgggcaagcgggagaagaaattgggagagtttgggaaggccaaggggtcccgggcaatctggtatatgtggctgggcgcgcgttatctggagtttgaggccctcgggttcctgaacgaggaccactggtttagccgtgagaactcctacagcggcgtggagggtgagggcctgcacaagcttggctacattctccgggatatctccaagatcccgggcggcgcgatgtacgctgacgacaccgccgggtgggatacccgcatcacggaggacgacctgcacaacgaggagaagattacgcagcagatggaccccgagcaccggcaactcgccaacgccatctttaagttaacctatcagaacaaggtcgtgaaggtccagagaccgactcccaccgggaccgtaatggacatcattagccgaaaggatcagcggggctccggccaggtcggcacgtacgggctgaacaccttcacaaacatggaggcccagctcatccgacagatggaaggagagggtgtgctgagcaaggccgacctggagaacccccatttaccggaaaagaagatcactcaatggctggagacgaagggcgtcgagcgtttaaaacggatggcgatctccggtgatgactgtgtggtcaagccaatcgacgaccgtttcgccaacgctctcctggcactcaacgacatggggaaggtccggaaagatataccccaatggcagccctcaaagggctggcatgactggcagcaggtcccgttctgctcccaccacttccacgagctcatcatgaaggacgggcgcaaactggtggtcccctgccggccccaggatgaactcattggccgcgccagaataagccaaggggcgggctggtccctacgtgagacggcctgtctaggcaaggcctacgcccagatgtggagcctcatgtatttccatcgccgggatttacgccttgcgtccaacgccatctgcagcgccgtgcccgtgcattgggtaccaacctccaggaccacgtggtcaattcacgcccaccaccagtggatgactaccgaggacatgctgacagtttggaaccgcgtgtggatcgaggacaatccctggatggaggacaagacgcccgtcacaacctgggagaatgtgccctacctcgggaagcgtgaggatcagtggtgcggaagcttaatcggtctgacctccagggcgacttgggctcagaacatcccgaccgccatccagcaggtacggagcctcatcggcaacgaggagttcttggattacatgccttccatgaagcgattccggaaagaggaggagtccgagggtgccatctggtga

SEQ ID NO: 25708 - RNA, 9873 nt, synthetic construct
  misc_feature 1..9873: note = derived and/or modified CDS sequence (opt11) from DENV-3__GU131877__SS-prME
  source 1..9873: mol_type = other RNA
acctctctgtgcctaatgatgatcctgccagccgccctggcgttccacctcaccagccgggacggggaaccccggatgatagttgggaagaatgagcgaggcaagagcctgctgtttaagaccgcctcagggatcaacatgtgcaccctcattgccatggacctgggcgaaatgtgcgatgacaccgtgacctacaagtgcccccacattaccgaggtggagccggaggacattgactgctggtgcaacctgaccagcacctgggtcacctacgggacgtgcaatcaggccggcgaacggcgccgggacaagcgctccgtggcattggcgccgcacgtgggcatggggctggacacccgtacccagacttggatgagtgccgagggagcctggcgacaggtggagaaggtggagacgtgggccctgaggcacccggggttcaccattctcgcccttttcctggcccactacatcggaacctctctcacccagaaggtggtgatttttatcctactgatgctcgtcacgccctctatgaccatgcggtgcgtgggagtgggcaaccgggacttcgtcgagggcctgtccggggccacctgggtggacgtggtcctggaacacggcgggtgcgtgaccaccatggccaagaacaagcccaccctcgacatcgaactgcagaagaccgaggccacgcagctggccacgctccgcaagctgtgcatcgaaggcaagatcaccaacatcaccaccgacagccggtgccccacgcagggcgaggctgtactgcctgaggagcaggaccagaactacgtgtgtaagcatacctacgttgacagggggtggggcaacgggtgcggcctcttcggtaaaggttccctggtgacctgtgccaagttccagtgcttagagcccatcgagggcaaggtcgtgcagtacgagaacctcaagtacaccgtgatcatcacggtccacaccggggaccagcaccaggtgggcaacgagacccaaggggttaccgccgagatcacgccccaagccagcaccaccgaggcgatactacccgaatatggcaccttagggttggaatgctccccgcggacaggcctcgacttcaacgagatgatcctactcacgatgaagaacaaggcctggatggtacatcgccagtggtttttcgacctgcccttaccctggaccagcggggccaccacggagacgcctacttggaaccggaaggagctattggtgacctttaagaacgcccacgccaagaagcaggaggtcgtggtgctggggtcccaggagggcgcgatgcacaccgctctcacgggtgctacggaaatccagaacagcggtggtaccagcatcttcgcaggccacttaaagtgccgcctgaagatggacaagctcgagctgaagggcatgagctatgccatgtgcaccaacacgttcgtcctgaagaaggaggtgtccgagacgcagcatgggaccatcctcattaaggttgagtatcggggcgaggacgctccctgcaagataccattctcgaccgaggacgggcaaggcaaggcccacaacggccgcctgatcacggccaatccggtcgtgaccaaaaaggaggaacccgtgaacatcgaggccgagccgccctttggggagtcgaatatagtcatcggaataggggacaacgccctgaaaatcaactggtacaagaagggttcgagcatcggtaaaatgttcgaggcaacagcacggggcgcccgtcgcatggcaatcctcggcgacactgcgtgggacttcgggtccgtgggcggggtgctcaacagcctgggtaaaatggtccaccagatcttcgggtccgcctacacggccctgttcagcggcgtgtcctgggtgatgaagatcggcatcggggtcctcctgacctggatcggcctgaacagcaagaacaccagcatgagcttctcctgcatagccatagggatcatcaccctatacttgggcgccgtggtccaggcggacatggggtgcgtcatcaactggaagggcaaggagctgaagtgcggctcagggatcttcgtgactaacgaggttcacacctggacggagcagtacaaattccaggctgactcccccaagcgactcgccacggctatagccggcgcgtgggagaatggggtctgcggcatcagaagcactacccgcatggagaacctgctgtggaaacagatcgccaatgagctcaattacatcctgtgggagaacaacatcaagctgactgtggtagtcggagacatcatcggcgttctcgagcagggtaagcgcaccctgactccacagccgatggagctgaagtactcctggaaaacatgggggaaggccaagatcgtaaccgccgaaacccaaaacagctccttcatcattgacgggcccaacacgcccgagtgcccatctgcgtccagggcctggaacgtctgggaggtagaggactacgggttcggcgtgttcaccactaacatctggctcaagctgcgcgaggtatacacccagctgtgtgaccatcggctcatgagcgccgccgtgaaggacgagcgtgccgttcatgcggacatgggctactggatagagagccagaagaatgggtcttggaagctcgagaaagcgtcactgatcgaggtcaaaacctgcacttggccgaagtcccacaccctatggtcgaacggcgtgctggagtccgacatgatcatccccaagagcctggccgggcccatctcccagcacaaccatcggcccggctaccacacccagaccgccgggccctggcatctcggcaagctggagctggacttcaattactgtgagggtacgaccgtcgtcatcaccgagaactgcgggacccgtggcccatcgctccggacaaccaccgtatccggcaaactaatccacgagtggtgttgccgcagctgcaccctgcccccgcttcgttacatgggtgaggacgggtgctggtacggcatggagatccgccccatctccgagaaggaggagaacatggtcaaatccctggtctccgctgggagcgggaaggtagacaatttcacgatgggcgtgctgtgcttagtcatcctgtttgaggaagtgatgcgggggaaatttggcaagaagcacatgattgcgggggtgttctttactttcgtcctgctcctgtccggccagatcacctggagggacatggcccacaccctgatcatgatcggctcgaacgcctcagaccggatggggatgggcgtgacgtacctcgccttaatcgccactttcaagatccagccctttctggcgctaggattcttccttagaaaactgaccagccgtgagaacctcctgctcggcgtgggcctcgccatggccaccacgctgcagttacccgaggacatcgagcagatggctaacgggatagcgcttggcctgatggccctgaagctcattacccaattcgagacctaccagctgtggacagccctgatcagcctcacctgctccaacaccatgttcaccttaaccgtcgcgtggcgcaccgccaccctgatcctcgcgggtgtgagcctgcttccggtctgccagtcaagcagtatgcgcaaaaccgactggctgcccatggccgtggccgccatgggcgtgccgcctctcccgctgttcatattcagcctgaaggacaccctgaagcggcgctcgtggcccctcaacgaaggagtcatggccgtaggtcttgtatcaatcctggcgtccagccttctccggaacgacgtccccatggccggccccctggtggcagggggcctgttaatcgcatgctacgtgataacggggacctcagccgacctgaccgtcgagaaggcggccgacataacgtgggaggaagaagcggaacaaacgggcgtgagccataacctgatgatcaccgtagacgacgacggtaccatgcgcattaaggacgacgagacggagaacatcctcaccgtcctgttaaagactgccctcctgatcatctccggcgtgttcccgtacagcatccccgccaccctgttggtgtggcacacctggcagaagcagacccagagatccggcgtcctgtgggacgtgcccagtccgcccgagacacagaaagccgagctcgaggagggggtgtaccggatcaaacagcagggcatcttcggaaagactcaggtcggcgtgggggttcagaaggagggcgtcttccacaccatgtggcacgtgacccgcggcgcggtcctcacgtacaatgggaagcgcctcgaaccaaactgggcgagcgtcaaaaaggacctcataagctacggcggggggtggcgattatccgcccagtggcagaagggggaagaggtccaggtgatcgcagtcgaacccggcaagaaccccaagaatttccagaccatgcccgggaccttccaaactacgaccggagagataggtgccatagcactggacttcaagccggggacgagcggctcgcccatcatcaaccgcgagggcaaggtggtgggactatacggtaacggggtagtgacaaaaaacggcggatacgtgagtgggatcgcacagacgaatgccgagccggacggccccacccccgagttagaggaggagatgttcaagaagcggaacttaaccataatggatctgcaccccggtagcggcaagacccgcaagtacctgccggctatcatacgtgaggccatcaagcgccggttgcggacgctgatattggcgccgacgcgggtagtggccgcagaaatggaggaggccctcaagggcctgccaatccgctaccagaccaccgccacgaagtccgagcacaccggccgggaaatcgttgacctgatgtgccacgccaccttcaccatgcgcctcctgagccccgtccgggtgccgaactacaacttgatcattatggacgaggcacacttcacggaccccgcctctatcgctgcccgcgggtatatcagcacacgcgtgggcatgggggaggccgccgcgatctttatgaccgcgactccgcccgggacggccgacgccttcccgcagtctaacgcccccatccaagacgaggaacgggacatacccgagcgctcatggaactccggcaacgagtggatcaccgacttcagcgggaagaccgtgtggttcgtgccctcaatcaaggcgggcaatgacatcgccaactgcctccggaagaacgggaagaaggtgatccagctgagccgcaaaaccttcgacacggagtaccagaagaccaagctgaatgactgggacttcgtagtgaccaccgacatctccgagatgggcgccaacttcaaagcagaccgggttatcgacccgcgtcggtgcctaaagccagtgatcctgacggacggccccgagcgcgtgatcctcgccgggcctatgccggtgaccgcggccagcgcagcccagcggcgcggacgggtcgggcgcaacccccagaaggagaacgaccagtacatcttcaccggccagcccctaaacaacgacgaggaccacgcccactggaccgaggcgaagatgctccttgacaacatcaacactcccgagggcatcatcccggccctcttcgagccggagcgagaaaagagcgccgccatcgacggcgagtaccgccttaaaggcgagagccggaagacgtttgtagagctgatgcggcgcggggacctcccggtgtggctggctcacaaagtcgcctcggagggaatcaagtataccgaccgcaaatggtgcttcgatgggcagcggaacaaccagatccttgaggagaatatggacgttgagatctggaccaaggagggcgaaaagaagaaactcaggccccgttggctggacgcccggacttacagcgacccgctcgcgctgaaggaattcaaggacttcgccgcgggccgcaagagtatagccctggacctggtcacggaaatcgggcgggttccctcccaccttgcccaccgcacgcggaacgccctggacaacctggtgatgctccacacaagcgagcacggcgggcgcgcctaccggcacgcggtcgaagagctgccggagaccatggagacgcttctcctgttgggcctcatgatcctgctgactgggggtgccatgctcttccttatctccggcaaggggatcggcaagacctcaatcgggcttatttgcgtgatcgcgtcctcgggcatgctctggatggccgagataccgctgcagtggatcgcgtccgcgattgtgctggagtttttcatgatggtcctcctgatccccgagcccgagaagcagcgaacgccccaggacaaccagttagcatacgtggttatcgggatcctgaccctggccgccatcatcgccgcaaacgagatgggcctgctcgagaccaccaaacgggacctggggatgagcaaggagccaggggtcgtgtcccccacctcgtacctggacgtggacctccaccccgcttccgcctggacgttatacgccgtcgcgactacggtgattacccccatgctgcgccacacgatcgagaactcaaccgctaacgtctccctcgccgccatcgccaaccaggcggtcgtgctgatgggccttgataagggatggcctatttcaaaaatggacttaggcgtgcccctcctggccctcgggtgctactcgcaggtgaaccccctgactctgaccgccgccgtgctcctgctgatcacgcactacgccatcattggccccggcctccaggcgaaggccacccgtgaagcccagaagcgcaccgccgcagggatcatgaagaacccgaccgtggacggcattatgacgatcgacctggatcccgtcatctacgactccaagtttgagaagcagctgggccaggtgatgttgctggtgctgtgtgccgtccaactcttactgatgagaacctcctgggcactctgtgaagcgctaaccctggccaccggccccatcactaccctctgggagggcagccccgggaagttctggaacaccaccatcgcggttagtatggccaacattttccgtggctcctacctggccggggctggcctggccttctcgatcatgaagtccgtggggacgggcaagcggggtaccgggagccagggcgagaccctcggcgagaagtggaagaagaagctgaaccagctgtcgcggaaagagttcgatttatacaagaagagcggcatcaccgaggtcgaccgtaccgaggcgaaggaggggctgaagcgcggagagatcacccaccacgccgtgtcccgggggtcagccaagctccagtggttcgttgaacgcaacatggtgatcccggagggccgggtgatcgacctcggctgcgggcgcggcgggtggtcctattactgcgccggcctcaagaaggtgaccgaggtccgaggctacaccaagggcgggcccggacacgaagagcccgtgcccatgtcgacctacggctggaacattgtgaaactgatgtccggcaaggacgtcttttacttgccgcccgagaagtgcgacacgctgctgtgcgacatcggcgagagctccccctcgcccaccgtggaggagagccgcaccatccgcgtcctgaagatggtcgagccgtggctcaaaaacaaccagttttgcattaaggtactgaatccctacatgcctacggtgatcgagcacctggagcggctccagcgcaagcacggcgggatgctagtgcggaacccccttagccgcaactccacccacgagatgtactggatcagcaacggcacagggaacattgttgcctccgttaacatggtctctaggctcctcctgaaccgcttcaccatgacccatagacgcccgacgatcgaaaaggacgtggacctcggcgcgggcacacggcacgtaaacgccgagccagaaacccccaacatggacgtcataggggagcgcatcaagcggatcaaggaggaacacaactccacctggcactacgacgacgagaacccgtacaagacgtgggcctaccacggctcttacgaggtgaaggccacggggagcgccagcagcatgatcaacggcgtggtcaagctgctgactaagccttgggacgtggtccctatggtgatccagatggcgatgacagacacgacccccttcgggcagcagcgcgtcttcaaggagaaggtggacacgcggaccccgcggagtatgcccggcacgcggcgcgtgatgggcatcaccgccgagtggctttggcgtacattaggccgcaacaagaagccacgcctgtgcacccgggaggagttcaccaagaaggttcgcaccaacgccgccatgggcgcggtctttactgaggagaaccagtgggacagcgctaaggccgccgtggaggacgaggacttttggaagctcgtggaccgggagcgcgaactacacaagctggggaagtgcggcagctgcgtctataatatgatggggaagcgggagaagaagttgggtgagtttggcaaagccaagggcagccgcgcgatctggtacatgtggttgggcgcccggtacctagaattcgaggctctcgggttcctgaacgaggaccactggtttagcagggaaaatagctacagcggagttgagggggagggcctgcacaagctcggctacatactgcgcgatatcagcaagatcccgggcggcgccatgtacgccgacgacaccgcgggctgggacacacggatcaccgaggacgacttacacaacgaagagaaaatcactcaacagatggacccggaacatcggcagctcgccaacgccatattcaagctgacctaccaaaacaaggtggtcaaggtgcagcgacccacacccactggcaccgtgatggacatcatctcccggaaggaccagcgcggctcggggcaggtcggcacgtacgggctgaacaccttcacgaacatggaggcccagctcatccggcaaatggagggcgagggggtgctgtctaaggcggacctggagaacccccacctcagcgaaaagaagatcacccagtggctggagaccaagggcgtggagcgcctgaagcggatggcgatctcgggcgatgactgcgtcgtgaagcctatcgacgaccgcttcgcgaacgccctcctggccctgaacgatatggggaaggtacggaaggacatcccccagtggcagcccagcaagggctggcacgactggcagcaagtgcccttctgctcccaccacttccacgagctcatcatgaaagacgggcgaaaactcgtggtgccgtgccggccccaggacgagctgattggccgcgcccggattagccagggggcgggctggagcctccgggagaccgcctgtttaggtaaggcctacgcgcagatgtggagtctcatgtacttccaccgtcgggacctccgcctggcgtccaatgctatctgcagcgctgtccccgtgcactgggtcccaacgagccggactacatggtccattcacgcccaccaccagtggatgaccacggaggacatgctgaccgtctggaaccgcgtgtggatcgaggacaatccgtggatggaggacaaaacccctgtcacaacgtgggagaacgtcccctacttaggtaagcgagaggaccagtggtgcggcagcctgatcggtctgacctcacgcgccacctgggcgcagaacattcctaccgcaatccagcaggtccggagcctcatcggcaacgaggagtttctggactacatgccgtccatgaagcgcttcagaaaggaagaggagagcgagggtgccatctggtga

SEQ ID NO: 25709 - RNA, 9873 nt, synthetic construct
  misc_feature 1..9873: note = derived and/or modified CDS sequence (opt11) from DENV-3__GU131878__SS-prME
  source 1..9873: mol_type = other RNA
acaagcctgtgcctaatgatgatactgcccgctgccctagccttccaccttacttccagagacggtgaacctagaatgatcgtgggcaaaaacgaacgaggaaaatcattattgttcaaaacggcttccggaataaacatgtgtacattgattgcgatggaccttggcgaaatgtgtgatgatacagtgacctacaaatgcccgcacataacagaagtggaacccgaggacatagactgctggtgtaacctcaccagcacgtgggtcacctatgggacctgcaaccaagcgggcgagcgacgccgcgacaaaagaagcgtcgccttagcgccccacgtcggcatgggcttggacacgcggacccaaacctggatgagcgcagaaggagcatggcgacaggtcgagaaagtggaaacctgggcactgcgacacccggggttcacaatactggcgctattcctggcgcactacataggaacaagcctcacgcagaaagtcgtaatatttattttgctaatgcttgtaacgccgagtatgactatgcgttgcgtcggagttggaaaccgtgacttcgtagaagggctatccggcgcaacctgggtagacgtcgtacttgaacacgggggatgcgtcaccacgatggctaaaaataaaccaacattagacattgaactacagaaaaccgaagccacccagctagcaacattgcgcaaactgtgtatcgagggtaagataaccaacataacaacggactcccggtgcccaacccaaggcgaggcagtacttccagaggaacaggatcaaaattacgtatgcaagcacacctacgtggacaggggatggggcaatggatgcggcctctttggaaagggatcgttagtaacctgcgccaagttccagtgcctcgagctcatagagggaaaagtggttcaatacgagaacctaaagtacaccgttattatcaccgtgcacacgggagaccaacaccaagtaggaaacgaaacacaaggagtaactgccgaaataacaccccaggcgtctaccacggaagcaatcttaccagaatacggaacactcggccttgagtgttcacctagaacggggctggatttcaatgaaatgatactactcacgatgaaaaacaaggcgtggatggtgcaccggcagtggttcttcgacttgcccttgccatggacgagtggggctacaacggaaacacctacgtggaacaggaaggaactcctagtcacgttcaagaacgcacacgcgaagaaacaggaagtcgtggttttggggagccaagagggagcaatgcacaccgcactcacaggtgcaacagaaattcagaacagcggcgggacaagtatattcgccgggcacttgaaatgccgactaaaaatggataagttggaactgaaaggcatgagctacgcgatgtgcaccaacacctttgtcctaaagaaagaggtgtccgaaactcaacacggaaccatactaatcaaagtcgaatacaagggggaagatgcaccgtgtaaaatcccgttttcaacagaagatggtcaagggaaggcgcataacggccgcctgatcacggctaacccggtagtcactaagaaagaagaacccgtaaatatagaagctgagccacccttcggcgaaagtaatatagtcattgggacgggagacaatgcgctgaagatcaactggtacaagaaaggatcgtcaattggtaaaatgttcgaggcgaccgcgagaggggcgcggcgcatggctatactgggcgacactgcgtgggacttcggcagcgttggaggggtactaaactccctcggtaaaatggtgcaccaaatcttcggctcagcgtacaccgcgctatttagtggagtcagctgggtgatgaagattggaatcggggtcttactcacgtggattggcttaaactcgaaaaacacatcaatgtcgttttcctgcattgcaatagggatcataaccctctacctcggagcggtggtacaggcagacatggggtgtgtgatcaattggaagggcaaggaactcaaatgtggatcgggtattttcgtcacgaacgaggtgcacacgtggacagagcaatataagttccaagctgactcgcccaaaaggctcgcgacggcgatcgcgggagcctgggaaaacggggtgtgcggcatacgcagcaccaccaggatggagaacctcttatggaagcaaatcgcaaacgaattgaactatattttatgggaaaacaatatcaagctcacagtcgtcgtcggggacattataggagtgttagaacagggaaaacgaaccctaacaccgcagcccatggaacttaagtacagttggaaaacatggggtaaggcgaaaattgtaacggccgaaactcagaactcgtcattcatcatagatggacccaacacgccagaatgtccctccgcatcgagagcttggaacgtatgggaggtcgaggactacggatttggcgtgtttaccacaaacatctggctcaaactcagggaagtctatactcagttgtgcgaccatcggttaatgagtgcagccgtcaaagacgaaagagcggtgcacgcagacatgggatactggatcgaaagccagaaaaacggaagctggaagttggaaaaggcatccttgatagaggtaaaaacctgtacctggccaaaatcacataccctctggagtaatggcgtgctggagagtgacatgattatacccaaatccctagcaggacctataagtcagcacaaccaccggcccggctaccatacacagacagccgggccctggcacctaggaaagctagaacttgattttaactattgcgaaggcaccacagtagtgataactgagaattgtgggacgagaggaccatccctgcgcaccaccacagtctccggcaaactgatccacgaatggtgctgcagatcatgcaccctaccaccactccggtacatgggagaagacggatgctggtatgggatggagattcggccgatatcggaaaaggaggaaaacatggtcaagagcttagtctccgccggatctggcaaagtggacaacttcacgatgggcgtgttatgcctagccatactattcgaagaggtaatgagaggaaaattcggtaagaaacacatgatagccggcgtgttctttacttttgttctactactctcaggtcagatcacctggagagacatggcgcatacactgatcatgataggatcgaacgccagcgaccggatggggatgggagtcacgtacctcgccctaattgcaacgttcaagatacagccatttctagcgctaggtttcttcctccgcaaactgacatcccgggagaacctgctactcggcgtaggactcgccatggcaaccacgctacaactcccagaggacatagagcagatggcgaacggaatcgccctagggcttatggcactgaaactaatcactcaatttgaaacctaccaactatggacggcgctgatatccctcacctgttccaatacaatgttcacgctcacagtggcatggcgcactgcaaccctgatccttgctggcgtatcactacttcccgtatgccagtcatcctccatgcgaaaaacggactggctaccgatggcggttgctgcgatgggagtacccccgctcccgctgtttatatttagcctaaaagacaccctcaaacggagatcatggcccctcaatgaaggggtcatggccgtcggcctagtatccatactcgcatcctcgcttctccgaaacgacgtacccatggcaggacccttagtagcgggaggcctacttatcgcatgttacgtcataaccggcacatcggcagatctgactgtcgagaaagccgcagatataacttgggaagaggaagcagagcagacgggagtatcacacaatctcatgattacagtagacgacgacggaacgatgcgcataaaggacgacgaaacagagaacatcctcaccgtgctacttaaaacggctttgctaatcgtatccggggtcttcccgtactcgataccagcaaccctgttagtatggcatacctggcaaaagcagacacaaagatccggggttctctgggacgtgcccagcccacccgagacccagaaagcagagcttgaggaaggtgtctatcgcatcaaacaacaaggcatttttggcaagacgcaagtcggtgtcggcgtacagaaggaaggagtcttccacacgatgtggcacgtcaccagaggggcagtgctaacatataacggcaaaagactcgagcccaattgggcctccgtgaagaaagacctgatctcctacggaggcggatggagacttagcgctcaatggcagaaaggcgaggaagtacaggttatagcggtggaacccggaaagaaccctaagaacttccagaccatgcccggcacctttcagactacgactggcgagatcggtgctatagcattggatttcaaaccaggtaccagtggcagcccaatcatcaaccgagagggcaaagtcgtcggcctctacggaaatggagtcgtaacgaagaacggaggctacgtatcaggcatagcgcagaccaacgccgaacccgacggtcccacaccagagttagaagaagaaatgttcaagaaaaggaacctgacaataatggaccttcaccccggtagcgggaagacacgaaaatatctccctgcgatcgtaagggaggctatcaaaagacgacttcgtacactaatcctagcacccactcgcgtagtcgctgcggaaatggaagaagcattaaaagggctacccattcggtaccagacgacagcaaccaagtccgaacacaccggaagggagattgtagatctgatgtgccacgcaaccttcacaatgaggctgctcagtccggtacgagtgccaaactataatctaataatcatggacgaagctcacttcaccgaccccgcgtcgatcgcagcccggggctacataagtacgcgagtggggatgggagaggccgcagcaatcttcatgacagcaactccacccggaaccgccgacgccttcccgcaatcgaacgctcccatccaggacgaagaaagagatatacccgaacgttcgtggaacagcggaaatgagtggatcacagatttcgcagggaaaaccgtatggttcgtcccgagcataaaagccggtaacgacatagcgaactgcctgcgaaagaacgggaagaaagttatacagctgtcccgcaagacattcgacactgaatatcaaaagaccaaactaaacgattgggacttcgtcgttacaacagacatctcagagatgggagcgaacttcaaggcagaccgggttattgacccgcgccgctgcctgaagccagtcatcctgacagatggtcccgagcgagttatactagccggcccaatgcccgtgaccgcagcctcggccgctcagcgacgcgggagagtaggtcggaatccccaaaaagaaaacgaccaatatattttcacaggacaaccgctcaacaacgatgaggaccacgcccactggaccgaagcaaaaatgctcctcgacaatatcaacacccccgaaggtataattcccgcactattcgaaccagaacgcgaaaaatccgcggcaatagacggagaatacaggctaaaaggagaatcgagaaagacgttcgtcgaactcatgagacggggagacctacccgtctggttagcccacaaagtagcatcggaggggataaagtatacggaccgcaaatggtgcttcgacgggcagaggaataaccagatcctagaagaaaatatggacgttgaaatctggaccaaagaaggcgagaagaagaaattgagaccacgatggctggacgcgcggacatactctgaccccttagcgctcaaagagtttaaagacttcgcggccggaaggaaatcaatcgctctagacctagtcacagaaataggacgggtaccgtcacatttggcgcatcgaacccgcaacgccctagacaacctggtcatgctccacacgagcgagcacggagggagagcatacaggcacgcagtagaagaactaccggaaacaatggaaacgctattgctcttaggattgatgatactgttgaccggcggggcgatgttattcctcataagcggcaaaggaatcggcaaaacctcaatagggcttatatgcgtcatcgcctcgtcgggaatgctttggatggcagccatacctctgcaatggatagcctcagcaatcgtactcgagttcttcatgatggtacttctaatccccgaaccagagaaacagaggacaccccaggacaatcagctagcctatgtagtcataggcatactaacgctcgcagccatcatagctgcaaacgaaatgggactcttagaaaccaccaaaagagacctaggaatgtctaaagagccaggtgtcgtgagcccaaccagctacctggacgtagacctccacccagcgagcgcgtggacgctctatgcggtcgctacaacggttataacacccatgttacgacatacgattgaaaattcaacggctaatgtatcactcgcagccatcgccaaccaagcggtggttttaatgggcctggacaaaggatggcccatctcgaaaatggacttaggagtacccttactggctctaggctgttacagccaggtcaatccgctcaccctgacggccgccgtactcctactaatcacacactatgcaataatcgggcccgggctgcaagcaaaagcaacacgggaggcgcaaaaacgcacagcggcaggaatcatgaaaaacccaacggttgacggtataatgacaatcgacctagaccccgtaatatacgatagtaaattcgaaaaacagctcgggcaagtgatgttactcgtcctgtgcgccgtccaactgctactaatgcgcacttcttgggcactctgcgaggccctgacgttagcaacgggaccaataactacgctatgggagggatccccaggaaagttttggaacacgaccatagcggttagcatggcgaatattttccgtgggagctacctcgctggcgctggattagcgttcagcatcatgaaaagcgtggggacggggaaacgaggcactggctctcagggcgaaaccctcggggaaaagtggaagaagaaactcaaccagttatctcgaaaagagtttgacctgtacaagaaatctggaatcaccgaagtcgataggaccgaagccaaagagggcctcaaaaggggcgaaataacccatcacgccgtgtcacgcggatccgccaaattacaatggttcgtggaacgaaatatggtcataccggagggacgagtcatcgacctaggctgcggacgcgggggatggtcatactactgtgcaggacttaagaaagtcaccgaagtccgcgggtacaccaaaggaggtccaggacatgaagaacccgtccccatgtcaacttacggatggaacatcgtcaaactcatgtcggggaaggatgtattctaccttcccccggaaaaatgtgacaccctcctgtgcgacataggggaaagcagcccgtcgcccaccgtagaggaaagcaggaccatcagagtactaaagatggtagagccctggctcaaaaacaatcaattctgcatcaaagtcctaaacccgtacatgcccacagtgatagaacatctggaaaggcttcagagaaagcacggtggcatgctagtgcgaaatccactaagccgcaattcaacccatgaaatgtactggatcagcaacggaaccggcaacatagtagcaagcgtaaacatggtctcaagactactactaaatcgctttacgatgacgcaccgcagaccaactatcgaaaaagacgtagacttgggcgctggcactcgacacgtgaacgccgaacccgagaccccaaatatggacgttataggcgagcggataaaaaggataaaggaggaacacaacagtacatggcactatgacgacgaaaatccatacaaaacatgggcgtaccacggcagctacgaagtaaaagcaacggggtcagcgagctcaatgataaacggggtcgtaaagctactcacgaaaccatgggacgtcgtgccaatggtaacgcagatggcaatgacagacaccacgccctttggacagcaacgcgtcttcaaggagaaggttgacacacgcacgcccagaagcatgcccggaacgagacgagtgatgggtatcaccgcagaatggttatggaggactctcggcagaaacaagaaaccaaggctctgcacgagagaagagttcacgaagaaagtccgcacaaacgctgctatgggcgccgtattcaccgaggaaaatcaatgggattcggccaaagcagcagtagaggacgaggacttctggaaactggtagatagggaacgcgaactgcataagctaggaaaatgcggcagttgcgtatacaatatgatgggcaagagagaaaagaaactcggcgagttcggcaaggcgaaaggaagccgagcgatctggtatatgtggttgggagctagatacctggagttcgaagcactagggttccttaacgaggaccattggttcagcagagaaaattcatacagcggagtcgaaggggaagggctacacaaacttggctatatactgagggacatatcaaaaatacccggaggcgccatgtacgccgacgacaccgcgggatgggacacaaggatcacagaagacgatctacacaacgaagagaaaataacccagcaaatggaccccgaacacagacaactcgcaaatgcaatattcaagttaacctatcaaaataaagttgtcaaagtacagcgtccgacaccaacgggcaccgtcatggacatcatatctcgaaaagaccaaagagggagcgggcaggtcggaacttatggactcaatacgttcaccaacatggaggcgcaactcatacggcaaatggagggtgaaggcgtactcagcaaagcagacctcgagaaccctcaccttccagagaagaaaatcacccaatggctcgagacgaaaggcgttgaacgacttaaacgcatggccatcagcggagacgactgtgtagtaaaacctatagacgaccgcttcgcgaatgcactcctagcactcaacgatatgggcaaagtccgcaaagatataccccaatggcagccaagcaaaggctggcacgactggcagcaagtcccattctgttcacaccactttcatgagcttataatgaaggatggtaggaagctagtcgtcccatgcaggccgcaagatgaactaatcggtcgagcccggatcagccaaggagcgggatggtcattacgcgaaacggcgtgcctggggaaggcgtatgcacaaatgtggagcctgatgtacttccaccggcgcgatctaagactagcgagcaacgcaatttgtagcgccgtacccgtccattgggtacccacgtctaggacgacgtggtctatacatgcacatcaccagtggatgacgactgaggatatgctcaccgtttggaacagggtatggatagaggacaacccgtggatggaagacaagactccggtgacgacgtgggaaaacgtcccctatttagggaagagagaagaccagtggtgcggttccctaatcgggttaacaagccgcgccacctgggcccaaaacatcccgactgctattcagcaagtacggagtctaataggcaacgaagagtttctggactatatgcctagtatgaaacgcttcaggaaggaagaggaaagcgagggagcaatatggtag

SEQ ID NO: 25710 - RNA, 9873 nt, synthetic construct
  misc_feature 1..9873: note = derived and/or modified CDS sequence (opt11) from DENV-3__FJ898455__SS-prME
  source 1..9873: mol_type = other RNA
acctcactgtgcctcatgatgatgctaccagccactcttgccttccacttaaccagccgcgatggcgagccacggatgatagttgggaaaaacgagcgtgggaagagtctgctgtttaagaccgccagcggaataaacatgtgcacgctgatcgccatggacctgggcgagatgtgcgacgacaccgttacctataagtgcccccttataaccgaggtggagcccgaggacatcgactgctggtgcaaccttacgtcaacgtgggtgacctacgggacctgcaaccaggccggtgaacaccggcgggacaagcggagcgtcgcccttgctccccacgtgggaatggggcttgacacgcgcacccagacctggatgagcgcagagggtgcttggcggcaagtcgaaaaggtcgaaacctgggccttccgccaccctgggttcacgatactcgccctgtttcttgcgcactacattggcacgtccctcacccagaaagtggtgatcttcatcttgcttatgttggtgacccccagcatgacaatgcggtgtgtaggagtgggcaatcgcgactttgtcgagggcctgagcggggcaacctgggtagatgtcgtcctggagcacggcgggtgtgtgacgaccatggccaagaacaagcctaccctggacatagagctgcagaagaccgaggccacgcagttggccaccctccggaagttatgcattgagggcaagatcactaacgtcacgaccgactctagatgccccacgcagggcgaggcgatcttaccagaggagcaggaccaaaactacgtctgcaagcacacctacgttgaccgggggtggggcaacggctgtggcttgttcggcaagggcagcctggtgacctgtgccaagtttcagtgcctagaaagcatcgagggcaaggccgtccagcacgagaacctcaagtacacggtgatcatcaccgtgcacaccggggaccagcatcaagttggcaacgagacccagggggtgacggccgagatcacgccccaagccagcaccgtcgaggcgatcctgcccgaatacggtaccctgggcctcgaatgttcgccacgcaccggcctggatttcaacgagatgatcctgttaacgatgaagaacaaggcctggatggtccaccggcaatggtttttcgatttgccgctgccctggacctccggcgccactacagagactcccacctggaacaagaaggagctgttagttaccttcaagaacgcccatgccaagaagcaggaggtagtcgtgctggggtcacaggaaggcgcgatgcacaccgcgttaaccggggccacagagatccaaacctccggcgggaccagcatcttcgccggccacctgaagtgccgcttaaagatggacaagctcgaactgaagggcatgtcctacgccatgtgcctgaacgcgttcgtactaaagaaggaggtgagcgagacgcagcacggtaccatcctcatcaaggtcgagtataagggcgaagacgccccctgcaagatcccgttcagcactgaggacggccagggcaaggcccacaacgggcgcctgatcaccgctaacccgatagtcacgaagaaggaggaacccgtgaacatagaggcggagcccccctttggtgagtccaacatagtgatcgggatcggggacaaggccctgaagatcaactggtataagaagggcagctccatcgggaaaatgttcgaggctaccgcccgcggcgcccggcggatggcgatcctcggcgacaccgcctgggacttcgggagcgtaggcggggttcttaactccctgggcaaaatggtccaccagatcttcgggagcgcctacaccgccctcttctccggcgtctcctggatcatgaagatcggcattggcgtcctactgacctggatcgggttgaactccaagaacaccagcatgagcttcagctgcatcgtgatcggcatcattaccctttacctgggagccgtcgtacaagcggacatggggtgcgtaataaactggaagggcaaggagctcaagtgcggctccgggatctttgtcaccaacgaggtacacacatggaccgagcagtacaaattccaggccgacagccccaagcgtttagctaccgccatcgcgggcgcgtgggagaacggcgtgtgcggcatccgctccaccactcgcatggagaacctgctctggaagcaaatcgccaacgagttaaactacatattgtgggagaacaacatcaagttgaccatagtggtgggggacgtgatcggcgtcctggagcagggcaagcgaaccctgacgccccaaccaatggagctcaagtattcatggaagacgtggggaaaggctaagatagtgaccgccgagacgcaaaactcctcgtttatcatcgacggcccgaacaccccggagtgcccctccgcaagccgcgcctggaatgtgtgggaggtcgaggattacggtttcggggtgttcacgaccaacatctggcttaagctgcgcgagatgtacacacagctctgcgatcaccgcctcatgtcggccgccgtgaaggacgagcgggccgtgcacgcagacatgggctactggattgagtcccaaaagaacggcagctggaagctggagaaggcttccctcatcgaggtaaagacgtgcacctggcccaaaagccatacgctgtggtcgaacggcgtgctggagtcggacatgatcatcccgaagtcgctcgccgggcccatcagccagcacaactaccgccccggctaccacacccaaacagccgggccgtggcacctgggcaagctagaactcgacttcaactattgcgagggcacgacggttgtgatcaccgagaactgtggtacccgaggccctagtctccgcacaacgactgtgagcggaaaactgatccacgagtggtgctgccggtcctgcactctgccgcccctccgctacatgggcgaggatgggtgctggtacggcatggaaatacggccgatcaacgaaaaggaagaaaatatggtcaaaagcctggtgtccgccggcagcgggaaggcggacaacttcaccatgggcgtcctctgcctggccatactgttcgaagaggtcatgcgcggaaagttcggcaagaaacacatgatcgcaggggccctcttcaccttcgtgctgctactctccggccagatcacgtggcgcgacatggcccacaccctgatcatgatcggcagcaacgcatccgatcgcatggggatgggtgttacctaccttgccctcatcgccacgttcaagatccagcccttcctggcgttagggttcttcctccggaagttgactagccgcgagaacctgctcctgggcgtcggactggcgatggccaccaccctccagctccccgaggacatcgagcagatggcaaacgggatcgcccttgggctcatggccctgaagctgatcacacagttcgagacataccagctgtggacagcattggtaagcctgatgtgctcaaacacgatcttcaccctcacagtggcctggcggacagccaccttaatccttgcggtcatctctctcctacctgtttgccagtcctcttccatgcgcaagacggactggctgccgatgaccgtggcagcgatgggggtgccgcctctccccttattcatattcagcttaaaagatactcttaaaagacgttcctggcccctcaatgagggcgtcatggccgtcgggctggttagtatcctcgcctctagcttccttcggaacgacgtcccgatggctggcccactggtcgccggcggactcctcattgcatgctacgtgattactggtacgtccgccgacctaacagtggagaaagccgccgatgtcacctgggaggaggaggcggagcaaactggtgtttcgcataacctcatgataacggtggacgatgacggcaccatgagaatcaaagacgacgaaaccgagaacatcctgaccgtcctactcaaaacggcactgctgatagtgtccgggatctttccctatagtatcccagccaccctcctggtatggcatacctggcagaagcagacccagaggtcgggcgtcctgtgggatgtcccctccccgccagagacccagaaggccgagctcgaagagggggtgtatcggatcaagcagcaagggatctttggcaagacgcaggtcggggtcggagtacacaaagagggggtattccacaccatgtggcacgtgacccgcggagccgtcctgacccacaacggaaagcggctggagccgaattgggccaacgtcaaaaaggacctcatctcctatgggggcgggtggaaattaagcgcacaatggcagaaaggcgaggaggtccaggtgatcgctgttgagcccgggaaaaatcctaagaacttccagaccatgccgggcatcttccagaccaccacgggagagatcggagctatagccttggacttcaagccgggcacgtccgggtcccccattatcaaccgggaaggcaaagtagtcggcctatacgggaatggtgtcgtgaccaaaaacgggggatacgtcagtgggatcgcgcagaccaacgccgaacccgacggacccacccctgagttagaagaggagatgttcaagaagcggaatctgacaatcatggacctacaccccggctcggggaagacgagaaagtatctccccgccatcgtccgggaagccattaagcgccgcctgcgcaccttgatattggctccgacccgggtggtggcggccgaaatggaggaggccctgaagggcttacccattcgctaccagacgactgccacgaagtcggagcacaccggacgggaaattgtcgaccttatgtgccacgccacatttaccatgcgcctgctgtccccagtgagggtgcccaactacaacctcatcgtcatggacgaggcgcacttcaccgacccggccagcatcgccgcccgcggctatatcagcacccgcgtcgggatgggagaggcggcagccatctttatgacggctactccccccggcacagccgacgcgttccctcagagcaacgcgccgattcaggacgaggagcgcgatatacccgagcggtcctggaattccggcaacgagtggatcacggatttcgccgggaagacggtgtggttcgtgccttccatcaaggccgggaatgatatcgccaattgcctgcgcaagaatggcaaaaaggtgatccaactgagcagaaagaccttcgacaccgagtaccagaagaccaaattaaacgattgggatttcgttgtcacaaccgacatctccgagatgggggctaatttcaaagctgaccgagtcatagacccccgccggtgcctaaagccggtaatcttaacggacggcccagaacgtgtcatcctcgcaggccccatgcccgtgacggtagcatcagctgcgcaacgtcgcgggcgggtcggccgtaacccgcaaaaggagaacgaccagtacatcttcacggggcagcctttgaacaacgacgaggaccacgcccactggaccgaggcaaagatgctgctcgacaacattaatacccccgagggtattattcccgccctgttcgagcccgaacgcgagaagtccgcagccatcgacggggagtaccgcctgaagggcgagtcccggaaaacgttcgtggagttaatgcgccggggagatctgccagtgtggctcgcacataaggtcgcatcggaagggataaagtacaccgaccgcaaatggtgtttcgatggagaacgaaacaaccaaatacttgaggaaaacatggacgtcgaaatatggacgaaggagggggagcgcaaaaagctgcggccccgctggctggacgcccgtacatatagcgaccccctcgcgttaaaagagttcaaagacttcgccgcaggccgcaagtcaatagccttagacctcgttaccgagatcggtagagtgcccagccacctagcccatcggacccgcaacgcactggacaatctggtgatgctgcacacatccgagcacggcggccgggcatacagacatgccgtagaagagcttcccgagaccatggagaccctcctgctactcgggttaatgatcttgttgaccggcggggccatgctgttcctaatcagcggcaaggggatagggaagacgtcaatcggcctgatctgcgtggtggcctcctcgggcatgttatggatggcggacgtccccctgcaatggatcgcctccgccatcgtgctcgagttcttcatgatggtgctcctaatcccggagcccgagaagcagcggaccccacaggataaccagctagcttacgtcgtgatcggcatccttaccctggccgcgatcgtggctgcaaatgaaatggggctcctagagaccactaagcgcgacctaggcatgtccaaggagcccggcgtggtgtccccgacatcgtacctcgacgtggaccttcaccctgctagtgcttggaccctgtacgcagtagccaccaccgtgatcacccctatgctccggcacaccatcgagaacagtaccgccaacgtgtccctggccgcgatcgcgaaccaagccgtcgtgctgatggggctagacaagggctggcccatcagcaagatggacctgggcgtcccgttgctcgccctcggctgctacagccaagtcaaccctctgaccctcaccgccgcagtgctgctcctcgtcacccattacgccattataggaccgggcctccaggccaaggctacacgcgaggcccagaaacggacggcggccggcataatgaagaatccgaccgtagacgggatcatgaccatcgatctggatccggtgatctatgacagcaagttcgagaagcaattaggccaggtaatgctgctggtcctttgcgccgtgcaactgctgttaatgcgcacatcctgggcgttttgtgaagcgctgaccctggccaccgggcccatcactaccctctgggaggggagcccgggcaaattctggaacacgaccatagcagtgagtatggctaacatatttcgggggagctatctcgccggtgcggggctggcgttctccattatgaaatccgtcggcacagggaaacgcggcaccgggagtcagggggaaacgctaggcgagaagtggaagaagaaactgaaccagttgagccggaaagaattcgacctctacaagaagagtgggatcaccgaagtggaccgcaccgaggccaaggagggccttaaacgcggagagattacccaccacgccgtgtcccgcggaagcgctaagctgcagtggttcgtcgagagaaacatggtgatccccgagggcagagtgatcgatctcgggtgtggccgcgggggctggtcctactactgcgcggggctgaagaaggtcaccgaggtgagaggttacacgaaaggcggcccgggccacgaggagcccgtgccgatgagcacctacgggtggaatatcgtcaagctgatgtccggcaaggatgttttctacctcccacccgaaaagtgcgataccctgctttgtgacattggggaatcatctccgagccccaccgtggaggagtcccggacgatacgcgtcctgaagatggtggagccctggctgaagaacaaccagttctgcatcaaagtcctgaacccatacatgcccacggtcatagagcacctggagagattacagaggaagcacggaggcatgctggtccgtaacccccttagccggaactcaactcacgagatgtactggatcagcaatggcaccggaaacatcgtaagctctgttaatatggtgtcccgcctcctgttgaatcgtttcacgatgacccaccggaggcctaccatcgagaaagacgtagacctcggggccggcacccgccacgtcaacgccgaaccggagacacccaacatggacgtgatcggcgagcggatccgccgtatcaaagaggagcactcaagcacatggcattacgacgacgagaacccctacaagacctgggcctatcacgggagctatgaggtgaaggccactggttccgcttctagcatgatcaacggggtcgtcaagctgctgacgaagccttgggacgttgtgccgatggtgacccagatggctatgacggacaccacgccctttggccagcagcgagtcttcaaagaaaaagtggacactaggacgccccggccgatgcccgggacccgtaaggtgatggagatcacggccgaatggttgtggcggaccctgggtcgtaataagcgcccgcgtctgtgcacccgcgaagaatttatcaaaaaggtccggaccaacgcggcgatgggggccgtgttcacggaggagaaccagtgggacagcgctcgggccgccgtggaagacgaagagttttggaagctcgtcgatagagagcgggagctacataagctggggaagtgcggctcttgcgtgtacaacatgatggggaagcgcgaaaaaaagttaggtgagttcgggaaggcgaagggctcccgcgccatctggtatatgtggctaggcgcaaggtatctggagtttgaggccctcgggttccttaacgaggaccactggtttagccgggagaactcctacagcggagtggagggggaaggcctccacaaactcgggtacatcctgagggacatatccaagattcccggaggcgccatgtacgcggacgataccgccgggtgggacacccggataaccgaggacgacttacataacgaggagaagatcactcaacagatggatcccgaacaccgccagctcgcgaacgcaatcttcaagctgacttatcagaataaggtcgtgaaggtgcagcggccgacgcccaagggcaccgtcatggatatcatcagccgcaaggaccagcgcgggtccggccaggtgggcacatatggactcaacaccttcacaaacatggaggctcagttaatccgccaaatggagggtgagggggtgttgagcaaggcggacctggaaaaccctcacctcctcgagaagaaggtcacccagtggctggagaccaagggcgtagagaggttgaagagaatggccatttccggggacgattgcgttgtaaaaccgatagacgaccggtttgccaacgccttgctggcgttaaacgacatgggcaaggtccgcaaggacatcccccagtggcagcccagtaagggctggcacgactggcagcaagtccccttctgctcccaccactttcacgagctgatcatgaaagatggacgaaagctggtcgtgccatgtcgcccccaggacgagctaatcggccgggcacgcatcagccagggggccggctggtctctgagggagaccgcctgcctggggaaggcatacgcgcaaatgtgggcactcatgtactttcaccggcgcgacctacggctggcctcgaatgcaatttgttctgccgttcccgtccactgggttccgaccagccgcaccacatggtccattcatgcgcaccaccaatggatgacgaccgaggacatgctcaccgtttggaaccgagtctggatcgaagacaacccctggatggaggataagacccccgtgacgacgtgggaagacgtgccttacctgggcaaacgcgaggatcaatggtgcggtagcctgatcgggctaaccagccgggctacctgggcccagaatatcctaacggcgatccaacaagtacggagtctgataggcaacgaggagttcctggattacatgcccagcatgaagcggttccgaaaggaggaggagtccgagggtgccatctggtaa

SEQ ID NO: 25711 - RNA, 9873 nt, synthetic construct
  misc_feature 1..9873: note = derived and/or modified CDS sequence (opt11) from DENV-3__GQ199891__SS-prME
  source 1..9873: mol_type = other RNA
accagcctgtgtttaatgatgatactgccggccgctctggcgttccatctaacctcacgggacggggagccccggatgatcgtggggaaaaacgagcggggcaagagcctgctgttcaagacggcctctggtataaacatgtgcaccttgatcgccatggacctgggagagatgtgcgatgacacagtgacatacaagtgcccccacatcacggaggtggagcccgaggacatcgactgctggtgcaacctgacctctacctgggtcacatacgggacgtgcaaccaggccggagagcatcggcgcgacaagcgcagcgtcgccctcgcgccgcacgtgggcatgggattggacaccaggacccagacatggatgagcgccgagggggcctggcgccaagtggagaaggtggagacctgggccctgcgccatcctgggttcaccattctcgccctgttcttagctcattatatcggcacttccctcacccaaaaggcagttatttttatcctgctgatgctcgttactcccagcatgaccatgcggtgcgtcggtgtgggcaaccgcgacttcgtagagggcctgtcgggggctacctgggttgacgtggtgcttgaacatggcgggtgtgttactactatggcaaagaacaagcccaccttggacatcgaacttcagaagacggaggcgacccaattagccacgctccggaaactgtgcatcgaagggaaaatcaccaacattacaaccgactcgcgctgccctacgcaaggtgaggccgtgttaccagaggagcaggaccagaactacgtgtgcaaacacacctacgtcgaccggggctggggcaacgggtgcggcctattcgggaagggatccctggtaacctgcgccaagttccagtgcctagagcccatcgagggcaaagtggtccagtacgagaacctcaagtacaccgtcatcataacggtacacaccggcgaccagcaccaggtgggcaacgagacacagggtgtcaccgctgaaattacaccccaggcgagcaccacagaggctatcctgcccgaatacggcaccctggggctcgagtgtagcccgaggaccggcctggactttaatgagatgattctgctcacgatgaagaacaaagcctggatggtccatcggcaatggttcttcgacctgccccttccctggacctccggcgccactaccgagacacccacctggaaccgaaaggaactcctggtaaccttcaagaacgcccacgcgaagaagcaggaggtggtcgtgcttggcagtcaggagggagctatgcataccgcactcacgggggcgacagagatccagaacagcggagggacctcaatcttcgccggccaccttaagtgccggttaaagatggacaagctcgaactgaagggtatgtcttatgccatgtgcaccaatacattcgtgctgaaaaaggaggtcagcgaaacccagcacgggacaatcctcattaaggtggaatacaagggtgaagacgtgccgtgcaagatccctttcagcaccgaggacgggcagggaaaggcccacaatggtcgtctgatcacggccaacccagtcgtgaccaagaaagaggagcctgtgaacatcgaggcggagcctcctttcggtgagagcaacatcgttattggcattggggacaacgcgctgaagattaactggtacaagaaaggctccagcatcgggaagatgttcgaggccaccgcccggggcgcccgccggatggccattctgggcgacacggcgtgggactttgggtccgtgggcggtgtgctcaacagcctggggaagatggtccaccagatcttcggatccgcctacacggcgctgttcagcggcgtgtcctgggtgatgaaaataggaatcggggtgctactaacttggatcggtctgaacagcaaaaacacctccatgtcattctcctgcatcgcgatcggcataataactctatatctcggcgcagtggtacaggccgacatgggctgcgttatcaattggaagggcaaggagctgaagtgcggcagcggtatcttcgtgacgaacgaagtgcatacctggaccgagcagtacaagttccaggctgactcaccaaagcgcctcgccaccgccatagccggcgcgtgggagaacggggtctgcggcatccgcagtacgacccgcatggagaacctgctgtggaagcagatagccaacgagctcaactacatcctgtgggagaacaacatcaagttgaccgttgtggtaggcgacatcatcggagtgttagagcagggcaagcgcaccctgacgccccaacctatggagctgaagtactcctggaaaacctggggcaaggccaagatcgtgaccgcagaaacccagaacagctcgttcatcatagacggccccaacacgcccgagtgcccgagcgcatcccgcgcctggaacgtctgggaagttgaggactatggtttcggcgtgtttaccacgaacatctggctgaaattgagggaagtctacacccagctgtgcgaccaccggttgatgagcgcagccgtgaaagatgagcgcgccgtgcatgccgacatggggtactggattgagtctcagaagaatgggtcatggaagctggagaaggccagcctgatcgaggtcaagacctgtacgtggccgaagtcccatacgctctggagcaacggcgtgctggagagtgacatgatcatccccaagtcactggccgggcctatctcccagcacaactaccggccaggctaccacacacagaccgccgggccctggcacctcggaaaactggagctggactttaattactgcgagggcacgaccgtggtcatcaccgaaaactgtgggacccgcggacccagcctccggacgacgacagtctccgggaagctgatccacgagtggtgctgccggtcttgcactctgccacccttgcggtacatgggcgaggacgggtgctggtacgggatggagattagacctatctccgaaaaggaggaaaacatggtgaagtcgctggtctcagccggcagcggggaggtagacaactttacaatgggcgtactgtgcttagcgatcctgttcgaggaggtcatgagagggaaattcggaaagaagcacatgatcgcaggggtgttcttcacgttcgtgctactcctgtctggccaaattacgtggagggacatggctcacaccttgataatgataggcagcaatgcctccgaccgaatggggatgggcgtcacttacctcgctttaatcgccaccttcaaaattcagcccttcctggcgctcgggttcttcttacgcaagttaacatcccgggagaacttgctgctgggcgtaggcctggccatggcgaccacccttcagctgcccgaggacatagagcaaatggctaacgggatagcgcttggcttaatggccctgaagctgatcacccagttcgagacctatcagctgtggactgccttaatcagcctcacatgctccaacaccatcttcacactgacggtggcctggagaactgctacgctgattctcgccggcgtctccttactgccagtgtgtcaatccagctccatgcggaagactgactggcttcccatgacggtcgctgccatgggcgtgccgcccctcccgctgttcatcttcagcttaaaggacacgttgaaacgacgatcctggccgttgaacgagggtgtgatggccgtcggcctcgtttcaatcttagcgtccagcctactccggaacgacgtaccgatggctggccctctagtcgccgggggactattaatcgcgtgctatgtaatcaccggcacgtccgcggacctgaccgtggagaaggcggccgatgtaacgtgggaggaagaggcggagcagaccggcgtatcgcacaatttgatgattaccgtggacgacgacggcacgatgcgcatcaaggacgacgagaccgagaacatactcacggtattgctgaaaaccgctctcttgatagtttccggcatcttcccgtatagcatccccgccaccctgttagtttggcacacctggcagaagcagacgcagcggtccggcgtcctgtgggacgtccccagcccgcccgagacgcagaaggcggagctggaggagggagtgtaccgcatcaagcagcagggaatcttcgggaaaacccaagtcggcgtaggggtgcagaaggagggcgtcttccacactatgtggcacgtgacgcgtggcgcagtgctgacttacaacgggaagcgcctggaacccaactgggcctccgtcaagaaggacctgatttcttacggaggaggctggagactctccgcccagtggcagaagggggaagaggtccaggtgattgcggttgagccgggcaagaaccccaagaacttccagaccatgcccggtaccttccagacgacaacaggggaaattggcgccatagctcttgatttcaaacccgggacgtcaggcagccccattatcaaccgcgaaggaaaagtggtggggttgtacggcaatggggtcgtaactaagaacggcgggtacgtctccgggatcgcacaaaccaacgccgaacccgatggccccacccccgaactggaggaggagatgtttaagaagcggaacctcacaatcatggacctgcaccccgggagcggcaagacgaggaagtacctgccggcgatcgtaagagaagccattaagcggcggctccgcacgctaatcctggcccccacccgtgtggtggccgccgagatggaagaggcgttgaaggggttgcccatcaggtaccagaccacggccactaagtccgagcacacaggccgggagatcgtagatctgatgtgccacgccaccttcactatgcgcctcttaagccccgtccgggtgccgaactacaacttaatcatcatggacgaagcgcacttcaccgaccccgcttccatcgcggcccgcgggtacatcagcacgcgggtaggcatgggcgaggccgccgcgatctttatgacggcaacgccacccgggaccgccgacgcattcccgcagagcaatgcccccatccaggatgaggagcgggacatccccgagcgcagctggaacagcggaaacgaatggatcacagactttgcggggaagaccgtatggttcgtgcctagcatcaaggctggcaacgacatcgccaactgcctacggaagaacgggaagaaggtcatccagctgtcccgcaagacattcgacaccgagtaccaaaagaccaagctgaacgactgggacttcgtggtaactacggatatatcagagatgggcgccaacttcaaggcggaccgggtaatcgacccgcgaagatgcctcaaacccgttatcctgaccgacggccccgaacgggtgatcctggcggggcccatgccagtcacagcagcctccgcggcccagcgccgaggacgggtggggcgcaacccccaaaaggagaatgaccagtacatcttcaccggccaacccttgaataacgacgaagatcacgcacactggaccgaggccaagatgttgctggataatatcaacacgcctgaggggatcatcccggcattattcgagcccgaacgggagaaaagcgctgcgatcgacggcgaataccgcctgaagggtgagtctcggaagacgtttgtggagttgatgaggcgcggggacttacccgtttggctggcccataaggtggcgagcgaaggcattaagtacacagaccgcaagtggtgcttcgacggacagcggaacaaccagatcctagaggagaatatggacgtcgagatttggaccaaggagggcgagaagaagaaacttcgcccccgatggctggacgctcgcacatactccgaccctctggccctaaaggagtttaaggacttcgcagcgggccgcaagtcaatcgcccttgacttagtgacagagatcgggagagtgcccacacacctcgcccatcgcacccggaacgctctcgacaacctagtcatgctccacacgagcgagcatggcgggaaggcttaccgccacgccgtagaagaactgcccgagaccatggagaccctgctcctacttggcctaatgatcctacttaccgggggtgccatgctgtttctgatcagcggcaagggaataggcaaaacgtcgattgggctaatttgcgtgatcgcctccagcggcatgctctggatggccgagattccgttgcagtggatcgcgtcagccatcgtcctggagttctttatgatggtgcttcttattcccgagccagagaagcagcgaacgccccaggataaccaactggcctacgtagtcatcgggatccttacgctggccgcgatcattgcggccaacgagatgggccttctagagaccacgaagcgcgacctgggcatgagcaaggagccgggggttgtttcccccaccagctatctggatgtagacctccaccccgcctcagcgtggaccctgtacgcggttgccaccacggtgatcacccccatgctgcggcacaccatcgagaacagcacagctaacgtcagcttagccgccatcgcgaaccaggcggtggtgttaatggggctggacaaggggtggccgataagcaagatggacttaggcgtcccactcttagccctcggatgctatagtcaagtgaaccccctgaccctgacggccgctgtgctcctcctgattacccactacgccatcatcggacccgggctacaggcaaaggcaactcgcgaggcccaaaagcgtacggccgcgggaatcatgaagaacccgaccgtagatggcataatgactattgatcttgaccccgtcatttacgacagtaaatttgagaagcagctgggccaggtgatgcttctcgtcctgtgcgcagtgcagctgctgctcatgcgcacctcctgggccctctgcgaggccctgacgctggcgaccggccccatcaccaccctctgggagggaagccccgggaagttttggaacaccactatcgcagtgtcaatggccaacatcttccggggtagctacttggccggggccggtctggcgttctccatcatgaaatccgtcgggaccggtaagcgcggcacggggtcccagggcgaaaccctcggggagaaatggaagaagaaactaaatcagctgagccggaaagagttcgacctctacaaaaagtccggtatcacagaggtggataggacagaggccaaggaaggtctgaagagaggggaaatcacccaccacgcggtgtcccgcggcagcgccaaactacagtggttcgtagaacgcaacatggtgataccggaaggacgcgtcatcgatttaggctgcgggagaggtgggtggagctactactgcgccggactgaagaaagtaacggaggtgcgcggctacactaagggcggacccggacacgaggagcccgtgccaatgagcacctatggatggaatatcgttaagttaatgtccgggaaggacgtgttctatctaccgcccgagaaatgtgacaccctgctgtgcgatatcggcgaaagctcccctagccctacggtggaggagtcccggacgatccgcgtcttaaagatggtggagccgtggctcaagaacaaccagttttgcatcaaggtgctgaatccctacatgcccaccgtcatcgaacacttggagcgccttcagcggaagcacggcggcatgctggtgcgcaaccccctgagtcgtaactccacccacgaaatgtactggatcagcaacggcaccggaaacatcgttgcgtcggtgaacatggtgagccgcctcttactgaaccggttcacgatgacgcatcgccggcccaccatcgagaaggacgtggacctaggcgctggcacccgccacgtcaacgccgagcccgaaactcctaacatggacgtgatcggggaacggataaagcgcataaaggaggagcacaactccacctggcactacgacgacgagaacccgtacaaaacgtgggcttaccacggcagttatgaggtgaaggccaccgggagtgcgagctccatgatcaacggcgttgtcaagctcctgacaaagccgtgggatgtcgtgccgatggtgacgcagatggctatgaccgacaccacgccctttggacagcagagagtttttaaggaaaaagtcgacacccgcaccccgcgttcaatgcccggcacccgacgggtgatgggcatcacggccgaatggctctggcgcaccctggggagaaacaagaaacctagattatgcacccgggaggagttcacaaagaaggtccggacaaatgcggccatgggagccgtctttaccgaggagaatcagtgggacagcgcaaaggccgcggtggaggatgaggacttctggaagctcgtcgatcgcgagcgggaactacacaagttgggaaagtgcggctcctgtgtgtacaacatgatggggaagcgcgaaaagaagctgggcgagttcggcaaggcaaagggttctcgggccatctggtacatgtggctgggcgctcgctaccttgagttcgaggccctcggctttctgaacgaggaccactggttctcccgggagaactcttactctggcgtggaaggggaaggactgcacaagttaggttacatccttcgcgacatcagtaagatacccgggggtgcaatgtatgcggacgacaccgccgggtgggatacccggatcacagaagatgacctgcacaacgaagagaagatcacgcagcaaatggacccagaacaccgacaactcgctaacgccatattcaagctgacctaccaaaacaaggtcgtgaaagtgcagcggccgacgcccaccggaaccgtcatggacatcatctcccgtaaagaccaaagaggctctggtcaggtggggacctatgggttaaacaccttcacgaacatggaagcacaattaattcgacaaatggagggcgaaggggtgttgtccaaggccgatttagagaacccccatctcccggagaagaagattacacagtggttggagaccaaaggcgtcgagcggctgaagcgcatggccataagcggcgatgactgcgtcgttaagcccatcgatgatcggtttgccaacgcactcctagccctgaacgacatggggaaagtgcggaaggacatccctcaatggcagccctcgaagggatggcatgactggcagcaggtccccttctgtagccaccatttccacgagctcataatgaaagatgggaggaaactggtggtcccctgccgcccccaggatgagttaatcggccgggcgcgcatctcccagggggcgggatggagcctccgggagacggcctgcctgggcaaggcgtacgcgcagatgtggtctctgatgtacttccacagacgtgacctcaggctagccagtaacgccatctgttccgccgtccctgtgcattgggttccgaccagtcgcacgacctggagcattcacgcccaccaccagtggatgacaaccgaggacatgctgacggtttggaatcgggtgtggatcgaggataacccatggatggaggataagacaccagtcacgacctgggagaacgtgccataccttgggaaacgcgaggaccagtggtgcggtagcctgatcgggctgaccagccgtgcgacttgggcccaaaatatccccaccgccatccaacaggtgcgttctctcatcgggaacgaagagttccttgactatatgcccagcatgaagcggtttcgcaaggaagaagagagcgagggagccatatggtga

SEQ ID NO: 25712 - RNA, 9873 nt, synthetic construct
  misc_feature 1..9873: note = derived and/or modified CDS sequence (opt11) from DENV-3__FJ898443__SS-prME
  source 1..9873: mol_type = other RNA
acgagcctctgtctcatgatgattctgcccgccgccctggcattccacttaaccagccgggacggggagccgcggatgatcgtggggaagaacgaacggggtaaaagcctgctgttcaagaccgccagtgggatcaacatgtgcaccctcatcgccatggacctgggtgagatgtgcgacgacaccgtaacctacaaatgcccccatattacagaggtggagcccgaggacattgactgctggtgtaacctgaccagcacctgggtgacctacgggacttgcaatcaggccggcgagcacagacgcgacaagcgcagcgtggccctcgcgccccacgtaggcatgggtctggacacccgcacccagacctggatgagcgctgagggcgcctggcgccaggtggagaaggtcgagacctgggccctgcgccacccggggttcaccatcctcgcgctattcctagcgcattacatcgggacctccctcacgcagaaggccgtgatcttcatcttactgatgctcgtaactcccagcatgaccatgcggtgcgtgggggtgggcaaccgtgatttcgtggaaggattatccggagcaacctgggtcgacgtggtgttggagcacggtgggtgcgtcaccacgatggcgaagaacaagcccaccttagatatcgagctgcagaagactgaagctacccagctggccacactccggaagctgtgcatcgagggcaaaatcaccaacataacaactgatagccgctgccccacgcagggcgaggccgtgctgccggaggagcaagaccagaactacgtgtgcaagcacacctacgttgacagaggttggggcaatgggtgcggcctcttcgggaagggctctctggtcacctgcgccaagttccagtgcctggagccaatagagggcaaggtggtccagtacgagaacctcaagtataccgtgatcatcacggtgcacaccggtgaccagcaccaggtcggcaacgagacgcaaggggttaccgcagaaatcaccccacaggctagcaccactgaagccatccttcccgagtacggcacgcttgggctcgagtgttccccgcgtactggcctggactttaatgagatgatcctgctcacgatgaaaaataaggcctggatggtccaccggcaatggttcttcgacctgcccctgccctggaccagcggcgccaccaccgagacgcccacgtggaaccgcaaggagctcttggtgaccttcaagaacgcccacgcaaagaagcaggaggtggtcgttctggggtcccaggagggcgccatgcacaccgcgctcacgggcgcgaccgaaatccaaaacagcggcgggacctccatcttcgccggccacctgaagtgccggctgaagatggacaagctcgaactgaagggcatgagctatgcgatgtgcaccaacacgtttgtgctgaagaaggaagtttccgaaacccagcacggaaccatccttatcaaggtggagtacaagggcgaagacgtgccgtgcaagatccccttcagcaccgaggacgggcagggcaaggcccacaacgggcgcctgatcacggccaaccccgtcgtgaccaaaaaggaggagcccgtgaatatcgaagcagagccgcccttcggcgagagcaacatcgtcatcggcaccggggacaacgcgctgaagatcaactggtacaagaagggctccagcatcggcaaaatgttcgaagctactgcccggggcgcccgcagaatggcgatcctgggcgacacggcgtgggacttcgggtccgtgggcggggtgctcaacagccttggcaagatggtccaccagatcttcgggtccgcgtataccgccctgttcagcggcgtgagctgggtgatgaagataggcattggggtcctcctgacgtggatcggcctgaacagcaagaatacgtcaatgtcattctcgtgcatcgccataggcatcataaccctgtacctgggggccgtagtgcaggctgacatggggtgcgtcattaactggaaggggaaggagctaaagtgcggatccgggatcttcgtgaccaacgaggtgcacacctggaccgagcagtacaagttccaagccgactcccctaagcgcctcgccacggccatcgccggcgcgtgggaaaatggggtctgtggcatccgctcaaccacccggatggagaaccttctgtggaagcagatcgccaacgagctcaattatatcctatgggagaacaatatcaaactgacggttgtggtcggggacatcatcggcgtgctcgagcagggcaagcgcacgctgactcctcaaccgatggagcttaagtactcgtggaagacctgggggaaggccaaaatcgtgaccgccgaaacgcagaacagctcattcatcatcgacggccccaacacccccgaatgcccatcggcgagccgggcctggaatgtctgggaggtggaggactacgggttcggcgtgttcaccacaaatatctggctcaagctgcgcgaggtctacacccagctgtgcgaccatcggttaatgtcagctgccgtgaaggacgagcgcgcagtgcatgcggacatgggctactggatcgaatcacagaagaatgggtcctggaagctggagaaggcctcattaatcgaggttaagacgtgcacctggccgaagagtcacaccctctggagcaatggggtgctcgagagtgacatgatcatccccaagagcctggccgggcccatctcccagcacaactaccggccgggctaccacacccaaacggccgggccctggcacctcggtaaactggaactggacttcaattactgcgagggaactacagtggtcatcaccgagaactgcgggacgcgcggccccagcctccggactaccacggtgagtggaaagctgatccacgaatggtgctgccgcagctgcacgctgcccccattaaggtacatgggcgaggacgggtgttggtacggaatggagatccgccccatctccgagaaggaggagaatatggtcaagagcctggtctccgctggctctgggaaggtggacaactttaccatgggcgtgttgtgcctcgcgatcctgttcgaagaggtgatgcgggggaagttcggcaagaagcacatgatcgcaggggtgttcttcaccttcgtgctgctcctgagcggccagatcacctggcgcgacatggcccacacgctcatcatgatcggcagcaatgcgtctgacagaatggggatgggtgtcacgtacctcgccttaatcgcgacctttaagatccagccattccttgccttggggtttttcctgcgcaagctgaccagccgggagaatttactcctgggtgtgggcctcgctatggctactacactgcaactgcccgaggacatcgagcagatggcgaacgggatcgccctcggtctgatggccctgaagctaataacccaattcgaaacctaccagctgtggactgccttgatctcccttacctgctccaataccattttcaccctaaccgttgcctggcgtaccgcgaccctgatcctcgcaggtgtaagcctgttaccggtgtgccagtcctcttccatgcggaagaccgactggctccccatgacggtcgcagccatgggcgtgccgcccttaccactgtttatcttcagcctcaaagacaccctgaaacgccgtagttggcccctgaacgagggagtgatggctgtcggcctcgtaagcatcctggcgtctagcctgctccgtaacgacgttcccatggcgggccctctggtcgccggcggcctgctcatcgcctgttatgtgatcacaggcactagcgccgacctgacggttgagaaggcggccgacgtcacctgggaagaggaggccgagcagaccggagtgagccacaacctgatgatcactgtggacgacgacgggacaatgcgcatcaaggatgacgaaacagagaacatcctgaccgtgctactgaagaccgccctcctgatcgtgtccggcatcttcccgtacagcatccctgcaaccctgttggtgtggcacacgtggcagaagcagacccagcggtccggcgtcctgtgggacgtgccctcaccacccgagacccagaaggcggagctggaggaaggggtgtaccgcataaagcagcagggcatcttcgggaagacccaggtcggggtaggggtgcagaaggaaggtgtcttccacacgatgtggcatgtgactcggggcgccgtgttaacctacaacgggaagcgtcttgagcccaactgggcctccgtcaagaaggacctgatcagctacggcggcggctggcgtctctccgcccaatggcagaagggggaggaggtccaggtgatcgcggtcgagcccggcaagaaccccaagaacttccagaccatgcccggcacttttcagaccaccactggggagataggtgccattgccctagacttcaaacccgggacgagcggcagcccaatcatcaaccgcgagggcaaggtggtggggctgtacggcaacggagttgtgaccaaaaacggcgggtacgtgtccggcattgcccagaccaatgccgagcctgacggccctacccccgagctggaggaggaaatgtttaagaagcggaacttgacgatcatggatctgcaccccgggagcggcaaaacccgtaagtacctgccggcgattgtgcgggaggccatcaaacgccggctccgcaccctgatcctggcccccacccgggtagttgccgctgaaatggaggaggcactcaagggcctgcctatacgctaccagacgaccgccaccaagtccgaacataccggccgtgagatcgtcgacctaatgtgccacgccaccttcaccatgcgtttactcagccccgtccgggtgccgaactacaatctgattatcatggacgaggctcactttacggacccggcctccatcgcggcccgcgggtacatcagcacccgggtcggcatgggcgaggcagccgccatcttcatgactgcgacgccgcccgggaccgccgacgccttcccgcagtccaacgcccccatccaggacgaagagcgcgacatccccgagcgcagttggaactccggcaacgagtggatcactgacttcgcggggaagacagtttggttcgttcccagcattaaggccggcaacgacatcgctaactgcctcagaaagaacgggaaaaaggtaattcagctttcccgcaagacgtttgacaccgagtaccagaagaccaagctgaacgactgggacttcgtggtgacgaccgacatcagcgagatgggcgctaatttcaaggcagatagggtcatcgacccgcgccggtgcctcaagcccgtgatcctgacggatggccccgagcgcgtgatcctggcagggcccatgccggttaccgccgcctccgccgcgcagaggcgcggtcgggtggggagaaacccccagaaggagaacgaccagtacatattcaccggccagcccctcaacaacgacgaggatcacgcgcactggacggaggccaagatgctgcttgataacatcaacactccagaggggatcatcccggcgctcttcgagcccgagcgtgagaagtctgccgcgatcgacggcgagtaccgcctgaagggcgagtcccggaagaccttcgtggaacttatgcgccgcggagacctacccgtctggctggcccacaaggtggcgtcggagggcataaagtacaccgaccgcaagtggtgcttcgatgggcagcgaaacaaccagatcctggaagagaacatggacgtcgagatctggacaaaggagggcgagaagaagaagcttaggccccgatggctggacgcacgcacctactccgatccgcttgcgctcaaggagttcaaggacttcgcggccggccgcaagtctatcgccctggatctggtgaccgagatagggcgtgtccccacccacctcgcccatcgcacgcgaaacgccctggacaacctggtcatgctccacacctccgagcacggcggcaaggcgtatcgccacgcggttgaggagctgcccgagaccatggaaactctgttgctgctgggcttgatgatcctgctgaccggaggggccatgctattcttgataagcgggaaggggatcgggaagaccagcatcggtctgatctgtgtgatcgcgagtagtggcatgctctggatggccgagatccccctgcagtggatagcctccgccatcgtcctggagttcttcatgatggtcctcttgatacccgagcccgagaagcagcgtacgccccaagacaaccagttggcctacgtggtcatcgggattctcaccctggccgccatcatcgccgccaacgagatgggtcttctcgagaccacgaaacgcgacttgggcatgagcaaggagccgggggtggtctccccaaccagctacctggacgtcgaccttcaccccgcttccgcctggaccctgtatgcggtggccacgaccgtgatcacacccatgctgcggcacacgatcgagaacagcacggccaacgtgagcctcgccgccatcgcgaatcaggccgtggtactaatgggcctggacaaggggtggccgatcagcaagatggacctcggcgttcccctgctggccctcggctgttactcccaggtgaaccccctgaccttaacagcggcagtgctcctcctcatcacccactacgcgatcatcggccccggtctccaggccaaggccacgcgcgaggcccagaaacggaccgccgcggggatcatgaagaacccgacggtcgacggtatcatgactattgacttagacccggtgatctacgacagtaagtttgagaagcaacttggccaagtgatgctcctggtcttgtgcgccgtgcagctcttgctgatgcgcacgtcctgggccctctgcgaagccctgacattggcaacgggacccatcaccacgctctgggagggctccccggggaagttctggaataccaccattgccgtttccatggccaacatcttccggggctcctacctcgccggggccggcctggcgttctccatcatgaagagtgtcggaaccggaaagcgcgggaccgggtcccagggcgagacgctcggtgagaagtggaagatgaagctgaaccagctaagccggaaggagttcgacctctacaagaagtccggcatcaccgaagtggaccgcacggaagccaaggaggggctgaagcgtggcgagatcacccaccacgccgtgtcccgcggcagcgcgaagctgcagtggttcgttgaaagaaacatggtgatccctgaggggcgcgtgatcgacttgggctgcgggcggggcgggtggtcctactactgcgccggtcttaagaaggtcacagaagtgaggggctacaccaagggggggccggggcacgaggagcccgtgccgatgagcacctacggctggaacatcgtcaagctgatgtccgggaaggacgtgttctacctcccgccagaaaagtgtgacaccctgctgtgcgacatcggcgagagctccccctcgcccacagtggaggagtcccggacgatccgggttctgaaaatggtggagccgtggctgaagaacaaccagttctgcatcaaggtgttaaacccctacatgcccaccgtcattgagcacctagagcgcctgcagcggaaacacggcgggatgctggtgaggaacccccttagccgaaattccacacacgagatgtactggattagcaacggcactgggaacatcgtggcgagtgtcaacatggttagccgactcctcctgaaccgtttcaccatgacacatcgccggccgacaatcgagaaggacgtggacctcggcgccggcacgcgccacgtcaacgccgagcccgaaacccccaacatggacgtcataggggagcggataaaacggatcaaggaggagcataacagtacttggcattacgacgacgagaacccgtacaagacgtgggcctaccatggcagctacgaggtgaaggccacggggtccgcgagctccatgatcaatggcgtcgttaagctgttaaccaagccctgggacgtcgtgcccatggtgacccagatggcgatgaccgataccaccccattcgggcaacagcgggtctttaaggagaaagtggacaccagaaccccacggagcatgccaggcacgcgccgagtgatgggcataaccgccgagtggctctggagaacccttgggagaaacaagaagccccgcctgtgcacccgggaggagtttactaagaaggttcgcaccaatgccgcgatgggcgccgtgttcactgaagagaaccagtgggacagcgccaaggccgccgtggaggacgaggacttctggaagctcgtcgaccgcgagcgtgagttacacaagctcggtaagtgcggctcctgcgtgtataacatgatgggtaaacgcgagaagaagctcggcgagttcggtaaggcgaagggatcacgagccatctggtacatgtggctgggggcccggtatctggagtttgaggccctcgggttcctgaacgaagaccattggttctcccgggagaacagctattccggcgtggagggggagggactgcacaagctcggatacatcctgcgcgatatcagcaagattccagggggcgccatgtacgcggacgacacagccggctgggacacgcggatcaccgaggacgacctgcacaacgaggaaaagatcacccagcagatggacccggagcatagacagctcgcaaacgccatattcaagctgacctaccagaacaaggtcgtgaaggtgcagcgtcccacccccacgggcaccgtcatggacatcatcagtcgcaaggaccagcggggcagcggtcaggtgggcacctacgggttaaacaccttcacgaacatggaggcacagctcatccgccagatggagggcgagggcgtgctgtccaaggctgacctggagaacccccacctcccggagaagaagatcacccagtggctggagaccaagggggttgagcgactgaagcgcatggccatcagcggcgacgactgcgtggtgaagcccatagacgaccgcttcgccaacgcgctcctggccctgaacgacatgggaaaggtccgcaaggacattccccagtggcagccctcaaaggggtggcacgactggcaacaggtaccgttctgcagccaccacttccacgagctcatcatgaaggacgggcgaaaactggtggtcccctgtcgcccccaggacgagctgattggccgggcccgcatctcgcaaggcgcgggctggagcctccgggagacagcctgcctgggcaaggcttacgcgcagatgtggagtttgatgtacttccaccgccgcgacctccggctggcaagcaacgccatctgtagcgccgtacccgtgcactgggtcccgacgagccggactacctggtccatccacgctcaccaccagtggatgaccacggaggacatgttgaccgtttggaaccgggtgtggatcgaggacaacccctggatggaggacaagacccccgtcaccacgtgggagaatgtgccctacctgggaaagcgcgaggaccagtggtgcggcagcctgatcgggctgaccagccgggcgacctgggcccagaacatcccgacggccatccagcaggtccgcagtctcatcggcaatgaggagttcctggactacatgcccagtatgaagcggttccgcaaggaggaagagctggaaggggccatatggtga

SEQ ID NO: 25713 - RNA, 9873 nt, synthetic construct
  misc_feature 1..9873: note = derived and/or modified CDS sequence (opt11) from DENV-3__FJ898444__SS-prME
  source 1..9873: mol_type = other RNA
accagcctgtgcctcatgatgattctgcccgccgccctggcgttccacctcacctcgcgggacggcgagcctcgtatgatcgtcggaaagaacgagcgtggcaagagcctgctcttcaaaaccgccagcgggatcaacatgtgcaccctaatcgccatggacctgggagaaatgtgtgacgacaccgtgacctacaaatgcccccacattactgaggtggagccggaagacattgattgctggtgcaacttaacaagcacctgggtgacctatgggacgtgcaaccaggcgggcgaacaccggcgtgacaagcggtcggtggccctcgcgccccacgtaggcatggggctcgacacccgcactcagacctggatgagcgccgagggcgcctggcgccaggtggagaaggtcgagacgtgggcgctcagacatccggggttcaccatcttggcgctgttcctggctcactacatcggaacctctctcacccagaaagtagtaatcttcatcctattgatgctcgtgacgcctagcatgaccatgcggtgcgtcggggttggtaatcgcgacttcgtcgagggcctttccggggccacctgggtggacgtggtcttggagcacggcggttgcgtcaccaccatggccaagaataagcccaccttggacatcgagctacagaagaccgaggccacccagttggccacgctcaggaagctgtgcatcgagggcaaaattaccaatatcaccaccgacagccgctgcccgacacagggcgaagccgtgctgccggaggaacaagaccagaactacgtctgcaagcacacatacgtggacagggggtgggggaacgggtgtggtctcttcggtaagggatcactggtcacctgtgccaaattccagtgcttggagcccatcgaaggcaaggtcgtgcaatacgaaaacctcaagtacaccgtgatcattacggttcacaccggggaccagcaccaagtgggcaacgagacgcagggcgtcactgccgaaatcacgccacaagcctcgactaccgaagcgatcttgcccgagtacggaacccttgggctcgagtgctctccgcgcactggattggacttcaacgagatgatcctactcacgatgaagaacaaggcctggatggtacaccggcagtggttcttcgacctgccactgccctggaccagcggggcgaccactgagacgcctacgtggaatagaaaggagctcctggtgaccttcaaaaatgcacacgccaagaagcaggaagtcgtggtgctcggcagccaggagggcgcgatgcacaccgccctcactggcgccaccgagattcagaacagcggcgggacgtccatctttgccggccacctgaagtgccggctgaagatggacaagctcgagcttaaaggcatgagctatgcaatgtgcaccaacacgttcgtcctgaagaaggaggtgtccgagacccagcacgggaccatcctcatcaaggtcgagtacaagggcgaagacgctccatgcaagattcccttttcaacggaggacgagcaaggtaaggcccacaacggacggttgataacggcaaaccccgtcgtgacaaagaaggaggagcccgtgaacatagaggccgaaccaccattcggagaaagcaacatcgtcatcgggatcggcgacaacgcgctgaagatcaactggtacaagaaggggtccagcatcggcaagatgttcgaggccactgcccgcggggcgcgccggatggcgatccttggcgacaccgcctgggacttcggttctgtcgggggcgtgcttaacagccttggtaaaatggtccaccaaatatttggcagtgcttacacggcgctgttcagcggggtgtcgtgggtgatgaaaattggtatcggcgtccttctgacgtggatcggactgaatagcaagaacacgtctatgagcttctcctgcatcgccatcggcatcatcactctctatctgggggccgtggtgcaggccgacatgggctgcgtcgtgaattggaaggggaaggagctgaagtgcggcagtggcatcttcgtaacaaatgaggtccacacctggaccgaacagtacaagttccaggccgattcccccaagcgcctcgccacggccatcgcgggcgcttgggagaatggcgtgtgtgggatacgctcaacgacccggatggaaaacctgctgtggaagcagattgccaatgagttaaactacatcctatgggagaacaacataaaactgaccgtggtcgtaggggacatcatcggggtactagagcagggcaagagaaccctgactccccagccgatggagctgaagtactcctggaaaacctggggcaaagccaagatagtcaccgccgagacccagaacagttccttcatcatcgacggccccaatacccccgagtgtccatcggcgtcccgggcttggaatgtgtgggaggttgaggactacggctttggggtcttcaccaccaatatatggctcaagttacgagaggtttacacccagttgtgcgaccaccgcctcatgtcagccgccgttaaggacgagcgcgccgtacacgcggacatgggttactggatcgagtcgcagaaaaacgggagctggaagctggagaaggccagcctgatcgaagtaaagacctgcacgtggccgaagagccacaccctctggagcaacggggtgctcgagtcggacatgataattcccaagagcctggcaggccctatctcccagcacaactaccggccggggtatcacacccagaccgccggcccatggcatctcgggaagctggagctcgactttaactactgcgagggcacaaccgtcgtgatcaccgagaactgcggtactcgcggtcccagcctgcggacgaccaccgtgagcggcaagctgatccacgagtggtgctgtcgcagctgcacactacctccgctccggtacatgggtgaggacggctgctggtacggcatggagatccgtcccatctccgagaaagaagagaacatggtcaagagccttgtgtccgccggaagcggcgaggtggataacttcacgatgggtgtcctgtgtctcgcgatccttttcgaggaggtgatgcggggcaagttcgggaagaagcacatgatcgctggcgtcttcttcaccttcgtcctgctcctttccggacagatcacctggcgcgacatggcccacaccctgatcatgatcgggagcaacgcctccgaccgaatgggcatgggggttacgtacctcgccttaatcgcgaccttcaaaatacagcctttcctggccctcggattcttcctcaggaagctgaccagccgggagaatctcctcctgggggtgggtctggctatggcgaccactttgcagctgcccgaggatatcgagcagatggcgaacggcatcgccttggggctgatggccctgaagctcataacccaattcgaaacctatcaactatggaccgccctcattagcttaacgtgctccaatacgatcttcaccttaactgtcgcctggcggaccgcgaccctgatcctcgccggcgtaagcctgctgcccgtctgccagtcctcttccatgcggaagaccgactggctccccatgaccgtggccgccatgggggtgccgccactgccgctgttcatcttcagcctcaaggatacgctcaagaggaggtcctggcccttaaacgagggcgtcatggccgtagggctcgtgagcatcctggcctcctcgctgctccggaacgacgtccctatggccggccccctggtggccggcgggctgttaatagcttgctacgtgatcactggcacttccgccgatctgacagtggagaaggcagccgacgtgacatgggaggaggaggcagagcaaaccggggtctcgcacaatctgatgattacggtcgacgacgacggcaccatgcgcatcaaggacgacgagaccgagaacattttgaccgtcttacttaagaccgcactcctgatcgtgtccggaatcttcccgtacagcatccccgccaccctgctcgtctggcacacctggcagaagcaaacgcagcggtcaggagtactgtgggacgtgcccagccctcccgagacccaaaaggctgagctggaagagggcgtctatcgcatcaagcagcaggggatcttcggcaagacacaggtcggagtgggggtccagaaggagggagtgtttcataccatgtggcatgtgacgagaggcgccgtcctgacttacaacggcaagcgcctggagcccaactgggcttccgtgaagaaggacctgattagctacgggggcgggtggcggttatccgcccagtggcagaagggcgaggaggtgcaagtgatagcagtggaacccggaaagaaccccaagaacttccagaccatgccgggcacgtttcagacaaccaccggcgagattggggccatcgcactggactttaaacccggaaccagcggtagccccattatcaaccgcgagggcaaggtagtcggcctgtacgggaacggggtcgttacgaagaatgggggctacgtctctgggatcgcccagaccaacgccgagccggacggccccacaccagagctcgaggaggagatgttcaagaagcggaacctcaccatcatggatctgcacccgggtagcgggaagacccgcaaatacctcccggcgatcgtgagggaagccatcaagcgccggctccgaaccctgatcctggcccccacccgggtggtcgccgccgagatggaggaggcattgaagggcctgcccatccgatatcagacaacggctaccaagtcagagcacacagggcgggagatcgtggatctgatgtgccacgccaccttcacgatgcgcctcctgagccccgtgcgggtccctaactacaaccttatcatcatggacgaggcccacttcacagaccccgcgtccatcgcggcacgcggctacatcagcacacgggtgggcatgggcgaggccgccgctattttcatgacggcaacgccacccggcactgctgacgccttcccgcagtccaacgctcccatccaggacgaggagcgcgacatcccagagcgttcgtggaactccgggaatgagtggatcaccgacttcgcgggcaagaccgtgtggtttgtccccagcatcaaggctgggaacgacatcgcaaattgtctgaggaagaacggcaagaaggttatccagctgtcccgcaagacgtttgatacggaataccagaagactaaactgaacgattgggacttcgttgtcacaacggatataagcgagatgggggccaattttaaagccgaccgggtgatcgacccgcgccggtgtctcaagcccgtgatcctgaccgacggccccgagcgggtgattctggcgggccccatgccagtgaccgccgcctccgccgcccagcggcgcgggcgcgtgggccgtaatccccagaaggagaacgaccagtacatcttcaccgggcaacccctgaataacgatgaggatcacgcgcactggaccgaagccaagatgctgttagataacatcaacacgcccgagggtatcatcccggctctcttcgagcccgagcgggagaagagtgccgcgatcgatggggagtacaggctgaagggtgagtctcgcaagaccttcgttgaactaatgcgcagaggcgacctccccgtctggctcgcctacaaggtcgccagcgaggggataaagtacaccgatcgcaagtggtgcttcgacggtcagaggaacaatcagatcctggaggaaaacatggacgtggaaatctggaccaaggagggggagaagaaaaagctccgcccccggtggctggacgcccgcacgtacagtgacccattggccctcaaagagtttaaagactttgcagcaggccgcaagtctatagcactggacttggtcacagagataggtcgggtcccgacacacctcgcgcatcgcaccaggaacgccctggacaacctggtgatgctacacacctcagagcatgggggcaaggcttacaggcacgccgtggaggagctacccgagaccatggagaccctgctcctgctggggctcatgattctattaaccggcggggcaatgctattcctgatatcaggcaagggcattgggaaaacaagcatcggcttgatctgcgtcatcgcctccagcgggatgctctggatggccgagatccccttacaatggatcgcgtcagccatcgtgcttgagttcttcatgatggtactcctgatacctgagcccgaaaaacagcgcaccccccaggataaccagctggcctacgtggtgatcggcatattaacactcgccgccatcatcgcggccaacgagatggggctgctcgagaccacgaaacgcgacttgggcatgtcccgcgagcctggcgtggtctcccccactagctacctggatgtggacctgcaccccgcatccgcctggaccctgtacgcggtggccaccacggtcataacacctatgctgcgacacaccatagagaacagcaccgccaacgtatccctcgccgccatcgcgaaccaagccgtagtcctgatggggctggataaaggctggccgatcagcaagatggacctcggggtgccgctgctcgccctaggatgctacagtcaagtgaaccccctgacgctgacagccgccgtcctcttattaataacgcactacgcgatcatcggtccggggttgcaggccaaagcgacccgggaggcccagaagcgcacggcagcgggaatcatgaagaacccgacagtggacggaatcatgaccatcgacctggaccccgtgatctacgacagtaagttcgaaaagcagcttggacaagtcatgctcctggtgctgtgcgccgtgcagctcctgttaatgcgcacctcctgggccctctgtgaggccttaacgcttgcgaccgggcccatcacgaccctctgggagggcagcccaggcaaattctggaacacgaccatcgccgtcagtatggccaacatttttcgagggtcctacctggccggcgctgggctggcgttctccatcatgaagtccgttggaacgggaaagcggggcactggctcccagggggagaccctcggcgagaagtggaagaagaagctgaaccagctaagccgcaaagagttcgatctatacaagaagtcggggatcaccgaggtggatcggaccgaggccaaggagggcctgaagaagggcgagatcacccaccacgccgtctcccgcggcagcgccaagctgcagtggttcgtggagagaaatatggtgatccctgagggccgcgtgatcgacctcggttgcggtcgcgggggctggtcctattattgcgccgggctgaaaaaggtgaccgaagtacgagggtacacgaagggcgggcccggccacgaggagcccgtcccgatgagcacctacgggtggaacatagtgaagttgatgtccgggaaggatgtgttttaccttccacccgagaagtgcgacaccctcctctgtgatatcggggaatcctccccctcacccaccgtcgaggaaagccgaacgatcagagtgctgaaaatggtggaaccgtggttgaagaataaccagttctgcatcaaggtcctgaacccctacatgcccaccgtgatcgagcatctggagcgcctccagcggaagcacggtggcatgctggttcgcaaccccctgagtcggaactccacacatgagatgtactggatcagcaacggcaccgggaacatagtcgcgtccgtgaacatggtgagccgactccttctgaaccggttcaccatgacgcaccgccggccgaccatcgagaaggacgtcgacttgggggccggtaccaggcacgtgaacgctgagcccgagacgcccaacatggacgtgatcggcgagcgtatcaagcgcatcaaggaggagcataactccacctggcactacgacgatgaaaacccgtacaagacctgggcctaccacgggtcgtacgaggtcaaggcaacgggcagcgcgagctccatgatcaacggggtggtgaagctgttaacgaaaccgtgggacgttgtacccatggtaacacagatggcgatgaccgacaccacgcctttcggtcagcagagggttttcaaggagaaagtggacacacgcacccctcggcccatgcccggaaccagacgggtcatggggatcacggcggagtggttatggcgtaccttaggtcggaataagaagcctcgcctgtgtacccgggaggaattcaccaaaaaggttcgcacaaatgccgcgatgggtgccgtgttcaccgaggaaaaccagtgggacagcgcgaaggccgccgtcgaggacgaagatttctggaagttggtggaccgagagcgggagcttcataagctggggaagtgcgggagctgtgtctataacatgatgggcaaacgcgagaagaagctcggggaattcggcaaagccaagggatcccgggccatttggtacatgtggctgggagcccgctacctggaattcgaggccttaggcttcctgaacgaagaccactggttcagccgggagaactcatacagcggggtagagggtgaggggctgcacaagctcggctacatactgcgggacatctccaaaatcccgggcggcgccatgtacgcggacgacaccgccgggtgggacacccggatcactgaggatgacctgcacaacgaggagaagatcacccagcagatggacccggagcaccgccaactggccaacgccatatttaaactgacgtaccagaacaaggtggtaaaggtccaacggcctacgcccactgggacggttatggacatcataagccgcaaggaccagaggggctccggccaggtagggacctacgggctgaacaccttcaccaacatggaagcccagctcatccgccaaatggaaggcgagggcgtcctgtctaaggcggacctggagaacccgcacctccccgagaagaaaatcacgcagtggctagagaccaagggggtggagcgtctgaaacgcatggccatcagcggagacgactgtgtggtcaaaccgattgacgaccgcttcgccaacgccctcctggccctgaatgacatgggcaaggtgcgcaaggatatcccgcagtggcagccgagcaaggggtggcacgactggcagcaggtgccattctgttcccaccatttccacgagctcatcatgaaggacggtcggaagctggtcgttccctgccgcccccaagacgagctgatcgggcgggctcgcatcagccagggcgctggctggagtttgcgggagaccgcatgcctgggtaaggcctacgcccagatgtggagtctgatgtacttccaccgtcgtgatctccggctggcctccaacgccatctgcagcgccgtcccggtccactgggtgccaacctcccgcacgacctggtccatccacgcccaccatcagtggatgaccaccgaggacatgttaacggtgtggaaccgggtctggatagaggacaacccttggatggaagacaagacacccgtgaccacctgggagaacgtgccgtatttaggaaaacgcgaggaccagtggtgcggttccttaatcggcctgacgagtcgggcgacctgggctcagaacatccccacggccatacaacaggtccgcagcctcatcgggaacgaggagttcctggactacatgccctccatgaagcggttccggaaggaggaagagagcgagggcgccatctggtaa

SEQ ID NO: 25714 - RNA, 9873 nt, synthetic construct
  misc_feature 1..9873: note = derived and/or modified CDS sequence (opt11) from DENV-3__FJ898445__SS-prME
  source 1..9873: mol_type = other RNA
acgtcgctttgcctcatgatgatcctgcccgcagcactggcattccatctgacctcccgagacggtgaaccgagaatgatagtggggaaaaatgaacgcggtaaaagcctgctctttaaaaccgcatcgggcataaacatgtgcaccctgatagcgatggaccttggagaaatgtgcgatgacaccgtcacctacaaatgcccacacatcaccgaagtggaaccggaagacatagactgctggtgcaacctcaccagcacctgggtcacgtacggcacgtgcaaccaagcgggagaacatcgacgagacaaacgatccgtagccttagcaccacacgtgggaatgggactagacacacgcacacaaacatggatgagcgcagaaggcgcatggagacaagtcgaaaaagtagaaacatgggcgctcagacatccgggcttcacaatactcgcgttattcctcgcacactacattgggacgtcgttaacgcaaaaagccgtcattttcactttgctaatgctcgtaacgccttcaatgaccatgcgctgcgtgggagtcggcaaccgagatttcgtggaaggcctgagtggggcgacatgggtcgatgtagtcctggaacacggcggctgcgtaaccacaatggccaaaaataaaccaacactagacatcgagcttcagaaaacagaggcgacgcaactagcaacacttagaaaattatgcatagaaggtaaaatcacgaacataactacggacagcagatgcccaacccaaggcgaggcggtcctacccgaagaacaagaccaaaactatgtgtgcaaacacacctacgtcgaccgaggctggggcaacgggtgcggcctcttcggaaaaggctcgctcgtaacgtgcgccaaatttcaatgcctagagcccatcgaaggcaaagtagtccaatatgagaacctcaaatacacagtgatcatcaccgtccacacaggcgatcagcatcaagtcggtaacgaaacacaaggggtaacagcagagataacgccccaggccagtaccacggaagccatactaccagaatacggaacgttgggactggaatgctcccctcgaacaggcctcgatttcaatgaaatgatactgttgaccatgaaaaacaaagcctggatggtacaccgtcagtggttcttcgacctaccactcccgtggacatccggagcaaccaccgaaaccccaacctggaacagaaaagagctgctggtaacattcaaaaacgcccatgccaagaaacaagaggtagtcgtgctgggatcgcaagaaggagccatgcacacagcactcacaggcgcaacagagatccaaaactcaggaggcacgtcaatcttcgcaggccacctcaaatgccgcctcaaaatggacaaactagaattgaaaggcatgtcatacgcaatgtgcacaaacaccttcgtccttaaaaaggaggtctccgagacacagcatggaaccattctaataaaggttgaatacaagggcgaggacgtgccctgcaaaataccattctcgacggaggacgggcaaggcaaggcccacaatggccgtttgatcaccgccaacccagtagtgacgaagcgtgaggagccagttaacattgaagcagaaccccctttcggtgaaagcaacatagttatcggaatcggagacaacgcgctaaaaatcaactggtacaaaaagggatcgtccattggaaaaatgttcgaggcaaccgcccgaggagcacgtagaatggcaatcctcggtgacacagcctgggacttcggaagtgtcggaggcgtactaaattcactcgggaaaatggtgcatcaaatctttgggtcagcgtacactgccctgttctcgggcgtcagctgggtcatgaagataggcataggcgtcctgctaacatggataggcctaaatagtaagaacacgagcatgtcattctcgtgtattgcaataggcataattacactatacctgggcgcggtagtacaagcggatatggggtgcgtcataaattggaaaggcaaagaattaaagtgtggcagtggcatctttgtaacaaacgaagtacacacgtggacggagcagtacaagttccaggcggattcgcccaagcggctcgccaccgccatcgccggggcgtgggagaacggagtatgtggaatacggagcaccaccaggatggagaacctgctgtggaaacagatagcaaatgaactcaactacatcctctgggaaaacaacataaaacttaccgtagtcgtcggtgacatcatcggcgtcctagaacaagggaaaaggacacttacacctcaaccgatggaactaaagtattcttggaagacttggggcaaagcgaaaatagtgacggcagagacacaaaactcctcgtttattattgacggccccaatacaccagagtgcccgtccgcttcaagggcatggaacgtgtgggaggtcgaagactacggcttcggagtcttcaccaccaatatatggctaaagctacgcgaagtctacacgcaattgtgcgatcatcgtctaatgagtgcagcggtaaaggatgagagggccgttcacgctgacatgggttactggatggagtcacagaaaaatggaagttggaagctagagaaggcttcacttatcgaggtcaagacatgcacctggccgaaaagtcacacattatggagtaacggtgtgctggaatccgatatgataatcccaaaaagcctagcaggacccatctcacagcacaactaccgacctggctaccacacgcaaacggccggaccatggcaccttggcaaacttgaactagacttcaactactgtgaaggcaccacggtggtaatcaccgagaattgcggaacaagaggccccagcttaagaacaactacggtgtccggaaagctaatacatgagtggtgctgtaggtcgtgcaccctgcctcctctcagatacatgggtgaagatgggtgttggtatggaatggagatcagacccatctccgaaaaagaggaaaacatggtcaagagccttgtatccgctgggtcaggcgaagtcgacaacttcaccatgggcgtattgtgcctagcaatcctattcgaagaggtaatgaggggaaaattcggcaagaaacatatgatcgctggagtattcttcaccttcgtactattactgtcagggcagatcacgtggagagacatggcacacacacttatcatgatagggtcaaacgcatccgaccgaatgggaatgggggtgacctatctcgccttgatcgcaactttcaaaatacagccattcctggctctgggtttcttcctgcgcaagctcacaagccgagaaaacctcctccttggagtaggactagcaatggcaacgacgctgcaattaccagaggacatcgagcagatggcaaacggaatcgcccttggactgatggcactgaaacttattacacaattcgaaacctaccagctatggacagcgctaattagcctcacatgcagtaacactatattcacactcaccgtcgcctggagaaccgctaccttaatcctagcaggcgttagcctattaccagtttgccaatcttcaagtatgcggaagaccgattggctccccatgactgttgctgcaatgggcgtacccccgctacccctattcattttctcactaaaggacacgctcaaacgccgcagttggccacttaacgaaggagtaatggccgtcgggctcgttagtatccttgcatcctcactccttcgcaacgacgtgccaatggccgggcctctagtggctggcggtctacttatcgcatgctacgttatcacaggaaccagcgcagacctcacggtggaaaaagccgcagatgttacatgggaagaagaggcagaacaaacgggcgtgagccataatcttatgatcacagtcgacgacgacgggaccatgcgcattaaagacgatgaaaccgagaacatcttaaccgttctgctcaaaaccgccctactcatcgtatcaggcattttcccatacagtatacccgccactttattagtctggcatacgtggcaaaaacagacacaacgatccggagtactatgggacgtcccttcaccgccagagacccagaaagcagagcttgaagaaggggtgtaccgcatcaaacaacaagggattttcggcaaaacacaggttggcgttggtgtacagaaagaaggagtatttcacactatgtggcacgtaacacgtggcgcagtcctaacttacaacggaaagagactagaaccaaactgggcaagcgtcaagaaagacctcatcagttacggcggaggttggagattatccgctcagtggcaaaaaggtgaggaagtacaagtaatagcagtagaaccgggtaaaaacccaaagaactttcaaacgatgccgggaacatttcaaactaccacgggggagatcggtgccatcgcccttgacttcaaacctgggacttccgggagccctatcatcaacagggaaggaaaagtagtggggttatatggaaacggcgtcgtaaccaaaaatggagggtacgtgtcagggatcgcccagacaaacgcagaaccggacgggccaacaccagaactggaagaagagatgttcaagaaaaggaatttaacaatcatggatctgcacccagggtcgggcaagacgcggaagtacttgcctgccattgtccgggaggcaattaagagaaggcttcggacattaatcctagcccctacacgagtcgtcgccgctgagatggaggaagccctgaaaggcctccccatcagataccaaactacagcaacaaaatccgagcacaccggccgtgaaatagtcgacctgatgtgccacgcaacatttaccatgagactgttaagcccagtaagagtcccgaactacaacctcatcattatggacgaagcacacttcacggacccagcgagcatagccgcccgaggctacatctcaacacgcgttggtatgggagaagccgcagccatctttatgaccgcgacacccccgggcaccgcggacgcctttccccaatccaacgctcccatacaggatgaagaacgagacatacccgagagatcctggaactcaggcaacgaatggataaccgattttgccggaaagactgtttggtttgtccccagtataaaagcggggaatgacatagccaactgcctgaggaaaaatggtaagaaagtgatccaactcagtagaaaaacgtttgacacagagtaccagaaaacgaagctcaacgactgggactttgtggtcaccacggacatcagcgagatgggggcgaatttcaaggccgaccgggtcattgaccctaggcggtgcctcaagccagttatcctcacagatggcccggaacgggtcattttagccggaccaatgcctgtaacagcggctagcgccgcccagcgacggggaagagtcggcagaaacccgcaaaaagagaatgaccaatacatcttcaccggccaaccgttaaacaacgacgaagaccacgcacattggacagaggcgaagatgctcttagacaatatcaacacccccgagggcatcatccccgcactgttcgagcctgaaagagagaaaagcgcagctattgatggagaataccgcctgaaaggggagagcagaaaaacattcgttgagctcatgcgacgcggcgatctacccgtctggctggcctacaaagtggcatcggaagggataaagtataccgatcgaaaatggtgtttcgatggccaacgaaataatcagattctcgaagagaacatggacgtcgaaatttggaccaaagaaggggagaagaagaaactgcgaccccgatggctagacgcacgcacatatagcgacccactcgccctaaaagagttcaaggatttcgccgcaggcaggaaatccattgcacttgaccttgtgacagagatcggccgcgtgccaacccacctcgcacatcgaacccgtaacgccctagacaatcttgtgatgctacacacgagcgagcacggaggcaaggcatatagacacgctgtagaagaactcccggagacaatggagaccctactcttgctcgggctaatgatacttctgacagggggtgccatgctattcctcataagcggaaagggcatcggtaagaccagcatcgggctgatatgtgtcatcgcttcgagtgggatgctgtggatggccgagataccactccaatggattgcgtcagcaatcgttttggagttcttcatgatggtacttctaatcccagaaccggagaagcaaaggacccctcaagacaaccagctggcctacgtagtaataggcatcttaaccttagcagcgatcatcgcagcaaacgagatgggcatgctagaaaccacaaagcgggaccttggaatgagtaaagaaccaggggtggcaagtccaacgagctatctcgacgtcgatctgcaccccgcaagcgcatggaccctatacgccgtcgcaacgacagtcatcacgccaatgctacgtcacacgattgaaaattcaacggcaaatgtatcgctagctgccattgcaaaccaggctgtggtactaatgggccttgacaaggggtggcccataagcaagatggacttgggcgtaccactactagccctaggatgctacagccaggtaaacccgctgactctgacagccgctgtactgctactaatcacacactacgcaataatagggccaggcctacaagcgaaggccactagagaagcgcagaaaagaacagcagcgggaattatgaaaaatccgacagtggacggcattatgactatagacctggaccccgtaatctatgactcaaagttcgaaaagcagctcgggcaagtcatgctactcgtgctgtgcgccgtacagctgctcctaatgcggacctcctgggcattgtgtgaagcgctcactctcgcaactgggcccatcaccaccctctgggagggctcgcccggaaaattctggaacacaacaattgccgtgtccatggctaatatatttcgcgggtcgtaccttgcgggcgcaggcctagccttcagtatcatgaagtctgtaggtaccggaaaacggggaacggggagccaaggagagacactcggcgaaaagtggaagaagaaactaaaccagctgagtcgcaaggagttcgatttgtacaaaaagagtggcatcactgaggtagaccgtacagaagcgaaagagggccttaagaggggtgagataacacaccacgccgtgtcgcgaggatctgcgaagctacagtggttcgtagagcgaaacatggtgatccccgaaggacgcgtaatagaccttggatgcggtagaggaggctggtcctattactgcgcagggctcaagaaagtcactgaggttaggggttacaccaaaggagggccaggccacgaggaacccgttccgatgagcacgtatggctggaatatagtcaagttaatgtcgggtaaagacgtcttctaccttccgccggaaaagtgcgacacactactatgcgacataggcgaatcgagcccgtcgcctaccgtcgaagaatcccgtacaattcgagtactcaaaatggtcgagccgtggctgaaaaacaatcagttctgcataaaagttctaaatccgtacatgcccaccgtaatagagcatctggaacgcctacaacgcaagcacggcggaatgcttgtgcgtaatccactgagtcgaaatagcacacatgaaatgtattggatatcgaacggaacaggaaacattgtagcgtccgtaaacatggtctcccgcctactgttgaataggtttaccatgacacaccgacgaccgactatcgaaaaggacgtggacctcggcgccggaacaagacatgtcaacgcggagccagagacaccaaacatggacgtcatcggcgagcggatcaaaagaataaaagaggaacataacagtacgtggcattacgatgatgaaaacccctataaaacctgggcataccacggatcgtatgaagttaaagcaacgggctctgctagcagcatgatcaacggcgtagtaaagctattaactaaaccctgggacgtggtacccatggtcatccaaatggcaatgactgacacgacgcctttcgggcagcaacgcgtgttcaaggagaaagtagacacacggacaccgcggtcaatgccagggactcgaagagttatgggaattactgcagaatggttatggcggacactggggcgaaacaagaaacctcggctatgcacccgggaggagttcactcgaaaggttcgcaccaacgccgccatgggcgccgtattcacggaagaaaatcagtgggattccgcgaaggcagcagtcgaagacgaagacttctggaaactggtcgatagagaacgcgaactccacaaattagggaagtgtggaagttgtgtgtataacatgatggggaaaagggagaagaaactaggggagttcggcaaggcgaaaggcagccgagcgatctggtacatgtggctaggcgcgagatatttagagtttgaagcactgggtttcctaaacgaagaccactggttcagcagagagaacagctattcaggggtagagggggagggcctacacaaactaggatacattttacgagatatatcaaaaatcccagggggcgcgatgtacgccgacgataccgcgggatgggacacgcggataacggaggatgaccttcacaacgaggagaaaatcacacagcaaatggacccagaacataggcaactggctaacgcaattttcaaactaacatatcagaataaagtagtcaaagtacaaaggccaacgccaacgggcactgtaatggacataattagccggaaagatcaacgtgggtcaggacaggtcgggacgtacggccttaacacattcaccaatatggaggcccaactaatccgtcaaatggaaggcgagggtgtactgtcaaaagccgatctggaaaacccgcacctaccagagaaaaagataactcaatggttggaaactaagggggtggagcggctcaaacgtatggcgataagtggggatgactgtgtcgtgaaaccaatagacgaccggttcgccaacgcactactggcactgaacgacatgggaaaagtccggaaagacattccccaatggcaaccgtccaaagggtggcacgattggcaacaagtcccattttgcagccaccactttcacgagctaattatgaaagatggtcgtaagttagttgtaccctgccgccctcaggacgaactcatcggcagagccagaatatcacaaggcgccggctggagtctaagggaaacagcgtgcctagggaaggcttacgcgcaaatgtggtcacttatgtactttcacaggagagaccttcgcctggcctcaaacgccatttgctctgccgtcccagtgcactgggttccaacctctcgaacgacctggagcattcacgcacaccaccaatggatgactacagaggacatgctgacggtctggaaccgcgtgtggatagaggataacccatggatggaagacaaaaccccggtaacaacatgggagaacgttccctacctcggcaagcgcgaagaccagtggtgcggctccctgatcggcttgacaagtagagccacatgggcgcagaacatcccaacagcgatccaacaggttcggagtttgataggtaatgaagagttcctagactacatgccgtctatgaaacgcttcagaaaagaggaagaatcggaaggggcgatctggtaa

SEQ ID NO: 25715 - RNA, 9873 nt, synthetic construct
  misc_feature 1..9873: note = derived and/or modified CDS sequence (opt11) from DENV-3__GQ868571__SS-prME
  source 1..9873: mol_type = other RNA
accagtctgtgcttgatgatgattctgcccgcagccctggctttccacctcactagccgggatggggaaccccggatgatcgtcgggaaaaacgaacggggcaagagccttctgttcaagaccgcaagcgggataaatatgtgtaccctcatcgccatggatctgggggaaatgtgcgatgacaccgtgacctacaagtgcccgcacattacggaggtggagccagaggacatcgattgctggtgcaatctgacaagcacctgggtgacctacggtacttgcaaccaggccggggaacaccgaagggacaaacggagcgtcgctctcgcgccccacgtgggcatggggctggacactcgcacccagacatggatgtctgccgaaggcgcatggaggcaggtagagaaggtagagacgtgggcgctgcgccacccggggttcaccatcctggctctgtttctggcccactacatcggtacctccttgacccagaaggcggttattttcatcctgctcatgcttgttacgccatcaatgaccatgcggtgcgtcggggtgggcaaccgggactttgtggagggcctttcaggcgctacctgggttgacgtagtcctggagcacggcgggtgcgtcaccaccatggccaagaacaaacccacactcgacatcgagctccagaagaccgaggctactcagctggcaactctccggaaactgtgcatcgaagggaaaatcaccaatatcaccaccgactcacgctgtcctacacagggagaggcggtgctaccggaggaacaggaccagaattacgtgtgcaaacacacctacgtagaccgcgggtggggcaacggatgcggccttttcgggaaaggctcccttgtgacttgtgccaaatttcagtgcctcgaaccgatcgaaggcaaagtggtccagtacgagaatctcaagtacacggtgattatcacagtgcacaccggtgatcaacaccaggtcggcaatgagacccagggggtgacggccgagatcacgccccaggctagtaccaccgaggccatactacccgagtacggcaccctgggcctcgagtgctcgccgcgcaccggcctggactttaacgaaatgatattgctcactatgaaaaacaaggcttggatggtgcaccgccagtggttctttgacctgccgttaccgtggacgagcggcgccaccaccgagacgcccacctggaatcgcaaagaactgctggtgaccttcaaaaatgcccacgcgaagaaacaggaggtggtcgtgctgggttcccaggagggcgcgatgcacacggcgctcacgggggccacagagatccagaacagtggcggcacctccatctttgcaggccacctgaagtgtcgtctgaagatggacaagctcgaactgaaaggtatgtcttacgctatgtgtaccaacacttttgtcctcaagaaagaagtgagcgaaacccagcacggaaccatcctcatcaaggtagagtataagggggaggatgtaccctgcaagatccccttctcaacagaagacgggcaaggaaaggcccacaacggccgcctgataacggccaaccccgtggtgacgaagaaagaggaacccgtaaacatcgaggcagagccgcctttcggcgaatcgaacatcgtcatcggcatcggagacaacgcgctcaagatcaactggtacaagaagggctccagtatcgggaagatgttcgaggccaccgcccgcggcgcgaggcggatggccatcctcggcgacaccgcgtgggacttcggatccgtgggcggggtcctcaatagcctgggcaagatggttcaccagatctttggttccgcgtacactgccctgttcagcggcgtgtcatgggtgatgaagattggaatcggggtcctcctaacatggatcggcttaaacagcaaaaacactagcatgtctttctcctgcatcgccattgggattatcaccttgtatctaggtgccgtggtccaggcggacatggggtgcgtcataaactggaaaggcaaggagctgaagtgcgggagcggaatcttcgtgaccaacgaagtgcacacttggactgagcagtacaagttccaagccgacagtcccaaacgcctcgcaaccgctatcgccggagcgtgggagaatggagtttgcggcatacgatcaacaacgagaatggagaacctgctttggaagcagatcgccaacgagttaaactacatcctgtgggagaacaacataaaactaaccgtggtggtaggggacatcattggcgtgctcgagcagggcaagagaacacttacgccacagccgatggagctgaaatatagttggaaaacctgggggaaggcgaagatcgtgaccgctgagactcaaaacagctccttcatcatagacggacccaatacgccagagtgcccctctgcgagtagagcatggaacgtctgggaagtggaagactatgggtttggcgtgtttacaaccaacatctggctcaagctacgcgaggtctacacccaactttgcgatcaccgtctcatgtcggccgctgttaaggacgaacgcgccgttcatgcagacatgggatactggatcgagagccaaaagaacggctcctggaaacttgagaaggcctcactgatcgaggtcaaaacctgcacgtggccgaagtcacacactctctggtccaatggtgtccttgaaagcgatatgatcatacctaagagcctggccgggcccatcagtcagcataactataggccgggctaccacacacagacagccggaccctggcatctcggtaagctggaactggactttaattactgcgagggcacgacagtggtaatcacggagaattgcgggacacgcggcccgtctctccggacgaccaccgtgtccggaaaactgatccacgagtggtgttgccgtagctgcaccctgcccccgctcagatacatgggcgaagatgggtgctggtatggcatggaaattcgccccatctccgaaaaggaggagaacatggtcaagtcgctcgtgtccgctggctctggggaggtggacaatttcacgatgggagtgctgtgcctcgcgatcttgttcgaggaagtcatgcggggcaaattcgggaagaaacacatgatcgccggggtatttttcacattcgtgcttcttctgtcagggcagatcacttggcgcgacatggcccacacactgattatgatcgggtcaaatgcctccgatcggatggggatgggcgtcacgtatcttgctctgatcgctacctttaaaattcagcccttcctagccctcgggtttttcctgcggaagctgacctcgcgggaaaacttactgttaggcgtgggcctcgccatggccaccacgcttcaattgccggaggacatcgaacagatggctaacgggattgcattaggcctgatggccctcaagctcataacccagttcgagacctatcagttatggactgcgctgatctcgcttacatgctctaatacaatcttcacgctgactgtggcctggagaacggcgaccctgatcctcgctggggtcagcctgttgccagtgtgccagtctagctccatgcgaaagaccgattggctccccatgaccgtcgcagccatgggtgtgccccctctcccgctgttcatctttagtctgaaagatacgttgaaacgccgtagctggcccctgaacgagggggtgatggccgtcggactcgttagcatcctagcgagctcactgctaaggaacgatgtgcctatggcgggaccgcttgtcgctggagggctgctcatcgcatgctacgtgatcactgggacctccgcagatctgacggtggaaaaagctgccgacgtcacgtgggaggaggaggccgagcagaccggcgtgagccataacctgatgattacagtggatgacgatggcaccatgcgtatcaaagacgacgaaaccgagaacatcctcacggtcctgctgaaaaccgccttattaatagtgtccggaatcttcccgtactctatccccgccacgctcttagtttggcatacctggcagaaacagacccaacgctccggagtgctctgggacgtgcctagccctccggagacgcagaaggcggagctggaggaaggggtgtaccgaatcaagcagcaggggatctttgggaagacacaggtaggcgtgggggtgcaaaaggaaggcgtcttccatacgatgtggcatgtaacacgtggcgccgtgctcacttacaacgggaagcggctcgaacccaactgggcctccgtaaagaaagatctgatcagctacggcggaggctggcggttatcagcccagtggcagaaaggggaggaagttcaggtgatcgcggtagagcccggcaagaaccccaaaaatttccagacaatgccgggaaccttccagacaacgaccggcgagatcggtgctatagccctcgatttcaaacccgggacctccggaagcccgatcatcaatagggagggcaaggtggtgggtctatacggcaacggcgtcgtaacaaagaacggcggttacgtttcaggcatcgcccagacaaacgccgagccggacggcccgacccctgagctcgaggaggagatgttcaagaaacggaacctcaccataatggacctgcaccccgggagcggaaagaccagaaagtacctgccggcgatcgttcgtgaggccatcaagcgtagactccgcaccctgattctggccccaaccagagtggtggccgctgagatggaggaggcgttgaaaggactcccaatcagatatcagaccacggctacaaagtccgagcataccggccgggagatagtcgacttgatgtgtcacgccaccttcacgatgcgcctcctgagccccgtgagggttccgaactacaacctgataatcatggacgaggcccacttcacggaccccgcctccatcgcggctcgcggctatataagcacccgggtcggaatgggagaggccgccgcgatatttatgaccgctacgccgcccgggacagcagacgcattcccgcaatccaatgcccccatccaggatgaggaacgcgacatccccgaacgctcatggaactccggcaatgagtggatcacagacttcgcggggaagacggtatggttcgtaccgtccataaaggctggcaatgacatcgccaattgcctcaggaaaaacgggaagaaggtcatccagttatccagaaagacgttcgatacagagtaccagaagaccaagctgaatgactgggacttcgtggtaaccacggacatctctgagatgggcgccaacttcaaggcggaccgggtcatcgatccgcggagatgtctgaagcccgtaatcctcaccgacggaccagaaagggtgatcttggcggggcctatgccggttacggccgcttctgccgcccagcgtcgcggccgggtggggcgcaacccccagaaggagaacgaccagtatatcttcacagggcaacccctcaacaacgacgaagatcacgcgcactggaccgaggccaagatgcttttagataacatcaacacgcccgaagggataatcccggcactcttcgaacccgagcgagagaagtccgcggcaatcgacggagagtaccgcctgaagggcgaatcccggaagacatttgtggagctgatgcgacgcggtgacttgccagtatggcttgcgcataaggttgccagcgagggcattaagtacaccgaccgaaagtggtgcttcgacgggcagcggaacaaccagatcttagaggaaaacatggacgtcgagatctggaccaaagagggcgagaagaagaagctccgaccgagatggctggacgcccgcacctactccgacccgctagccctaaaagagttcaaggatttcgcggccggccgcaagtcaatcgccctggacctggttaccgagatcggtcgggtccccactcacttagcccaccggacccggaatgccctggacaacctggtcatgcttcacacgtccgagcatggtgggaaggcgtaccgccacgccgtagaggagctgcctgagacaatggaaacgttattactgctcgggctaatgatcctattaaccgggggcgccatgctgtttctcatcagcggcaagggcatcggcaaaaccagcatcgggctgatttgcgtgattgcatccagcggtatgctgtggatggccgagatcccgttacaatggatcgcgtccgctatcgtcctggagttctttatgatggtcctcttaatccccgagcccgaaaagcagagaacaccccaggacaaccagctggcttatgtcgtcatcgggatcttgaccctggcagccattatagcggccaacgagatggggatgctcgaaacaacgaagcgggacctgggcatgagtaaagaaccgggagtggtgtcccctactagctacctagacgtcgacctgcatccggcttccgcctggaccctttacgcagttgccacgacggttatcacccccatgctgcgccacacaatcgaaaattctaccgccaatgtatccctagccgccatcgcaaaccaggccgtggtgctgatgggactggacaaggggtggccgatcagcaaaatggacctgggcgtccccctccttgcactgggttgctactcacaggtgaaccccctaacgttaaccgccgccgtgctgctcctgatcactcactacgcgataatcgggcccggattgcaagcgaaggccacccgagaggctcaaaagaggaccgccgccgggatcatgaagaatccgacggtggacgggattatgaccattgacctcgaccctgtgatctatgacagcaaattcgagaagcagctgggccaggtaatgctgctcgtcctgtgcgccgtgcagttactcctgatgcgcacgtcctgggccctgtgtgaggccttgacgctggcaaccggtcccattaccaccctgtgggaaggctcgccgggcaagttctggaacacgaccatcgcggtgtccatggcaaacattttccgcggaagctacctcgccggagccggtctggcgttcagtatcatgaagtccgtcggtaccggcaagcgcgggaccgggtcccagggtgagacattgggtgagaagtggaaaaagaagctcaaccagctttcgcgtaaggagttcgatctgtacaagaagtcaggcatcacagaggtggaccgcaccgaggccaaagaggggttaaagcgtggggagatcactcaccatgcggtttcccggggctctgccaaactgcagtggtttgtcgagcgaaatatggtcatcccggagggtagagtgatcgatctaggctgcgggcggggcggctggtcctactattgcgccggtttgaagaaggtgactgaggtacgcggttacacgaagggcggcccaggtcatgaggagcccgtgcccatgagcacctacggatggaacattgtcaagctgatgtccgggaaggacgtgttctacctaccgcccgagaaatgtgacaccctcctgtgtgacatcggcgaaagctcccctagccctaccgtggaggagtcacggacgatacgcgttttgaagatggtggagccttggctgaagaacaaccaattctgtattaaggtgcttaacccctacatgccaacggtcatcgaacacctggaacgtctgcaacgaaagcacggcgggatgctcgtgaggaaccccctgagcagaaattccacccacgagatgtactggataagcaacggaaccgggaacatcgtggcctccgtcaacatggtgtcgcgcctgctcctgaaccgttttacgatgacccaccgccggcctaccatcgagaaagacgtggacctgggcgcaggcacccgtcacgtaaatgcagagccagagactcccaatatggacgtcattggggagagaatcaagcgcatcaaagaggagcacaattctacatggcactacgacgacgagaacccatacaaaacctgggcctatcacggctcttacgaggtgaaggccacagggtccgcaagctccatgataaatggcgtagtgaagctcctaacgaaaccctgggatgtcgtgccgatggtgacccagatggccatgaccgataccacgcccttcgggcagcaaagagtcttcaaggaaaaagttgacacacgcaccccgcggagcatgcccggtacccgtcgggtgatgggtatcacggccgagtggctatggcgaaccctcgggcggaacaaaaagccccgactatgcactcgtgaagagttcaccaagaaagtgcgcacaaacgcagcaatgggcgccgtgtttactgaggagaaccaatgggacagcgccaaggctgccgttgaagacgaggacttctggaagctggtcgatcgcgagcgggagctgcacaaacttgggaagtgtggaagttgcgtttacaacatgatgggaaaacgcgagaagaagctgggcgagttcggcaaagcaaaaggaagccgggccatttggtacatgtggcttggggcccgctacctcgagttcgaggccctggggttcctgaacgaggaccactggttcagtcgggagaacagctattccggcgtggaaggtgagggcctgcacaaactgggctacatcctccgcgatatcagtaagatcccagggggcgccatgtacgccgatgacacggccggctgggacacccggataactgaggacgacctgcacaacgaagagaagatcacccagcaaatggacccggaacaccgccagctggccaacgccatattcaagctcacataccaaaataaggtcgtgaaggtgcagcggcccacccccactggcaccgtcatggacataatcagccgcaaagaccagaggggctccggacaggtgggcacctacgggctaaacaccttcacaaacatggaggcacagctgatccgccagatggagggcgagggcgtgctctccaaagcggaccttgagaatccccatctgccggagaagaagatcacgcagtggctggagactaaaggtgtcgagcggctgaaacgcatggcgatcagcggagacgactgcgtggtgaagcccattgacgaccggttcgccaacgcgttacttgccctgaacgacatggggaaggtccgcaaggacataccccaatggcagccctccaagggttggcacgactggcagcaggtcccattttgcagccaccatttccacgagctgataatgaaagacgggcggaagctagtcgtcccatgtcgcccccaggacgagctgattgggcgggcgcggatctcccaaggtgctggttggtcattgcgcgagacagcctgcctcggaaaggcctacgcgcagatgtggtccctgatgtacttccacagacgcgacctgcgcctcgcatcgaacgccatttgctccgctgtgccggtacactgggtcccgacttcccgcaccacgtggtcaatccacgcccaccaccagtggatgaccaccgaggacatgctcacggtttggaaccgggtgtggatcgaggacaatccttggatggaggacaaaacccccgtgacaacctgggagaatgttccctacttagggaagcgcgaggatcagtggtgcggcagcttaattggacttacaagtcgggcgacgtgggcccagaacatcccgaccgcgatccaacaggtgcgctcactgataggcaacgaagagttcctcgattatatgccgagcatgaagcgtttccgcaaggaagaggagtccgagggggcaatctggtga

SEQ ID NO: 25716 - RNA, 9873 nt, synthetic construct
  misc_feature 1..9873: note = derived and/or modified CDS sequence (opt11) from DENV-3__GU131951__SS-prME
  source 1..9873: mol_type = other RNA
acgagcctgtgcctcatgatgatcctgcccgcggcactggcgttccacctcacaagccgggatggcgagccgcgtatgatcgtgggaaagaacgagcggggcaagagtctgctgttcaagaccgccagcggtatcaacatgtgcacgctcatcgcaatggacctgggtgagatgtgcgacgacaccgtgacctacaaatgccctcatattaccgaggtggagcccgaggacattgactgctggtgcaacttaaccagcacctgggtcacctacgggacttgcaaccaggccggcgagcatcggcgcgacaaacggtccgtcgccctcgcgcctcacgtgggcatggggctggacacccgcacccaaacctggatgagcgccgagggcgcctggcgccaagtcgagaaggtcgagacgtgggccctgcgccacccggggttcacaatcctcgcactgttcctggcccattacatcggcacctccctcacccaaaaggtggtcatcttcatcctgctgatgctcgttaccccatcgatgaccatgcgctgcgtgggtgtgggcaaccgcgacttcgtcgagggcctgtctggggccacatgggtggacgtggtgttagagcacggggggtgcgtgaccacaatgagcaagaataagcccaccctagacatcgagctgcagaagacagaggccacccagctggctacgctaaggaagctgtgcatcgagggcaagatcaccaacatcaccaccgactccagatgcccgacgcagggcgaggcggtgttaccagaggagcaggaccagaactacgtatgtaaacatacctacgtggatcggggatggggcaatggctgcggcctattcgggaagggcagcctggtaacttgcgcaaagttccagtgcctggagccgatagagggcaaggtcgtgcagtacgagaatcttaagtacacagtgattatcaccgtccacaccggcgaccaacaccaggtgggcaatgagacccagggggtcaccgccgagatcacgccgcaggcctcgaccaccgaggctatactgcccgagtacggcaccctggggctcgagtgctcaccgcgcaccggcctggacttcaatgagatgattctgctcacgatgaagaataaggcgtggatggttcatcggcaatggtttttcgacctacctctgccctggacttccggcgccaccaccgagacgcccacctggaaccgcaaggagctactggtaaccttcaaaaatgcccacgccaagaagcaggaggtcgtggtgctgggcagccaggagggcgctatgcacaccgcgctgacaggggcaaccgagatccagaactccggcgggaccagcatcttcgccggtcatctcaagtgccgcctgaagatggacaagctcgagctgaagggcatgtcctacgctatgtgtaccaacacattcgtcttaaagaaggaggtgagcgagacccagcacggaacaatcctcatcaaagtggagtacaaaggcgaggacgtcccgtgcaaaatccccttcagcaccgaagatgggcagggcaaggcacacaacgggcgcctgattacggcgaatcccgtggtgaccaagaaggaggagcccgtgaacattgaagccgagccgcccttcggggagtccaacatcgtgataggcatcggtgacaacgccctgaagatcaactggtataagaagggcagctccatcgggaagatgtttgaggccaccgcgcggggagcacgccggatggccatcctgggagacacggcctgggacttcgggtcagtgggcggggtcctcaactccctgggcaagatggtccaccagatctttgggagcgcctacacggccctgttctccggcgtgtcatgggtcatgaagattgggatcggggtgctcctgacctggatcggcctaaactccaagaataccagcatgtccttctcctgcatcgcaattggcatcatcacgctctaccttggcgccgtggtacaggccgatatgggctgtgtgatcaactggaagggcaaggagctgaaatgcggatccgggatcttcgtcacgaacgaggttcacacctggaccgagcagtacaagttccaggccgattcccccaaacgccttgcgaccgcaatcgcgggcgcctgggaaaacggggtgtgcggcatccgctccacgacacggatggagaacctgctgtggaagcagatcgccaatgagctcaactacatcctgtgggaaaacaacatcaaactgaccgtggtcgtgggggacatcataggtgtgctcgagcagggcaagcgcaccctgacgccacaaccgatggagctgaagtatagctggaagacctgggggaaggcgaagatcgttaccgcagagacccaaaactccagcttcatcatcgacggccccaacacgcccgagtgcccatccgccagccgggcctggaacgtgtgggaggttgaggactatgggttcggcgtcttcacaaccaatatctggctcaagctgcgcgaggtatacacccaactgtgcgaccaccggctgatgtcggcggccgtgaaggacgagcgcgccgtacacgcagatatgggctattggatcgagtcccagaagaacggaagctggaagctggagaaggccagcctcatcgaggtgaaaacctgtacgtggcccaagtctcacacgctctggtccaacggagtgttggagagtgacatgatcatccccaagtccctggcggggcccatcagccaacacaactacagacccggctaccacacccaaactgccgggccctggcacctcggcaagcttgagctcgacttcaactactgcgagggcacgaccgtcgtgatcaccgagaattgcgggacccgcggcccatcattacggacgaccaccgtgagcgggaagctgatccacgagtggtgctgccgctcctgcacgctgcccccgctccggtacatgggcgaggacgggtgctggtatggaatggagatccgacccatcagcgagaaggaggaaaacatggtcaagagtctggtgagcgccggttctggggaggtggacaacttcacgatgggcgtcctgtgtctcgccatcctgttcgaggaggtaatgcgagggaagttcggcaagaagcacatgatcgccggtgtgttctttaccttcgtcctgctactgtcggggcagatcacctggcgcgatatggcgcacaccctgatcatgatcggctccaacgcctcagacagaatgggaatgggcgtgacctacctcgccctgattgccaccttcaagatccagcccttcctggccctcgggttcttcctacgcaagctgactagccgggagaatctgttgctgggcgtgggcctcgcgatggccaccacgctgcagttgcctgaggacatcgagcaaatggccaacgggatcgccctcggcctgatggcgctgaaactaatcacgcagttcgagacctaccagttgtggactgccctgatttccctcacttgcagcaacacaatcttcaccctgaccgttgcctggcgcactgccaccctgatcctcgccggggtgtcccttctacctgtctgtcaaagctccagcatgcggaagacagactggctccccatgaccgtggcggccatgggcgtaccgcccctcccgctgttcatcttcagtcttaaggacacgctgaagcgccgttcgtggcctctgaacgagggggtcatggccgtgggcctcgtgtccatcttggctagctcccttctccggaacgacgtccctatggccggccccctggtggccggcgggctgctcatcgcctgctacgtaatcacagggacttccgccgacctgacagtagagaaggccgccgacgtgacgtgggaagaggaggcggagcagaccggggtgtcacacaacctaatgatcaccgtcgacgacgacgggaccatgcgcatcaaggacgacgagaccgagaacattttgacggtgctgctaaagaccgccctcctgatcgtgagcggcatctttccgtattcaatccccgcgacccttctcgtatggcacacttggcagaagcaaacgcagcggagtggggtgctatgggacgtaccgagcccccccgaggcccagaaggccgagttggaggagggggtctaccgcatcaagcagcagggcatcttcgggaagacccaagtgggcgtgggggtccaaaaggagggcgtgttccacaccatgtggcatgtgacccgcggcgcggtcctcacgtataacgggaaacgactggagcccaactgggcgagcgttaagaaggacctgatctcctacggcgggggctggcgtctgagcgcccagtggcaaaagggagaggaggttcaggtgatcgccgtagagcccggcaaaaaccccaagaacttccagaccatgcccggcacctttcagaccactaccggggagatcggcgcgatcgccctggacttcaagcccgggacctccggcagtcccatcattaaccgcgagggcaaggttgtcgggctgtacggcaacggggtggtgaccaagaatggggggtacgtctccggcatcgcacagactaacgccgagccggacggtcccaccccagagctggaggaggagatgttcaaaaagcggaacctcaccatcatggacctgcacccagggtccgggaaaacccgcaagtacctgccggccatcgtacgcgaggcgatcaagcgccggttgaggacgctgatactggctcccacccgggtggtcgccgccgagatggaggaggccctcaaggggctgcccatccgctaccagactaccgccaccaagtcggagcacaccggcagagagattgtggaccttatgtgccacgcgacctttaccatgcgcctcctgtcccccgtgcgtgtccccaactacaacctgatcatcatggacgaagcccatttcacagaccccgccagcatcgcagcccgcgggtacatctccacccgggtgggcatgggcgaggccgccgccatcttcatgacagcgactccgcccgggacggccgacgccttcccgcagtcaaacgcccccatccaggacgaggagcgtgacatcccagagcgctcctggaactcgggcaacgaatggattactgacttcgcgggaaaaaccgtgtggttcgtcccgtccatcaaggcggggaacgacatcgcaaactgcctccggaagaacgggaagaaggtgatccagctcagccgcaagacgtttgacacggagtaccaaaagacaaagctgaatgactgggacttcgttgtcaccaccgacatctccgagatgggcgcaaacttcaaggccgaccgggtgattgacccgcgtcggtgcctcaagcccgtgatcttgacggacggccccgagcgggtcatcctggccgggcccatgccagtgaccgcggccagcgccgcgcagcgaaggggccgggtggggaggaatccccagaaggaaaacgaccagtacattttcaccggccagcccctcaacaacgacgaggaccatgcgcactggaccgaagcaaaaatgttgctggacaacatcaacacccccgaggggatcataccggccctcttcgagcccgagcgggagaagtccgccgccattgacggtgagtaccgattaaagggcgagagccggaaaacgtttgtcgagttaatgcgccgcggggacctccccgtgtggctggcgcacaaggtggcctccgagggcatcaaatacactgatcggaagtggtgcttcgatgggcaacggaacaatcagatcctggaggagaatatggatgtggaaatctggaccaaggagggcgagaagaagaagctccgccctcggtggctggatgcccgcacctacagcgacccgctggccctcaaggagttcaaggacttcgccgcaggccgcaagagtattgccttagatctggtgacggagatcgggagggtccccagccacctcgcccaccgcacccggaacgctctggacaacctggtgatgctccacaccagcgagcacggcgggaaagcctatcgccacgcagtggaagagctccccgagaccatggagacgctcctcctgttgggccttatgatcctcctgaccggcggcgctatgctgttcctgatttccggcaaagggataggcaagaccagtatcgggctgatctgcgtgatcgcctcgagtggcatgctctggatggcagagatccctctgcagtggatcgcctccgctatcgtattagagttcttcatgatggtgcttcttatccccgagcccgagaaacagcgcacgccccaggacaaccagctagcctatgtcgtgatcgggatactcactttggccgccatcatcgccgcgaacgagatgggcctgctcgagaccaccaagcgggacctgggcatgagcaaggagccgggggtggtgtcccccaccagctacctggacgttgaccttcacccggcctccgcctggacgctgtatgcagtcgcgactaccgtcatcacccccatgctgcggcatacgatcgagaacagcaccgccaacgtgtccctagccgctatcgccaaccaggcggtggtcctgatgggcctggacaaggggtggccgatcagcaagatggaccttggcgtgcccctgctggcgcttggctgctattcccaggtgaaccccctgactctgacggccgccgtcctactgctgatcacgcactacgccatcatcggccccggcttacaagcgaaggccacccgcgaagcccaaaagcggactgccgcagggataatgaagaatccgaccgtggacggcatcatgacgatcgacttggaccccgtgatctacgacagcaagttcgagaagcagctggggcaggtaatgttgctggtgctatgcgcggtccagctcctgctgatgcggacctcttgggcgttgtgtgaggccctgaccctggccaccggccctatcactactctgtgggagggtagccccgggaagttctggaacacgacgatcgcggtctcgatggccaacatcttccggggcagctacctggcaggcgccggactagccttctccataatgaagtccgtggggacgggcaaaaggggaaccgggagtcagggcgagaccctcggtgagaagtggaaaaagaagctgaaccagttgagtcggaaggagttcgacctttacaagaaatccggcatcactgaagtggatcgcaccgaggcgaaggagggattaaagcggggtgaaatcacgcaccacgcagtctcccgaggcagcgccaagctgcagtggtttgttgaacggaacatggtgaccccagaagggcgagttatcgacctcggttgcgggcggggcgggtggtcctactactgcgccggcctgaaaaaggttacggaagtgcgcggctacaccaagggaggaccagggcacgaggagcccgttcccatgtcgacttacggctggaacatagtgaagctgatgtctgggaaggatgtgttctatctcccgcccgagaagtgcgataccctgctgtgtgacatcggcgagagctccccaagtcccatcgtcgaggagtcccggaccatccgcgtgttgaagatggtggagccgtggctcaagaacaaccagttctgcatcaaagtgctgaacccgtacatgcccaccgtcatcgagcacctcgagcgcctccagcgtaagcacggcgggatgcttgtgagaaacccactgagccggaactccacgcacgagatgtactggatcagtaacggcaccgggaacatcgtagcctccgtgaacatggtcagccgcctcctgctgaaccgattcacgatgacccaccgccggcccacaatcgagaaagacgtcgacttaggagcaggcacacgccacgtgaacgccgaacccgagacccccaatatggacgtgatcggggagcgtataaaacgcatcaaagaggaacacaactcgacctggcactacgacgacgagaacccgtacaagacgtgggcctaccatggcagctacgaggtcaaggccaccgggtccgccagcagcatgataaacggcgtagtgaagctgttaactaagccttgggacgtggtgcccatggtgacccagatggcgatgaccgacaccacccccttcgggcagcagcgagtgtttaaggagaaagtcgacacacgcacgccccggtccatgcccggcacaagacgggtcatgggaatcaccgccgaatggctctggcggaccctggggcggaacaaaaagccccgcctgtgtacgagggaggagttcaccaagaaagtgcgcaccaacgccgcaatgggcgctgtcttcacggaggagaaccagtgggatagcgccaaggccgccgtcgaggacgaggacttctggaagctagtggaccgcgagcgggagctgcacaagctcggcaagtgcggctcctgcgtgtacaacatgatggggaagcgtgagaagaagttgggcgaattcggcaaggccaaggggtctcgggcgatctggtacatgtggctgggagcacgctacctggaattcgaggccctcgggttccttaacgaagatcattggttctccagggagaacagttacagtggcgtcgaaggtgagggccttcacaaactcggctacatcctgcgcgacataagcaaaatccccgggggcgcgatgtacgccgacgacacagcggggtgggacacccgaatcaccgaggacgacttacacaatgaggagaagatcacccagcagatggatccggaacaccgccagctcgccaacgccatcttcaagttaacataccaaaacaaggtggtgaaggtccaacggcccacccccactgggaccgttatggacatcatctccagaaaagaccagcggggcagcggccaggtgggcacctacggactgaacacgttcaccaacatggaggcccagctcataaggcagatggagggcgagggggtcctgtccaaggcggacctggagaacccccacctgccggaaaagaagatcacccagtggctggaaaccaagggcgtggagaggctgaagcgcatggcgatcagcggcgacgactgcgtagtcaagcccatagacgatcggttcgccaacgccctcttagcgctgaacgacatggggaaggtccgcaaggacatcccccagtggcagccgtccaagggatggcacgactggcagcaggtcccgttctgctcccaccacttccacgagctcatcatgaaggacgggcggaagctggtcgtgccttgccgtccccaggacgagctgatcggccgggcacgcatctcccagggtgctgggtggagtctacgggagacggcctgcctaggcaaggcctacgcccagatgtggtccctgatgtacttccaccgccgcgatctgcggctggcgagcaacgcgatttgctccgccgtgcccgtccactgggtgcctaccagccgcaccacctggagcatccacgcccaccaccagtggatgacgaccgaagatatgctgaccgtgtggaatcgggtttggatcgaggacaacccgtggatggaggacaagacccccgtgacgacctgggagaacgtgccctacctcggtaagcgcgaggaccagtggtgcggctccttaattgggctaacctcaagggccacctgggcgcagaacatcccgacggctatccaacaggtacgctccctaatcggcaacgaggaattcctcgactacatgccctctatgaagcggttccggaaggaggaggagtccgaaggggccatctggtga

SEQ ID NO: 25717 - RNA, 9873 nt, synthetic construct
  misc_feature 1..9873: note = derived and/or modified CDS sequence (opt11) from DENV-3__GQ868572__SS-prME
  source 1..9873: mol_type = other RNA
accagcctgtgcctcatgatgatcctgcctgctgccttggcgtttcacctcaccagccgggacggggaacctcgcatgatagtggggaagaatgagcggggcaagtcactgctgtttaagaccgccagcgggatcaacatgtgcacgctcatcgccatggacctgggcgagatgtgtgacgacaccgtgacctacaagtgcccccacataacggaggtggagcccgaggacatcgactgctggtgcaacctcacgtcgacctgggtgacctacggcacgtgcaatcaggccggcgagcaccggcgcgacaagaggagcgtagccttagcgccccacgtaggcatggggctggacacacgcacccagacctggatgagcgccgagggcgcctggcgccaggtggagaaggttgagacgtgggcccttcgccacccggggttcaccatcctcgcgctgttcctggcccactacatcggcacttccctcacccagaaggcggttatctttatactcttgatgctcgtgacgcccagcatgaccatgcgatgcgttggggtgggcaaccgcgacttcgtcgagggcttatccggggccacgtgggtcgatgttgtgctggagcacggcgggtgcgtcaccacaatggctaaaaacaaacccaccctcgacatcgagctgcagaaaaccgaggccacccaactggccacgctccggaagctgtgcatcgagggcaagataaccaatatcaccacagacagccgctgccccacgcaaggggaagccgtgctgccggaggaacaagaccagaactacgtgtgcaagcacacctacgtcgatcgggggtggggcaacgggtgcggtctctttgggaagggctccctggtgacctgcgccaagttccagtgcctagaacccatcgaaggaaaggtcgtccagtacgagaacctcaagtacaccgtcatcatcacggtgcacacaggggaccagcaccaggtcggcaacgagacccagggggtgaccgcggagatcacgccacaggcgagcaccacggaggcgatcctgcccgagtatggcacactagggctcgagtgctccccgcgcaccggactggacttcaacgagatgatcctgctcacgatgaagaacaaggcctggatggtccaccggcagtggtttttcgatctgcccctgccctggaccagcggcgccaccaccgagacgcccacctggaaccgaaaggagctcctggtgacctttaagaacgcccacgccaaaaagcaggaggttgtcgtgttggggtcccaggagggtgctatgcacaccgccctcaccggggccaccgagatccagaacagcggcgggacgtccatattcgcaggccacctgaagtgccggctgaaaatggacaaactcgaactgaagggaatgagctacgcgatgtgcaccaacacattcgtgctgaagaaggaggtctccgaaacccagcacgggacgatcctcatcaaggtggagtacaagggcgaggacgtgccgtgcaagattccctttagcaccgaggatgggcaaggcaaggtccacaacggcagactgatcacggccaaccctgtggttaccaagaaggaggagcccgtcaacatcgaggcggaaccgcccttcggggagagcaatatcgttattggaatcggggacaacgccctgaagatcaattggtacaagaagggctcctcaatcgggaagatgttcgaagcgaccgcccggggcgcccgccggatggcaatactaggcgatactgcctgggactttgggagtgtgggcggggtcctgaactcgctggggaaaatggtgcatcagatctttgggtccgcgtacacggccctgttcagcggcgtgtcctgggtcatgaagatcggcatcggggtactcttgacctggatcgggctcaacagcaagaacacatccatgtcgttctcctgcatcgccatcggcattatcactctctacctgggcgccgtggtccaagccgacatggggtgcgtgatcaactggaagggcaaagagctgaagtgcggaagcgggattttcgtgacgaacgaggtacacacctggaccgaacagtacaagtttcaggccgactcgcccaagcgcctcgccaccgcaatcgcgggcgcctgggagaacggtgtctgcggcatccggagcacgacacgaatggagaatctgctgtggaagcagattgctaacgagctcaattacatcctgtgggagaacaatatcaagctgaccgtggtcgtgggggatatcatcggcgtgctcgagcagggaaagaggacgctaacgccccaaccgatggagctgaagtattcctggaagacctgggggaaagccaagatcgtcaccgcagaaacgcagaacagctccttcattattgacggccccaatacgcccgagtgccccagcgccagtcgggcgtggaacgtctgggaggtggaggattacgggttcggcgtctttaccaccaatatttggttaaaacttcgcgaggtgtacacccagttgtgtgaccaccgcctcatgagcgccgccgtgaaggacgaaagagcagtccacgcagatatgggttactggatcgagagccagaagaacggctcctggaagctggagaaggcgagcctgatcgaggtaaagacctgcacgtggccgaagtcccacaccctctggagcaacggcgtgctggagtccgacatgatcatccccaagagcctggccggtcccatctcccagcacaactaccggccgggctatcacacccagaccgccggaccctggcacctcggcaagctggagctggacttcaactactgcgagggcacaaccgtcgtgatcaccgaaaactgtggcacaagggggcccagtctccggaccaccaccgtgtcaggaaaattgatccacgagtggtgctgccgcagctgcaccttgccccctctccggtatatgggcgaggatgggtgctggtacggaatggagatccgccccatctccgagaaggaggagaacatggtcaagagcctggtgtccgccggcagcggggaggtggacaatttcacgatgggagtcctgtgcctcgcgatcctgttcgaggaggtgatgcgggggaagttcggcaagaagcacatgatcgcgggagtgttctttaccttcgtcctgctcctatccggtcagataacctggcgcgatatggcccacaccctcatcatgatagggagcaatgcctccgaccgcatggggatgggcgtgacgtatctcgccctgattgcgacctttaagatccagcccttcctcgcgttaggtttcttcctgcgcaagctgacctctcgagagaacctgctgctgggtgtcggcctcgcgatggccactacgctgcagctgcccgaagacattgagcagatggccaatgggatcgcgctcggcctcatggccctgaagctcatcacccagttcgagacttaccagctgtggaccgccctgatctcgcttacctgctccaacaccattttcaccctgacagtcgcctggcgcacggccaccctaatactagcgggggtgagcttgctaccagtctgccagtcctcctccatgcggaagacagactggctcccgatgaccgtggcggcgatgggcgtgccgcccttaccgctgtttatcttcagcctcaaggacacgctgaagcgccgctcctggcccctgaatgagggagtcatggccgtgggcctcgtgagcatcctggcatccagcctgctccggaacgatgtgcccatggcgggcccccttgtggccgggggactgctcatcgcctgctatgttattaccgggacctccgccgacctgaccgtcgaaaaagccgcggatgttacatgggaggaggaggccgagcagaccggcgtcagccataacttaatgatcaccgtggacgacgatgggaccatgcgcattaaggacgacgaaaccgaaaatattctcacggtgctgctgaagaccgccctcctaatagtgtccggcatcttcccgtacagtatacccgccacactgttagtatggcatacctggcagaagcaaacgcagcggtcgggggtgttatgggacgttcccagtcccccagagacccaaaaggccgagctggaggaaggggtctaccgcatcaagcagcagggcatcttcgggaagacccaggtgggcgtgggggtgcaaaaggagggcgttttccacaccatgtggcacgtgacgcggggcgccgtcctcacttacaacggtaagagactggagcccaactgggcgtccgtcaagaaggacctgatcagctacggcgggggctggcggctatccgcacagtggcagaagggcgaggaggtgcaggtcatcgccgtggagcccggaaagaaccccaaaaattttcagaccatgcccggcaccttccaaacgacaaccggggagatcggcgcgatagctctggacttcaagcccgggaccagcggcagccccatcataaaccgcgagggcaaggtggtcggcctgtatggaaacggggttgtgacgaagaacggcggctacgtctccggcatagctcagaccaatgccgagccggacgggcccacccccgaacttgaagaggagatgttcaagaaacggaacctcaccatcatggacctgcaccccgggtctggcaaaacgcgaaaatacctcccggccatcgtgcgggaggcgatcaagcgccggctccgcaccctgatcctggcccccacccgggtggtcgccgccgagatggaggaggccctcaagggtcttcccatacgctaccaaacaacggcgaccaagtccgaacacaccggcagggagatcgtggacttgatgtgccacgccaccttcaccatgcgcctcctgagccccgtgcgggtaccgaactataacctgataatcatggacgaggcccactttaccgaccccgcctccatagccgcacgcgggtacatcagtacccgggtgggtatgggcgaggccgcagcgatattcatgaccgcgacgccgcccggtaccgccgatgcatttccgcaatccaatgcgccaatccaggacgaggagcgcgacatccccgaacgcagctggaactccgggaacgaatggatcaccgatttcgccgggaagaccgtgtggttcgtcccctcgatcaaggcgggcaacgacattgccaattgtttgcggaagaacggcaagaaggtgatccagctatcccgcaagacgttcgacaccgagtaccagaagaccaaactgaacgactgggacttcgtggtaactacggacatcagcgagatgggcgccaacttcaaggccgaccgggtgatcgaccccagaaggtgcctcaagcccgtaatccttaccgatggccccgagcgcgtcatcctggctgggcctatgccagttaccgcggcctccgccgcgcagcggcgcggccgtgtgggccgcaacccccagaaggagaacgaccagtacatcttcaccggccaaccccttaacaacgacgaagaccacgcccactggaccgaggcgaagatgctgctggataacatcaacacacccgagggaatcatcccggccctctttgagcccgaacgggaaaagagcgcggccatcgacggtgagtatcgcctgaagggcgagtcccggaagaccttcgtcgagctgatgcgccgcggggacctccccgtgtggctggcgcataaggtagccagtgaggggatcaagtacactgacaggaagtggtgcttcgacggtcagcggaataaccagatcctggaggagaacatggacgtggagatctggaccaaagagggcgagaagaagaagctccgcccccggtggctggacgcccgcacgtattccgacccgctggccctcaaggagttcaaggacttcgccgcgggtcgcaagagcatagcccttgacctggtgaccgagatcggtcgggtccccacccatctcgcccacagaacccggaatgccctggacaacctggtgatgctccacacgtctgagcacggcgggaaagcctaccgccatgcggtggaagaactccccgagaccatggagacgcttctcctgctgggtctcatgatcctcttgactgggggcgccatgttgttcctgatcagcggcaaggggatcggcaaaacgagcattgggctgatctgcgtaatcgcatccagcggcatgctctggatggcagagatcccgctgcagtggatcgcttccgcgatcgtgttggagttctttatgatggtcctcctgatccccgagcccgagaagcagcggacaccccaagacaatcagctggcctacgtcgtgattggcatcctcaccctggcggccatcattgcagccaacgaaatgggcttgctagagaccaccaaacgtgacctgggcatgagcaaggagccgggtgtggtctccccgactagctacctggatgtagacctccaccccgcctccgcctggaccctgtacgccgtggcgacgaccgtcataactcccatgctgcggcatacgatcgagaactctaccgccaacgtctccctcgccgccatcgcaaaccaagcggtagtcctgatgggccttgacaagggatggccgatcagcaagatggacctcggtgtacccctgctggcattagggtgctactcccaggtgaaccccctgacgctgaccgccgccgtgctcctgttaattacacattacgccatcattggcccgggcctccaggcgaaggccaccagggaggcccagaagcggacggccgccgggataatgaaaaacccgaccgtggatggcatcatgaccatcgacctggaccccgtgatctacgacagcaagtttgagaagcagctggggcaggtcatgctcctggtgttatgcgcggtacagctccttctgatgcgcacttcatgggcactctgcgaagccctgacgttagccaccggccccatcaccaccctctgggagggcagccccggaaagttctggaacactaccatcgcggtgtccatggccaacatcttccggggtagctatctcgccggtgccgggctcgccttctccatcatgaagtccgtgggaaccggcaagcgcggcactgggtcccagggtgagaccttgggggaaaagtggaaaaagaagctgaaccaactatcccggaaggagttcgacctatacaagaagtccggcatcactgaggtcgatcgcaccgaggcgaaggaggggctgaagcggggcgaaataactcaccatgccgtttcccgcggctctgctaagctgcagtggttcgtggagcggaacatggtaatcccggaggggcgcgtcatcgatttgggctgcgggagaggagggtggtcctactactgcgcgggcctgaagaaggtgaccgaggtgcgcggctacacgaagggcgggcctgggcacgaggagcccgtccccatgagcacctacggctggaacatcgtgaagctgatgtccggtaaggacgttttctacttaccgcccgagaaatgcgataccctcctgtgtgacatcggcgagagctcccccagccctaccgtcgaggagtccaggacgatccgcgtgctgaagatggtggagccctggttgaagaataaccagttctgtattaaggtcctgaatccctacatgcccaccgtgatcgagcacctggagcgcctccagcggaagcatggagggatgttagtgcgcaaccccttgagtcggaactccacccacgagatgtactggatcagcaacggcacgggcaatatcgtcgccagcgtgaacatggtcagccgcctcctgctgaaccggttcacgatgacccaccgccggccaacgatcgagaaagatgttgatctcggcgcgggcacccgtcacgttaacgccgagcctgagacgcccaacatggacgtcatcggggagcggatcaagcgcatcaaagaggagcacaactccacatggcactacgacgacgagaacccgtacaagacctgggcctaccacgggtcctacgaggtcaaagccaccggtagcgccagctccatgatcaacggcgttgtcaaactgctgacgaagccttgggacgtggtgcccatggtcacccagatggcgatgaccgacacgactcccttcgggcaacagcgggtgttcaaagagaaagtcgacacccgaaccccgcggagcatgcctggcacccgccgggttatgggcatcaccgccgagtggctctggcgcacactcggacgtaacaagaagcctcgcctgtgtacccgggaagagttcaccaagaaggttcgcacgaacgccgccatgggcgcagtgttcaccgaggaaaaccagtgggatagcgccaaggccgccgtcgaggacgaggacttctggaagctcgtagaccgcgagcgggagctgcataagctggggaagtgcggctcctgcgtttacaacatgatgggcaagcgcgagaagaaacttggtgagttcggcaaggcgaaagggtcacgggcgatctggtacatgtggctgggcgcacgctacttggagttcgaggccctcgggttcctgaacgaggaccactggttctcccgggagaacagctactccggcgtcgagggggagggcctgcacaaactcggctatatcctgcgtgacatcagcaagatccctgggggcgcgatgtacgcggacgacaccgcgggatgggacaccagaatcacggaggatgacctgcacaacgaggagaagatcactcagcagatggacccggaacatcgccagctcgccaacgcgattttcaaattgacctaccagaacaaagttgttaaggtgcagcggccaactcccaccggcacggtaatggacatcatctcccgcaaggaccagcggggcagcggccaagtgggtacttatggcctgaacacctttaccaacatggaggctcaactcatccgccagatggagggcgagggggtcctgtccaaggccgacctggagaacccacacctccccgagaagaagatcacgcagtggctggagaccaagggggtagaacggttgaagcggatggcgatatctggggacgactgcgtggtcaagccaatcgacgatcgattcgccaacgccctcctggccctgaacgatatggggaaggtgcgcaaagacatcccccaatggcaaccctccaagggatggcatgactggcagcaggtcccgttctgcagccatcacttccacgagctcatcatgaaggatggtcgtaagctggtcgtgccctgccgcccacaggacgagctaataggacgggcccgaattagtcagggggcgggttggtcgctccgggagactgcctgcctgggcaaagcctacgcccaaatgtggagtctcatgtacttccaccgccgcgacctccggctggcgagcaacgctatctgcagcgccgtacccgtccactgggtgcctaccagccgcacgacgtggtctatccacgcccaccatcagtggatgaccaccgaagacatgttaacagtgtggaaccgggtctggatcgaagataacccctggatggaggacaagaccccagtgaccacatgggagaacgtgccctacctcggtaagcgcgaggaccagtggtgcggaagcctgatcgggctgacgagccgtgcaacctgggcgcagaacatcccgaccgctatccagcaggtccgctctctcatcggcaacgaggaatttttggactacatgcccagcatgaagcggttccgcaaggaagaggagtccgaaggggccatctggtga

SEQ ID NO: 25718 - RNA, 9873 nt, synthetic construct
  misc_feature 1..9873: note = derived and/or modified CDS sequence (opt11) from DENV-3__GQ868573__SS-prME
  source 1..9873: mol_type = other RNA
acctccttctgcctgatgatgatacttcccgcggccctggcgttccacctgaccagcagagacggggagccccgcatgatcgtggggaaaaacgagcgcggtaagagcctactgttcaagacagcctcgggaataaacatgtgcaccctgatcgctatggacctcggcgaaatgtgcgacgacaccgtgacctacaagtgtccccacatcaccgaggtggaacccgaagacatcgactgctggtgtaaccttaccagtacctgggtgacctacgggacgtgcaaccaggccggcgagcatcggcgtgacaagcggagcgtggcccttgcaccccacgtaggcatggggctcgacacacgcacccagacgtggatgagcgcagaaggcgcctggcgccaggtggagaaagtggagacgtgggccctgcgccacccggggttcaccatcctggccctcttcctggcccattacatcggcaccagccttacccagaaggcggtgatcttcatactgctgatgctggttacacccagcatgaccatgcgatgtgtcggtgtgggaaaccgcgacttcgttgaaggcctatccggggccacctgggtcgacgtggtgttggagcacggcggttgtgtaaccactatggccaagaacaagcccacactggacatagaactccagaagacggaggcgacccagctggccacgctccgtaagctctgtatcgagggtaagatcaccaacatcacgaccgacagccgctgccccacgcagggagaggccgtgttgccggaagagcaggaccaaaactacgtgtgcaagcatacgtacgttgaccggggctggggcaacgggtgtggcctgtttgggaagggctccctcgtgacctgcgccaagtttcagtgcctggagccaatcgagggcaaggtggtccagtacgagaacctgaagtacaccgtcattatcacagtgcacaccggggaccagcaccaggtcggcaacgagacccaaggtgtgaccgccgagatcacgccccaggcgagcacaaccgaggccatcctccccgaatacggcaccctggggctggaatgctccccgcgcaccggcctcgatttcaacgagatgatattgctcacgatgaagaacaaggcctggatggtccatcggcagtggttcttcgacctccccttgccctggacctccggcgccactacggaaactccaacctggaaccgaaaggagctgctcgtgaccttcaagaacgcccatgcgaagaagcaggaggtggtcgtgctagggtcccaggagggcgccatgcacacggccctgacgggggccaccgaaatccagaactccggcgggaccagtatctttgccggacacttaaaatgcagactgaaaatggacaagctggaactcaagggtatgtcatacgcgatgtgcaccaacacgttcgtgctgaagaaggaggtttccgaaacccagcacgggaccatcctgatcaaggtggagtacaagggcgaggacgtgccgtgcaagatccccttcagcacagaagacgggcagggcaaggcccacaacggccgcctcatcacggccaatcccgtcgtgacaaagaaggaggagcccgtaaacatcgaggccgagccgccctttggggagagcaacatcgtcatcgggatcggggacaacgcgttgaagatcaactggtacaagaagggctccagcatcgggaagatgttcgaggccacggcccggggcgcccgccggatggccatcctcggcgacaccgcgtgggatttcgggtccgtgggcggagtgctgaactccctcggcaagatggtccaccagatcttcgggtccgcctacaccgccctgttcagcggcgtttcctgggttatgaaaatcggaatcggggtccttctcacctggatcggcctgaatagtaagaacacctccatgagcttcagttgtatcgcaatcgggatcataaccctctacttgggcgccgtggtgcaagcggacatggggtgcgtcatcaactggaagggcaaggagctcaaatgcggcagcggtatcttcgtcacaaatgaagtgcatacctggacagagcagtacaagttccaggccgactccccaaaacgcctcgccaccgctatcgccggggcgtgggagaatggcgtatgcggcattcgaagcaccacccggatggagaacctcttgtggaaacagattgccaatgagctaaactacatcctctgggaaaataacatcaagttaaccgtggtggtgggtgacatcatcggcgtgctggagcagggcaagcgcaccctcacaccgcagccgatggagctgaagtactcctggaagacctggggcaaggccaaaattgtgaccgccgagacccagaatagctcttttatcatcgatggcccgaacacgcccgagtgccccagcgcgtcccgcgcctggaacgtctgggaggtggaggattacgggttcggggtattcaccacgaatatctggctgaagctccgcgaggtttacactcagctgtgcgaccaccgactcatgtctgccgccgtgaaagacgagcgcgccgtgcacgccgacatgggctactggattgagagccagaagaacgggtcctggaagctcgagaaggccagcctgatcgaggtcaagacgtgtacgtggccgaagtcccataccctatggagtaacggggtgctcgagagtgacatgatcatccccaaaagcttggccgggcccatctcccaacataattaccggccaggataccacacccagaccgccgggccctggcacctgggcaagctcgaattggacttcaattattgtgagggcacgactgtcgtcataaccgagaactgcgggacgcgcggcccctcactgcggacgaccaccgtgagcgggaagctcatccacgagtggtgctgtcgcagctgcaccctgcccccgttgaggtacatgggcgaggacggttgctggtatggtatggagatccgccccatctcggaaaaggaggaaaacatggtgaagagcctcgtctccgccggcagcggcgaggtggacaacttcacgatgggggtgctatgcttagccatcttgttcgaggaggtcatgcgggggaagtttggcaaaaaacacatgatcgccggggttttcttcacgttcgtgctactgctctccggccagatcacctggagggatatggcccacaccctgatcatgatcggctccaatgcctccgatcggatggggatgggagtcacgtacctggccttgatcgcgactttcaagatccaacccttcctggccctggggttttttcttcgcaaactgaccagccgggagaacctgttactgggcgtgggcctggccatggccaccacgctccaactacccgaggacatcgagcagatggcgaacggaatcgccctgggcctcatggccctgaagttgatcactcagttcgagacctaccagttatggactgccctgataagcctgacatgcagcaacaccatctttacgttaaccgtggcttggcgcacggctaccttgatcctggccggtgtttcactcctgcctgtatgccaatcctcgtcgatgcggaagaccgactggctgcccatgaccgtcgccgccatgggcctaccgccgctcccactgttcatcttcagcctcaaggacacgttgaaacgccgtagttggcccctgaacgagggagtaatggccgtgggcctcgtcagcatactggcgtccagccttctacgaaatgacgtgcccatggccgggcccctcgtggccgggggcctgctcatcgcttgctacgtcatcaccggcacctccgcggacctgaccgtggagaaagcggcggacgtgacatgggaagaggaggccgagcagaccggcgtctcccacaatctgatgatcaccgttgacgacgacggtaccatgcgcatcaaggacgatgaaaccgagaatatcctcactgtgctgctgaagaccgccctcctgatcgtctccgggatcttcccgtacagcatcccggctaccttactcgtgtggcacacctggcaaaagcaaacgcagcggtccggggtgctgtgggacgtccctagcccgcccgagacacaaaaggcggagctggaggagggcgtgtaccgcatcaagcagcaaggcatatttggcaaaacccaagttggcgtaggggtgcaaaaggagggcgtgtttcacactatgtggcacgtcacgcgaggcgccgtcttaacctacaacggaaagcgcctggagcccaactgggcctctgtgaagaaggacctgattagttacggggggggctggcgtctctcagcccaatggcagaagggggaggaagtacaagtgatcgcggtggagccaggtaaaaatcctaagaacttccaaaccatgccagggacattccaaacgaccaccggggagatcggcgccattgcactggacttcaagcctggaaccagcggcagccccatcatcaaccgagagggcaaggtagtggggctgtacggcaatggcgtcgttaccaagaatggcgggtacgtgtccggtatcgctcaaaccaacgccgagccggacgggcccacccccgagctggaggaggagatgtttaagaagcgaaacctcaccatcatggacctgcatcccgggagcgggaagacgcgcaaatacctgccagcgatagtgcgggaggcgataaagagacggctccgcacgttaatcctggcccccacccgggttgtggccgccgagatggaggaggccctcaaggggctacccatccgctaccaaacgactgccaccaagtccgagcacaccggccgtgagatcgtggatctgatgtgccacgcgacctttacgatgcgcctcctgagcccggtgcgggtaccgaactacaatttgataataatggacgaggcccactttacggaccccgcatccatcgcggcccgcggttacatcagcacccgggtgggcatgggcgaggctgccgctatcttcatgaccgccacacctcccgggaccgccgacgccttcccccagtccaatgcccccatccaggacgaggagcgcgacatccccgagcgcagctggaactccggcaacgagtggattaccgactttgcggggaagaccgtctggttcgtgccctcgatcaaggccggtaacgacatcgccaattgcctccggaagaatgggaagaaggtgatccaattaagtcgcaagacgttcgacaccgagtaccagaagaccaagctgaacgactgggacttcgtcgtgacaacggacatcagcgagatgggtgccaatttcaaggccgaccgggtgatcgacccgcgccgatgtctcaagcccgtcatcctgaccgacggccccgaacgcgtgatcctggcagggcccatgccggtaaccgccgcctccgccgcccagcggcgcggccgggttgggaggaacccccaaaaggagaatgaccagtatatcttcactggccagccgctcaacaacgatgaggaccacgcgcactggaccgaagccaagatgctgctggacaacattaacacgcccgaggggattattccggccctgttcgagccggagcgtgagaagagtgcagcgatcgacggcgagtaccgcctgaagggcgaatccagaaagaccttcgtggaactgatgcgccgcggggacctgcccgtgtggctcgcccacaaggttgccagcgaggggattaagtacactgatcgcaaatggtgtttcgacgggcagcggaataaccagatactggaggagaacatggacgtggaaatatggaccaaggagggcgagaagaagaaactccgtccccggtggctggacgctaggacgtactccgacccactggccctcaaggagttcaaggacttcgcggctggccgcaagtctatcgcccttgacctggtcaccgaaattggacgggttcccacccacctcgcgcacagaacccggaacgccctggacaacctggtgatgctccacactagtgagcatggcgggaaggcgtaccgccacgccgtagaggagctgcccgaaaccatggaaaccctgctcctgctaggcctcatgatactgctgactgggggcgccatgctgtttctgatcagcggcaaggggattggcaagacgagcatcgggctgatatgcgtgattgcctccagcggtatgctctggatggccgagatccctctgcaatggatcgcttccgccatcgtgctggagttcttcatgatggttctcttgatccccgagcccgaaaagcaacgaacgccccaggacaaccaactggcgtacgtggtgatagggatcctaaccttagctgccatcatcgcggcaaacgagatgggcctgctcgagaccacgaagcgcgacctcggcatgtcaaaggagccgggggttgtgtcccccaccagctaccttgacgtggacctccatcccgcctccgcctggaccctgtacgcggtcgccaccacggtgatcacccccatgctgcggcacaccatcgaaaatagcaccgccaacgtgtccctcgcggcgatcgcgaaccaggccgtggtgctgatgggattagacaaggggtggcctatctcgaagatggacttgggcgtgccactgctggcactagggtgctactcacaggtcaatcccctcacgctgaccgccgccgtgctactgctgatcacccattacgcgatcatcggccccggactccaggcgaaggccacccgcgaagcccagaaacggaccgcagcggggatcatgaagaacccgaccgttgacggcattatgaccatcgacctggacccagtcatctacgactccaaattcgagaagcagctcggccaggtgatgctcctagtgctgtgcgcggtccagctcctactgatgcgcacctcatgggccctctgtgaggcactgacgctggctaccggccccattaccaccttatgggagggcagtcccgggaaattctggaacacgaccatagccgtgtccatggccaatatattccggggaagctacctggcaggcgccggcctggcgttctccatcatgaaatccgttgggaccggcaagcggggcaccgggtcacagggcgaaaccctcggggagaagtggaagaagaagctgaaccagttgagccggaaggagtttgacttgtacaaaaaaagcggcatcacggaggtcgaccgcaccgaggccaaggaggggctgaagcgaggcgaaatcacgcaccacgccgtgtcccgcggcagcgcgaagcttcagtggttcgtagagcggaacatggtaatcccggaggggcgggtgatagaccttggctgcgggcggggcggttggtcctactactgcgccggtctgaaaaaggttacagaggtcaggggctatacgaaaggggggcccggacacgaggagcccgtgcccatgagcacctacggctggaacatcgtgaagctgatgtcagggaaagacgtcttctatctccctcccgagaaatgcgacaccctgctgtgcgacatcggcgagagctcccccagccccaccgtggaagaatctaggacgatacgcgtcctgaagatggtcgagccctggttgaagaacaaccaattctgtataaaggtgctgaacccctatatgcccaccgtaatcgaacacctcgagcggctccagcggaagcacggcggtatgctggtccgcaacccactgtcgagaaactccacgcacgagatgtactggatcagcaacgggactggaaacattgtagcgtcggttaacatggtcagccgcttgcttctaaaccggttcacaatgacccaccgccggccgaccatcgagaaggacgttgacctcggcgcaggcacccgccacgtgaacgccgagcccgaaactccgaacatggacgtaataggggagcgcatcaaacgcatcaaagaggaacacaactccacctggcactacgacgacgagaacccgtataagacctgggcctatcatggctcttacgaggtgaaggccaccggttccgcgtcatccatgatcaacggcgtggtcaagcttctgaccaaaccgtgggacgtggtccccatggtgacccagatggccatgacagatacgacgcctttcgggcagcagcgtgtgttcaaggagaaggtcgacacccgcaccccgcggagtatgccgggcacgcgccgggtgatgggcatcacagccgagtggctctggcgcaccttaggacggaataagaagccccgactatgcacacgcgaagagttcaccaagaaggtgcgcacgaacgccgccatgggcgccgttttcaccgaagagaatcagtgggactcggctaaggccgcagtggaggacgaggacttctggaagctcgttgatcgtgagcgggagctgcacaaactgggcaagtgcggaagttgtgtgtacaacatgatgggaaagcgcgagaagaagctcggtgagttcggcaaggctaaggggtcgcgggccatctggtacatgtggttaggcgcacgctacttagagttcgaggcgttggggttcctgaacgaagatcactggttctcccgggaaaacagctacagcggagttgagggggaaggcctacacaaactcggctacatcctgcgcgacattagcaagattccagggggcgccatgtacgcggatgacaccgccggttgggacacccggatcacagaagacgacctgcacaatgaggagaagatcacacaacagatggacccggaacatcgccagctcgccaatgctatctttaagctgacttatcagaacaaggtagtcaaggtccagaggccgacgcctaccggcaccgtgatggatatcatatccaggaaggaccagcggggctcaggacaagttggcacctacgggctaaacaccttcacaaacatggaggcgcaactcatccgccaaatggagggagaaggggtgttatccaaggcggacctggagaacccccacctcccggagaagaagatcacgcagtggctggagacgaaaggggtggaacggctgaagcgaatggccatcagcggcgacgattgcgtcgtgaagcccatcgacgatcggttcgccaacgccctcctagctttgaatgacatggggaaggtgcgcaaggacatcccgcagtggcaaccctcgaagggctggcacgactggcagcaggtcccgttctgcagccaccacttccatgagctcattatgaaagacggacggaagctggtagtgccgtgtaggccccaagacgagctgatcggccgggcgcgcatctcccaaggggccggttggtcactacgggagaccgcctgcctgggcaaggcttacgcgcagatgtggtctctgatgtacttccaccgacgcgacctccggctggcaagcaatgccatctgctccgctgtccccgtacactgggtgcccaccagccgcacgacctggtccatccacgcccaccaccagtggatgaccaccgaggacatgctgacagtctggaatcgggtgtggatcgaggacaacccctggatggaggacaagacgcccgtgaccacctgggagaacgtcccttatctcgggaagcgcgaggaccagtggtgcggctctctgatcgggctgacgagccgggcgacctgggcccagaacataccgaccgccatacagcaagtcaggtccctcatcggcaacgaagagttcctggactacatgccaagcatgaaacggttccgcaaggaagaggagtccgagggtgctatctggtga

SEQ ID NO: 25719 - RNA, 9873 nt, synthetic construct
  misc_feature 1..9873: note = derived and/or modified CDS sequence (opt11) from DENV-3__GQ868574__SS-prME
  source 1..9873: mol_type = other RNA
acctcgctgtgtctcatgatgatcctgcccgccgccctggcgtttcacctcacctcccgggatggggagccgcggatgatcgtagggaaaaatgagcggggcaagagtctactcttcaagaccgcctctgggatcaacatgtgtaccctcatagccatggacctgggcgagatgtgcgacgacaccgtgacctacaagtgtccccacatcacggaggtggagcccgaggacatcgactgttggtgtaatttgaccagcacgtgggtgacctacgggacgtgcaaccaggccggcgagcaccgtcgcgacaagcggagcgtagccctcgcgccccacgtgggcatggggctggacacccgcacccagacctggatgagcgccgagggcgcctggcgccaggtggagaaggtcgaaacctgggccctgcgccacccagggttcaccatcctcgcgctgtttctggcgcactacattggcacctccctcacccagaaggccgtgatattcatcctgctgatgctcgtgactccctccatgacgatgcggtgcgtcggggtgggcaaccgcgacttcgtggagggcctgtccggggccacctgggtcgacgtggttttagaacatggcgggtgcgtcaccacaatggccaagaacaagcccaccctcgatatcgagctgcagaagacagaggcgacacagctggccacgctgcggaagctgtgcatcgaagggaagatcaccaacatcacaaccgacagccgctgccccacgcagggcgaggccgtgctgccggaggagcaggaccagaattacgtgtgcaagcacacctacgtggaccgggggtggggcaatgggtgcgggttgtttgggaagggctccctggttacctgcgccaagttccagtgcctggagcccatagaaggcaaagtggtccagtacgagaacctcaagtacacggtgatcatcacggtacacaccggggaccagcatcaggtgggcaacgagacccagggggtgaccgcagagatcacgcctcaggcctctaccacagaggccatcttacccgagtacggcaccctggggctcgagtgctccccgcgcaccggcctggacttcaacgagatgatcctgctcacgatgaagaacaaggcctggatggtccaccggcagtggttcttcgacctgcccctgccctggacctctggcgctaccaccgagacgcccacctggaaccgtaaggagctcctggtgaccttcaagaacgcccacgcgaagaaacaggaggtggtagtgctggggtcacaggaaggcgccatgcataccgcactcacgggggccaccgagatccaaaacagcggcgggacctcgatcttcgccggccacttaaaatgccgcctgaagatggacaagctcgagctgaagggcatgagctacgcgatgtgcaccaacacgttcgtgctgaagaaggaggtctccgagacccagcacgggaccatcctcatcaaggtggagtacaagggggaggacgtgccgtgcaagatcccatttagcaccgaggacggacagggcaaggcccacaacggccggctgatcacagccaaccccgtcgtgaccaagaaggaggagcccgtgaacatcgaggccgagccgcccttcggggagagcaacatcgtcatcggcatcggggacaacgcactcaagatcaactggtacaagaagggctccagcatcgggaagatgttcgaggccaccgccagaggggcccgccgcatggccatcttgggcgacaccgcgtgggacttcggttccgtgggaggggtgctcaacagcctgggcaagatggtccaccagatcttcggatccgcctacacggccctgttcagcggtgtgtcctgggtgatgaagattggcatcggggtcctcctgacctggatcggcctgaacagcaagaacaccagcatgtcgttctcctgcatcgccatagggatcatcaccctctacctgggcgccgtggtgcaggccgatatggggtgcgtcattaactggaagggaaaggagctgaagtgcggcagcgggattttcgtgacgaacgaggtgcacacctggaccgagcagtataagttccaagccgacagccccaagcgcctcgccaccgcaatcgctggcgcgtgggagaacggcgtatgcggcatccgcagtacgacccggatggagaacttattgtggaagcaaatagcgaacgagctcaactacatcctgtgggagaacaacatcaagctgactgtggttgtcggggacatcatcggcgtgctcgagcagggcaagcgcaccctgacgccccagccgatggagctgaagtattcatggaagacttgggggaaggccaagatcgtgaccgccgagacccagaacagcagttttatcatcgacggccccaatacgcccgagtgtcccagcgcttcccgtgcgtggaacgtctgggaggtagaggactacggtttcggcgtgttcactaccaatatctggctcaagctgcgcgaggtctacacccagctgtgcgaccaccgtctcatgagcgccgccgtgaaggacgagcgagccgtacacgcggacatgggctactggatcgagagccagaaaaacgggtcttggaagctggaaaaggccagcctgatcgaagtcaagacctgcacgtggccgaagtcgcataccctctggagcaacggcgtgctggaatctgacatgatcatccctaagagcctggcagggcccatatcccaacacaattaccggcctggctatcacacccagaccgccgggccttggcacctcggtaagctggagctggacttcagctactgcgagggcacaaccgtggtcataaccgagaactgcgggacccgcggcccctccttacggacgaccacagtgagcgggaagctgatccatgaatggtgctgtcgcagttgcaccctgcccccgctacggtacatgggcgaggacggatgttggtacggcatggagattcgccccatcagcgagaaggaggaaaacatggttaagtccctggtcagcgccggttccggggaagtggacaacttcacgatgggtgtgctgtgcctcgcgatcctgttcgaggaggtcatgcgcgggaagttcggcaagaagcacatgatcgccggggtgttcttcacgttcgtgctgctactgtccggtcagatcacctggcgcgacatggcccacacgctcatcatgatcggctcgaacgccagcgatcggatggggatgggcgtcacgtatctagccctgatcgccaccttcaagatccagcccttcctggcactcggctttttcctccgcaagctgaccagccgagagaacctcctgctgggcgtgggcctcgccatggccaccacgctgcagcttcccgaggatatcgagcagatggccaacgggatcgccctcggcctgatggccctgaagctcatcacccaattcgagacctaccagctgtggaccgccttaattagtctcacgtgcagcaatacgatcttcaccttaaccgtggcctggcgaacggcgaccctgatcctcgccggggtctccctgctaccggtgtgccagagctcatctatgcggaagaccgactggctcccgatgaccgtagcggccatgggagtgccgccgctcccgctgttcatcttctccctcaaggacacgctgaaacgccgcagctggcccctgaacgagggggtaatggccgtcggcctcgtgtccatactggcgagctccctgctccgaaacgacgtccccatggcaggccccctggtcgccgggggcctgctcatcgcgtgctacgtgatcaccggtaccagcgccgacctgactgtggagaaggcggccgacgtcacgtgggaggaggaggccgagcagaccggggtgtcccacaacctgatgattacagtggacgacgacgggaccatgcgaatcaaagacgacgagaccgagaacatcctaacggtgttattaaagaccgccctcctgatagtaagcggcatcttcccgtactccatacccgcgaccctgctcgtgtggcacacctggcagaagcagacgcaacggagcggcgtcctgtgggacgtgcccagcccgcccgagacccagaaggctgagctggaggagggtgtgtaccgcatcaagcagcagggcatctttgggaagacccaggtcggcgtgggggtgcagaaggagggcgtcttccacacgatgtggcacgtgacgcgaggcgccgtcctcacctacaacgggaagcggctggagccgaattgggcctccgtcaagaaagacctgatctcctacggcgggggctggcggctcagcgcacagtggcagaagggggaggaggtccaggtgattgcggtggagcccggcaagaaccccaagaacttccagaccatgcccggcaccttccagactacgaccggggagatcggcgcaatcgccctggacttcaaacccgggaccagcggctcccccatcattaaccgcgagggcaaggtggtggggctgtacggtaacggggtcgtgacgaagaatggcgggtacgtgtctggcatcgctcagaccaacgccgagccggacggccccacccccgaacttgaggaagagatgtttaagaagaggaatctcaccattatggacctgcaccccgggtccggcaagacgcgcaaatatctgccggcgatcgtccgggaggccatcaagcgcagactccgaaccctgatccttgcccccacccgtgtggtggcggccgagatggaggaggcactcaagggtttacccattcgctaccagaccacggcaaccaagagcgagcacaccggccgggagatcgtcgacctgatgtgccacgccactttcacgatgcgcctcctgtccccagtgagagtgccgaactataacctgataatcatggacgaggcacacttcaccgaccccgcgagcatagcggcccgcgggtacatatccaccagagtcggcatgggcgaggccgccgcgatcttcatgaccgccactccgcccgggaccgccgacgccttcccgcagagcaacgcccccatccaggacgaggagcgggacatacccgagcgctcctggaacagcggaaacgagtggatcactgactttgcgggaaagaccgtgtggtttgtaccctccatcaaggccggcaatgacatcgctaactgcctccggaagaacgggaagaaggtcatccagctgtcccgcaagacgttcgacacagagtaccaaaagaccaagctgaacgactgggatttcgtggttaccacggacatctccgagatgggcgccaatttcaaagccgaccgggtcatcgacccgcgccggtgtctcaagcccgttatcttaaccgacggccccgagcgcgtgatcctggcggggcccatgcctgtcaccgccgccagcgccgcccagcggcgcggccgggtggggagaaacccccagaaggagaacgaccagtacatcttcaccggacaacccttgaacaacgacgaggaccacgcgcactggaccgaggcgaagatgctgctggataatatcaacacgccagaggggatcattcctgccctcttcgagcccgaacgggagaagtccgccgcgatcgacggcgagtaccgcctgaagggcgagagccggaaaaccttcgtggagctgatgcgccgcggggacctgcccgtctggctagcccacaaggtggcctccgagggcatcaagtacaccgaccgcaagtggtgtttcgatgggcagcggaacaaccagatcctggaggagaatatggacgtcgagatctggaccaaggagggcgagaagaagaagttgcggccccgttggttggacgcccgcacctatagtgacccgctggccctcaaggagttcaaggacttcgcggccggccgcaagtccatcgccctagacctggtgacagagataggtcgggtgcccacgcacctcgcacaccgtacacgcaatgccctggacaacctggtcatgctccatacgagcgagcacggcggcaaggcataccgccacgccgtggaggagcttcccgagaccatggagaccctattactgctgggcctcatgatcctgctgacaggaggggccatgctgttcctgatcagcggcaagggaattggcaaaacgtccatcgggctcatctgcgttatcgccagctccggcatgctctggatggcagagatcccgctgcagtggatcgcgagcgccatcgtcctggagttcttcatgatggtcctcctgatccccgagcccgagaagcagcgtacgccccaggacaaccagctggcctacgtggtgatcgggatcctcaccctggccgcgatcatcgccgccaacgagatgggcatgcttgagacaacgaagcgcgacctcggcatgtccaaggagccgggggtggccagccccacctcctatctggacgtggacctgcacccagccagcgcttggaccctatacgccgtcgccaccacggtgatcactcccatgctgcggcataccatagagaactccaccgccaacgtgtcgttggcagcgatcgccaaccaagccgtcgtgctaatgggcctggataaaggctggccgatctccaagatggacctgggcgtgcccctcctggccctggggtgctacagccaggtcaacccccttacgctgaccgccgcggtgctgctactgatcacccactacgccatcatcggccccggcctgcaggccaaggccacccgcgaggcgcagaagcggacggcggccgggatcatgaagaacccgaccgtggacggcataatgaccatcgacctcgaccccgtcatttacgacagtaagtttgagaaacaactgggccaggtgatgctgctcgtgctgtgtgccgtccagctgctcctgatgcgcaccagctgggccctgtgcgaggcgctcacgctcgccaccggccccatcacaacactgtgggagggctcccccgggaagttttggaataccaccattgcagttagcatggcgaatattttccggggctcctacctcgccggggcagggctggccttcagcatcatgaagtccgtgggcactggcaagcgcggcaccgggtcccaaggcgagaccctgggagagaaatggaagaagaaactcaaccagctctctagaaaggagttcgatttatacaagaaatccggaattacggaggtcgaccgcaccgaagccaaggaggggttgaagcggggcgagattacccaccacgctgtgagccgcggctccgccaagctacagtggttcgtggagcgcaacatggtcataccggaggggcgcgtgattgatctgggctgcgggcgtggtgggtggagctactactgcgcggggctgaagaaggtgaccgaggtccgcggctatacgaagggaggacccggtcacgaggagcccgtgcccatgtccacctacggttggaacatcgtgaaacttatgagcgggaaggacgtcttctacctgccgcccgagaagtgcgacaccctcctctgcgacatcggcgaatccagcccctcccccaccgtggaggagagcagaacgatccgcgtgctgaagatggtcgagccgtggctgaaaaacaaccagttttgcatcaaggtgctcaatccctacatgcccaccgtgatagaacacctggagcgcctgcagcggaagcacggcggaatgcttgtccgcaaccccctgtcccggaacagcacgcacgagatgtactggatatccaacggcaccgggaacatcgtggcctcagtgaacatggtctcccgcctactcttaaatcggttcacgatgacccaccgccggccgacgatagagaaggacgtagacctgggcgccggcacccgtcacgtgaacgccgagcccgagacgccaaacatggacgttatcggggagcggatcaagcgcatcaaggaggagcacaacagcacctggcactacgacgacgagaacccgtacaagacctgggcctaccacggctcctacgaggtaaaggcgactggtagcgcctccagcatgatcaacggcgtggtcaaattgctgacgaagccctgggacgtggtccccatggtgacacagatggccatgaccgacaccacgcccttcgggcaacagagagtgttcaaggagaaggtcgacacccgcaccccgcggagcatgcccggcaccaggcgggtgatgggcatcacggccgagtggctgtggcgcaccctcgggcggaacaagaaaccccgcctgtgcacccgggaggagttcaccaagaaggttcgaacgaacgcggccatgggagccgttttcaccgaggagaaccagtgggactcggcgaaggccgcggttgaggacgaagacttctggaagttagttgaccgcgagcgggagctccacaagctggggaagtgcgggagctgcgtctacaacatgatggggaagcgcgagaagaagctgggcgagttcggcaaggccaaggggtcccgggcgatatggtacatgtggctcggcgcccgctacctcgagttcgaggcgctggggttcctcaacgaggaccactggttcagccgggagaactcctatagcggagtggagggggagggcctgcataagctgggatacatcctccgcgacatctccaagattcccgggggagcgatgtacgcagacgacaccgcggggtgggacacccggatcaccgaggacgaccttcataacgaggagaagatcacccaacagatggacccggagcacaggcagctggcgaacgcgatcttcaagctcacttaccagaacaaggtcgtcaaggtacagcggcccacacccaccggcacggtgatggacatcatcagccgcaaggaccagagaggctccgggcaggtcggcacctacgggctgaacaccttcaccaacatggaggcgcagctgatccgccagatggagggcgagggggtcctcagcaaggccgacctggagaacccgcacctccccgagaagaagatcacccagtggctggagaccaagggcgtggagcgcctgaaacgcatggccatctccggtgacgactgcgtggtgaaacccatcgacgaccggttcgccaacgccctgctagcgctgaacgacatggggaaggtgcgcaaggacatcccccaatggcagcccagcaagggatggcacgactggcagcaggtcccgttctgttcccaccacttccacgagctgatcatgaaggacggccggaagctcgtggtgccctgccgcccccaggacgagctgatcggtcgggcccgcatcagtcagggggccggctggtccctgcgggagaccgcatgcctcggaaaggcgtacgcccagatgtggagcctgatgtacttccaccgccgcgacctgcggctggcctccaacgccatctgcagtgccgtccccgtgcactgggttcccaccagccgcacaacctggagcatccacgcgcatcaccagtggatgacgaccgaggacatgctgacggtctggaaccgggtttggatagaagacaacccctggatggaagacaaaacccccgtgaccacctgggagaacgtcccctacctggggaagcgcgaagaccaatggtgcggcagcctgatcgggctgacctcccgggccacctgggcgcagaacatcccgaccgccatacagcaggtacgcagcctgatcggcaacgaagagttcctagactacatgccctccatgaagcggttccgcaaggaggaggagtctgagggggctatctggtag

SEQ ID NO: 25720 - RNA, 9873 nt, synthetic construct
  misc_feature 1..9873: note = derived and/or modified CDS sequence (opt11) from DENV-3__GQ868575__SS-prME
  source 1..9873: mol_type = other RNA
accagcctatgcttaatgatgatcctgccagccgccttagcgttccacctcaccagccgggacggagagccgcggatgatcgttgggaagaacgagcgtggcaagagcctgctgttcaagaccgccagcgggatcaacatgtgtaccttgatcgccatggatctgggcgaaatgtgtgacgacactgtcacctacaaatgtccccatatcacggaggtagagcccgaggatattgactgctggtgcaacctgaccagcacttgggtgacctacggcacctgcaaccaggccggcgagcaccggcgcgacaagcgatccgtagccttggcgccccatgtgggcatgggactggatacccgcacccaaacctggatgagcgccgagggcgcctggcgccaggtggagaaagtggagacgtgggccctgcgccaccctgggttcaccatcctcgcgttgttcctggcccactacatcgggacctccttgacccagaaggccgtgatcttcattctgctgatgctcgtgactcccagcatgaccatgcgatgcgtaggggtcggcaaccgcgacttcgtggagggcctttccggggccacctgggtagacgtggtgctggaacacggggggtgcgtcaccacaatggcgaagaacaagcccaccctcgacatagagctgcagaagaccgaggcgacccagctggcaacgctccggaagctttgcatcgagggcaaaatcaccaacatcactactgactcaagatgccctacccagggggaagcggtgctgcctgaggagcaggaccaaaactacgtctgcaagcatacctacgtcgaccggggctggggcaacggatgcggcctcttcgggaagggctccctggtcacttgcgccaagttccaatgcctggaacccatcgagggcaaggtggtccaatacgagaacttaaaatacaccgtgatcataaccgttcacaccggggaccagcaccaggtgggcaacgaaacccaaggggtgacagccgagatcacgccccaggcttcgactaccgaggctatcctccccgagtatggcacactgggtctcgagtgttccccgcgcaccggcctagacttcaacgagatgatcctgttgacgatgaagaataaagcctggatggtccaccggcagtggttcttcgacctgcccctgccctggaccagtggcgccaccacggagacgcccacctggaatcgaaaggagctcctggtgaccttcaagaacgcacatgcgaagaagcaggaggtggtcgtgctgggatcccaggagggcgccatgcacacagccctcaccggggccaccgagatccagaacagcggaggcacctccatcttcgccggccatttgaagtgccggctgaagatggataagctcgagctgaaaggaatgagctacgcaatgtgcaccaacacgttcgtgctgaaaaaggaggtttccgaaacccagcatgggaccatcctcatcaaggtggagtacaaaggagaggatgtgccatgcaaaatccccttcagcaccgaggacgggcagggcaaagcccacaacggccgcctgataacggccaatccggttgtgaccaagaaagaggagcccgtaaacatcgaggcagagccgcccttcggggaaagcaacatcgtaatcggcatcggggataacgcgctcaagatcaactggtacaagaagggctccagcatcggaaagatgttcgaggccaccgcccggggagcccgccggatggccatcctgggcgacaccgcatgggacttcgggtccgtgggcggggtgctcaacagcctcggaaagatggtacaccagatcttcgggtccgcctacacggcactgttctcgggcgtgagttgggtgatgaagatcggaatcggggtcctcctgacctggatcggcctgaatagcaagaacacctccatgtcattctcttgcatcgccatcgggattatcactctctacctgggcgccgtggtgcaggcagatatggggtgcgtcatcaactggaagggcaaggagctgaagtgcggcagcgggatattcgtgaccaatgaggtgcacacctggacagagcaatacaaattccaggccgactcaccaaagcgcttagcgaccgccatcgccggggcgtgggagaacggggtctgcggcatccgcagcacgacccggatggagaacctcctgtggaaacagatcgccaatgagctcaattacatcctatgggagaataacatcaagttgaccgtggtggtcggggacatcatcggcgtgcttgagcagggcaagcgcaccctgacgccccagccgatggagctgaaatactcctggaagacctgggggaaagctaagatcgtgaccgctgagacccagaacttcagcttcatcatcgacggccccaacacaccagagtgtccctccgcgtcacgggcctggaacgtctgggaggtggaggattatgggttcggggtgttcaccaccaacatatggcttaagctgcgcgaggtctacacccagctgtgcgaccaccggttaatgtccgcggcggtaaaggacgagcgcgccgtgcatgcggacatgggctactggatcgagtcgcagaagaacggaagctggaagctcgagaaggcctccttaatcgaggtcaagacctgcacgtggcccaaaagccacaccctctggtccaacggcgtcctggagtcagacatgatcatccccaagtccctggccgggcccatcagccagcataattaccgtcccggttaccacacccagaccgcgggaccctggcacctcggcaagttagagctggacttcaactactgcgagggcacgaccgtggtcatcaccgagaactgtgggactcgcggcccctcgttacggacaacaaccgtgtcggggaagctcatccacgagtggtgttgtcgctcctgcaccctgccgccgctacggtacatgggcgaggacgggtgttggtacgggatggaaatcagacccatcagcgagaaagaggagaatatggtcaagtcccttgtaagcgctggctccggggaggtggataacttcacgatgggcgtgctatgcctcgcgatcctgtttgaagaggtcatgcgggggaagttcggcaagaagcacatgatcgcaggggtgttctttaccttcgtgctgctcctgagcggccagatcacctggcgcgatatggctcacaccctgatcatgatcggctccaacgccagcgataagatggggatgggcgtcacttacctcgccctgatcgctacgttcaagatacagcccttcctggccctcgggttcttcctgcggaagttaaccagtcgcgagaacttgctgctgggcgtgggcctcgccatggccaccacgctccagctgcccgaggacatcgagcagatggcgaacgggatcgccctaggcctgatggccctaaagctcatcacccaattcgagacctaccagctgtggaccgcgttgatcagcctcacgtgtagcaacaccatcttcaccctgaccgtggcttggcgcacggcgaccctaatcctcgcgggggtgtccctactgccggtgtgccagagctccagcatgcgcaagactgactggttacccatgaccgtcgccgccatgggcgtgccgcctctcccgctgtttatcttcgggctcaaggacacgttgaaacggcgctcctggccacttaacgagggcgtgatggccgtcggcctcgtgagcatcctggcgtccagcctactccgcaatgacgtgccaatggccggtcccctggtcgccggcgggctgttaatcgcgtgctacgtgatcaccggcacctccgccgacctgaccgtagagaaggcggccgacgtcacgtgggaggaggaggccgagcagactggggtgagtcacaacctgatgatcaccgtggacgatgatggtaccatgcggatcaaggacgacgagaccgagaacatcctcacggtccttctgaagaccgctctcctgatcgtgtccggcatcttcccgtacagcatccccgccaccctgttggtatggcacacctggcagaagcagactcagcgctccggggtactgtgggacgtccccagcccacctgagactcaaaaggcggagctggaggagggcgtataccggatcaagcaacagggcattttcggcaagacccaggtcggcgtgggcgtgcagaaggagggcgtcttccacaccatgtggcacgtgacgcgcggcgccgtgctcacctacaacggcaagcgcctggagcctaactgggcctccgtcaaaaaggacttgatcagctacgggggcgggtggcgcctctccgcccaatggcagaagggagaggaggtccaggtgatcgcggtggagcccggaaagaatcccaaaaacttccagaccatgccagggaccttccagacgaccaccggcgagattggggccatcgccctggactttaagcccggaaccagcggctcccccatcatcaaccgggaggggaaggtggtggggctgtacgggaacggtgtggttacgaaaaacggaggctacgtaagcggcatcgcccagaccaacgccgaaccggatgggccgacgcccgagctagaggaggagatgttcaagaaacggaacctcaccataatggacctacatcccgggtcaggaaagacgcggaagtacctaccggcgatcgtgagggaggctattaaacggcggctccggaccttgatcctagcccccacccgcgtggtggccgcagagatggaggaggcgctcaaaggcctgcccatccggtaccagaccacggccaccaagtcagagcataccgggcgcgagatcgtcgacctgatgtgccacgcgaccttcacgatgcggcttctgagccccgtgcgagtgccgaactacaacctaatcatcatggacgaggcccacttcaccgaccctgcctccatcgcagcgcggggctacattagcacccgagtcggcatgggggaggccgccgcgatcttcatgaccgccacgcccccaggcaccgccgacgctttcccgcagagcaacgccccaattcaggacgaagagcgggacatacccgagcgcagctggaactccgggaacgagtggataaccgacttcgcgggcaagaccgtgtggtttgtgcccagcatcaaagccggaaacgacatcgccaactgcctccgcaagaacggcaagaaggttatccagctgtcgcggaaaacgttcgacaccgagtaccagaagaccaagctgaacgactgggactttgtggtgaccacggacataagcgagatgggcgccaacttcaaggcggatcgcgtcatagacccgcggcgctgcctcaagcccgtgatcctgactgacggtcccgagcgggtgatcctggcggggccaatgccggtcacggccgctagtgccgcccagcgccgggggagagtgggccggaaccctcagaaggaaaatgatcagtacatcttcaccggacagcccttaaacaacgatgaggaccacgcgcactggaccgaggcgaagatgctgctggacaacataaacacgcccgaaggcattatacccgcgctctttgaaccagaacgggagaagtccgccgccatcgatggggagtaccggctgaagggtgagagtcgcaaaaccttcgtggagctcatgagacgcggagacctccccgtatggctagcccacaaggtggcgagcgagggtataaagtacaccgaccggaagtggtgcttcgacggccagcgcaacaatcagatactggaggagaacatggacgttgagatctggacaaaggagggcgagaaaaagaaactccggccccgctggctcgatgctcggacgtactccgacccgctggccctgaaggaattcaaggacttcgcggccgggcgcaaatctattgccttggacctagtgaccgagatcggtcgcgtgcccacccacttagcgcaccggacccgcaacgctctagacaacctggtcatgctccacacgagtgagcacgggggcaaggcgtaccggcatgctgtggaggagctgccagagaccatggagaccctgctcttgcttgggctaatgatcctgctgaccgggggggccatgctgttcttaatcagcggtaagggcatcgggaagacatctattggcctgatctgtgttatcgccagtagcggcatgctttggatggcagagatcccgctgcagtggatcgcgtccgccatcgtcctggagttcttcatgatggtgcttctgataccagagcccgagaagcagcgcacgccacaggataatcagctggcctacgtggtcatcggcatactcacccttgccgccattatcgccgccaacgagatgggcctgctcgagaccactaagcgggacctagggatgtccagagagccaggcgtggtttcccccacttcgtacctggacgttgaccttcaccccgcctccgcctggaccctgtacgccgtggccacaacagtgatcaccccaatgttacggcacaccatcgagaacagcactgctaacgtctccctcgccgccatcgcaaaccaggccgtggtgttaatggggctagacaaaggctggccgatcagcaagatggacctcggcgtccccctactggcgctcggctgctactcccaggtgaaccccctgacgctgaccgccgccgtgctcctgctgatcacccactacgcgatcatcggtcctggacttcaggccaaggccaccagggaggcccagaagcggacggccgcgggcatcatgaagaacccaaccgtggacgggatcatgaccatcgaccttgaccccgtcatatacgacagcaagttcgaaaaacagctcggacaggtgatgctcctggtcctgtgcgccgtgcagcttcttctgatgcgcacatcatgggccctctgcgaggcgctaacgctggcgaccggtccaattaccacgctttgggagggtagccccggcaagttctggaacacgaccatcgccgtgtccatggccaacatcttccgggggtcgtacctagccggcgccgggctggcattctccatcatgaagtccgtcggcaccggtaaacgcgggacgggctcccagggtgagaccctcggcgagaagtggaagaagaagctgaaccagctaagccggaaggagttcgacctctacaagaaatccggtatcaccgaagtggatcgcaccgaagccaaggagggcctgaagcggggcgagatcacccaccatgccgtgagccgcggcagcgctaagcttcaatggtttgtcgaacggaacatggtgatcccggagggccgcgtgatcgacctcgggtgcggccgagggggctggtcttattactgcgccgggctgaaaaaggtcactgaggtacgcgggtacacgaagggcgggcccggccacgaagagcccgtgcctatgtcaacctatgggtggaacatcgtcaagctgatgtccggcaaggatgtgttttatctcccccccgagaaatgtgacacactcctgtgcgacatcggcgagagctcgccttcgccaaccgtagaggagtcgcggacgatccgcgtcctgaagatggtggagccgtggctcaagaacaaccagttctgcatcaaggtgctgaacccctacatgcccaccgtaatcgaacacctggagcgcctccagcggaagcacgggggcatgctggtacgcaaccctctgagccgaaactccacccacgagatgtactggatcagcaacggaaccggcaacatcgtggcgtctgtcaacatggtgagccgcctactgctgaaccgcttcacgatgactcatcgccggccgaccatcgaaaaggacgtggacctcggcgccggaacccgccacgtcaacgccgagccggagattcctaacatggatgtgatcggcgaacggatcaagcgcatcaaagaggagcacaactccacgtggcactatgacgacgagaacccctacaagacctgggcgtaccatgggagctacgaagtgaaggccaccggcagtgcgagctccatgatcaatggggtcgtgaagctcctgaccaagccctgggatgtcgtgcccatggtgacgcagatggccatgacagacaccacgcctttcggccagcaacgggtctttaaggagaaggtggacacgcgcaccccgcggtcaatgcccggcaccagaagagtgatggggatcaccgccgagtggctctggcgcacgctgggccgtaacaagaaaccccgcctgtgcacacgggaggagttcaccaagaaggtccgcaccaatgccgcgatgggggccgtgttcacggaggaaaaccagtgggactccgccaaggccgcggtggaggacgaggacttctggaagttagtcgatcgggagcgggaactgcataagctgggcaagtgcgggagctgcgtgtacaacatgatggggaagcgcgagaagaagctcggagagttcgggaaggcgaagggcagccgggcgatctggtacatgtggctgggggcccgctatctggaattcgaggccctcggcttcctgaacgaggaccactggttcagccgggagaacagctactccggggtggagggggagggcctccacaagctcggatacatcctgcgtgacatcagcaaaatccccggcggggctatgtacgcggacgacacggccggctgggatacccggatcaccgaggacgaccttcacaacgaagagaagatcactcagcagatggacccggagcaccgccagctcgccaatgccatcttcaagctgacctatcagaacaaggttgtgaaggtgcagcggccgacccccactgggaccgtaatggacatcatcagtcgcaaggaccagcgggggagcgggcaggtggggacgtacggcctgaacaccttcactaacatggaggcccagctcatccgccagatggagggggaaggcgtcctgtccaaagcggatctggagaacccccacctcccggaaaagaaaatcacccagtggctcgagacgaagggcgtcgaaagactgaagagaatggcgatcagcggggacgactgcgtggtaaaacccatagacgaccggttcgcgaatgccctgctggccctgaacgacatgggcaaagttcgcaaggacatcccccagtggcagccttccaagggctggcacgactggcagcaggtcccgttctgcagccaccacttccacgagctaatcatgaaggacggtcggaagctggtggtcccctgccgcccccaagacgaacttatagggcgggcccgcatctcccagggcgccggctggtctctccgggagaccgcttgcttggggaaggcctacgcgcaaatgtggagtctgatgtacttccaccgccgcgacctccggctggcaagcaacgccatctgctccgccgtgccagtacactgggtgccgacgagccgcaccacttggtccatccacgcccaccaccagtggatgaccaccgaggatatgctgactgtgtggaaccgagtgtggatcgaggataacccctggatggaggacaaaacgcccgtcaccacctgggagaatgtgccatacctcgggaagcgcgaggaccagtggtgcgggagcctgatcggcctgacttcccgggcgacgtgggcgcagaacatcccgaccgccatccagcaggtccgcagcctcataggaaacgaggagttcctggactacatgcccagcatgaagcggttccgcaaggaggaggagagcgagggcgcaatctggtga

SEQ ID NO: 25721 - RNA, 9873 nt, synthetic construct
  misc_feature 1..9873: note = derived and/or modified CDS sequence (opt11) from DENV-3__GU131953__SS-prME
  source 1..9873: mol_type = other RNA
acgtcgctttgtttgatgatgatactcccagcggccttagccttccacctaacaagccgggacggggaaccacggatgatagtagggaaaaatgaacgcggtaaatctctgctattcaaaacggcaagcggcatcaatatgtgtacactgatagcaatggacctgggagaaatgtgcgacgacaccgtcacatacaagtgtccgcatataactgaagtggagccggaagacatagattgctggtgtaacctgacaagcacctgggttacctacgggacctgcaaccaagctggcgagcaccggcgggacaaacgatccgtagccttagctccgcacgtaggaatgggtttagacacccgcacccaaacatggatgagcgcagaaggcgcttggagacaagtggaaaaggtagagacatgggcactcagacacccaggcttcacgatcttagccctgttcttggcccactatatcgggactagtctaacacagaaggctgttatcttcatcctcctcatgcttgtaacaccgtccatgaccatgagatgcgtcggagtcggaaaccgcgattttgtcgaagggctgtcaggcgccacctgggtagatgtggtcctagaacacggcggctgcgtaacgacaatggcaaagaacaagccgacactcgatatcgagctacagaagactgaggctacgcagctagcaacgctccgcaagctctgtatagagggcaaaatcacgaacatcacgacagactctcgatgcccgacccaaggcgaagcagtcttgcccgaggaacaagatcaaaactacgtgtgcaaacacacctatgtcgacagaggttggggaaacgggtgtggtctcttcggcaaaggatcactcgtgacatgcgctaaatttcagtgcctcgaaccgatcgaaggaaaagtagtccagtatgaaaatctaaaatacaccgtaatcattaccgtccacacaggagatcaacatcaagttggcaatgagacccaaggcgtcactgcggaaatcacaccccaggcaagtactaccgaagctatactcccagagtatggcacactaggcctagaatgctctccacgtacaggcctggacttcaacgagatgatactattgaccatgaaaaataaggcatggatggtccaccgacaatggttcttcgatctaccgttaccctggacctctggcgccaccaccgaaacgcccacctggaacaggaaggaactactagtcacatttaagaacgcgcacgccaaaaaacaggaggttgtcgttttaggcagccaagagggcgcgatgcataccgcgctcactggtgccacagaaatccagaattcgggtgggaccagtatattcgccggccacctgaaatgccgcctcaaaatggataagctcgagttgaaaggaatgagctacgcaatgtgtaccaacacctttgtactcaagaaggaagtcagcgagacacaacacggcacaatcctaattaaagtcgaatataaaggcgaggacgtaccctgcaagatcccattcagtacggaagatgggcagggcaaggctcacaacgggaggctcatcacggctaaccccgtcgtaacgaaaaaagaagaacccgtcaacatagaagccgaaccaccattcggcgaatccaacattgtgatcgggatcggcgataacgccctaaaaatcaactggtacaaaaaaggaagttcaatagggaaaatgttcgaagccacagccaggggcgcgcgtcggatggcgatactaggagacacggcctgggacttcggaagcgtcggcggcgtcctgaacagtctaggcaaaatggtccaccagatattcgggtccgcgtataccgcactatttagcggcgtgtcatgggttatgaagatcggaataggagtattgctgacctggataggactgaactccaaaaatacttccatgtcattcagttgtatcgccatcggtatcataaccttatacctcggcgcggtagtccaagctgatatgggctgtgtgatcaactggaagggcaaggaattaaaatgcgggagtggaatcttcgtaaccaacgaagtccatacctggaccgaacaatacaaattccaagcggattcacctaagcgactagcgacagcaatcgccggtgcctgggagaacggggtctgcgggatacgcagtacgacccgtatggaaaacttactctggaaacaaatagcaaacgaactaaactacatcctctgggaaaacaacataaaactgactgtagtcgtcggcgacataataggggtgcttgaacagggaaagcgcactctaaccccacaaccaatggaactaaaatactcctggaaaacctggggcaaagcgaagatcgtcaccgccgaaacacagaacagcagcttcataattgacgggcccaacacgccagaatgtcccagcgcctcaagagcctggaacgtatgggaagttgaggactacggcttcggcgtattcaccacaaacatctggctaaaattgagagaagtctacacgcaactctgcgaccacaggctcatgtctgccgccgtcaaagacgagcgcgcagtgcacgcggatatgggatattggatagagtcacaaaaaaacggttcatggaaattagagaaagcgtccctcatagaagtcaaaacgtgcacctggccgaaaagccacacgttatggtccaacgcagtactagaatctgacatgattatccccaagagccttgccgggccaatttcacaacataactaccgccctggataccacacccaaaccgccggcccatggcaccttggcaaactcgagctcgacttcaactactgcgagggcacaactgtggttattacagaaaactgtggcactcgcggaccaagtctcagaacaaccactgtgagtggaaaactgatccatgaatggtgctgccgctcatgcacactgcctccattacggtatatgggagaggatggttgctggtatggaatggaaatacgaccaatatccgaaaaggaggaaaatatggtgaaatccctggtatcggcaggatcgggtgaagtggacaacttcacgatgggagtactctgcttagctatactgttcgaagaggtgatgagaggcaaattcggcaaaaaacacatgatcgcaggggtattcttcactttcgtactcctgctctcgggccagataacctggagggatatggcgcacaccctcattatgatcggatcaaacgcctcagatcgcatgggaatgggcgtcacatatcttgcactaatcgcgaccttcaaaattcagcccttcctcgccctaggtttcttcctgcgcaagctcacaagccgcgagaatttactactcggcgtgggcctagccatggccaccaccctccaacttccggaagatatcgagcaaatggccaacggcattgccctcggattaatggcactcaagttaatcacccaattcgaaacctatcaactatggacagcgctaatcagcttaacatgttcaaacacaatcttcacgctaacagtggcctggaggactgccacgctgatccttgccggcgtatccctactgccagtatgccaatcaagttccatgagaaaaaccgactggcttcccatgacagtcgcagcaatgggcgtcccgcctcttcccttgtttatcttttccctaaaagataccctaaaacgccgcagctggccccttaatgaaggcgtaatggcagtcggtttggtatccattctggccagctcgctgctaagaaacgacgtgccgatggcaggaccccttgtcgcaggagggctattgatagcgtgctacgtgattaccggaaccagtgcggacctgacggttgagaaagcagcagacgtgacatgggaggaggaagcggagcagactggagtgagccataacctgatgataacagtcgatgatgacgggaccatgcgcataaaagacgacgagactgaaaacatcctaacggtacttttgaagaccgcactcctcatcgtatcgggcatatttccgtatagcataccagcgacactactagtatggcacacctggcaaaaacagactcaacgctccggagtgttgtgggacgtaccatcccctccagagacccaaaaggcagaactcgaagaaggggtatatagaataaaacaacagggcatattcgggaagacgcaagtgggagtgggcgtgcaaaaggaaggggtctttcacacgatgtggcatgtaacccggggggcagtactgacatataacgggaaacgcctagaaccaaactgggcatcggttaagaaggacctgatttcctacggaggtggatggcgactatccgcccagtggcagaagggggaagaagtgcaggttattgcggtcgaaccagggaaaaaccccaagaacttccaaaccatgcccggcacctttcagacgacaacgggagagattggcgcgattgcccttgacttcaaaccaggcacctcaggctctcccatcataaaccgggaaggcaaagtcgttggactatacggaaacggcgtagtcaccaaaaatggcggatacgtatccgggatcgcccaaaccaatgcggagccggacggaccgacacccgaactcgaagaagagatgttcaaaaaacgcaacctcacgatcatggacctgcatccaggctccggcaaaacaagaaagtacctcccagcaattgtcagagaagccataaaacgaaggctacgaaccttgatcctcgcaccaacaagagtagtagcggcagaaatggaagaggccctgaaaggcctcccaatccgataccaaaccacggcaaccaaaagtgaacacactggccgcgaaatagtagacctcatgtgccacgcaacgttcaccatgcggctcctaagcccagtcagagtgcctaattataacctaattatcatggacgaagcacacttcaccgatccagcatcaatcgcagcaaggggctacatatctacccgggtagggatgggtgaagccgcggcgatcttcatgacagccaccccccccgggactgccgacgcgttcccacaatctaatgctcccatccaggacgaggagcgggacatcccagagcgcagctggaacagcggaaacgaatggatcaccgactttgcgggaaaaaccgtgtggttcgtccctagcataaaagctggcaacgacatagccaattgcttacgaaaaaacggaaaaaaagtcattcaactttcgcgaaagaccttcgacactgaataccagaaaacgaaacttaacgattgggatttcgtcgtgaccacagatatatcagaaatgggagccaacttcaaagcggaccgggtgattgacccacggagatgccttaagccggtcatactaaccgacgggccagagagagtaatcctggccggccctatgcccgtaaccgcggcttcagctgcacagcgccgcgggcgagtaggccgaaacccgcagaaagagaacgaccagtacattttcacggggcagcccctgaacaacgacgaagaccacgcccactggaccgaagcgaaaatgcttctcgataatataaacaccccagagggaataataccagccctcttcgaacccgaaagagaaaagagtgccgccatagacggcgaataccgactaaagggcgagtccagaaaaacgtttgtcgagctaatgagaaggggagatttaccggtctggctggcgcacaaggtggcctcagaaggcatcaagtacacagaccgtaagtggtgcttcgacgggcaacgcaataaccaaatcctggaagaaaacatggatgtcgagatctggactaaagaaggagaaaaaaagaaactgcgcccacgctggttggacgcgcgcacttactctgacccactagccctgaaagagttcaaggacttcgccgccggtagaaaaagtatagcattggatttggttacagaaataggaagggtaccaacacacttggctcatcgcacccgcaatgcgcttgacaatttagtgatgctgcacacgtccgaacacggaggtaaggcgtatcggcacgcagtcgaggagttacctgagacgatggagactctactactactcggtctaatgatactgttgactggcggggccatgctcttcctaatctccggaaagggaataggcaaaaccagtatcgggttaatatgcgtaatcgcatcatcaggaatgctctggatggcggaaatccccttgcaatggatcgcatcagcgatagtgctcgagttttttatgatggttttacttatcccggaaccggaaaagcaaagaacaccacaagataaccaactagcgtacgtcgttataggaatcctgacacttgccgccataatagccgccaatgaaatgggcttactggaaacaaccaaacgagacctaggcatgtccaaagagccaggcgtggtctcccccacaagctacctggatgtcgacctgcatccagcctccgcatggaccctttacgcagttgcgacaacggtaattacaccaatgctcagacacacgatcgaaaacagcacagcaaatgtgtccttagccgctattgccaaccaggcagtcgtactcatggggttagacaagggatggccgatctccaaaatggacctgggcgtgcctctcttggcactaggttgctatagccaagtcaacccgttgacactcaccgctgctgtgctgctcttaataacacattacgcgataataggacctggcctccaggctaaggcgacccgggaagcccagaaacgcacggccgcaggaatcatgaagaaccccacagttgacgggatcatgaccatagacctcgacccagtcatctacgacagcaaatttgaaaaacaactgggccaagttatgctcctagtattatgcgctgtccaactattattaatgcgcactagctgggcgctgtgcgaagctctgaccttggccaccggaccgatcacaaccctatgggagggaagccctggaaagttttggaacaccacaatagccgtcagcatggcaaacatattccgaggtagctacttagccggagcgggattggccttctccatcatgaaatcagttggtacgggaaagcgagggaccggctcacaaggcgaaacgctaggcgaaaagtggaaaaagaaactcaaccagctatcgaggaaagaattcgatttatacaaaaaatcaggaatcaccgaagtcgaccgcacagaagcgaaagaaggcctcaaaagaggcgagataacacaccatgctgtctcgcgggggtcggcaaagctccaatggttcgttgaacggaacatggtcattccggaggggagagtgatagacctcggatgtggccgaggcggctggagctattactgcgccggcctcaaaaaagtcaccgaagtgagagggtacacaaaaggcgggcctggacacgaagaaccagtccccatgagcacctatggttggaacatagtaaagcttatgtccgggaaagacgtcttctacttaccaccagaaaagtgtgacaccctactgtgtgatatcggcgaatcctcgccgagcccaacggtggaggaatcccgaaccatccgagtcctaaagatggtggagccttggttgaaaaacaaccagttctgcatcaaagtactgaatccctacatgccgactgtgatagaacatctagaacgactacagagaaagcacggtggtatgttagtacgaaatcccctttcccgtaacagtacccatgagatgtactggatctccaacggcaccggaaatatcgtagcaagcgttaacatggtaagcagattgctacttaacagattcacgatgactcacaggcgcccaaccatcgagaaggacgtcgatttgggcgccggtacccggcacgtaaacgccgaacccgaaacgccaaatatggacgtaattggcgagcggatcaaaagaatcaaagaggaacacaactccacctggcactatgacgacgaaaatccgtacaaaacttgggcctaccacggctcctacgaagtgaaagccactgggtcagccagcagcatgatcaacggagtagtgaagttattgaccaaaccctgggatgtcgtaccgatggtcacgcaaatggcgatgacagacaccacacccttcggacaacaaagagtattcaaagagaaagttgacacccgaacaccacgcagtatgccgggtacgagaagagtgatggaaataacagctgagtggctgtggcgtacactcggccgaaacaaaaagccgcgactatgcaccagagaagagttcacaaaaaaagtgagaactaatgcagcgatgggagcagtgttcacggaagaaaaccagtgggacagcgccaaggccgcagttgaagacgaagacttctggaagctagtggatcgagaaagagagctccataaactgggaaaatgcggctcatgcgtatacaacatgatgggtaagcgggaaaaaaaactcggggaattcgggaaagctaaaggtagcagagcgatctggtacatgtggcttggagcacggtacctagaatttgaagcgttggggtttttgaatgaagaccattggttcagtcgagagaactcttacagcggggtcgagggggaaggccttcataagctcgggtacatattgagggacatctccaagatccccggaggggccatgtacgcagacgacacagcggggtgggacacccgaatcaccgaagacgaccttcacaacgaagagaagatcacgcagcaaatggaccccgagcacagacttctggcaaacgcgatattcaaactcacgtaccaaaacaaagtggtgaaagttcaacgccccacccccaccggaacagtaatggacataataagccggaaagaccagagagggtccggacaggtagggacatatggattgaacacattcacgaacatggaagcccaattgatacgccaaatggagggtgaaggtgtgctttccaaagcagacctagagaacccccacctatccgagaagaaggtaacacaatggctagagaccaaaggcgtagaacgattaaagcggatggcgatctcgggggacgactgtgtcgtcaaaccaatcgacgaccgattcgctaatgcccttcttgccctgaacgacatgggaaaagttaggaaggacatcccccaatggcaaccgagcaaaggctggcacgactggcaacaggtgcccttctgcagtcatcatttccacgagctcatcatgaaagacggtagaaaactcgtagtcccatgcaggccccaggacgagctaattggccgtgcacgcatctcacagggggcaggatggtccctcagagagacagcttgcctcggaaaggcctacgcccaaatgtggtcactaatgtactttcaccgccgcgatctacgactagcgtcaaacgcaatatgctcggcagtcccagtccactgggtaccgacatcaagaactacatggagtatccacgcgcaccaccagtggatgaccacagaagacatgctaaccgtatggaaccgcgtgtggatagaggataatccttggatggaggataaaacaccggtcaccacatgggagaacgtcccgtacctgggaaaacgagaagaccaatggtgcgggagcctcatcgggttaacctcccgcgcaacctgggcacaaaacataccaactgcgatccaacaggtcagatcgcttataggtaatgaggagttcttagactatatgcctagcatgaagcgcttcagaaaggaggaagaatctgaaggagcgatatggtag

SEQ ID NO: 25722 - RNA, 9873 nt, synthetic construct
  misc_feature 1..9873: note = derived and/or modified CDS sequence (opt11) from DENV-3__GQ868577__SS-prME
  source 1..9873: mol_type = other RNA
acctctctgtgcctcatgatgatcctgcctgccgccctggcgtttcatctcacctccagggacggggagccccggatgatcgtggggaagaacgagcggggcaagagcctgctgttcaagaccgccagcgggatcaacatgtgcaccctcatcgccatggatctaggggagatgtgcgacgataccgtgacctacaaatgcccgcacataaccgaggtggagcccgaggacatcgactgctggtgcaatctgacttccacctgggtgacctacgggacgtgcaaccaggccggcgagcaccggcgcgacaagcggagcgtcgctctcgcgccccacgtgggcatggggctggacacgcgcacgcaaacctggatgagcgccgaaggcgcatggcgccaggtggagaaagtcgagacgtgggccttacgtcacccgggattcaccatcctggcgctgttcctggcccactacataggcacctccctcacccagaaggtggtgatcttcatcctgttaatgctcgtcactccgagcatgacgatgaggtgcgtgggcgtgggtaacagggacttcgtcgagggcctttccggggcaacctgggtggatgtggtcctggagcacggcgggtgcgtcaccacaatggccaaaaacaagcccactctcgacattgagctgcagaagaccgaggccactcaactggctacgctccggaagttgtgcatagagggcaagatcaccaacatcaccaccgactcgcgctgccccacgcagggcgaagccgtactgccggaggagcaagaccaaaactacgtctgcaagcacacatatgtggaccggggctgggggaacggatgcggcctattcgggaagggctctctggtaacgtgtgccaagtttcagtgccttgagcccatcgagggcaaggtcgtgcagtacgaaaatctcaagtacaccgtgatcatcacggttcacaccggggaccagcaccaagtaggcaacgagacgcaaggggtcaccgctgagatcacgccccaggcctccacgaccgaggcgatcctgcccgaatacggcacgctcgggctcgagtgctctccgcgaacagggctggacttcaatgaaatgatcctgctcacgatgaagaacaaggcctggatggtgcaccggcagtggttcttcgatttaccactgccctggacgagcggggctacgaccgaaacgccgacatggaaccgcaaggaactcctggtgacattcaagaacgcccacgccaagaagcaggaggtcgtagtgctggggtcccaggagggggcgatgcacaccgccctcacgggggcgaccgagatacagaacagcggcgggacctccatcttcgccgggcacctaaagtgccggctgaagatggacaagctcgagctgaagggtatgagctacgccatgtgcaccaacacgttcgtcctgaaaaaggaggtgtccgagacgcagcacgggaccattctaatcaaagtggagtacaagggcgaggacgtcccatgcaaaatcccattctctactgaggacggccagggaaaagcacacaacggtcgcctgataacggccaaccccgtggtgaccaagaaggaggagcccgtaaacatcgaggccgagccgcccttcggggagagcaacatcgtgattgggatcggagacaacgctctgaagatcaactggtacaagaaaggctcgagcatcgggaaaatgtttgaagcgaccgccagaggcgcccgccggatggccatcctgggcgacaccgcctgggacttcgggtcagtcggcggggtcctaaatagcctagggaagatggtgcatcagatcttcggttccgcctatacggccctgtttagcggcgtgtcatgggtcatgaaaatcggcatcggggtgctccttacttggatcggcctgaactcaaagaatacgtccatgagcttctcgtgcatcgccatcggcatcatcacactctacctgggcgccgtggttcaggccgacatggggtgcgtgatcaactggaagggcaaggaactcaagtgcggcagcgggatcttcgtgacgaacgaggtccatacatggacagagcagtataagttccaggcggactcccccaagcgcctcgccaccgccattgctggcgcctgggagaacggagtgtgcggcatccgctctacgacccggatggagaatctgctctggaagcagatagcaaatgagctcaactatatcctgtgggagaacaacataaagctgaccgtggtcgtgggggacatcataggcgtgctagagcaaggtaagcgcaccttgacgccccagccaatggagctgaagtactcatggaagacctgggggaaagccaagatagtcacggccgaaacccaaaatagctcctttataatcgacggcccaaacacgccggagtgtcccagcgcctcgcgggcgtggaacgtgtgggaggtggaggactatgggttcggggtattcaccacaaacatctggctcaagctgcgcgaagtgtacacccagctgtgcgaccatagactcatgtccgcagccgtaaaagatgagcgtgctgtccacgccgacatgggatactggatcgagagtcagaaaaacgggtcctggaagctggagaaggccagccttatcgaagtgaagacctgcacgtggccgaagtcgcacaccctttggagtaacggcgtgctggagtcggacatgatcatccccaagtcccttgccggccccatctcccagcacaactaccggccggggtaccacacccagaccgccgggccctggcacctcggcaagttggagctggacttcaactattgcgaaggcacaacagtcgtgatcactgagaactgcgggacccgcggcccctctctccggacgaccaccgtgtccgggaagctgatccatgagtggtgttgccgctcctgtaccttacccccgctcagatacatgggcgaggacgggtgctggtatggcatggagatccgccccatctccgagaaggaggagaacatggttaagtcactggtgtccgccggatcaggtgaggtggacaacttcacgatgggcgtcctgtgcctcgcaattctgtttgaggaggtgatgcgggggaagttcggcaagaagcacatgatcgcaggggttttctttaccttcgtcctgctcctgtccggccaaatcacctggcgagacatggcccacacattgatcatgatcggcagcaatgcttccgataggatgggtatgggtgtcacgtacttagccctgatcgccacctttaaaatccagcccttcctggcgctcgggttcttccttcgcaagctgacctcgcgggagaacctcctgttaggcgttggccttgccatggccacaacgcttcaactgcctgaggacatcgaacagatggcaaacgggatcgcgctcggcctgatggcactgaagctcatcacccagtttgagacttaccagctgtggaccgccttaataagcctcacctgctccaacaccatattcacgctgacggtcgcctggagaacggcaaccctgattctcgcgggggtgtcgctgttgccggtttgccagtcctcctccatgcggaagaccgactggctgccgatgaccgtggcggccatgggcgttccccccctgccgctgtttatctttagcctgaaagacacgctgaaacgccgatcctggcccttgaacgagggggtcatggccgtgggcctcgtgagcatcctggcttcgagcctgctccggaacgacgtccccatggcgggccccctggtggccgggggcctgctcattgcatgctatgtaatcacagggacatccgcagacctgactgtcgagaaggccgcggacgtgacatgggaggaggaggctgaacagaccggcgtctcccacaacctgatgatcaccgtagatgacgacgggaccatgcgcatcaaggacgacgaaaccgagaacatcctcacggtgctgctgaagaccgccctcctgatcgtgtccggcatattcccctacagcatccccgcaactctgctcgtatggcacacatggcagaaacagacccagcggtcgggggtgctgtgggacgtgcccagcccgcccgagacccagaaggccgagctggaggagggggtataccgaatcaaacagcagggaatcttcggaaagacccaggtgggcgtgggggtccagaaggaaggtgtgttccacaccatgtggcatgtgacgcggggcgcggtccttacctacaacgggaagcgcctggagccgaactgggcatccgtgaaaaaagatttaatcagctacggtgggggctggcggctgtccgcccaatggcagaagggagaggaagtgcaggtcatcgcggtggagcccggtaagaaccccaagaacttccagacaatgcctgggaccttccaaacgaccaccggggagatcggcgcaatcgccctggacttcaagcccggcacgagcggttcacccatcatcaaccgggagggcaaaatcgtggggttgtacggtaatggggtcgtgacgaagaacggcgggtacgtatccggcattgcccagaccaacgccgagcctgacggccctacccccgagctggaggaggagatgttcaagaagcggaacctcaccatcatggacttgcaccccggtagcggcaaaaccaggaagtacctgcctgccatcgtccgggaggcaatcaagcgccggctccgcaccctgatcctggcccccacccgtgtggttgccgctgaaatggaagaagccctgaaggggctgcccatccgttaccagaccacggcgaccaagtccgagcacaccggccgggagatcgtcgaccttatgtgccacgccacgttcactatgcgcctcctaagccccgtgcgggtgccgaactacaacttgatcattatggacgaagcccacttcaccgaccctgcctccatcgccgctcgcgggtacatcagcacccgggtcggaatgggcgaggccgctgcgatcttcatgaccgcgacgccgccgggaaccgccgatgccttcccgcaatccaacgccccaatccaggatgaggagcgcgacatccccgagcgcagctggaactccggcaacgagtggattaccgatttcgccgggaagaccgtgtggttcgtgccgagcatcaaagcgggtaacgacatagccaactgtctccggaagaacgggaagaaggttatccagctctccagaaagacgttcgacacggagtaccaaaagaccaagcttaacgattgggacttcgtggtcaccacggacatatctgaaatgggcgccaacttcaaggctgaccgggtgatcgacccgcgccgctgtctcaagccagtgatcttaacagacggcccggaacgcgtgatccttgccggtcccatgccggtcaccgctgcctccgccgctcagcggcgcggacgggtggggcggaacccccagaaggagaatgaccagtacatcttcaccggccagcccctcaacaatgacgaagaccacgctcactggaccgaggcgaagatgctgttggacaacatcaacacacccgaggggataatcccggccctcttcgaacccgaacgggagaagtcagctgccatcgacggcgagtaccgcttgaagggggagagcagaaagacctttgtggagctaatgcgccgcggggacctacccgtgtggctggcgtacaaggttgcctctgaggggatcaagtacaccgaccgcaagtggtgcttcgacgggcagcggaataaccagatactggaggagaacatggatgttgagatctggacgaaggagggcgagaagaaaaaactccgcccacgttggctggacgcccgcacctattccgaccccttagctttaaaggagttcaaggacttcgcagcaggccgcaaaagtattgccctggaccttgtgaccgagatcgggcgggtgccgacgcacctcgcccatcgcacacggaacgcacttgacaacctggtcatgctccacacgtccgagcacggcgggaaagcctatcgtcatgcggtcgaggaactgcccgagaccatggaaaccctgctcttactgggccttatgatccttcttacggggggcgccatgctgttcctgatttccggtaaagggatcggcaagacgagcatcgggctaatctgcgtgattgcctccagcggcatgctgtggatggccgagatcccgctgcagtggatcgcctccgcgatcgtcctggagttcttcatgatggtgctcctgatcccagagcctgagaagcaacggacgccgcaggacaaccagctggcctacgtggttatcggtatcctcaccctggccgccatcatcgcggccaacgagatgggcctgctcgagaccacgaaacgcgaccttggaatgagcaaagagccgggcgtggtgtcccccacgtcttacttagacgtcgacttgcaccccgcctcagcctggactttgtacgccgtggcgaccacggtgatcaccccgatgctgcggcacaccatcgagaacagcactgcgaacgtctcgcttgccgcaatcgctaaccaggctgtagttcttatgggattagataaggggtggccgatcagcaagatggaccttggcgtccccctgctggccctcggatgctactcccaggtaaaccccctgaccctgaccgccgcggtgctcctgttgatcacacactacgccatcattggccccggtctccaggcgaaggccacccgagaggcgcagaagaggacggccgccgggatcatgaagaaccctaccgttgacggtattatgaccatagatctggaccccgtgatctacgactctaagttcgagaagcagttggggcaagtcatgctcctggtcttatgcgcggtgcagctcctgctgatgcgcacgagctgggcgctctgcgaggccctgacgctggccaccggccccatcaccaccctctgggagggcagcccagggaagttctggaacactaccatcgcggtttctatggccaacatcttccggggctcctacctggccggggccggcttagctttttccatcatgaagtcggtcgggacgggcaagcgcggcacggggagtcaaggcgaaaccctcggggagaagtggaagaagaagctgaatcaactgtctcgtaaggagttcgacctctacaagaagtccggaatcaccgaagtcgatcgcactgaggccaaagaggggttaaagcggggcgagatcacccaccacgccgtgtcccgcggaagcgcaaagctccagtggttcgtcgagcgaaatatggtgattcctgagggccgcgtgatcgacctcggttgcgggcggggcggttggtcctattattgcgctggcctgaagaaggtaacggaggtgcgcggctacacgaagggcgggcccggccacgaagagcccgtgcccatgagcacctatggctggaacattgtcaagctgatgtccgggaaggatgtgttctacttgccacccgagaagtgcgacaccttactgtgcgacattggcgagagctcgcctagccccaccgtggaagagagtaggactattagagtcctaaaaatggtggaaccgtggctcaagaacaaccagttctgcatcaaggtgctgaacccctacatgcccaccgtcatcgagcacctggagcgcctccagagaaagcatggagggatgctagtgcgcaaccccctgagccggaactccacccacgagatgtattggatcagcaacggcaccgggaacatcgtggcttccgtcaatatggtgagccggctactgctgaaccggttcactatgactcaccgccggccgaccatcgagaaggacgtggacctcggcgcgggcaccaggcacgtcaacgccgagcccgagacgcccaacatggacgtgataggggagcgcataaagagaatcaaagaggagcacaactccacctggcactacgacgacgagaatccgtacaaaacctgggcctaccacggaagctacgaggtgaaggccaccgggtctgccagctccatgataaacggcgtcgtgaagctgctgacgaagccctgggacgtcgtgcccatggtgacccagatggctatgactgacaccactcccttcgggcagcaacgggtcttcaaggagaaggtggacacgcgcactccacggtccatgccaggcacacgccgggtgatgggcatcactgcagagtggctctggcgcacacttgggcgaaataagaagccccgcctgtgtaccagggaggagttcacaaaaaaagtccgcactaacgctgccatgggcgcggtgttcactgaggagaaccagtgggacagcgccaaggccgctgtagaggacgaggacttctggaagcttgtggaccgtgagcgagagttgcacaagctgggtaagtgcggctcctgcgtttacaacatgatggggaagcgcgagaagaagctcggcgagttcggaaaggccaaggggtctcgggcgatctggtacatgtggctgggggcaaggtatttggagtttgaggccttggggttcctgaacgaagatcactggttctcccgggagaacagctactccggggtagagggggagggcttacacaagcttggttacatccttcgcgacatcagcaagatcccgggaggggctatgtacgccgacgacaccgcggggtgggacacccggatcacggaggatgacctgcacaacgaggagaagatcacacagcagatggaccccgagcaccgccaactcgcaaacgcaatcttcaagctgacgtaccagaacaaggtcgtgaaggtgcagcgtccaacgcccaccggaacagtcatggacattatctcccgtaaggaccagcggggctcaggccaggtggggacctacggattgaacacttttaccaacatggaggcccagctcatccgccagatggagggcgaaggtgtgctgagtaaggccgacctggagaacccacatttaccggagaagaagatagcacaatggctagagaccaagggcgtcgagcggcttaagcgcatggccatcagcggcgatgactgcgttgtcaagcccatcgacgaccgattcgccaacgccctcctggcccttaacgacatggggaaggtccgaaaggatattccccagtggcagccctccaaaggctggcacgactggcagcaagtcccgttctgctcccaccacttccacgagctcatcatgaaggacggacggaaactggtggtcccctgccgcccacaagacgagctgataggcagggcgcgcatctcccagggggccggctggagcctccgggaaaccgcctgcctaggcaaggcctatgcgcagatgtggtctctaatgtacttccataggcgcgacctcaggctcgccagcaacgccatatgttctgcggtgcccgtgcactgggtcccgaccagccgcactacctggtcgatccatgcccatcatcaatggatgaccaccgaggacatgctgacggtgtggaaccgggtgtggatcgaggacaacccctggatggaaaacaagactcccgtcaccacatgggagaacgtgccctacctgggaaaaagagaggaccagtggtgcggcagcctgatcgggctgaccagccgggcgacgtgggcccaaaatatccccaccgccatacaacaggtccgctcattgatcgggaacgaggagttcttagactatatgccgagcatgaagcggttccgcaaggaagaagagtctgagggggccatctggtag

SEQ ID NO: 25723 - RNA, 9873 nt, synthetic construct
  misc_feature 1..9873: note = derived and/or modified CDS sequence (opt11) from DENV-3__GU131954__SS-prME
  source 1..9873: mol_type = other RNA
accagcctgtgtcttatgatgattctgcccgccgctctggcattccacctaaccagtcgggacggggaacctaggatgatcgttgggaagaacgaacggggcaagagcctgctgttcaaaaccgcaagcgggatcaacatgtgtaccctcatcgccatggaccttggcgagatgtgcgacgacaccgttacatataaatgcccccacatcacggaggtggagcccgaagacatcgattgctggtgtaacctgacctccacgtgggtgacctacgggacgtgcaaccaagccggcgagcatagacgcgacaagcggtccgtagcgcttgctccccacgtgggcatggggctggacacccgcacacagacctggatgtcagccgaaggcgcctggcgccaggtggagaaggtcgaaacatgggccctgcgccaccccggtttcaccatcctcgcattgttcctggcacactacatcggcacatccctcacccagaaagtggtgatcttcatattgctgatgctggtaacgccctctatgacaatgcggtgcgtgggggtgggcaaccgagatttcgttgagggcctgagcggggccacgtgggtggacgtggttcttgagcacgggggctgcgtaaccaccatggccaagaacaaacccaccctcgacatcgagctgcagaagacggaggccacccagctggctacgctccggaagctgtgtatcgagggcaagatcacaaatatcacgaccgacagccgctgccccacgcagggcgaagcagtgctgccggaggagcaggatcagaactacgtctgcaagcatacctacgtggatcgggggtggggcaatgggtgtggcctcttcggcaagggttccctggtgacctgcgccaagtttcagtgcctggagcccatcgagggcaaggtcgtccagtacgagaacctcaagtacaccgtcatcattacggtccacaccggggaccagcaccaggtgggcaacgaaacccagggagtcaccgctgagatcacgccccaagccagcaccacagaagcgatcctgcccgagtacggcaccctggggctcgagtgcagcccgcgaacaggtctggactttaacgagatgatcttactcactatgaaaaacaaggcgtggatggtccaccggcaatggttcttcgacctgccattaccctggacctctggagctacaaccgagacgcccacctggaaccgcaaggagctcctggttacgtttaagaacgcgcacgccaagaagcaggaggtcgtggtactggggtcccaggagggtgcgatgcacacagccttaacgggtgccaccgagatccaaaatagcgggggcacgtccatctttgccggccacctgaagtgtcggttgaagatggacaagctcgagctgaagggcatgagctacgccatgtgcaccaacacgttcgtcctcaagaaggaggtttcggagacacaacacggaactatcttaattaaggtagaatacaagggggaagacgtcccgtgcaagatacccttctcgaccgaggatgggcagggcaaggcgcacaacggccgcctgatcaccgccaatcccgtggtaacaaagaaggaggagcccgtcaacattgaggccgagccgcccttcggggagagcaacattgtgatcggcatcggggacaacgccctgaagataaactggtacaagaaaggcagcagcattggaaagatgtttgaagcgaccgccagaggcgcccgccggatggccatcctgggcgacactgcctgggacttcgggagcgtgggcggggtcctgaactcgctgggcaagatggtgcaccagatcttcgggtccgcatacacggccctgtttagcggcgtgtcttgggtcatgaaaatcggcatcggggtgctgctgacctggatcgggctgaactcgaaaaacacctcgatgagcttctcctgcatcgcaatcgggatcatcacactctacctgggcgccgtagtccaggcagatatgggctgcgtaatcaattggaagggcaaggagttaaagtgtggtagcgggatctttgtgaccaacgaggttcacacctggaccgaacagtacaaattccaggctgactcccccaagcgcctcgccaccgccatcgcgggcgcctgggaaaacggggtgtgtggcatacgcagcacgacccggatggagaacctgctgtggaagcagatcgcgaatgaactcaactacatactgtgggagaacaacatcaagctgaccgtggtcgtcggggatataatcggcgtgctcgaacagggcaagagaactctgacgccacagccgatggaactgaagtactcttggaaaacctgggggaaggcgaaaatcgtcacagccgagactcaaaactcctccttcataatcgatggccccaacaccccagagtgccccagcgcatcccgggcgtggaacgtctgggaggtggaggactatgggttcggtgttttcacaaccaacatctggctcaaactccgcgaggtgtacacccaactttgcgatcatagacttatgtccgcagcagttaaagacgagcgcgccgtccatgccgacatgggctattggatcgagagtcagaaaaacgggtcctggaagctggagaaagcgagtctgattgaggtgaagacctgcacgtggccgaagtcccacaccctctggagcaacggcgtactggaatcggacatgatcatcccgaagtcactggccgggcccatctcccagcacaattaccgtccgggttaccacacccagaccgccggaccctggcacctcggcaagctggagctggacttcaactactgtgagggcacgacagtcgtcattaccgagaactgcgggacccgagggcccagcctccggacgaccaccgtgtccgggaagctaatccacgaatggtgttgccgctcctgcaccctgcccccgctccgctacatgggcgaggacggttgctggtacggaatggaaatccgccccatctccgagaaggaggagaacatggtaaaaagccttgtgtccgccggctcaggtgaggtggacaacttcacgatgggtgttctgtgcctggccatcctgtttgaagaggtgatgcggggcaagttcggcaagaagcacatgatcgcgggggtcttcttcaccttcgtcctgctactgtccggccagattacctggcgcgacatggcccacaccctcatcatgatcggcagtaacgcctcagaccgtatgggaatgggcgtgacgtacctcgccctgatcgccaccttcaaaatccagcccttcctggcgctcgggttcttcctgcgtaagctgacctcccgggagaacctactgctgggcgtaggtctcgccatggccaccactcttcagctgccagaggacatcgagcagatggcaaacgggatcgcgttgggcctgatggccctgaagctcatcacccaatttgaaacctaccagttatggactgccctcattagcctcacttgttccaacaccatcttcactttgaccgtcgcctggagaacggccaccctgatccttgcgggggtgagcttactgcctgtctgccagtcaagctccatgcgcaagaccgactggctccccatgaccgtagcggccatgggcgtcccgcccctccccctgttcattttctcgctaaaggacacactgaaacggcgctcttggcccctgaacgagggggtgatggcagtgggtctcgtgagcatcctcgcctccagcctgctccggaacgacgtccccatggcgggtccccttgtagccggaggccttctcatcgcctgctacgtgatcacggggacctcggctgacctgaccgtcgaaaaggctgcggatgtgacgtgggaggaagaagccgaacaaactggcgtgtcccacaacctgatgataaccgttgacgacgacgggaccatgcgcatcaaggacgacgagaccgagaatatcctcactgtactgctcaaaaccgccctccttattgtatccggcatattcccgtactccatcccagccactctgctcgtgtggcacacctggcagaagcaaacgcagcggagtggcgtgttatgggatgtgccatccccgcccgaaacccagaaggccgaactggaggaaggagtataccgaatcaagcagcaggggatcttcggaaagacccaagttggcgtgggggtccagaaggaaggcgtgttccacaccatgtggcacgtcacgcgcggcgcggtcctcacttacaacgggaaacgtctggagccgaactgggcctcggtgaagaaggacctgatcagctacggtgggggctggcggctctccgcacagtggcagaagggggaagaggtgcaggtcatcgcagttgagcccggcaagaatcctaaaaacttccaaactatgccagggacctttcagacgaccactggagaaatcggcgctatcgccctggacttcaagccgggcaccagcggcagtcccatcataaaccgcgagggcaaggtcgtcggcctgtacggcaacggggtggtgacgaagaacggtgggtacgtcagcggcatcgcccagaccaacgctgagccggacggccccacacccgagttggaggaagagatgttcaagaagcggaacctcacaatcatggacctgcacccgggtagcgggaagacgcgcaagtaccttcccgccattgtgcgggaggcgattaagcgccggttgcgcacactgatccttgccccgacgagagtagtcgccgcggaaatggaggaggccctcaaggggctgcccatccgctaccagactacggccacaaagtccgagcacaccggccgggagatcgtggacctgatgtgccacgcgaccttcacgatgcgcttgctgagccccgtgcgggtgcccaactacaacctcataataatggacgaagcacacttcacggaccccgcctccatagcggctcgcggatacatcagcacacgggtaggcatgggcgaggccgccgccattttcatgacggcgacgccacccgggacagccgacgccttcccgcagagtaacgcaccgatccaagacgaggagcgcgacattcctgaacgttcgtggaactccggcaacgagtggatcacagacttcgcgggcaaaacagtgtggttcgtccccagcataaaggcgggcaacgacatcgcgaactgcctccggaagaacgggaaaaaggtgatacagctttcccgcaagaccttcgacactgaataccagaagaccaagctgaacgactgggacttcgtggttacgactgatatcagcgagatgggcgctaacttcaaggccgaccgggtgatcgatccgagacggtgtctcaagcccgtgatcttgaccgacggcccagagcgcgtcattctggccgggcccatgccggtgaccgcggccagcgccgcccagcggcgaggccgggtggggcgcaacccccagaaggaaaacgatcaatacatcttcacgggccaacctctcaacaacgatgaggaccacgcccactggaccgaggcgaagatgctcttggacaatatcaatacccccgaggggatcatcccggccctcttcgagcccgagcgggagaagtcggccgccattgacggcgagtatcgcctgaaaggcgagtcccggaagaccttcgtggagctgatgcgccgcggcgacctcccggtttggctcgcgtacaaagtcgccagcgagggcatcaaatacaccgaccgcaagtggtgtttcgacgggcagcgtaacaaccagatcctggaggagaatatggacgtggagatctggaccaaggagggcgagaaaaaaaaacttcgcccccggtggctggatgcccgcacgtactccgacccactggccctcaaggagtttaaggatttcgctgcgggccggaagagcatcgcccttgatctggtgaccgagatcgggcgggtccccacccacctcgcccaccgtacccggaacgcgctggataatctggtaatgctccacacgtccgagcacggcgggaaggcttaccgccacgcggtggaggagctgcccgagaccatggaaaccctactcctgctgggactcatgattctgctcaccgggggcgtaatgctcttcctgattagcggaaaggggatcggcaagacgagcattggcctgatctgcgtcatcgcctcgagcggcatgctctggatggccgagatcccgctccagtggatcgcctctgccatcgtgctcgagttctttatgatggtcctgctgatccccgagcccgagaagcagcgaacaccccaggataaccagctggcgtacgtggtgatcgggatcctcaccctcgccgccataatagccgccaacgaaatgggcctgctggagaccacgaagcgcgaccttggaatgaccaaagagccgggggcggtctcacccacgtcctacctggacgtggacttgcaccccgccagcgcctggactctgtatgccgtcgcgacgactgtcataacgcccatgctgcggcatacaatcgaaaactccacggctaacgttagtctcgcagccatagccaaccaggcggtggtcctgatgggactggacaaggggtggcctatctccaagatggacctcggggtgcccctgctggccctcgggtgctacagccaggtgaaccccctgactctgaccgccgccgtcttgctactgattacccactacgccatcatcggccccggcctccaagcgaaggcgacgcgcgaggcgcaaaagcggaccgccgcagggataatgaagaatccgaccgtggacggcataatgacaatagatctcgatcccgtgatatacgactccaagttcgagaagcagctcgggcaagttatgctactggtgctgtgcgctgtgcaactgttactgatgcgaactagttgggccctctgcgaggccctgacccttgccaccggccccatcaccacgctctgggagggttccccagggaagttctggaacaccaccatcgcggtcagtatggccaacatcttccggggctcctacctggccggggcgggcctggccttctccatcatgaagtccgtgggtaccgggaagcgcggcaccggatcgcagggcgagacgcttggtgagaagtggaagaaaaagctaaaccagttaagccggaaagaattcgacttgtacaaaaagtctggcataaccgaagtggaccgcaccgaggccaaggaggggctgaagcggggagaaatcacgcaccacgccgtcagccgcggctccgcaaaactgcaatggttcgtcgagcggaacatggtgatcccagaggggagagtcatcgacctcggctgcgggcggggcgggtggtcctactattgtgccggccttaagaaggtgaccgaggtacgaggctacaccaagggcgggcccgggcatgaggagcccgtccccatgtccacgtacggctggaacatcgtcaagctgatgagcgggaaggacgtgttctatctaccgcccgagaagtgcgacaccctcctgtgcgacatcggcgaatcctctccctcaccaacggtcgaggaatctcggaccatccgcgtgctgaagatggtggaaccatggctcaagaacaaccagttctgcatcaaggtcctgaacccctacatgcctaccgtgatcgagcacctcgagcgcttacagaggaaacatggcgggatgttagtgcgcaacccactgtcgcgtaacagcacccacgaaatgtactggattagtaacggcacggggaatatcgtggcctcagtgaacatggtgtcccgcctcctgctcaaccggttcaccatgacgcaccgccggccgactatagagaaagacgtcgatctcggcgcgggcacgcgccacgttaacgcagagccagagacccccaacatggacgtgatcggagagagaatcaagcgcatcaaagaggagcataacagcacctggcactacgacgacgagaacccgtacaagacctgggcctaccacggctcctacgaggtcaaggccacgggaagcgcctccagtatgatcaacggcgtggttaagctgctgaccaaaccttgggacgtggtgcccatggtcacccagatggcgatgaccgacacaacccccttcggacagcagcgggtgttcaaggagaaggtggacacacggacaccacggtccatgccaggcacgagaagagttatgggtatcaccgcagagtggctctggcgcaccttggggcggaacaagaagccccggctgtgcacccgcgaagagttcactaagaaggtgcgtacaaacgcagccatgggagcggtgttcaccgaagagaatcagtgggacagcgcaaaagccgccgtcgaagacgaggacttctggaagctcgtggaccgcgaacgggagctgcacaagctggggaagtgcggcagctgcgtttacaacatgatggggaagcgcgaaaagaagctcggcgagttcggcaaggccaaggggtcccgggcgatctggtacatgtggctgggcgcccgctacctggagttcgaggccctcgggttcctgaacgaggaccactggttcagtcgtgagaactcctacagcggcgtcgagggggagggtctgcacaagttaggctatatacttcgcgacatcagtaagatccccgggggcgctatgtacgccgacgataccgcggggtgggacacgcggatcaccgaggatgatctgcataacgaggagaagatcactcagcagatggacccagagcatcgccagctggccaacgctatcttcaagctgacgtatcaaaacaaagtggtgaaggtccagcggcccacccccacgggcaccgtgatggacataataagccgcaaggaccagcggggctccggccaggttgggacctacgggctgaacacgttcacgaatatggaagctcagctcatccgccagatggaaggcgagggggtcctaagcaaggctgacctggagaacccccacttacccgagaagaaggtgacccaatggctggaaaccaagggggtagagcggctgaagcgcatggcgatctccggcgacgactgcgtcgtgaaaccgatcgacgaccggtttgccaacgccctcctggccctcaatgacatgggcaaggtgcgcaaggacatcccccagtggcagcccagcaagggctggcacgactggcagcaggtaccgttctgctcccaccacttccacgagttgataatgaaggacgggcgaaaactggtcgtgccctgccgcccacaggacgagctgatcggccgggcccgcatcagccaaggggccggctggtcgctacgggaaaccgcctgcctgggcaaggcatacgcccaaatgtggagcctcatgtacttccaccgcagggacctccggttggcgtccaatgctatctgctctgccgtccccgtgcactgggtgccgacgtcccgcacaacctggtcaattcacgcccaccaccagtggatgaccacggaggacatgctaaccgtatggaaccgggtgtggatagaggacaacccctggatggaagacaagaccccagtgacgacgtgggaaaacgtcccctatctcgggaaacgcgaggaccaatggtgcggtagcctgatagggctgaccagccgggccacctgggctcagaatataccgacagccatccagcaggtacggtctctcatcggaaacgaggagttcctggactatatgccgtccatgaagcggttcagaaaggaggaagagagcgagggggctatctggtag

SEQ ID NO: 25724 - RNA, 9873 nt, synthetic construct
  misc_feature 1..9873: note = derived and/or modified CDS sequence (opt11) from DENV-3__GQ868578__SS-prME
  source 1..9873: mol_type = other RNA
accagcttatgcctaatgatgattctacccgcggcgctcgcattccatctgacctcacgggacggagaaccgcgaatgattgtagggaaaaacgaacgaggaaaatcactgttgttcaaaaccgccagcggcataaacatgtgcaccctcatcgccatggacctcggggaaatgtgcgacgacacggtaacgtacaaatgcccgcacataacagaagtggaaccggaagacatagactgctggtgtaacttaacgtccacatgggtaacgtacgggacgtgcaaccaagctggagaacaccgtagagacaaacggtcagtagccctagccccgcacgtgggaatgggcctcgacacccgcactcaaacgtggatgtcggcagaaggtgcatggcggcaagtagaaaaagtagaaacctgggccctgcgccaccccgggttcacaatcctcgcccttttcctagctcattacattggcacatcactaacccaaaaagtggttatatttatactactgatgctagtaaccccgtcgatgaccatgcgctgcgtaggggttgggaaccgcgacttcgtggaaggattatccggcgccacctgggtagacgtggtactagaacacggcggatgcgtcacaaccatggccaaaaacaaacccacattagacatcgaactgcagaaaaccgaagccacccaactggcaaccctaagaaaactgtgcatagaaggaaaaattacgaatatcacaactgactcgcggtgtcccactcaaggcgaagccgtgctgcccgaggaacaagaccagaattatgtctgtaaacatacatacgtggatcgcggctggggaaatggatgcggcttattcggcaaagggtcacttgttacctgcgcgaaattccaatgccttgagtctattgagggaaaagtcgttcaatatgaaaatctaaaatacacggtaataatcacggtacatacgggggatcagcaccaagtgggaaacgaaacccaaggtgtcaccgcggaaattaccccacaagcgtcaaccaccgaagccatacttcccgagtacggaacactgggtctcgaatgtagcccccgaacgggactagatttcaacgaaatgattctactgacaatgaaaaacaaagcgtggatggtacatcgccagtggttcttcgacctcccactaccgtggacctctggggcaacgactgaaacgcccacctggaatagaaaagaactcttagtaacatttaaaaacgctcacgcaaagaaacaggaggtagtcgtcttaggatcccaagagggagcaatgcacacagcattgacgggggcaacagaaatccaaaactcaggtggaacgagcatattcgccggccacctcaaatgccgcttgaaaatggacaaactagagttaaaaggaatgagctacgcaatgtgcacaaacacattcgtcctcaagaaagaagtgtcggagacccaacacggcacgatactgataaaagtagagtacaaaggcgaggacgtcccctgcaaaattccgttctccacagaagacggacagggaaaagcacacaatgggcggctcataaccgccaacccagtcgtcacaaagaaggaggaaccggtgaacatagaggctgaacccccattcggcgagagcaacatcgtaatcggaatcggagacaacgccttaaaaatcaattggtacaagaaaggcagcagtataggcaaaatgttcgaggccacagctcggggagcgagaaggatggccatccttggggacacagcatgggacttcggtagtgtaggaggagtcttaaattccctgggaaaaatggtccaccaaatatttgggagtgcgtatacagcgctgttttccggtgtatcatgggtaatgaaaatcggtatcggtgtactactgacgtggatcggcctcaattctaaaaacacctcgatgagcttcagctgtatcgccataggaatcataactctatatctcggcgctgtcgtacaggcagatatgggatgcgtcatcaactggaagggaaaggagctgaaatgcggatcgggaatcttcgtcaccaacgaagtgcacacctggaccgagcaatataagtttcaggctgactcacccaaacgccttgcgacggcaatagcaggagcctgggaaaatggggtatgcggtattagaagcacaacccggatggagaatctgctatggaaacaaattgcaaatgagctgaactatatactttgggaaaacaacataaagctaacagtggtggtaggtgacataatcggcgtgttagaacaaggaaaaaggacgctcacaccccagcccatggaactcaaatactcgtggaaaacgtggggcaaggccaagatcgtcaccgctgaaacccagaactcatccttcatcattgacggccccaacacgccagagtgccccagcgcgagcagagcttggaacgtatgggaagtagaagactatgggttcggagtatttaccacaaacatctggctaaaactcagagaagtgtatacacaactctgtgaccatcgcctaatgtccgctgcagtaaaggacgaacgagccgtacacgcagacatgggctactggatcgaatcccaaaagaatggcagttggaaactcgagaaagcctcgctcatagaagtgaagacttgtaaatggccaaaaagccacaccctctggtcgaacggcgtcctagaatcggacatgataatcccgaaaagtttagcagggccaatctctcaacacaactaccggcccggctaccacacacaaacagcaggcccctggcacttaggcaaactagaactagactttaattactgcgaaggaacgacagtcgtcatcacagaaaactgcggaacccgcggtccaagcctgaggacaacgacagtatctgggaaactcatacatgaatggtgctgcagatcctgcaccctccctccactccggtatatgggggaagacggctgttggtacggaatggaaattcggcccacttcggaaaaagaggagaacatggtgaagtcgctggtcagcgcggggtctggggaggttgacaacttcacgatgggagtgctgtgcctcgccattcttttcgaggaggttatgcgaggaaaatttggcaagaaacatatgatagcaggcgtactcttcaccttcgtcctactgctctccggacaaataacctggagagatatggcacatacactcatcatgatagggtccaacgcatccgaccgcatgggaatgggagttacctacctggcactcatcgcaacgttcaaaatacagccgttcctagccctaggcttctttctaagaaagttgacatccagagaaaacctacttctaggtgttggactcgccatggcaacaacccttcaattgcccgaagacatcgaacagatggcaaacggcatagcgcttggccttatggccctaaaacttataactcaatttgagacctaccaactatggacggcgttaatcagcctgacctgctcaaacactatattcacactgaccgtggcatggcggaccgcgacacttatactcgcaggggtctccctcctccccgtgtgccagagcagcagcatgcgaaagaccgactggctacccatgaccgtagccgcaatgggtgtacctcctctcccactcttcatcttctcgctgaaagatacactcaaaaggcgcagctggcccctcaacgaaggagtaatggcggtaggcctggtaagcatcctggcgagcagcttactacgtaacgacgtaccgatggcggggccgctggtcgcgggcgggttactaatcgcatgctatgtgataaccggcacatcggccgacctaaccgtggaaaaggctgctgacgttacatgggaagaagaggccgagcaaaccggagtttctcacaatctcatgataacagtcgacgacgacgggacgatgcgaataaaagacgatgaaactgagaacatacttacagtgttactcaaaacagcactcctcatagtaagtggcatctttccctactccatacctgccaccctattagtgtggcacacgtggcagaaacaaacccagcgaagcggggttttgtgggacgtcccaagtcctcccgagactcaaaaggcagaactagaagagggcgtgtatcgcataaagcaacagggcatattcggtaaaacacaagtaggtgtcggcgtgcaaaaggagggggtgttccacacgatgtggcacgtgaccaggggcgcggtccttacatacaatggaaagagactggagcccaactgggcatctgtaaagaaggatctgatcagctatggcggcggctggcgcctttcggcccaatggcagaaaggcgaagaagtacaggtcatagctgtagaacctgggaagaaccctaagaatttccaaacgatgccgggcacattccaaacgaccacgggtgaaataggagccatcgccttagacttcaaaccggggacttcagggagtccaataatcaaccgagaggggaagatcgtggggctgtacggcaacggagtagtaaccaaaaatggcgggtacgtatcaggcatcgcccaaaccaatgcagaaccagacggacccacccccgaactagaagaggaaatgttcaagaaacgcaacttgaccataatggacttacatccaggctcgggaaaaacgcgaaaatatcttccagcaatagttagagaagccatcaagagacggcttaggacactcatactggcgccgactagagtagtggcggccgagatggaggaagcactgaaaggcctaccgatacgctaccagacgacggcaacgaaatccgaacatactggacgcgaaattgtcgacctgatgtgtcacgccaccttcactatgaggcttctatcccctgtccgggtgccaaattacaacctaatcataatggacgaggcccactttactgacccggcctccatagcagcccggggatacatcagcacgcgcgtaggaatgggagaagcggctgccatattcatgaccgcaacgccgccaggaaccgcagatgccttccctcaatcaaacgcccccatccaagatgaagagagggatattcccgaaagaagctggaactccggcaatgaatggatcaccgactttgccggcaagactgtatggtttgtgcccagtataaaagctggcaatgatatcgccaattgcctacgcaagaacgggaagaaagtaatccaactgagccgcaaaaccttcgataccgagtatcagaaaacgaaactaaacgattgggattttgtagtaacgaccgacataagcgagatgggcgcaaacttcaaagcagaccgcgttatcgacccgagacggtgtctaaaacccgttattctaacggacgggcctgaaagggtgatactcgcaggccccatgcccgtcacggccgcgagcgccgcccaacggcgaggtcgggttggacgtaacccacaaaaggaaaacgaccagtacatattcacagggcagcctctaaataatgacgaagaccacgcccactggacggaagctaaaatgctacttgacaacatcaacactcccgaaggcatcattccagccttatttgaacccgaacgagagaaaagcgccgcaatagacggcgaatataggctgaagggcgaatcaagaaaaactttcgtggaactaatgagaagaggggacctgccggtctggctcgcctacaaagtagcatccgaggggataaaatacacagacagaaaatggtgtttcgacggccaaagaaacaaccaaatcctagaagaaaacatggacgtggaaatctggactaaagaaggcgagaagaagaaattgaggccgcgctggctggacgcccgaacctattcggacccgttagccctaaaagaatttaaagatttcgcggccgggaggaaatctattgccctagacctcgtcacggaaataggccgcgtaccgacgcacttagcccacaggacacgcaacgccctcgacaatctagtgatgctacataccagcgaacatggcgggaaggcgtataggcacgccgtagaagaattgcctgagacgatggaaacactattactcttaggtttaatgatcctcctcactgggggcgccatgctgttcctaatatcgggtaaggggatcggcaagaccagtatcgggctcatctgcgtcattgcctccagtggcatgctatggatggcagagatacccttacagtggatcgcaagcgcaatcgtgttagagttcttcatgatggttctcctgatccccgagcccgaaaaacagcgaacaccgcaagataatcaacttgcctacgtagtcatcggaatcctcaccctcgccgcgattatcgcggctaacgaaatgggcctactcgaaacgaccaaaagagacctaggcatgtcgaaggagccgggtgtcgttagcccaacatcgtacctagacgtcgacctacaccccgcgagcgcctggacgctctacgcagtagccacgaccgtgataacacccatgctcagacatacaattgaaaactcgacggcgaacgtcagcctcgccgcaatagccaaccaggccgtagtattaatgggcctcgacaaaggatggcccatcagcaagatggacttaggcgtacccctacttgcactggggtgctatagtcaggtcaaccccctgacacttacggcagccgtactgctactgatcacgcattacgcaatcataggcccagggctccaagcaaaagccacacgggaggcccaaaaacggacggccgccggaatcatgaagaacccgaccgtcgatggcatcatgacaattgacctagatcccgtcatatacgattccaaattcgagaaacaattaggccaagtgatgctgttagtactctgcgccgtccagctgctcttgatgaggacatcatgggccctctgcgaagcccttacgcttgcaaccggaccaatcacaaccctctgggaaggaagtccagggaagttctggaacactaccattgccgtaagcatggcaaacatattcagaggcagttacctagccggcgcgggcctggccttcagcatcatgaaatccgttgggaccggcaaacggggcaccggttcccagggtgaaacactcggcgagaagtggaagaagaagctaaatcagctatcgcggaaggagtttgacctatacaagaaatcggggataacagaggtagaccgaacagaagccaaagagggactaaaacgaggagagatcactcaccacgccgtcagcagaggaagtgcgaagctgcaatggttcgtcgaaagaaacatggtaataccagaggggagagtgatcgacttgggatgcggccgagggggctggagttattactgtgcaggtctgaagaaagtcacggaggtccgaggctataccaaaggcggaccgggacatgaggaaccagtacccatgagcacatacggctggaacatagtaaagctgatgagcggcaaagatgtgttctatctaccacccgaaaagtgcgacaccctactatgcgatattggtgagtcctcgccctcgccaacagtcgaggaatcacggaccatccgagtcctaaagatggtagaaccgtggttgaaaaacaaccagttctgtatcaaagtgctcaatccgtacatgccgacagtaatagaacacctcgaacgattacagcgtaagcatggaggcatgctcgtgcgcaacccgctgtcgcgcaacagcacacacgagatgtactggatatcaaacggaactggaaatatcgtagcctccgtcaacatggtgagtagattgttactcaatcggttcacaatgacgcaccgtcgccccaccatagaaaaagacgtagatttgggagcgggaacaagacacgtaaacgcggagccggaaaccccgaacatggatgtgatcggagagaggataaagcgtataaaagaagaacacaacagcacatggcactacgatgacgagaacccatacaagacctgggcctaccacggttcttacgaagtaaaggctactggctcagcaagttcgatgataaacggggtagtaaagctcctcaccaagccctgggacgtcgtcccgatggtaacgcagatggcgatgacggacacaacacccttcggccaacaacgcgtgttcaaagagaaagtagatacgcgaactccgagatcaatgcccggcacaagacgtgtcatgggcatcacagcagaatggttatggagaacgctcgggcgaaataaaaagccgagactatgcacaagagaagaatttaccaagaaagtgagaacaaatgctgccatgggagcggtctttaccgaagagaaccagtgggacagcgcaaaagccgccgtggaggatgaggacttctggaaattggtggatagggagagagagttgcacaaactgggaaagtgcgggagctgcgtctacaacatgatgggaaagagagagaagaaactcggggagttcggaaaagcgaaaggctcaagagcaatatggtacatgtggctaggggcccgctacttagagtttgaggccctaggcttcctcaacgaggaccattggttctcgcgagagaactcttattccggcgtcgagggcgaaggtctccacaaattaggatatatactccgagacatctcaaaaataccgggcggagccatgtacgcagacgacaccgcgggatgggatacacggatcacagaggacgacctacataacgaagaaaagatcactcagcaaatggaccccgagcaccgacaattggcgaacgcaatcttcaaactaacataccagaacaaggtcgtaaaagttcagcggccaactcctaccggaacagtaatggacatcatctcgcggaaagaccagcgtggcagcggacaagtcgggacttatgggctaaacacatttacaaacatggaggctcagctgatacgacagatggaaggcgagggtgtgctcagcaaagccgatctggaaaacccccaccttccagagaagaaaatagcccaatggctagagaccaaaggggtggagcggctgaaacggatggcgatcagtggggacgactgcgtggtgaaacctatagatgacagattcgcgaacgcactccttgctctaaatgacatgggaaaagtgcgaaaggacatcccacagtggcagccgagcaaaggatggcacgattggcaacaggtcccattttgcagccaccatttccatgaattaataatgaaagacgggcgaaaactggtggtcccatgtcgaccccaggatgaactaataggtagagcaagaatcagccaaggggcaggatggtcattaagggaaaccgcatgcctcgggaaggcctacgcacagatgtggtccctaatgtacttccaccgccgcgatctccgcttagcatcaaatgcaatctgcagtgccgtcccggttcactgggtaccaacatcgcgaacaacatggtccatccacgcgcaccaccaatggatgactaccgaagacatgctaacagtttggaaccgggtatggatagaagataatccctggatggaggacaagaccccggtcacaacctgggagaacgtgccgtaccttggcaaacgcgaagaccagtggtgtggatcactaatcggtctcactagccgcgcgacgtgggcccagaacatcccgacggcgatccaacaggtacggagcctgatgggcaatgaagagttcctagactacatgccatccatgaagagattccgtaaggaagaggagagcgaaggcgccatttggtag

SEQ ID NO: 25725 - RNA, 9873 nt, synthetic construct
  misc_feature 1..9873: note = derived and/or modified CDS sequence (opt11) from DENV-3__FJ898457__SS-prME
  source 1..9873: mol_type = other RNA
accagcttgtgcctcatgatgatattacccgccgctttagctttccacctcacctcacgggacggcgagccccggatgattgtggggaagaacgagcggggcaagagcttgcttttcaagaccgcgtcgggtatcaacatgtgtacgctgatcgcaatggacctgggcgagatgtgcgatgacactgttacctacaagtgtccccacatcactgaggtggaacccgaggacatcgactgttggtgtaacctgaccagtacttgggttacgtacggcacatgcaaccaggccggcgaacaccgtcgagacaagcggtcggttgccctcgcaccccatgtgggcatggggctggatacccggacgcaaacctggatgtccgccgaaggcgcatggcggcaagtcgagaaagtcgaaacgtgggcgctgcggcatcccgggttcacgatattggccctatttttagctcactatatcggcacctctctaacccagaaagtcgtgatcttcatcctgctgatgctcgtaaccccgagcatgaccatgcggtgcgtgggggtgggcaaccgggacttcgtcgaggggctatctggggcaacgtgggtcgacgttgtcctggaacacggcggctgcgtgaccacgatggccaaaaacaagccaacgctagacatcgagctgcagaaaacagaggctacccagctcgcaaccctccgtaagttatgtatagagggtaagatcactaacattaccaccgatagtaggtgcccaacgcaaggcgaggccgtgctgccggaggagcaggaccagaactatgtctgcaaacacacctacgtggatcgaggctggggtaacggctgtggactcttcggcaaaggatccctcgttacctgcgcgaagttccagtgcctggagccaatcgagggcaaggttgtgcaacacgagaaccttaagtacactgtgatcatcacggtccacaccggagatcagcaccaggtaggcaacgagacccaaggcgtaacggctgagatcacaccgcaggcaagcacaaccgaggcgattcttcccgagtacggcacgctagggctcgagtgctcccctcggaccggcttagattttaacgagatgatcctgctcacgatgaagaacaaggcgtggatggtccaccggcagtggttctttgatctccctcttccctggacctcgggcgcgaccacggagactcccacatggaacagaaaggagctgcttgtcaccttcaaaaacgcccacgccaagaagcaggaggtcgtggtgctcggcagccaggaaggtgccatgcacaccgccctcacgggggccaccgaaatccagaactccggcggtacctccatattcgctggtcacctgaagtgtcggctgaagatggacaagctagaactgaagggcatgagctacgccatgtgcaccaacacattcgtgctcaagaaggaagtgtccgagacccagcacggtaccatccttatcaaggtggagtacaaaggtgaagacgcgccgtgcaagatcccgtttagtactgaggacggtcagggaaaggcgcacaacgggcgcctgatcacggcgaatccagttgtgacaaagaaggaggaacccgtgaacattgaagccgaaccacccttcggggagagcaacatcgttataggcatcggagataacgccctgaagatcaattggtacaagaagggatcttccatcggaaaaatgttcgaggcgaccgcccgcggggcacgccggatggcgatcctgggcgacaccgcatgggacttcggctcagtgggtggcgtgctaaacagcttgggcaaaatggtacatcagattttcggaagcgcctacacagccctctttagtggagtttcctggatcatgaagattggcatcggggttctcctaacctggatcggcctaaattctaagaatacctccatgtcgttctcttgcatcgccatcgggatcatcaccctctacctaggagccgttgtgcaagcggacatgggctgcgtgatcaactggaaaggcaaggagctgaagtgcggcagcggtatattcgtcacgaacgaagtgcacacctggaccgaacaatacaagtttcaggccgacagccccaagcgactcgccaccgcaatcgccggcgcctgggagaacggggtgtgcggcatacgctcgactacccggatggagaacctgctttggaaacagatcgccaacgaactcaactacattctgtgggagaataacataaaattgactgtcgttgtgggcgacatcatcggggtgctcgagcagggcaagcgcactttaacgccacaaccgatggagctgaagtattcctggaaaacatggggtaaggctaagatcgtgacggccgaaacgcagaactcctccttcataatagatggtcctaacacacccgaatgcccctcggcgtccagggcctggaatgtgtgggaagtcgaggactacggtttcggcgtcttcacaaccaacatatggctgaaattgcgcgaggtgtatacgcaattatgtgaccatcgtctcatgagcgccgccgtcaaggacgaacgtgcggttcacgcggacatgggctactggattgaaagccagaagaacggatcctggaagctggaaaaggccagcctgatcgaggtgaagacctgcacgtggcctaagagccacactttatggagcaacggggtcctggaatcagacatgatcatacccaaaagcctggccggtcctatcagccaacataatcaccgcccgggctaccatactcaaaccgctgggccttggcatctgggaaagctggaactagatttcaactattgcgagggaaccaccgttgtgatcaccgagaactgcggtacccggggcccgtccctccgcacgaccacggtctcggggaagttgatccacgagtggtgctgccggtcgtgcaccctgcccccgctccggtacatgggagaagacgggtgctggtacggcatggagatacgacccatctcggaaaaggaggagaacatggtaaagagcctggtgagtgccggcagcgggaaggtcgataacttcactatgggagtgctgtgcttagctattctctttgaggaagtgatgcgggggaaatttggcaagaagcacatgatcgctggtgtctttttcaccttcgtgctcctactgtccggccagatcacgtggcgcgacatggcccataccttgattatgatcggcagtaacgcctccgaccgcatggggatgggagtcacgtacctcgcattaatagcgaccttcaagattcaacccttcctggccctagggttcttcctgagaaaactgaccagccgtgagaacttattgctcggggttgggctcgccatggccaccactctgcaacttccggaagacattgaacagatggccaatgggattgccctagggcttatggcactgaagctaatcacccagttcgagacctaccagctgtggaccgccctgatcagcctcacgtgctccaacaccatattcaccctgaccgtagcatggcgcacagcgaccctgattttagccggcgtgtctctcttaccggtctgccaaagtagctccatgcgcaagaccgactggctgcccatggccgtagccgcgatgggggtaccgcccctccctctgtttatatttagcctcaaggacaccttaaaacgccgcagttggccactgaacgaaggagtgatggcggtgggtttagtcagcatcctagcctccagcttgttgcggaacgacgtacccatggcaggccccctggttgccggcggactgctcatagcctgctacgtcatcacgggaaccagtgcggatctcaccgtggagaaagctgccgatatcacgtgggaggaggaggccgagcagacgggcgtgtcccacaatctgatgatcacagtcgacgatgacgggacaatgaggattaaggacgacgagaccgagaacatcctcaccgtgctgctgaagaccgccctcctgatcgtttcaggcatcttcccctactcgatcccggccaccctgctcgtctggcatacatggcagaagcagacccaacggagtggggttctgtgggacgtgcccagcccgccagagacgcagaaagccgagctggaggaaggtgtgtaccgcatcaagcagcaggggatatttgggaaaacgcaagtcggcgtgggagtccagaaggaaggcgtattccataccatgtggcatgtgacgcgaggagccgttttaacgtacaatgggaaaagacttgaacccaactgggcctccgtgaaaaaggacctgatcagctatggtgggggttggagactctccgcacagtggcaaaaaggcgaagaggtacaggtcatagccgtggagccaggcaagaaccccaagaacttccagacaatgcccggtacattccagaccacgaccggggagatcggcgccattgcactcgacttcaagcccggtacgagcgggagtcccataataaatagagaggggaaagtggtcgggctgtacggcaacggggtggtgactaagaacggcgggtacgtgtccggcatagctcagacgaacgcagagcctgacggccccacccccgaattagaagaggagatgttcaaaaagcggaacctcaccatcatggacttgcaccccgggagcggcaagacccggaaatacctgccggctatagtgcgggaggctataaaacgccggctacgaactttaatcctggcccccactcgggtggtggcggcggagatggaggaggccctaaaaggcttaccgatccgctaccagactaccgcaacgaagtccgagcacacgggtcgggagatcgtggatctgatgtgtcatgccaccttcaccatgcgcctactaagcccggttcgggtccccaattacaacctgatcataatggacgaggcacattttaccgatccagcttccatagcagcccgcggatacatcagcacacgggtcgggatgggagaggcggcggccatctttatgaccgccacgccgccggggacagctgatgcctttccgcagtctaacgcgcccatccaagacgaggagcgcgatatccccgagaggtcttggaactcagggaatgaatggatcaccgatttcgccgggaagaccgtgtggttcgtgccgtcgattaaggcgggcaacgatatcgccaactgtctcagaaagaacgggaagaaagtaatccagttatctcgcaagacgtttgacacagagtaccagaaaaccaagttaaacgactgggacttcgtcgtcacgacggatatcagcgaaatgggcgccaacttcaaggcggaccgagtcatcgatccacggcggtgtctcaaaccagtgattctgaccgacggtcccgagcgcgtcattctcgccggtcccatgcctgtgaccgccgcttcggcggcgcagcgccgcggtagagtggggcgcaatccccagaaggagaacgatcaatacattttcaccggccagcccctcaacaatgacgaggaccacgcccactggaccgaggccaagatgctcctggacaacatcaataccccggaagggataatcccggctctcttcgaacccgaacgagagaaaagcgccgccatcgacggcgaataccgcctgaagggcgagtccaggaagactttcgtcgaactgatgcgccgtggggacctccccgtgtggcttgcacacaaagtggccagcgaaggtataaagtacactgaccgcaaatggtgtttcgacggtcagcgaaacaaccagatactggaggaaaacatggatgtagagatttggacaaaggagggcgagaagaagaaactcaggccaagatggctagacgcgagaacgtactctgacccattggcactcaaggagttcaaagattttgccgccggccgtaagagcatagctctggatctggtgacggaaatcgggcgagtcccgtcccacctcgctcatcgaactcggaacgccctagacaacctggtgatgctccacacctcggagcatggtgggagggcctaccgccacgctgtagaggagttacccgagaccatggaaacgctgcttctgctgggattgatgatcctgctgaccgggggcgccatgctttttctgatctcaggcaaggggatcggaaaaacatcgatcggtttaatctgcgttatcgcaagctccgggatgctctggatggctgagataccgcttcagtggattgcgtcagctatcgtgctagagtttttcatgatggtgctgctgatacccgagcccgagaagcagcgcacgcctcaggacaaccagttggcctacgtagttatcggaatcctcacgttggccgccataatcgccgccaacgaaatgggattactcgaaacgaccaagcgcgacctcgggatgtccaaggagcccggagtcgtaagcccaacttcctacctggatgtagacctccatcctgccagtgcgtggacgctgtacgcagttgccaccacagtgatcacccccatgctgcgccacacaatcgaaaattctaccgcaaacgtgagcctagccgcgatagctaaccaagccgtggtcttgatgggactggacaagggttggccgatttctaaaatggacctgggggtgcccctgctggctctcggttgctattcgcaagtgaaccccctaacgctgaccgcggcggtcttactactgatcacgcactacgccataatcggtcccggactccaggcaaaggccacccgggaagcccagaagcgtaccgcggccggcatcatgaaaaatccgaccgtggacggcatcatgactatcgacctggaccccgttatttacgattccaaattcgagaagcaactcgggcaagtgatgctcctggtactgtgtgcggtccaactcctgctaatgcggacttcatgggccctatgcgaagcgcttaccctagcgaccgggccaatcaccaccctctgggaaggcagtcccggcaagttttggaacactacaatcgcagtttccatggccaacattttccgtggcagctaccttgctggggcagggctagccttcagcatcatgaagacggtcgggactggcaaacgcggcaccggatcccagggcgaaaccttaggcgagaagtggaagaagaaactgaaccagttaagccgcaaagagtttgacctctataagaaatccggcatcaccgaggtggacaggactgaggcgaaggaagggcttaaacgcggcgagatcactcaccacgctgtctcccggggcagtgcgaagctgcagtggttcgtggaacgcaacatggttatcccggaggggcgggtcatcgacttaggttgcgggaggggagggtggtcctactactgcgccggcctgaagaaggtgacggaggttcgaggctatacgaagggcgggcccggtcacgaggaacccgtgcccatgagtacgtacggatggaatatagtcaaactaatgtccggtaaggacgtgttctatctcccgcctgaaaagtgcgataccctgctatgcgacatcggtgagagctcacccagccccacggttgaggagtcccgcaccattcgcgtgttgaaaatggtggagccgtggctcaaaaacaatcagttctgcatcaaggtcctgaacccatatatgcccacggtcatcgaacacctggagcggctccagagaaagcacggcggaatgctggttcggaaccccctgtcacgcaattctacccacgagatgtactggatctcgaatggcaccgggaacatagttgcatccgtgaacatggtgagccgcctcctcctaaaccgattcaccatgacgcaccgaaggccaacgattgagaaggatgtggacttaggagcgggtacccggcacgttaatgcggaaccggaaacaccgaacatggatgtgatcggggaaaggataaaaaggataaaggaagaacacaactccacgtggcattatgacgatgagaacccgtataagacctgggcgtaccatggttcttatgaggtgaaagcaaccggctccgcctcgagcatgatcaacggtgttgtcaaacttctcacaaagccgtgggacgtcgtgccgatggtcacgcaaatggccatgacagacacgacccccttcgggcagcaacgcgtattcaaggagaaagtggacacacggaccccgcgctctatgcccggcactcggagagtcatgggcattaccgccgagtggttatggcggacgctaggacggaataagaaaccgcggttgtgcactcgcgaggaatttaccaagaaggttcggaccaatgctgccatgggtgccgtcttcactgaagaaaatcagtgggacagtgccaaagcggcagtcgaggacgaggacttctggaagctcgttgacagggagcgggaactgcacaagctggggaagtgcgggtcctgtgtgtacaacatgatgggtaagcgggagaaaaagctgggcgagttcggcaaggcgaaaggatctcgcgccatctggtatatgtggctgggcgcacggtacctggagtttgaggcccttggcttcctgaacgaggaccattggttttcccgcgagaacagctatagcggcgtcgaaggagagggcctgcacaaactcggttacattctacgtgacatttcaaaaatacccgggggcgcgatgtacgccgatgacacagccggttgggacacccgcatcacagaagatgacctccacaacgaagaaaagatcacgcaacagatggatcctgagcatcggcaactggccaacgcgatcttcaaacttacatatcagaacaaggtagttaaggtgcaacgacccacgccaaccggtaccgtgatggacataatctcgcggaaggaccagcgaggaagcggccaagtaggcacgtacgggctgaacacattcacaaacatggaagcacagctcatacggcagatggaaggcgagggggtcctgtctaaggccgacttggagaacccacacctcccggagaagaaaatcacccagtggttagagacgaagggcgtggagaggttaaaacgtatggcgataagtggcgatgactgcgtggtcaagcccattgacgaccgatttgctaacgccctcctagcgttgaacgacatggggaaagtgcggaaggatatcccccagtggcaaccctccaagggctggcatgactggcagcaagttccgttctgtagccaccacttccatgaactcataatgaaggatgggcgaaagctggtagtaccttgtcggccgcaagacgaactgatcggccgcgcaagaatttctcagggagccggctggagccttagagaaacagcctgcctcggcaaggcatacgcacaaatgtggtcgttaatgtacttccaccggcgggacctccggctcgccagcaacgccatctgctccgccgtgccagttcactgggtgcccacctcaagaaccacatggtccattcatgcccaccaccagtggatgaccaccgaggacatgctgaccgtatggaatcgggtttggattgaggacaacccttggatggaggacaagacgcctgtcactacctgggagaatgtgccctacctcggtaagcgggaggaccagtggtgcggcagtcttatcggtcttaccagcagggccacctgggcccagaacatcccgaccgcaatccagcaggtccggtccctcatcggcaacgaggagttcctagactacatgccatccatgaagcgattccggaaggaggaggaatccgagggcgcaatctggtga

SEQ ID NO: 25726 - RNA, 9873 nt, synthetic construct
  misc_feature 1..9873: note = derived and/or modified CDS sequence (opt11) from DENV-3__KF955505__SS-prME
  source 1..9873: mol_type = other RNA
accagcctctgtctaatgatgatcctgcccgctgccctggctttccacctcacatctcggaacggggagccacggatgatcgtgggtaagaacgagcggggcaagagcctgctgttcaaaaccgcctccgggatcaacatgtgcacacttatcgccatggacctgggggagatgtgcgacgacacggtgacctacaaatgcccccacatcacggaggtggagcccgaggacattgactgttggtgtaacctgaccagcacgtgggtcacctacgggacatgcaaccaagccggagagcaccggcgcgacaagcggtccgtggccctcgcgccccacgtgggcatggggttggacacccggacccagacctggatgagcgccgagggcgcctggcgccaagtcgagaaggtggagacatgggccttacgccacccggggttcactatcctcgccctgttcctggcccactacatcggcacgtccctcacccaaaaggtggttatcttcatcctgctgatgttggtgacgccgtcaatgaccatgcggtgcgtgggggtcggcaaccgcgacttcgtcgagggcctgtcgggggccacctgggtggacgtagtcctagagcacggcggatgcgtgaccacaatggccaagaacaaacccaccctcgacatcgaactgcagaaaacggaggctacccagttggccactctccggaagctgtgcatagagggcaagatcacaaacatcaccacggacagccgctgccccacgcagggcgaggccgtgcttccggaggagcaggatcagaactacgtctgcaaacacacctacgtggaccggggctggggtaacggatgcggactctttgggaagggctccctggtgacttgcgcgaagttccagtgtttagaacccatcgagggcaaggtcgtgcagtacgagaacctcaagtataccgtgatcatcacggtccacacgggggaccagcaccaggtaggcaacgagacccagggggtcaccgcggagatcacgccacaggccagcaccaccgaagcgatcctacctgagtacggcaccctgggcctcgagtgctccccgcgtacaggccttgacttcaacgaaatgatcctgctcactatgaagaacaaggcctggatggtccaccgtcagtggttcttcgacctgccgctaccctggacctctggcgccacaaccgagacgccaacctggaaccgcaaggagctactggtgaccttcaagaacgctcatgccaaaaagcaggaggtcgtggtgctggggtcccaggagggagcaatgcataccgccctcacgggggccacggagatccagaactctggcgggacctccatcttcgcgggccacctgaagtgccgcctgaagatggacaagctcgagttgaaagggatgagctacgccatgtgcactaatactttcgtgttaaagaaggaggtgtccgagacacagcacgggaccatcctcatcaaggtggagtacaagggggaggacgcgccgtgcaagattccgttctcgactgaagatgggcaaggcaaagcacacaatggccgcctgatcacggccaaccccgttgtgaccaagaaagaggagcccgtcaatatcgaagccgagccgcccttcggggagagtaatatagtaataggtatcggggacaacgcgctgaaaatcaactggtacaagaagggttcctctatcgggaagatgttcgaagccaccgcccgtggcgcccgccggatggccatcctcggcgataccgcgtgggacttcgggagcgtgggcggggtgctcaactcgcttggcaagatggtccaccagatcttcgggtctgcctacacagccctgttcagcggcgtctcctgggtgatgaagattggcatcggtgtcctcctcacctggatcggcctgaacagcaagaacacctccatgagcttctcctgcatcgccattgggatcatcaccctctacctgggcgccgtggtgcaggcggacatggggtgcgtcatcaactggaagggaaaagaactgaagtgcggaagcggcatcttcgtgacgaatgaggtgcacacctggacagagcagtacaagttccaagccgactcccccaaacgcctagccaccgccatcgccggcgcttgggagaacggcgtctgcggcatccgcagcacgacccggatggagaatctgctgtggaagcagatcgccaacgagctcaattacatcctgtgggagaacaatatcaagctgaccgttgtggtcggggacatcatcggcgtgttagagcaggggaaacgcaccctgactccccaaccgatggagctgaagtactcgtggaagacctgggggaaggccaagatcgtgactgccgagacccagaacagctccttcatcatcgatggccccaacacgcccgaatgccccagcgcgtcccgtgcatggaacgtctgggaggtggaggactatggcttcggcgtgttcaccaccaacatctggctcaaactgcgcgaggtctacacccagctgtgcgaccacagactcatgagcgccgccgtgaaggacgaacgcgccgtgcacgcggacatgggttactggatcgagagccagaagaacgggtcctggaagctggagaaggcttccctgatcgaagtcaagacctgtacgtggccgaaaagtcataccctctggagcaacggcgtgcttgagtccgacatgatcattcctaagtctctggccgggcccatctcccagcacaaccacagaccgggctatcacacccagaccgcaggaccctggcatctcggtaagctggagctggactttaactactgcgagggaacgacggtggtcataaccgagaattgtggaacaagaggcccgagcctacggacgaccaccgtgtccggaaagttaatccacgagtggtgttgccggtcttgcacgctcccccccttgcgatacatgggcgaagatgggtgctggtacggaatggagatccgccccatttccgagaaggaggagaacatggtcaaaagcctggtctccgccggctctgggaaggtggataacttcacgatgggggttctttgcctcgcgatcctgttcgaggaggtcatgcgggggaagttcggcaagaagcatatgatcgccggtgtgttcttcacctttgtgctgctcctgtcaggccaaatcacctggcgcgacatggcccacaccctaattatgatcgggagcaacgcctccgaccggatggggatgggcgtcacgtacctcgccctaattgcgacgttcaagatccagcccttcctggccctcgggttcttcctgcgcaagctgacctcacgggagaacctcctgctgggcgtgggccttgccatggccaccacgctgcagctgcccgaggacattgagcagatggccaacggtatcgccctcggcctgatggctttgaagctcattacccagttcgagacataccagctgtggaccgcactgatttccctaacatgcagtaacactatgttcaccctgaccgtggcctggcgcacggcgaccctcattctggccggggtcagcctgctgccggtgtgccagtccagctccatgcggaagaccgactggctcccgatggccgtcgccgccatgggcgtgccgcccttgccgctattcatattttcactcaaggataccctgaagcgccgctcctggccactgaacgagggggtaatggccgtcggtctcgtgagtatcctggcctccagcctgctccgtaatgatgtgcctatggccggccccctggtcgcaggggggcttctcattgcctgctacgtgatcactggaacctccgcggacttaaccgtggagaaggccgccgacatcacctgggaggaggaggccgagcagacgggcgtcagccacaacctgatgatcacagtggacgacgacgggaccatgaggatcaaagacgacgagaccgagaatatactcaccgtgctactgaagacggccctcctgatagtctccggagtcttcccgtacagcatccccgcgaccctgctcgtgtggcacacctggcagaagcagactcagcggtccggcgtcctgtgggacgtgcccagcccgcccgaaacgcagaaggccgaactggaggagggcgtataccgcatcaagcagcagggcatctttggcaagacccaggtcggagtgggggttcagaaagagggcgtattccacaccatgtggcacgtgaccaggggcgctgtgctaacgtacaacgggaaaagactggaacccaactgggccagcgtaaagaaggacctgatcagctacggcggtggctggcggttgtccgcgcagtggcagaagggggaggaggtccaggttattgccgttgagcccggcaagaatcccaagaacttccagacaatgcccggcactttccagaccacgaccggcgagatcggcgccatagccctggacttcaagcccgggaccagcggtagccccattatcaatcgcgagggcaaggttgtggggctgtacggcaacggggtagttaccaagaacggcgggtacgtctccggcatcgcccagacgaacgcggaaccggacggccccacccccgagttagaggaggagatgttcaaaaagcggaacctcaccatcatggacctgcaccccgggagtggcaagacccggaaatacctgccggccatagtccgggaagccataaagcgccggctccgcacgctgatcttggccccaacccgggtggtggccgcggagatggaggaggccctcaaggggctgcctatccgctaccaaactaccgccacgaagagcgaacacactggccgggagatcgttgacctgatgtgccacgccacattcaccatgcgccttctgagccccgtgcgggttccgaattacaacctgatcatcatggacgaggctcacttcacggaccccgcgtccatcgccgcccgcgggtacatcagcacccgggtcggcatgggcgaggctgcggccatctttatgaccgccacgccccccgggaccgccgacgcctttccgcagagtaacgcgcccatccaggacgaggagcgcgacatccccgagcgctcgtggaactccggcaacgagtggataacagacttcgccggcaagaccgtgtggttcgttcccagcatcaaggcgggtaacgatatcgccaactgcttgcggaagaacgggaaaaaggtcatccagctgtcccgcaagactttcgacacggaataccagaagaccaagctgaatgactgggacttcgtggtgaccacagacatcagcgagatgggcgccaacttcaaggcagaccgggtaatagacccgcgccgctgcctcaagcccgtgattctgacggacggcccagagcgggtgatcctggccggtcccatgccggtcaccgccgcctccgcagcgcagcggcgcggccgggtagggcgcaacccccagaaggagaatgaccaatacatcttcaccggccagcccttgaacaacgacgaggaccacgctcactggaccgaggctaagatgctgctagacaacatcaacacccccgaggggatcatcccggccctcttcgagcccgagcgggaaaagtctgcggccattgacggcgagtaccgcctgaagggtgagagtcgaaaaacgtttgtggagctgatgcgccggggggacctccctgtgtggctagcacacaaggtggcaagcgagggcatcaagtacacggatcgcaaatggtgcttcgacggacagcggaacaatcagatcctggaagagaacatggacgtcgagatctggaccaaagagggcgagaaaaagaaactacgcccccggtggctggatgcccgcacgtactccgacccgcttgcgctcaaggagttcaaggacttcgcggcaggccgcaaaagcatcgccttagacctggtgacggagatcgggcgggtgccctcgcacctcgcccaccgcactaggaacgcgctggacaacctggtcatgctccacacctctgagcacggagggagggcctaccggcatgccgtggaggagctgccggagaccatggaaactttactcctgctgggcctcatgatcttgcttaccgggggcgccatgctgttcctcatcagcggtaagggtatcggcaagacctcgatcgggctgatctgcgtgatcgccagttccggcatgctgtggatggcggagatccccctgcagtggatcgccagcgccatcgtcctggagttcttcatgatggtgctcttaatccccgagcccgagaagcagcgcaccccccaggacaatcagctggcctacgtagtcattgggatcctcacgctcgcagcgatcatcgccgccaacgagatgggcctgctcgagaccaccaagcgggacctgggcatgtcaaaggaaccgggggtggtgagcccgacgtcctatctggatgtcgatctccaccctgcctccgcgtggacgttgtatgcagtggccaccaccgtgattacccccatgttacgccacacgatcgagaactccaccgccaacgtctcactagctgcaatcgccaaccaggccgtggtgctgatgggcctggacaagggttggccaatctccaagatggacctcggcgtcccactgctggccctcgggtgctacagccaggtgaaccccctgaccctgaccgctgcggtgctactgctgatcactcactatgccataatcggccccggcctccaggccaaggccacccgggaagcgcagaagcgtaccgcggcggggataatgaagaacccgaccgtcgacggcatcatgaccatcgacctggaccccgtgatctacgactcaaagttcgagaagcagttaggccaggtgatgctactggtgctatgcgctgtgcagctcctcctgatgcggaccagctgggctctctgcgaggctctaaccctggcgaccggccccatcacgactctctgggagggctcccctgggaagttctggaacaccaccatagccgtgagcatggccaatatctttcgcggctcctacctggccggggcaggcctggccttcagcatcatgaaatccgtcgggacgggcaagcggggcaccgggagtcagggcgagacactcggggagaagtggaaaaagaagctgaaccagctgagccgcaaggagtttgacctctacaagaagagtggcataacagaggtggaccggaccgaggccaaggaggggctgaagcgcggcgagactactcaccacgccgtgtcacggggttccgcaaagctgcagtggttcgtcgagcgcaacatggtgatcccggaggggagagtcatcgacttgggttgcgggcgcggtggttggtcctactactgcgcgggtctgaagaaagtcaccgaggtgcggggctataccaagggtgggcccgggcatgaggagccggtgcccatgtcaacgtacggctggaacatcgtcaagctgatgtcggggaaggacgtgttctacctcccgcccgagaagtgcgacaccctgctgtgcgacatcggagagagctcaccttcccccaccgtggaggagagccgcaccatccgcgtcctaaagatggtggagccgtggctaaagaacaaccagttctgcatcaaagtgcttaacccctacatgcccacggtcatcgagcacctggagcggctccagcgcaagcacggcggcatgctggttcggaaccccctgtcccgcaacagcacccacgagatgtactggatatccaacggaacagggaatatcgtggcctcggtcaacatggtctcccggctcctgcttaaccgcttcacaatgacgcacaggcggccgaccatcgagaaagatgtggacctcggcgccggtactcgtcacgtcaatgccgagcccgaaacccccaacatggacgtgatcggagagcgcatcaagcggatcaaggaggagcacaactccacatggcactacgacgacgaaaacccgtacaagacctgggcctaccacggctcctacgaggtaaaggcgaccgggagcgccagcagcatgataaacggcgtggtaaagctgctgaccaagccctgggacgtcgtgcccatggtgactcagatggccatgaccgacaccactcccttcgggcagcagcgcgtcttcaaggagaaggtggacactcgcaccccgcgcagcatgcccggcacccgacgcgtgatgggtatcaccgccgagtggctctggcggaccctggggcggaacaagaaaccccggctgtgcccccgcgaggagtttaccaaaaaggtccgcaccaacgcggccatgggcgccgtgtttaccgaggagaatcagtgggactccgccaaagccgcggtggaggatgaagacttctggaaactcgtcgatagggagcgcgagctgcacaagctggggaagtgcggcagctgcgtgtataacatgatgggaaagcgggagaaaaaactcggcgaatttggcaaggccaagggctcccgcgccatctggtacatgtggctgggcgcccggtacttggagttcgaagctctcgggttcttaaacgaggaccactggttcagccgcgagaactcctacagcggcgtggagggcgaaggccttccgaaactcggctatatcctgcgggacatctccaagatccccgggggcgcgatgtacgccgacgacacggccgggtgggataccaggatcaccgaagacgatctgcacaacgaggagaagataccccaccagatggacccagagcactcccgcttagccaacgccatcttcaagctgacctaccagaacaaggttgttaaggtgcagcgaccgacgcccaccgggaccgtcatggacatcatctcccggaaggctcaacgcggcagcggacaggttggcacgtacggactgaacaccttcacgaacatggaggcccagctcatcaggcaaatggagggcgagggggtcctgtccaaggccgacctggagaacccacatctccccgagaagaagatcacgcagtggctggagaccaagggcgtggagcgcctgaagcgtatggctataaccggtgacgattgtgtggtgaagccgatcgacgatcgcttcgccaacgcgttactggccctgaacgacatggggaaggtccggaaggacatcccgcagtggcagcccagcaagggatggcacgactggcaacaggtccccttctgcagtcaccacttccacgagctcatcatgaaggatggtcgcaagctggtagtcccttgtcggccccaagatgagctgatcggccgcgcgcggatcagccagggtgccggctggtccttacgcgaaacggcgtgcctgggaaaggcctacgcccagatgtggagcctgatgtacttccatcgccgggacctcaggctggcctcgaacgccatctgctctgcggtgccagtgcactgggtgcccaccagtcggaccacctggagcatccacgcccaccaccagtggatgactaccgaggacatgctgaccgtgtggaatcgcgtgtggattgaggacaacccatggatggaggacaagacccccgtaacgacgtgggagaacgtgccctacctcgggaagcgggaggatcagtggtgcggtagcctgattgggctgaccagtcgcgccacctgggcccagaacatcccgacggccatccagcaggtccggagcctcatcggcaacgaagagttcctggactacatgccatccatgaagcgattccggaaggaagaggagagcgagggggcgatctggtga

SEQ ID NO: 25727 - RNA, 9873 nt, synthetic construct
  misc_feature 1..9873: note = derived and/or modified CDS sequence (opt11) from DENV-3__FJ898464__SS-prME
  source 1..9873: mol_type = other RNA
acaagcctttgtctaatgatgatactacccgccgcacttgccttccatttgacaagcagggacggagaacctcgaatgatcgtcggtaaaaatgaaagggggaaatcacttctgttcaaaaccgcctccgggataaacatgtgcacattaatcgcgatggatctcggagagatgtgcgatgacactgtcacctacaaatgtccccacataaccgaggtcgaacccgaagatatagattgctggtgcaacctaacatctacatgggtgacatacggcacatgcaatcaagcgggagaacatagacgcgacaaacgttcagtagcactagcaccacacgtaggaatgggcttagatacccgaacacaaacatggatgtccgctgaaggggcctggcgacaggtcgaaaaagtggagacgtgggccctgcggcacccaggcttcacgatcctcgctctgttcttagcacattacataggaacaagcctcacccaaaaagtggtgatattcatactgctcatgctggtgactccaagcatgacaatgagatgcgtcggagtaggaaacagagacttcgtcgaagggctcagtggagccacgtgggtcgacgtagtactagaacacggagggtgtgtcacaaccatggcgaaaaacaaacccacactagacatagaacttcagaaaaccgaagccacacaactagctacgctacgaaaactatgcatagagggtaaaattacaaacataaccaccgactcccgctgcccaacgcaaggggaagcagtactaccggaagaacaggaccagaactatgtatgtaaacacacctacgtcgaccggggctgggggaacggctgcggactatttggaaagggctcattggtgacatgcgcgaagttccaatgcctcgaaccgatcgaaggaaaggtcgtacagtatgagaatctaaaatacacagtcattatcacggtccacacgggcgaccagcaccaagtgggaaacgagacacaaggagtcacagctgaaatcacaccccaggcaagcaccacggaagcaatcctgcccgagtacggcaccctcggattagagtgcagtccccgcacaggtctcgacttcaatgagatgattctcctgacaatgaagaataaggcatggatggtgcacaggcaatggttcttcgatctccctctgccctggacatcaggggcaacgactgaaacccccacctggaaccgcaaggagctgctcgtaacatttaagaacgcacatgcaaagaagcaggaagtcgtcgtgcttggatctcaagagggcgcgatgcacaccgcgctcacaggcgcaaccgaaatacaaaatagcggcggtacctcaatattcgcggggcacctcaaatgccgactgaaaatggacaagctggagctgaaaggtatgtcgtacgcgatgtgcaccaacacctttgtcttaaagaaagaagtctctgaaacacaacatggcacgatcctcataaaagtcgagtacaagggcgaggacgctccctgcaagattcccttctcaactgaggacggacagggcaaagcccacaatggtaggctcatcactgcaaacccggtggtcactaagaaggaagaaccggtaaacatcgaagctgagccgcctttcggcgaatccaatatcgtaatcgggataggtgacaatgccttaaaaattaactggtacaagaaagggtcatccataggaaagatgttcgaagccaccgcgcgaggtgcccgaagaatggccatactaggggacacggcatgggacttcggctccgtaggaggggtgctgaacagcctagggaagatggtacaccaaatattcgggagcgcctacactgcgctgttcagcggagtgtcgtgggtcatgaaaatagggatcggagtgcttctgacctggatcgggctaaatagtaagaatacatccatgagcttcagctgcatagctatcggcattatcacactgtatcttggggcagttgtccaagccgacatgggctgcgtcatcaactggaaggggaaagagcttaaatgtggaagcggtatcttcgtcacgaacgaagtccatacatggacagagcagtacaagtttcaagcggattcgcctaaaagactagccacagccatagcaggagcctgggaaaatggtgtctgcgggatccgctcgaccacccgcatggagaatcttctgtggaagcaaatcgctaacgagcttaactacatactctgggagaacaacataaaactaaccgtcgtagtaggcgacataatcggcgttctcgagcaaggcaaacgaactcttacgccgcaacccatggagctcaaatattcgtggaaaacgtgggggaaagcgaaaatcgtcactgccgaaacccagaactcaagtttcatcatcgacgggccaaacaccccggagtgtcccagcgccagccgggcttggaacgtatgggaagtcgaagattatggattcggcgtgtttaccacaaacatctggctcaagctccgcgaagtatacacacaactatgcgaccacaggctgatgtcagcggcggtcaaagacgaaagagccgtacacgcggacatgggatactggatagaatcacagaaaaacggatcatggaaattagaaaaagcctcactcatcgaggttaaaacgtgcacatggcccaagagtcatacactttggtctaacggcgtattagaaagcgacatgataataccaaaatcactagcaggaccgatcagccaacataaccatcgccccggctatcacacgcaaactgcaggcccttggcacctcggtaaactcgagctagatttcaattactgcgaaggcacaacggtggtgataaccgagaattgtggcacacgtggcccatccctccgtaccaccacagtaagcggaaagctcattcacgaatggtgctgtcgatcgtgcaccttgcccccactccggtacatgggagaggacggatgctggtacggtatggagatccgccccataagcgagaaggaagaaaacatggtcaagtcgctggtcagcgccgggagcggcaaagtcgacaattttaccatgggagtactttgcctagcgatactattcgaagaggtaatgaggggaaagttcggaaagaaacatatgatcgcgggagtatttttcaccttcgtcctacttctctcaggccaaatcacgtggcgtgacatggcacatacgttgatcatgataggaagcaatgcctccgaccgtatggggatgggggtgacttatctggccctcatcgctacatttaagatccagccgttcctggcactaggctttttccttcgtaaactgaccagtagagaaaaccttctactcggagtaggactagcaatggcaactaccctccaactgcccgaagacatcgaacaaatggccaatggcatcgcactggggcttatggctttgaaactgattacccagttcgagacgtaccaactctggaccgccctcatatcgttaacatgcagcaatacaatgttcactcttacggtagcatggcggaccgccaccctaattttagcaggagtcagccttcttcccgtgtgccaatcaagctcgatgcgaaagacagattggctgcccatggcagttgcagcaatgggggtaccacccttgccccttttcattttctccctcaaagatacactaaaacgacggtcttggcccctaaacgaaggggtcatggcagtagggctagtatccattctcgcttcgtctctactacgaaacgacgtcccgatggcgggcccacttgtcgccggtgggctactaatcgcatgctacgtaatcactggcacttccgccgacctaacagtagagaaagcggcggacatcacgtgggaagaggaagccgaacaaactggagtgtcacataacctaatgatcacagtagacgacgacggaaccatgcgtatcaaggacgacgaaaccgagaatatactgacagtattgctcaaaacggcgctgttaatagtgagcggcgtcttcccatacagcatcccagcgacgctcctcgtatggcacacatggcaaaagcagacacagagatccggcgtcctgtgggacgtcccaagcccaccggagacacaaaaagctgagctggaggaaggagtctacagaatcaaacaacagggaatcttcggcaaaacacaggtaggagtcggcgtgcaaaaggagggcgtcttccacactatgtggcacgtaacacggggcgcagtgcttacttataatgggaaacgcctagagcccaactgggcgagtgtgaagaaggacctgatctcgtacggcgggggatggagactatccgcgcagtggcaaaaaggcgaagaagtacaagtaatcgcggtggaaccaggcaaaaatcccaaaaacttccaaacaatgcctggcacctttcaaaccacaacgggggagatcggcgcgatcgcactcgatttcaagcccggcacatcagggtcacccataataaacagggagggcaaagttgtaggactgtatggaaacggggtggtaacaaagaacggaggatatgtgtccggcatcgcgcagaccaacgcggagcccgacggcccgacgcccgagctcgaggaagagatgttcaagaaacgtaacctaacaataatggatctacaccccggctccggcaagactagaaaatatttgcccgctatagtaagagaagcgatcaagcgacgactcagaactctgatattggcaccaacaagggtggttgcagcagaaatggaggaggcactcaagggactgcctatccgctaccaaacaacagccaccaagtcagaacacaccggacgggaaatcgtagacctgatgtgtcacgcaactttcacaatgcgactcctatcgccagttagagtacctaattacaacttaatcataatggacgaggcacacttcactgatccagcaagtatcgccgcaagagggtacatctccacgcgagtaggcatgggagaagcagcagccatattcatgacagctacaccgccgggaacagcagatgccttccctcagtccaatgcaccaattcaggacgaggaacgcgacatacccgaaaggagttggaactcaggtaacgagtggataacagattttgccggaaaaacagtctggttcgtgccgtctataaaggcgggaaacgatatagccaactgcctacgcaagaacggcaagaaagtcatacaattgtcccgaaaaacgttcgatacggaataccagaaaaccaaactcaacgattgggattttgtagttacaaccgatatatccgaaatgggtgcaaacttcaaagcggatcgcgtgatagacccccggcggtgcctaaagcccgtgatacttaccgatggacccgaacgcgtcatactggcgggtcccatgccggtcaccgcagcgagcgcagcccagcgccgcggccgagtgggcagaaacccacaaaaagaaaatgatcaatacatcttcacagggcagccactcaacaacgacgaagatcacgcccactggacagaagcgaagatgctgttggacaatatcaacacccctgaagggatcattccagcactcttcgaaccagagcgggaaaaatcagcggctatagacggagaataccgcctcaaaggggaatcccgcaagacgttcgtcgaactcatgaggcgcggcgaccttccggtatggctagcacacaaagtggccagtgaaggtatcaaatacacagatagaaaatggtgcttcgatgggcaaaggaacaaccaaatcctggaagaaaacatggacgtcgaaatatggaccaaagaaggggaaaagaaaaagctaagaccacgctggctagacgcacgaacttacagtgacccccttgcattaaaagagttcaaggactttgccgctggacgaaaatccatcgccctcgatctggttactgagataggccgcgtgccaagccatctagcgcatcggacacgaaacgcattggataacttagttatgttacacaccagtgaacacggaggcagagcatatagacacgcagttgaagaacttccagaaacgatggagacactgttacttctaggattaatgatactcttaaccggaggagccatgcttttcttaatcagtgggaaggggatcggcaagacgagcattggactaatatgcgtaatcgccagcagtggcatgctttggatggccgagattccactccaatggatcgcatcggcgatagtgctcgagttctttatgatggtccttcttatccccgaaccagagaagcagagaacaccacaagacaaccagctagcctacgtggtaatagggattctaactcttgcagccataatagcagccaacgaaatggggctgctagaaacaacaaaaagggacctgggcatgagtaaagaaccgggcgtagtctcacctacgtcctacctggacgtagacctgcacccagcatctgcatggactctatacgcagtagcgacgacggtaataaccccaatgctcaggcatacaatagagaacagcaccgcaaacgtttcccttgccgcaatcgcaaaccaagcagtggtactaatgggcctcgacaaagggtggcccatctcaaaaatggacctaggcgtgcccctactagcgttggggtgttacagccaggtgaatccactcacgttgacagcggccgtgttactcctcataacccactacgcaataataggccctggactacaagctaaggcaacgcgagaggcccagaaaagaacggccgcagggataatgaaaaacccgactgttgacgggataatgaccatagacctggaccccgtgatatacgacagcaagttcgaaaaacaattgggacaagtcatgctactggtactatgcgccgtccaactgctgctcatgagaacaagctgggccctctgtgaagcgcttaccctcgccacaggtccgataacaacgctatgggaagggagtccaggaaaattctggaacacgacaatagccgtttccatggcgaacatattccgcgggagctacctggcaggagccggactagccttttccattatgaaaagcgttgggactggtaaacggggaacaggcagccaaggggaaaccctcggggaaaaatggaagaagaaactaaaccagcttagcaggaaagagttcgacctttacaagaaaagcggaatcacggaagtcgaccgcaccgaagccaaagaaggcttaaaacgcggagagaccacccaccatgctgtctcaagagggtccgctaagctacagtggtttgtcgaacgaaacatggtcataccagagggtcgcgtcatcgacctcggttgcggcaggggcggatggagctactactgcgccggactaaagaaagtaacagaagtccgggggtataccaaaggaggaccgggccacgaagaaccggtaccaatgtcaacttacggatggaatatcgttaaacttatgagtggtaaagacgtcttctacctaccacccgagaaatgcgatacactactctgcgacattggtgaaagttcaccatcgccaacggtagaagagtcacgaacaatacgggtattgaaaatggttgaaccgtggctaaagaacaaccaattctgcatcaaagtcttgaacccctacatgcctacagtcatcgagcatctagaaagactccaacggaaacatgggggaatgctcgtccgaaatccgctgtccagaaacagcacgcacgaaatgtactggatatcaaatggcacgggaaatatagtagcaagcgtgaacatggtatcaagattactcttaaacaggtttactatgacccacagacgacccactatcgagaaagacgtagatctcggtgccgggacgagacatgtcaatgccgagcctgaaacaccgaacatggatgttataggggaacggataaaaagaataaaagaagaacacaatagcacctggcattacgacgacgaaaatccctacaaaacatgggcttaccacggatcgtacgaggtcaaagcaacgggaagcgcaagttccatgattaacggcgtggtaaaactactaactaagccctgggatgtcgttcccatggtaactcaaatggccatgaccgacacaaccccattcggccaacagagggtgtttaaagaaaaagtagacaccagaacaccccgatcgatgccgggaactcgccgagtcatgggcattacggcggaatggctgtggcgaactctaggacgtaacaagaaaccacggctctgtacgcgcgaggagtttactaagaaagtccgaaccaacgcagcgatgggcgccgtattcaccgaggagaaccaatgggattccgccaaagcagcagttgaggatgaagacttttggaaactcgtggaccgggaaagggagctccacaagctgggcaaatgtgggtcatgcgtctataacatgatggggaaacgcgagaagaaactcggggaatttggaaaggccaaaggctccagagcaatatggtatatgtggctaggggcgcgatacttagagtttgaagcactcggattcctaaatgaggaccattggttctcaagggaaaattcttatagcggggtcgaaggcgagggcctccacaaactcggctacatcctaagagacataagtaagatcccagggggtgccatgtacgcggacgacacagccggatgggacacccgaattacggaggacgacctgcacaatgaggagaaaataacacagcagatggacccagaacataggcagctcgcgaacgcaatcttcaaactaacctaccagaacaaagttgtaaaggtccaacggcctacgccaacaggcaccgtaatggacatcatctcgcgtaaagaccagcgcggaagcggacaggtgggaacctatgggctaaatactttcacaaacatggaggcccagctgatccgccaaatggaaggtgaaggagtgctatctaaagccgatctggaaaacccgcacttaccagagaagaaaataacgcagtggctggaaacaaagggtgtagagaggttgaagagaatggccataagtggagatgactgtgtagtcaaacccatcgatgaccgattcgcgaacgccctgttggctcttaatgatatggggaaggtgcgaaaagacataccgcagtggcagccatcgaagggatggcacgactggcaacaagtgcccttttgctcgcaccattttcacgaactcatcatgaaggacggccggaaattggtcgtaccgtgccgcccgcaggacgaactaattggcagagctcgtatatcgcaaggggctgggtggagcctccgcgagacagcgtgccttggaaaggcatacgcacaaatgtggtcactcatgtattttcaccgacgcgacttacgtctcgccagcaacgcaatatgctccgcagtacccgtacattgggtccccacaagtagaacaacctggtccattcacgcccaccatcaatggatgacgactgaagacatgctcacggtttggaacagagtctggatagaagacaatccatggatggaagacaagactcctgtgaccacttgggaaaacgtaccttacctagggaaacgcgaagaccaatggtgcgggagcctaataggcttaacgagccgagccacgtgggcgcagaacatcccaacagccatccagcaggtccgcagcctcataggtaatgaagaatttcttgactacatgccctcaatgaaacggtttagaaaagaagaggagagcgaaggagccatatggtga

SEQ ID NO: 25728 - RNA, 9873 nt, synthetic construct
  misc_feature 1..9873: note = derived and/or modified CDS sequence (opt11) from DENV-3__JQ922556__SS-prME
  source 1..9873: mol_type = other RNA
accagcctgtgtctcatgatgattctgcccgccgccctggcgttccacctcacttcccgggacggcgagccccggatgatcgttggtaaaaacgagcggggaaagtctctgctgttcaagaccgcatctgggatcaacatgtgcaccctcatcgcaatggatctgggcgaaatgtgcgacgacaccgtaacctataagtgccctcatatcaccgaggtggaacccgaggacatcgactgctggtgcaacctgaccagcacttgggtcacctacgggacctgcaaccaggccggcgagcatcggagagataagcggtccgtggccctcgctccacatgtaggtatgggcctcgacacccggacccagacgtggatgagcgccgagggcgcctggcgccaggtcgagaaggtggagacgtgggccttgcgccacccggggttcaccatcctcgcgctgttcctggcacactatatcggcacttccctcacccagaaagtggtgatcttcatcctacttatgctagtgacccccagcatgaccatgcggtgtgtaggagtgggcaatcgcgacttcgtcgaggggctgtccggggctacctgggtggacgtggtcctagaacatggcgggtgcgtgaccacgatggccaagaacaagccaactttagacattgagctgcagaagaccgaggcaacccagctggcgacgctccggaaactttgcatcgagggcaagatcaccaacatcaccacagactcgcgctgccccacgcagggcgaggcggtgctgccagaggaacaggaccagaactacgtctgcaagcacacctacgttgaccgggggtggggcaacggctgcggtctcttcgggaagggatccttagttacctgcgccaaatttcagtgcttggagcccatagagggaaaggtcgtccagtacgagaatctcaaatacaccgtgattatcacggtccataccggggaccaacatcaggtcgggaacgagacccagggggtcaccgcagagataacgccccaggccagcaccactgaggctatcctgcccgaatacggcacgttagggctagagtgcagcccccgcaccggcctggacttcaacgagatgatcctgctgacgatgaagaacaaggcctggatggtgcacagacagtggttcttcgacctgcccctgccatggacctccggcgccaccaccgagacacctacatggaaccgcaaggagctcctggtgaccttcaagaatgcccacgcgaagaagcaggaggtcgtagtgctggggtctcaggagggcgcgatgcacaccgccctaacgggggccaccgagatccagaactccggcgggacctccatctttgccggccacttaaaatgtcggttgaagatggacaagctcgagctgaagggcatgagctacgccatgtgcacaaatacgttcgtcctgaagaaagaggtttccgaaacccagcacggcaccatcctcatcaaagttgagtacaagggggaggatgctccgtgtaagatccccttctcaaccgaggatgggcagggtaaggcccacaacggtcgcctaatcacggccaaccccgtcgttacaaagaaagaggagcccgtgaacatcgaggccgagccgcctttcggtgagagcaatatcgtcattgggatcggggacaacgcgctgaagatcaactggtacaagaaaggctccagcatcggtaagatgttcgaggcccctgcacggggcgcccgccggatggccatcctgggcgacaccgcgtgggtattcgggtccgtcggcggggtcctcaacagcttaggcaagatggtgcaccagatcttcgggtccgcctacaccgcgctattcagcggcgtgtcctgggtcatgaagatcggcatcggggtgctcctgacgtggattggcctgaacagcaagaacacctctatgagcttctcgtgcatcgccatcgggatcataaccctctatctgggcgccgtggtacaggcagacatgggatgcgtgatcaactggaagggcaaggagcttaagtgcggcagcggtatctttgtgaccaacgaggtccacacgtggaccgaacagtacaagttccaggccgactcccccaagcgcctcgccaccgccatcgccggcgcgtgggagaacggggtgtgtgggatacgttcgaccacgcggatggaaaatctgctgtggaagcagatagccaacgagctcaactacatcctgtgggagaacaacatcaaactgaccgtcgtcgtgggagacaccatcggcgttctcgagcaaggcaagcgcacactgacgccccagccgatggagctcaagtactcctggaaaacctggggaaaggccaagatagtcaccgccgagacccagaacagctcctttatcatcgacggccccagcacgcccgagtgcccgtccgcgtcacgggcttggaatgtgtgggaagtggaggactatgggttcggcgttttcacaaccaacatctggctcaaactgcgagaagtttacacccagatgtgcgaccaccggctgatgtcccccgccgtgaaagacgaaagagccgtccacgccgacatgggctactggatcgagagtcagaaaaatgggagctggaagctggagaaggcgtccctgatcgaggtgaagacctgcacgtggcccaagagtcacaccctgtggtccaatggcgtgctcgagtccgacatgatcatcccgaagtccctcgcggggcccatcagccagcataactaccggcccggctaccatacccaaacggccgggccctggcacttaggcaagctcgaactggacttcaattactgtgagggcacgaccgttgtgattaccgagaactgtgggacccgcggtcccagtctgcggacaaccaccgtgagtgggaagctcatccacgagtggtgctgccgcagctgcaccttgccaccgctgcggtatatgggcgaggacgggtgctggtacggcatggagatccgccccatcagcgagaaggaggagaacatggtcaaatcactcgtgagcgccggctccggtaaggtggacaacttcacgatgggagtcctgtgtttggccatcctattcgaggaggtgatgcgggggaagttcggcaagaagcacatgatcgcgggtgtgttcttcaccttcgtcctgctgctcagcggccagatcacgtggcgcgatatggctcataccctgatcatgatcggatccaacgcatcagaccgaatgggcatgggcgtgacgtacctggccctcatcgccaccttcaagattcagcctttcctggcgctggggttcttcctccgcaagctgaccagccgggagaacctgttactgggcgtgggcctggcaatggccacgacgctccagctgcccgaggatatcgaacagatggccaacgggatcgctttaggcctcatggctttcaagctgatcactcagttcgaaacctaccagctgtggacagccctcatctccttaacgtgcagcaacaccattttcaccctgaccgtggcctggcgtactgccaccctcatcctggcgggggtctccttactccccgtctgccagagctccagcatgcgcaagacagactggctgcccatgaccgtggccgccatgggcgtgcctccgctgcctctcttcattttctccctgaaggatacgctgaagcgccgaagctggcctctcaacgagggggttatggccgtgggcctggtctcaatcctggccagctccctcctacggaacgatgtccccatggcgggaccactggtggccggaggcctcttaatcgcctgctatgtggggaccggcacttcggcggacctgaccgtcgagcaggctgcggacgtgacgtgggaagaggaggccgagcaaaccggggtgtcccacaacttaatgattaccgttgacgacgatggtaccatgcgcatcaaggatgacgagacggaaaatatacttacggtgcttttaaagaccgccctcctgatagtgagcggcatcttcccctattccattcccgccaccctcctggtttggcacacctggcagaagcagacgcagcggagcggggtgctgtgggacgtgcctagcccgcccgagacacagaaggccgagctagaggagggcgtctaccgcatcaagcagcaggggattctgggcaagacccaagtgggggtgggcgtccagaaggagggcgtgttccacaccatgtggcacgtgacgcgcggagcggttctcacccataacggcaagcgcttagagcccaactgggcaagcgtgaagaaggacctgatctcctatgggggtgggtggaggctgagccctcagtggcaaaagggggaggaggtgcaggtcatcaccgtcgagcctgggaagaaccccaagaacttccagactatgccggggacgttccagaccacgaccggagaaataggggccattgcgctcgacttcaaacccggcactagcggttcgcccatcatcaaccgcgaggggaaggtggtcggactgtacgggaacggcgtggtcacgaagaacgggggatacgtcagcggtatcgcgcagaccaatgccgaaccggacgggccgacccccgagttagaggaggagatgttcaagaaacggaacctgacgatcatggacctccaccccggcagtgggaagacccgcaagtacctgcccgccatcgtgcgagaggccatcaaccgccggctccgcactctcatcctggccccgactcgggtagtcgctgccgagatggaggaggccctgaagggcctccccatccgatatcaaacgacggctacaaaaagtgaacacaccgggcgggagatcgtggacttgatgtgccatgccacgtttaccatgcgcctgttgtcccccgtgcgtgtccccaactacaacttgataatcatggacgaagcccacttcaccgacccggcgagcatcgccgcccgcggctacatctccacccgtgtcggcatgggagaggccgcggcaatcttcatgacggcaacgccgcccggcaccgccgacgcgttcccccagtcaaacgccccaatccaggatgaggagcgcgacatccctgaacgatcctggaacagcgggaacgagtggattaccgactttgccggcaagaccgtgtggttcgtcccctccatcaaagccgggaacgacatcgccaactgcctgcgaaagaacggcaagaaggtgatccagttatcacgcaagaccttcgagaccgagtaccagaaaacaaagctgaacgattgggatttcgtgggcacgaccgacatctccgagatgggggcgaacttcaaggccgaccgggtcatcgacccccgccggtgcctaaaaccgggcatcctaaccgatggacccgagggcgtgatcctggccgggcccatgcccgtgaccgcagccagcgcggcccagcgccgcggacgcgtcggccggaacccgcagaaggagaatgaccagtacatcttcactgggcagcccctgaataacgatgaagaccacgcccactggactgaggccaagatgctcctagacaacatcaacacccccgaggggatcatcccggccctattcgagccggagcgcgagaaatccgcggctatcgacggggagtaccgactcaaaggagagagcagaaaaaccttcgtggagctcatgaggcgcggcgacctccccgtttggctcgcccataaggtggcctccgagggcataaaatacaccgaccggaagtggtgcttcgacggacagcgcaacaaccagatcctggaagaaaacatggacgttgagatctggacaaaggaaggtgaaaagatcaagctccgcccccgctggctcgacgcgcggacctattcggacccgctggcactgaaggagttcaaggacttcgccgccggcagaaagtccatcgccctcgaccttgtcaccgaaatcgggagagtccccagccacctggcgcatcggacccgtaacgctctcgacaacctcgtgatgctgcacacgagcgagcacggcggccgggcctaccgacacgccgtcgaagagttgcctgaaactatggagaccctgttgctactgggactgatgatcctcttgacaggcggggccatgttgtttcttatctccggcaaggggatcggcaaaacgagcattggcctgatctgcgtaatagcgagcagcggcatgctgtggatggcagagattccacttcagtggatcgcttccgctatcgtgctggagttcttcatgatggtcctgctcataccggagcccgagaagcagcggacgccccaggacaatcagctagcatacgtggtgattggcatcctgaccctcgcggccattatagccgccaacgagatggggctcctggagaccacgaagcgcgacctcggcgtcagcaaggaaccgggtgtggtgagcccgaccagctacctggacgtcgacctgcaccccgcctccgcatggaccctctacgccgtggcaaccacggtgatcacccccatgctccggcacaccattgagaacagcacggcgaacgtatcactggcggccatcgcaaaccaggctgtggtgcttatgggcctagacaagggctggcccatctcgaagatggatctgggtgtcccgctcctggcgctgggctgctactcccaggtgaatcccttgacgctgaccgcggccgttctgctccttattacccactatgccatcataggacccggcctgcaggcaaaggcaacccgcgaggcgcaaaagaggacggccgccggcatcatgaagaaccccaccgttgacggtataatcaccatcgatctcgacccggtgatctacgatagcaaattcgagaagcagctgggccaggttatgctgttagtcctgtgcgccgtgcagctgctccttatgcgaacctcctgggctctatgtgaggcgctcacactggccaccgggccgataacgactctgtgggagggcagccctgggaagttctggaatacaaccatcgctgtgagtatggccaacattttccggggctcgtacctcgcaggcgctggtctggccttctccatcatgaagtccgtcggcaccggcaagcgcggcactggaagccagggcgagacgctgggcgagaaatggaaaaagaagctcaaccagctgagccggaaagagttcgacttgtacaaaaagtccgggatcaccgaggtggataggaccgaggccaaggagggtctcaaacgcggggagctgacacaccacgcggtgtcccgcggcagcgcgaagctacagtggttcgtcgagagaaacatggtgatccccgaggggcgcgtgatagacctcggctgcggtcgcggcgggtggtcctactattgtgccgggctgaagaaggtcaccgaggtccgcgggtacacgaagggcggcccgggccacgaagaacccgtgcctatgagcacctacggatggaacatcgtcaagctcatgtcgggcaaggacgtgttctacctcccgcccgaaaagtgcgacacgctgctttgcgacattggggaatcctcccccagtcccaccgtagaggaatcccggacgatccgcgtcctgaagatggtggagccgtggctcaagaacaaccaattttgcatcaaggtgctgaacccttacatgcccgcggtgatcgagcacctggaacgtctccagcggaagcacggcggcatgcttgtacgcaacccccttagccggaactccacccacgagatgtattggatctctaacgggaccggtaacatcgtgtccagcgtgaacatggtgtcccgcctccttctgaaccgcttcaccatgacgcaccgtcgcccgactatcgagaaggacgtggacctcggggccggcacccgccacgtcaacgccgagcccgagaccccgaacatggacgttatcggcgagcggattaagcgaataaaggaggaacacaatagcacgtggcattatgacgatgagaacccctacaagacctgggcgtaccacggatcctatgaagtgaaggccacaggaagcggctcctccatgatcaatggagtcgtgaaattgttgaccaagccgtgggacgttgttcccatggtgacgcagatggccatgacggacaccacccccttcgggcagcagcgggtcttcaaagagaaggtggacacccgcacgccccggccgatgcctggcacgcgtaaggtaatggagatcaccgcagagtggctctggcggacgttaggtcgcaacaaacggccccgcctgtgcactcgtgaggagttcaccaagaaggtccgcaccaacgccgcaatgggtgcagtattcacggaggagaaccagtgggacagcgccaaggccgcggtggaggatgaggagttctggaagctggtcgaccgagagcgggaactgcacaagctgggcaagtgcgggtcctgtgtgtacaacatgatgggcgggcgagagaaaaagctcggagagttcgggaaggccaaggggagccgggccatctggtacatgtggctgggggcccgatacttagagttcgaggcgctcgggtttctgaatgaagaccactggttctcccgcgagaatagttactccggcgtggagggggaaggcctgcacaagctcggctacatcctacgcgacatatccaagatccccgggggcgcgatgtacgccgacgacaccgccgggtgggacacgagaatcaccgaggacgatctgcacaacgaggagaagattacgcagcaaatggacccggagcaccgcctcctagccaatgccatcttcaagctgacctaccagaacaaggtagtgaaggtgcaacggcccacccccaccggcaccgtaatggacataatttcccgcaaggaccaacgggggagcggccaggtcggcacatacggtcttaacaccttcaccaacatggaggcgcaactggtgcgccagatggagggggagggcgtactgtccaaggcagacctcgagaacccacacctccccgaaaagaagatcacccagtggctcgaaacgaagggcgttgagcggcttaagcgcatggccatcagcggggatgactgcgtggtaaagccaattgacgaccggttcgccaacgcccttctagcgctcaacgacatgggaaaggtgcgcaaggatatcccgcagtggcaaccgtcgaaaggctggcacgactggcagcaggtcccgttttgctcccaccacttccacgagctgatcatgaaggacgggcggaagctggtcgtgccctgccgcccacaggatgagctcatcggccgggccagaatctcccaaggggccggctggagcctgcgtgagaccgcgtgcctgggaaaggcttatgcgcagatgtggagcctcatgtacttccaccgccgggacctgcgcctggcctctaacgccatctgttccgcagtgcccgttcactgggttacaaccagccgcacaacgtggagcatacacgcacatcaccaatggatgaccacagaggacatgctcacagtgtggaatcgggtatggattgaggacaacccttggatggaggacaaaacgcccgtgaccacgtgggagaacgtgccatatctgggtaaacgcgaggaccagtggtgcggctccttgatcgggcttactagccgggccacctgggcacaaaacattccgaccgccatccagcaggtccgcagcctgatcggaaacgaggagttcctggattacatgccctcaatgaagcggttccgcaaagaagaagaatccgagggagccatctggtga

SEQ ID NO: 25729 - RNA, 9873 nt, synthetic construct
  misc_feature 1..9873: note = derived and/or modified CDS sequence (opt11) from DENV-3__JQ922557__SS-prME
  source 1..9873: mol_type = other RNA
accagcctgtgcctcatgatgatcctgcccgccgccctggcgttccatctcaccagccgtgacggggagccgcggatgatagtgggtaagaacgagagaggcaagtctctactattcaaaaccgcctccgggatcaatatgtgtaccctcatcgccatggatctgggggagatgtgcgacgacacagtgacttataagtgcccccacatcaccgaggtggagccagaggacatcgattgctggtgcaacctgactagcacgtgggtgacgtatgggacctgcaaccaagccggcgaacacaggcgcgacaaacggtccgtggctctcgcgccccacgtgggcatgggactggacacccgaacccaaacctggatgtcagccgagggcgcctggagacaggtcgaaaaagtggagacgtgggccctaaggcacccggggttcaccattctcgctctgttcttagcccactacatcgggaccagtctcacccagaaggtggtcatctttatcctgttaatgctcgtcaccccctcgatgaccatgcggtgcgtcggggtggggaaccgcgacttcgtcgagcggctgagcggcgccacctgggtggacgtggtcctggagcacggggggtgcgtgacaacgatggccaagaacaaacccaccctcgacatcgaactgcagaagaccgaagccacccagctggcgactctccgcaagttgtgcatcgaggggaagatcaccaacatcaccaccgactctcggtgccctacgcagggcgaggccgtgcttccggaggagcaggaccagaactacgtctgcaaacacacctacgtggaccgcggctgggggaacggctgcggtctgttcggcaaggggtccctggtgacctgtgccaagttccagtgcctggagcccattgagggcaaggtcgtgcagtacgaaaaccttaagtacactgtgattatcacggtccacacaggtgaccagcatcaggtgggaaacgagacccaaggggtcaccgccgagattacgccgcaggcctctaccaccgaagcgatcctgcccgagtacgggaccctgggtctagagtgctccccgcggaccgggttagacttcaacgagatgatcctgctcacgatgaagaacaaggcctggatggtacatcgccaatggtttttcgacctgcccctgccctggaccagcggtgccaccaccgagactcccacctggaaccgcaaagagctcttagttaccttcaagaacgcacacgccaagaagcaggaagtcgtggtgctgggctcccaagagggagctatgcataccgccctgacgggcgccaccgagatccagaacagcgggggtaccagcatcttcgccggacatctgaagtgccgtctgaagatggacaaattagagctgaagggtatgagctacgccatgtgtaccaatacgttcgtccttaagaaggaggtctccgagactcagcatggcaccatcctcatcaaggtggagtacaagggagaggacgcgccctgcaagattccttttagcaccgaagatggccaaggcaaagctcacaacggccggctgatcacggccaaccccgtcgtgaccaaaaaggaggagcccgtcaacatcgaagccgagccgccattcggcgaatcgaacatcgtaattgggatcggcgacaatgcgctgaagatcaactggtacaagaaggggtcgagcatcggcaagatgttcgaggccaccgcccgcggggcccggcgcatggccatcctgggggacacggcgtgggatttcggaagtgtcgggggtgtgctcaactcgctggggaagatggtgcaccaaatattcgggtccgcctatacggccctattcagtggtgtttcatgggtgatgaagataggcattggagtcctcctcacctggataggactgaacagcaagaacacgtccatgagcttctcctgtatcgccatcggcatcatcacactctacctgggggccgttgtgcaggcagacatgggctgcgtcatcaactggaagggtaaggagctgaaatgcggcagcgggatctttgtgacgaacgaggtccacacttggactgagcagtataaattccaggccgattctcccaaacgcctcgccactgctattgccggggcgtgggagaacggcgtttgcggaatccgatcaactacgcgcatggagaatctactgtggaagcagatagccaacgagctgaactatatcttatgggaaaacaacatcaagctgaccgtggtcgtcggagacaccatcggggtgctcgagcagggcaagcggacactgacgccccaaccgatggagctaaagtactcctggaagacctggggaaaggccaagattgttaccgcagagactcaaaactcaagtttcataatcgacgggcccaacacccccgagtgcccgagcgcgtcccgagcctggaacgtctgggaggtggaggactacggcttcggcgtgttcaccacaaacatctggctaaagctgcgggaggtctatacacagatgtgcgaccaccgactgatgtctgccgccgtgaaggacgagcgggccgtgcacgcggacatgggctactggatcgagagccagaagaacggctcctggaagctagagaaggccagcctaatcgaggtcaaaacatgcacctggccgaagtcccacaccttgtggagcaacggggtgcttgagagtgacatgatcatccccaagagcctggcaggccccatctcccagcacaactacagaccggggtaccacacccagacggccggcccgtggcatctgggaaaattagagctagatttcaactactgcgagggtactacggtggtcatcaccgagaactgcggcacgcgcgggcccagcctgcgcaccactaccgtgtccggcaagctcatccatgagtggtgctgccgaagctgtacgctgcccccgctgcgctacatgggcgaggacggctgctggtacggaatggaaatcaggcccatctccgagaaggaggagaacatggtcaagtccctcgtctccgcgggtaagagcaagcgcgacaactccaccatgggcgtactgtgcctggctattctctttgaggaagtgatgcgggggaagttcggcaagaagcacatgatcgccggcgtcttcttcactttcgtgctgctgttaagcggacagatcacttggagggacatggcccatacgctaattatgatcgggtcgaacgccagtgaccggatgggcatgggcgtaacgtatctggcactcattgctaccttcaagatccagccctttctggccctggggttctttctccgtaaactgaccagccgggaaaacctgatgctcggcgtcgggctggccatggccactacactacagctccccgaggacatcgaacagatggcgaacggtatcgcgctcggactgatggccctcaagctgatcacgcagttcgagacttaccagttatggacggccctcatcagtttgacctgcagcaacaccatcttcacgctgacggtagcctggcgcacggcaaccctcattctcgccggggtgtccctgcttcctgtctgccagagcagcagcatgcggaagaccgactggctgccaatgactgtagccgccatgggcgtcccacccctgcccctcttcatcttctccctgaaggataccctgaagcggcggtcgtggcccctcaacgagggggtgatggccgtgggcctggtatccatcctggcgagctccctgctccggaacgacgtccccatggccgggccgctggtggccggaggcttgctgatcgcctgctacgtcattaccggtaccagcgccgacctgacggtggagaaggcggcggacgtgacctgggaagaggaagctgagcaaaccggcgtgtcgcacaacttactgataaccgtggacgacaacgggaccatgcgcatcaaagacgacgagacggaaatcatattaaccgtgctattgaaaaccgcactacagatcgtcagcggcatcttcccttacagcattcccgccaccctcttagtttggcacacttggcagaagcagacccaacggagcggggtactgtgggatgtgcccagtccccctgagacccagaaagcggagctcgaggagggcgtgtacagaatcaagcagcaaggcatcctggggaagacccaggtgggcgtcggggtgcagaaggagggcgttttccacactatgtggcacgtaacccgtggggctgtgctgacccacaacggcaagcgcctcgagccgaactgggcgagcgtgaaaaaggacctgatttcttatggtggtggttggcgtctgagcgcccagtggcagaagggggaggaggtgcaggtgatcgcagtggagcctggcaagaaccccaaaaactttcaaacgatgccagggacgttccagaccaccaccggcgagatcggcgctatagccctcgacttcaagcccgggacatcaggctcacccataatcaaccgcgaggggaaggtcgtgggcctctatggcaacggggttgtcaccaagaacggggattacttaagcgggattgcccaaaccaacgccgagccgtacggcccctcccccgaccttgaggaggagatgtttaagaagcggaaactcaccatcatggacctgcaccccgggagcggccagacgctcaaatatctcccggcgatcgtaagggacgccatcaagcggcgcttgcgcatactgatcctcgccccaaccagggtagtcgccgccgagatggaagaggcgctaaagggcctgccgatacggtaccagacaaccgccacaaagtccgaacacaccgggcgcgaaatcgtggacctcatgtgccacgcgactttcacgatgcgcctgttgtcgccggtgcgcgttcccaattacaacctcatcatcatggatgaggcgcatttcacggaccccgcctcgatcgcggccagaggctacatcagcactcgcgttgggatgggcgaggccgccgcgatcttcatgaccgcgaccccgcccgggactgccgacgcctttccgcagtccaacgctcccatccaggacgccgaacgcgacatccccgagcggagctggaattccggcaacgagtggatcaccgacttcgccggcaagaccgtgtggttcgtacccagcatcaaagccgggaacgacattgccaactgcctgcgcaaaaacggcaagaaggtgatccagctttccaggaaaaccttcgagacagaataccagaagaccaagctcaacgactgggatttcgtggtaaccaccgatatctccgagatgggggccaacttcaaagctgaccgagttattgacccccggcgctgcctgaagcccgtgattctgacggacggccctaagcgggtcattctcgccgggcccatgccggacaccgccgccagtgccgcccagagacggggcagagtcggccggaacccccagaaggagaacgaccagtacattttccccgggcagcccctgaacaccgacgaggaccacgcacactggccggagactaagctgctcatggacctgttcaccacgcccgaaggcatcctgcccagccacttcgacccccacggagagaatttcccggagatctccggcgagtaccgactcaagggggagagccgtaaaaccttcgtagaactgatgcgccggggggacctgcccgtttggctggcccataaggtagcgtcagaaggcatcaagtataccgacaggaagtggtgcttcgacgggcagagaaacaaccagatcctggaggagaacatggacgtggagatatggaccaaggagggcgagaaaaaaaaactgcgtccacgatggctcgacgcgcgaacgtatagtgacccgttagccctgaaggaatttaaggacttcgccgccggccgcaaaagcatcgcccttgacttggtcaccgagatcggccgggtgccctcccatttagcccaccgcacccggaacgcgctcgacaacttagtcatgctgcacaccagcgaacacggcgggcgcgcgtacaggcatgccgtggaagagctcccagaaacgatggaaacgttactgctcctgggcctaatgatactcctgaccgggggcgccatgctttttctcatctccgggaaaggcatcggcaagaccagcatcgggctgatttgcgtgatcgcgtccagtggcatgctatggatggccgaaatccctctacagtggatcgccagcgctatagtcctggagttttttatgatggtactgctcattccggagcctgagaagcagcgcacgccacaggacaaccaactggcctacgtggtcatcgggatcctgacacttgcggccattatcgccgccaacgagatggggctgttagaaactaccaagagagatctcggcatgagcaaggaacccggcgtggtctccccgacgagctacctggacgtcgactcccatcccgcttctgcctggaccttatacgccgttgccaccacagtaataacccccatgctccgccacaccatcgagaactccaccgctaacgtaagcctagcggcaatcgccaaccaggccgtagtgctgatgggcctcgacaaagggtggcccatctccaagatggatctgggcgtgcctcttctcgccctggggtgctacagccaagttaaccccctgaccctcacggcggctgtgctgttgttaattactcactacgccatcatcggccccgggctgcaggcgaaggctacgcgggaggcgcagaagcgcaccgccgccggcattatgaagaaccccaccgtcgacgggatcataaccatcgacctagacccggttatctatgattccaagtttgagaagcagctcggccaggtgatgctactcgtcctctgcgccgtgcagctcctgctcatgcggacttcgtgggcgctttgcgaggccctgacccttgccacgggccccatgaccaccttgtgggaagggagtcccggcaagatctggaacacaacgatcgccgtgagcatggctaacattttccgcggaagctacctggcgggggcaggcctcgcgttctccatcatgaagtcagtcgggaccggaaagcgggggaccggctcccagggcgagaccttaggggaaaagtggaaaaagaagttaaaccagctctctcggaaggagttcgacctgtacaagaagtccggcataaccgaagttgacagaacggaagctaaggaggggctgaaaagaggtgagacgacccaccacgccgtcagtcgcgggtccgcaaagctgcagtggtttgtcgagaggaacatggttatccccgaaggccgggtcatcgacttggggtgcgggcgcggaggttggagctactactgcgctggtttaaagaaggtcaccgaggtccgcgggtacacgaagggcggcccggggcacgaggagcccgtgcccatgtccacctacgggtggaacatcgtcaagctcatgagcgggaaggacgtgttttatcttcccccggagaagtgtgacaccctgctgtgcgacattggcgagtccagcccctcccccacagtggaagagagccgcactatccgcgtcctcaagatggtggagccctggctgaagaacaaccagttctgcatcaaggtcttaaacccgtatatgccagccgtgatagaacacctcgagagattgcagcgaaagcatgggggcatgttggtgcggaatcccctctcccgcaacagcacgcacgagatgcactggatttccaacggcacagggaacatcgtgagctccgtcaacatggttagcagattacttctcaaccggttcaccatgacgcaccggaggccgaccatcgagaaggatgttgatctgggcgccgggacgaggcacgtcaacgccgagcccgagacccccaatatggatgtgatcggcgagcgcatcaagcggatcaaggaggagcacaacagcacgtggcactacgacgacgagaacccctacaagacctgggcgtatcacggtagctacgaggtaaaggcgaccgggtcagcatccagcatgatcaacggcgtagtgaagctgctcaccaagccgtgggacgtggtgccgatggtgacgcagatggcgatgactgacaccacccccttcgggcagcagcgcgtttttaaggagaaggtggacacgcggacgccgcggccgatgcccggcacccggaaggttatggagatcaccgccgaatggttgtggcgcaccctgggccgaaacaagcgccctcgtctctgcacccgcgaggaattcaccaagaaggtcaggacaaacgcggccatgggcgccgtgttcacggaggagaatcagtgggactcagccaaagctgccgtcgaagacgaggaattctggaagctggtcgaccgggaacgcgaactgcacaagttaggcaaatgtgggagctgcgtgtacaacatgatgggcaaacgggagaagaagctgggggagtttggcaaagcaaaggggtcccgcgccatctggtacatgtggctaggcgcccggtacctcgagttcgaagcgctgggctttctgaatgaagaccattggttcagcagagagaactcctacagcggggtggagggcgagggacttcacaaactcggttacattctacgcgacatttccaagatccccgggggcgccatgtacgccgacgacaccgctggttgggacacacgcatcaccgaggacgatctccacaacgaagagaagattacgcagcagatggatccggagcaccgccttctggccaacgccatcttcaagctaacgtaccagaacaaggtcgtgaaggtgcaacgccctactcccaccgggaccgtcatggacattatcagccggaaggaccagcgaggttccggacaggtgggtacgtacggcctgaacaccttcaccaatatggaggcccagcttgtgcggcagatggaaggggaaggagtcctcagcaaagccgacttggaaaacccccacctccccgagaagaaaatcacccagtggcttgagacgaagggggtggagcgcctgaagcggatggcgatctccggcgacgactgtgttgtcaaaccaatcgatgaccgcttcgccaatgcgcttctcgccctgaacgacatgggaaaggtgcggaaagatatcccccagtggcagcccagcaagggctggcacgactggcaacaggtccccttctgctcccatcacttccacgagctaattatgaaggacggccgcaagttggtcgtaccctgccggccccaggacgagctaatcgggcgcgcgaggattagccaaggcgccgggtggtccctgcgcgagaccgcgtgccttgggaaagcttacgcccagatgtggagcctgatgtactttcaccgccgcgacctgcgcctcgccagcaatgccatctgctcagcggtacccgtccactgggtgccgaccagccgtacaacgtggtccatccacgcacaccaccagtggatgaccaccgaggacatgctcaccgtgtggaaccgcgtctggatagaagacaacccctggatggaggacaagacgcccgtgaccacttgggagaaccctccctacttagggaaacgggaggaccagtggtgcggcagcatcatcggcctctccagccgtgccacctgggcacagaacatccccacggccatacagcaggtgcggtcactgatcggtaacgaggagttcctggactatatgccctcgatgaagcgcttccggaaggaggaggagtccgagggtgcaatctggtga

SEQ ID NO: 25730 - RNA, 9873 nt, synthetic construct
  misc_feature 1..9873: note = derived and/or modified CDS sequence (opt11) from DENV-3__JQ922555__SS-prME
  source 1..9873: mol_type = other RNA
acaagtctgtgcctgatgatgatcctacccgccgccttagcgttccacctgaccagccgggacggcgagccacggatgatcgtggggaaaaacgagcggggcaagagcctgctgttcaagaccgcctcagggatcaatatgtgcactttaatcgccatggacctgggggaaatgtgcgacgataccgtgacctacaagtgcccccacatcaccgaggtggagcccgaagacatcgactgttggtgtaacctgacctccacctgggtgacctacgggacctgcaaccaggccggcgagcaccgacgcgacaagcgctccgtggctttagcgccccacgtggggatggggctcgacacccgcacccaaacatggatgagcgccgaaggcgcctggcgccaagtggagaaggtggagacgtgggccttacgccatcccgggttcaccatcctcgcgctgttcctggctcactacatcggcacatccctcactcagaaggttgtgatcttcatattattgatgttagtgacgcccagcatgacgatgaggtgcgtgggggtcgggaatcgtgacttcgtcgagggcctgtccggggctacctgggtggacgttgtactggagcacggcgggtgtgtgaccacgatggccaaaaataagcccactctcgacatcgaactgcagaaaaccgaggctacacagctggcgaccctccgaaagttgtgcatcgagggcaagatcaccaacatcaccaccgacagccgctgtcccacgcagggcgaggcggtgctgccagaggagcaggaccagaactacgtttgcaagcacacctacgtggaccgggggtggggcaacgggtgcggcctcttcggcaagggctccttggtgacgtgcgctaagttccagtgcctggaatctatcgagggtaaggtcgtgcagtacgagaacctcaagtacaccgttatcataacggttcacaccggggaccaacaccaagttggcaacgagacgcagggggtcaccgcggagataacgcctcaagcctccaccgcggaggccatcctgcccgagtatggcaccctggggctcgaatgtagcccccgtacgggcttggactttaacgaaatgatccttctcaccatgaagaacaaggcatggatggggcaccggcaaatgctgttcgatctgccgacgccctggacctccggaactaccacagagaccagtgcctggaaccgcaaggagccgttcgtcaccttcaagaatgcacacacgaagaaacaggaggtggtcgtgctcggctcacaggaaggggcgatgcacacggctctgacaggcgccaccgagatccagaacagcgggggcacctccatcttcgccggtcatctaaagtgcaggctcaaaatggacaagctggagctaaaagggatgagttacgccatgtgcacaaataccttcgtcctcaagaaggaggtctcggagacccagcacggcacgatcctcgtgaaagtagagtacaagggggaggatgcgccctgcaagattccgttctctacggaagacggccagggaaaggcccacaacgggcgcctgatcaccgccaaccccgtggtgaccaagaaggaggagcctgtgaacatcgaagccgagcccccgttcggcgagagcaacatcgtcattgggatcggcgacaaggccctcaagatcaactggtatcggaaggggtcctcaatcggcaagatgtttgaggccacctcccgtggtgcccgccgaatggccatcctaggggacacggcctgggacttcggcagcgtcgggggagttctgaactccttagggaagatggtgcatcagatcttcggaagcgcgtacaccgctctgttctccggagtaagctgggtgatgaagatcgggatcggcgtcctgctgacctggatcggtctcaattccaaaaacacctctatgtccttcagctgcatcgccatcggcattatcacactgtacctgggggccgtggtacaggccgacatgggctgcgtcataaactggaagggcaaggagctcaaatgcgggtccggcattttcgtgacaaacgaagtgcacacctggacggagcagtataagttccaggccgatagcccgaagcgcctggccacggctatcgcgggcgcctgggagaacggcgtctgcggcatacggtccaccacgcgtatggagaacctgctctggaagcagatcgccaacgagctcaactacatcctgtgggagaataatatcaagctcacagtggtggtaggcgacacgataggcgttctggagcagggcaaacggaccctgactccacagcccatggagctcaagtacagctggaaaacttggggaaaggcgaagatcgtgacggccgagacgcagaactccagcttcatcatcgatgggccgaatacccccgagtgccccagcgcctcccgcgcgtggaacgtctgggaggtggaggactacggcttcggcgtgttcacgaccaacatctggctgaagctgcgggaggtctacacgcagatctgcgaccaccgtctcatgagcgccgccgtaaaagatgagcgggccgtgcacgccgacatggggtattggatcgagagccagaaaaatggcagctggaaactggagaaggcgagcctgatcgaggtcaagaccagcacctggcccaaatcacacaccctctggagcaacggggttcaggaatccgatatgatcatccccaaatcgctggccggaccgattagtcaacacaactaccggccggggtatcacacgcagaccgccggcccctggcacctgggcaagctcgagctggacttcaactactgcgaggggaccaccgtggtcatcacggaaaactgcgggacgcgggggcccagcctgcgcacaaccacggtctcagggaaacttatccacgagtggtgctgccggagctgcaccctgccgcccctccgatacatgggagaggatggttgctggtacgggatggagatccggccgatctctgaaaaggaggagaatatggttaagtcgctcgcatctgccggcagcggcaaagtcgacaacttcactatgggggtgctgtgtctggcgatactcttcgaggaagtgatgcgcggcaagttcgggaagaagcacatgatcgctggcgtcctgttcactttcgtgctgctcttgtccggccagatcacgtggcgggacatggccaggaccctaataatgattgggtccaacgccagcgaccggatgggcatgggtgtgacatacctcgcgcttatcgcgaccttcaagattcagcccttcctggccctcggcttcttcctccgcaagctgacgtcccgggagaatctgctgctgggcgtcggcctcgccatggccaccaccttgcaactgcccgaggacatcgagcaaatggcgaacggcatagccctcggtttgatggccctgaagctaatcacacagttcgagacttaccaactgtggaccgcattagtgtctctgacctgctccaacaccattttcacgctaaccgtggcctggcgcaccgcgaccctgatccttgcaggcgtcagcctgttgcccgtgtgccaaagttcgtccatgcgcaagactgactggctcccgatgaccgttgccgccatgggggtaccgccgctgcccctgtttatcttctcactcaaagacaccctgaaaagacgctcctggccgcttaatgagggcgtgatggccgtcggcctggtgagcatcctggcgtccagccttctccggaatggagtgcccatggccggccccttggtcgccgggggcctgctcatagcgtgctacgtgatcaccggtacttccgccgatctgaccgtcgaaaaagcggccgacgtcacctgggaggaagaggcagaacaaacgggcgtgagccacaacctaatgatcaccgtggacgacgacgggacgatgcgcataaaggacgacgaaacggagaacattttaaccgtccttctgaagaccgcactcctgatcgtgtctgggatcttcccctacagcatcccggccacgcttctcgtatggcacacctggcagaagcaaacccagcgatccggcgtgttgtgggacgtaccctcgccgcccgagactcagaaggcggagctcgaggagggcgtgtaccgaatcaagcaacaaggcatttttggcaaaacgcaggtcggcgtgggggtgcagaaggaaggggtcttccataccatgtggcatgtaacccggggcgccgtgctcacccacaacggaaagcgcttggagccgaactgggccagtgttaagaaggacctcatctcatacggtgggggctggcggctgagcgcccagtggcagaaaggcgaagaggtccaggtaatcgccgtcgaacccgggaagaatcccaagaattttcaaactatgcccggcacctttcagaccacctccggtgagatcggcgccatcgccctggacttcaagccgggaacgagcggctcccccataatcaaccgggaggggaaagtcgtggggctgtacgggaacggagtcgtgaccaagaacggcggctacgtgtcgggcatcgcccaaaccaatgccgaacctgacgggccgacccccgagttggaggaggagatgtttaagaagcggaacctgacgatcatggatctgcatcccgggagtggcaagacccgcaaatacctgcccgcgatcgtccgggaagccatcaagcgccggctccgcaccttgatcctggccccgacccgggtggtagcggccgagatggaggaggcactcaaggggctgcccatacgctaccagaccactgccaccaagagcgaacatacgggccgggagattgttgacctgatgtgccacgccacttttactatgcgcctcctgagccccgtcagggtgcccaactacaacctgattatcatggacgaggcccattttaccgacccggccagcatcgccgcccgcggctacatctccacccgcgtcgggatgggcgaggcagccgccatcttcatgactgctacgccacccgggaccgccgacgccttcccccagagcaacgctccgattcaggacgaggaacgggacatccccgaacgcagttggaacagcggcaatgagtggattactgactttgcgggtaagacggtgtggtttgtgccctcaatcaaagccggcaacgatattgccaactgcttacggaaaaacggcaagaaggtgatccagctgtctcgtaaaaccttcgacaccgagtaccagaagacgaaactgaacgactgggacttcgtcgttacgaccgacatctccgaaatgggcgccaacttcaaagccgacagggtcattgacccccgccggtgcctcaagccggttatcctaaccgacgggcccgaacgcgtcatcctggcggggcctatgcccgttactgctgcgagcgctgctcagcggcgaggccgggtcgggcgcaatccgcagaaggaaaacgaccagtacatcttcaccggccagccgctcaataacgacgaggaccatgctcactggacggatgccaagatgctgctggagaacatcaacaccccggagggcatcatccccgccctcttcgagcccgagagagagaaatccgcagggttagacggagagtaccgcctgaagggtgagagccgaaagacctttgtggagctcatgcgtcggggcgacttacccgtctggcttgcgcacaaggtggccagcgagggcatcctctacactgaccgcaagtggtgcttcgatgggcagcggaacaaccagatcctggaggagaatatggacgtcgagatctggacgaaggagggcgagaagaagaagctaaggccccgatggctcgacgcccggacctactccgacccgctggccctgaaggagttcaaggacttcgccgcggggcgcaagtcaattgcccttgacctggtgaccgagatcggccgggtgtccagccacctggcccaccgcacacggaacgcactcgacaacaagatgatgttacacacgtccgagtacgggggccgagcctaccggcacgcggtcgaggagttaccggaaaccatggagaccttactgttgctcggactgatgatcctgctaactggaggggccatgctctttctgatcagcggcaaaggcatcgggaagacatctatcggactcatttgtgtgatcgcctcttccgggatgttgtggatggcagacgtccccctgcaatggatcgcgagtgcgatcgtcctggagttctttatgatggtgctgctaatccctgagccggagaagcaaagaacgccccaggacaaccagttagcctatgttgtcatcgggatcctgacactggccgcaataatcgccgctaacgagatgggcctcctggaaaccacgaagcgggaccttggggtgagcaaggagcccggcgtggtcagccccacttcctacttggatgtggacctccacccggccagcgcatggaccttgtatgccgtggcgaccaccgtcatcgccccgatgctccgccacaccatagaaaactccactgcgaatgtgagcatggccgccatcgccaatcaagcagtcgtcctgatggggctggacaagggctggcccatctcgaaaatggacctcggagtgcccctgctggccctcgggtgctatttttacgtgaacccgctcactctgacggccgcagtcttcctcctggtgacccactatgctatcattgggcccggactgcaggcaaaagccacgcgggaggcccacaagaagactgcagctggcatcatgaacccgccacccggagacgggatcatgacgatagacctcgaccccgtgatatatgacagcaaattcgagaaacaactcggacaggtaatgctcctcgtgctttgtgctgtgcagctgctgctgatgcgaacctcctgggccctgtgcgaggcgctcacgctggctaccgggcccacaaccaccctgtgggagggctcgcccgggaagttctggaacaccacgatcgcagtctctatggccaacatcttccgaggctcctacctcgccggcgccgggctggcgttcagtatcatgaagtccgtgggcacgggtaagcgcggcaccggaagccagggtgaaaccctgggcgagaaatggaagaaaaagctcaaccagctgtcccgaaaggagttcgacctgtacaaaaagtccgggattaccgaggtggacagaacggaggccaaggagggcctcaagcgcggggagatcacccatcatgctgtctcgcgcggcagcgccaagctgcagtggttcgtggaacgcaatatggttatccccgaggggcgcgtgattgacctgggctgcggcaagggcggttggtcctactactgcgccggcctcaagaaggtgaccgaggtgcggggctacaccaaaggagggcccggccacgaggaacctgtccccatgtccacgtacgggtggaacatcgtgaaacttatgtccggaaaggacgttttctacctgccgcccgaaaagtgtgacaccctcctgtgcgacatcggggagagctccccctcgccgacagtcgaggagtcccgcaccataagagttctaaagatggtggagccgtggctgaagaacaaccagttctgcatcaaggtcctgaacccctacatgcctacggtgatagagcacctggagaggttgcagcgcaaacacggcggcatgctcgttcggaatcccctgagcaggaactcgcggaacgagatgtactggataagcaatgggaccggcaacatcgtctccagcgttaatatggtatcccgcctgctccttaatcggttcaccatgactcaccgccgtccaacgatcgagaaggacgtagacctgggggcgggcacgcgccatgtaaacgccgagcccgagacccccaacatggatgttatcggcgaacgcattaagcgcatcaaagaggagcacaactccacctggcactacgacgacgagaacccctacaagacgtgggcctaccacggctcatacgaggtcaaggcaacaggttcggcaagcagtatgataaacggggtggtcaagctcctgaccaagccctgggatgtggtgcctatggtcacccaaatggccatgacggacactacccctttcggccagcaacgtgtgttcaaggagaaggtggacaccagaaccccgcggctgatgccacgcacccggaaggtaatggagatcaccgccgagtggctctggcgcaccctggggcggaacaagcgccctcgtctgtgcacgagagaggaatttaccaagaaggtgcgccccatcgccgctatgggcgcggtctttacccagcgcgaccagtgggacagcgccaaagccgctgtcgaggacgaagagttctggaagccggtggaccgtgagtgcaactcccaccagctcgggaagtgtggcagctgcgtgtacaatatgatgggcaagcgggagaagaagctgggggagttcggcaaagccaaggggtcccgtgcgatctggtacatgtggctgggcgcacggtacttggagttcgaggccctcgggttcctcaatgaagaccattggttcagccgcgagaactcctacagcggcgtcgagggggaagggcttcacaaacttggctacatcctgcgcgacatctccaagatccccgggggagccatgtacgcagacgacaccgcggggtgggacacgcgcaacaccgaggacgacctccacatgaaggagaagatcacccagcagatggggcccgggcacagccggctggccaatgccatctttaagctaacctatcagaacaaagtggtcaaggtgcagcgccccacgccgaccgggacggtgatggacatcataagtcgtaaagatcagaggggcagcggtcaagtgggcacctacggactcaacacctttacgaacatggaggcccagctggttcggcagatggagggtgagggcgtgttgtccaaggccgatctcgagaacccccacctattggagaagaagatcacccagtggctcgagaccaagggggtcgagcgcctcaagcgtatggcgatcagcggagacgactgtgtagtaaagcccatcgacgaccgcttcgccaatgccttgctcgcgctcaatgacatggggaaggtgcggaaggacatcccccagtggcagccgtccaagggctggcatgactggcagcaggtacccttctgctcccaccatttccacgaactgatcatgaaggacggccgcaagctggtggtgccttgccggcctcaggacgaattaatcggtcgcgcccggatcagccagggcgcggggtggagcctgcgggagaccgcctgcctaggcaaggcctacgcccagatgtggagcttgatgtacttccaccgccgcgacctgcgcctcgcatccaacgccatttgcagcgccgtcccggtgcactgggttcctacgagccggaccacctggtcgatacacgcccaccaccagtggatgactacggaggacatgctcaccgtgtggaatcgcgtgtggatcgaggacaacccctggatggaggacaagaccccagtgacaacgtgggagaacgtcccgtacctggggaagcgggaagaccagtggtgcggctcactaatcggccttaccagccgtgccacgtgggcgcaaaacatccctaccgcgattcagcaagtccggtcgctgatcggcaacgaggagttcttagactacatgcccagcatgaaacgctttcggaaggaggaggagtccgaaggcgccatctggtga

SEQ ID NO: 25731 - RNA, 9873 nt, synthetic construct
  misc_feature 1..9873: note = derived and/or modified CDS sequence (opt11) from DENV-3__GU131903__SS-prME
  source 1..9873: mol_type = other RNA
accagcctttgcctgatgatgatgctgcccgccaccctggccttccacctcaccagccgggacggcgaacctcggatgatcgtggggaagaacgagcgcggcaagtcccttctgttcaaaacggcttcggggatcaacatgtgcaccctaatcgccatggacctgggcgagatgtgcgacgacacggtaacttacaagtgccccctgatcgcggaggtggagcccgaggacatcgactgctggtgcaacctcacgagcacgtgggtaacctacgggacatgcaaccaagccggcgagcaccgccgcgacaaacggtccgtggccctcgctccccacgtgggcatggggctggacacccgcacacagacctggatgagcgcggagggagcctggcgccaggtggagaaggtcgagacgtgggccctccgccaccctgggttcacaatcctagcgctgttcctcgcccattacatcggtacctccctgacgcaaaaggtcgtaatctttatcctgctcatgctggtcacgccttctatgaccatgcggtgcgtgggggtgggcaaccgagacttcgtcgagggcctgtccggggccacctgggtggacgtcgtcctcgagcacggcgggtgcgtgactacaatggccaagagcaagcccaccctggacatcgagctgcagaagacagaggccacccagctcgcgacgctgcggaagctatgcatcgagggcaagatcaccaacatcaccaccgactcacgctgccccacgcagggcgaggccaccctcccggaggagcaagaccagaactacgtgtgcaagcacacctacgtggaccgggggtggggcaacggatgcggcctatttgggaagggcagcctcgtgacctgcgctaaattccagtgcttggagcccatcgaaggcaaggtcgtccagcacgagaacctgaagtatacggtgatcatcactgtgcacaccggggaccagcaccaggtcggcaacgatactcagggtgtaacggtcgagatcacgccacaggcctccaccgtggaggctgtccttcccgagtatggaaccctcgggctggagtgcagcccgcgcaccggccttgacttcaacgagatgatcctcttaacgatgaagaacaaggcgtggatggtccaccggcagtggttcttcgacctgcccctcccctggacctccggcgccacgaccgagacgcctacctggaaccgaaaggagctgctggtgaccttcaagaacgctcatgccaagaagcaggaagtggttgtcctcgggtctcaggagggagccatgcacacagcgctcaccggggcaaccgagatccagaattccggggggaccagcatcttcgccggccacctgaagtgtcggctcaagatggacaagctggagctgaagggcatgtcctatgcaatgtgcctcaacaccttcgtgctgaaaaaggaggtcagcgagacccaacacgggaccattctgatcaaggtggagtacaagggggaggacgccccgtgcaagatacccttcagcaccgaagacggccagggcaaggcgcactctggtcgcctgatcaccgcgaatcccgtggtcaccaaaaaggaggagcccgtgaacatcgaggccgagccgccattcggggagtcaaacatagtgatcggcatcggggataaggccctcaagattaactggtacaaaaagggctccagcatcgggaagatgttcgaggctactgcccggggcgccagacggatggctatcctgggcgacaccgcctgggacttcgggtccgtcggcggggtgctgaacagcctcggcaagatggtgcaccagatcttcggtagcgcgtacaccgccctgttcagcggcgtctcctggatcatgaagatcggcatcggggtgctgctcacctggattggattgaacagcaagaacacgtccatgagcttctcctgcatcgtgatcgggataatcactctctacctcggcgcggtcgtacaagccgacatggggtgcgtgatcaactggaagggcaaggagctgaagtgtgggagcggtatcttcgtcaccaacgaggtgcacacgtggaccgagcagtacaagttccaggccgactcacccaagcgcctggcgaccgcaatcgccggcgcctgggagaacggggtttgcggcatccgcagcaccacgcggatggagaacctcctgtggaagcagattgccaacgagcttaactacattctctgggagaacaacatcaagctcaccgttgtggtgggcgacatcattggcgtcctcgagcagggcaagcgcaccctcacgccccagccgatggaactgaagtactcctggaagacgtgggggaaggcgaagatagtgaccgccgagacccagaatagctccttcatcattgacggacccaacacccccgagtgccccaacgccagccgcgcctggaacgtgtgggaggtcgaggactacgggttcggcgtgttcacgaccaacatctggctgaagctccgtgaggtgtacacccagtcgtgtgaccaccggctgatgtcggccgccatcaaggacgagcgcgccgtacacgcggacatgggttattggatcgagagccagaagaacgggtcctggaaactcgagaaggccagcttcatagaagtgaagacgtgcacctggccgaagtcccacacgctctggagcaacggcgtgctggagtccgacatgatcatccccaagtcactggcgggacccatttcacaacacaaccaccggccgggataccacactcagacggccgggccctggcacctcggcaagctggagttagacttcaactattgcgagggcaccaccgtagtgatcaccgagaactgcggtacgcgcggcccatccctgcggaccacaaccgtgtcggggaagctgatccacgagtggtgctgccgcagctgcaccctgcccccgctacggtacatgggcgaggacgggtgctggtacgggatggagatccgccccatcaacgagaaagaggagaacatggtcaaaagtttggttagcgccggatccgggaaggtggacaacttcacaatgggcgtcttatgtctcgccatcctgttcgaggaggtcatgcgggggaagttcggaaaaaagcacatgatcgccggcgtgctgttcacgttcgtcctcctgctgagcggccagatcacctggcgcgacatggcgcacaccctcatcatgatcggttccaacgccagcgaccggatggggatgggcgtaacctacctggccctgatcgccacgttcaagatacagcccttcctggccctgggattcttcctgcgcaagttaaccagccgggagaaccttctgctcggcgtcggcctggcgatggccaccaccctgcagctccccgaggacatcgagcaaatggcgaacggtatcgccctgggcctgatgacgctcaagctgatcacacagttcgagacctaccagctgtggaccgcactcgtctccctgacgtgctcaaacaccatcttcaccctgaccgtggcctggcgcaccgccacactcattctggccggggtctccttactcccgctgtgccagagctccagcatgcggaaaacggactggctgcccatgaccgtggccgcgatgggcgtcccgcccctgcctctgttcatcttctccctgaaagacacgcccaagcgcagaagctggcccctcaacgagggggttatggccgtgggcctggtgtccatcctggccagctccttactgcggaacgatgtccccatggccggcccgctggtggccgggggcctcttaatcgcatgctacgttatcaccgggaccagcgccgacctcaccgtcgagaaggccgcggacgtcacgtgggaggaagaggccgaacagacgggcgtgtctcataacctcatgatcaccgtagatgacgacgggaccatgcgcatcaaggatgatgagaccgagaacatcctaactgtgttactaaagaccgctctgctgattgtgagtggcatcttcccatactccattccagccaccctcctggtctggcacacctggcaaaagcagacgcaacgtagcggcgtactgtgggacgtgccctctccgcccgagacccagaaggctgagctcgaagaaggtgtttaccgcatcaagcaacagggcatcttcgggaagacccaggtgggggtaggggtccagaaggagggcgtgttccacaccatgtggcacgtgacgcggggcgccgtcctgacccacaatgggaaacgcctggagcccaactgggcctctgtgaagaaggacctcatctcctacggggggggttggcgcctgaatgcgcagtggcagaagggggaggaggtacaagtcatcgccgtggagcccggcaagaacccgaaaaatttccagactatgccgggcatctttcagacaacgaccggggaaatcggcgctattgccctggacttcaagcccgggaccagcggatctccgatcatcaatcgcgagggtaaggtagtggggttgtacggcaatggggtcgtaaccaagaacggcgggtacgtctcgggcattgcgcagacgaatgcggagccagacggtcccacgcccgagctggaggaggagatgttcaagaagcggaacctgaccatcatggacctccacccggggtcaggcaagactaggaagtatctccccgccatcgtgcgggaggccatcaagagacggctacgcacgctgatactcgcgccaacccgagtggtggcggcagagatggaggaagctctgaagggtctgcccatccgctaccagaccaccgcaacgaagtccgagcacactggccgggagatcgtggacctcatgtgccacgccaccttcaccatgcgcttgctgagcccggtgcgggtccccaactataacctcgttatcatggacgaggcgcacttcacggaccccgcctccatcgccgcccgcgggtacatcagcacccgggtggggatgggcgaggccgcggccattttcatgaccgccacgccgcctgggacggccgaggcgttcccacagagcaatgcccccattcaggacgaggagagagacattcccgagcgctcttggaactccggaaacgagtggatcaccgacttcgtcgggaaaacagtgtggttcgtgccaagcatcaaggcgggcaacgacatcgccaactgcctgcggaaaaacgggaagaaggtcatacagttgtcccgtaagaccttcgacaccgagtatcagaagacccgactcaacgactgggacttcgtggtgactaccgacatcagcgagatgggcgctaacttcaaggccgaccgcgtcatcgacccccggcgctgtctgaaacccgttattctgacggacggccccgagcgggtgatcctcgcagggccgatgccagtcaccgccgcctccgccgcgcaacgacgaggccgcgtggggcggaaccctcagaaggagaacgaccagtacatcttcaccggccaacccttaaacaacgacgaggatcacgcgcactggaccgaggccaagatgctgctcgacaacatcaataccccggaggggatcatccccgccctgttcgagcccgagcgagagaagagcgctgccatcgacggtgagtaccggctcaagggcgagtcccgcaagacattcgtcgagctcatgagaaggggggacctgcctgtgtggttggcccacaaggtagccagcgagggcatcaagtacaccgaccggaagtggtgtttcgacggggagaggaacaaccaaatactcgaggagaacatggatgtggagatatggacgaaggagggcgagcggaagaagctccgtccgcgctggctggacgcacggacctactccgaccccttagcgctgaaggagttcaaggacttcgccgcgggcagaaagagcatcgccttggatctcgtgacggagattgggcgggttccctcccacttggcccaccgcacccggaacgcgctggacaacctcgtaatgctgcacaccagcgagcacggcggtcgcgcgtaccggcacgccgtggaagagttgccggagacaatggagacgctcctgctcctcggcctgatgatcctcctcactggcggcgccatgctgttcctgatcagcggcaagggcatcggcaagacctccatcggactcatctgcgtgattgtcagcagcggcatgctgtggatggccgacgtgcccctacagtggatcgctagcgccatcgtgctcgagttcttcatgatggtcctactgatccccgagcccgaaaagcagcgaaccccgcaggacaaccagctcgcctacgtggtgatcgggattctgacactggctgccatcgtcgcggctaacgaaatgggcttgctggagaccaccaaacgggatctgggcatgtccaaggagcccggggtggtgagccccacctcctaccttgatgtcgacctgcaccccgccagcgcgtggacgctgtatgccgttgcgactacggtgattacccccatgctccgccacacgatagagaactccacagcaaacgtcagcctggccgccatcgcgaaccaggccgtcgtgctgatgggcctagacaaggggtggcccatctccaagatggacctgggcgtccccctgttggcactgggatgctacagtcaagtgaacccccttaccctcaccgccgccgttctgctgctcgtcacgcactacgcgatcatcggcccgggcctgcaggccaaagccacccgggaggcccagaagcgcaccgccgcggggatcatgaagaacccaacagtggacggaattatgactatcgacctggatcccgtgatctatgattccaaatttgagaagcagctcgggcaggtaatgctgttggtgctctgcgcagtgcagctgctgctcatgcgtaccagctgggccttgtgcgaggccctgaccctggccactggccccatcacgaccctgtgggagggctctccggggaagttctggaataccaccatcgcggtgagcatggccaacatctttcgcggctcttacctggccggggccggcctcgctttcagcatcatgaagtcggttgggactggacggcgcggcactgggagccaaggcgagaccctcggagagaagtggaagaagaagcttaaccagctcagccggaaggagttcgacttatacaagaagtccggcatcaccgaggtggaccgcaccgaagccaaggagggcctcaagcggggcgagacgacccaccacgccgtgagccgcggctccgccaagctccagtggttcgtggagcggaacatggtgatccccgaggggagagtcatcgacctgggctgcgggcgcggcgggtggagctactactgcgctggcctcaagaaggtcaccgaagttcggggctacaccaaggcggggcccggccacgaggaacccgtcccgatgtccacgtatgggtggaatatcgtcaaactcatgagcgggaaagacgttttttacctgccgcccgagaagtgcgacaccctcctgtgcgatatcggcgagtccagccccagtccgaccgtcgaggagagccgcaccatccgggtgctcaagatggtggagccctggctgcggaacaaccagttctgcatcaaggttctcaacccctacatggccaccggcatcgagcaccttgagcggctgcagcgcaagtatggcggtatgctggtgcggaaccccctctctcgcaacagcacccacgagatggactggatcagtaacggcaccgggaacatcgtgagctccgtcaacatggtgagccggctgctgttgaaccgcttcaccatgacgcatcggagaccgaccatcgagaaggatgtcgacctgggcgccggcacccggcacgtgaacgcggaaccagagaccccgaacatggacgtaatcggagagcgtatcaagcgaataaaggaggagcattctagcacgtggcattatgacgatgagaacccctataagacctgggcctaccacggctcctacgaagttaaagctaccgggtcggccagctccatgatcaacggggtggtaaagctactaaccaagccgtgggacgtcgtgcccatggtgacccagatggccatgaccgacaccactcctttcggccagcagcgcgtctttaaggagaaggtggacacgcggactccgcgccccatgcccgggaccagaaaagtgatggagatcaccgcggagtggctgtggcgcacactgggccgcaacaagaaaccccggctctgcacccgcgaggaattcactaagaaagtccggaccaacgccgcgatgggggccgttttcacggaagagaaccagtgggacagcgcccgggccgcggtcgaggatgaggagttttggaagctggtcgatcgggagcgcgagctgcataagctcggcaagtgcgggtcctgtgtgtacaatatgatgggcaagcgggagaagaagctcggggagttcggcaaggccaagggaagccgcgccatctggtacatgtggctgggggccagatacctcgaattcgaggccctgggcttcctgaacgaagaccactggttctcccgcgaaaatagttactccggggtggagggcgaggggctccacaagctcggctatatcctgcgggacatcagcaagatcccgggcggggcgatgtacgccgacgacacagccggctgggacactcgcatcaccgaggacgacctccacaacgaggagaagattacgcagcagatggacccagagcataggcagctggccaacgcaatattcaaactgacgtaccagaataaggtcgtcaaggtgcagcgccccacccccaaggggactgtcatggacataatcagtcggaaggaccagcgcggtagcggccaggtggggacatatggcctcaacacgttcaccaatatggaggcgcagttagttcggcaaatggagggggaaggcgtcctgtccaaagccgacctcgagaacccccacctcctggaaaaaaagataacccagtggctcgagaccaagggggtggaacggctgaagcggatggccatcagcggcgacgactgtgtggtcaagcccatcgacgaccgcttcgccaatgcgctcctggcgctcaacgacatgggcaaggtgagaaaagacattccccaatggcagccctccaaggggtggcacgactggcagcaggtcccgttttgtagccaccacttccacgagctgatcatgaaagacggccgaaagctcgtcgtcccctgtcgcccccaggatgagctgatcggacgggccaggatttcccagggcgcgggctggagcctgaaggagacggcttgcctcggcaaggcctacgcgcaaatgtggagcctgatgtacttccaccgacgcgatctgcggctcgcctcaaacgcaatctgctccgccgtacctgtccactggatccctacatcacgcaccacatggagcatccacgcgcaccaccagtggatgacgaccgaggacatgctgaccgtgtggaaccgggtgtggatcgaggacaacccctggatggaggacaaaacccccgtcacaacatgggaagacgtgccctacctgggcaagcgcgaggaccaatggtgcgggtccctcatcggtttaaccagccgggccacgtgggcccagaacatcctgacggccattcagcaagtgcgctctctcataggggacgaggagttcctcgattacatgccgagcatgaaacggttccgcaaggaggaggagagtgagggcgccatctggtga

SEQ ID NO: 25732 - RNA, 9873 nt, synthetic construct
  misc_feature 1..9873: note = derived and/or modified CDS sequence (opt11) from DENV-3__GU131904__SS-prME
  source 1..9873: mol_type = other RNA
accagcctttgcctcatgatgatgctgcccgccaccctggcgttccacctcacaagccgtgacggggagcctcggatgatcgtggggaagaacgagcgcggcaaaagcctgctgttcaaaaccgcgagcgggatcaatatgtgcaccctcatcgccatggacttgggcgagatgtgcgacgacaccgtgacctacaagtgccccctgatcgcagaggtggagcccgaggacatcgactgctggtgcaacctcacctcgacctgggtgacctacgggacatgcaaccaggcgggcgagcaccggcgcgacaagcgttccgtggccctggcgccccacgtgggcatggggttagacacccgcacccagacgtggatgagcgccgagggggcctggcggcaggtggagaaggttgagacctgggccctccgccacccggggttcaccatcctggcactgttcctcgcccactacataggcacatctctgacccagaaagtggtgatattcatcctgctcatgctggtcacgcccagcatgaccatgcggtgcgtgggggtcggcaaccgcgacttcgtagagggcctgtccggggcaacctgggtggatgtggtccttgagcacggcgggtgcgtgaccacgatggccaagtcgaagcccaccctggacattgagctgcagaagaccgaggccacccagctcgcgacgctgcggaagctgtgcatcgagggcaagatcaccaacatcaccaccgactcccgctgccccacgcagggagaggcaaccctcccggaggagcaggaccagaactacgtgtgcaagcacacctacgtagaccggggctggggcaacggttgcggtctgtttgggaaaggcagccttgtgacctgtgccaaattccagtgcctcgagcccatcgagggtaaagtggtccaatacgagaacttaaagtatacggtgataatcaccgtgcacaccggggaccagcaccaggtcggcaacgacacccagggggtgacggtcgagatcacaccccaggcctccactgtggaggctgtgctgcccgagtatggtaccctcggactggagtgcagcccgcgcaccggcctggatttcaacgagatgatcctcctgactatgaaaaataaagcgtggatggtccaccggcagtggttcttcgatctgcccctcccctggacctccggcgccaccaccgagacgcccacctggaaccgcaaggaactgctggtgacctttaaaaacgcccatgccaagaagcaggaagtagtcgtgttagggagccaggagggcgccatgcacactgcgctgacgggggccaccgagatacagaattccggcgggaccagcatcttcgccggccacctgaagtgccgcctaaagatggacaagctggaactgaagggcatgagctacgcaatgtgcctcaacaccttcgtgctgaagaaggaggtcagcgagacgcagcacgggaccatcctgatcaaagtagagtacaagggagaggacgccccgtgcaagatccccttcagcaccgaggacgggcagggcaaggcgcacaacggccgcctgatcaccgccaaccccgtggtcacgaagaaggaggagcccgttaacatcgaggccgagccgccctttggggagtccaacatagttatcggcatcggcgacaaggccctcaagataaactggtacaagaagggtagctccatcggcaagatgttcgaggcgaccgcccggggcgctcggcggatggcgatcctgggcgacaccgcttgggacttcgggagcgtcggcggggtgctgaactcgctcggcaagatggtgcaccagattttcgggagcgcgtacaccgccctgttctccggcgtctcttggatcatgaagataggcattggggtgctcctcacgtggatcggcctgaactccaagaacacctcgatgtccttctcgtgcatcgtcatcgggatcatcacactgtacctcggcgccgtggtacaggccgacatggggtgcgtgatcaactggaagggcaaggagctgaagtgcggctccggtatcttcgtcaccaatgaggtgcacacctggaccgagcagtacaaattccaggccgactcccccaaacggctggcgaccgccatcgccggcgcctgggagaatggggtgtgcggcatccgctccaccacacggatggagaacctcctgtggaagcagatcgccaacgaactgaactacatcctctgggaaaacagcatcaagctgaccgtcgtcgtgggggacatcatcggcgtcctggaacaggggaagcgcaccctaaccccccagccgatggagctgaagtactcctggaagacgtgggggaaggcgaagattgtgaccgccgagacccagaactcaagtttcataatcgacggccccaacactcccgagtgtcccagcgcgtcgcgggcctggaacgtctgggaagtcgaggactacgggtttggcgtgttcaccaccaacatatggctgaagctccgcgaggtgtacacccagtcatgcgaccatagactgatgagcgcggccatcaaggacgagcgcgccgtccatgccgatatgggctattggatcgagtcccagaagaacgggagctggaaactagaaaaggcctcctttatcgaggtgaagacttgcacctggccgaagagccacacgctctggtccaacggcgttctggagagcgacatgatcatccccaagtccctggcggggcctatcagccagcacaatcaccggcccggctaccacacccagactgccgggccctggcacctcggcaagctggagctggacttcaactactgcgagggcaccacggtcgtgatcaccgagaactgcgggacccgcggcccgtccctccggacaacgaccgtgagcgggaagctcatccacgagtggtgctgccgctcctgcaccttacccccgctccggtatatgggcgaggacgggtgttggtacggcatggagatccgccctatcaacgagaaggaggagaacatggtgaagagcctggtctccgccggcagcgggaaggtggacaactttaccatgggcgtgctgtgcctcgccatcctgttcgaggaggtaatgagagggaagttcggaaagaaacacatgatcgccggggtgctgttcacgttcgtcctcctgctgtccggccagatcacctggcgcgacatggctcacaccttgatcatgatcggcagcaacgccagcgatcggatggggatgggcgtgacctacctggccctgatagcgacgtttaagatccagccctttctcgccctggggttcttcctgcgcaagctcacatcccgggagaaccttctgctcggcgtggggctggcgatggccaccaccctgcagctccccgaggacatcgagcagatggccaacgggatagccctgggcttaatgacgctcaagctgatcacccagttcgagacctaccaactatggaccgcgctcgtctctctgacctgctccaataccatttttaccctgactgtggcctggcgcacagccaccctcattctagccggggtctctttgctcccactgtgccagtccagctccatgagaaagaccgattggctgcccatgacggtcgccgcgatgggtgtgccacccttaccgctgttcattttcagcctgaaagacacgcccaagcggcgctcctggccactcaacgagggggtcatggccgtggggctggtgagcatccttgcctcctccttgctgcggaacgacgtgcccatggccgggccgctagtggccgggggcctcctgatcgcgtgctacgtgatcacggggacctccgccgacctgaccgtagagaaggccgccgatgtgacgtgggaggaggaggccgagcagaccggggtgtcgcacaacctcatgatcaccgtcgacgacgacgggaccatgcgcatcaaggatgacgagaccgagaacatcctgaccgtgctgctcaagaccgcactgttgattgtatccggcatctttccctatagcatccccgccaccctcctggtctggcacacctggcagaagcagacgcagcggtccggggttctgtgggacgtgcccagcccgcccgagacccagaaggcagagctcgaggagggggtctaccgcatcaagcagcagggcatcttcgggaaaacccaggtgggtgttggggtccagaaggagggcgtatttcacaccatgtggcacgtgactcggggagccgtactgacccacaacggtaagcgcctggagccgaactgggcctccgtgaaaaaagacctaatcagctacggcgggggctggcgtctgagcgcgcagtggcagaagggggaggaggtgcaggtaatagccgtggagcccggcaagaacccgaagaatttccagaccatgccaggcatctttcagaccacgaccggggagatcggcgccatcgccctggacttcaagcccgggacctccggctcaccgatcatcaaccgcgagggcaaggtggtcggactgtacggcaacggggtggttactaagaatggcgggtacgtctccggcatcgcgcagacgaacgccgaacccgacggccccacccccgaactcgaagaggaaatgttcaagaagcgtaatctcaccatcatggatctccacccggggagcggcaaaacacgcaagtacctcccagccatcgtacgagaagccatcaagcgcaggctgcgcactctgatcctcgcccccacccgggtggtcgcagccgagatggaggaggccctgaaagggctgcccatccgctaccaaactaccgctaccaagtccgagcacaccggcagggaaattgtcgaccttatgtgccacgccaccttcaccatgcgcctgctcagcccggtgcgggtccccaactacaatttggtgatcatggacgaggcgcacttcacggaccccgcctccatcgcagcccgcgggtacatcagcacccgagtgggcatgggcgaggccgcggccatcttcatgacggccacgccgcccggaacggccgaggccttcccccagtccaacgcccccatccaggatgaggaacgcgacatacccgagcgtagctggaactccgggaacgaatggattaccgacttcgtcgggaagaccgtgtggttcgtgcccagcattaaggccggtaacgacatcgccaactgcctgcgaaagaacgggaagaaggtcatacagctgagccgcaagaccttcgacacagagtaccagaagacgcgactcaacgactgggacttcgtggtgaccaccgacattagcgagatgggcgccaacttcaaggcggaccgcgtcatcgaccccagacgctgtctgaagcccgtgatcctgacggatggccctgaacgggtgattctcgcggggcccatgcccgtcactgccgcctccgccgcgcagcgacggggccgcgttgggaggaacccccagaaggagaacgaccaatatatcttcacgggccagcccctgaacaacgacgaggaccacgcccactggaccgaggccaagatgctgcttgacaatatcaataccccggagggtatcatccccgccctgttcgagcccgagcgcgagaagtccgccgctatcgacggggagtacaggcttaagggcgagtcccgcaagacgttcgtagagctcatgcggcgcggggatctgcccgtgtggctcgcacacaaggtggccagcgagggcatcaagtacaccgacaggaagtggtgcttcgacggggagcgcaacaaccaaatcctcgaggagaacatggacgtagagatatggaccaaggagggcgagcggaagaagctgcgtccgcgctggctggacgccagaacctactccgacccactcgcgctaaaagagttcaaagacttcgccgccggccgcaagagcatcgccctggacctcgtgacagaaatcgggcgggtgccctctcacctggcccaccgcacccggaacgcgctggacaacctcgtcatgctgcatacctccgagcatggagggagggcctaccggcacgccgttgaggagctgccggagactatggagacgcttctgctgctcggcctgatgattttgctcaccgggggcgccatgttgttcctgatcagcggcaaggggatcggcaaaacctccatagggctcatctgcgtgatcgcgagctccggcatgctgtggatggcagacgtgcctctgcagtggattgccagtgccatcgtgctcgaattcttcatgatggttctgctgatccccgagccagaaaagcagcgcaccccgcaggacaaccagctcgcctacgtcgtgatcgggatcctgacgctggccgctatcgtggccgccaacgagatgggcctcctcgagaccaccaaaagagacctgggtatgtccaaggagcccggggtcgtgagccccaccagttatctcgacgtggacctccaccccgccagcgcctggacgctatacgcggtcgccaccaccgtgatcacccccatgctccgccatacgatagaaaattccaccgcaaacgtgagcctggccgcgatcgccaaccaggccgtcgtgctgatgggcctcgacaaggggtggccgatctctaagatggacctgggcgtgccactgctcgccctgggttgctacagccaggtcaaccccctgaccctcaccgccgcggtcctgctactcgtaacgcactacgccatcatcggcccgggccttcaggccaaggccacccgggaggcccaaaagcgcaccgcggccggaatcatgaagaatccgaccgtcgacggcattatgacgatcgatctggaccccgtgatctacgacagcaagttcgagaaacagctcggccaggtcatgctgctggtcctctgcgccgtgcagctgctgctcatgcggaccagctgggctctttgcgaggccctgaccctggccaccggccctatcacgaccctgtgggagggctccccgggtaagttctggaacaccaccatcgccgtgagcatggcaaatatcttccgcggctcctacttagccggggccggactcgccttcagcatcatgaagtccgtcgggacgggccggaggggcactgggtcccaaggcgagaccctgggggagaagtggaagaagaagctgaatcagctctcgcggaaggagttcgacttatacaagaagtccggcatcaccgaggtggatagaaccgaggccaaggagggcctgaagcggggggagacgacccaccatgccgtgagccgcggctctgccaagctccagtggttcgtcgagcggaatatggtgatccccgaagggcgcgtgatcgacctgggctgcgggcgtggcgggtggagctactactgtgcgggcctacggaaagtcaccgaggtgcgcgggtacaccaagggtggccccggccacgaggagcccgtcccgatgtccacgtatggctggaacatcgtcaagctcatgagcgggaaggacgtgttctacctgccacccgagaagtgcgataccctgctgtgcgacatcggggagtccagcccctccccgactgtggaggagagccggaccatccgcgtcctcaagatggttgagccctggctccggaacaaccagttctgcattaaggtgctaaacccctacatgcccacggtcatagaacacctcgagcgcctgcagcggaagtacggcgggatgctggtgaggaatccgctctcccggaatagcacccacgagatgtattggatctccaacggcaccggaaacatcgtgagctccgtcaacatggtgagccgcctgctgttgaaccggttcaccatgacccacaggcggcccaccatcgagaaagatgtcgacctcggggccggcacacgccatgtaaacgctgaacccgagaccccgaacatggacgttatcggggaacggatcaagcgtattaaggaggagcactccagcacgtggcactacgacgacgagaacccctacaagacgtgggcctaccacggctcgtacgaggtcaaggccaccgggtccgcgagctccatgatcaacggagtagtgaagctgcttaccaagccctgggacgtcgtacccatggtgacgcagatggccatgactgacaccacgccgttcgggcagcagcgggtcttcaaggagaaggtggatacacgcacgccccggcccatggccggcacccgcaaggtgatggagatcaccgccgagtggctgtggcgcacactgggccggaacaagaagcctcgcctctgtacacgggaggagttcacaaagaaggtacgtaccaacgccgcaatgggggcggtgttcactgaggaaaaccagtgggactcggcccgggccgcagtggaggacgaggagttctggaagctggtagaccgcgagcgggagctgcacaagctcggcaagtgcgggtcctgcgtgtacaatatgatgggcaagcgcgagaagaagctgggggagttcggcaaggccaagggctcgagggccatttggtacatgtggctgggggctcggtacctcgagttcgaagccctgggcttcctgaacgaggaccactggttctcccgggagaatagctactccggggtggaaggcgagggcctccataagctgggctacatcctgcgcgacatcagcaagatcccgggcggggcgatgtacgctgacgacaccgcgggctgggacacccggatcaccgaggacgaccttcacaacgaggagaagatcacgcagcagatggaccccgagcaccgccagctggccaacgccatcttcaaactgacctaccagaacaaggttgtgaaggtacagcggcctacccccaaggggacggttatggatatcatatcccgcaaggaccagcggggtagcggccaggtggggacctacggcctcaatacgttcaccaacatggaggcgcagctggtgcgccagatggagggcgagggtgtcctgtccaaggccgacctcgagaacccgcacctcctggagaagaaaatcactcagtggctcgagaccaagggggtcgagcggcttaagcgcatggcaattagcggtgacgactgcgtagtcaagcccatcgacgaccggttcgccaacgccttactcgcgctgaacgacatgggcaaggtgcgcaaggacatcccccagtggcagccctcgaaggggtggcacgattggcagcaggtgccgttctgcagccaccactttcatgaactaatcatgaaggacggccgcaagcttgtcgtgccctgccggccccaggacgagctgatcgggagagcccggatctcccagggcgccgggtggagcctgaaggagacggcctgcctcggaaaggcctatgcgcagatgtggtccctgatgtacttccaccgccgggacctgcgccttgcctccaacgccatctgcagcgccgtgcccgtccactggatcccgacctcccggaccacctggagtatccacgcgcatcaccagtggatgacgaccgaggacatgctgactgtctggaaccgggtttggatcgaggacaacccctggatggaggataaaacccctgtcacgacctgggaggacgtgccctaccttggcaagcgggaggaccagtggtgcggttcgctcatcggcctcaccagcagggcgacctgggcccaaaatatccttacggccatccaacaagtccggtctctcatcggggacgaggagttcctggactacatgccgtctatgaagcgctttcgcaaggaggaagagtccgagggcgccatctggtga

SEQ ID NO: 25733 - RNA, 9873 nt, synthetic construct
  misc_feature 1..9873: note = derived and/or modified CDS sequence (opt11) from DENV-3__GU131906__SS-prME
  source 1..9873: mol_type = other RNA
acctcgttatgcctcatgatgatgttacctgcgacgctagcgttccacttgacctcaagggacggggaaccccgaatgatagtagggaaaaacgaacgcggaaaatcactcctcttcaaaacagccagcggcataaacatgtgcaccctaatcgcaatggaccttggtgaaatgtgcgacgatacagtcacctacaaatgtcccctcatagcagaagtggagcccgaggacatcgactgttggtgcaacctgacttcaacgtgggtgacctacggaacctgtaaccaggcaggggaacacaggcgcgacaaacgctccgtggcactcgcaccgcatgtcggaatgggattagataccagaacgcaaacttggatgtcagcagagggagcatggcgtcaagtagagaaagtcgaaacctgggcgctccggcacccgggattcacgatcctagccctattcctcgcccactacatcggaacaagtctaacccaaaaagtcgtgatctttatcctgttaatgctcgtaactccttcaatgacaatgcgctgcgtaggagtaggcaatagagattttgtagaaggactatccggggccacgtgggtggacgtcgtcctagaacatgggggatgcgtgacgaccatggccaaaagcaaacccacgctcgacatagaattacagaaaacggaggccacacaactagcaacgctcaggaaactatgtatagaaggaaaaattacgaacataaccaccgacagccgatgtccgacccaaggtgaggcgacattgcccgaagaacaagaccaaaactacgtatgcaaacacacctacgtagaccgcggatggggcaacggttgcggactttttggaaaaggctccctagtgacgtgcgctaagtttcagtgcctcgaacccatcgaaggaaaagtagtacaatacgaaaatctaaaatacacagtaataataacagttcatacaggcgaccaacaccaggtaggaaatgacacgcaaggagttaccgtcgaaattacgcctcaagccagtaccgtagaagccgtacttcctgaatacggaactctgggtctagagtgctcaccacgaacaggtctcgacttcaacgagatgatcttactaaccatgaaaaacaaagcctggatggtacaccgccagtggttctttgacttaccgcttccttggacgtcgggggcaaccaccgaaaccccgacctggaacagaaaagaacttctagttaccttcaaaaacgcgcacgcgaagaaacaagaggtagttgtactgggctcacaggaaggtgcaatgcacactgcattgaccggagctactgaaatccagaacagtggaggcaccagcatcttcgccggccatctgaaatgccggctgaaaatggataaattggagctaaaaggcatgtcatacgcgatgtgcctaaacactttcgtattaaagaaagaagtaagcgaaactcaacacggaaccattttaatcaaagtcgagtacaagggcgaggacgctccatgcaaaatccccttctcgaccgaggacggacaaggaaaagctcacaacgggagactaattacggccaaccccgtcgtcacgaagaaagaagaacctgtaaacatcgaggcggaaccacccttcggggagagtaacatcgtgatcggcatcggggacaaagccctcaaaatcaactggtacaagaaaggatcttcaatagggaaaatgttcgaagctactgcccggggcgcccgccgaatggccatattgggtgacaccgcatgggatttcgggtctgtaggaggagtcctaaacagtcttggaaaaatggtgcaccaaatcttcgggagcgcgtacacggcactcttctccggggtgagttggataatgaagatcgggattggcgttctgctaacgtggataggactaaacagcaaaaacacctcaatgtccttctcctgcatcgtaatagggatcataaccctatatttgggtgcggtagtacaggctgacatgggctgcgtaattaactggaaaggaaaagaactgaaatgcggcagcggcatttttgttaccaacgaggttcacacatggacagaacagtacaaattccaagctgacagtcccaagaggctggcgacagctatagccggagcctgggaaaatggcgtttgtggcattcgatcaacgaccagaatggaaaacctgctctggaaacagatagccaacgaactgaactacatactctgggaaaacaacataaaactcactgtggtagtaggagatataatcggtgtcctcgagcaaggaaaacgaaccttaacaccccaacctatggaacttaaatacagttggaagacttgggggaaagccaaaattgtaacagccgagactcaaaattctagcttcattatcgacggcccaaacacccccgaatgcccctcggccagcagagcctggaacgtctgggaggtcgaagactacggctttggcgtcttcacgaccaacatatggttaaagctacgtgaggtatacacacaatcgtgcgaccaccgattaatgtctgccgccatcaaagacgaacgagcggtccacgcggacatgggctactggattgaatcccagaaaaatggctcctggaaactagaaaaagccagcttcatagaggtgaagacatgcacatggcccaagagccacaccttatggtcgaacggcgtcctagaatcagacatgataatcccaaagagcctcgcaggcccgattagccaacacaaccaccgccccggttatcacacacaaaccgccggaccatggcacctcggcaaattggaactcgatttcaactactgcgagggtactacagtggtaatcactgaaaattgcggcacacgaggtccgtcactccggaccaccactgtctcgggaaaacttatccacgaatggtgctgccggagctgtaccctaccacccctcagatatatgggtgaagacggatgctggtacggcatggaaatcagaccaattaacgagaaagaggaaaacatggtcaagtccctcgtctcagccggttcgggtaaagttgataacttcacgatgggcgtgctgtgccttgccatcctattcgaagaagtcatgcgcggaaagttcgggaagaaacacatgatagccggagtactcttcacgtttgttctccttctctcgggccaaatcacatggcgagatatggcgcatacgctcattatgattggttcaaatgcaagcgaccggatgggcatgggagtaacatacttagcactcatcgccacgttcaagatacaacctttcctggcactaggctttttcctacgaaagttgacctcccgagagaacctcctattgggggtagggctagctatggccaccacgcttcaattaccggaggacatagaacaaatggcgaacggaatagcgctagggctcatgaccttaaaactaatcactcaattcgagacgtatcaactatggaccgcactggtgagcctaacctgcagtaacacgatatttacactgacggtagcgtggagaacagcaacactcatactagccggcgtctcactgctacccctgtgccagagctcaagcatgcgtaaaactgactggcttcccatgacagtggcggctatgggcgtacctccattacccttgttcatattctctctaaaagatacacctagacgacgaagttggcccttaaacgaaggagtcatggctgtagggctcgtcagcatcctagcaagctcgctcctgcgaaacgacgtaccgatggcaggaccgttagtcgccggtggcctactcatcgcatgttacgttataaccggaaccagtgccgacctgaccgtagaaaaagcagcggacgttacatgggaagaagaggcggaacaaacaggggttagccacaatctgatgattaccgtcgacgacgacggaaccatgcgaatcaaagatgacgagacagaaaacatcctaacagtacttctcaaaaccgcattactgatagtttccggtatattcccgtacagtatccccgccacactgctcgtatggcatacatggcagaaacaaacacagagaagcggcgtcctatgggacgtacccagcccgcccgaaacccaaaaagcagaacttgaagaaggcgtttacaggatcaagcagcaaggaatttttggcaaaacgcaagttggagtgggcgtccaaaaagagggagtgttccacaccatgtggcatgtgacccgcggagccgtcttaacgcataatggaaaaagactggagccaaattgggctagcgtcaagaaagacctaatctcctacggaggagggtggcggctttccgcgcagtggcaaaaaggggaggaagtccaagtaattgcagtagaaccaggcaaaaaccccaaaaacttccaaacaatgcctggcatattccagacaaccacaggcgaaatcggcgccatagcacttgacttcaagccaggcacgtcaggatcgccgatcataaatagagagggaaaagtagtcggactctacggcaacggtgtggtaacaaagaacgggggatacgtcagcgggatagcccaaacaaacgcggagcccgacggacccactcccgagctcgaggaagaaatgtttaagaaaagaaacctcaccatcatggatctacaccccggctcaggcaagacacgcaaatatcttccggccatcgtcagagaggcaatcaaacggcgcttaagaaccctgattctagccccaacacgtgtcgtcgccgcagaaatggaagaggcattaaaggggctgccgatccgataccaaacaaccgccacaaaatcggagcacacggggcgagaaattgtcgacctaatgtgtcacgccacattcactatgcgcctgcttagcccagtgagagtaccaaattacaacctggtgatcatggacgaagcccattttaccgatcccgccagcatagcggccagggggtacatctcaacccgtgtaggaatgggggaagccgctgcaatctttatgaccgccacgccgccaggaacagcggaggcattcccacaatcgaacgcaccaattcaggacgaggaacgcgacatacccgaacgcagctggaactcgggcaacgaatggatcacagacttcgtggggaaaacagtgtggttcgtccccagcatcaaagcgggtaatgacatcgccaactgcctcaggaaaaacggaaagaaagtaatccaactcagtaggaaaaccttcgatacagaataccagaaaactcgcctgaacgactgggacttcgtagtcacaacagatatctccgaaatgggggccaactttaaggccgaccgcgtcattgatcctcggaggtgtctgaaaccggtcatccttacggacggcccagaacgggtgatcctagctgggcctatgccagttactgccgcttcagcggcgcagcgcaggggccgagtaggtcgaaacccccaaaaggaaaatgatcaatatatattcacagggcagccgctcaacaacgatgaagatcacgcgcattggacagaggctaagatgcttctggacaacatcaatacaccagaaggcatcataccagcgctattcgaaccagaacgagaaaagtcagccgcaatcgacggggaataccgactaaagggcgaatcgcgcaagacctttgtagaactaatgcgaaggggagacttgccagtgtggcttgcccacaaggtagcatccgaaggtataaaatatacggatagaaagtggtgcttcgacggcgagcgcaataaccaaatcctagaggagaacatggacgtggaaatctggactaaggagggagaacggaagaaattacgcccccggtggcttgacgcaagaacatacagcgacccgctcgctctgaaggagttcaaagatttcgcagcaggacgcaaatccatagcactcgatctcgtcacggaaattggccgtgtcccgagccacctcgctcaccggacccgcaacgcacttgacaacctcgtgatgctacacaccagtgagcacggaggcagggcttatagacacgcagtagaagaactcccggagaccatggaaacactcctcctactagggctcatgatcctattaacgggtggtgcaatgctattcctaatcagcggcaaaggcattggcaaaacctccatcgggctaatatgcgtaattgcgagtagcggcatgctatggatggccgacgtcccgctacaatggatcgctagcgcaatcgtactcgaatttttcatgatggtcctgctcatacccgaaccggagaagcaacgcaccccacaggacaaccagctagcttacgttgtcattgggatactcacactagccgcaatcgtagctgccaacgaaatgggactgctagagaccacaaaacgggacctcggtatgtcaaaggagccaggagtcgtctccccaaccagctacttagatgtagacctgcaccctgctagtgcgtggacgttatacgccgtcgcaaccacagtaattaccccgatgttacgccatacaatcgaaaacagtacagccaacgttagcctcgccgccatagcgaaccaagcggttgtgctgatggggcttgacaaaggatggcctattagtaagatggacctaggagtaccattgctagcgcttggctgctatagccaggtgaacccactaacactaacagccgccgtcctgttgctcgtaacccattacgctatcatcgggcccggtttgcaggcaaaagcaaccagggaggcacaaaaacgcacggcagcaggaataatgaaaaatcccactgtggacgggatcatgacaattgacctcgacccagtaatctacgatagcaaattcgagaaacaactcggccaagtaatgctgttggtgctctgcgcagtacaacttcttctcatgagaacaagttgggccttatgtgaagcactaacactcgcaaccgggccgataacgacactctgggaggggtctcccggcaaattctggaacacgaccatagcggtctctatggcgaatatattcagaggttcttacctagcgggggccggcctagccttctccattatgaaatcggtcggtacgggacgacgcgggacaggaagtcagggagaaacactgggggagaagtggaaaaagaaacttaaccaactcagtcgaaaagagttcgacctgtataagaaaagcggaatcaccgaggtagaccgaacggaagcaaaagaaggcctaaaaagaggcgagactacccaccacgcggtgagccgaggatcagccaagctccaatggttcgtagaaaggaacatggtcataccagagggacgcgtgatagacctaggctgtgggagaggcggctggagctactactgcgccggcctaaagaaagttacggaggtacgagggtacacaaagggaggacctggacacgaggaaccggtccctatgagcacctacggttggaacatagtcaaactcatgagcggcaaggatgtcttctacctaccacccgaaaaatgcgatacgttgctgtgcgatatcggcgagtcaagcccatctcccacagtcgaagaaagtagaacaataagagtcctcaagatggtagaaccgtggctccgcaacaatcaattctgcattaaagtactaaatccttacatgccgactgtcatagaacatctcgaacgcctacagagaaagtacgggggtatgttggtcaggaacccgctatcaaggaatagcacccacgaaatgtactggatcagcaacggcacagggaacatcgtatcgagtgttaacatggtaagccggctgctactaaatcgatttaccatgacacaccgcaggccgacaatcgagaaagatgtggacctcggcgcgggcacaagacacgtaaatgcagaaccggaaacgccaaacatggacgtgattggagagcgtataaaaaggataaaagaagaacactcctccacgtggcattacgatgacgaaaacccctataaaacctgggcgtaccacggctcatacgaagttaaagcaacaggaagcgcttcatcgatgattaacggcgtagtgaaacttctaactaaaccttgggatgtagtcccaatggttacacagatggccatgaccgacacgaccccatttgggcagcaacgcgttttcaaggagaaagtggacaccaggaccccgcgccccatgccaggcacccgcaaagtcatggagatcaccgccgagtggttatggaggacgttgggtcgcaataagaaaccgaggctgtgcacccgtgaagagttcaccaaaaaggtgagaactaacgcagcaatgggcgcagtattcacagaagaaaaccagtgggatagcgcacgagcagcagttgaggatgaagagttctggaagttagtcgaccgggagcgggaactccataagctcggaaaatgcggtagctgtgtgtacaacatgatggggaaacgtgagaagaaactaggcgagttcgggaaagccaaaggttcaagggccatttggtacatgtggctaggcgcgcgatacctagagttcgaggcgctaggattcttaaacgaagaccactggttcagcagggagaatagctacagcggggtagaaggagaaggacttcacaaacttgggtatatcctgcgagacataagcaagatcccgggaggagccatgtacgctgatgacaccgcaggatgggatacacggataacggaagatgacctacataacgaggagaaaatcacgcagcaaatggacccagaacacagacaattggccaacgccatcttcaagttaacataccagaacaaagtagtaaaagtccaaagaccaaccccgaaaggcaccgtgatggatatcatcagccgcaaggaccaaagagggagcggacaagtgggaacgtatggcttgaacaccttcactaacatggaagctcagctcgtgcgccaaatggagggtgaaggggtactgagcaaagcagaccttgagaacccgcacctcttaggcaagaaaatcacccaatggctggagacgaagggggtggagagactgaaacgaatggctatatcaggtgacgattgcgtggtcaagcctattgacgaccggtttgcaaacgcacttctcgccttgaacgatatgggcaaagtgagaaaagacataccccaatggcagccatccaaggggtggcacgactggcaacaggtcccgttctgctcccatcacttccacgaactcataatgaaagacggtcgaaagctagtcgtgccgtgcaggccgcaagacgaactcattgggcgcgctagaatatctcaaggggcaggatggtcgttgaaagaaacagcctgcctcggaaaggcgtatgcccaaatgtggtcgctcatgtatttccataggcgtgacctccggctggcgagcaacgcaatttgctccgcggtgccggtacactggatccccaccagtcggacgacatggagcattcacgcccatcatcaatggatgaccacagaggatatgctaacagtatggaatcgggtctggatcgaggataatccatggatggaagacaaaactcctgtaacaacctgggaagacgtaccatacctaggtaagcgcgaagaccaatggtgtggctcgctcatagggctaacgagccgggcaacctgggcacagaatattctcacagcaatacaacaagtacggagcctgatcggggacgaagagttcctagactacatgccaagtatgaagcgattccgaaaggaagaggagagcgaaggagctatatggtga

SEQ ID NO: 25734 - RNA, 9873 nt, synthetic construct
  misc_feature 1..9873: note = derived and/or modified CDS sequence (opt11) from DENV-3__GU131907__SS-prME
  source 1..9873: mol_type = other RNA
accagcctgtgcctcatgatgatgcttcccgctaccctggcgttccacctcaccagccgcgatggcgagccgcgaatgatcgtggggaagaacgagagaggcaaatcactactgttcaagaccgcatccggaattaacatgtgtacacttatcgccatggacctgggggagatgtgcgacgatacagtcacgtacaaatgccccctgatcgccgaggttgaacccgaggacatcgactgctggtgcaacctgacctcgacctgggtcacgtacggtacctgtaaccaggccggcgagcaccggcgcgataagagatccgtcgctctggcgccgcacgtgggaatggggctggacacacgcactcagacctggatgagcgccgagggcgcctggcgccaagtcgagaaggtcgagacctgggccctccgacatcctgggttcaccattctggcgctgttcctcgctcactacatcgggacttcactgacccagaaggttgtgatctttatcttactcatgttagttacgccctctatgaccatgcggtgcgtgggggtgggaaaccgcgacttcgtcgagggtctaagtggagccacctgggtggacgtggtactcgagcacggcggctgcgtgaccacgatggccaagtccaagccgaccctggatatcgagctgcagaagaccgaggcaacccagctggcgacgttacgtaagctatgcatcgaaggtaagatcactaatatcaccacagactcccggtgcccgacacagggcgaggccaccctcccggaagagcaggaccagaactacgtgtgcaagcatacctacgtagaccgggggtggggcaatgggtgcggactcttcgggaaaggctctttggtaacctgcgctaaattccagtgcctcgagcccattgagggcaaggtggtccaatacgaaaacctgaagtatacggtgattataaccgtccacaccggggaccagcaccaagtcggcaacgacacccagggcgtgacggtcgagatcaccccccaggcctccactgttgaggccgtgctgcccgaatacggcaccctcgggttagagtgcagcccgcgcacgggcctggacttcaacgagatgatcctcctgacgatgaagaacaaggcatggatggtccaccggcagtggttctttgacttaccattaccctggacctccggagccacgaccgagacgcctacctggaatcggaaggagttgctggttacgttcaagaacgcacacgctaagaaacaagaggtcgtcgtcctaggtagccaggaaggggcaatgcacactgcgctgacaggggcaaccgagatccaaaactccggaggcacatcgatcttcgctggacatttaaagtgccggttgaagatggacaagctggagctgaagggcatgagctacgccatgtgcttaaataccttcgtgcttaagaaggaagtcagcgagacgcagcatgggaccatcctcataaaggtggagtacaaaggcgaggatgctccatgtaaaatccccttttccacggaagacgggcagggaaaagcgcataacgggcgtttaatcacggccaaccccgtggtgacgaagaaagaggaaccggtcaacatagaagccgagccgcccttcggggaatccaacatcgtgatcggtatcggtgataaggcgctcaagatcaactggtacaaaaagggaagctccatagggaagatgttcgaggcgacagctcggggcgcccgacggatggccatcctgggcgataccgcctgggatttcgggagcgtcggcggggtgctgaactccctcggtaagatggtgcaccagattttcgggtcagcgtacaccgccctgttctccggcgtaagctggatcatgaagatcggcatcggggtgctcctcacgtggatcggccttaactccaaaaacaccagcatgtcattcagctgcatcgtgatcgggatcattaccctgtacctaggcgccgtcgtgcaggccgacatggggtgcgtcatcaactggaaaggtaaagagctgaaatgcggcaatggaatcttcgtcaccaacgaagtgcacacgtggaccgagcagtataagttccaggccgattcccccaagcgtttggccactgctatagccggggcgtgggagaacggcgtgtgcggcatccgctcaactacgcggatggagaacctcctttggaagcagatcgcgaatgagctgaactatatcctctgggaaaacaatatcaagctaaccgtcgtggtgggggacatcatcggcgtcctggagcagggcaagagaaccctgacgccccaacccatggagcttaaatactcgtggaaaacgtgggggaaggcaaagatagttacggcggagacccagaacagctcgttcataatagacggccccaatacccccgaatgccccagcgccagccgggcctggaacgtatgggaggtcgaggactacgggttcggcgtgttcacgaccaacatctggctgaagctacgcgaggtgtacacgcagtcctgcgaccaccggctgatgtctgcggctatcaaagatgagcgcgccgtgcacgccgacatgggatactggatcgagtcccagaaaaacgggagctggaagttagaaaaagccagtttcatcgaggtgaagacctgcacctggcccaaatcacacacgctctggagcaacggcgtgctggaatcggacatgatcatccctaagtccttggcgggtcccatcagccaacacaaccaccgccccggctaccacacgcagaccgccgggccctggcacctcggtaaactggagttggacttcaactattgtgagggcaccacggtggtgatcgccgaaaactgcgggacccgcggaccgtcattacggaccacaactgtgagcgggaagctgatccatgagtggtgctgtcgctcatgtaccctgccccctctacggtacatgggcgaggacgggtgctggtacggtatggaaatccgccccataaacgagaaagaggagaacatggtcaagagcctggtatccgccggaagcgggaaggtagacaacttcaccatgggcgtcctgtgccttgcaatcctgttcgaggaagtgatgcgcggcaagttcggcaagaaacatatgatcgcgggtgtcctgttcaccttcgtactcctgctcagtggccagatcacttggcgcgacatggcccacacactcattatgatcggcagcaacgcttcagatagaatggggatgggcgtgacctacctggccttgaccgcgactttcaaaatccaacccttcctcgcgctggggttcttcttacgcaagctcactagccgggagaacctgctgctcggcgtgggcctggccatggcgaccactctgcagctacccgaggatatcgaacagatggccaacgggattgcgctgggcctgatgacgttgaagctgatcacacagttcgagacctatcagctgtggaccgccctggtctcactgacctgctccaatactattttcaccttgaccgtggcctggcgaacggccaccctcatcctggccggggtcagcttattgccattgtgccaatcctcttccatgcggaaaacggattggctgcccatgaccgtagccgccatgggcgtgcctcccttgccactgtttatcttcagcttaaaggacacgcccaagcgtcgctcctggcccctcaacgagggggtaatggccgtgggcctggtgtccatcctggcctcctccctcctgcgtaacgatgtccccatggccggtccgctcgtggccggtggcttactgatcgcctgctacgtgataaccggtacctctgccgatctgaccgtagagaaggctgcggacgtgacctgggaggaggaggcggagcaaaccggggtgagccacaacctcatgatcaccgtagacgatgacggcacaatgcgcatcaaggacgacgagaccgaaaacatcctgacggtccttctcaagacagcactcctgatcgtgtccggcatcttcccctacagcatccccgccaccctcctggtctggcacacgtggcaaaaacaaacccagcgctccggcgtcctgtgggacgttccttctccgcccgaaacccagaaggccgagctggaggaaggtgtttaccgtattaagcagcagggcatcttcggcaagacccaggtgggcgttggggtccaaaaagaaggggtgttccacaccatgtggcacgtgacgaggggcgcagtgctcacccacaacgggaagcgcctggagcccaattgggcgtccgtaaagaaggaccttatctcgtacggcggtggctggcgcctatccgcccagtggcagaaaggggaggaggttcaggtcatagccgtggagcccggaaagaacccgaagaacttccagactatgcccgggatcttccagaccacgaccggggaaatcggcgccatcgcgctggacttcaagcccgggacgagcggtagcccgataatcaacagggaaggcaaagtggtcgggctgtacggcaatggggtagtgacgaaaaacggagggtacgtcagcggcattgctcagacgaacgccgagccagatggccccacccctgagcttgaggaggagatgttcaagaagcggaacctgacaatcatggacctgcaccctgggagcggcaagactcgcaagtatctacccgccatagtgcgggaggccatcaaacgccggttacgtacgttgatcctcgcgcctacccgggtcgtcgccgccgagatggaagaggccctgaaggggcttcccattcgctaccagaccaccgcgaccaagtcagagcacaccggcagagaaatcgtggacctcatgtgccatgcgactttcacgatgcgcctgctctcccctgtgcgggtccccaactacaacctcgttatcatggatgaggcccattttacggaccccgcctctatcgcagccagggggtacatctcaacccgagtgggcatgggcgaggcggccgccatcttcatgaccgccacgccgccggggacggcggaggccttcccccagtccaacgcacccatccaggacgaggagcgcgacatccctgaacgcagctggaactcgggcaacgagtggatcactgacttcgttgggaagaccgtttggttcgtgccctcaatcaaggccggcaacgacatcgcgaactgcctgcggaaaaacgggaagaaggtcatccagctatcccgcaagaccttcgacactgagtaccaaaaaacccggcttaacgactgggacttcgtcgtgactaccgacataagcgagatgggagcgaatttcaaagcagaccgcgtaatcgacccgcggcgctgtttaaaacccgttatcttaaccgatggccctgagcgggtgattctggctggtccgatgccagtaaccgcagcctccgccgcgcaacgccggggccgcgtcggccgaaatccccagaaggagaacgatcagtacatattcaccggccagcccttgaacaacgacgaggaccacgcccactggaccgaggccaagatgcttctagacaatatcaacaccccggaggggattatccccgcccttttcgagccagagcgcgagaagtccgccgccatcgatggagagtacaggctgaagggagagtccagaaagacgttcgtagagctcatgaggcgcggcgatctccccgtgtggctggctcacaaggtggccagcgaggggatcaagtacaccgaccggaagtggtgctttgacggtgagcggaacaaccaaatcttggaggagaacatggacgtagagatttggactaaggagggcgagcggaagaagctgcgcccccgctggttggacgcgcgcacatattccgacccgctggccctcaaggagttcaaggattttgccgcaggccgaaagagcatcgcgctggacctcgtgacggagattgggcgggtcccctcgcacctggcgcaccgcacccgaaacgcgctggataatcttgtaatgctccacacgagcgagcacggcgggcgcgcttataggcacgccgtggaggagctgccggagaccatggagacacttcttctgttgggactgatgatccttctcaccgggggtgccatgttgttcctgatctccgggaaggggatcgggaaaacctctatcggcctcatctgtgtgatagtctcttccggtatgttgtggatggccgacgtgccgttgcagtggattgcctctgccatcgtgctcgaattcttcatgatggttctgttaattcccgagcctgagaagcagcgcaccccgcaagataaccagttggcctatgtggtcatcggcatccttacattagccgccatcgtcgcagccaacgaaatgggcctcctagagaccaccaaacgggacctgggtatgtccaaggaaccaggggtagtgagccccacatcctatttagacgtcgacctccaccccgcctccgcctggacgctgtatgcagtggccaccaccgtgatcacccctatgctccgccacaccatcgagaactccaccgccaacgtcagcctagcggcaatcgccaaccaggcggtggtcctgatgggccttgacaagggctggcccatcagcaagatggacctgggtgtccctctcctcgccctggggtgctactcccaggtgaaccccctgacccttactgctgcagtgctgctgttggtcacgcactatgccatcattggtcccggcttacaggctaaagccacacgcgaggctcagaagcgcacagcggccggaattatgaagaaccccaccgtcgacggcataatgacgatcgacctggacccggtgatatacgactccaagttcgagaaacagctcgggcaagtgatgttgctggtactctgcgccgtgcagctgcttcttatgcggaccagctgggccttgtgcgaggccctgacgctcgcgaccggccccatcacgacgctgtgggaggggtctccagggaagttctggaacaccaccatcgccgtcagcatggcaaacatctttcgcggcagttatctggccggagcaggcttagcgttcagcatcatgaaatccgtggggaccggccggcgaggcaccggatcccagggcgaaaccctgggggaaaagtggaaaaaaaaactgaaccagctcagccggaaggaatttgacctgtacaagaagtccggcatcaccgaggtggaccgcaccgaggcaaaggaagggctcaaacgcggcgagacgactcaccacgctgtctctcgcggctccgccaaactccaatggttcgtggagcggaacatggtgatccccgaggggcgcgtcatcgatctgggctgcgggcgcggcgggtggtcatattactgtgcggggctgaagaaggtcaccgaggtccggggatacacaaagggcggccccgggcatgaagagccggtcccgatgtccacgtacggctggaacatcgtgaagctaatgagcgggaaggacgtcttctacttgccaccagagaaatgcgacaccctgctgtgcgacataggcgagtccagcccctcccctaccgtagaggagagccggacaatccgggttctcaagatggtggagccctggctgcgcaacaaccaattttgcattaaggtcctcaacccgtacatgcccacggtgatcgagcacctcgaacggctccagaggaagtacggtgggatgctagtccggaacccgctcagccggaacagcacacatgaaatgtactggatatccaacgggaccgggaacatcgtcagctccgtcaacatggtcagccgactgcttctaaaccgcttcaccatgacgcaccggcgcccaactatagagaaggacgtcgaccttggtgccgggaccagacacgtgaacgcggagcccgagacccccaacatggacgtcataggagaacgtatcaagcggataaaggaggagcactcatccacgtggcactacgacgacgaaaacccctacaagacctgggcctaccacggctcgtacgaggtgaaggccaccgggagcgcgagctccatgatcaacggcgtggttaagctgctcactaaaccctgggacgtagttcccatggtcacgcagatggccatgaccgacaccaccccattcggtcagcagagggtgttcaaggagaaggtggacactcggacaccccggcccatgcccggcacccgaaaagtcatggaaatcaccgccgagtggctctggcgcacgctggggcgcaacaagaagccaagactatgcacccgcgaggagttcaccaaaaaggtgagaaccaatgccgccatgggggcggtgttcaccgaggagaaccagtgggacagcgcccgtgccgccgtggaggacgaggagttctggaagctggtggacaaagagcgggagctgcacaaattgggtaagtgtggatcctgcgtgtacaacatgatgggcaaacgagagaagaagctgggtgagtttgggaaagccaagggctcaagagccatctggtacatgtggctgggcgcccgctacctcgagttcgaggccttaggcttcttaaacgaagaccactggttctcccgggagaacagctactcgggagtcgagggtgagggtttgcacaagctgggctatatcctgagggacatatcgaagatccccggcggggccatgtacgcggatgacacagccggatgggacacgcgcatcaccgaggacgacctccataacgaggagaagatcacgcagcagatggaccctgagcacagacagctggctaacgcaatcttcaagctgacctatcagaacaaggttgtgaaggtccaacggccaaccccgaaggggacggtgatggatatcatctcccggaaggatcagcggggcagtggccaggtgggcacctacgggctcaacactttcacaaacatggaggcgcagctagtccgccagatggagggggagggggtgctttccaaagccgatttagaaaacccccatctccttgagaagaagatcacccagtggctagaaacaaagggagttgagcggctgaaacgaatggccatcagcggagacgactgcgtcgtgaaacccatcgacgaccggttcgccaacgccctacttgccttaaacgacatgggaaaggtacggaaagacattccccaatggcagccatccaagggatggcacgactggcagcaggttcccttttgcagccaccacttccacgagcttattatgaaggacggacggaagttagtcgtcccatgccgtccccaggacgagctgatcgggcgcgcgcggatatcgcagggtgccgggtggagcctgaaggagacggcctgcttgggcaaggcctacgcacagatgtggtcactgatgtactttcaccgccgggacctgcgcttagcgtctaacgccatctgctctgccgtgccggtacactggatacccacctcgcggaccacctggtccattcacgcccatcaccagtggatgactactgaggacatgctgaccgtatggaaccgcgtctggattgaggacaacccgtggatggaggacaagacccccgtgacgacctgggaggacgtcccatatctgggcaagcgggaggaccagtggtgcgggtccttaataggtctgactagccgggcaacttgggctcaaaacatcctgacggccatccaacaggtccggagtttaatcggggacgaggagttcctggattacatgccctctatgaagcgtttccggaaggaggaggaaaccgagggcgccatttggtga

SEQ ID NO: 25735 - RNA, 9873 nt, synthetic construct
  misc_feature 1..9873: note = derived and/or modified CDS sequence (opt11) from DENV-3__GQ868634__SS-prME
  source 1..9873: mol_type = other RNA
acaagcctgtgtctcatgatgatgctacccgcgaccctggcctttcacctcacctctcgcgacggcgagccccggatgatcgtcgggaagaacgagcgcggcaagagcctgctgttcaagaccgcgtccgggatcaacatgtgcaccctcatcgccatggacctaggcgagatgtgcgacgacaccgtaacctacaagtgtccactgattgccgaggtggaacccgaggacatcgactgctggtgcaatctcacctcgacctgggtgacctatgggacgtgtaaccaggcgggcgaacatcggcgcgacaagcggtccgttgccctggcgccccacgtaggaatggggctggacacacgcacccagacctggatgtccgcggagggcgcttggcgccaggtggagaaagtggaaacctgggccctccgccacccggggttcactatcctggcgttgtttctggcccattacatcggaacctccctgacccaaaaggtggtaatcttcatccttctcatgcttgtcacgccaagcatgaccatgaggtgcgtgggggtgggaaacagggacttcgtcgagggtctctccggcgccacctgggtggacgtagtgttggagcacggcggttgcgtgaccacgatggccaaatctaaacccaccctagatatcgagctgcaaaaaaccgaggccacccagcttgcgacgctccgcaagctgtgcatagagggcaagatcacaaacattacgactgacagccggtgtcccacgcagggcgaggccacgctcccggaggagcaggaccagaactatgtgtgcaaacacacttacgtcgacagagggtggggcaacggttgcggcctgttcgggaagggcagcctagttacctgcgcgaagttccagtgcctcgagcccatcgagggcaaggtggtccagtacgagaatctgaagtacacggtgataatcaccgtgcataccggtgaccagcaccaggttggcaacgacacccagggcgtgacggtcgagatcacgccgcaggcatccaccgttgaggccgtcctgcccgagtacggaacccttgggctggagtgcagccctcgcaccggcctggacttcaacgagatgatcctactaacgatgaagaacaaggcgtggatggtacacagacagtggtttttcgatctgccccttccctggacttccggcgcaactaccgagacacccacctggaacagaaaggagctgctggtgaccttcaagaacgcacacgctaagaagcaggaggttgtagtgttagggagccaggagggcgcaatgcacaccgctttgacaggggccaccgagatacagaactccggcgggaccagcatcttcgccggccacctgaagtgccggttaaaaatggacaaactcgaactgaagggcatgtcatacgccatgtgcctcaacacatttgtgttaaagaaggaggtcagcgagacgcagcacgggaccatcttaatcaaggtggagtacaagggcgaggacgcaccgtgcaaaataccgttcagcaccgaggacgggcaaggcaaagcgcataatggccgactcatcaccgccaaccccgtggtgacgaagaaagaggaacctgtaaacatcgaggccgagccgcccttcggggagtccaacatcgtgatcggcatcggtgacaaagccctcaagattaactggtacaagaagggtagttccatcgggaagatgttcgaggccacggcgcggggcgctaggcggatggccatcttgggcgacaccgcatgggacttcgggagcgtcggcggggtgctgaactctctcgggaagatggtacaccagatcttcgggagcgcgtacacggctctgttttctggcgtcagctggatcatgaaaatcgggatcggggtgttactcacgtggatcgggttaaactccaagaacactagcatgtcgttctcctgtatcgtgataggcatcatcaccctttacctaggggccgtggtccaggccgacatggggtgcgccatcaactggaagggcaaggagctgaagtgcggctccgggatcttcgtgaccaacgaagtccatacctggaccgagcagtataagttccaggcggacagccccaaaaggctagccaccgcgatcgccggtgcctgggagaacggggtgtgcggcatcagatccacaacgcgaatggagaacctcctatggaagcaaatcgccaacgaactgaactacatcctctgggaaaataacatcaaactcaccgtggtcgtcggtgacatcataggcgtgctggagcagggcaagcgcaccctcacgcctcaaccgatggagctgaagtatagctggaagacgtgggggaaggcgaagatcgtcaccgccgaaacccagaactccagcttcatcatcgacggcccaaacacccccgagtgtcccagcgctagtagagcctggaacgtgtgggaagtggaggactacgggtttggcgtcttcactaccaacatctggctgaagctccgcgaggtgtatacccagagctgcgaccacagactgatgtcggccgccatcaaggacgagcgcgccgtgcatgccgatatgggctactggattgaaagccagaagaacggctcctggaagttggagaaagcgtcgttcatcgaggtcaagacgtgcacctggccgaaatcccatacgctctggtccaacggcgtgctggagagtgacatgatcatccccaagtccctggccgggccaatctctcagcacaaccatcggcccggctatcacacgcagaccgccgggccctggcatttgggcaagctggagctggacttcaactactgcgaggggacgactgtggtcattactgagaactgcgggacccgcggccccagcctccggaccacgactgtgtccgggaagctgatccacgagtggtgctgccgcagctgcaccctgcctccgctccggtacatgggcgaggacggatgctggtacggaatggagatacggccaatcaacgagaaagaggagaacatggtgaagagcctggtaagcgccggatccggaaaagtggacaacttcaccatgggggtgctgtgcctcgccatcctgttcgaggaggtaatgcgggggaagttcggcaagaaacacatgatagcgggggtactgttcacattcgtgctactgctaagcggccagatcacctggcgcgacatggcccacaccctcatcatgattggttcgaacgccagcgaccggatgggtatgggcgtcacttacctggctctgatcgcaacattcaagatccagcccttcctcgccctgggctttttcctgcgcaagctcaccagcagagagaacctgctgctcggcgtgggcctggcgatggccaccacactccagctgcccgaagacatcgagcagatggccaatggaatcgcgctgggtctgatgacactcaaacttataacccagttcgagacttaccagctctggactgctctcgtgtcactcacgtgcagcaacaccatctttaccctaaccgtggcctggcgcacggcgaccctcatcctggcaggggtgtcgctgctcccactgtgccagagctccagcatgcgcaaaaccgactggctgcccatgaccgtcgcggccatgggcgtgccgcccctaccgctgttcattttttcgttaaaggacacgcccaagcgccgctcttggccccttaacgagggagtgatggccgtcggtttagtgtctatcctggccagctctctcctgcggaacgacgtgccgatggcgggcccgctcgtcgcggggggtctcttaattgcctgctacgtgattactgggaccagcgccgacctgaccgtagagaaggccgccgacgtcacgtgggaggaggaagccgagcaaaccggggtatcccacaacttaatgattacggtggacgacgacggtaccatgcgcatcaaggacgacgagaccgagaacatactgacggtcctgctaaagaccgcgctgctaatcgtgagcggtatcttcccttactccatccccgccactctactggtgtggcacacctggcagaagcagacgcagcggagcggggtactttgggatgtgccctccccgcctgagacacagaaggcggagctcgaggagggggtctatcgcatcaagcagcagggtatcttcgggaagacccaggttggcgtgggggtacagaaggagggtgtctttcacacgatgtggcatgtgacgcggggcgccgtcttgacccacaacgggaagcgacttgagcccaactgggccagcgtcaagaaggacctcatttcctacggcgggggatggcgtttaaacgcccagtggcagaagggcgaggaggtccaagtgatagccgtggagcccgggaagaatccgaagaacttccaaaccatgcccggaatcttccaaaccactaccggggagatcggcgcaatagcgttagacttcaaacccggcacctccgggagcccgatcatcaatcgtgagggcaaggtggtgggactgtacggcaacggggttgtgaccaagaacggcggctacgtgtccggtatagcccagacgaacgccgagcccgacggccccactcccgagttagaggaggagatgttcaagaagagaaacctgacgataatggacctgcacccagggagcggcaagacccgcaagtacttgcccgccatcgtccgcgaggccatcaagcgacggctgcgcacgttgattctcgcgcccacccgtgtggtggccgccgagatggaggaagccctcaaggggctgcccatccgctatcagacaaccgccaccaagtcagaacacaccggcagagagatcgtcgatcttatgtgccacgcgaccttcactatgcgcctgttaagcccggtgagagtgcccaattacaacctcgtaatcatggacgaagcccacttcacggaccctgcctcgatcgccgcccgcggctacatctcgaccagagtgggtatgggcgaggcggccgctatcttcatgacagccacgccgcccgggacagcggaggccttccctcagtccaacgcccccatccaggacgaggagcgcgacatccccgagaggagttggaattccggcaacgagtggatcaccgacttcgtgggaaaaacggtctggtttgtgcctagcataaaggccggcaatgacatagcgaactgcctgcggaagaacgggaagaaggtgatacagctgtcccgcaagacctttgacacggaataccaaaagacccgactcaacgactgggacttcgtcgtgaccaccgacatcagcgagatgggcgcgaactttaaggccgatcgcgttatcgacccccggcgctgcctgaagcctgtcatcctgacagacggccccgagcgggtgatactcgccgggcccatgcccgtgaccgcagcctcggcagcacagcgccgggggcgcgtcgggcgtaacccccagaaagagaatgaccagtatatctttaccggccaacccctgaacaacgacgaagatcacgcccattggaccgaggccaagatgctgctcgacaatatcaacaccccggagggcatcatccctgctctgttcgagcccgagcgcgagaaatccgcggctattgacggcgagtatcggctgaagggcgaaagccgcaagacttttgttgagctgatgcggagaggtgaccttcccgtgtggctggcccataaggtggccagcgaaggcattaagtacaccgacaggaagtggtgttttgacggggaacgcaacaaccagatcctcgaggagaacatggacgtggagatctggactaaggagggcgaacggaagaagctgcggccgcgctggttagacgcgcggacctactccgacccgctcgcgctgaaggaattcaaggacttcgctgccggcaggaagagcatcgccttggatctcgtaacggagatcgggagagtgccgagtcacttagctcaccgcacccggaacgccctcgacaacctcgtcatgctgcacacctctgagcacggcggtcgcgcttaccggcacgctgttgaggagctgccggaaaccatggagaccctcctgttactcggcctgatgatcctcctaaccgggggtgccatgctgttcctgatttcaggcaaggggataggcaagaccagcatagggctcatatgcgtgatcgtgagctccggcatgttatggatggcggacgtccccctgcagtggatagcctcggccatcgtgcttgaattcttcatgatggtgttactcatacccgagcccgagaagcagcgaactcctcaggacaaccagctcgcctacgtcgtgatcgggattctgacgctggccgcgatcgtggccgccaacgagatgggccttctggagaccacgaaaagagacctgggcatgtccaaggagccaggagtcgtgagccccacctcctacctcgacgtggacctgcaccccgccagcgcctggacgctctacgcggtggccactaccgtgattaccccgatgctccgccacacgatcgagaactccaccgccaacgtatccctggccgcgatagccaaccaggccgtcgtactgatggggctcgacaaggggtggcccatctccaagatggacctgggggtgcccctgctcgccctggggtgctatagccaggtaaatcctctgaccctaaccgccgcggttctgctgctcgtgacccactacgcgatcatcggcccgggccttcaggcaaaggccacgagggaggctcagaagcgcaccgcggcgggtatcatgaagaaccccaccgtcgacggcatcatgacgatcgaccttgaccccgtgatctacgactccaagtttgagaagcaattgggccaggttatgctgctggttttgtgcgccgtgcagcttctgctcatgcgtacctcttgggctttatgcgaagccctgaccctcgcgaccggtcccatcaccaccctctgggagggctcccccgggaagttctggaacaccaccatcgccgtgtcaatggctaacatattcagaggctcctatctggccggggcgggtctcgcgttcagcatcatgaagtcggtcgggacaggccggcgcggaactgggtctcagggcgagaccctgggggagaaatggaagaagaagctgaaccagctcagccggaaggagttcgacctgtataagaagtccggtataaccgaggtagaccgcactgaggcaaaagaagggctgaagcggggcgagacgacacaccatgccgttagtcgcggctccgcgaagctccagtggttcgtcgagcggaacatggtgatccccgaaggacgcgtgattgacctaggttgcgggcgcggaggctggagctactactgtgccggcctaaagaaggttactgaagtccggggatacaccaagggcgggcctgggcacgaggagcccgtaccgatgtccacgtacggatggaacatcgttaagctaatgagcgggaaagacgtgttttacctgccgcccgagaagtgcgacaccctactgtgtgacattggagagtccagcccctccccgactgtggaggagtcacgaaccatccgcgtcctcaagatggtggagccctggctgcgcaacaaccagttttgcatcaaggtgctgaatccctacatgcccacggttatcgagcacctggagcgactgcagcgcaagtatggtgggatgttggtgagaaatcccctctcccgcaacagcacgcacgagatgtactggatatccaatggcaccgggaacatcgtcagcagcgtcaatatggtgagccggctgctgctcaaccgctttaccatgacacaccgccgccccaccatcgagaaggatgtcgacctaggcgcaggcactcggcacgtaaatgccgagcccgagaccccgaacatggatgtaatcggggagcgcatcaagagaatcaaggaagagcactcttcaacgtggcactatgacgacgaaaacccatataagacttgggcctaccacgggtcgtacgaagtcaaagcaaccggaagcgcttcttccatgataaacggcgtcgtgaagctgctcacaaaaccctgggacgtcgtgcccatggtcacgcagatggccatgaccgacaccacgccgttcgggcagcagcgagtcttcaaggaaaaggtggacaccaggacgccgcgtcccatgccgggcacccgaaaggtgatggagatcactgccgagtggctctggcgcacgctcggccgcaataagaagcctcgtttgtgcaccagggaggaattcactaagaaagtccggaccaacgccgccatgggggccgtgttcacggaggagaatcaatgggacagcgcacgtgcagccgtcgaggacgaggagttctggaagctagttgaccgggagcgcgagctgcacaagctcggcaaatgcggatcctgcgtgtacaacatgatgggaaagagagagaagaagctgggggagttcggaaaggcgaagggctctcgtgctatctggtacatgtggctgggggcccgctacctcgagtttgaggccctgggcttcctgaacgaggaccactggttttcccgcgagaacagctactccggggtggaaggcgaggggctccataaactgggctacatcctgcgggacataagcaagatccccggcggggcgatgtacgcggacgacaccgcgggttgggacacgaggatcaccgaggacgatctccacaacgaggagaagatcacgcagcagatggaccccgagcaccgccaactggcaaacgcaatcttcaagctgacttatcagaacaaagtcgtgaaggtgcagcgccccacgccgaaagggaccgtaatggatatcatctcccggaaggaccagcgcggctcgggtcaggtagggacctacggtctcaacacgttcaccaacatggaggctcagctggtgcggcagatggaaggcgagggcgtcctttccaaggctgatttagagaacccacacctcctggaaaagaagatcacccagtggctcgagacaaagggcgtggagcgcctaaaacggatggccatctctggcgacgattgcgtggtcaaaccaatcgacgaccgcttcgccaacgccctgctcgccctgaacgacatgggcaaggtacggaaggacattcctcagtggcaaccgtccaagggttggcatgactggcagcaagtccccttctgctcacatcactttcacgagctgataatgaaggatggccgcaaactcgtcgtgccctgccgcccccaggacgaattaattgggcgggcacgcatttcccaaggcgccgggtggagcttaaaagagacggcctgcctcggaaaggcctacgcgcagatgtggtccttgatgtatttccaccggcgcgacctgcggctcgcatctaacgcaatctgctccgccgttccggtccattggatccccaccagccgaaccacctggtctatccacgcccatcatcagtggatgacgaccgaggacatgctgaccgtgtggaaccgggtgtggatcgaggacaatccttggatggaggacaagacccccgtcaccacctgggaagatgtgccgtatcttggcaaacgagaggaccagtggtgcgggtcacttattggcctgactagccgggctacttgggcccaaaatatcttgaccgcgatacagcaagtgcgttccctcatcggggacgaggagttccttgactatatgccgagcatgaagaggttccgaaaggaggaagagagcgagggcgccatatggtga

SEQ ID NO: 25736 - RNA, 9873 nt, synthetic construct
  misc_feature 1..9873: note = derived and/or modified CDS sequence (opt11) from DENV-3__GU131908__SS-prME
  source 1..9873: mol_type = other RNA
acctcactgtgcctgatgatgatgctgccggctacgctcgcgttccaccttacaagcagagatggtgagccacggatgatcgttggtaaaaacgagagaggaaagagcctcttattcaaaacagctagcggcatcaacatgtgcacactgatagcaatggacctcggcgagatgtgtgacgatactgtaacttacaaatgtccactgatcgcggaggtggaaccagaagacatcgactgctggtgcaacctgaccagtacctgggtgacctacgggacatgcaatcaggccggtgaacatcgtagggacaagcgatccgttgcattagcgccacacgtcgggatgggcctagatacgcgcacgcaaacatggatgtccgcagagggagcttggcgccaagtcgagaaagtcgaaacctgggccctacgccatcccgggttcacgatcctggcgttgttcctcgcgcattacataggcacgagcctaacgcagaaagtcgtgatcttcatcctcctgatgcttgtcacaccaagtatgacaatgagatgcgtcggcgtagggaaccgagattttgtagaaggcttgtccggggcaacgtgggtggacgtggtactcgaacacggcggctgcgtaactacgatggcgaagagcaagccgacactggacattgagttacagaaaacagaagccacacaactggccacgctacgaaagttatgcattgagggaaagatcaccaatatcacaaccgatagcaggtgcccgacgcagggcgaggccaccctcccggaggaacaggaccagaattacgtctgcaagcatacgtatgtcgaccggggatggggcaacggatgtggcctgttcgggaaagggtcactggtaacctgcgccaaattccagtgcctcgaaccgatagagggtaaagtggtacagtatgagaatctgaaatataccgtcataataacggtacacacaggcgaccagcaccaagtcggcaacgacacgcagggagttacagtggaaataaccccacaggccagtacggtggaagcagtgctgccagagtacgggaccctcgggttggaatgcagtccaaggacaggactagactttaacgaaatgatcctgctcacaatgaagaacaaagcctggatggtgcacagacagtggttctttgaccttccgctcccgtggacctcaggagcaacgactgaaacaccaacgtggaacagaaaggagctgctcgtcacattcaaaaacgcacacgccaagaagcaagaggtcgtagtgctcgggtcccaagagggggccatgcacacagcgctgacgggagcaacagagatccagaacagtggcggaacttccatatttgccggccacttaaagtgccggttaaaaatggataaactcgaactaaaaggaatgagctacgccatgtgcctaaacacatttgtgctcaaaaaagaggtaagcgaaacacagcacggcacgatactgatcaaagtagaatataaaggggaggacgcgccatgcaaaataccatttagcacggaggatggccaggggaaagcccacaacggtcggctgatcacggccaacccagtagtaacgaagaaggaggagcctgtcaacatcgaggccgaaccccccttcggggagtccaacatcgtaatagggatcggggataaagcgctcaaaataaactggtacaaaaagggatcatcaatcgggaaaatgttcgaggcgacggcgagaggcgcaaggaggatggctatcctcggcgacaccgcatgggatttcggcagcgtcggaggtgtgttaaatagcctagggaagatggtacaccaaatattcggcagcgcatacacggccctattcagcggcgtctcatggattatgaaaatcggtataggcgtgctattaacatggataggcctcaatagcaagaacacgagcatgtcgttcagctgtatcgtaatcggcatcatcactctatacctaggtgccgtagtacaggcggacatgggctgcgcgatcaactggaaggggaaagaactaaaatgcgggtcaggaatcttcgtcacaaacgaggtacacacgtggactgagcaatacaagtttcaggcagattcaccgaaaaggctagccacggcaatcgcgggagcgtggaagaatggggtatgtggcatccgttctacaacgcgcatggaaaatctgctgtggaaacaaatagcaaacgaattaaactacatattatgggaaaataacataaaactcacggtcgtcgtcggagacatcataggcgtcctggaacaggggaagagaacgctcacacctcagcccatggagctgaagtactcatggaaaacgtgggggaaggcgaagatcgtcacagcggaaacgcaaaacagcagctttatcatcgacgggcccaacactcccgagtgtccctcagcgagtagagcgtggaacgtctgggaagttgaagattatggattcggagtattcactacgaacatatggttgaaattaagggaggtctatacgcaatcgtgcgaccacagattgatgagcgctgcaatcaaagacgagcgggcagtgcacgcggatatgggatattggatagaatcgcaaaagaacggttcttggaagctggaaaaagcatctttcatcgaagtaaaaacctgcacctggccaaaaagccacacattgtggtccaacggggtactcgaaagcgacatgatcatcccgaaatcacttgcaggtccgatcagccaacacaaccaccggccgggctaccacacacagactgcaggaccatggcacctaggaaaattagagctggactttaattactgtgaaggtacaacggttgtaataaccgaaaactgcggcacaagagggcccagtctcaggactacgacagtaagcggcaagctaatacacgaatggtgctgtcgatcatgcacattgccccctctccgatatatgggcgaagacggttgttggtacggaatggaaatacggccgattaacgaaaaggaggaaaatatggtcaaatcactcgtcagcgcgggtagtggaaaggtcgacaacttcacaatgggcgttctctgtctcgccatccttttcgaagaggtaatgcgaggaaaattcgggaaaaagcatatgatcgctggggtactgttcaccttcgtgctgctactcagcggtcagatcacatggcgagacatggcccatactttaataatgataggaagcaacgcatcagaccgaatggggatgggagtaacgtacctggcactcatcgctacttttaaaatccaacctttcttagcattgggattctttctgcgaaaactaacgtcacgagaaaacctcctactgggagtggggcttgccatggccaccacactccagctacccgaagatatcgagcagatggccaacgggattgctctcggactcatgacgcttaagctcataacccaattcgaaacataccagctatggacagcgctagtgagcctaacttgcagtaacaccatctttacattaacagtagcgtggcgaacagccacactgatattggcgggggtgagtctgttgccactatgccaaagctccagtatgaggaaaaccgactggttgccaatgacggtggcggcaatgggagttcctccgctacccctgtttatattcagcctcaaggatacccccaagcggcgctcctggcccttgaacgaaggagtaatggcggtggggctcgtaagcatcctggcctcaagcctactaagaaatgacgtcccgatggccggaccgttggtggctggaggcctgctcattgcatgctacgttataaccggaaccagtgcggacctgacagtagaaaaagctgccgacgttacctgggaagaagaagcagaacagaccggcgtaagtcataatctaatgatcacggtagacgacgatgggacaatgcgcatcaaggacgacgagacagaaaacatactgaccgtgttgctcaaaacagcacttcttatcgtctctggcatttttccctactctattccggcaaccctgctcgtatggcacacctggcagaaacagacacagcgttcgggagttctatgggacgtgccctcaccacccgagacccaaaaagcagagctggaggagggggtatacagaatcaagcaacagggcatattcggaaaaacgcaagtaggcgtgggagttcagaaagagggggtattccataccatgtggcacgtaacccgaggggccgtcttaacgcacaatggaaagcgactagaaccaaactgggccagcgtaaagaaagacctgattagttacgggggcggctggaggctaaacgcgcagtggcagaaaggagaagaggtccaagtaatcgccgtagaacccggaaaaaacccgaagaacttccaaaccatgccaggtatcttccaaaccacaactggcgaaattggagccattgcactcgacttcaaacccggtacgagcgggtcaccaataatcaaccgggaagggaaagtggtcggactgtacggcaacggcgtcgtaaccaaaaacggaggatatgtgtccgggatagcgcagaccaatgcggaacccgatggaccgactcccgaactcgaagaagagatgttcaaaaagcgcaatctgacaataatggatctacaccccgggtcaggaaagaccagaaaatatctaccggcaatagtaagggaagccataaagaggcgcctacgaacgttgatactcgccccaaccagggtggtcgcagccgagatggaagaggcactcaagggattaccaatccgttaccaaaccacggccaccaaatcagagcacacaggacgagaaatagttgacttgatgtgccacgccacgttcaccatgcgattactatcccccgtaagagtcccaaactacaacctggtaatcatggatgaagctcacttcactgacccagcatcgattgcagcgcggggctacatcagcacccgggttggaatgggagaagcggctgccatctttatgacggccacgcctccagggacggcagaagccttcccacaaagtaacgcccccatacaggacgaggaaagggacataccagagaggtcgtggaactcaggcaacgagtggataactgactttgttggcaagaccgtatggtttgtcccctcaatcaaggcgggaaacgacatagcgaactgcctcagaaaaaatggcaaaaaggtaatacagcttagccggaagacctttgacacggaataccaaaaaacaagactcaacgactgggatttcgtagtgaccactgacatatccgaaatgggagccaactttaaagcggaccgagtcatagatccgcgaagatgtttgaagccagtcatattgaccgacgggccggaacgagtaatactggcaggtccaatgcccgtaactgcggcctcagctgcccagcggagggggcgtgtgggaagaaatccacaaaaagaaaacgaccagtacatattcacggggcagccgttaaataacgacgaagaccacgcccactggacagaagccaaaatgctccttgataacatcaatacaccggaggggataattccggcgctcttcgaacccgagcgggaaaagagcgctgctatagacggagaatatcgattgaagggagagtcacgcaaaaccttcgtagagctaatgagacgaggggatttgccggtctggctagcacacaaagtagcatcagaaggtataaagtatacggaccgtaaatggtgcttcgatggagagcgaaataaccaaattctagaggagaacatggacgtagaaatctggacaaaggagggagaaagaaagaagctaagacctagatggctagacgcaagaacgtacagcgatccactagccttgaaggaattcaaggacttcgccgcgggtaggaaaagtatagcgcttgacctagtgacagaaataggcagagtgccgagtcatctcgcacatcggacgcgaaatgccctggacaacctagtcatgctccacacttcggaacatgggggccgcgcctaccgacacgcagtcgaggaactgccagagacaatggaaaccctgctgttgttaggcttaatgatcctcctaaccggtggtgccatgctatttctcatttctgggaaaggaattggaaagaccagcataggactaatctgtgtgatagtctcaagcgggatgttatggatggccgacgtgcctctgcaatggatcgcatcggccatagtactggaattctttatgatggtactactgatcccggagccagaaaaacaacgcacaccacaagacaaccagctcgcatatgtagtcatagggattctcacactcgctgcaatagtcgcagctaacgagatgggactcctagagactacaaagcgcgatctgggtatgagcaaagagcccggagtagtaagccccacgtcctacctagacgttgacttacacccagccagcgcgtggacactatatgccgtcgcaaccacagtaatcactccaatgttgaggcataccattgaaaatagcacggccaacgtcagtttggcagctatagcaaaccaagccgtcgtattgatgggactcgacaaaggctggccgataagtaaaatggaccttggcgtacccctcctagcacttgggtgctacagccaggtaaatccccttaccctaaccgcggcggtgttgcttctggttacacactacgccatcattgggccagggctccaagccaaagcgacacgggaggcgcaaaaacgaaccgctgcaggaatcatgaaaaatcccaccgtagacggcatcatgaccatcgacctggacccggtcatatacgacagtaaattcgaaaaacaactgggtcaagtaatgctactagtactctgcgccgtccaattactgctcatgcggacctcatgggcgctctgcgaggcactgacactagcaacgggaccgattacaaccctatgggaaggaagcccaggaaaattctggaacaccacaatagcagtcagtatggcgaacatatttaggggaagttaccttgcaggcgcgggcctcgcattttcgatcatgaaaagtgtggggacagggcgacggggaacgggctctcaaggggagacactaggagaaaagtggaaaaagaaactgaaccaactgtctagaaaagaattcgatctctataaaaagagcggaattaccgaagtagacagaacggaggcaaaagagggcctaaagaggggggaaaccacccaccacgcagtatcccggggttccgccaaactacaatggttcgtagaaagaaacatggttataccggaaggacgagttatagacctagggtgcggaagaggaggttggagctactactgcgcagggctgaaaaaagtcaccgaagttagagggtatacaaaaggaggcccgggacacgaagagccagtgcctatgtccacatatggctggaacattgtaaaattgatgtcagggaaagacgtattttacctaccgccagagaagtgcgacaccctactgtgcgacataggcgaatcgagtccgtcgccaactgtcgaagaatcccgaactatccgggtactgaaaatggtagagccatggttacgcaacaaccaattctgcataaaagtgctcaacccctatatgccgacagtgatagaacacctagaacgactccagcgaaagtacggaggtatgctcgtacgcaacccgctttctaggaacagtacacacgaaatgtattggatctccaacgggaccgggaacatcgtaagctcagtgaatatggtaagcaggttactgctcaaccgtttcaccatgactcacagaagacccacaatcgaaaaagacgtggatctaggcgcgggaacgcgtcacgtaaatgccgaaccggaaacaccaaacatggacgttatcggggaacgaattaaacgtatcaaagaggaacactctagtacatggcactacgacgacgagaacccgtacaagacatgggcctaccatgggtcgtacgaagtaaaggcgacgggcagtgcaagtagcatgatcaacggcgtggtaaaactactaaccaaaccgtgggacgtagtaccgatggtaacccaaatggctatgactgacaccacaccgttcggccagcaaagagtgttcaaagaaaaagtcgacacgcgaacgccacgtcccatgccgggcacccgcaaagtcatggaaataaccgcagaatggctctggagaacactgggcagaaacaagaaaccccgactctgtaccagagaagaattcacgaaaaaagttaggaccaatgcagcaatgggggccgtcttcaccgaggaaaaccaatgggactcagccagggcggccgtagaggatgaagagttctggaagttagtagaccgcgagagagaactacacaaattgggaaaatgcggaagctgtgtctacaacatgatgggaaagcgcgagaaaaaactcggagaattcggaaaagccaagggatcacgggccatctggtacatgtggctaggcgcacgctacctagaattcgaggctctagggtttctgaatgaagaccattggttcagtagagaaaactcctattccggcgtagaaggggaaggactacacaagctcggatacatattgcgcgacatcagcaagatacctgggggcgccatgtatgctgacgataccgcaggctgggacacacgaataacagaggacgacctgcacaacgaggagaagataacacaacagatggatcccgagcaccgccaactggcaaatgccatctttaaactcacataccagaataaggtagtcaaagtgcagcggcccacacctaagggcacggtgatggatatcatcagccgcaaagaccaaagaggaagtgggcaagtaggtacctacgggctcaacacatttacaaacatggaagcccagttagtgcgacaaatggagggagaaggggtcctcagcaaggccgacctggaaaatccacacctcctggaaaaaaaaatcacgcaatggttggaaacgaaaggtgtggagcgactgaaacgtatggccatctccggagatgactgtgtcgtcaagccaattgatgacaggtttgcaaacgcgctattggccctgaacgacatggggaaagtgagaaaagatattccccaatggcaaccctccaaaggatggcacgactggcaacaagttccattctgcagccaccatttccacgaactcataatgaaagatggccgcaaattagtagtcccctgcaggcctcaggacgagctcatcggaagagccagaatatcgcagggcgccggttggagcctcaaggaaacagcgtgcctcggcaaagcatacgcgcagatgtggtcgctgatgtactttcacaggagggacttacgactcgcttcgaacgccatctgtagcgcggtaccagtgcactggatcccgacctctcggaccacgtggtccatccatgcgcaccaccaatggatgacaactgaagacatgctgaccgtctggaacagagtgtggatcgaagacaacccctggatggaggataaaacacccgtaactacctgggaagacgtcccatacctgggcaaaagagaagaccagtggtgcggttccctcataggattaacatcgagggcaacatgggctcaaaatatactgactgccatacagcaagtacgatcattaataggggacgaggaattcctagactacatgcccagtatgaaacggtttcgaaaagaagaggaatcagagggcgcaatctggtga

SEQ ID NO: 25737 - RNA, 9873 nt, synthetic construct
  misc_feature 1..9873: note = derived and/or modified CDS sequence (opt11) from DENV-3__GU131909__SS-prME
  source 1..9873: mol_type = other RNA
acgagcttatgcttgatgatgatgctccccgctacactcgcgttccaccttacaagtcgtgacggtgaacccagaatgatagtgggcaaaaacgaacgagggaaaagcctgctattcaaaacagcgtccggcataaacatgtgcacactcatagctatggacttaggagagatgtgtgatgacacagtcacttacaaatgcccactcattgcggaagtagaaccggaagatatcgattgctggtgtaacctcacatcaacatgggtaacctatggaacctgcaaccaagcgggcgaacaccgcagagacaaaagatccgtcgccctggcaccccacgtagggatgggcctagacacgcgcactcagacatggatgtccgccgaaggcgcctggcgacaagttgaaaaggtggaaacatgggcgtttcgccacccagggttcacaatactagcattgttcctcgcacactacataggcacgtccctaacacaaaaagtggttatcttcatcttactgatgttggtaacacccagtatgaccatgaggtgcgtaggagtgggcaaccgggatttcgtcgaaggcctatccggcgccacctgggtagacgtcgttcttgaacacggaggatgcgtgacaacgatggccaagagcaagcctacgctcgatatcgaacttcagaaaactgaagccacccaactggctacgctgcgcaaactctgcatcgaaggcaaaataaccaatataactacagactccaggtgccctacacaaggggaagcgacacttccggaagaacaagatcagaactacgtgtgcaaacatacatacgtagaccgaggctgggggaatggctgtgggttgtttggaaaaggtagcttggtcacctgtgcgaaattccagtgcctagaacccatagaaggaaaagtagtccaatatgaaaacttgaaatacaccgtcataataaccgttcacactggtgaccaacaccaagtaggcaacgacacgcaaggagtaacagtcgagatcacaccccaagcgtcgaccgtggaagcagtgttacccgaatacggaacgctggggctggagtgctctccgcggacaggcctggattttaatgagatgatactactcacgatgaaaaacaaagcctggatggtacacaggcaatggtttttcgatttaccactcccctggacaagtggagctactacagagacaccaacgtggaatcgaaaggagctcctcgtgaccttcaaaaatgcacacgcaaagaaacaggaagttgtcgtgctcggtagccaagaaggagccatgcacacagcactgacgggggctacagaaattcaaaatagcggcggaacctccatcttcgcagggcacctgaaatgcagattgaagatggacaaactcgaattgaagggcatgtcatacgcgatgtgtctaaacacctttgtcttgaagaaggaagtttccgaaacccagcatggaaccatcctaatcaaagttgagtataaaggtgaagacgctccctgcaagataccattctccacggaggacggacagggcaaagcccataacggtcggctgatcactgcaaacccagtcgtaaccaagaaagaagaaccagtaaatattgaagcagaacccccgttcggggaatcaaacatagtgattgggataggtgacaaagctctcaagataaattggtacaagaaaggaagctcaatcggaaagatgttcgaggccaccgcacgaggagcacgaagaatggcaattcttggagacacagcgtgggactttggatcagtaggcggggtcctaaacagcttaggaaagatggtacaccaaatcttcggcagcgcctatacggccctgttcagcggggtttcatggatcatgaaaatcgggattggcgtcctcctcacctggataggcctaaactcaaagaatacatctatgtcattttcttgtatagtcattggaataataacactgtacctaggggcagtagtccaggccgacatgggctgcgccatcaactggaaagggaaagagttgaagtgcggaagcggaatatttgtcacaaacgaagtacacacatggacagaacaatacaaattccaggccgacagtcctaagcgacttgcaaccgcaattgccggggcctgggagaacggagtatgcgggatacgcagtacgacacgtatggaaaatctgctgtggaaacagatagccaacgagctgaactacatactatgggaaaataacatcaaactgacggtcgtagtcggagacatcatcggtgttctcgaacaggggaaacggactctcactccgcagcctatggaacttaaatactcatggaagacctggggcaaagccaaaatcgtaactgctgaaacacaaaattcctcgttcataattgacggaccgaacacgcccgagtgccccagtgcgagccgggcctggaacgtatgggaagtcgaggactacggtttcggggttttcacaacaaacatctggctgaaactccgtgaagtatacactcagagctgcgaccaccgcttgatgagcgcagccattaaagacgaacgcgcggtccacgctgacatggggtactggattgaatcccaaaagaatggaagctggaaactagaaaaggcatcgttcatagaagtaaagacctgcacctggccgaagagtcacacgctatggtccaacggcgttctggagagcgacatgataataccaaagagcctcgcagggcctataagtcagcacaaccatcgccccgggtaccatacgcaaactgccggaccgtggcacttaggtaaactcgagctagatttcaactactgtgaagggacgaccgtggtcatcactgaaaattgcggtacgagagggccttccctcagaacaaccacagttagcggtaagctaatccacgaatggtgttgccgtagctgcactctaccacccttgcgatacatgggcgaagatggatgctggtatggaatggaaatacgaccaataaacgaaaaagaagaaaatatggtaaagtccctggtaagcgcaggctccggaaaagtcgacaatttcacgatgggcgtcctgtgccttgcaatcctattcgaggaggtcatgagggggaaatttggaaagaaacacatgatcgcgggcgtcctattcacctttgttctgctcctctctggccaaatcacatggagggatatggctcataccctaatcatgataggttcgaacgcgtcagaccgcatgggtatgggtgtaacatatctcgcactgatagctacatttaagatccagccatttctggcactgggattcttcctccggaaactgacatctagagaaaacctcttgctaggagtaggcctagccatggctaccacactccaactgcccgaggatatcgaacagatggcgaacggtatagctctcggtttgatgactttgaagctaatcacccagttcgagacctaccaactgtggacagcgctagtgagtttaacatgtagcaacacaatattcacactcacggtggcatggcggacggcaacattaatcctcgcaggggtctcgctactgccgctgtgccagtcgtcgtccatgaggaaaacagattggctgcctatgaccgttgccgcgatgggggtacctcccctaccgctttttatattttcgctcaaagacacgccaaaacggcgaagctggcccctcaacgaaggggtcatggcagtaggactcgtatcaattctcgcctcgtcactgctacgcaacgacgtgcccatggcaggacctctagtcgcaggcggccttctcatagcatgctacgtcattacggggaccagtgctgaccttactgtggaaaaggcagccgacgtcacctgggaagaagaggccgagcagaccggcgtttcccacaacctcatgatcacggtagatgacgacggaacaatgcgaatcaaggacgacgaaacagaaaacatccttacagtactcctgaaaactgcactcctcatagtaagcggcatcttcccctacagcatccctgcaacgctgcttgtatggcatacctggcagaagcaaacgcaacgctcaggggtcctctgggatgtcccatcaccaccggaaacacagaaagccgaactggaagagggagtataccggatcaaacagcaaggcattttcggtaaaacacaagtaggcgtcggcgtacagaaggagggcgttttccacacaatgtggcacgtaacacgcggcgctgttcttacccacaatggaaaacgcctggagccaaattgggcaagcgtcaaaaaggacctgatctcatatggaggtggatggaggctcaacgcccagtggcagaagggggaagaggtccaagtgatagccgttgagccaggaaagaacccgaaaaactttcagacgatgcccggcatcttccaaacaacaacaggagaaataggcgcgatagcgctagacttcaaaccgggaacgtcagggtctccaatcatcaacagggagggaaaagtagttggactctatgggaacggcgtcgtaacgaaaaacggaggatacgtaagcggtatagcgcaaacgaatgccgagcccgatggaccaacacccgaactagaggaggaaatgtttaagaagcgcaaccttaccataatggatctccatccaggatcagggaaaactcgtaagtatctaccggccatagtcagggaagctataaaacgacgcctgcggaccctaatcctagcaccgactcgcgtggtagctgcagaaatggaagaagccctcaagggcctgcccatccgctaccaaaccacagccacaaaaagcgaacacacagggagagagatcgtcgacctaatgtgccacgcaacattcacgatgcggcttttgtccccggtccgtgtacctaattacaatctggtcatcatggatgaagcacacttcactgaccccgcgagcatcgccgcgagagggtacattagtacaagggttgggatgggcgaagccgccgccatctttatgacggccacacccccgggcacggcagaagcattcccacaatcgaacgcgccgatccaagacgaggaacgggacataccggaacgcagctggaacagcggaaacgaatggatcacagacttcgtcggtaagacggtgtggtttgttccaagtataaaggcaggaaatgacatagccaattgcctccgaaagaacgggaagaaggtcatacaactatcccggaaaacattcgacacagaataccagaaaacacgcctgaacgattgggacttcgtggtaaccacagacatatcggagatgggcgcgaatttcaaagccgacagagtaatagatcccagacggtgtctaaagccagtaatcctcactgacggaccagaacgagtgattctcgccggacccatgccagtaaccgcagcgtcagccgcacaacgccggggacgggtcgggcgaaatccccagaaggaaaatgaccagtatatcttcaccggacaacccctcaacaacgacgaggaccacgcacactggacggaggccaagatgttgctagacaacatcaacacacctgaagggatcatcccggcccttttcgaaccagagagagagaagtcggcagcaatagatggagaatataggctcaaaggagaatccagaaagaccttcgtcgagctaatgcgccgaggggaccttccggtttggctcgcccataaagtggccagtgaagggatcaagtacacagatagaaaatggtgtttcgacggtgagaggaacaaccaaatactagaagaaaacatggacgtagagatatggacgaaggaaggagaacggaagaagctacggccgagatggctcgacgccagaacgtactccgatccgctcgcgctcaaagagttcaaagacttcgctgcaggacgaaaaagcatagcactggacctggtgaccgaaatcggacgcgtgccgtcccacctcgcgcatcgcacccgaaacgccctagacaatttagtaatgcttcacacaagcgagcacggcgggagagcctatagacacgcggtagaagaactgcctgaaaccatggagacactcttactgctcggcctcatgatccttctgaccggaggggcgatgttatttctcatatccggcaagggcataggcaaaaccagcataggcctcatatgcgtgatcgttagtagtggtatgctgtggatggccgacgttccgttacaatggatagcatcagccatagtactggagttctttatgatggtcctgctaatccccgaacccgagaaacaacggacgccccaggacaaccaactagcatacgtggtaataggaatcctaacgttggccgccatagttgcagcaaacgaaatgggcctcctagagaccacaaaacgagacctggggatgtctaaggaaccgggagtagtcagccccaccagctatctagacgtcgacctacatccggcaagcgcgtggacgctctatgcagtagcgaccacagtgatcactcccatgctgcgccatactattgaaaatagcaccgcgaacgtaagtcttgctgccattgcaaatcaggcagtcgtcctcatgggccttgacaaggggtggcccatctcaaaaatggacctcggagtgccactcctcgccctaggctgctactcccaagtgaaccccttgacgttgacagctgcagtgctactattagttacgcactacgcgatcatcggaccggggctacaagcaaaggctacacgagaagcccagaagcgaaccgcagctggcataatgaagaaccctaccgtggacgggataatgactatcgacctcgacccagtcatatacgactcaaaatttgagaagcaactcggccaagtaatgttactcgttctatgtgccgtacagttactcttaatgcgaacaagctgggctctttgcgaggctctgacacttgccaccggtccgatcaccacactttgggaaggctcgcccggtaaattctggaacacaaccatcgcggtcagtatggcaaacatcttccgcggttcgtacttggcaggggccggcttagccttcagtataatgaaaagcgtgggcaccggcagacgtgggacagggtcacaaggcgaaacgctaggcgaaaagtggaagaagaaactaaaccaactctcgcggaaagagttcgacctatacaagaaaagtgggattactgaagttgacagaacagaagcgaaagaaggactaaaacgaggggagaccacacaccacgcagtcagtagaggaagtgcaaaactgcagtggtttgttgaaagaaacatggtcataccggaggggcgagtaatcgacctcggctgcggcagaggaggttggagttactattgcgcagggctcaagaaagtgacagaggtcaggggttacacgaaagggggcccgggacatgaagaacccgtgccgatgtctacttacgggtggaacatagtcaaactaatgtcaggtaaggatgtcttctaccttccaccggagaaatgcgacaccctactttgcgatataggggaaagtagcccctcacccacagtcgaagaatccagaacgatccgcgtactaaaaatggtagagccgtggctccgaaataaccaattctgcataaaagtcctaaacccgtacatgccgaccgtgatcgagcatctagagagactacaaagaaaatatggaggcatgctagtcaggaaccccctgagtagaaatagcactcacgaaatgtactggatcagcaacggcacaggcaacatcgtaagcagtgtaaatatggtatccaggctattactaaaccggttcacgatgacgcaccgtaggccaaccatcgaaaaagatgtagaccttggcgccggtacgagacacgtaaacgctgaacccgaaacgccgaatatggatgtcataggcgaacgcataaagcggataaaagaagaacattcatcaacgtggcactacgacgacgaaaacccatacaaaacgtgggcctatcacggatcgtacgaagtaaaggcgacagggagtgcatcatccatgatcaacggggttgtcaaacttttgacaaagccatgggatgtagtacctatggtgacgcagatggccatgacagataccacgccgttcgggcaacaacgcgttttcaaagaaaaggtagacaccagaaccccgagacctatgccagggactaggaaggtgatggaaataaccgcggagtggttgtggcgtacgctaggacggaacaagaaaccgagactatgtacgcgcgaggagttcacgaagaaagtacgtaccaacgcggccatgggagcagtgttcacagaagagaaccaatgggactccgcccgcgccgcggtggaagacgaggagttctggaaattagtagaccgggagcgcgaactgcacaaactaggcaaatgcggcagttgtgtctacaacatgatgggaaaacgagaaaagaagctaggagaatttgggaaggccaaggggagtagggcaatatggtacatgtggctgggggcaaggtacttagagttcgaagcactaggattcctgaacgaggaccactggttttcacgagaaaattcatatagtggcgtggaaggcgaaggtctccacaagctgggatacatcctgagagatatctcaaaaattcccgggggcgccatgtatgcagacgacaccgccgggtgggacacacgaatcacggaggacgatcttcacaacgaagagaaaatcacacagcaaatggacccagaacaccgacagttagccaatgccatcttcaaattgacatatcaaaataaggtggtgaaagtgcaaaggcccaccccgaagggaacggtcatggacatcatatcgcgaaaagatcaacggggaagcgggcaagtgggaacatacggccttaacactttcacaaacatggaagcgcagttagtacgacagatggagggagagggggtacttagtaaagcagatctagagaacccccacctactcgaaaagaaaataacccaatggctcgaaaccaaaggagtggaacgcctaaaacggatggccattagcggagacgactgcgtggtaaaaccaatagacgaccgattcgccaacgccctcctcgcactaaacgacatgggaaaagtgagaaaagacatcccacagtggcagccaagcaaggggtggcatgattggcagcaagtaccattctgctcacaccacttccatgagctaatcatgaaagacggaagaaagctagtcgtcccatgccgaccgcaagacgaactaataggcagggccaggataagccagggcgcaggatggtccttaaaagaaacggcatgtctaggaaaggcctacgcacaaatgtggtcgctgatgtacttccaccgcagagacttaagacttgcatcaaacgccatctgttctgctgtaccagtgcattggatccctacgagtcgaaccacgtggagtatccacgcacaccatcaatggatgacgacggaagacatgcttaccgtctggaaccgcgtatggatcgaagacaacccttggatggaagacaagactcctgtaacaacgtgggaggatgtaccctatctcggcaagcgcgaggatcagtggtgcggcagcttaatcggtctcacttcgagagccacgtgggcccaaaacatactcacggcgatccaacaagtcaggagcttaataggcgacgaagagttcctggactatatgccctcgatgaagcggtttagaaaagaagaggaatccgagggcgcgatctggtga

SEQ ID NO: 25738 - RNA, 9873 nt, synthetic construct
  misc_feature 1..9873: note = derived and/or modified CDS sequence (opt11) from DENV-3__GU131912__SS-prME
  source 1..9873: mol_type = other RNA
accagcctgtgccttatgatgatgctgcccgccaccctggccttccacctcacctctagagacggcgaaccgcggatgatcgtggggaaaaacgaacgcggcaagagcctgctgttcaaaaccgcgagcgggatcaacatgtgcaccttgatcgccatggacctgggcgagatgtgcgacgacaccgttacctacaagtgccccctgatcgccgaggtggagccagaggatatcgactgctggtgcaacctcacctcaacttgggttacatacgggacctgcaaccaggcgggcgagcaccggagggacaagcgttcggtggcgctcgcgccacacgtgggcatggggctggacacccgcacccagacatggatgagcgccgagggtgcctggcgtcaggtggagaaggtggagacgtgggcgctccgccacccgggcttcaccatcctggcgctgttcctcgcccactacattggcacctccctgacccagaaagtcgtgatcttcatcctgctcatgctagtgacgccctctatgaccatgcggtgcgtgggggtgggcaaccgcgattttgtcgaggggctgtccggtgctacctgggtcgacgttgtcttagagcacggcgggtgcgtcaccacgatggccaagagcaagccaaccctggacatcgagctgcagaaaaccgaggccacccagctagcgacgctgcgaaaactttgtatcgaaggcaagattaccaatatcacgaccgattcaaggtgtcccacgcagggcgaggccaccctcccggaggagcaggaccagaactacgtttgcaagcacacctacgtcgaccgggggtggggcaacgggtgcggcctgttcggtaaggggtcgctggtgacctgcgccaagtttcaatgcctcgagcccattgagggcaaggtagtccagtatgagaacctgaagtacacggtgatcatcaccgtgcataccggggaccagcaccaggtcgggaacgacactcagggagtgacggtcgaaatcacgccccaggctagtaccgtggaggccgtgcttcccgagtacggcaccctggggctggaatgcagcccacgcaccggcctggacttcaacgaaatgatcctcttgacgatgaagaacaaggcgtggatggtccaccggcagtggttcttcgatctgcctctcccctggacctcaggcgcaaccactgaaacgcccacttggaatagaaaagagctgctggtgaccttcaagaacgcccacgccaagaagcaggaggtggtagtgttgggaagccaggagggcgccatgcacaccgcgctgacgggggccacggagatacaaaactccggtgggacgaacatcttcgccggacacctgaagtgccggctaaagatggacaagctggaactaaaggggatgagctacgcaatgtgcctcaacaccttcgtgttgaagaaggaggtcagtgagacgcagcacggaaccatcctgatcaaggttgagtacaagggcgaggacgccccgtgcaagatacccttcagcaccgaggacgggcaggggaaggcgcacaatggcaggctgatcaccgcaaaccccgtggtcacgaagaaggaggagcccatcaacattgaggccgagccgccctttggcgagtccaacatcgtgattggcattggggataaggccctcaagataaactggtacaagaagggctccagcatcggtaagatgttcgaggcgacagcccgaggcgcccgacggatggccatactgggcgacacagcctgggacttcggtagcgtgggtggggtgctgaacagcctcggcaaaatggtgcaccagatctttgggtccgcgtacaccgccctgttcagtggcgtgtcgtggattatgaagatcggcatcggggttctgctcacttggatcggcctgaatagcaaaaacacctccatgagcttctcctgtatcgtcatagggatcatcaccctgtacttgggcgccgttgtccaggccgacatggggtgcgtgatcaactggaagggcaaggaattaaagtgcggtaacgggatcttcgtgaccaacgaggtccacacgtggaccgagcaatacaagttccaggccgatagccccaagcgtctggcgaccgcgatcgccggctcctgggaaaacggggtgtgtggcattagaagcaccacgcgtatggagaatcttctgtggaagcaaatcgcgaatgagctcaactacatcctctgggagaacaacataaagctgaccgtggtagtaggtgacatcatcggtgtgctggagcagggcaagcgcactctcacgccacagccgatggagctgaagtactcttggaagacgtgggggaaggcgaagatcgtcaccgcggagactcagaacagctcattcatcattgacggccccaacacccccgagtgccccagcgcctcccgggcctggaacgtgtgggaagtggaagactacgggttcggggtattcacgaccaatatctggctgaaacttcgcgaggtgtatacccagtcctgtgaccaccggctcatgagcgccgcgatcaaggacgagcgagccgtgcacgccgacatgggatactggatcgagtctcagaagaacgggagctggaaattagagaaggcctcctttatcgaagtcaagacctgcacatggcccaagagccacacgctttggagcaacggcgtgctggagtcggacatgattatcccaaagtccctggccgggcccatcagccagcataaccaccgaccgggctatcacacccaaaccgccggaccatggcacctcggcaagctggagttagacttcaactactgcgagggcaccacggtggtcatcgccgagaactgcgggacccgcggcccctccttgcggaccaccacggtcagcgggaaactcatccacgagtggtgctgccgctcctgcaccctgcccccgctccggtacatgggagaggatgggtgctggtacgggatggagatccgccccataaacgaaaaggaggaaaacatggtcaagagcctggtctcagccggctctgggaaagtggacaacttcaccatgggcgtgctgtgcctcgcaatactatttgaggaggtcatgcgggggaaattcggcaagaagcatatgatcgccggggtgctgttcaccttcgtgctcctgctttccgggcaaattacgtggcgtgatatggcccacaccctcatcatgatcgggagcaacgcctccgaccggatggggatgggcgtcacctacctggcactgatcgccaccttcaagatccagcccttcctcgccctggggttcttcctgcgcaagctcactagccgggagaacctgttactcggcgtggggctggcaatggcgaccaccctgcagttacccgaggacatcgagcaaatggccaacgggattgcgctgggcctgatgactctcaaactgatcacgcagttcgagacctaccagctgtggacggcactcgtgtccctgacctgctccaacacgatcttcacgctgactgtcgcctggcgcactgccactcttatcctggcgggagtgagcctgctcccgctgtgccaaagttcgtcaatgcggaaaactgattggctgcccatgaccgtcgccgctatgggggtgccgcccctgccgctgttcatcttctcactgaaggacactcccaaacgcaagtcctggcccctcaacgagggggtgatggccgtcggccttgtgagcatcctggcctcttctctcctgcgtaacgacgtcccgatggccggcccgctggtcgcagggggcctcctgatcgcgtgttacgtgatcacggggacctccgcagacttgaccgtagaaaaggccgccgacgtcacttgggaggaggaggccgagcaaacaggcgtatcgcataatctcatgattaccgtggacgatgacggaaccatgagaatcaaggatgacgagaccgagaacattctgaccgtcctgctcaagacggcgctgctcatcgtgtccggcatcttcccctacagcatcccagccaccctcctggtttggcatacctggcagaagcagacccagcgatcaggcgtgctgtgggacgtcccctcgccacccgagacgcagaaggccgagctcgaggagggggtgtaccggataaagcagcagggcatattcgggaagacccaggtgggggtgggcgtgcagaaggagggcgtatttcacaccatgtggcatgtgacccgcggcgctgtactgactcacaacgggaagcggctggagcccaactgggcgtccgtcaagaaggacctcatcagctacggagggggctggcgcttgtccgcgcagtggcagaagggggaggaggtacaggtgatcgccgtcgagcccggcaagaatcctaaaaacttccagaccatgcccggaatcttccaaacgaccacgggagagataggagcgatcgccctggactttaagcccgggacatctggcagcccgatcattaaccgggagggtaaggttgtggggctatacgggaacggggtcgtgaccaagaacggcgggtacgtgtccggcatcgcgcagaccaacgccgagcccgacggccccacgcccgagctcgaggaggaaatgtttaagaagcggaacctgaccattatggacctgcacccggggagcggtaagacccggaaatacctccctgccatcgtacgcgaggcaattaagaggcgcctgcgtaccctgatactcgctcctacgagagtcgtggcggccgagatggaggaggccctgaaggggctgcccatacgttaccagaccaccgcctctaagtcagagcacaccggccgcgagatcgtggacctcatgtgccacgccactttcaccatgcggctgctgtctcctgtaagggtgccaaactacaacctcatcattatggacgaggcgcacttcacggatcccgccagcatcgccgcccgggggtacatctcaactcgcgtcggcatgggagaggccgcggccatcttcatgacggcgacgccgccggggaccgcagaggcgttccctcagtcaaacgcccccatccaggatgaggagcgggacattcccgaacgttcctggaactcgggcaacgagtggatcaccgacttcgtgggcaagacggtttggttcgtcccctcaatcaaggccggaaacgacatcgctaactgcctgcggaagaacggtaagaaggtgatccagctgagcagaaagaccttcgacaccgagtaccagaagacccgcctcaacgattgggacttcgtggtcacgaccgacatctcggagatgggcgccaacttcaaggcggacagagtgatcgacccccgccggtgcctgaagcccgtgatcctgaccgacggccccgagcgcgtgatcctcgccggaccgatgcccgttaccgccgccagcgccgctcagcggcgagggcgggtggggcgcaatccgcagaaggagaacgaccagtacattttcacgggccagcccctgaacaatgacgaagaccacgcccactggaccgaggccaagatgctgctcgataacatcaacaccccggagggcataatccccgccctgtttgagcccgaacgagagaagtccgcagcgatcgacggagagtaccgcctgaagggcgagagccggaagacattcgtggagctgatgcgccgcggggacctgccagtgtggctggcccacaaggtcgcctccgagggcatcaagtacaccgaccgcaagtggtgcttcgacggggagcggaacaaccagatcctcgaagaaaacatggacgtcgagatctggacgaaagagggcgagcgcaaaaagttacgaccgaggtggctggacgctcgcacctacagcgatcccctcgctctgaaggagttcaaggacttcgccgccggccggaagtccatcgcactggatctcgtaaccgaaatcgggcgcgtccccagccacctcgcccacaggacccggaacgcgctggacaatctcgtgatgctgcatacgtctgaacacggcgggagggcctaccgccacgccgttgaggagctgccggagaccatggagaccctcctgctgctcggcctgatgatcctgctcaccgggggcgccatgctgttcctgatctctggcaaggggatcggtaagacgagtatcgggctcatctgcgtcatagtgtcaagcggcatgctgtggatggccgacgtgcccctgcagtggatcgcgtccgccatcgtcctcgagttcttcatgatggtgctactgatccccgagcccgagaagcagcggaccccgcaagacaaccagctcgcctacgtggtcatcggcatcctgaccctggccgccatcgtggcggccaacgagatgggtctcctggagactacaaagcgtgacctgggcatgtctaaggagcccggggtggtctcacccaccagctatctcgacgtggacctgcaccctgcctccgcctggacactgtatgccgtggcgaccacggtcatcaccccaatgctccggcacacaattgagaacagcactgccaacgtgagccttgcagccatagcgaaccaggccgtggtcctaatgggcttggacaaggggtggcccatcagcaagatggacctgggggtgcctctgcttgccctgggatgctattcccaggtgaatcccctgacgttaaccgccgccgtcctgctgctcgtgacacactacgcgatcataggcccgggcctgcaagcgaaggccacccgagaggcccagaagcggacggccgcggggatcatgaagaaccccaccgtggacggcattatgaccattgacctggatcccgtcatctacgacagcaagttcgaaaagcagctcggccaggtgatgctgctggtgctttgcgccgtgcaactgctgctgatgcgcacctcctgggccctgtgcgaagccctgacgctcgccaccgggcccatcacaaccctgtgggaggggagtcctggtaagttctggaatacgaccattgcggtgtccatggctaacatctttcggggcagctacctcgctggggccggcctcgcgttctccatcatgaaatccgtggggaccggccgccggggcacggggagccagggcgagacgctgggggagaaatggaagaagaaacttaaccagctctctcggaaggagttcgacctgtataagaagtccggcatcactgaggtcgatcggaccgaggccaaggaggggctgaagcgcggcgaaaccacccaccacgccgtctcacggggtagcgctaagttacagtggttcgtggaacgcaatatggtaatccccgaggggcgcgtaatcgacttaggctgcgggcgcggcgggtggagctactactgcgccggcctgaagaaagtgacggaggtccgcggctacaccaaaggaggcccggggcatgaggagcccgtcccaatgagcacctacggctggaacattgtaaaactgatgtccgggaaggacgtcttctacctgccgcctgagaagtgcgataccctgctgtgcgacatcggcgagtcctccccaagcccgacggtggaagagagccggaccatacgcgtgctccggatggtagaaccatggctgcgcaacaaccaattttgtatcaaggtgctgaacccctacatgcccaatgtaatcgagcatctcgaacggctgcagaggaagtatggagggatgctggtccggaatccgctcagcagaaattccacccatgagatgtactggatcagcaacggcaccggtaacatcgtgtccagcgttaacatggtctcccggctcctgctcaacagattcaccatgacccaccggcgccccaccatcgagaaggatgttgacctgggcgcgggcacccgtcacgtgaacgccgagcccgagacccctaacatggacgtgatcggtgagcgcatcaagcggatcaaagaggaacacagttccacctggcattacgacgacgagaatccctacaagacctgggcctaccacggaagctacgaggtgaaggctaccggcagcgccagttctatgatcaacggtgtggtgaagctgctcacgaagccttgggacgtggtccccatggtgacccagatggcgatgaccgatactacgccgtttgggcagcagcgcgtgttcaaggaaaaggtcgatacccggacgccccggcccatgcccggcacccgtaaggtcatggaaatcacggccgagtggctgtggcgcaccctgggccgcaacaagaagccgcggctctgcaccagagaggagttcaccaagaaggtacggacgaatgccgccatgggggccgtattcaccgaggagaaccagtgggactccgcgcgcgccgccgtggaagatgaggagttctggaagctggtggacaaggaacgggagctgcacaagctcggcaagtgcgggagctgcgtctataacatgatgggcaagcgcgagaagaaacttggagagttcggtaaagccaaaggctctcgagcgatctggtacatgtggttaggggcccgctacctcgagttcgaggccctgggctttctgaacgaggaccattggttcagccgggaaaactcctacagcggggtggagggcgagggattgcacaaactaggatacattcttcgagacatcagtaagatccccggcggggccatgtacgccgacgataccgctggctgggacactaggataaccgaggacgaccttcacaatgaggagaagatcacccagcaaatggacccggagcaccgccaactggccaacgccatcttcaaattaacttaccagaacaaggtcgtcaaggtgcaacggcccacaccgaaggggacggtgatggacatcatatcacgcaaagaccaacggggctcaggccaggtcgggacctacggcctcaacaccttcaccaacatggaggcccagctggtgagacagatggagggggaaggcgtgttgagcgaagccgacctcgagaacccccacctactggaaaagaagatcacacagtggctcgagacgaagggggtcgagcggctgaaacgcatggcgatctccggtgatgactgtgtggtgaagcctatcgacgaccggttcgccaatgctctgttggccctcaacgatatgggaaaggtcagaaaggacataccccagtggcagccgagcaaagggtggcacgactggcagcaggtccccttctgctcccaccacttccacgaactgatcatgaaggatggccggaagctcgtggtcccgtgccgcccccaggatgagttaatcgggcgcgcccggatcagccagggcgcgggctggtccctgaaggagacggcctgcttgggtaaggcctacgcccagatgtggagcctgatgtacttccatcgcagagacctgcgcctcgcctctaacgcgatctgctctgccgttcctgtgcattggatcccgactagccggaccacgtggtccatccacgcccaccaccagtggatgaccacagaggacatgctgacggtctggaaccgagtgtggatcgaggacaatccctggatggaagacaagacgccagtgaccacgtgggaggacgtcccgtacctgggcaagcgggaggaccaatggtgcgggagcctcatcggcctgacatcccgcgccacctgggcgcagaacatcttaaccgccatccagcaagtgcgcagcctcatcggggacgaggagttcctggactatatgccctccatgaagcgctttcggaaggaggaggagagcgagggcgccatatggtga

SEQ ID NO: 25739 - RNA, 9873 nt, synthetic construct
  misc_feature 1..9873: note = derived and/or modified CDS sequence (opt11) from DENV-3__GU131913__SS-prME
  source 1..9873: mol_type = other RNA
acctctctctgcctgatgatgatgctgcccgcgacccttgctttccacctcaccagccgagacggcgaaccgcggatgatcgtggggaagaatgaacgggggaaaagcctcttattcaagactgcgagcgggatcaacatgtgcaccctcatcgccatggacctgggcgaaatgtgcgacgacaccgttacctacaagtgcccgctgatagccgaggtcgagcccgaggacatcgactgctggtgcaacctcactagcacctgggtgacctacggaacatgcaaccaggcgggcgagcacagacgtgacaagcggtcagtcgccctagcgccccacgtgggcatggggctggacacccgaacacagacctggatgagcgcggagggggcctggcgccaggtggagaaagtcgaaacgtgggccctcaggcatccgggttttaccattctcgctctgttcctagcccactacataggtacaagcctgacacagaaggtggtgatcttcatcctgctaatgctggtcacacccagcatgactatgcggtgcgtcggcgtgggaaatcgcgacttcgtggagggcctgtccggtgccacctgggtggacgtggtcctcgagcacggcggttgcgtgactacgatggccaagtccaaacccaccctggacattgagctgcaaaagactgaggccacacagctcgcgacgcttaggaagctctgtatcgagggcaagatcaccaacatcaccactgattcacgctgccccacgcagggcgaagccacgctcccggaagaacaggaccaaaattacgtgtgcaagcacacctacgtcgacagagggtgggggaatggatgcggcctgttcgggaagggaagcctggtaacctgcgccaaattccagtgcctcgaacccatcgagggcaaagtggtccaatacgagaacctgaagtataccgtcatcatcaccgttcacaccggtgatcaacaccaggtcgggaatgacacccaaggggtgactgtcgagataactccccaagcatccaccgtagaagccgttctgccggagtacgggacactcggattagagtgtagcccgcgcaccggcctggacttcaacgagatgatcctccttacgatgaagaacaaggcgtggatggtgcaccgtcagtggttcttcgacctgcctctcccctggaccagcggcgctacaacggagacccccacttggaatcgcaaagagctcctggtgacctttaagaacgcccacgctaagaagcaggaggtggtggtgctcggcagccaggagggcgcaatgcacacagcgctgacgggggcgaccgaaatccagaactccggtggtaccagcatcttcgccgggcacctgaagtgccggctcaagatggacaaactggagctgaagggcatgtcctacgccatgtgcttaaataccttcgtgttaaagaaggaggttagcgagacgcaacatggaaccatcctgatcaaggtggagtacaagggggaggacgccccgtgcaagattcccttcagcaccgaggacggccagggtaaggcgcacaacggccgcctgatcaccgctaaccccgtcgttacgaagaaggaggagcccatcaatatcgaggccgagccgcccttcggggaaagcaatatagtgatcggcatcggtgacaaggccttgaaaatcaactggtacaagaagggcagctccatcggcaagatgtttgaggcgaccgcccggggagccagacgaatggccatcctgggcgacactgcctgggactttgggagtgttggtggggtcctgaactccctcgggaaaatggtccaccagattttcgggtctgcgtacaccgcactgttctccggcgtgtcatggataatgaagatcggcatcggggtcctgctcacgtggatcggcctgaactccaagaacactagcatgtccttcagctgcatcgtgatcggtatcgttacgttgtacctcggcgcggtcgtgcaagctgacatggggtgcgtgatcaattggaaggggaaagagctgaagtgcggcaatgggatattcgtcacaaacgaggtgcatacgtggaccgagcaatacaagtttcaggccgactcccccaagcgcttagcgacggccatcgccggcgcctgggagaatggagtgtgcggcatccgcagcacgacgcggatggagaacctcctgtggaagcagattgcaaacgagctgaactacatcctgtgggaaaacaacattaaactgaccgtagtagtgggggatatcataggggtcctggagcagggcaagcgcaccttaacgccccagccaatggagctgaaatactcctggaagacgtggggcaaggcgaaaatcgtaaccgccgagacccaaaactcatccttcatcatcgacggtcccaacacccccgagtgcccatcggcctcgcgggcctggaacgtgtgggaggtggaagactacgggttcggcgtgttcacgactaacatctggctgaagctccgcgaggtgcatacacagagctgtgatcaccggctgatgagcgcggcaatcaaggacgagcgggccgtgcacgcggatatgggctactggatcgagtcccagaaaaacgggagctggaagctggagaaggcctcgttcatcgaggtcaagacgtgcacctggcccaagagccacacgctctggtctaacggcgtgctagagagtgacatgataatccccaagtccctggcggggcccatcagccaacacaaccaccgtccgggataccacacccaaaccgccgggccctggcacctaggtaaattagagctggacttcaactactgcgaaggtaccacggtcgtaatcgccgaaaactgcggaacacggggccctagcctacggaccacaacggtaagcggaaagctgatccacgagtggtgctgtcgcagttgcacccttcctcccctccgctacatgggcgaagacggttgttggtatggtatggagatccgtcccatcaacgagaaagaggagaacatggtcaagtccctggtgtccgcagggtccggtaaggtggacaacttcaccatgggcgtcctgtgcctcgcaattctattcgaggaggtgatgcgaggcaagttcgggaagaagcacatgattgctggggtgttattcaccttcgtcctcctattgtcgggccagattacgtggcgcgatatggctcatacgctcatcatgatcggcagcaacgcgtccgaccgcatggggatgggcgtgacctacctggcccttatagccaccttcaaaatccagcccttcctagcgctggggttcttcctacgcaagctcacgagtcgggagaacctgctgctcggcgtgggcctggccatggccacgacgctgcagctccccgaggacatcgagcagatggccaacgggatcgcgctgggcctcatgaccctaaagttaatcacgcagttcgagacctaccagctctggaccgctctagttagcctgacctgctccaacacaatcttcactctgacggtggcctggaggacagccaccctcatcctcgctggggtctctctcctccctctgtgccaatccagttccatgcgaaagaccgattggctgcccatgaccgtagcggccatgggagtaccccctctgccgctattcatcttcagcctgaaggatacccccaaacggaagtcgtggcccctcaacgagggggtcatggcagtgggcctggttagcatcctggcctccagcctcctccggaacgatgtccccatggccggtccgctggtggccggagggctcctgatcgcctgttacgtaattacgggcacctccgccgatttgaccgtggaaaaggcagccgatgtgacctgggaggaggaagcggagcagactggagtgtctcacaacttgatgatcactgtcgacgacgatgggaccatgaggatcaaggacgatgagacagagaacatcctgaccgtgctacttaagacggccctgctaattgtgtcaggcatctttccatattcgatccccgccacgctcctggtctggcacacctggcaaaaacagacccagcgtagcggtgtactctgggatgtgcccagtccacccgaaacacaaaaggccgaacttgaagagggggtctataggatcaagcagcagggcatcttcgggaagacccaggtgggggtgggggtccagaaagagggcgtcttccacacaatgtggcacgtgacccgcggcgccgtcctgacgcataatggcaagaggttggagcccaactgggcgtccgtcaagaaagacctcatcagctacggcggagggtggcgcctgtcagcccagtggcagaaaggggaggaagtgcaggtcatcgccgtggagcccggaaagaatcctaagaatttccaaaccatgcccggcatcttccagaccacgacgggtgagatcggcgccatcgcgctagacttcaagcccgggacctcgggcagcccgatcattaaccgtgagggcaaggtggtcgggctttacggcaacggggtggttactaagaacggcgggtacgtcagcggcatagcccagacaaacgccgagcccgacggccccactccggagttggaggaagagatgttcaagaaaaggaacctgaccatcatggacctgcaccccgggtcgggcaagacccggaaatacctcccagccatcgtgcgcgaggccatcaagcgccgactgcggaccctgatcctagcgcccacacgcgttgtcgcagccgaaatggaggaggccttgaaagggctgcctatccgatatcaaacaaccgccaccaagtccgagcacacgggtcgagaaatcgtggacttgatgtgtcacgcgaccttcaccatgcgtctactgtcgccggtgcgcgttcccaattacaatttagtgatcatggacgaggcccacttcaccgacccggccagtatcgccgcccgagggtacatcagcacaagagtgggcatgggcgaggctgccgcaatattcatgaccgccacgccgcccgggactgctgaggccttcccccagagcaatgctccaatccaggacgaggagcgggacatccccgagcgctcctggaactccggcaacgaatggatcacggacttcgtggggaaaactgtgtggtttgtgccgagcatcaaagctggcaatgacatcgccaactgcctacgcaagaacggcaagaaagtcatccagttatcccggaagacctttgacacagagtaccaaaagacgaggctgaacgattgggacttcgtggtgaccactgacatctcagagatgggggcgaatttcaaggccgaccgcgtcatcgaccccagacggtgcttaaagcctgtgatcctgactgatggccctgagcgcgtgatcctcgccggaccgatgcccgtaacggccgcctccgcggcccaacggcgaggccgcgtagggcgcaacccccagaaagagaacgaccagtacatctttaccggccagccactaaacaatgatgaggaccacgcccactggaccgaggccaagatgctgctcgacaacattaataccccggaggggatcataccggctctgttcgagcccgagcgcgagaagtcagcggccatcgacggtgaatatagactgaagggcgaatctcggaagaccttcgtcgagctcatgcgccgcggggatctgcccgtatggcttgcacacaaagtggccagtgagggcataaagtacacggaccgcaagtggtgcttcgacggagagcggaacaaccagattttggaggagaacatggacgtagaaatctggacaaaggagggcgagcggaagaagctgcgaccgcgatggcttgacgctcgcacttactccgaccccctcgccctgaaggagttcaaggacttcgccgccggccgcaagtctattgccctggacctcgtgacagaaatagggcgcgtgccctcccacttggcgcaccgaacgcgcaacgccctagacaacttggtcatgctgcacacaagtgagcatggtgggcgggcttatcgccacgccgtggaggagctgcctgagaccatggagaccctattgctgttaggcctgatgattctcctcacgggaggtgccatgctgtttctgatcagtggcaagggaatcggcaagacctccatcggactgatctgcgtaattgtatcatccggcatgttatggatggcggacgtaccccttcagtggatcgccagcgccattgtcctcgagttcttcatgatggtcctgctgatcccggaacccgaaaaacagcggacacctcaggataaccagctcgcctatgttgtaatagggattctgacgttggccgcgattgttgccgccaacgagatgggcctgttagagacaactaagcgcgacctgggcatgtccaaggagcccggtgtagtaagcccaacctcctacttggatgtcgacctccacccggccagcgcatggaccctgtacgcggtggcgacgaccgtgatcactccgatgttacggcacaccatcgagaactccactgccaacgtcagcttggccgcgatcgccaaccaggccgtggtgctgatgggccttgacaagggatggccgatatccaagatggatctgggcgtccccctgctcgcgctgggttgctatagccaggtgaaccccctgactctaaccgccgcggtgctgctgctcgtcacccactacgctattatcggcccgggcctgcaagccaaggccacgcgcgaagcacagaagcggaccgcggccggtatcatgaaaaaccctacagtggacggcataatgaccatcgatttagatcccgtgatctacgattcaaaattcgagaagcagctcgggcaggtcatgttactggtgctgtgtgccgtgcagctgttattaatgcgcactagctgggctctatgcgaggccctcaccctggcgaccggtcccatcaccacgctgtgggagggctcccccgggaagttctggaacaccaccatcgccgtctcgatggcgaacattttccggggctcctatttagccggggcgggcctagctttcagcatcatgaagtctgttggcaccggccgccgggggactgggtcgcagggcgagaccctgggcgagaaatggaagaagaaacttaatcagctgagccgcaaggaatttgacttatataaaaagtctggcatcaccgaggttgatcggaccgaagcaaaggaggggctgaagcggggcgagaccacgcaccacgccgtcagtcggggctccgccaaactccagtggttcgtggagcgcaacatggtgatccccgaaggtcgggtcattgacctgggatgtgggcgcggcggttggtcgtactactgtgcgggcttgaagaaagtaacggaggtgcgaggctacacaaagggcggccccgggcacgaggaacccgtcccgatgtccacttacggctggaatatcgtgaagctcatgagtgggaaggacgtgttctacctgccgcccgagaagtgtgacacgctgctgtgcgacatcggcgagtcttccccctccccgacagtcgaggagagccgtaccatacgtgtgttgaagatggtcgagccctggctgcggaacaaccagttctgcataaaggtcctgaatccctatatgcccaatgtcatcgagcacctcgagcgcttgcagcggaaatacggcggtatgctagtgcggaacccactcagccggaactccacccacgagatgtactggataagtaacggtacggggaacatagtcagctccgtgaatatggtctcccgcctattgctaaaccgtttcactatgacacatcgacggcccacaatcgagaaggacgtagacctgggggcaggcacgcgccacgtcaacgccgagccggagacaccgaatatggacgtcatcggggaacggatcaaacggatcaaggaggagcactccagcacctggcactacgacgatgagaacccctacaagacatgggcttatcacggaagttacgaggtcaaagccaccggatcggcgagctccatgatcaacggcgtggtcaagctgttgacaaagccctgggacgttgttcctatggtcacgcaaatggcgatgaccgacacgacgcccttcgggcagcagcgggttttcaaggagaaggtggacacccgcactccacggcccatgccggggacgcgcaaggttatggaaatcaccgccgagtggttatggcggaccctgggcagaaacaagaagccgcgtctctgcacccgagaggagttcactaagaaggtgcgtaccaacgcggccatgggggctgtattcaccgaggagaaccagtgggactcggcgcgggccgccgtcgaggacgaggagttctggaagctggtcgacaaggagcgcgagctacacaagctcggtaaatgcgggtcctgcgtgtataatatgatgggcaaaagagagaaaaagctgggggagttcggaaaggctaaaggcagccgcgctatatggtacatgtggctgggggccagatttctagagttcgaggccctgggcttcctaaacgaagaccactggttttcaagagagaacagctacagtggggtcgagggcgagggactgcacaaactgggctacattctacgggacatcagcaagatccccggaggggcaatgtatgcggacgacaccgccggctgggatacgcgcatcaccgaggatgacctccacaatgaagagaaaatcacccagcaaatggatccagaacaccggcaactggccaacgccatcttcaagctcacttaccaaaacaaagtggtgaaggtacagcgccccacgccgaaggggaccgttatggacatcatctctcgaaaggaccagcgcggcagcggccaggtggggacctacggccttaacacctttaccaacatggaggcccagctggtccggcagatggaaggggagggcgtcttatccgaagctgacctcgagaacccccacctacttgaaaagaagatcactcagtggttagagaccaaaggggtcgagcgattgaaacggatggccatctcgggcgacgattgtgtcgtcaagcccatcgacgaccgctttgccaacgctctgctcgcgctcaacgacatgggcaaggtccggaaggacatcccccagtggcaaccgtccaaaggttggcacgactggcagcaggtccctttctgctctcaccacttccacgagctgatcatgaaggacggacgtaaacttgtggtgccctgccggcctcaggacgaattaatcgggagagcccgcatcagtcagggggcggggtggtctctgaaggagacagcctgtctcggcaaggcctacgcccagatgtggtcgctgatgtactttcaccggcgtgacctgcggctcgcgagtaacgccatttgctcagccgtcccggttcattggatccccaccagccgtacgacctggtctatccatgcccaccaccagtggatgacgaccgaggacatgctgacggtatggaaccgcgtctggatagaagataacccatggatgggcgacaagacccccgtgacaacttgggaggacgtgccgtacctgggtaagcgcgaagaccagtggtgtggcagcctcatcgggttaacgagccgcgctacctgggcccagaacatccttacagccatccaacaggtccggtctttgataggcgacgaggagttcttagactacatgcctagtatgaagcggttcagaaaagaggaagagagtgagggggcaatctggtaa

SEQ ID NO: 25740 - RNA, 9873 nt, synthetic construct
  misc_feature 1..9873: note = derived and/or modified CDS sequence (opt11) from DENV-3__GU131914__SS-prME
  source 1..9873: mol_type = other RNA
accagtctgtgcctcatgatgatgcttcccgcaacgctagccttccacctcaccagccgggacggcgagccacggatgatcgttgggaaaaacgaaaggggcaaaagtctgctgtttaagacagcttcggggatcaacatgtgcaccctcatcgccatggacctgggtgagatgtgcgacgataccgtgacctataagtgccctctgatcgccgaagtggagcccgaggacatcgactgctggtgcaacctcacctctacgtgggtcacctatgggacctgtaaccaggccggcgagcaccggcgtgacaagaggtccgtggccctggcgccccacgtgggtatgggactggatactcgcacccagacctggatgagcgccgagggcgcctggcgccaggtggaaaaggtagaaacgtgggccctacggcacccggggttcaccatcctggcgctgttcctcgcccactacatcggcaccagcctgacccagaaggtagtgatcttcatcctgctaatgctggttacgcccagcatgacaatgagatgcgtgggggtgggcaaccgcgacttcgtagaaggcctgagcggggccacctgggtggacgtggtcctcgagcacggcgggtgtgtgacaacgatggctaagagcaaaccgacccttgacatcgagctgcagaagaccgaggccacccagttagcgacgttacggaagctgtgcatcgaggggaagattaccaacataactaccgactcccgctgccccacgcagggcgaggccaccctcccggaggaacaggaccagaactacgtgtgcaagcacacctacgtcgatagagggtggggcaacgggtgcggcctattcggtaaaggcagcctggtgacctgcgctaaattccaatgcttagagcccatcgaaggcaaggtggtccaatacgaaaacctcaagtacactgtgatcatcaccgtccataccggggaccagcaccaggtaggaaatgacacccaaggggtgacggtagagatcaccccgcaggcctccacagttgaggcagtgctgcctgagtacggcaccctcgggttggaatgcagcccccgcactggactggacttcaacgagatgatcctcctgaccatgaaaaacaaagcgtggatggttcatcgccagtggtttttcgacttaccgctcccctggacctccggcgccaccaccgaaactcccacgtggaaccgcaaggaactgctggtgaccttcaagaacgcgcatgcgaagaagcaggaggttgtcgtactcgggtctcaggagggcgccatgcacactgcactgacgggggctaccgagatacaaaattccggcgggacgagcatattcgccggccatctgaagtgccggctcaaaatggataagctggaactgaagggaatgagttacgccatgtgtctcaatacctttgtgctgaagaaggaggttagcgagactcagcacggaaccatcctgatcaaggtggagtacaagggcgaagatgccccgtgtaagataccgttctcaaccgaagacggacagggcaaggcgcacaacggccggctgataaccgcaaaccccgtcgtcacgaagaaggaggagcctatcaatatcgaagccgagccgccttttggggagagtaacattgtgattggtatcggcgataaggcgctcaagatcaactggtacaagaaaggatcctccatcgggaaaatgtttgaggctacagcccggggtgcccgccggatggccatattaggcgatacggcctgggactttgggagcgtgggcggagtgctgaattcactcggtaagatggtgcaccagatcttcggaagcgcgtatacggccctgttctccggcgtgtcgtggatcatgaaaataggcatcggcgttctgctcacgtggatcggcctgaattccaagaatacgagcatgtcatttagctgtatagtcatcgggatcatcaccctgtacctgggcgccgtggtccaggccgacatggggtgcgtaatcaattggaagggcaaggagctgaagtgcggcaacgggatcttcgtgacgaacgaggtacacacatggaccgagcagtacaagttccaagctgactcccccaagcgcctggccaccgccatcgccggcgcatgggaaaacggggtatgcgggatccgcagcacaacgaggatggagaacctcctgtggaagcagatcgccaacgagctaaactacattctctgggagaacaacataaagctcaccgtggtcgtgggggacatcatcggcgtgctggagcagggaaagcgcacgctcacgccccagccgatggaactgaaatactcctggaagacctgggggaaggccaagatcgtcactgccgaaacccaaaatagctccttcatcatcgatggccccaacacccccgagtgtccctccgcctcccgggcctggaacgtctgggaagttgaggactatggcttcggcgtcttcacgaccaacatctggctcaagctccgtgaagtgcacacccagagctgcgaccaccggctgatgtctgcggccatcaaagacgagcgcgccgtgcacgccgatatgggctactggatagagtcccaaaaaaacgggagctggaaactcgagaaggcctcctttatcgaggtgaagacctgcacctggcccaagagccacacgctctggtcaaatggagtgctggagagcgacatgataatccccaagagcctggccggacccatcagccagcacaatcacagacccgggtaccacacacaaaccgccgggccctggcatctcggcaagcttgagctggacttcaattactgtgagggcaccacggttgtcatcgccgagaattgcggcacacgcggcccaagcctccggacaacaacggtaagcgggaagctgatccacgagtggtgctgcaggtcctgcacccttcccccgctcaggtacatgggcgaggacgggtgctggtacggcatggagatccgccccatcaacgagaaggaggaaaacatggtgaagagcctggtctccgccggcagcggtaaggtggacaacttcacgatgggagtgctgtgcctcgccatactgtttgaggaagtgatgcggggcaagtttggcaagaagcatatgatcgcgggtgtgctgttcacatttgtgctccttctgtccgggcagataacgtggagagacatggcccatacgctaatcatgataggctcgaacgcctccgaccggatggggatgggcgtcacctaccttgccctgatcgcaactttcaagatccagccgtttctcgcacttgggtttttcctgagaaagctgacgtcccgggaaaacctgctgctcggagtcggcctggccatggcaaccaccctgcagctacccgaggacatcgaacagatggcaaacgggatcgcgctgggcctgatgaccctcaagttaatcacgcaattcgagacataccagctgtggacggcactcgtcagcctgacctgctccaatacgatcttcactttgaccgtcgcctggagaaccgccacactcatcctggccggcgtaagcctgttaccgctgtgccagtctagctccatgcggaaaaccgactggctgcccatgaccgtcgcggccatgggcgtaccgcccctgccgctgttcattttctctctgaaagacacccccaaacgaaaatcgtggccactcaatgagggcgtgatggccgtagggctggtttcgatcctggcctccagtctcctgcgcaacgacgtgccaatggccggtccgctggtagccggcggactccttatagcctgctacgttatcacgggcacctcagccgacctaacagttgagaaggccgcggacgtaacctgggaagaggaggcggagcagacgggggtcagccacaacctcatgatcaccgtggacgatgacggaacaatgcggataaaggacgacgaaactgagaacatactgaccgtcctactcaagactgcgctgctgatagtgagcggtatctttccctacagtattcccgccaccctgctggtgtggcatacttggcagaagcagacgcagcgcagcggagtcctttgggacgtgccgagcccgccagagacccagaaagcagagctcgaagagggggtgtatcggattaagcagcaggggatctttggcaagacccaggttggagtgggggtacagaaagaaggcgtcttccacaccatgtggcacgtaacccgcggggccgtactcacgcataacggaaaacggctggagcccaactgggcgagtgtcaagaaggatttgatctcgtacggcgggggctggcgcctttccgcccagtggcaaaaaggcgaggaggttcaggtgatcgccgtagagccggggaaaaatcctaagaactttcaaaccatgcccggcatcttccagacgaccacaggagagatcggcgccatcgcattagacttcaagcccggtacaagcggctccccgataataaaccgtgagggtaaggtggtgggcctctacggcaacggggtcgttaccaagaacggcgggtacgtgtcaggcatagcccagacaaatgccgagcccgatggccccacgcccgagctcgaggaggagatgttcaagaagcgtaatcttacaatcatggacctgcacccggggtcggggaagacacggaagtacctgcccgccattgtccgcgaggccatcaagcgccgcctgcggacgctcatcctcgcgccaacgagggtggtggccgccgagatggaggaagccctgaaggggctccccatccggtaccagaccacagccaccaaatccgagcacacgggccgcgaaatagtagacctgatgtgccacgcgaccttcaccatgagactactgtcccccgtgagggtgcccaactataacctcgtcataatggatgaagcccactttaccgaccctgcgtccatcgccgcccgggggtatatctccactcgggtaggaatgggggaggcggccgcaatcttcatgaccgccacccctcccgggacggcggaagccttcccacagtccaatgcacccatccaggacgaggagcgtgatatccccgaacgcagctggaattctggcaacgagtggataacggactttgtggggaagaccgtgtggttcgtgccctctatcaaggccgggaacgacatcgcgaactgtttacgaaagaacggaaagaaagtgatccagctgtcccggaagaccttcgacaccgagtaccaaaaaacgagactcaacgattgggacttcgtcgtgactaccgacatctccgagatgggtgcgaacttcaaagccgaccgggtgatcgaccctcgccgttgcctaaagccagtcatccttaccgacggcccggagcgcgtgattctcgccgggccaatgcctgttaccgccgccagtgcggcccagcggcgcggccgggtggggcgcaatccacagaaggagaacgaccagtacatttttaccggacagcctctgaataacgatgaagaccacgcacactggaccgaggccaagatgttactcgacaacatcaacaccccagaggggattattcccgccctgttcgagcccgagcgagagaagagtgcggccatcgatggcgagtaccgcctgaagggcgagtcccggaagaccttcgtcgagctcatgcgccggggggatctgcccgtctggctggcacacaaagtcgcgagcgagggcatcaagtacacggatcggaagtggtgcttcgatggggaacggaacaatcagatccttgaggaaaacatggacgttgagatctggacgaaggagggcgagcgtaagaagctccggccgcgttggctggatgcgcggacctactccgaccccctcgccctgaaggaattcaaggacttcgccgccggccgtaagtccattgccttggacctagtaacggagattgggcgcgtaccttctcacctggcacatcggacgcgcaacgcgctagacaacctagtcatgctacacaccagcgagcatggcgggcgggcataccggcacgccgtcgaggagctgcccgaaaccatggaaacactcctccttttgggcctgatgatcttgttaaccggaggtgccatgctttttcttatcagcgggaaagggatcggcaagacatccatcggcctcatatgtgtcatcgtgtcctccggcatgctgtggatggcggacgtcccactacaatggatcgccagtgccattgtgctcgaatttttcatgatggtgctgctgatcccggagccggaaaagcagcggaccccgcaggacaatcaattggcttacgtcgtgatcggcatcctgaccctcgccgcgatagtcgccgctaacgagatgggcctcctggagacgactaagcgtgatctgggcatgtcaaaggagcctggcgttgtcagtcccacctcctacctcgacgttgacctgcaccccgccagcgcttggacactgtacgcggtcgccacgacggtgatcaccccgatgctacgtcacaccatcgagaacagtactgccaacgtgtctctggcagcgatcgcgaaccaggcagtcgtgttaatgggcttagacaagggatggccaatcagcaagatggatctgggagtgccattactcgcactggggtgttacagccaggtcaaccccctaaccctcacagccgctgtgctgttgctggtaacccactacgctataatcggaccgggcctccaggccaaggccacgcgcgaggcccagaaacggaccgcagccgggattatgaaaaacccgaccgttgatggaatcatgaccattgatctagaccccgtaatctacgacagcaagtttgaaaagcagctgggacaggttatgctactggtcctttgcgctgtgcagctgcttctcatgcgtacatcttgggccctgtgcgaggcactcaccctggcgaccggccccatcaccaccctatgggaaggctccccgggtaagttctggaatactaccatcgccgtgtctatggctaacatattccgcggctcttatctagcaggtgccgggctcgcgttcagcatcatgaagtccgttggcactggccggcgggggacggggagccagggcgagaccctgggggagaaatggaagaagaagttaaaccaactcagccgcaaggagtttgacctgtacaagaagtccggtattaccgaggtggaccggacggaggccaaggaggggctgaagcgcggggagaccacgcaccacgccgtgagccggggctccgccaagctccagtggttcgtcgagcgcaatatggtgattcccgagggccgggtaatcgacctgggctgcgggcgcggcggatggagctactactgcgcgggcctgaaaaaggtcacagaggtacgaggctataccaagggaggcccagggcacgaggagcccgtgccgatgagtacctacggctggaacatagtcaagctcatgtcagggaaggatgtcttctacctgcctcccgaaaagtgtgacacgctgttgtgcgacatcggtgaatctagcccctccccgaccgtagaggagagccggacgatccgcgtcctgaagatggtagaaccctggttgcggaacaaccagttctgtatcaaggttctgaacccctacatgcccaacgtcatagaacatctcgagagactgcaacggaagtatggcgggatgctggtgcgcaacccactgagccggaactcaacacacgagatgtactggatctccaatggcacgggaaacatagtgagctccgtcaacatggtaagccgcttgctactcaaccgtttcacgatgacccaccgacgacctaccatagagaaggacgtcgacctgggagccggcacgcgccacgtgaatgccgagcccgaaaccccaaacatggatgtgatcggtgagcgtatcaagcgcatcaaggaagaacactccagcacctggcactatgacgatgagaacccctacaagacttgggcttaccatggctcctacgaagtcaaggccactggatccgctagttccatgatcaacggcgtggtgaagctgctcaccaagccctgggacgtcgtgcccatggtaacccagatggcaatgacggacacgaccccattcgggcagcagagagtcttcaaagagaaggtggacacccgcactccccggccgatgcccggcacacgcaaggtgatggagatcactgcggagtggctgtggaggaccctgggccgcaataagaagccgcgcctctgcacccgcgaggaattcaccaagaaggtccgcaccaacgccgctatgggtgcggtgtttaccgaggaaaatcagtgggacagcgctcgggccgccgtggaggacgaggagttctggaagctggtcgacaaggagcgcgagctgcacaagctcggcaagtgcgggtcctgcgtgtacaacatgatgggcaagcgcgagaagaagctgggtgagtttggcaaggctaaaggcagccgcgccatctggtacatgtggttgggggcccggttcctcgagttcgaggccctcggcttcctgaatgaggatcactggttctcccgcgagaactcgtattccggcgtggagggggaggggctccacaagctgggctacatcctgcgggacatcagcaagatcccaggcggtgccatgtacgcggacgacacagcgggctgggacactcgcatcaccgaggacgacctccataacgaggagaaaatcacccagcagatggaccccgagcacagacaactagccaacgctatctttaagttaacataccaaaacaaggtcgtaaaggtgcagagacctacgccgaaagggactgtgatggatattatctcccggaaagatcaacgcggctctggccaggtggggacttacggcttgaacacgttcaccaacatggaagcacagctggtgcgtcaaatggagggggagggcgtcctgtccgaggcggacctggagaacccccatctgcttgagaagaagatcacgcagtggctcgagaccaaaggggtggagcgattaaagcgcatggccattagcggggacgattgtgtcgtcaagccgatcgacgaccgcttcgccaacgccctgttggccctgaatgacatgggcaaagtgcggaaggatatcccccagtggcagccatccaagggttggcacgactggcagcaggtccccttctgtagccaccacttccacgagctgattatgaaggacggacgtaaactcgtggtgccgtgccggccccaggacgagctgatagggcgcgcgcgcatttcacagggcgccgggtggtccctgaaggaaaccgcctgcctcggcaaagcctacgctcagatgtggtccctgatgtactttcaccgacgcgacctgagactcgcaagcaacgccatctgttccgctgtgccagtccactggataccaacctcgcgcacgacgtggagtatccacgcccatcaccagtggatgaccaccgaggatatgctgaccgtgtggaaccgcgtatggatcgaggataacccctggatgggagacaagacccccgtcaccacctgggaggacgtgccatacctggggaaacgggaggaccagtggtgcggctccctaatcgggctaaccagccgggcgacctgggcccagaatattttaaccgccatccagcaggtccgcagcctcatcggcgacgaggagttcctggactatatgcctagcatgaagcggttccgcaaggaggaggagtccgagggagcgatctggtga

SEQ ID NO: 25741 - RNA, 9873 nt, synthetic construct
  misc_feature 1..9873: note = derived and/or modified CDS sequence (opt11) from DENV-3__GU131915__SS-prME
  source 1..9873: mol_type = other RNA
actagcctgtgtttgatgatgatgcttcccgccaccttggctttccacctcaccagccgcgacggcgaaccgcggatgatcgtgggcaaaaacgaacgcggaaaatcactgctgttcaaaaccgcgagcgggatcaacatgtgcaccttgatcgcgatggacctgggcgagatgtgcgacgacaccgtcacgtacaagtgcccactgatagcagaggccgagcccgaggacatcgactgctggtgcaacctcacctctacttgggtgacgtacgggacctgcaaccaggccggcgagcaccggcgcgacaagaggtccgttgcactggcaccccatgttggcatggggcttgatactcgcacccagacctggatgagcgcggagggggcctggcgacaggttgaaaaagtagagacgtgggcgttacgtcacccgggtttcaccatccttgctctgttcttagcccactacatcggcacaagtctgacgcagaaggtggtgatattcattctgctcatgttggtgacgccgtccatgactatgaggtgcgtcggggtaggtaatcgtgacttcgtggagggcctgtccggtgcgacctgggtcgatgtagtgctcgagcacggcgggtgcgtcaccacgatggcgaaaagcaagcccaccctggacatcgagctgcagaagacggaagcaacccagctcgccactctccggaagctgtgcatagagggcaagattaccaacatcactaccgactccaggtgccccacccaaggcgaggcgaccttgccggaagaacaggaccagaactacgtgtgtaagcacacgtacgtggaccgggggtggggtaacgggtgcgggctgttcgggaagggcagcctagttacctgcgcgaagtttcagtgcctcgagccgatcgaaggcaaggtggtgcagcacgagaacctgaagtacaccgtgatcatcaccgtgcacaccggagaccaacaccaggtgggtaacgacacccagggggtcacggtggagatcacgccccaggcctccacggtcgaagccgtgctgcctgagtacggcaccctcggcttagaatgcagccctcggaccgggctggacttcaacgagatgatcctgctgacaatgaagaacaaggcatggatggtacaccggcagtggttcttcgatctgcccctgccatggacctctggagccaccaccgagacgcccacttggaaccgcaaagagctgctagtcaccttcaagaacgcgcacgcgaagaagcaagaagtggtggtcctggggagtcaggagggcgcgatgcacactgccttaactggggccaccgagattcagaactccggcgggaccagcatcttcgcgggacacctaaaatgtcggctcaagatggacaagctggagctgaagggcatgtcttatgcgatgtgcctcaacaccttcgtgctgaagaaagaggttagtgagacgcagcacgggactatccttatcaaggtggagtacaagggcgaggatgcaccttgcaagatccccttcagtacggaggatggacagggcaaggcgcactccggccgcctgataaccgccaaccccgtggtgacgaagaaggaggagcctgtcaacatcgaagccgagccgcccttcggggagagtaacatagtaatcggcatcggggacaaggcgttaaaaatcaactggtacaagaaaggctcgagcattggaaagatgttcgaggccacagcccggggcgcccgccggatggccatccttggcgacacagcatgggacttcgggtcggtaggcggggtattgaacagcctgggcaagatggtgcatcagatcttcggctccgcctatacagccctgttctccggagtgtcctggatcatgaaaattgggatcggtgtcctgctcacctggataggcctaaacagcaagaacacctccatgagcttctcctgcatagtaatcggcatcattacactgtatctcggcgccgttgtccaggccgatatggggtgcgtgatcaactggaagggcaaggaattgaagtgcggcagcgggatattcgtgaccaacgaggtccatacgtggacagagcagtataagtttcaggcggactcgcccaagcgcctggcaaccgcgatcgccggcgcttgggagaacggagtgtgcggcatccgcagcaccactcggatggaaaatctcctgtggaaacagatcgctaacgagctgaactatatactgtgggagaacaacatcaaactgactgtagtcgtgggcgacatcatcggtgtgctggagcagggcaagcgaaccctcacgccccagcccatggagctgaaatattcctggaagacctggggtaaggcgaagatcgtgaccgccgagacccagaacagctctttcatcatagacggccccaatacccccgagtgtcccagtgccagccgggcgtggaacgtgtgggaggtggaagactacggttttggcgtttttacgactaacatatggctcaaactccgcgaggtgtatacccaatcctgcgaccaccggctcatgagcgccgccatcaaagatgagcgggccgtgcacgctgatatgggctactggattgagtctcagaagaacgggagctggaaactggagaaggcgtccttcatcgaggtcaagacttgcacgtggcccaaaagtcacacgctctggagcaacggggtcctagagtctgacatgatcatccccaagtccctggccgggccaatcagccagcacaatcaccggcccggctaccacactcagaccgccggaccctggcacctcggcaagctggagctggacttcaactactgcgagggaaccactgtggtcatcacggaaaattgcggtacccgcggcccctccctgcggaccacgaccgtatctgggaagctgatccatgagtggtgctgccgctcctgcacgctgcccccgctccggtacatgggcgaggacggatgctggtatggcatggagatccgtcccattaacgagaaggaggagaacatggtaaagagcctggtctccgccggcagtgggaaggtggacaacttcactatgggagtgttatgtctcgccatcctgttcgaggaggtcatgcggggtaagttcggcaagaagcatatgatagctggggtgctgttcacgtttgtgctcctgctttccggccagatcacctggcgggacatggcccacacactcattatgatcggctccaacgccagcgaccggatggggatgggcgtcacatacctggccctaatcgccacgttcaagattcagccgttcctcgctcttgggttcttcctgcgtaagctaaccagtagagagaacctgctgctcggcgtgggcctcgccatggccaccaccctgcagctcccggaggacatcgaacagatggccaacgggatcgcactgggtctaatgacgctaaagttaatcactcagttcgagacctaccaattatggactgctctcgtctcgttaacgtgctccaacactatcttcacccttacagtcgcctggcgcaccgccacccttatcctggctggtgtgtcgttattaccgctgtgccagtcgagctccatgcgcaagaccgactggttacccatgacggtcgcggccatgggcgtgccgccccttccacttttcatctttagcctaaaggatacgcctaaacgccgctcctggcccctcaacgagggagtgatggccgtaggactggtgagcatcctagcgtccagccttctgcgcaacgacgtgccaatggccggcccgctcgtcgctggaggcctccttatcgcctgctacgttataaccgggacctccgcagacctgaccgtggagaaggccgcagacgtcacgtgggaagaggaggcggagcagactggcgttagccacaacctcatgatcaccgtggacgacgacgggactatgcgtattaaggacgacgaaaccgagaacatcctgacagtcttactcaagaccgccctgctgatcgttagcggcatctttccgtactctatccccgcgaccctcctggtgtggcacacctggcaaaagcagacgcagcggtccggtgttctatgggacgtgcccagcccgcccgagacccagaaagcagagctcgaggagggagtgtacaggatcaagcagcagggcatttttggaaagacccaagtcggcgtcggagtccagaaggagggcgtcttccacaccatgtggcacgtgacgaggggcgccgtcttgacccacaacgggaagcgccttgaacccaactgggcgtccgtcaagaaggatctcattagctatggcggaggctggagattgaatgcccagtggcagaagggggaggaggtccaggtgatagccgtcgagcccgggaagaacccgaagaacttccagaccatgcccggcattttccagacaacaaccggtgagattggtgccatcgcactagatttcaagcccgggaccagcggcagccctatcataaaccgtgaaggcaaagtggtcgggctctatggtaacggggtcgtaactaagaatggtgggtacgtgtcaggtatcgcccagaccaacgccgagccggacggcccaacccccgagctcgaagaagaaatgttcaaaaagcggaatcttaccattatggacctgcatcccggttccggaaagaccagaaagtacttgcccgccattgtccgggaggccattaagcggagactgcgcaccctgatcctagcgcccacccgggtcgtggccgccgagatggaggaggccctgaaggggcttcccatccgctaccaaaccacggccaccaagtcagagcacaccggccgcgagatcgtcgacctcatgtgccacgctaccttcaccatgcgactgctgtcccccgtgcgggttcccaactacaatctcgtgataatggacgaggcccatttcacggaccccgccagcatcgctgcccgcgggtacatctccacccgggtggggatgggcgaggcggcagccatcttcatgaccgccacgcctcccgggacggcggaggctttcccccagtccaacgccccgatacaggacgaggaacgcgacatccccgagagatcgtggaactcagggaacgagtggataacagacttcgtggggaagaccgtctggttcgtgccctccatcaaggccggtaacgacatcgccaattgcctgcggaagaacggcaagaaagttatccagctgtcacggaagacctttgacaccgagtatcagaagacccggctcaacgactgggacttcgtcgtcaccaccgacatcagcgagatgggcgcgaatttcaaggccgatagagtgatcgatccccgacgctgcctgaagccggttatcttaacagatggacccgagcgggtaatcctcgccgggccaatgcccgtgaccgctgccagcgcggcccagcgccgggggcgcgtcggccggaacccacagaaggagaatgatcagtacatattcaccgggcaacccctgaacaacgacgaagatcacgcccactggaccgaggccaagatgttgctggacaacattaacaccccggaagggatcatccccgccctgttcgagcccgagagggagaagtccgcggccatcgacggcgagtacaggctaaagggcgagagtcgcaagacctttgtggaactcatgcggcgcggggacttgcccgtctggctcgcacacaaggtggcctccgagggcatcaagtacacagacaggaagtggtgctttgatggagagcgcaacaaccagatactcgaggagaacatggatgttgaaatctggaccaaggagggtgagagaaagaaactgcgcccgcgctggctggacgcacggacatatagcgatccactcgccttaaaagagttcaaagacttcgccgcgggccgcaaatccatcgccctggacctggtaacggagatcgggcgagtgcccagccacctggcgcaccgtacccggaatgccttagacaacttagtaatgctgcacacatcagagcacggcgggagggcctaccggcacgccgtcgaggagctgccggagaccatggagacgctcctgctgctcggtctgatgatcctgctcactggaggggcaatgctattcctcatctccggcaaggggataggcaagaccagcattggactcatctgtgtcatcgtgtccagcggcatgctgtggatggcggacgtccctctgcaatggatcgcctccgctatcgtgctcgaatttttcatgatggtgttactgatacctgagcccgaaaagcagcgtacaccccaggacaaccaactcgcctatgtagtgatcggaatcctgacactcgccgcgatagttgcggccaacgagatgggcctcctggaaaccaccaagcgggaccttggtatgagcaaggagcccggggtcgtttcgccaacctcttacctcgacgtagacctgcatcctgcctccgcctggacgctgtacgcggtcgccaccaccgtgatcaccccgatgctaagacatacgatcgagaacagcaccgcaaacgtgtccctggccgcgatcgccaaccaggccgttgttctgatgggcctcgacaaagggtggcccatatccaagatggacctcggcgtgccccttctcgcccttgggtgctactcccaagtaaaccccctcaccctgaccgccgcggtgctgctgttagtaacgcactacgccatcataggtccgggcctccaggccaaagccacccgggaggcccaaaagcgtacggccgcgggaattatgaaaaatccaaccgtcgacggaatcatgactatcgatctggaccccgtgatctacgactcaaagttcgagaaacagctcggccaggtgatgctgctcgtcctctgtgccgttcagcttctgctcatgcggacctcctgggccctgtgcgaagccctgaccctcgcgaccggccccatcacgaccctgtgggagggaagcccggggaagttttggaataccaccattgccgtgtccatggccaacatcttccgcggctcgtacctggccggggccggattggccttctccatcatgaagtccgtcgggacgggtcggcgcgggactgggtcccaaggcgagaccctaggagaaaagtggaagaagaagttgaatcaactctcgcgaaaggagttcgacctgtacaagaaatccggcataaccgaggtggataggaccgaggctaaggaggggcttaagagaggggaaacgactcaccacgccgtgtcccgtggcagcgcgaagctccagtggtttgttgagcgtaacatggtgattcccgaggggcgcgttattgacctgggctgtgggcgcggcggatggtcctactactgcgcgggcctaaagaaggttaccgaggtccggggctacacaaagggcgggcccgggcacgaggagcccgtgccgatgagcacatacggttggaatatagttaaacttatgtccgggaaggatgtgttctacttgccgcccgagaagtgtgacacgctgctgtgcgatatcggcgagagctccccaagccctaccgtggaagaatcccgcactatccgggtcctaaagatggtggagccctggctacgcaacaaccagttctgcatcaaggtactgaacccgtacatgccaactgtcatcgagcacttggagcggctgcagcgcaagtacggcgggatgctggtgcggaacccgcttagccgcaactccacccacgagatgtactggatcagcaatggcaccggaaatatagtttccagcgtcaacatggtatcccggctgttactcaaccgcttcacaatgacgcaccggcgccccacaatcgagaaggacgtcgacctgggcgccggcactcggcatgtgaatgccgagccggagacgcctaacatggatgttattggtgagagaatcaagcggatcaaagaggagcacagctccacgtggcactatgacgacgaaaatccctataaaacctgggcctaccacggctcctatgaggtcaaggccactgggagcgcttccagcatgatcaacggcgtggtgaagctgctgaccaaaccttgggacgtcgtgccaatggtgacacagatggccatgactgataccactccgttcgggcagcagagggtcttcaaggaaaaggttgacacgcggacgccccggcccatgcctgggacccggaaggtgatggagatcaccgccgagtggctgtggcgcacgctggggcgaaacaagaagccgcggctctgcacacgggaagagtttaccaagaaagtccgtaccaatgccgccatgggggcggtgttcacggaagagaaccagtgggactccgcccgcgccgccgtggaggacgaggagttctggaagctggtagaccgggaacgagagctgcacaagctcggcaagtgcgggagctgcgtgtacaacatgatgggaaagcgggagaaaaagctgggtgagttcggtaaagcgaagggaagtcgcgccatctggtacatgtggctgggtgcccgctacctagagttcgaggcccttggcttcctgaacgaggaccactggttcagccgcgagaactcctatagcggtgtggagggagagggactccacaagttaggctatatacttcgggacatctccaagatcccaggcggggccatgtatgcagacgacacggccggatgggataccaggatcaccgaggatgacctccacaatgaggagaagatcacgcagcagatggaccccgagcatcggcagttggccaacgccatctttaaacttacctatcagaataaagtcgtgaaagtgcagcgccccaccccgaaggggacagtcatggacataatttcccgtaaggaccagcgcgggtcaggccaagtgggaacctacggcctcaacactttcaccaatatggaggcccagttggtgcggcagatggagggggaaggcgtcctatccaaggcggacctcgagaacccccacctcctggagaagaagatcacccagtggctcgagaccaagggggtggagcgcctaaagcgaatggccatatccggagatgactgcgtggtcaagcccatcgacgaccgctttgcgaacgccctgctcgccctgaacgacatggggaaggtgaggaaagacataccccaatggcagccgagcaaggggtggcatgactggcagcaagtcccattctgcagccaccacttccatgaactgatcatgaaggacggccgaaagctagtcgtgccttgcagaccccaggatgagctgatcggacgggcacgcatcagccagggcgccgggtggtccctgaaggagacggcgtgcctcggcaaggcctatgcccagatgtggagcctcatgtatttccaccggcgcgatctgcgcttagcgtccaatgccatttgcagcgctgtaccagtccattggatccctacctcgcggaccacgtggtccatccacgcgcaccaccaatggatgacaaccgaggacatgctgaccgtgtggaaccgcgtatggatcgaggacaatccctggatggaggacaagacccccgtgacgacctgggaagacgttccgtacctgggcaagcgtgaggaccaatggtgtgggagcctcatcgggctgacgagtcgggcgacatgggcccagaacattctgacggccatccaacaggtccgcagcctcataggggacgaggagttcctggactatatgccctctatgaagcgtttccgcaaggaggaggaaagcgagggggccatctggtga

SEQ ID NO: 25742 - RNA, 9873 nt, synthetic construct
  misc_feature 1..9873: note = derived and/or modified CDS sequence (opt11) from DENV-3__GU131916__SS-prME
  source 1..9873: mol_type = other RNA
accagcctatgcctcatgatgatgctgcccgccaccctagcgttccacttgaccagccgggacggggagccccggatgatcgttgggaaaaacgagaggggcaaaagcctgctgttcaagaccgcgtccgggataaatatgtgcaccttaatcgccatggacctgggcgagatgtgcgacgacaccgtgacctacaagtgcccgctgatcgcagaggtagaacccgaagacatcgactgctggtgcaaccttaccagtacctgggtgacttacgggacgtgcaaccaggccggcgaacacaggcgcgacaaacgatcggtggccctggcgcctcacgtgggcatgggtctggacactcgtacccagacctggatgagcgccgagggcgcctggcgccaggtggagaaagtcgaaacatgggcactccgtcaccccgggttcaccatcctggcgctgttcctcgcccactatatcggtacctctctgacccaaaaggtggtgatattcatcttactcatgcttgtcacgccctccatgaccatgcggtgcgtcggggtgggcaaccgcgacttcgtcgagggcctgtccggggccacctgggtggacgtggtcctcgaacacggcgggtgcgtgaccacgatggccaagagcaagcccaccctggacatcgagctgcagaagaccgaggcgacccagctcgcgacgctgcggaagctgtgtatcgaggggaagatcaccaacattaccactgattcccggtgcccgacgcaaggcgaggccaccctcccggaggagcaggaccagaattacgtgtgcaagcacacctacgtcgaccgggggtggggtaacgggtgcggcttattcggaaagggcagcctagtgacctgcgccaaattccagtgcctcgagccaatcgagggcaaggtagtccagtacgagaacctgaagtacacggtgatcatcaccgtgcacaccggcgaccagcatcaggtcggcaacgatacgcagggggttaccgtcgaaatcacaccccaggccagcaccgtggaggctgtgctgcccgagtacggcaccctcggtctggagtgctccccgcgcaccggcctggacttcaacgagatgatcttgctgacaatgaagaacaaggcgtggatggtccaccgtcagtggttcttcgacctgcccctcccgtggacttccggcgccaccacagaaacgcccacctggaaccgcaaggagctgttagtgaccttcaagaatgcgcacgcaaagaagcaggaggtggtcgtgctaggcagccaggaaggcgccatgcataccgcgctaacaggcgccaccgagatacagaactccggtgggaccagcatcttcgccggccacctgaagtgccggctgaagatggacaagctggagctaaaaggcatgtcctacgccatgtgcctcaataccttcgtgctgaagaaggaggtcagcgagactcagcacggtaccatattaatcaaggtggaatacaaaggcgaggacgctccgtgcaagatcccctttagcaccgaggacgggcagggcaaggcgcataacggccgcctgatcaccgctaacccggtggtcacgaaaaaggaggagcctgtcaacatcgaggccgagccacccttcggagagtccaacatcgtgatcggtatcggggacaaggccctcaaaatcaattggtacaagaagggctcgtccatcgggaagatgttcgaggcgaccgcccggggcgcccgccggatggcaatattgggcgacaccgcctgggacttcgggagcgtcggcggggtgctgaactccctcgggaagatggtgcaccagatcttcgggtcagcgtacaccgccctgttttccggcgtcagctggatcatgaagatcggcatcggagtactgctcacgtggatcggtctgaactccaagaacaccagcatgtccttcagctgtatcgtgattgggatcataaccctgtacctcggcgccgttgtgcaggccgacatggggtgcgtaatcaactggaagggcaaggagctgaaatgcggctccgggattttcgtcactaacgaggtgcatacgtggaccgagcagtacaaattccaggcagactcacccaagagactggcgaccgccatcgccggcgcctgggagaacggggtgtgtggtatccgctccaccacccggatggagaacctcctgtggaaacagatagcaaacgagctgaactacatcctctgggagaacaacatcaaactgaccgtggtggtcggggacatcatcggcgtactggagcagggaaagcgtaccttgacgccacagccgatggaactgaagtacagctggaaaacgtgggggaaggcgaagatcgtgaccgccgagacccagaattcctcatttatcatcgacggccccaacacccccgagtgcccaagcgccagccgggcctggaacgtgtgggaggtcgaagactacgggttcggcgtgttcacgaccaacatctggctgaaactccgagaggtgtacacccagagctgcgatcaccggttaatgtccgcagccatcaaagacgagcgcgccgtacacgccgatatgggctactggatcgagagccagaagaacgggtcctggaagctggagaaggccagcttcatcgaggtgaagacttgcacctggccgaaatcccacactctctggagcaacggcgtcctggagtccgatatgataattcccaaaagcctggcggggccgatctcccagcacaaccaccggccaggctaccatacgcagaccgccgggccctggcacctcggcaagctagaacttgacttcaactactgcgagggcaccacggtcgtgatcactgagaactgcgggacgcgcggacccagcctacgaaccacgaccgtgagcggcaagttgatccatgagtggtgttgccgtagctgcaccctgcccccgctccggtacatgggcgaggacgggtgctggtacggtatggagatccgcccaatcaacgagaaggaggaaaacatggtcaaatccctcgtcagcgccggctccggaaaggtggacaattttaccatgggcgtcctgtgcctcgccatccttttcgaggaggtgatgcggggtaagttcggcaagaagcacatgatcgccggggtgctgttcactttcgtcctcctactgagcggccagatcacctggcgcgacatggcgcacaccctcattatgatcggctccaacgccagcgaccggatggggatgggagtgacctacctcgccctgatcgccacgtttaagatccaacccttcctcgccttagggttctttctgcgcaagctcacctcgcgggagaacctgctgctcggcgtgggcctggcgatggccaccacactgcaattacccgaagatatcgagcagatggccaacgggatagcactcggcctgatgacgctcaagctgatcacgcaatttgaaacttaccagctgtggaccgcgctagtctccctgacgtgtagcaacacgatcttcaccctgactgtggcctggcgcacggccaccctcatcctggccggggtctccctgttgccgctgtgccagagctctagcatgcggaagaccgactggctgcccatgaccgtcgccgcgatgggagtcccacccctgccgttattcatcttctccttaaaagacacgcccaagcgcaggtcgtggcccctcaatgagggggtcatggccgtcggcctggtgtctatcctggccagctcgctccttcggaacgacgtccccatggccggcccgctggtggccgggggcttgctgatagcgtgctacgtgatcaccggaaccagcgccgacctgactgtcgagaaggccgccgacgttacctgggaagaggaagccgaacagaccggcgtgtcgcacaacctcatgatcaccgtcgacgacgacgggacaatgcgcatcaaggacgacgagaccgagaacatcctgacggtgctgctcaagaccgcgctgctgatcgtgagcggcatcttcccctactccatacccgcaaccctgctggtttggcacacctggcagaaacagacgcagcgttccggcgtgctgtgggacgtgccatctccgcccgagactcagaaggcggaactcgaggagggggtctaccgtatcaagcagcagggcatctttggaaagacccaggtgggcgtgggggtgcagaaggagggcgtgttccacaccatgtggcacgttacgcggggcgccgtcctgacccacaacggaaagcgcctggaacccaattgggccagcgtgaaaaaggacctcatcagttacggcggggggtggcggctgagcgcgcagtggcagaagggggaggaagtgcaagtcatcgccgtggagcccggcaaaaatccgaagaatttccagacgatgcccgggatcttccagaccactaccggggagataggcgccatcgccttagacttcaaacccgggaccagcggatctccgatcatcaaccgcgagggcaaggtcgtcgggctgtacggcaacggtgtgatcaccaagaacggcgggtacgtatctggcatcgcgcagaccaacgccgagcccgacggccctacccccgagctggaggaggagatgttcaagaagcggaacctgacaatcatggacctgcacccggggtccggcaagacgcgcaagtacctccccgccatagtccgggaggccatcaagcgccggctgcgcacgcttatcctcgctcccacccgggtcgtggcggctgaaatggaagaggcccttaaggggctacccatccggtatcagaccaccgcgaccaagagcgagcacactggccgggaaatcgtcgacttaatgtgccacgcaaccttcacgatgcggctactgtcccctgtgcgggtacccaactacaacctggtcatcatggacgaagcgcacttcacggaccccgcctctatcgcagcccgcgggtatatctccacccgcgtcggcatgggcgaggccgcggccatcttcatgaccgccacgccgcccgggacggcggaagccttcccccaaagcaacgccccgattcaggacgaggagagggacatcccagagcgatcctggaacagcgggaacgagtggatcaccgacttcgtgggaaagaccgtctggtttgtgccctccatcaaggccggcaacgacatcgctaactgcctacggaagaacgggaagaaagtgatccagttaagccgcaagaccttcgacacagagtaccagaagacccggcttaacgactgggacttcgtcgtgaccaccgacatttccgagatgggtgccaacttcaaggcggatcgcgttatcgatccgaggcgctgcctgaaacccgtcatcctgacggacggccccgagcgggttatcctggccggaccgatgcccgtgaccgccgcctcagccgctcagcgtcgtggcagagtcggccggaatccccagaaggagaacgaccaatatatattcacaggccagcccctgaacaacgacgaggaccacgcccactggaccgaagccaaaatgttactcgataacatcaacacgccggaggggatcatccccgcgctgttcgagcccgagcgcgagaagtccgcagcaatagatggcgagtaccggctgaagggcgaaagccgcaaaactttcgtggagcttatgagacgcggggacctgcccgtttggctggcccacaaggtggcgtccgagggcatcaagtacaccgaccggaagtggtgtttcgacggggagcgcaacaaccagattttagaggagaacatggacgtagagatctggacgaaggagggcgagcgtaaaaagctgcgcccgcgctggttagacgcccgaacatacagtgaccccttggcgctaaaggagttcaaggacttcgccgccggccgaaagtctatcgccctggacctagtcacggagatcgggcgggttcccagtcatctggcccacaggacccggaacgcgctggataacctcgttatgctgcacaccagcgagcacggcgggcgcgcctaccggcacgccgtggaggagctgccggagaccatggagacgctcttattgttgggcctaatgatcctgcttacctcaggtgccatgctgtttctgatctcgggcaagggaatcggaaagacctccattggcctcatctgcgtcatcgtgtcttccgggatgctgtggatggccgacgtccccctgcagtggatcgctagcgccatcgtgctcgagttcttcatgatggtattgctgatccccgagcccgagaagcagcgcaccccgcaggacaaccagctcgcttacgtcgtgataggtatcttaacgctggccgccatcgtggcggccaacgagatggggctcttggagaccaccaagcgggacctgggaatgagcaaggagcccggcgtcgtgagccccacctcctacttggacgtggacttacaccccgcctctgcctggacgctgtacgccgtagcgaccactgtgatcaccccgatgctcagacacacgatcgagaacagcaccgccaacgtatccctggcagccatcgcgaaccaggctgtagtcctgatggggctcgacaagggctggcccatctccaagatggacctcggggtgcccctgctcgccctggggtgctactcgcaggtcaaccccttaactctcacagccgccgtgctgctgctagtgacgcactacgcgatcattgggccaggcttgcaggccaaggcaacccgagaggcgcagaagcgcacagccgcgggcatcatgaaaaatccaaccgtcgacgggattatgacgatcgacctggaccccgtgatctacgactccaagttcgagaagcaactgggccaggttatgctgctggtcctctgcgccgtgcagctgctgctcatgcggacctcttgggccttatgcgaagccctgaccctcgcgaccgggcccatcacgaccctgtgggaggggtccccgggcaaattctggaacacgacaatcgctgtctctatggccaacattttccgcgggtcctatctggccggtgcaggactcgcgttcagcatcatgaagtcggtcggcacggggcggcgcgggaccggctcacagggggagaccctgggcgagaagtggaaaaagaagttaaaccagctcagccggaaggagttcgacctgtacaagaagtctgggatcaccgaagtggaccgcaccgaggccaaggagggcctgaagagaggggagacgacccaccacgccgtgtcacgcggttccgccaagctccagtggttcgtcgagcgtaatatggtgattcccgagggccgggtgatcgacctgggatgtggccgcggaggttggagctactactgcgctgggctaaagaaggtcaccgaagtgaggggctacaccaagggggggccaggtcacgaagagcccgtcccgatgtccacgtacggatggaacatcgtcaaactcatgagcggcaaggacgtgttctacttaccccccgaaaagtgcgacacgctgttgtgcgacatcggggaatccagcccctccccgaccgtggaggaaagccgcaccatccgggttctcaagatggtggaaccgtggctacgcaataaccagttctgtatcaaggtgctaaacccctatatgcccacagtcatcgagcacctcgagcggctgcagcgcaagtacggcggcatgctcgtgaggaacccgctctcacgcaactcgacacatgaaatgtactggatctccaacgggaccggaaacattgtaagctctgtcaacatggtgagccggctgctgctcaatcgcttcaccatgacgcaccggcgccccaccatcgagaaggacgtcgatctgggggcgggcacccggcacgtgaacgccgagcccgagaccccgaacatggacgtgatcggcgaacgcatcaagcggattaaggaggagcactccagcacgtggcactacgacgatgagaacccctacaagacctgggcgtaccacgggagctacgaggtcaaggccacaggctccgctagctccatgatcaacggcgtggtgaagctactcaccaagccctgggacgtcgtgcccatggtgacgcagatggcgatgaccgataccaccccgttcggccagcagcgcgtcttcaaagagaaggtggatacgcggacacctcgccccatgcccggtacccggaaggtgatggagatcaccgctgagtggctatggcgtacgctgggccgcaacaagaaaccgcggctctgcacccgtgaggagttcaccaagaaggttcggaccaacgctgccatgggcgccgtgtttactgaagagaaccagtgggacagcgcgcgcgccgctgtcgaagacgaagagttctggaagttagtcgacagagagcgcgagctgcacaagctcgggaagtgcggttcctgcgtgtataacatgatgggtaagcgagaaaagaagctgggcgaattcgggaaggccaaggggtctcgcgcgatctggtatatgtggctgggcgcccggtacctcgagttcgaggccctggggttcctgaacgaggaccactggttctccagggagaactcctattccggcgtggaaggggagggcctgcacaagctggggtacatcctgcgggacatcagcaagattcccggcggcgctatgtatgccgacgacacggcgggctgggacacccgcatcaccgaggacgacctccacaacgaggagaagatcacccagcagatggacccagagcacagacagcttgccaacgccatcttcaaattgacgtaccagaacaaggtcgtgaaggtgcagcgccccaccccgaagggcaccgtgatggacatcatctcaagaaaagaccaacgcgggtcaggccaggtaggcacctacggcctcaatacgttcacgaatatggaggcgcagctggtgcgacagatggagggagaggacgtcctgtccaaggctgacctcgagaatccccacttattagagaagaagattacccagtggctcgaaacaaaaggggtggagcgcctgaagcggatggccatctccggcgacgactgcgtggttaaaccgatcgacgatcgcttcgccaacgcgctactcgctctgaacgacatggggaaagttcgtaaggacataccccagtggcaaccatccaagggctggcatgactggcagcaggtgcccttctgcagccaccacttccacgagctgatcatgaaggacggacgcaagctcgtcgtgccctgccgcccccaggacgagctgatcgggcgggccagaatctcgcagggcgcggggtggtctctgaaggagactgcctgtctcggcaaggcatacgcccagatgtggtccctgatgtatttccaccggcgcgaccttcggttagcgagcaacgcgatttgcagcgcagtgccggtccactggatccccacctccagaaccacatggtcaatccacgcccaccaccagtggatgacgaccgaagacatgctgactgtgtggaaccgggtgtggatcgaggacaacccctggatggaggacaagaccccagtaacgacctgggaggacgtgccctacctggggaagcgcgaagatcagtggtgcggctctttaataggcctgaccagcagagctacctgggcgcaaaacatcctgacagcaatccagcaggtccgctctctcatcggggacgaggagttcagcgactacatgccttccatgaagcggttccgcaaggaagaggagagcgagggcgcgatctggtga

SEQ ID NO: 25743 - RNA, 9873 nt, synthetic construct
  misc_feature 1..9873: note = derived and/or modified CDS sequence (opt11) from DENV-3__GU131917__SS-prME
  source 1..9873: mol_type = other RNA
acctcgctgtgtctcatgatgatgctgccggcaactttagcattccacctaacctcaagggacggagaaccgcggatgatcgttgggaaaaatgaaagaggaaaatcactcctgttcaaaacggcaagtggcatcaatatgtgtactctaatcgcaatggatcttggagaaatgtgcgacgacacggtaacatacaaatgtccactcatcgccgaagtagaacctgaagatatcgattgctggtgtaacctaacgtccacgtgggtaacgtacggcacgtgtaatcaagcaggagaacaccggcgggacaaacgcagcgtcgcattggctccacacgttgggatggggctagacacccgaacccagacctggatgagcgcagaaggggcgtggcgacaggtagaaaaagttgaaacatgggcgctccgtcacccaggcttcacaatactggcactcttcctcgcacactacatcggaacaagcctaactcaaaaagtagtcatatttacactcctaatgctcgtgacacccagcatgaccatgaggtgcgttggtgtgggaaacagggatttcgtagaaggactaagcggagccacatgggtagacgtggtgctcgaacatggcggctgcgttaccacaatggcgaaaagtaaacccacattagacatcgaactccagaagacagaagcaacacagctagccacattgcgcaaactgtgcatagaagggaaaataacaaacatcaccacggacagcagatgcccgacccaaggagaagccacgttacctgaagaacaggatcagaactacgtctgtaaacacacctacgtagaccgcggctgggggaacgggtgcggcctattcgggaagggaagcctagtcacatgcgcaaagttccaatgcctcgagccgattgaaggtaaagtcgtccagtacgaaaatctgaagtatacggtaattattacagtccacacaggggaccaacaccaagtaggaaacgatacacagggagtcactgttgagataaccccacaagcctccaccgtggaggcggtactccccgagtatggaaccttgggcttagaatgcagcccacgcacgggcctggacttcaacgaaatgatactcctaacaatgaagaacaaggcatggatggtccatcgacaatggttcttcgatttacctctaccgtggacaagcggagcgaccacagaaacccctacctggaaccgcaaggagctgttagtcacattcaagaacgcacacgccaagaaacaagaagtggtggtcctcgggtcacaagaaggagcaatgcacacagcgctaacaggcgccactgagatccaaaattccggaggcacaagtatctttgcaggacacttaaaatgccgccttaagatggataagctggaactaaaaggaatgagttatgcaatgtgtttaaacacttttgtcctcaaaaaggaagtgagcgaaacccaacacggcacaatcctaattaaagtcgagtacaagggcgaagacgccccatgtaagattccgttctcaactgaagacggccagggcaaagctcacaatggtagactcataactgccaaccccgtcgtgaccaagaaagaggaacccgtgaacatagaagctgaacccccgttcggcgaatccaatatcgtaatcggcatcggagataaagctctgaagattaactggtataagaaaggtagcagcataggtaaaatgttcgaggccacggcaagaggggctaggagaatggccatactaggagataccgcctgggacttcgggtcggtagggggagttctaaactcactaggcaagatggtccaccaaatcttcggcagcgcctacacggcgctcttttccggagtatcctggattatgaagatagggattggagtccttctaacctggatcgggctcaacagcaaaaacacctcaatgtccttcagctgcatagtcataggaatcataaccctctacctcggcgctgtcgtccaagcggacatgggttgcgtgattaactggaaagggaaggagctaaagtgcggcaacggaatctttgtgactaatgaggtgcatacgtggaccgagcaatacaaattccaagcagactcccccaagcggctagccaccgcgatcgccggagcgtgggaaaacggtgtatgcggaataagaagcacgacgcgaatggaaaatctcctgtggaaacagatcgcgaacgaactgaactacatcttatgggaaaataacataaaacttacagtagtggtgggcgacatcatcggtgtactcgaacaaggaaagagaaccctgacaccccaaccaatggagctaaaatatagctggaaaacatgggggaaggcgaagatcgtcacggccgaaacacagaacagctctttcattattgacggcccgaacaccccggagtgcccgagcgccagtcgcgcatggaacgtctgggaggtcgaggactatggcttcggtgtgttcacaacgaacatttggttaaaacttagagaagtctacacgcaatcttgtgatcacagactaatgagcgcagcaataaaagatgaaagagccgtccacgcggacatgggttactggatcgagagccagaagaacgggagctggaaattggaaaaggcctcgttcatagaagtaaaaacgtgtacgtggccgaaaagccacacgctatggtcgaacggagtattggaaagcgacatgataatcccgaaaagccttgcgggaccaatatcacaacataaccaccggccggggtaccacactcagacggcgggaccgtggcacctcggcaaactggagctggacttcaactattgcgaaggcaccaccgtagtcatcgcagaaaactgcggaactcgcgggccatctctccgcacaactaccgtctccggcaagctgatacacgaatggtgctgcagatcctgtacgcttccacccctccgttacatgggggaggacggatgctggtacggtatggaaataagacccatcaatgagaaagaggaaaacatggtaaaaagtctcgtaagcgcaggcagtggaaaagtcgacaacttcacaatgggagtgttatgtctagcaattctcttcgaagaagtaatgcgcgggaagtttggcaaaaagcacatgatcgccggggtactatttaccttcgtactgctgctgtccggtcagataacatggcgcgacatggcacataccctaattatgatagggtcaaatgcgagcgacagaatgggcatgggtgtgacgtacctggcactcatagccacgttcaagatccaaccgttcctggcactgggtttcttcctgcgtaaattaacctccagagagaacctactactcggagtgggcctcgccatggcaaccacgttgcagttgcccgaagatatagaacaaatggctaacggcatagccctaggacttatgacactaaaactcataacccaattcgagacgtatcagctgtggaccgccctcgtctcgctaacatgcagcaacaccatatttacactaacggtagcctggcgtaccgccaccctaatactcgcgggggtctccctgctaccgctgtgccaatcgagcagcatgcggaagactgactggctccccatgaccgtagctgcaatgggtgtacctccccttccactattcatcttctcgctcaaagacacaccgaaaagacgctcatggccactaaacgaaggtgtaatggcagtcggcctagtcagtatacttgccagcagcctactacgcaatgatgtccctatggccggcccccttgtcgccgggggcctactcatcgcttgctacgtaataaccgggacctcagcagatcttactgtcgagaaggctgctgacgtaacctgggaagaggaggcagaacagacaggagttagccacaaccttatgatcaccgtggatgacgacggtacgatgagaattaaagacgacgaaaccgaaaacattctgacagtactcctgaaaacagccttactgatcgtaagcggaatctttccctactctatacccgccacgctcctagtttggcacacctggcagaaacaaacacaacgcagcggggtcctctgggacgttccgagcccgcccgaaacccagaaagcggaattagaagaaggggtttaccggattaaacagcaagggatattcggaaaaacccaagtcggcgtgggagtccagaaagaaggcgtttttcataccatgtggcacgtcacgcgcggagccgtgctaacgcacaacgggaagcgcctagagccgaactgggcaagtgtcaagaaagacttaataagttacggcggaggatggaggctctccgcccagtggcaaaagggggaggaggtccaggtaattgccgtcgaaccaggcaaaaaccccaaaaattttcaaaccatgcccgggatcttccagacaacaacgggcgagatcggagctatagccctggacttcaaaccaggcacgtcgggaagtcctatcataaacagggaaggcaaagttgtagggctttatggaaatggggtggtcaccaaaaacggaggctacgtgagcggaatcgcacagacgaacgctgaaccagacgggccgacgcccgaactcgaagaagagatgtttaagaagcgtaatctcaccataatggacctacaccctgggagcgggaaaaccagaaagtacctcccagccatagtccgagaggcgatcaaacgaagactaagaactttgatcctggccccgacaagggtggtcgctgcagaaatggaagaggcccttaagggtctacctataaggtaccagaccacggccacaaagtccgaacacaccggccgcgaaatcgtcgacctgatgtgtcatgccacattcactatgaggctactgtcgcccgtaagagttccaaattacaacctcgtcataatggacgaagcccatttcaccgatccagctagtatcgcagcacgagggtatatctcaacacgtgtaggaatgggtgaggctgctgcgatattcatgacggcaaccccgccggggacagctgaggctttcccgcagagcaacgctccgatacaagacgaagaaagggacatcccagagcgttcttggaatagcggcaacgagtggattacggactttgtcggaaagacagtatggttcgtcccaagcatcaaagctggaaacgatatcgcaaactgcctacgcaaaaacggcaagaaagtcatacagctcagtaggaaaacgttcgatacggagtaccagaaaacccgtctgaacgactgggatttcgtcgtgacaacagatatctccgaaatgggagcaaattttaaagcggatcgagtgattgaccctaggaggtgcctaaaaccagtaatcctaaccgacgggccagagcgcgttatcctcgcgggaccgatgcccgtaaccgcggcctcagcggcgcaaagacgcggccgggtaggaaggaatccacaaaaggaaaatgaccagtacatatttacgggccaaccactaaacaacgacgaagaccacgcccattggactgaagctaaaatgctcctggacaacataaacacccccgagggcattataccagcgctattcgagccagagagagagaaaagtgcggccatagacggtgagtaccgtctaaaaggcgaaagcagaaaaacattcgtagagttgatgcgaagaggggacctgcccgtttggctagcacacaaggttgctagcgaaggcataaagtacaccgataggaagtggtgcttcgacggggaaaggaacaaccaaattcttgaggaaaatatggatgtcgagatatggacaaaagagggagagaggaagaagctgcgaccaagatggctcgacgcccggacttactccgatccgcttgcgctcaaagagttcaaagacttcgccgccggacggaaatcaatcgcgctcgaccttgtcacagagatcggtcgggtacccagccacctcgcgcacagaacaagaaacgcccttgacaatttagtaatgttacacacaagtgaacacggaggtcgggcctaccgacacgcagttgaagaactaccggaaacaatggaaacacttttgctgctcggtctcatgatccttcttacaggaggggcgatgctattcctaataagtggaaagggcataggcaagacgagtatcggtctgatatgcgttatagtaagttccgggatgctgtggatggccgacgttcccctgcaatggatagcgtctgccatcgtactcgagttcttcatgatggtgttactaataccggaaccggaaaaacaacggacaccccaggacaaccaactcgcatacgtggtaataggaatactaacactagcggcgatcgtggcagcaaacgaaatgggcctgttagagacgactaagagagaccttggaatgagtaaagaaccgggagttgtatcgccaacgtcctacttagacgtcgacctgcatccggccagtgcatggacactatatgccgtagcaacaaccgtgatcacgcctatgctgcgccataccatcgagaactccacggccaacgtgtccttggcagccattgcgaatcaagcagtcgtactaatgggactggacaaaggttggccaatctcgaagatggacctaggcgtacccctcttggcactaggctgttactcacaggtcaaccccctgaccctcaccgccgcggtccttctcctagtgacgcactatgctataataggccccgggcttcaggcgaaggctacacgagaagctcagaaaagaacggcggcgggaataatgaagaacccaactgtagatgggatcatgactatcgaccttgatcccgtcatctacgactcaaagtttgaaaagcaactgggacaggtaatgctattagtattatgcgcggtccagctgttgctaatgagaacatcatgggccctctgtgaagcacttacgctcgccaccggacccataactaccctatgggaggggtcaccgggcaagttttggaacaccacgatcgcagtgagcatggccaacatcttccgcgggagttaccttgccggagcgggtctggccttcagcataatgaagtccgtgggaactggcaaacgcgggacaggcagtcagggtgagacattgggtgagaaatggaagaagaaactgaatcaactctcaaggaaagaatttgacctctacaagaaaagcggaataacagaggtagacagaagtgaagcaaaagaagggctcaaacgcggagagacgacccaccacgcagtgtcacgaggctccgccaaacttcaatggttcgtcgagagaaacatggtaattccggaggggagagtgatcgacctcggatgtggaagagggggatggtcgtactattgtgctggactaaagaaggtaacagaggtgaggggctacaccaagggcggcccggggcatgaggaaccagtgccgatgtccacctacggttggaatattgtaaaacttatgagcggcaaggacgtgttctacctccctccggaaaagtgcgacacattattatgtgacatcggcgaaagcagcccgagccccacggttgaggaaagcaggaccatcagagtcctgaaaatggtagaaccttggctaaggaacaatcagttctgtatcaaagtgctcaacccctacatgcccacagtaattgagcacctggaacgattgcagcgtaaatacgggggcatgctcgtcaggaacccactctccagaaactcaacgcatgaaatgtactggatctctaatggaacagggaacatcgtgtcctctgtaaacatggtctcacggttgttattgaacaggttcacaatgacccacaggaggcccacaatagaaaaagacgtagatttaggggctggaaccagacacgttaacgctgaacccgaaaccccgaacatggacgtgatcggggaacgtataaaacgcataaaggaggagcacagtagcacatggcactatgacgacgagaatccgtacaaaacttgggcctaccatggcagctacgaggtaaaagctaccggcagcgcgagctccatgataaatggagtagtcaagctactgaccaaaccttgggatgtggtccccatggttactcaaatggccatgaccgacaccacgccgtttgggcagcaacgcgtattcaaagagaaagttgatacccgaacgcctcggcctatgcctgggacgagaaaagtgatggagataaccgcggagtggctttggcggacccttgggcgtaacaagaaaccccgactatgcacccgggaagagtttaccaagaaagtacgtacaaacgctgcgatgggcgcggtattcaccgaggaaaaccagtgggactcggcccgcgcggctgtagaggacgaagagttctggaaactcgtggacaaggagagagaactgcacaaattaggaaagtgcggctcatgcgtgtataatatgatgggaaaacgggagaagaaactcggggagtttgggaaagcaaaaggcagtagggcaatctggtacatgtggctgggcgcaaggtatctagagttcgaagcacttggttttctcaatgaggaccattggttcagccgagaaaactcatattccggggtggaaggagagggcctacacaaactaggatacatcttaagagacatatccaaaattcccgggggagcaatgtacgcggacgacacagccggctgggacacgagaataactgaagacgatctacataatgaagagaagataacacaacaaatggatccagaacatagacaactggcgaatgcgatttttaagctcacgtatcagaacaaagttgtgaaagtgcagcgtccgacaccaaagggcacggttatggatataataagtcgcaaggaccagcgaggaagcggacaagtgggcacttacggtctaaatacatttaccaacatggaagcacagctcgtccggcagatggagggcgagggagtcctaagcaaggccgacctagaaaacccccatctcctggagaagaaaatcatccagtggctagaaacgaaaggtgtcgagcgtcttaaacgcatggcaatatcaggggacgattgtgtcgtcaaaccaatagacgacaggttcgcgaacgccctgctagcactcaatgatatgggcaaggtgcgcaaggacataccccaatggcaaccaagcaaaggatggcatgattggcaacaagtgcccttttgtagccatcacttccatgagctaataatgaaggacgggcgcaagctggttgtaccctgccgaccgcaagacgaactgatagggagggcaagaatatcccaaggagcaggctggagtctcaaagaaaccgcctgcctaggtaaggcgtacgcgcaaatgtggtcgttaatgtactttcaccgacgtgacctgagactagcatcaaacgcaatatgcagcgcggtaccagtgcactggatcccgacctcccggacgacgtggagcattcacgcacaccatcaatggatgaccactgaagacatgctgagtgtctggaaccgagtctggatagaagacaatccatggatggaggataagacgccagtaacaacatgggaagacgtaccatatttgggcaaaagggaagaccaatggtgcggaagcctgataggactaacaagccgagcaacatgggcccagaatattctcacggcgatccaacaggttcggagcctaataggagacgaggagtttctggactacatgcctagtatgaagcgattccgcaaagaagaagagagcgaaggcgctatatggtga

SEQ ID NO: 25744 - RNA, 9873 nt, synthetic construct
  misc_feature 1..9873: note = derived and/or modified CDS sequence (opt11) from DENV-3__GU131918__SS-prME
  source 1..9873: mol_type = other RNA
acaagcctgtgtttaatgatgatgttgcccgccaccttagcctttcacctcaccagccgggacggcgaaccgaggatgatcgttgggaagaacgagcgaggcaagtccctgctgttcaaaacggcgtccggtatcaacatgtgcaccctcatagccatggacctgggcgagatgtgcgacgacaccgtcacctacaagtgcccactgatcgcggaagtggagccagaggacatagattgttggtgtaacctcactagcacctgggtgacctacgggacctgcaaccaggccggcgagcacaggcgggacaagcggtccgtcgccttagcaccccacgtgggcatggggctggacacccgcacccagacctggatgagcgccgagggcgcttggcgccaggtagagaaggtagagacgtgggcactccgccaccccggtttcaccatcctcgcactcttccttgcgcactacatcgggacctccttaacccagaaggtggtgatcttcatcctgctcatgctggtcactcccagcatgaccatgcggtgtgtaggggtgggcaatcgtgactttgtggagggtttgagcggggccacctgggttgacgtggtcttggagcacggcgggtgcgtgaccaccatggcaaagagtaaacccacgctggatatcgagctgcagaagactgaggccacgcagctcgcgacccttaggaagctgtgcatcgaaggtaaaatcaccaacatcactaccgattcacgctgtcccacacagggcgaggccaccctccccgaggaacaggaccagaactatgtgtgcaaacacacgtacgttgaccgggggtggggtaacgggtgcggcttgtttggtaagggtagcctggtgacatgcgccaagttccagtgcctcgagcccatcgagggcaaagtagtccagtacgagaatctgaagtatacggtgatcataaccgtgcacaccggggaccagcaccaggtaggtaacgacacccaaggggtgacagttgaaatcactccccaggccagtaccgtggaggctgttctgcccgaatacggtaccctcgggctggagtgcagccctcgcaccggcctggactttaacgagatgattctcctgacgatgaagaacaaggcgtggatggttcaccggcaatggttcttcgaccttcccctcccctggacctccggcgccaccactgaaacgcctacctggaaccgcaaggaactgctggttaccttcaagaatgcacatgccaagaaacaggaggtggtcgtgctcggaagtcaggagggcgccatgcacacagcgctgactggggccaccgagatccagaactccggcgggacctcaatcttcgccggccacctgaaatgccggctcaagatggataagttagagttgaagggaatgtcctatgccatgtgcctcaataccttcgtgctgaagaaggaggttagcgagacgcagcatgggaccatcctgataaaggtggagtacaagggagaggacgccccgtgcaagatccccttcagcaccgaagacggccaaggcaaggcgcacaacggccgcctaatcaccgccaaccccgttgtcaccaagaaagaggaacccgtgaacatcgaggccgagccgcccttcggggagtctaacatcgtgatcggtataggggataaagccctaaagatcaactggtataagaaggggtcgtccattgggaagatgttcgaggcgacagctcgtggtgcccgccgtatggccatcttaggcgacaccgcctgggacttcggtagcgtcggcggggtgctgaactccctagggaaaatggtgcaccagatctttgggagcgcgtataccgctttgttctccggcgtttcatggatcatgaaaatcggcataggggtgctgctcacgtggataggccttaactcaaagaacaccagtatgtccttctcgtgcatcgtaatcgggattatcaccctgtatctcggcgccgttgtgcaggccgatatggggtgcgtaatcaactggaagggcaaggagcttaagtgtggtaatgggatcttcgtcacaaatgaggtgcacacgtggacagagcagtacaaattccaggccgattccccaaagcgcctggcgaccgccattgccggcgcgtgggagaatggggtttgcggcatcaggagcacaacgcggatggagaacctcctgtggaagcagatcgccaacgagcttaactatatcctctgggagaacaatatcaaactgaccgtcgtggtaggtgacatcatcggcgtcctagagcagggcaagcgcaccctaaccccacaaccaatggagctgaagtactcatggaagacgtgggggaaggcgaaaatcgtgaccgccgagactcaaaacagctccttcatcatcgatggccccaacacacccgagtgcccaagcgcctcaagggcctggaacgtgtgggaggtcgaagactacgggttcggggtgttcaccacaaacatctggcttaaactccgcgaagtgtacacccagagctgcgaccaccggctgatgagcgcggccataaaagacgagcgcgcggtccacgccgacatgggctactggatcgagagccaaaagaacgggagctggaaattagaaaaggcctccttcatcgaggtgaagacctgcacctggcccaagagccatacgttatggtccaacggggtgctggagagcgacatgatcatcccaaagtccctagcggggcccatcagccagcataaccaccggccgggctatcacacccaaaccgccggtccttggcatctcggcaaactggagctggactttaactattgcgagggcacaacggtcgtgatcaccgagaactgcgggacacgtggcccctcgctccggaccacgaccgtgtccggcaagctcatacacgagtggtgctgccgctcttgcacgctgcccccgctccggtacatgggggaggacgggtgctggtacggcatggaaatccggcccatcaacgagaaggaggagaacatggtcaagagcctggtgagcgccggctcagggaaagtggacaactttaccatgggcgtgctgtgccttgcaattttattcgaggaagtgatgagagggaaattcggtaaaaagcacatgatcgccggggtgctgttcacgttcgtcctcctgctttccggccagatcacctggcgcgacatggcccacacgctcatcatgatcggcagtaacgcgtcagaccggatggggatgggcgttacttacctggccctgatcgcaactttcaaaatccagcctttcctcgctctggggttcttcctgcggaagctcaccagccgggagaacttactgttgggagtgggtttagctatggccaccaccctgcagctgcccgaggacatcgagcagatggccaatgggatcgccctgggcctgatgacgctaaagctgatcacccagttcgagacctaccagctgtggaccgctctggtcagcctgacatgctccaacaccatttttactctgacggtggcctggcgcacagctaccttgatcctggccggagtcagcttgctccctctttgccagagctcctccatgcggaagaccgactggctaccaatgaccgtcgccgcgatgggcgtgccgccgctgccgctgttcatcttctcccttaaggacacgccgaaacgccgctcctggcccctcaacgagggagtgatggccgtgggtctggtgagtatcctggcgtccagcctgctgaggaacgacgtccccatggccggcccgctcgtggccggagggctcttaatagcgtgctacgtgattaccggaacctccgccgatcttaccgtcgagaaggccgccgacgtgacttgggaggaggaggccgaacagacaggcgtcagccataacctcatgatcaccgttgacgacgacgggaccatgcgcatcaaggacgacgagaccgagaatattttaactgtgctattaaagactgcgctgctgatcgtttccggcatcttcccatactctataccagcgaccctcctggtctggcacacctggcagaagcagacgcagcggtcgggagtgttgtgggacgtgccctccccgccggagacccagaaggccgaactcgaggagggggtgtaccgcatcaagcaacagggaatcttcgggaagacccaagtgggggtgggcgtccagaaggagggtgtgtttcacaccatgtggcacgtaacgcggggcgccgtcctgacccataatggtaagcgcctggagccaaactgggcctccgtgaagaaggacctcatctcatacggcggagggtggcggctgtccgcacagtggcagaagggtgaggaggtacaggtgattgccgtcgagcccggcaagaacccgaaaaacttccagaccatgcccggcatcttccagaccactaccggggagatcggcgccattgccctggatttcaagcccgggaccagtggcagccctataataaacagagagggcaaggtggtcggtctatacggtaacggggtggtgaccaaaaacggcggctacgtctcaggcatcgcgcagacgaacgccgagcccgacggccccacacccgagctcgaggaggaaatgtttaagaagaggaacttaacaatcatggatctgcacccgggtagcggaaagacccgcaagtatctccccgccatcgtacgggaagccatcaagcgcaggctgcgcacgttgatcctcgcacccacccgggttgtcgcggcggagatggaagaggccctgaaggggcttcccataaggtaccagacaacagccacgaagtccgaacacaccggacgggagatagtggacctcatgtgccacgccaccttcaccatgcgcctgctgtctccggtgcgcgtgcctaactacaacctcgtgatcatggacgaggcccacttcacggaccctgcctccatcgccgctagggggtacatcagcacccgggtcggcatgggcgaggccgcggcgattttcatgacagccactcctcccgggaccgccgaagcgtttccccaatccaacgcccccatccaagacgaagaacgcgacatccccgagcgctcctggaactctggtaacgaatggatcaccgacttcgtcgggaaaaccgtgtggttcgtaccgagcatcaaggccggcaacgacatcgccaactgcctgcggaagaacggcaagaaggtcattcagctatcccgaaagacattcgacacggagtaccaaaagacccggcttaacgattgggacttcgtcgtgacaaccgacatcagcgagatgggtgccaacttcaaagcggatcgcgtcatagacccccggcgctgtctgaaaccggtgatcctgacggacggccccgagcgggtgatcctcgcggggccgatgcccgtcaccgccgcctccgctgctcagagacgaggccgcgtgggccggaacccccagaaggagaatgatcagtacatcttcaccggccaaccccttaacaacgacgaggaccacgcccactggaccgaggccaagatgctgctcgacaacatcaacaccccggaggggatcatccccgctctgttcgagcctgagagagagaaatccgcggctatcgacggcgaatatcggctgaagggcgaaagccgcaagacgttcgtcgagctcatgcggcgcggggacctgccggtgtggctggcccacaaggtggccagcgagggcatcaagtacaccgatcggaagtggtgtttcgacggggaacgtaacaatcagatcctcgaagagaacatggatgtcgagatttggaccaaggaaggcgagcggaagaagctgcgcccgcgctggttggacgcccggacttactccgaccctctggccttgaaggagttcaaggacttcgccgccggccggaagtccatcgccctggatctcgtgacggagatcggacgcgtgcccagtcatctggcccacagaactcggaatgcgctggacaacctcgtaatgctgcataccagcgagcacggagggcgagcctaccggcacgccgttgaggagctgccggagactatggagacactcctgctcctcggcctgatgatactgctcaccggtggcgccatgctgtttctcatcagtggtaaggggatcggaaagacctctatcggactcatctgtgtgatcgtcagctccggaatgctctggatggccgacgtgccactgcaatggatcgcgagcgccatagtgcttgagttcttcatgatggtcctgctgatccccgagcccgagaaacagcgcacgccgcaggacaaccagctcgcatacgtggtgatcgggatcctgacgctggccgccatcgtcgcggccaacgagatgggcctcctggagaccaccaagcgggacctgggcatgtccaaggaacccggggtcgtgagccctacatcctacttggacgtcgacctgcatcccgccagcgcctggactctgtacgcggttgcgaccaccgtgatcacccccatgctccgccatacgatcgagaactccactgccaatgtgagcctggcagctatcgcgaatcaggccgtggtgctgatgggcttagacaaggggtggccgatctccaagatggacctcggcgttcccctactcgccctggggtgttacagccaagtgaaccccctgacattaacggccgccgtgttattactcgtcacgcactatgcgatcatcggcccgggcctgcaggccaaggccacccgggaggcccagaagagaactgcggcggggatcatgaagaatccaactgtggacggcatcatgacgatcgacctggaccccgtgatctatgactccaagtttgagaagcagctcggccaggtcatgctgttggtcctctgcgcagttcagctgctgttaatgcgtaccagctgggcactgtgtgaggccctcaccttagccaccggtcccatcaccacgctgtgggaaggctccccggggaagttctggaacaccaccatcgctgtcagcatggccaacatctttcgcggttcctacctagccggggcggggctcgcattcagcatcatgaagtccgtgggaacgggcaaacggggcaccggaagccagggtgagaccttaggggaaaaatggaagaagaagctgaatcagctcagtcgaaaggagtttgacctgtacaagaagtccggcatcaccgaggtggatcgcagcgaagctaaagaggggctgaagcgcggcgagaccacgcaccacgccgtcagccggggcagcgctaagctccagtggttcgtcgagcgaaacatggtgatcccggaggggcgggtgatagacctgggctgcgggcgcggcgggtggtcctactactgcgccggcctaaagaaagtgaccgaggtgcgcggatacaccaagggagggcccgggcacgaggaacccgtcccaatgagtacctacggctggaacattgttaagctcatgtctgggaaggacgtgttttacctgccgccagagaagtgcgacaccttgttgtgcgatatcggcgagagctcaccctctcccaccgtcgaggagtcccgaaccatccgggtgctcaagatggttgagccctggctccgtaacaaccagttctgcatcaaggtcttaaacccctatatgccgacagtgatcgagcacctcgagcgcctgcagcggaaatacggcgggatgctcgtgaggaacccgctcagccggaactcgactcacgagatgtattggatatcaaacggcaccgggaacatcgtatctagcgtcaacatggtgtcccggcttctgctcaatcggttcaccatgacccaccgccggcctactattgagaaggacgtagacctgggagcgggcacccgccacgtaaatgccgagcctgagactcctaacatggacgttatcggggagaggattaagagaatcaaagaggagcactcctccacctggcactatgacgacgagaacccctacaagacgtgggcctaccacggcagctacgaggtgaaggccaccgggtctgcctccagtatgatcaacggcgtggtaaagttgctcaccaaaccctgggacgtggtgcccatggtcacccagatggcgatgacggacacgacgcccttcgggcaacagcgggtgttcaaggagaaggtggacacccgcacccctcgacccatgcctggtacccgcaaggtcatggagatcaccgctgaatggttgtggcggacgctgggccgaaacaaaaagccgcgcctctgtactagggaagagttcaccaagaaagtaagaaccaacgctgccatgggggccgtcttcaccgaagagaaccagtgggattccgcgcgcgccgcagtcgaagacgaggagttctggaaacttgtggataaggaacgcgaactgcacaagctcggcaagtgcgggagctgcgtgtacaacatgatgggaaagcgggagaaaaagctgggggagttcggaaaggctaagggctcccgtgcgatttggtacatgtggctcggggcccggtatcttgagttcgaggccctgggctttctgaacgaggaccactggttcagccgcgaaaattcctacagcggagtcgagggcgaggggctccacaagctgggatatatcctgcgggacatctccaaaatccccggtggggcaatgtacgccgacgacacagcgggctgggacacccgcattacggaggacgacctccacaacgaggaaaagatcacccaacagatggaccccgagcacaggcagctggccaacgccatcttcaagctgacctaccagaacaaggtggtgaaggtccagcgccccacaccgaaggggaccgtcatggacattatcagtcggaaggaccagagaggctccgggcaggtcggtacctatggtctgaataccttcacgaacatggaggcccagctggtccggcagatggagggcgagggcgttctgtccaaagccgatttagagaatccccacttactggagaagaaaatcatccagtggctcgagactaaaggagtggagcgcttaaaacggatggcaatctcgggcgacgactgtgtcgtgaagccaatcgacgaccgctttgccaatgccctcctagcgctaaacgacatgggcaaagtacggaaggacatcccccaatggcagccgtccaaggggtggcacgactggcagcaggtccccttttgttcccaccactttcacgaacttattatgaaggacggccgcaagctcgtggtgccctgccggccccaggacgagctgatcgggcgcgcccgcattagccaaggcgcggggtggagcctgaaggagaccgcgtgcctaggcaaggcttacgcacagatgtggagcctgatgtacttccatcggcgagatctgcgactcgccagcaacgcaatctgtagcgccgtcccggtacactggatccccacttcgcgcacgacctggagcatccacgctcaccaccaatggatgactaccgaggacatgctgagcgtgtggaaccgggtttggatcgaggacaacccttggatggaggacaagacgcccgttaccacgtgggaggacgtgccgtacctgggcaaaagagaagaccagtggtgcgggtccctcatcggactgaccagccgggccacgtgggctcagaacatcttgaccgccattcaacaggtgcgctccttgatcggggacgaggagttcctggactacatgccgagcatgaagcggttcagaaaggaagaggagtccgagggtgcgatatggtga

SEQ ID NO: 25745 - RNA, 9873 nt, synthetic construct
  misc_feature 1..9873: note = derived and/or modified CDS sequence (opt11) from DENV-3__GU131933__SS-prME
  source 1..9873: mol_type = other RNA
accagcctgtgtctcatgatgatgctgccggctaccctggccttccacctcacctcgcgggacggcgagccgcggatgatagtggggaaaaacgagcgcggcaaaagcttactgttcaaaaccgcgagcgggatcaacatgtgcaccctcatcgctatggacctgggcgagatgtgcgacgacaccgtgacctacaagtgcccactgattgccgaggttgagccagaggacatcgattgctggtgcaacctcaccagcacctgggtgacctacgggacgtgcaaccaggccggcgagcaccggcgcgacaaacggtccgtggccctggcgccccacgtgggcatggggctggacacccgcactcaaacctggatgagcgccgagggcgcctggcgccaggtggagaaagtcgagacgtgggccctcagacacccggggttcacgatcctggcgctgttcctcgcccactacatcggcacctcccttacccagaaggtggttatcttcatcctgctgatgctggtaacgcccagcatgaccatgcggtgcgtgggggtgggcaatcgcgacttcgtcgaaggcttatccggggctacctgggtggacgtggtgctagaacacggcgggtgcgtgaccacgatggccaagagcaaacccactttagacatcgaactgcagaaaaccgaggccacacaactcgcgacgctgcggaagctgtgcatcgagggcaagataactaacatcactaccgactcccgatgccccacgcagggcgaggccaccctccccgaggagcaggaccagaactacgtgtgcaagcacacctacgtcgaccggggttggggcaatgggtgcggccttttcgggaagggaagcctggtgacatgcgccaagttccagtgcctcgaacccatcgagggcaaagtggtccagtacgagaacctgaagtatacggtgatcatcaccgtgcacaccggcgaccagcaccaggtcggcaacgacacccagggggtgacggtcgagatcacgccccaggcctccaccgtggaggcggtgttacccgagtacggcaccttaggcctggagtgcagcccgcgcacaggcctggacttcaacgagatgatcctcctgacgatgaagaacaaggcgtggatggtccatcggcagtggttcttcgacctacccctcccctggacctccggcgctaccaccgagacgcccacatggaataggaaggagctcctggtgactttcaagaacgcccacgccaagaagcaggaggttgtcgtgctcgggagccaggagggcgccatgcacaccgctctgaccggggccaccgaaatccagaactccggcgggaccagcatctttgccggccatctgaaatgccggctcaagatggacaagctggagctcaaaggcatgagttacgccatgtgcctaaacactttcgtgctgaagaaggaggtcagcgaaacgcagcacggtaccatcctcatcaaggtggagtacaagggcgaggacgccccgtgcaagatccctttcagcaccgaggacgggcagggcaaggcacacaacgggcgcctgatcaccgccaaccccgtggttacgaagaaagaggagcctgtgaacatcgaggccgagccgcccttcggcgaatccaacatcgtgatcggcatcggggacaaggccctcaagatcaactggtacaagaagggcagctccatcgggaagatgtttgaggcgaccgcccggggcgcccgccggatggcaatcctgggcgacactgcctgggactttgggtctgtcggaggggtgctgaactccctcggcaagatggtccaccagatcttcggcagcgcgtacaccgccctgttctcgggcgtcagctggataatgaagataggcatcggggtgctgctcacgtggattgggctgaactccaagaacacctctatgtcattcagctgcatagtgatcggtatcatcaccctgtacctcggtgccgtcgtgcaggctgacatggggtgcgtcatcaactggaaaggcaaggagctgaagtgtggctccggcatatttgtcactaacgaggtgcacacgtggaccgagcagtacaagttccaggccgacagcccaaagcgcctggcgaccgccatcgccggcgcctgggaaaacggggtctgcggcatccgctccaccactcggatggagaatctcctgtggaaacagatagccaacgagctgaactacatactctgggagaacagcatcaagctgaccgtcgtggtgggggatatcataggcgtcctggagcagggtaagcgcaccttaacgccccagccgatggagctgaagtactcctggaagacgtgggggaaagcgaagatcgtgaccgcggaaacccagaacagcagtttcatcatcgacggccctaacacccccgagtgccctagcgccagccgggcctggaacgtgtgggaggtcgaagactacggatttggcgtgttcacaaccaacatctggttgaagctccgcgaggtgtacacccagagctgcgatcaccggctgatgagcgctgctatcaaggacgaaagagcggtccacgcggacatgggctactggattgagtcccagaagaacgggagctggaagctggagaaagcctccttcatcgaggtaaagacctgcacctggccaaagagccatactctctggtccaatggcgtgctggagagcgacatgatcatacccaagtccctggcggggcccatctcacagcacaaccaccgtccgggctaccacacccagaccgccgggccctggcacttgggcaagctggagctggacttcaactactgcgagggaacaacggtcgtcatcaccgaaaactgtgggacccgcggcccttccctccggactacgaccgtgagcggcaagctgatccacgagtggtgctgccgttcctgcaccctgcccccgctccgctatatgggcgaggacgggtgctggtacggcatggagatccgccccatcaacgagaaggaggagaacatggtcaagtctctggtgtccgctggcagcgggaaggtagacaacttcacgatgggcgtcctgtgcctcgccatcctcttcgaggaggtgatgcgggggaagttcggcaagaagcacatgatcgccggggtgctcttcacgttcgtcctcctgctgtccggccagatcacctggcgcgacatggcgcacaccttgatcatgatcggcagcaacgccagtgaccggatgggcatgggcgtgacctatctagccctgatcgccaccttcaagatccaacccttcctcgcactgggcttcttcctgcgcaagctcacctccagggagaacctgctcctcggcgtgggcctggcgatggccaccaccctgcaactccccgaggacatcgagcagatggccaacggaatcgccctcggcctgatgacgcttaaactgatcacccagttcgagacctaccagctctggaccgcgctcgtcagcctgacgtgctccaacaccatcttcaccctgaccgtggcctggcgcaccgccacgctcatactggctggggtctcgctgctcccgctttgccagtccagctccatgcggaaaaccgactggctgcccatgaccgtcgccgcgatgggcgttccgcccctgcctcttttcatctttagccttaaggatacgcccaagcgccgctcctggcccttaaacgagggggtaatggccgtgggcctggtgagcatactggcctcctcgctcctgcggaacgatgtccccatggccggcccgctggtggctggtgggctcctgatcgcatgctacgtgattaccgggacctccgccgacctgaccgtggagaaggccgcggacgtgacgtgggaggaggaggccgagcagaccggcgttagccacaacctcatgatcaccgtcgacgacgacggtaccatgcgcattaaggatgacgagaccgagaacatcctgacggtccttcttaagaccgccctgctgatcgtatcaggcatcttcccctacagcatccccgccaccctcctggtctggcacacctggcagaagcagacccagcggtccggcgtgctgtgggacgtgcctagcccccccgagacccaaaaggccgagttagaggagggggtctaccgcatcaaacagcagggtatcttcggtaagacccaggtgggagtgggggtccagaaagagggcgtgttccacacaatgtggcacgtcactagaggagcagttctgacccataacgggaagcgcctggagcccaactgggcctccgtgaagaaagacctcatctcttacggcgggggatggcgtctgagcgcccagtggcagaaaggggaggaggtgcaggtcatcgctgtggagcccggcaagaaccccaagaatttccagactatgcccgggatcttccaaaccacgatgggagagattggtgccatcgcgctcgactttaagcccgggaccagcggcagcccgatcatcaaccgcgagggcaaggtggtcgggctatacggcaacggggtggtgaccaagaatggagggtacgtctccggcatagcgcaaacgaacgctgagcccgacggccccactcccgagctcgaagaggagatgtttaagaagcggaacctgaccatcatggacctgcacccggggagcggcaagaccaggaagtacctccccgctatagtgcgggaggcaatcaagcgccggctgcgtaccctgatcctcgcccccactcgggtggtcgcggccgagatggaggaggcgcttaaggggttgccgatccgctaccagaccaccgccaccaaatccgagcacacgggccgggagatcgtggaccttatgtgccacgccaccttcaccatgcggctgctgagcccggtgcgggtccccaactacaacttagtgataatggacgaggcgcacttcaccgatcccgcctccatcgccgcacgagggtacatcagcacgcgggtgggcatgggcgaggccgctgcaatcttcatgaccgccaccccgcccgggaccgccgaggcgttcccccaatccaacgcccccatacaggacgaagaacgcgacatccccgaacgcagctggaactcgggcaacgagtggatcacggacttcgtcgggaagaccgtgtggttcgtgcccagcatcaaggcgggcaacgacatcgcaaactgcctgcggaagaacggaaagaaggtcattcagttgtcccgcaagaccttcgacaccgagtaccagaagacgcggctcaacgactgggatttcgtggtgaccaccgacatcagcgagatgggcgccaatttcaaggcggaccgcgtcatcgacccaagacgctgcctcaaacccgtgattctgaccgacggccctgagcgggtgatcttggccggtccgatgcctgttacggcggcctccgccgcccaacgccggggacgtgtggggagaaacccacagaaggagaacgaccagtacatcttcaccggccagcccctgaacaacgatgaagaccacgcccactggaccgaggccaagatgctgctcgacaacataaacaccccggagggcatcatccccgccctgttcgaacccgagcgcgagaagtccgccgcgatagacggcgagtaccggctgaagggcgagtcccgcaagaccttcgttgagctcatgcggcgcggggatctgccagtgtggctggcccacaaggtggcctctgagggcatcaagtacactgaccggaagtggtgcttcgacggggagcgcaacaaccagatcctcgaggagaacatggacgttgagatctggactaaggagggcgaacggaagaaactgcgcccgcgctggttagacgctcggacttacagtgaccccctcgccctgaaggagttcaaggacttcgccgccggccgcaagagtatcgccctggacctcgtgaccgagatcgggcgggtgcccagccacctggcccatcgcacgcggaacgcgctggacaacctcgtcatgctccacacctccgagcacggcggccgcgcctaccggcacgcggtggaggagctgccggagacaatggagaccctcctgctcctcggcctgatgatcctgctcaccggtggcgcaatgctcttcctgatcagcgggaagggtatcggcaagacctcgatcgggttaatctgcgtgatcgctagctccggcatgctctggatggcggatgtccctctgcagtggattgccagcgccatcgtgctcgagttcttcatgatggtgctgctgatccccgagcccgagaagcagcgcaccccgcaggacaaccaactcgcctacgtcgtgatcggtatcctgaccctggccgcgatcgtggccgcaaatgagatgggcctcctggagacgaccaagagagacctgggtatgtcgaaggagcccggggtcgtaagccctaccagctacctcgacgtggacctgcaccccgccagcgcttggaccctgtacgcggtcgccacgaccgtgatcaccccgatgctccggcacactattgagaactccacggccaacgtgagcctggccgcgattgccaaccaggccgtcgtcctcatgggcctcgacaagggctggcccatctctaagatggacctgggcgtgcccctcctcgctttagggtgctacagccaggtcaaccccttaaccctcaccgccgcggtgctgctgctcgtgacgcactacgccatcatcggcccgggcctgcaagccaaagccacacgggaggcgcagaaacgcaccgcggccggaatcatgaagaaccccaccgtcgacggcattatgaccatagacctggaccctgtgatctacgacagcaagttcgagaagcagctcgggcaggtgatgctgctggtcctttgcgcagtgcagttactgcttatgcggacgagctgggccctgtgcgaggcccttaccctcgcgaccggcccgatcaccacgttgtgggagggctccccggggaagttctggaatactacaatcgccgttagcatggccaacattttccgaggctcctacctggccggggccgggctcgccttcagcatcatgaagtccgtcgggaccggccggcgcggtacggggtcgcagggagagaccctgggtgagaaatggaagaaaaagttaaaccagctcagccggaaggagttcgatctctacaagaagtccggcattacggaagttgaccgcaccgaggccaaggaggggctgaagcggggtgagaccacgcaccacgccgtgagccggggctccgccaaactccagtggtttgtcgagcggaacatggtgatacccgagggccgcgtgatagacctgggctgcgggaggggtgggtggagctactactgcgcgggcctgaagaaggtcaccgaggtgcggggatacaccaagggcgggcctgggcacgaggagcccgtgccgatgtcgacgtacggctggaacatcgtcaagctcatgtcggggaaggacgtgttttacctgccgcccgagaagtgcgacacgctgttgtgcgacatcggcgagtccagcccctccccgacggtagaggagagccgcaccatccgagtcctcaagatggtggagccctggctacgcaacaaccagttctgcatcaaggtgctgaacccatacatgccaaccgtaatcgagcacctcgaacggctgcagcgcaaatatggcgggatgctagtgcggaaccccctatccagaaacagcacgcacgagatgtattggatctccaacggcaccgggaacatcgtgagctccgtcaacatggtgagccggctgctgctcaaccgcttcaccatgacccaccgacgccccacgatcgagaaggacgtcgacctgggagccgggacacggcacgtgaacgccgagcctgaaaccccgaacatggacgtaatcggggagcgcatcaagcggatcaaggaggagcactccagcacctggcactatgacgatgagaacccctacaagacgtgggcctatcacggcagctacgaggtcaaggccaccgggagcgcgagctccatgatcaacggcgtagtgaaactgctcaccaagccctgggacgtagtgcccatggtgacccagatggccatgacggacaccacccctttcgggcagcagcgcgtgtttaaggaaaaggtggatacccggacgcctcgcccgatggccggaacccggaaggtgatggagatcacagccgagtggctgtggcgcacactgggcaggaataagaagccacgactttgcacgcgcgaggagttcaccaagaaagtcagaaccaacgctgcgatgggggcagtgtttaccgaggagaatcagtgggacagcgctcgcgcggcggtggaggacgaggaattctggaaactggtagaccgagaacgcgagctgcacaagctcggcaaatgcgggtcctgcgtgtacaacatgatgggcaagcgggaaaagaagctgggcgagttcggcaaggccaagggtagtcgcgcgatatggtacatgtggctgggagcccggtatctcgagttcgaagccctgggcttcctgaacgaggaccattggttctcccgcgaaaacagctactccggcgttgagggcgaggggctccacaagctgggctatatcctgcgggacattagcaagataccgggcggggcgatgtacgctgacgacacggccggctgggacacccgtatcaccgaggacgacctacataacgaggagaagatcacccagcagatggaccccgagcatcgacagctggccaacgcgatctttaagctgacgtaccagaataaagtcgtgaaggtgcagcgcccaaccccgaagggaaccgtcatggacatcatctcccggaaggaccagcgcgggagcggccaggtggggacctacggcctcaacacctttacgaacatggaggcgcagctggtccgtcagatggagggggagggcgtcctgtccaaggcagacctcgagaacccgcatctactggagaaaaaaatcacccagtggcttgagaccaagggcgtggagcgcctgaagcggatggccattagcggcgacgactgcgtggtcaaaccgattgatgaccgcttcgccaacgccctgctcgcattaaacgacatgggcaaggtgcggaaggacattccccaatggcagccttccaaagggtggcacgactggcagcaggtcccgttctgcagccaccacttccatgagctgataatgaaggacggccgcaaactcgtcgttccctgccgaccccaggacgagctgatcgggagggccaggatctcccaaggcgccgggtggagcctgaaggagaccgcctgcctcggcaaggcctacgcgcagatgtggtccctgatgtacttccaccggcgcgacctgcggctcgcctcgaatgccatctgcagcgcagtgcccgtccactggatccctactagccgcaccacctggagcatccatgcgcaccaccagtggatgaccacagaggacatgctgacggtgtggaaccgggtgtggatcgaggacaacccctggatggaggacaagacccccgtcaccacgtgggaggacgtgccctatctgggcaaacgcgaggaccagtggtgcgggtccttgatcgggctcaccagcagagccacctgggcccagaacatcctgaccgccatccagcaagttcgctccctcatcggggacgaagagttcctagactacatgccaagcatgaagcggttccgcaaggaggaggagtccgagggtgccatctggtag

SEQ ID NO: 25746 - RNA, 9873 nt, synthetic construct
  misc_feature 1..9873: note = derived and/or modified CDS sequence (opt11) from DENV-3__GU131934__SS-prME
  source 1..9873: mol_type = other RNA
acctcgctgtgcctcatgatgatgctgcccgcgacactggccttccatctcacctcccgagacggagagccgcgcatgatcgtagggaagaacgagcgcggcaagagtctcctgttcaagacagcgtctggcatcaacatgtgcaccctcatagcgatggacctgggcgagatgtgtgacgacaccgtcacctacaagtgccccctgatcgccgaggtggagcccgaggacattgattgctggtgcaacttgacctccacctgggtgacctacggaacgtgcaaccaggcgggcgagcaccggcgcgacaaacggtcggtcgcactggcaccccacgtgggaatggggctcgacacccgcactcagacctggatgtcagccgagggtgcgtggcggcaagtcgaaaaagtcgagacatgggccttacgccaccctgggttcactatcctggctttatttctcgcccattacatcggcacgtcgctcacccagaaggtggtaatcttcatcctgctcatgctggtcacgccttcaatgaccatgcgctgcgtgggggtgggcaaccgcgattttgtcgagggcctgtccggtgccacctggattgatgtggtgctcgaacacggaggatgcgtaacgaccatggccaagagcaaacccaccctggacatcgagttgcaaaagactgaggcaacccagcttgctacactacggaagctgtgcatcgaaggcaagatcaccaacatcacgaccgacagccgttgcccaacacagggcgaggccacattgccagaagagcaggaccagaactacgtttgtaagcacacctacgtagacaggggttggggcaacgggtgtggcctgtttggaaagggatcgctggtgacatgcgcaaagttccagtgcctagaacccatcgaaggcaaagtggtgcaatacgagaacctgaagtacacagtcatcattaccgtgcacactggggaccagcaccaggtcggcaacgacacccagggggtcacggtggagataacgccccaggcctccaccgtcgaggccgttctgcccgagtacggtactctcggactcgaatgcagcccacgcaccggcctggacttcaatgagatgatcctcctgacgatgaagaataaggcttggatggtgcatcgccagtggttcttcgacctaccacttccctggacctctggggccaccaccgagaccccaacctggaaccgcaaggagctgctggtaacattcaaaaatgcccacgccaaaaagcaggaggttgtagtgcttgggagccaagaaggcgccatgcacaccgcgctgaccggggcgacggaaatccagaactccggcggaacaagcatctttgccggccacctgaagtgccgactgaagatggataagttagagctcaagggcatgtcctacgcgatgtgcctaaacacctttgtgctgaagaaggaggtctcagagacgcaacacgggacgattctgataaaggtggagtacaaaggcgaggacgccccgtgtaagattccattcagcaccgaagacgggcagggcaaagctcataacggcaggcttatcactgcaaatcccgttgttacgaagaaggaggaacccgttaacatcgaggctgagccgcccttcggggagtctaacatagtgataggaattggggataaagccctcaagatcaactggtataaaaagggcagctccatcgggaagatgtttgaggcgaccgcccggggcgccaggcggatggccatcctgggcgataccgcttgggacttcgggagcgtgggtggggtcctgaactctttaggaaagatggtacaccagatattcggctccgcgtatacggccctgttctccggcgttagctggattatgaagatcgggatcggggtcctgcttacgtggatcggccttaactcgaagaacaccagcatgtcctttagctgcatcgtgattggggtgattaccctgtacctaggcgcggttgtgcaagcggacatgggatgcgttatcaactggaagggcaaggagttaaagtgcggcaacgggatctttgtgaccaatgaggtgcacacgtggacagagcaatacaagtttcaggcggactcccctaagcgcctggcgaccgccatagctggcgcttgggaaaacggggtgtgcggcatccgcagcaccacgagaatggagaacctactgtggaagcagatcgccaacgagctgaactacatcctctgggagaataacatcaagttgaccgtcgtggtgggtgacatcatcggcgtactggaacaaggcaagagaactctcacgccccaaccgatggagctgaagtactcttggaagacgtgggggaaggctaagatcgtgaccgccgaaaaccagaactccagcttcattatagacggaccgaacaccccagagtgtccatcagcctcccgggcctggaacgtttgggaggtcgaggactacgggtttggggtgttcactacaaacatctggcttaagttgcgcgaagtgtatacccaaagctgcgatcaccggctgatgagtgcggccatcaaggatgaacgagccgtccatgcggacatgggctactggattgaatcccagaagaatgggagctggaaattggagaaggcctccttcatcgaggtgaaaacttgcacgtggcctaagtcgcacaccttgtggtccaatggcgtactggagagcgatatgatcattcccaagtccctcgctgggcccatctcgcagcataaccacaggccaggttaccacacgcaaaccgccggtccctggcacctcggcaaactggagctggacttcaattattgcgaaggcaccaccgttgtgatcgccgagaactgcggcacgcgcggcccatccctgcgtacaactaccgtgtctgggaaactcatccacgagtggtgctgccgctcctgtacgctgcccccgctccggtacatgggagaagacggttgctggtatgggatggagatccgtcccatcaacgagaaggaggaaaacatggtcaaaagcctggtttctgccggcagtgggaaggtggacaatttcaccatgggtgtcctgtgcctcgccattctctttgaggaggtaatgcgggggaagttcggcaaaaagcacatgatcgccggggtgctgttcaccttcgtccttctgctgtccggccagatcacctggcgcgatatggcccacacgcttatcatgatcggctccaacgcgagtgatcggatggggatgggcgtgacctaccttgccctgatagcaacgttcaagatacagccctttctcgcgctgggattcttcttacgcaaactcacaagcagggagaacttgctgctcggcgtgggcctggccatggcgacgaccctgcaactccccgaagatatcgagcaaatggccaacggaatcgcgctgggtcttatgaccctcaaactgataacgcagttcgagacctaccagctatggaccgcactcgtcagcctaacctgttccaacaccatctttacgctcaccgtggcctggcgcaccgcaactctcatcttagctggagtcagtctccttccgctgtgccaaagttcgtccatgcggaagactgactggctacccatgaccgtggcggccatgggagtgccgccccttccgctgttcatcttctcgctgaaggacacccccaaacgccgctcctggccgctcaacgagggggttatggccgtgggcttggtgagcatcctggcctcgagcctgctgcggaatgatgtacccatggcgggtccgctggtggccggcgggctactgattgcctgctacgtgatcacaggtacgtccgcggacctgaccgtcgagaaggccgccgacgtgacctgggaggaggaggcggaacagaccggcgtgtcccataacctcatgatcacggttgacgacgacgggacgatgcgcatcaaggacgacgaaaccgaaaatatcttgaccgttctactcaagaccgccctgttaatcgtcagcggcatcttcccatatagcattccggccacgctcctggtatggcacacctggcaaaaacagacacaacgctccggagtgctgtgggacgtcccatcccctcctgagacccagaaggcggaactcgaagagggcgtctatcgcatcaaacagcagggtatcttcgggaagactcaggtgggcgtgggagtgcaaaaggagggcgtgttccacactatgtggcacgtgacgagaggcgccgttctgacgcataacggaaaacgcctggagccgaactgggcaagtgtaaagaaagatctcatctcgtatggcgggggctggcggctgagcgcccaatggcaaaagggggaggaagtgcaggtcatagccgtcgagcccggcaaaaacccgaagaacttccagacaattccgggtatcttccagaccactacaggggagataggcgccatcgctttggacttcaagcccgggacgagcggcagcccaatcatcaatcgagagggaaaggtggtagggctgtatggtaacggggtggtgaccaagaatggcggctacgtatccgggatcgcccagaccaacgccgaacctgacggccccacgcccgagctagaagaggaaatgttcaagaagcggaacctgacgatcatggatctccatccgggaagcggcaagactcgcaagtacctccccgccatcgtacgggaggccataaagcgccggttacgtacactcatactcgcacccacccgtgtggttgcggccgagatggaggaggccctgaaggggctgccaattagataccagactacggcgaccaagtccgagcacacgggtcgggagatcgtggacctcatgtgccacgcgacgttcaccatgagattgctgtcaccggtgcgggtccctaactacaatctcgttatcatggacgaggctcactttacggaccccgcgagtatagccgcccgcgggtacatcagtacgcgggtcggaatgggggaggcggccgcgatcttcatgacggctacgccgccggggaccgcggaagcgtttccccagtccaatgcgcccatacaagacgaagagcgcgacatccccgagcgcagctggaattccggcaacgagtggatcaccgactttgtcgggaagacagtgtggtttgtgcctagcattaaggccggcaacgacattgccaactgcttacggaagaacgggaagaaagtcatacaactgtcccggaagaccttcgacaccgaataccaaaagaccagactgaatgactgggatttcgtggtgacgacagacatcagtgagatgggcgcgaatttcaaggccgaccgcgtcattgatccccggcgctgcctgaagcccgtaatcctcacagacggcccagagcgggtgatactggccgggcccatgcctgtcactgccgcgtccgcggcccagcgtcggggtcgcgtaggccggaacccccaaaaggagaatgaccagtacatctttacgggccagcctctgaacaatgatgaggaccacgcacactggaccgaggctaaaatgctcctcgacaacataaacaccccggaggggattattccggccctgttcgagcccgagcgcgaaaaatccgccgccatcgacggcgagtatcggctaaagggcgagtcacgcaagacctttgtggaactcatgcggcggggagacttacccgtgtggctggcccacaaggtggccagcgagggcatcaaatataccgaccggaagtggtgcttcgacggggagaggaacaaccagatcctggaggagaacatggatgtagagatatggacgaaggagggcgaacggaaaaagctgagaccgcgctggctggacgcgcgaacctacagtgacccactcgccctaaaggagttcaaggactttgccgccggtcggaaaagcatcgccttagatttagtcaccgagatagggcgggtgccctcccacctagcgcatcgcactcggaacgccctcgacaacctcgtcatgctgcacacgtcagagcatggcgggcgggcctaccgccatgctgtggaggagctgccggagactatggagaccctcctgctgctcggcctgatgatcctgctcaccgggggtgccatgctgttcctgatctcagggaaggggataggcaagacatccatcgggctcatctgcgtaatagtcagctcaggcatgctatggatggcagacgtgcccctgcaatggatcgcctcagccatcgtgctagagttcttcatgatggtgttgcttataccagagcctgagaagcagcgcaccccgcaggacaatcaactagcctacgtggtgattggcattctgactctggccgccatagtcgccgccaacgaaatgggcttactggagaccacgaagcgggacctgggcatgtcgaaggagcccggggtggtgagcccgacctcttacttggatgtcgacttacaccccgccagcgcctggacgctatacgcggtggccactacggtgataaccccgatgcttcgccacacaatcgaaaactcgaccgccaacgtgtccctggccgccatcgccaaccaagctgtcgtgctgatgggcttggacaagggatggccgatttccaaaatggacctgggcgtcccactccttgcgctggggtgctactctcaggtcaacccactgacgctcaccgcggcggtcctcctgctagtgacccactacgccatcatcggcccgggcctgcaggccaaagccacacgggaagcccagaagcgaacggcggcagggatcatgaagaacccgaccgtggacggcatcatgactatcgacttggatccagtcatctacgactccaagttcgagaagcaactggggcaggttatgttattagtgctttgcgccgtgcagctgctgttgatgcgcaccagctgggccctttgtgaggctctgacccttgcaactggccctatcacaacgttatgggaggggtcccctgggaagttctggaacactacaatcgctgtcagcatggctaacatcttccgcgggagttacctggctggagcgggcctcgccttcagcatcatgaaatccgtgggtaccgggcggcgcggcactgggagccagggcgagacgctgggggagaaatggaagaagaagctgaaccagctcagcaggaaggagttcgacctctacaagaagtccggcatcacggaggtggaccgtaccgaagcaaaggagggcttaaagcggggcgagacgacccaccacgcagtcagccggggctctgcgaagctacagtggttcgttgaacgtaacatggttatccccgagggtcgcgtgatcgacctcgggtgcgggcgaggcgggtggtcgtactactgcgcgggcctgaagaaagtgacggaggtgcggggctacaccaaaggcggccctgggcatgaggagcccgtcccgatgagcacctatggctggaacatagtgaagctcatgagcggaaaggatgtgttttacctgccgcccgagaaatgtgacaccctgctgtgcgatatcggggagtccagcccctctccgacggttgaggagagccgcaccatcagggtgttaaagatggtggagccatggctgcgcaacaaccagttctgcataaaggtccttaacccctacatgcctaccgtgatagagcacctcgagcgactacagagaaagtacggggggatgctggtgcgaaaccctctctcccgcaacagcacccacgagatgtactggatctccaatggcacagggaacatcgtcagctcagtgaatatggtctcgagactactgctcaaccgcttcaccatgacccatcggcgcccgaccatcgagaaggacgttgacctgggcgccggcacgcggcacgtaaacgcggagccagagaccccaaatatggatgtcataggtgaaaggatcaagcggatcaaggaggagcattcctcgacctggcactacgacgacgagaatccctataagacctgggcctaccacggatcatatgaagtgaaggccacggggtctgcgagctcaatgattaacggtgtggttaagctgctcacgaaaccttgggacgtcgtgccaatggttacacagatggctatgaccgacacaacccccttcgggcagcagcgcgtgttcaaggagaaggtggatacccggaccccccgcccaatgcccggtacgcggaaagtaatggagataaccgccgagtggctgtggcgcacccttggtcgcaacaagaagccgcgactttgcacacgggaagagttcaccaaaaaagtgcgaacgaacgccgccatgggggcggttttcaccgaagagaaccagtgggacagcgcccgcgccgcagtcgaagacgaggaattctggaaactagtggataaggaacgcgagctgcacaaattagggaagtgcggttcctgtgtgtacaacatgatgggcaagcgcgagaagaagctgggggagttcggcaaagcgaagggaagcagagccatctggtacatgtggctgggggcaaggtacctcgagttcgaggccctgggcttcctgaacgaggaccactggttctcccgggagaactcgtacagcggggtcgagggcgaggggctgcacaagctgggatacatcctccgggacattagcaaaatcccgggcggcgcgatgtacgccgacgacacagcaggctgggacacgcgaatcactgaggacgacttacacaatgaggaaaaaatcacacagcaaatggaccccgaacatagacagctggccaacgccatctttaagttaacctaccaaaacaaggtggtgaaggtccagcggcccacgcccaaggggactgtgatggacataatctcccgcaaggaccagcggggctctgggcaggtcgggacgtatggactgaacacctttacgaacatggaggcccagttggtccgccagatggagggtgagggcgtgctctccaaggcggatctcgaaaacccccacctcctcgaaaagaagatcacccaatggctcgagaccaagggggtggagcgccttaagcgcatggcaatttctggcgacgattgcgtcgtgaaacccatcgacgacagattcgcaaacgccctgctcgccctaaacgatatgggaaaggtgcgcaaggacatcccccaatggcagccgtccaaaggttggcatgactggcaacaggtccccttctgcagccaccactttcacgagctgatcatgaaggacggcagaaaactcgtggtgccttgccggccccaggacgagttgattgggcgcgctcggatatcccagggcgccggctggagcctgaaagaaactgcgtgccttggcaaagcttacgcccaaatgtggtccctgatgtactttcaccgtcgggaccttcgcctcgcgagcaacgcgatctgctcagcagtccctgtgcactggatcccaacctctcggacgacctggagcatccacgcccaccatcagtggatgactacagaggacatgctgacggtgtggaacagggtctggatagaggataacccttggatggaggacaagacccctgtcactacgtgggaggacgttccctacctgggcaagcgtgaggaccagtggtgtgggtccttaatcgggctgacgagccgcgcgacttgggcacagaacatcctgaccgccatccaacaggtccgatcgttaatcggggacgaggagttcctcgactatatgcccagcatgaaacggttccggaaggaagaggagaccgagggcgcaatctggtga

SEQ ID NO: 25747 - RNA, 9873 nt, synthetic construct
  misc_feature 1..9873: note = derived and/or modified CDS sequence (opt11) from DENV-3__GU131935__SS-prME
  source 1..9873: mol_type = other RNA
acgagtctgtgcctgatgatgatgttacctgcaaccctagccttccacctgaccagcagagatggggaacctcgtatgatcgtagggaaaaacgaacggggaaaatctctactcttcaaaaccgcaagcgggatcaacatgtgcaccctcatcgcgatggacctaggtgaaatgtgcgacgataccgttacgtataaatgcccactgatcgccgaagtcgaacccgaagacatagactgctggtgcaacctcacctcgacttgggtaacatatggaacatgcaaccaagccggcgaacatcgacgagacaaaagatccgtagcactggcaccgcacgtaggaatgggcctagacactaggacccaaacatggatgtcggccgaaggagcctggagacaagtcgaaaaagtcgaaacatgggctctgagacatcccgggttcacaatcttagctttattcctagcccactatatcggcacctcactcactcaaaaagtcgtaatattcatcctcctcatgctagtgacacctagcatgacaatgcgctgcgtaggtgtagggaatagggacttcgtggagggattaagcggtgccacgtgggtcgacgtcgtactagaacatggagggtgcgtcaccacaatggcaaaatcaaaacctacactggacatcgaattacagaaaacagaagccacacaactggcgacattacggaaattatgcatcgaaggaaaaataaccaacatcacaaccgatagtagatgcccgacacaaggggaggccacactaccggaggagcaagaccaaaattacgtatgtaaacacacatacgtggacagggggtggggcaacggctgcggcctgttcggaaagggaagcctggtaacatgcgccaaattccaatgcctcgaacccatcgaaggaaaagtagttcaatatgagaacctcaagtacaccgttatcataacagttcatactggcgaccaacatcaagtggggaacgacactcaaggcgtaacggtagaaataacgccccaagcctctacagtggaagcagttctgcctgaatacggaaccctcggcctcgagtgcagtccccggacaggactcgatttcaatgagatgatactgctgacaatgaagaacaaagcatggatggtacacaggcaatggttcttcgacctaccccttccatggacttcaggagctaccacagaaacacctacatggaatagaaaagaactactcgtcacgttcaaaaacgcacacgcgaaaaagcaagaggtagtggtgctagggagccaagaaggtgccatgcacacagcgttgaccggcgccacggaaatacagaactccggcggcacatcaatcttcgcaggacacctaaaatgccgcttaaaaatggacaaactggaactaaagggcatgtcttatgcaatgtgcttgaacacattcgtactcaagaaagaggtcagcgagacgcagcatggcacgatactgatcaaggtcgagtacaaaggcgaagacgctccctgcaaaataccattcagcacggaggacgggcagggaaaggcacacaatggacgccttatcacagccaacccggtcgtgaccaagaaagaggaacctgttaacatagaggcagaacctccatttggcgagtcaaatatcgtaatcggcatcggcgataaagcgctgaagataaactggtataagaaaggtagctcgatcggaaagatgttcgaagccacagcacgaggagcgcgacgcatggcgatattgggagacacggcctgggactttggctccgtagggggcgtgctcaattcattagggaaaatggttcaccaaattttcggatccgcctacacggcgctgttctcaggcgtcagctggataatgaaaatcggaataggcgtgctactaacatggatagggttaaattcgaagaatacatcaatgagcttttcctgcatcgtaattggaatcatcacgttatacctcggcgcggtcgtccaggcggatatgggatgtgcaatcaactggaaggggaaagagttaaaatgcgggagcggaatcttcgtaacgaatgaagttcacacgtggaccgagcagtacaaattccaagcggactccccaaaacgcttagctaccgcaatcgcgggagcctgggaaaacggtgtatgcgggatacggtccaccacaaggatggagaacttgctctggaaacaaatcgctaacgaattaaattacatactgtgggaaaataatataaaattgaccgtagtagttggagacataatcggcgtcttagagcagggcaagagaaccttaacgccccaaccaatggaactgaaatacagctggaaaacttgggggaaagctaagatcgttaccgcggagacccaaaacagcagctttataatcgatggcccgaacacaccagaatgcccgtcggcaagcagggcttggaacgtctgggaggtagaagattacggctttggagtgttcaccactaacatctggctcaagttacgcgaggtttacactcaaagctgcgatcaccgcctaatgagcgcagccattaaggatgaacgagccgtccacgctgacatgggatactggatagaatcacagaaaaacggcagctggaaactcgaaaaagccagcttcatagaggtgaaaacctgtacctggccaaagtcgcacacactctggagtaacggcgttctcgaaagcgacatgattatccccaagagcttagccggaccaatcagccagcacaaccaccgcccaggataccacacacaaaccgccggtccatggcacctgggtaaactcgaactagacttcaattattgcgagggtacgactgtagtcatcacagagaactgtggaacaagaggaccttccctgcgcaccacaaccgtatcgggcaaactgatccatgagtggtgctgcagaagttgcacactacccccactcaggtacatgggggaagacggatgctggtatggcatggagattcgacctatcaacgagaaagaggaaaatatggtaaagtcactggttagcgcgggttccgggaaagtcgacaacttcacaatgggggtcctatgcctagcgatcctgttcgaggaagtaatgcggggaaagttcgggaaaaagcacatgatagccggtgtgctgttcacattcgtcctcttgctatccggacaaataacatggcgagacatggcgcacacgcttattatgattggatcgaacgcgtcagaccgaatggggatgggagtcacgtacctagctctaatagcaacgtttaagatacaaccgtttctcgccctaggcttctttctgaggaaattgacgtcaagagagaaccttctactcggagtcggactcgcgatggctacaacgctgcagctgccagaggacatcgagcagatggcgaacggtatagcattaggtctgatgacattgaagctaataacacaatttgaaacgtaccaattgtggacggccctagtaagtttaacttgtagcaacactatcttcacactcaccgtggcctggcggaccgccacactcatcctcgcgggagttagtctcctacccctgtgccaaagctcgtccatgcgcaagacagactggctcccgatgacagtcgcggccatgggcgtcccgccgctgcccttattcattttcagcctcaaggacacgccaaaacgacggagctggccattaaacgagggtgtgatggcagtgggcctagtatccatactcgcgagctcccttctacgaaatgacgttcccatggcgggtccgcttgttgcaggcggtttactaatcgcatgctacgtgataaccggcacttcagcggacctcaccgtagagaaggcagctgacgtaacctgggaagaagaggccgagcaaaccggtgtgagccacaatcttatgattacagtagacgacgacgggacaatgcgaataaaagatgacgaaacagagaatatactaactgtgctgcttaagaccgcgctattgatcgtaagcgggatcttcccttatagcattcccgcgacacttctagtatggcacacatggcaaaaacaaacccagaggagtggcgtattatgggatgtacccagcccgcccgaaacgcagaaggcggagctagaagaaggcgtataccggatcaagcagcaaggcattttcggtaaaacccaggtgggggtaggagttcaaaaggaaggggtcttccatacaatgtggcacgtcacgcgaggcgcagtcctgacacataacggtaaaaggctcgaacccaattgggcctccgtaaagaaagacctcatatcgtacggtggcgggtggcgacttaacgcccaatggcaaaagggggaagaagtccaggtgatagcggtcgagccgggtaagaaccccaaaaacttccagaccatgccaggcatcttccagacgaccactggcgaaataggagccattgcactagacttcaaaccaggcacgagcggcagcccaattattaaccgtgaaggcaaggtggtcggactctacgggaacggggtcgtaactaagaacggcggctacgtgtctggtatcgcacaaacaaatgcagagcctgatggacccacccccgaattagaagaagagatgttcaaaaagcgcaatcttaccatcatggacctccacccagggtccggcaaaacacgaaaatatcttccagcaatagtcagggaagccataaagcgccgcctaaggaccttgattctcgcccctacacgcgttgtggccgcagaaatggaagaagccctgaaagggctgcccatcagataccaaacgaccgcgacaaaaagcgaacatacagggagagagatagttgacctaatgtgccacgcgacattcaccatgcgactcctgagcccagtgcgagtccccaactacaatctagtaataatggatgaggctcacttcacggaccccgccagtatagccgcccgagggtatatctcaacgagagtaggaatgggagaagcggcggcgatatttatgacggcaacgccacctgggaccgcagaggcattcccacaaagcaacgcacccatccaagatgaggaacgggacataccagaacgcagctggaacagcggaaatgaatggataacggacttcgtaggcaagacagtatggttcgtcccctccataaaggcaggtaacgacatagcgaactgtctccgcaaaaacggaaagaaagtaatacagctgagccgaaagactttcgacacggaataccaaaagacacggctgaacgactgggacttcgtagtaacgacagacatctccgagatgggcgccaattttaaggctgaccgagtaattgacccgcggcgctgcctcaaaccagtcattctcaccgacggtccggaacgagtcatactcgctgggcccatgcccgtgacggctgccagtgcagcccaaagacgaggccgagtagggcgaaacccgcaaaaggaaaacgaccagtacatctttaccggccagccgctaaacaacgacgaagaccatgcccactggacagaagcgaaaatgctattagacaacatcaacactcctgagggaatcatcccagcattatttgaaccagagagagagaaaagcgccgcaatagacggcgaataccgactaaaaggagaaagcagaaaaacttttgtagaactaatgagacgaggcgacctaccggtgtggcttgctcacaaagtcgcaagcgaaggtatcaagtacacggacagaaaatggtgcttcgacggcgagcgcaacaaccaaatattagaagaaaacatggacgtggagatctggacaaaagagggagagcgaaagaaattacgcccccgatggctggacgctagaacttactcagatcccctagcactcaaagaatttaaggatttcgcggcaggacgtaagagtatagccctcgatctggtgactgaaattggtagggttccatcccacctagctcataggacacgaaacgcactcgacaatctagtcatgttgcatacgtcggagcacggaggcagagcatacaggcacgcggtcgaggagttgcccgagacaatggagacgctactgctgctaggcttgatgatactcctcactgggggcgtgatgctctttctgataagcggtaagggaatcgggaaaacttccattggcctgatctgcgtgatagtctcgagtggcatgctgtggatggcggacgtgcccctccagtggatagccagtgcaatagtcctcgagttcttcatgatggtcttattaatccccgagccagaaaaacaaaggacgccccaagacaaccaactcgcctacgttgtcatcggaatactaacactagccgccatagtagcggctaacgagatgggcctgctcgaaacaacgaaacgagacctaggaatgagtaaggaaccgggagtagtctcccccacatcttacctagacgtcgacctacacccggcgagcgcctggaccctctacgctgtggcaacaacagttataacacctatgctccgacataccatcgagaacagcacagcaaacgtctccctcgcagcgatcgctaaccaggccgtggtcctcatggggctagacaaagggtggcccatctcaaaaatggatttgggagtgccgctcctggcgctcggatgctattcccaagtcaacccactgaccctaacagcagccgtcctgctgcttgtcactcattacgcaataattggaccaggactacaagcaaaggcaacccgagaagcgcagaaaaggacagccgcgggaattatgaaaaacccaacagtcgacgggatcatgacaatcgacctggatcccgtcatatacgactccaagttcgagaaacaattgggacaagtcatgctcctagtcctctgtacagttcagttactcttaatgcgtacctcctgggcgctgtgcgaggcactcaccctggctacaggacctattaccacactgtgggaggggagccctgggaaattctggaacaccacaattgccgtctcaatggctaacatcttccgaggcagttacctagccggcgcagggctggccttctccatcatgaagtccgtcgggacaggacgaagagggacgggtagccaaggagaaacccttggtgagaagtggaagaagaaactgaaccaactttcccgaaaagaatttgacttatacaagaagtcaggcataacggaggtagaccgcactgaagcgaaggaagggctgaagaggggcgaaacaacccaccacgcggtttcgagaggaagtgctaaactacaatggttcgtcgagcggaacatggtaatcccggaaggcagagtgatagatcttggctgcggacgaggtggatggtcctactactgcgccggcctcaagaaagtcactgaggtaaggggatatacgaagggtggccccgggcatgaggaaccggtccccatgagcacctacggctggaacatcgttaaacttatgagcgggaaagacgtcttctacctgccaccggagaagtgcgacacactactctgcgacataggcgaatcctccccaagtcccacagtcgaagaaagccggaccatcagggtactgaaaatggtcgagccatggcttcgaaacaatcaattctgtataaaggtcttgaacccatacatgcccacggttatcgaacacctggagcggttacagcggaagtatgggggaatgctcgtgcgcaatcccctgtcgcgcaattccacacatgaaatgtactggatcagcaacggtaccggtaacatagtatcctccgtaaacatggtgtcacgcctcctcctgaaccgattcacaatgactcaccgacgcccaactatcgaaaaggatgtggacctcggcgctggcactaggcatgtaaacgccgagccggagacgcccaacatggacgtgatcggtgaacgcataaagcgcataaaagaagaacactcaagcacgtggcactacgatgacgagaacccgtacaaaacctgggcataccacggctcatacgaagtaaaagcaacgggaagcgcttcgagcatgataaacggagtggtgaagctcctcacaaaaccctgggacgtggtacctatggtaactcagatggccatgacagataccacccccttcggacaacaacgcgtgttcaaagaaaaggtcgacacacgtactccccgcccgatgcccgggacccgaaaagtaatggagattaccgccgagtggctatggcgcacgctagggagaaacaaaaagccacgactatgcacacgggaagagtttacgaagaaagtacggacgaacgcggcaatgggagcagttttcacagaggaaaaccaatgggacagcgccagagccgcggttgaggacgaagagttctggaaactggtcgaccgagaacgcgagctccataagttgggcaaatgcggcagctgcgtctataacatgatgggaaagcgcgagaagaagctgggtgagttcggtaaagcaaaaggcagccgggccatatggtacatgtggctaggtgcaaggtacctagagttcgaagcgctaggattcctcaacgaggatcattggttcagccgggagaacagttattctggcgtcgagggtgaaggactgcacaaactggggtatattttaagggacatcagcaaaattccgggaggagcaatgtacgcggatgatacggctggatgggacacgcgaataacggaggacgaccttcataatgaagaaaagatcacgcaacagatggaccccgagcatcgacagctagcaaatgccatattcaaacttacataccagaacaaggtagtaaaagtgcaaaggccgaccccgaaaggaacggtgatggacattatcagtcggaaggaccagcgaggaagcggtcaagtaggaacctatgggctcaacacctttaccaacatggaagcacagttggtacgacaaatggaaggagaaggagtactttctaaagctgacctagaaaatccacaccttctggagaagaagatcacacaatggctagaaactaagggagtggaaaggctgaaacggatggccatcagcggcgacgactgcgttgtcaaaccgatagacgaccggttcgccaacgcgctgttagccttaaacgacatgggaaaggtacgcaaagacataccgcagtggcaaccttccaaaggctggcacgactggcagcaagtacccttctgcagccaccacttccacgagctcataatgaaggacggaagaaagctagtagttccatgccgcccccaagatgagctcatcgggagagcaagaattagccaaggagcaggctggagcctaaaggagaccgcctgcctaggcaaagcctacgcccagatgtggagcctaatgtactttcacagacgagacttaagactagcctcaaacgccatatgcagcgcagttccagtccactggatacctacgagcagaaccacgtggtctatccacgcgcaccatcagtggatgactacagaggacatgctgaccgtatggaatagagtctggatcgaagataacccgtggatggaggataaaactccagtaacaacttgggaagatgttccgtacctgggcaaacgcgaagaccagtggtgcggctcgctcataggactcacctcaagagcgacctgggcacagaatatcttgactgcaatacaacaagtaaggagccttatagggaacgaggagttcctcgattatatgccgtcaatgaagcgattccgcaaagaagaagaatccgaaggggcgatttggtaa

SEQ ID NO: 25748 - RNA, 9873 nt, synthetic construct
  misc_feature 1..9873: note = derived and/or modified CDS sequence (opt11) from DENV-3__GU131936__SS-prME
  source 1..9873: mol_type = other RNA
acctcattatgcctcatgatgatgctgcccgccactctggccttccacctcaccagccgggacggcgagccccggatgatcgtggggaagaacgagcgcggcaagagcctgctcttcaagacagcgtctgggatcaacatgtgtaccctcatcgcaatggacctgggcgagatgtgcgacgataccgtaacatataagtgtcccctgattgccgaggtggaacccgaggatattgattgttggtgcaacttaaccagcacctgggtgacatacgggacatgtaaccaggccggcgagcatcggcgcgacaagcggtctgtggccctggcgccccacgtgggcatgggtctggatacgcggacccaaacctggatgagcgccgagggcgcctggaggcaggtggagaaggtcgagacgtgggcgctccgccaccccgggttcaccatactggctttattccttgctcactatatcggaacctccctgactcagaaggtggtgatcttcatcctgctcatgctggtcacgcccagcatgactatgcggtgcgtgggggtgggcaaccgcgacttcgtcgagggcctgtccggggcaacttgggtggacgtggtcctcgagcacggcgggtgcgtcacaacgatggccaagtcaaaacccaccctagacatcgagctgcagaagactgaggccacccagctcgcgaccctgcggaagctgtgcatagagggcaagatcaccaacatcaccaccgactcacgatgccccacgcagggtgaggccaccctcccggaggagcaagatcagaattacgtgtgcaagcacacctacgtcgaccgggggtgggggaacgggtgtggcttattcgggaagggcagcctggtgacctgcgccaagtttcaatgcctcgaatccatcgagggaaaggtggtgcagtatgagaacctgaagtacacggtgatcatcaccgtgcacaccggggaccagcaccaagtcggcaacgacacccagggtgtgactgttgagatcacgccgcaggccagcaccgtggaggcagtgctgccggagtacggcaccctcgggttagagtgctcgccccggaccggcctggacttcaacgagatgatcctcctgacgatgaaaaacaaagcctggatggtccaccggcagtggttcttcgacctgccgctgccctggactagcggggccacgacggagacacccacctggaaccgcaaggaactcctggtgacttttaagaatgcccacgccaaaaagcaggaagtggtcgtgctcgggtcccaggagggggccatgcataccgcgctgacgggggcgacagaaattcagaatagcggtggcacctccatcttcgccggccacctgaagtgcaggctcaaaatggacaagctggagttaaagggcatgtcatatgcaatgtgcctgaatacattcgttttgaaaaaggaggtcagtgagactcagcatgggacgatcctgattaaggtagagtacaagggcgaggacgccccctgcaagatcccgttctctaccgaggacgggcagggaaaggcgcacaacggccgtctgatcaccgccaaccccgtggtcacgaaaaaggaggagcccgtgaacatcgaggccgaaccaccattcggcgagtcaaacatcgtgatcggcattggagacaaggccctcaagatcaactggtacaagaaggggtccagcatcgggaagatgttcgaagcgaccgcccggggtgcacgccgaatggccatcctgggcgacacagcgtgggacttcggttccgtagggggggtgctgaacagcctcggcaaaatggtgcaccaaatcttcgggtccgcgtacaccgcactgttctctggcgtctcctggattatgaagatcggcatcggggtgctactcacgtggatcggccttaacagcaagaacacctccatgagcttcagttgcatcgtgatcgggatcatcacactgtacctcggcgccgtcgtgcaggccgatatggggtgcgtgatcaactggaagggcaaggagctaaagtgtggcaacgggattttcgtcaccaatgaggtgcacacgtggaccgagcagtacaagttccaggccgacagccccaagcgcctggcgaccgccatagccggcgcctgggagaacggggtgtgcggcatccgctccaccacgcggatggagaaccttctgtggaagcaaatcgccaacgagctcaactacattctttgggaaaacaacatcaagctgaccgtcgttgtaggggatatcatcggcgtcctggaacagggcaagcgcgcactaacgccccagccgatggagctaaagtacagctggaagacctgggggaaggccaagatcgtgacggccgagacccagaactccagcttcatcatcgacggcccaaatacccccgagtgcccctccgctagccgggcgtggaacgtgtgggaggtcgaagactacgggttcggagtgttcaccacgaacatatggttgaagctgagagaggtgtacactcaaagttgtgaccaccggctaatgtccgccgctatcaaggacgaacgcgccgtccacgccgacatggggtactggatcgagagccagaagaacgggagctggaagctggagaaggcgagcttcatcgaggtgaagacctgcacctggccaaaatcccacaccctctggagcaacggggttctggagtccgacatgatcatccccaagtccctggccggacccatctcccagcacaaccaccggcccggttaccacacgcagaccgccggtccctggcacctcggaaagctggaactggacttcaattactgcgagggcaccacagtcgtgatagcggaaaattgcgggacgcgcggtccgagcctcaggaccaccaccgtgtccgggaagctgatccacgagtggtgttgccgcagctgtacgctgccacccctgcgttacatgggcgaggacgggtgctggtacgggatggaaatccgcccgatcaacgagaaggaggagaacatggttaagtccttggtgagcgccggttcggggaaggtggacaacttcaccatgggcgtcctgtgcctcgcgatcctgtttgaagaggtgatgcgggggaagtttggcaagaagcatatgattgccggggtactgttcacttttgtcctactgctaagcggccagatcacctggcgcgatatggcccacaccctcatcatgatcggctctaacgccagcgaccggatggggatgggcgtgacctacctggccctgatcgcgaccttcaagatccagcctttcctcgccctgggcttcttcctccgcaagctcaccagccgggagaacttactgttgggcgtgggcctggccatggccaccaccctgcaactccccgaggacatcgagcagatggcgaacggtatcgccctgggcctgatgacgctcaagctgatcacgcagttcgagacgtaccagctgtggacggcactcgtctccctgacctgcagcaatacaatcttcacgctgaccgttgcctggcgcacagccacgctcatcctggcgggggtctccctgctacccctgtgccagagctccagcatgcggaagacagactggctgcctatgactgtggccgcaatgggcgtaccgcccctccccctgttcatcttctccctgaaggacaccccgaagcgccgcagctggcccctcaatgagggtgtcatggccgtgggcctggtgagcatcctggcctcgtccctcctgcggaacgatgtccccatggcgggcccactggtggcagggggcctcctcatcgcgtgctacgtgatcactgggacgagcgcagacctgaccgtcgagaaagcagcggatgtgacctgggaggaggaggcagagcagactggcgtgtcccataatctgatgatcacggtcgacgacgacgggaccatgaagattaaggacgacgagaccgagaacatcctgaccgtgctgctcaagaccgcgctgctaatcgtgagcggcatcttcccgtattccatccccgccacgctcctggtctggcacacctggcagaagcaaacccagcgcagcggcgttctgtgggacgtgcccagcccgcccgaaacccagaaggccgagctcgaggagggggtctaccggatcaagcagcaagggatcttcgggaagacccaagtcggcgtgggagtccagaaggagggagtgtttcacactatgtggcacgtaacccggggggcggtcctgacccacaacggcaagcggctggagcccaactgggcaagcgtgaaaaaggacctcatctcctacggcgggggctggaggctgagtgcccagtggcagaagggtgaagaggtgcaagtcatagccgtggagcccggcaaaaaccccaagaacttccagacgatgcccgggatcttccagaccaccaccggggagatcggcgcgatcgccctggactttaagcccgggacttcaggctcccccatcatcaaccgggagggtaaggtggtcgggctgtacggcaatggggtggtaacaaagaacggtgggtatgtcagcggaatcgcccagaccaacgctgagccggacggccccaccccagagctcgaggaggagatgtttaagaaacgcaacctgacgatcatggacctgcaccccggatccggcaaaacacgcaaatacctcccggccatcgtgcgcgaggctatcaagcgccgtctccgaacgctgattctggcaccgacccgcgtggtggctgccgagatggaggaggcactgaaggggttgcccatccggtaccagactaccgcgaccaagagcgaacatactgggcgcgagatcgtcgatttgatgtgtcacgccacgttcaccatgcggctgctgtcccccgtgcgcgtcccgaactacaacctcgtgatcatggatgaggcacacttcaccgacccagcctctatcgccgctcgaggatacatctccacccgcgtgggtatgggcgaggcagcagccatcttcatgacggcgacaccgccggggacggctgaggccttcccgcagagtaacgcccccatccaggacgaggagcgggacatccccgaacgctcgtggaacagcggcaacgagtggatcaccgacttcgtggggaagacggtgtggttcgtgccgtccatcaaggccggtaacgacatcgctaattgccttcgcaagaacgggaagaaggttatccagctcagccgtaaaaccttcgataccgagtatcagaaaacccgcctcaacgactgggatttcgtggtgacgaccgacatatccgagatgggcgccaatttcaaggctgacagggttatcgacccccgccgttgcctgaaacccgtgatcctgaccgacggccccgaacgcgtgatactcgccgggccgatgccagttaccgccgcgagcgctgcccagcggcgcggcagggtggggcgcaacccacagaaggagaacgaccagtacatcttcatgggccagcctttgaataacgacgaggaccacgcccactggacggaggccaagatgctgctagacaacatcaacacccccgaggggatcatcccggctcttttcgagcccgagcgggagaagtccgcggcgattgacggcgagtaccgcctgaagggcgagagccggaagaccttcgtcgagctcatgcgccgcggtgacttgcctgtgtggctggcccacaaggtggcgtccgaggggataaagtacaccgaccgcaaatggtgcttcgacggagagcggaacaatcaaattctcgaggagaatatggacgtcgagatctggaccaaggagggcgagcgcaaaaagctgcggccccgctggctggatgcccgcacgtacagcgacccgcttgccctgaaggagttcaaggatttcgcagcaggccggaagtccatcgcgctagatctcgtgaccgagatcgggcgcgtgccaagccacctggctcacagaaccagaaacgccctggacaacctcgtcatgctgcacacatcggagcacgggggacgggcataccgccacgcagtggaggagttacccgagacgatggagaccctccttctactgggcttgatgattttgcttaccgggggcgcgatgcttttcctgatttccggcaagggaatcggcaagactagcatcgggctcatttgcgtgatagtctccagcggcatgctgtggatggcggacgtgccgctgcaatggatcgcctccgccatcgtgctcgaattcttcatgatggtcctcctaatccccgagcctgaaaagcagcgtacgccccaggacaaccagctcgcctacgtggtaatcgggatccttaccctggcggctatcgtcgccgccaatgaaatgggtctcctggagaccaccaagcgagacctgggcatgagtaaagagccgggggtggtaagtcccacgagctaccttgacgtcgatctgcatcccgccagtgcgtggaccctgtacgcggtcgccacgaccgtcataacacccatgctcaggcacaccatcgagaacagcaccgctaacgtctccctggcggccatcgccaaccaggccgtggtgcttatgggcctcgacaaaggttggcccatctcaaagatggacctgggcgtccctctgctcgccctgggatgctactcccaggtgaaccccctaaccctcacggcggccgtgctactgctcgtcacccactatgcgatcatcggccccggcctgcaggccaaggcgacgcgtgaagcgcagaaacggaccgccgccgggatcatgaagaacccgacggtggacggaatcatgaccatcgacctggaccccgtcatctatgacagcaagttcgagaagcagttagggcaggttatgctgctcgtgctctgcgcagtacagctgctgcttatgcgcacctcctgggctctgtgcgaggcactgactcttgccaccggccccatcaccaccctgtgggagggctcgcccggaaagttctggaacaccacgattgccgtctccatggccaacatcttccggggcagctacctggcgggggccggcctagccttctccattatgaagtccgtgggcaccggccgccggggcaccgggagccagggcgaaaccctgggggagaagtggaagaagaagctgaaccagctgtcccgcaaggagttcgacctttataagaagtccggaatcacagaagtggaccgcaccgaggccaaggaggggctgaagcgcggcgaaaccacccaccacgccgtctcccggggcagcgcgaagctccagtggtttgtggagcgcaacatggtgatcccggaggggcgcgtcatcgacctcggctgcgggaggggcgggtggtcctactactgtgcgggcctgaagaaggtcaccgaggtgaggggctacacgaagggcgggcccgggcacgaggaacccgtgcccatgagcacctacggctggaacatcgtcaagcttatgtccgggaaggacgtgttctacctgccgccggagaaatgcgataccctgctgtgcgacatcggggagagctcccccagccccaccgtggaggagagccgaacgatacgcgtgctcaagatggtggagccgtggttacggagcaaccagttctgcattaaggtccttaacccttatatgcccaccgtgattgagcacctcgagcgcctgcagcggaaatacggcggtatgctggttcgcaaccccctatcgcggaactcaacccacgagatgtactggatcagtaacggcaccggaaacatcgtcagcagcgtgaacatggtctcacgcctgctgctcaaccggttcacaatgactcaccgccggccgaccattgagaaagacgtggacctgggtgccggtacccgccacgttaacgctgaacccgagacgcccaacatggacgtcatcggggagcggatcaagaggattaaggaggagcacagtagcacctggcattatgacgacgagaacccgtacaagacctgggcctaccacggttcctatgaggtgaaagcgaccgggtccgcatcatctatgatcaacggcgtggtcaagctgctcacgaagccatgggacgtagtgccgatggtcacccagatggccatgaccgataccacccccttcgggcagcagagggtgttcaaggaaaaggttgatacccgcaccccgcggcctatgcccggaacccgcaaggtgatggagatcacggccgagtggctgtggcgtacgctcggccgcaacaagaagccccgcttatgcacacgggaggagttcaccaagaaagtgaggacgaacgcagcgatgggggctgtcttcaccgaggagaaccagtgggacagcgcccgggctgccgttgaggacgaggagttttggaagcttgtagacaaggagcgcgagctgcacaaactcggcaaatgtgggtcctgcgtctacaacatgatgggcaagcgggagaagaagctcggggagttcggcaaggccaaaggaagccgcgccatctggtacatgtggctgggggcccggtacctcgaattcgaggccctcggcttcttaaacgaggaccactggttctcccgcgagaactcctattccggggtcgagggcgaggggctacacaagcttggctatatcctgcgggacatcagcaagatcccgggcggggccatgtacgcggacgacaccgcaggatgggacacccgcatcacggaggacgatctccacaacgaggagaagataacccagcagatggatcccgaacatcggcagcttgctaacgctatcttcaagctgacctatcaaaacaaggtggtgaaagtccagcgacccacccccaaggggacggtgatggacatcatctcccggaaggaccagcgcggctcaggccaggtggggacctacggcctcaacaccttcaccaacatggaggcgcagctggtccggcaaatggagggggagggcgtcctgtccaaagccgatctcgagaacccgcacctgctggagaagaaaatcacccagtggctagagacgaagggggtggagcgcctcaagcggatggccatctcgggtgacgactgcgtcgtgaagcccatagacgaccgtttcgccaacgccctgctcgcgctgaacgacatgggcaaggtgcggaaagacattcctcaatggcaacccagtaaggggtggcatgactggcagcaggtcccgttctgcagccaccactttcacgagctgattatgaaagacgggcgaaagctcgtagtgccctgtcggccccaggacgaactgatcggtagagcccgcatctcccagggtgcggggtggtcgctgaaggagaccgcctgcctcggcaaagcgtacgcgcagatgtggtccctgatgtattttcaccggagggaccttcggctggccagcaacgccatttgctccgccgtccccgtgcactggattccgacatcacgcacgacgtggtctatccacgcgcaccaccagtggatgaccaccgaggacatgctgaccgtttggaaccgggtctggatcgaagacaacccctggatggaggataagacgcccgtgaccacctgggaggacgttccctacctgggcaagagggaggaccaatggtgtgggtccctaatcggcctgaccagccgggcaacatgggcccagaacatcctgacagcaatccagcaggtgcgttctctcatcggggacgaggagttcctggattacatgccgagcatgaaacgtttccgcaaggaggaggagaccgagggcgcaatatggtga

SEQ ID NO: 25749 - RNA, 9873 nt, synthetic construct
  misc_feature 1..9873: note = derived and/or modified CDS sequence (opt11) from DENV-3__GU131937__SS-prME
  source 1..9873: mol_type = other RNA
accagcctgtgcctcatgatgatgctgcccgccactctggccttccacctcacatcgcgcgacggagagcctcggatgatcgtggggaaaaacgagcgcggtaagagcttgctgttcaagaccgcgagcgggatcaacatgtgcaccctcatcgccatggacctgggcgagatgtgcgatgataccgtcacttacaagtgccccctgattgccgaggtcgaacccgaggacatagactgctggtgcaatttgaccagcacttgggtgacctacgggacctgcaaccaggccggggaacaccggagagacaagcggagcgtcgcgttagcgccgcacgtgggaatgggcctggacacccgcactcagacatggatgagcgccgagggcgcctggcgacaggtggaaaaggttgaaacgtgggccctccgccaccccggtttcactatcctggcgctctttttagcccactatatcggcacctccctgacccaaaaggtggtgatcttcatcctgctcatgttagtgacgcccagcatgactatgcgctgcgtgggggtgggcaaccgtgattttgtcgagggcctgagtggggcaacgtgggtcgatgtggttcttgagcatggggggtgcgtcaccacgatggccaagagcaaacccaccctagatatcgagctgcagaaaacagaggccacccagttggcaactctgcggaaactgtgcatagagggcaagattaccaacattaccaccgattcaagatgcccaacgcaaggcgaggctacactcccggaggagcaggaccagaactatgtttgcaagcacacctacgtcgaccgcggttgggggaacgggtgcggcctctttggcaaaggctcgctagtgacctgtgccaagtttcagtgtctagagcccattgaaggaaaggtcgtccagtacgaaaacctgaagtacacggtgatcatcaccgtgcacaccggtgatcaacaccaggtcggcaacgacactcaaggggtgaccgtggagatcacgccccaggcctcaaccgtggaggccgtgctgcccgagtacggcacactgggtctggaatgtagcccgcgcaccggcctggactttaacgaaatgattctcctgacgatgaagaataaagcgtggatggttcaccggcagtggttctttgacttgccgctcccctggacatccggcgctacgacagagacgccgacctggaaccgcaaagagctgctggtgacattcaagaacgcccacgcgaagaagcaagaggtggtcgtactcgggagtcaagagggcgccatgcatactgcgctaacaggggcaacagagatccagaattcaggcgggacctctattttcgccggtcacctgaagtgccgcctcaaaatggacaagcttgaacttaagggcatgagttatgccatgtgtctcaacaccttcgttctgaagaaggaggtcagcgaaacccagcacgggaccatactaatcaaggtggagtacaaaggcgaagacgccccgtgcaagataccattcagcaccgaagacgggcagggcaaggcgcacaacgggcgcctgatcacagccaaccccgtcgtaaccaagaaggaggagcctgtgaacatagaggcagagccacccttcggggagagcaacatcgtgatagggataggggacaaggccctcaaaatcaattggtacaagaagggcagcagcattgggaagatgtttgaggcaaccgcccggggcgcccgccgaatggcgatcctgggcgacaccgcctgggacttcggtagcgtcggcggagtgctgaactcccttggaaagatggtacaccagatcttcggaagcgcgtataccgccctgttttcgggcgtcagctggataatgaagataggcatcggggtgctgctcacgtggatcggcctgaactctaagaacactagcatgtccttttcctgcatcgtgatcggaatcattaccctgtacttgggcgccgtagtacaggccgacatgggctgcgtgatcaattggaagggcaaagagctgaaatgcggatccggaatctttgtgaccaacgaggttcacacctggaccgagcagtacaagttccaggccgacagccccaagcgtctggctaccgccatcgctggcgcatgggagaatggggtgtgcggaatccgatcgaccacacggatggagaacctcctgtggaagcagatcgctaacgaactgaactacatactctgggagaataacattaagcttaccgtcgtggttggagacatcatcggcgtcttggagcagggtaagagaacactcacaccgcagccgatggagctcaagtacagctggaaaacgtgggggaaggcaaagatcgttaccgccgaaacccagaattccagcttcatcattgatggtcccaacactcccgagtgcccctcgacgcttcgggcctggaacgtatgggaggtcgaggactacggcttcggagtgttcaccaccaatatatggttaaagctgcgggaggtgtacacccagtcttgtgaccatcggctgatgagcgcagcgatcaaggacgagagagccgtccatgcagacatgggctactggatcgagtcccaaaagaatgggagttggaaactcgaaaaggcctcctttatcgaggttaagacgtgcacgtggccaaagagccataccctgtggagtaacggtgtgctggagagcgacatgatcatccccaagtccctcgcggggcccatcagccagcacaactaccggccgggttaccacacccagactgcggggccctggcacctcggtaaactggagctcgacttcaactactgtgagggaaccacggtcgtgataacagagaattgtgggacccgcggcccatcactgcggacgaccactgtgagcgggaagctgatccacgaatggtgctgcagaagctgcacccttccgcccctgcggtacatgggagaggacgggtgctggtacggcatggagatacgaccaattaatgaaaaggaggaaaacatggtgaagtctctggtatccgcgggcagtggaaaagttgacaacttcaccatgggagtcctctgcctggccatcttatttgaggaggtgatgcgagggaagttcggcaagaagcacatgatcgccggggtactgttcacctttgtgttgttgctctccgggcaaattacttggcgggatatggctcacaccctgattatgataggcagcaacgcatccgatcggatggggatgggcgtgacgtatctggccctcatcgccacgtttaagatccagcccttcctggccctggggttcttcctccgcaagctgacctctcgggaaaacttactactgggcgtgggcttggcgatggcgactacgctccagctcccggaggacatagagcagatggccaacgggattgccttgggtctcatgaccctgaagttaattacgcagttcgagacctaccaactctggacggccctagtcagcctgacctgctccaacaccatctttacactcacggtagcgtggcgcaccgctaccctgatcctggccggggtcagcttactgccactgtgccaatccagctcaatgcgaaagaccgactggctgcccatgacggtggccgccatgggggtgccgcccctccctctgttcatcttcagtttaaaggacacccccaagcggcgctcctggcctttgaacgagggggtcatggcggtgggcctggtgagcatactcgcctcctcattgcttcggaatgacgtccccatggccggaccactcgtggccgggggcctgctgatcgcctgctacgtgatcacagggacctctgcggaccttacggtcgagaaggcagccgatgttacctgggaagaggaggccgaacagactggcgtgagccacaatctgatgatcaccgtcgacgacgatgggactatgcgcataaaggacgacgaaacggagaacatccttacggtgctcctaaagaccgctctactcatagtgtccggcatcttcccctatagcatcccagcaaccctgctggtgtggcacacgtggcaaaagcagacgcagcgctccggcgtgctttgggacgtgccaagtccgcccgagacacagaaggccgagctggaagagggagtctatcgcatcaagcagcagggcatcttcgggaagacccaggtgggcgtaggagtccaaaaggaaggcgtgttccatacgatgtggcacgtcacgcggggcgcagtcctgacccacaacgggaagcgtctcgagcccaactgggcttccgtgaagaaggatctgatcagttacggcgggggctggcggctttctgcccagtggcagaagggggaggaggtgcaggtgatcgcggtggaacctggcaaaaacccgaagaacttccagaccatgcccggcatctttcagactacaaccggggagatcggcgcaattgcactggatttcaagcccgggaccagcggcagccccattatcaaccgcgagggcaaggtggtcggtctatacggcaacggggtcgttacgaagaacggtggttacgtttccggcatcgcccagaccaacgctgagcccgatgggcccacccccgagctggaggaggagatgttcaaaaagcggaaccttaccataatggacctccacccggggtcaggaaaaacgcgcaaatatctgcccgccatcgtgcgggaggccattaaacgtcgcctacgcaccctaatcctggctcctacccgggtggttgccgcggagatggaagaggcccttaaagggctccccatccgctaccagaccacggccaccaagtcggaacacaccggccgggagattgtggatctgatgtgtcacgccacctttacgatgcgcttattatctccggtacgcgtcccaaattacaacctggttatcatggacgaggcccacttcacggaccccgcatccatcgcagcccgcgggtacatctcaacccgagtcggcatgggcgaggccgcagctatcttcatgaccgccacgcccccggggaccgccgaggcattcccgcaatccaatgcgcccatccaagacgaggaacgcgatatcccggaaagaagctggaattcgggtaacgagtggatcactgatttcgttgggaaaaccgtctggttcgtgccgtctataaaagccggcaacgacatcgccaactgcctgcggaagaacgggaagaaggttatacaactctcacgcaagacgtttgacaccgagtaccagaaaaccagactcaacgattgggacttcgtggtcaccaccgacatcagcgaaatgggagccaacttcaaggctgacagggttatagacccccggcggtgcttaaagcccgtgatcttaaccgacggtcctgagagagtgatcctagcgggtccgatgcccgttaccgccgcctccgccgcacagcgccggggccgcgtagggcggaatccccagaaggagaacgaccagtacatcttcactggccagccgctcaacaatgatgaggaccacgcgcactggacagaggccaaaatgctcctggacaatatcaacacccctgaaggaatcatccccgcccttttcgagcccgagcgcgagaagagcgcggccatcgacggcgagtaccggctcaagggcgagtcccgcaagacgttcgtcgagctgatgagacgaggggacttgcccgtgtggctcgcgcataaagtcgccagcgagggtatcaagtataccgacaggaagtggtgttttgacggtgagcgcaacaaccaaatactggaagagaacatggacgtcgagatctggacaaaagagggcgagcggaagaagctgcgcccacgctggttagacgcgcggacgtactccgatcccctggccttgaaggagttcaaagactttgcggccggccgaaaaagcattgccctcgacctggtgaccgagatcggcagggttccttcccacctagcccaccgcactcgaaacgcactcgacaacctagtcatgctgcacaccagtgagcatggcgggcgagcgtaccgacatgcagtggaggagctcccggaaacgatggagacgctgctgctcctggggctgatgataagcctcaccggcggcgcgatgctgttcctgatttccggcaagggcatcggcaagaccagcatcggtctcatctgcgtgatcgtgagttcaggcatgctctggatggccgacgtgcccttgcagtggatagcctccgccatcgtgctcgagtttttcatgatggtcctgctgatccccgagcccgaaaagcagcgaacgccgcaggacaaccagttggcctacgtggtgatcggtatactgacgctggccgcaatcgtagctgctaacgaaatgggactcctggagacgacgaagcgagacctgggcatgagtaaggagccgggggttgtgtcccctacgagctatctcgacgtggacctgcaccccgcgagcgcctggaccctatacgcagttgccaccaccgtgataaccccaatgctacggcacaccattgaaaacagcaccgcgaatgtatcgctggccgccatagccaaccaggcagtggtgctgatgggcctcgataaggggtggcccatcagcaaaatggacctaggcgtccccctcctcgccctcgggtgttactcccaagtgaaccccctaaccttgacggcggcagtgctgttgctagtcacccattacgcgattatcggaccgggactgcaggctaaggccacccgtgaggcgcagaaacgcactgccgcagggatcatgaagaatcccacggtcgacggcatcatgaccatcgatttggacccagtgatctacgacagtaagttcgagaagcaactcggccaagtaatgttactggtgctatgcgctgtccagctgctgcttatgcgcacctcctgggccctgtgcgaagccctgacactggccaccggacccatcacgactctgtgggagggctcgccgggcaaattctggaacaccaccatagcagtctccatggcgaacatatttcgtggaagctacctggccggtgccggcctggctttctccatcatgaagtccgtcgggactggcagacgcggcaccggttcccaaggcgagacactgggagagaagtggaagaagaagctgaaccagctctcccgaaaggagttcgatctgtacaagaagtccggtatcaccgaggtggatcgcactgaggctaaagaagggctgaagcggggcgagaccacccaccacgctgtctcccgcggaagtgccaagctccagtggttcgtggagcggaacatggtaattcccgaggggcgcgtcatcgacctaggatgcgggcgcggggggtggtcctactactgtgcagggctgaagaaggtgaccgaggtgcgcggatatacaaagggaggtcccggacacgaagagccggtccctatgagcacctatggctggaacatcgttaagctcatgagtggaaaggacgtcttctaccttccccccgagaagtgcgacacactcctgtgcgacataggcgagtctagccccagcccgaccgtcgaggagaaccgcacgatccgcgtgctcaaaatggtggagccttggctccgcaacaatcaattctgcatcaaagtgttgaatccttacatgcccaccgtgatcgagcacctcgagcggcttcagagaaagtacggcgggatgttagtgaggaaccctctctcccgtaacagcacccatgagatgtactggatctccaacggtacggggaacatcgtcagcagcgtgaacatggtcagccgtctgttgctcaaccgcttcaccatgacacaccggcgcccgaccatcgagaaggatgtggatctaggtgctggcacccggcacgttaatgcggagccagagacgccgaacatggacgtaatcggagagcgcatcaagaggatcaaggaggagcacagttcaacctggcactatgatgacgagaacccgtacaagacatgggcctaccacggctcctatgaggtgaaggcaacagggagcgcgagctccatgattaacggcgtggtcaagctgctaacgaaaccatgggacgtggtacccatggtaacgcagatggcgatgacggataccacgccatttgggcagcaaagggtgttcaaagaaaaggtcgatacccggacgccccggcccatgccgggcacccggaaggtcatggagatcacggcggagtggctgtggaggactctgggccgcaataagaagccacggctctgcacacgcgaagagttcaccaagaaggtgcgtacgaacgccgccatgggggccgttttcaccgaggaaaatcaatgggacagcgcacgcgctgccgtcgaggacgaggagttctggaaactggttgatcgggagcgcgagttacacaagctcggcaagtgtggttcctgcgtttacaacatgatgggcaagcgggagaagaagctgggggagtttgggaaggccaaaggcagccgcgctatctggtacatgtggttaggggcacggtatctagaattcgaggcactgggcttcctgaacgaggaccactggttttcccgcgagaatagctactccggcgtagaaggcgaagggttgcacaagttaggctacatcttacgggacatatccaagatccctggcggggccatgtacgccgacgacaccgcaggctgggatactcgcatcacggaagacgatcttcacaacgaggagaagatcacccagcaaatggatcccgagcatagacagctagcgaacgccattttcaagctaacatatcagaacaaggtggtgaaagtccagcgcccaaccccgaaggggaccgtgatggacatcatctcccggaaggatcaacgaggcagcggccaagtaggtacgtatggccttaacacattcaccaacatggaggcccaactggtccggcagatggagggggagggcgtcctgtcgaaggccgacctcgagaacccacacctcctggagaagaagatcacccagtggcttgaaacgaagggtgtggagcgcctgaagaggatggccatcagcggcgacgactgcgtcgtaaagccgattgacgaccgcttcgcgaacgccctcctcgccttaaacgacatgggcaaagtacggaaggacataccccaatggcagccgtccaaggggtggcacgactggcagcaggttccattctgtagccaccacttccacgagcttatcatgaaagacggccgcaaactcgtagtgccctgcaggccgcaggacgagttgatcggacgtgcccggatttcccaaggtgcagggtggagcctgaaggagacggcgtgcctcggaaaggcctacgcccagatgtggtccctgatgtacttccatcggcgcgatctccggctcgcctcaaacgcgatttgctccgccgtcccggtgcattggatccccaccagccgaaccacgtggagcattcacgcccatcaccagtggatgaccaccgaggacatgcttaccgtgtggaatcgagtctggattgaggacaatccctggatggaggacaagacgcccgttaccacgtgggaggacgtgccgtacctgggcaagcgggaggaccagtggtgcgggtccctcattggattgaccagccgggccacgtgggcccagaacatcctcaccgcgatccagcaggtccgcagcctcataggagacgaggagttcctggactacatgcctagtatgaagcggttccgcaaggaggaagagtcagagggggccatatggtga

SEQ ID NO: 25750 - RNA, 9873 nt, synthetic construct
  misc_feature 1..9873: note = derived and/or modified CDS sequence (opt11) from DENV-3__GU131938__SS-prME
  source 1..9873: mol_type = other RNA
acctcgctgtgcctcatgatgatgctgcccgccacccttgccttccatctaaccagccgcgacggcgagccccggatgatcgtggggaagaacgagcgcggcaagtcactactgttcaaaaccgcgtcggggatcaacatgtgcaccctcatcgcaatggacctgggcgaaatgtgtgatgacaccgtcacgtataagtgccccctgatcgctgaggtagagcccgaggacatcgactgctggtgcaacttgacctcaacctgggtgacctacggaacctgcaaccaagccggggagcaccggcgcgacaagcggtcagtcgccctggcgccccacgtgggcatggggctggacacccgcacccaaacttggatgagcgctgagggcgcctggaggcaggtggaaaaggtcgagacatgggccctccgacacccggggttcacgatcctggcgctgtttctcgcccactacatcggcacctcactgactcagaaggtggtcatattcatattgctcatgttggttaccccgagtatgaccatgcggtgcgtgggggtgggcaacagagacttcgtcgagggcttatccggggccacctgggtggacgtggtcctcgagcacggtgggtgcgtgaccacgatggccaagtccaagcccactctggatatcgagctgcagaaaaccgaggccacccagctcgcgacgctgcggaagctgtgcatcgagggcaagatcaccaacatcactaccgactcccgctgtcccacgcagggcgaggccactctccctgaggagcaggatcagaactacgtgtgcaagcacacctacgtagaccgggggtggggtaacgggtgcggactgttcgggaagggcagtctggtgacctgtgccaagttccagtgcctcgagtccatcgagggcaaggtcgtccagtatgagaacctgaagtacaccgtgatcatcaccgtgcacacgggggaccagcaccaggttggcaacgacacccagggtgtgacggtcgagattacgcctcaggccagcaccgtggaggcagtgctgccggaatacggcacgctcggactggagtgcagcccccgcaccggcctggacttcaacgagatgatactgttgacgatgaagaacaaagcgtggatggtccaccggcagtggttcttcgacctgcctctcccctggaccagcggcgcaaccaccgagacgccgacctggaaccgcaaggagctgctggtgacctttaagaatgctcatgccaagaaacaggaggtggtcgtgcttgggtcccaggagggggccatgcacaccgcgttgacgggggccaccgagatccagaacagcggcggtacctccatcttcgccggacacctgaagtgccggttgaaaatggacaagctggaactgaaaggcatgagctacgcgatgtgtctcaacaccttcgttctgaagaaggaggtcagcgagacgcagcacgggaccatcctgatcaaggtagagtacaagggagaggatgccccctgcaagatccccttttccaccgaagatggtcagggcaaggcgcataacggccgcctgatcaccgccaaccccgtggtcacgaagaaggaggagcccgtgaacatcgaggccgagcctccattcggagagagcaacatcgtgataggcatcggcgataaggccctcaagatcaactggtacaagaagggctccagcatagggaagatgttcgaggcgactgcccggggcgcccgccggatggcaatcctcggtgacactgcctgggacttcggttccgttggcggggtgctgaactcgctcggcaagatggtgcaccagatctttgggagcgcgtatactgccctgttcagcggagtcagttggatcatgaagatcggcatcggggtgctgctcacgtggatcggcctgaacagcaagaacacatccatgagtttctcctgcatcgtcatcggaatcatcaccttatacctcggcgccgtcgtgcaggccgacatgggctgcgtcatcaactggaaggggaaggagctcaagtgtggcaacggtatcttcgtcacgaacgaggtacacacgtggacggagcagtacaagttccaagctgatagccccaagcgcctggctaccgccatcgccggcgcctgggagaacggggtgtgcggtatacgctccaccacgcggatggaaaacttgctatggaagcagatcgccaacgagctaaactacattctctgggaaaacaacatcaagctgactgtcgtggttggtgacatcatcggcgtcctggaacagggaaagcgcgcgctcacgcctcagcccatggagctgaagtacagctggaagacgtgggggaaggcaaagatcgtgacggccgagacccagaactctagcttcataatcgacggtccgaacacccccgagtgtccctccgcctcacgggcgtggaacgtgtgggaggtcgaggactacgggtttggggtgttcaccacgaacatatggctgaagctccgcgaagtatacactcagagctgcgaccaccggctgatgtccgccgccataaaggacgagagggccgtccacgcggacatgggctactggattgagagccagaagaacgggtcctggaaactggagaaggcgagcttcatcgaggtgaagacctgtacctggccaaagtcccacacactctggagcaacggcgtgctcgagtccgacatgatcattcccaagtccctggcagggccgatctcgcagcacaaccacagacccggttaccatacgcagactgcggggccgtggcaccttggcaaactggaattagatttcaactactgcgagggcaccaccgtcgtgatcgcagagaactgcgggacacgcggccccagcctccggaccaccaccgtgtccgggaagctcatccacgagtggtgctgccgctcctgcacgctgccgcctctgcgatacatgggcgaggacgggtgctggtacggcatggaaatccgcccgataaacgagaaggaggagaacatggtcaagtcactggtgagcgccggcagcgggaaggtggataactttaccatgggcgtcctgtgcttagcgatcctgttcgaagaggtgatgcgggggaagtttggcaaaaagcacatgatcgccggggtcctcttcaccttcgtccttctgctgagcggccagatcacctggcgcgacatggctcatacgttaatcatgatcggcagtaacgccagcgaccggatggggatgggggtgacttacctggccctgatcgcgaccttcaagattcagcccttcctcgccctagggttcttcttgagaaaattaaccagccgggaaaacttactgctgggcgtcggcctggccatggccactaccctgcaactacccgaggacatcgagcagatggcgaacggcatagccctgggtctgatgaccctcaagctcatcacacagttcgagacgtaccaactgtggaccgcactcgtctccctgacctgcagcaacaccatcttcacgctgaccgtggcctggcgcaccgccaccctaattttagcgggggtctccctgctccccctgtgccaaagcagcagcatgcggaagacagactggctgccgatgaccgtagccgccatgggcgtgccccccctccccctgtttatattcagtcttaaggacaccccgaagcgccggagctggcccctcaacgagggggtcatggcagtgggcctggtgtccatcctggccagctctctcctgcggaacgacgtcccaatggcaggccccctggtcgccggaggcctcctaatcgcctgctacgtgattaccgggacaagcgccgatctcaccgtcgagaaggccgcggacgtgacttgggaggaggaggccgagcagaccggcgtgtcccacaacctcatgatcacggtcgacgacgacgggaccatgaagatcaaagacgacgagactgaaaacatcctgactgtactgctcaaaacggcgctgctgatcgtcagcggtatcttcccgtactccatccccgccaccctcctggtatggcacacctggcagaagcagacccagcgctcgggggtgctttgggacgtgccaagcccgcccgaaacccagaaggccgagctcgaggagggggtctatagaatcaagcagcagggcatcttcgggaagacgcaggtgggggtgggggtccagaaggagggcgtgtttcacaccatgtggcacgtgacccgcggggcggtcctgacccacaacgggaagcggctggagcctaactgggccagcgtgaagaaggacctcatctcatacggcgggggctggagactgagcgcccagtggcagaagggggaggaggtgcaagtcatcgccgttgagcccggtaagaatcccaagaactttcagacgatgcccggcatcttccagaccacgaccggggagatcggcgcgatcgcgctcgactttaagccaggcacgagcggcagtcccatcatcaaccgtgagggcaaggttgtcgggctgtacggcaacggggtggtgaccaagaacggcgggtacgtgagcggcatcgcacagaccaacgccgagccggacggccccacccccgagctcgaagaggaaatgttcaagaagcgcaacctgacgatcatggacctgcacccggggagtggcaaaacacggaagtatttgcccgccatagttagagaggcaatcaaacggcgcctgcgcaccctgatactcgcccccacccgcgtggtcgcagccgagatggaggaagccctgaagggcttgcccatccgatatcagacgaccgcgaccaagtctgagcacaccggaagggagatcgtggatctcatgtgccatgctacattcaccatgcggttgttgtcccccgtgcgcgtcccaaactacaacttggtgatcatggacgaggcccactttaccgatcccgccagcatagccgcacgggggtacatatccacccgcgtgggcatgggcgaagccgccgccatcttcatgacggccacgccgcccgggaccgccgaggccttcccccagagcaacgcacccatccaggacgaagagcgggacatccccgaacgctcctggaatagcggaaacgagtggatcaccgacttcgtagggaagacggtgtggttcgtgccctccataaaagccggcaacgacatcgcgaattgtctgcgcaagaacgggaagaaggtgatacagctgagccggaagacgttcgacaccgagtatcaaaagacccgcctcaacgactgggacttcgttgtgacgaccgatatctccgagatgggcgccaacttcaaggccgaccgggtcattgacccgcgcagatgcctcaagcccgttatcctgaccgacggcccagaacgcgtgatcctcgctggtccgatgccggtcaccgccgcgagcgccgcccagagacgcggccgtgtggggcgaaatccccagaaggagaacgaccagtacatctttatgggccagcccctgaacaacgatgaggaccatgcacattggacggaggccaagatgctgctcgataacatcaacacccccgaggcgatcatcccggccttattcgagcccgagcgtgagaagtccgcggccatcgacggggagtaccgcctcaaaggcgaaagccggaaaaccttcgtcgagttgatgcgtcgcggtgatttgcccgtgtggcttgcgcacaaggtcgccagtgaggggatcaagtacactgataggaagtggtgcttcgacggcgagcggaacaaccagatccttgaagagaatatggatgtcgagatctggaccaaggagggggaaaggaagaagctccggccccgctggctcgacgctcgcacgtacagcgacccgctcgccctgaaggagttcaaggacttcgccgcgggccggaagtccatcgctctggatctggtaactgagatcggccgcgtgccaagccacctggcccaccggacccgcaacgcccttgacaacctcgtcatgctgcacaccagcgagcacggtggtcgggcctaccgccacgcggtggaggagctgcccgaaactatggagactctcctgctgctcgggctcatgatcctcctcaccggcggggccatgctgttcctgatttccggtaagggcatcgggaagaccagcatcggtcttatatgcgtcatcgtctcctccggaatgctatggatggccgacgtgccgctgcagtggatagcatccgccatcgtcctcgagttcttcatgatggtcctgctgatccccgagcccgagaagcagcggacgccccaggacaaccagctcgcgtacgtggtgatcggcattctgaccctggccgcaatcgtcgccgccaacgagatggggctcttggagaccaccaagcgcgacctgggcatgtctaaggagcctggcgtggtgtcgcccacaagctacctcgacgttgatcttcaccccgcgtcagcctggaccctatacgccgtggctaccaccgtgattacgcccatgctcagacacaccatagaaaacagcaccgctaacgtctccctggccgccattgccaaccaggcagtggtgctaatggggctcgataaaggctggccgatcagcaaaatggacctcggggtccccttgctcgcgctcggctgctactcccaggtgaaccccctaacactcacagccgccgtgctgttactcgtaacccactacgccatcatcgggccgggcttgcaggcaaaggcgacccgggaagcccagaagcggaccgccgccggtattatgaagaatccgacggtggatgggatcatgaccatcgacctggaccccgttatctacgacagcaaattcgaaaagcagctcggccaggtcatgttgctggtgctctgtgccgtgcagctgctgctcatgcgaacttcctgggcgctgtgcgaggccctgaccctcgccacggggcccatcaccaccctgtgggagggctcacccggcaaattctggaacaccaccatcgcagtctcaatggcaaacatcttccgggggagctacctggcaggcgctggtctcgccttctcaatcatgaagtccgtcggcacggggcgccggggcacgggctcgcagggggagaccctgggcgaaaagtggaaaaagaagttaaaccagctctctcgcaaggagttcgacctgtacaagaaatccgggatcacggaggtggaccggaccgaagccaaggaggggctgaagcgcggagagactacgcaccatgcggtatcccggggcagcgccaagctccagtggttcgtggaaagaaacatggtgattccagaggggcgggtcatagacctggggtgcggccgcgggggctggtcctattactgcgccggcctgaagaaagtaaccgaggtgcgcggctacacgaagggcgggcccggccacgaggagcccgtccccatgagcacctacgggtggaacatcgtgaagctcatgtccggcaaggacgtgttctacctgccgcccgagaagtgcgacaccctgctgtgcgacatcggagagagctcccccagccccaccgtcgaggagtcccgcacgatccgcgtgctcaagatggtagagccatggctgcggagcaaccagttctgcataaaggttctgaacccctacatgcccaccgtgatcgagcaccttgagcgcctgcagcggaagtacggtggaatgctggtgcgcaatcccctctcccggaacagcacccacgagatgtactggatttccaacggtaccggcaacattgtcagctccgtgaacatggtcagccgcctgctgttaaaccggttcacgatgacccaccgccggccgaccatcgagaaggacgtggacctcggggccggcacccgccacgttaacgcagagccggagacgcccaacatggatgtcatcggcgagcggatcaagcgcatcaaggaggagcactcaagcacctggcactacgatgacgagaacccgtacaagacctgggcgtaccacggatcatacgaggtgaaggcgactggatccgccagctctatgatcaatggagttgtaaaactcctcacaaaaccctgggacgtcgtgcccatggtcacccagatggctatgaccgacaccaccccgtttggacaacagcgggtgtttaaagaaaaggtagacacccgcaccccgcggcccatgccggggacccgcaaggtcatggagatcacggccgaatggctgtggcggaccctgggccgcaacaagaagccccgcctctgcacccgggaggagtttaccaagaaggtacgcacgaacgcggccatgggcgccgtgttcaccgaggagaaccagtgggacagcgcccgggccgccgtcgaggacgaggagttctggaaactagtagacaaggagcgtgagctgcacaagctcgggaagtgcggctcctgcgtgtataacatgatggggaagcgggagaagaagctgggtgagttcgggaaggctaagggcagtcgggcaatctggtacatgtggctgggggctcggtacctcgagttcgaggcgcttgggttcctgaacgaggaccactggttctcccgcgagaacagctactccggggtagagggagagggcctccacaagctgggatatatcctgcgggacatcagcaagatccccggaggtgccatgtatgccgacgacaccgccgggtgggacacccgcatcacggaggacgacctccacaacgaggagaagatcacacagcagatggaccccgagcatagacaattagccaacgcgatctttaagcttacatatcagaacaaggtggtgaaggtccagcgccccacgcccaagggcacggtgatggacatcatatcacggaaggaccagcgggggtcgggccaggtcggcacatacgggttgaacaccttcaccaacatggaagcccagctggtacggcaaatggagggcgagggagtgctctccaaggccgacctagagaacccgcacctcctggagaaaaagatcacccagtggctcgagactaagggcgtggagcgcctgaagcggatggccattagcggggacgactgcgttgtgaagccaatcgacgacagattcgccaacgcactcttagcactgaacgatatgggaaaggtgcggaaggacatcccccaatggcagccctccaagggctggcacgactggcaacaggtgccgttttgcagccaccacttccatgagctgattatgaaggacgggcgcaagttagtggtgccctgccggcctcaggatgagctgatcgggagggcccgcatctcccagggggccggctggagcctgaaggaaacagcctgtctcgggaaagcgtacgcccagatgtggtcactgatgtacttccaccggcgcgacctgcggctcgccagcaatgccatctgttcagcggtccccgtgcactggatcccgacctcgcgcaccacgtggagcatccacgcgcaccaccagtggatgacgacggaagacatgctgaccgtttggaaccgggtgtggatcgaggacaacccctggatggaggacaagacgcccgtcaccacatgggaggacgtgccctatttaggcaagcgcgaggaccaatggtgcggctccctcattgggctgacctcacgggcaacttgggctcagaacattttaaccgctatccagcaggtacgctcgctcatcggcgatgaggagttcctggactacatgccgagtatgaagcggttcagaaaggaggaggaaaccgagggggcgatctggtga

SEQ ID NO: 25751 - RNA, 9873 nt, synthetic construct
  misc_feature 1..9873: note = derived and/or modified CDS sequence (opt11) from DENV-3__GU131939__SS-prME
  source 1..9873: mol_type = other RNA
accagcctgtgtcttatgatgatgctgccggcgacactggccttccacctcacaagccgcgacggcgagcctagaatgatcgttgggaagaacgaacgcggcaagagcttgctgttcaagaccgcgtccggaatcaacatgtgcaccctcatcgctatggacctgggagagatgtgcgacgacaccgtgacctacaagtgccccctgattgccgaggtggagcccgaagacatcgattgctggtgcaacctcacaagcacctgggtgacttacgggacctgcaaccaggccggcgagcatcggcgcgataagcggtccgtggccctggcgccgcatgtaggcatggggcttgatactaggacccaaacctggatgtcggccgagggcgcctggcgccaggtggagaaggtggagacgtgggccctccgccacccggggttcaccattctggctctgttcctcgctcactacatcggcacctccctcacccagaaagtggtgatcttcatcctgctcatgctggttacgcccagcatgaccatgcggtgtgtgggagtgggcaaccgcgacttcgtggagggcctgtccggggccacctgggtggacgtggttctcgagcacggcgggtgtgtgactacgatggccaaaagcaagcccacactggacatcgagctgcaaaagaccgaggccacccagctcgcgacgctgcgtaaattatgcatcgagggcaagatcaccaacatcaccaccgactcacgctgccccacgcagggcgaagctaccctcccggaagagcaggaccagaattatgtgtgcaagcacacctatgtcgaccgggggtgggggaacggttgcggcctgttcgggaagggcagcctggttacctgcgccaagttccagtgcctcgagcccatcgagggtaaagtggtacagtacgagaatctgaagtacacggtaatcataactgtccataccggggatcagcatcaagtcggcaacgacacccaaggcgtgacggtcgagatcacgccacaggcgtccactgtggaggccgtgctgcccgagtatggcaccttggggctggagtgcagcccccgcacaggcctggacttcaacgagatgatcctactgacgatgaagaataaggcctggatggtgcacagacaatggttcttcgatttacccctcccctggaccagtggcgccaccaccgaaactcccacctggaaccgcaaggagctgctggtaaccttcaagaacgcccatgccaaaaagcaggaggtggtcgtcctggggagtcaggagggtgctatgcacacggcgctgacaggtgcaaccgaaatccagaactccggcgggacctcaatcttcgcaggccatctgaagtgtcgactaaagatggacaagctggagcttaagggcatgtcctacgctatgtgcctcaacaccttcgtgctgaagaaggaggtcagcgagacgcagcatgggaccatcctgatcaaggtggagtacaagggagaggacgccccgtgcaagatacccttcagcacagaggacgggcagggcaaggcgcacaacggtcgcctgatcaccgccaaccccgtggtcacgaagaaagaggagcccatcaacatcgaagctgaacctcccttcggggaatccaacatcgtaatcgggataggggacaaggcactcaagatcaactggtacaagaaaggcagctccatcgggaagatgttcgaagcgaccgcccggggcgcccgccggatggccatactgggcgacacagcctgggacttcgggagcgtgggcggggtcctgaattccctcggcaagatggtacatcagatcttcgggagcgcgtacaccgccctgttctcgggagtcagctggatcatgaagatcggcatcggcgtcctgttaacgtggatcggactgaactccaagaacacgagcatgtccttcagctgcatcgtgatcgggataatcacactgtacctaggcgccgtggtccaagcggacatgggatgcgtgatcaactggaagggcaaggagctgaagtgcggcaatggaatattcgtgaccaacgaggtccatacgtggacggaacagtacaagttccaagccgactcccccaagcgcctggcgaccgccatcgcaggcgcctgggagaacggggtgtgcggcatcagaagcaccacgcggatggagaacctcctctggaagcagattgccaacgagctgaactatatcctgtgggaaaacaacatcaagctgaccgtggtcgtaggtgacatcatcggcgtgcttgagcagggcaagcgcaccctcacaccacaaccgatggagctaaagtatagttggaagacgtgggggaaggcgaagatcgtgacagccgaaactcagaatagcagtttcatcatcgacggccccaacacccccgagtgcccctccgcttcccgggcctggaacgtgtgggaggtggaggactacggtttcggcgtgttcacgaccaacatctggcttaaactccgtgaggtgtacacgcagagctgtgaccaccgtctcatgagcgccgccatcaaagacgagcgcgcagtgcacgctgacatgggctactggatcgagtcccagaagaacgggagctggaagctggagaaggcctcctttatcgaagtcaagacttgcacctggcccaagtcgcacacgctctggtccaatggcgtgctggagagtgacatgatcatccccaaatccttagcgggacccatcagtcagcacaaccaccggccgggctaccatacccagaccgccggtccctggcatctaggcaagctggagcttgacttcaactactgcgagggcaccacggtggtcatcgccgagaactgcgggaccaggggaccatctcttcggaccactacggtgagcggaaagctcatccatgagtggtgctgccgcagctgcacccttcctccgcttcggtacatgggtgaggacgggtgctggtatggcatggagatccgccccatcaacgagaaggaggagaacatggtcaagtcgctggttagcgccggcagcgggaaagtggataacttcaccatgggcgtcctgtgcctcgccatcctcttcgaggaagtaatgcggggtaagttcggcaagaaacacatgatcgccggggtgctcttcaccttcgtcctcctgctgtccggccagatcacctggcgcgatatggctcacaccctcatcatgatcggctcgaatgcgagcgaccggatgggtatgggcgtaacctacctggctctgatcgccaccttcaagatccagccatttctcgccctggggttctttttacgcaagctcacgtcgcgagaaaacttgctgctcggcgtgggcctcgccatggccaccaccctccagctccccgaggacatcgagcagatggctaacgggatcgctctgggcctgatgacactcaagctgatcacgcaattcgagacctaccagctatggaccgccctcgtgagcttaacgtgttccaacacgatattcaccctgaccgttgcctggcggaccgccacactcatcctggccggggtaagcctgcttccgctgtgccagtccagcagtatgcgtaagacagactggctgcccatgaccgtcgctgccatgggcgtgccgcccctgccgctgttcatcttcagcctgaaggacacacccaagcgcaagagttggcccttaaacgagggggttatggccgtcggactggtttctatcctggcctcctcgctactgcgcaacgacgtgcccatggccggccctctggtcgctggcgggctactaatcgcctgctacgtgatcacggggacctccgccgacctgactgtggagaaagccgccgatgtaacctgggaggaggaggcggagcagacgggggtgagccacaatctcatgatcacggtggacgatgatggtaccatgcgcatcaaggacgacgaaaccgaaaacatactaacggtcctactcaagacggccctgctgattgtgagcggcatattcccgtactcgatcccagccaccctcctggtgtggcacacctggcagaagcagacccagcgctccggcgtcctgtgggacgtgcccagcccgcctgagacgcagaaggccgagctcgaagagggggtgtaccggattaaacagcagggcatcttcgggaagacccaggtcggcgttggggtgcagaaggagggggtcttccacaccatgtggcacgtgacccgcggtgccgtcctgacgcacaatgggaagcggctggagcccaactgggcgtccgtcaagaaagatctcatcagctacggcggtggatggcgactttcagcccagtggcaaaagggggaagaagtccaagtgatcgccgtcgagcccgggaagaacccgaagaacttccagaccatgcccggcatcttccagaccactacaggggagatcggtgcgatcgcgctggacttcaagccggggaccagcggcagcccgatcataaatcgggaaggcaaggtggtgggtctgtacggtaacggggtagtgaccaaaaacggggggtacgtgtccggtatagcccagaccaacgccgaaccagacgggcccacccccgagctcgaggaggagatgtttaagaaacgcaacctgaccatcatggatctacatccgggatcaggaaagacccgcaagtacctccccgcgatcgtgcgcgaggccatcaagcggcgcctgcggaccctgatcctcgcgcccacccgcgttgtggccgccgagatggaggaggccctgaagggtctgcccatccggtaccagaccaccgcgaccaagtccgaacacacgggcagagagatcgtcgacctcatgtgtcacgcgacttttaccatgcggctgcttagcccggtgagggtgcccaactacaacctcatcatcatggatgaggcccacttcaccgaccccgcctccatcgccgcccgggggtacatcagcacgcgcgtcggcatgggtgaggccgccgccatcttcatgaccgcgacgccgcccgggaccgcggaggcctttccccagagcaacgcccccatacaggacgaggagcgggacattccagagcgctcgtggaactccggcaacgagtggatcaccgacttcgtcgggaagaccgtgtggttcgtcccaagcatcaaggccggcaatgacatcgccaattgcctgcgcaagaacggcaagagggtgatccagctgtcccgcaagaccttcgacacggagtaccagaagacacggttaaacgactgggacttcgtggtaacaaccgacatcagcgaaatgggcgcgaatttcaaggcagatcgcgtgatcgacccccggcgctgcctgaagcccgtgatccttaccgatggccccgagcgggtcatcctcgccggccctatgcccgtgaccgctgcctccgcagcccagcgccggggccgcgtggggcggaatccccagaaagagaacgaccaatacatcttcaccggccagcccctgaacaacgacgaagaccacgctcactggactgaggcgaagatgcttttggacaacatcaacaccccggaggggataatccccgcccttttcgagcccgagcgcgagaagtccgccgctatcgatggcgagtaccggctaaagggagagtccagaaaaacctttgtcgagctcatgcggcgcggcgacctgcccgtgtggttagcccacaaggtcgcctcagagggcatcaagtacacggaccggaagtggtgcttcgatggcgagcgcaacaaccaaatcctcgaggagaacatggacgtagagatctggaccaaggagggcgagcgtaagaagctgcgccctcgctggctggatgcacggacctacagtgaccccctcgctctgaaggaattcaaggacttcgcagcaggccgcaagagcatcgccttagatctcgtcaccgagatagggcgggtcccctcccacttggcgcaccgtactcggaacgctctggacaacctcgtaatgctgcacaccagcgagcacggggggcgtgcctaccggcatgcggtagaggagctgccggagaccatggaaaccttactgctgctcggcttaatgattctgctgacaggaggggccatgctgtttcttatcagcgggaaggggatcggcaagacctccatcggtctcatttgcgtaatcgtgagctctggcatgctttggatggcagacgtgccgctccagtggatcgccagcgccatcgtcctcgagttctttatgatggtgcttctgatacccgagcccgagaagcagcgcaccccacaggataatcaactcgcctatgtggtaatcggcatactgacccttgccgcgatagtggccgccaacgagatgggcctcctggagaccacgaaacgggaccttggcatgtccaaggaacccggggtggtctctcccacctcctacctcgacgtggacctgcaccctgccagcgcctggaccctgtacgcggtagccacgactgtgatcacccccatgttaagacacaccatcgagaactccacggccaacgtgtctcttgccgcgatagccaatcaggccgtggtcctgatgggcctcgataaggggtggcccatttccaaaatggacctgggggtacccctgttagccctgggctgctacagccaggtgaaccccctgactctcaccgccgcggtcctcctgctggtgacccactatgctatcatcggtccgggcctccaggccaaggccacgcgggaggcccagaagcgcaccgcggccgggatcatgaaaaaccccaccgtggacggcatcatgaccatcgacctggatcccgtcatctacgactccaagttcgagaagcagctcggccaagtcatgctgctcgtgctctgtgccgtccagctgctgctcatgcggacgagctgggccctctgcgaggctctgaccctggcgactggccccatcacgacgctgtgggagggctcgccggggaagttctggaacaccaccatcgccgtgagcatggccaacatatttcgcggctcctacctggccggggccggcttagccttcagcatcatgaagtccgttgggaccggacgtcgcgggacggggagccagggcgagaccctaggggagaagtggaagaagaagctgaaccagttgagtcggaaagagttcgacctgtacaaaaagagcggtatcaccgaggtggaccgcaccgaggccaaggagggactgaagcggggcgagacaacacaccacgccgtgagccgcggctccgccaagctccagtggtttgtggagcggaatatggtcatccccgaggggcgcgtgatcgacctgggctgcgggcgcggcggatggagctactactgcgcgggactgaagaaggtaaccgaggtccgggggtacaccaagggaggaccagggcacgaggagcccgtgccgatgtccacctacggctggaacatcgtgaagttaatgagcgggaaggacgttttctacctgccgccagagaagtgcgacacgctgctgtgcgacatcggcgaaagtagcccctcccctaccgtggaggagagccggacgatacgcgtgctcaaaatggtcgagccctggctgcggaacaaccagttctgcatcaaagtgctgaatccctacatgccaaacgtgatcgagcacttagagcggctgcagcgcaagtacggcgggatgctggtccggaaccctttatcccggaacagtactcacgagatgtactggatctccaacggcacggggaacatcgtaagctccgtgaacatggtcagccggctgctgctcaataggttcaccatgacccaccggcgcccaacaatcgagaaggatgtggacctgggcgccggcacgcggcacgtcaacgccgagccagagaccccaaacatggacgtgatcggcgagcgcatcaagcggatcaaagaggagcactcctccacctggcattacgacgacgagaatccctacaagacctgggcctaccacggctcctatgaggtgaaagccacggggagcgcgagctccatgatcaacggcgttgtgaagctgctcaccaaaccctgggatgtggtccccatggtgactcaaatggcgatgaccgatacgaccccttttgggcagcagcgcgtgttcaaggagaaggtggacacccggaccccccggcccatgcccggcacgcgtaaagtgatggagattactgccgagtggctgtggcgaaccttaggccggaacaagaagcctcggctctgtacccgcgaggagttcacgaagaaagtgcggaccaacgccgccatgggagcggtcttcacggaggagaatcagtgggacagcgcccgcgccgctgtcgaggacgaagaattttggaagctggtggataaggagcgggagctgcacaagttgggaaaatgcgggagttgtgtctacaacatgatgggcaagcgcgagaagaagctaggggagttcggcaaagcgaagggttcgcgggccatctggtacatgtggctgggcgcccgctacctcgagtttgaggccctgggcttccttaacgaggaccactggttctcccgggagaattcgtactccggagttgagggcgaagggcttcacaagctgggctacatcctgagagacatcagcaagatccccggcggggcgatgtacgcggacgatacggcaggctgggacacacggatcactgaggacgacctccataacgaggagaagatcacccaacagatggatcccgagcaccgccaactagccaatgcaatcttcaagcttacttaccagaacaaagtggtcaaggtgcagcggcccacgccgaaagggaccgtgatggacatcatttcccgcaaagaccagcgggggtctggccaggtcgggacgtacggactcaacacattcaccaacatggaggcccagctggtgaggcagatggagggtgagggcgtcctgtccgaggcggacctcgagaacccccatctgctggagaagaagatcacgcagtggctcgagacaaagggggtcgaacggctgaagcgcatggccatctcgggcgacgattgcgtggtgaaacccatcgacgaccgattcgctaacgctctgctcgccttaaacgacatgggcaaggtacgcaaggacatcccgcaatggcaaccgtcaaagggatggcacgactggcagcaagtccccttctgtagccaccacttccacgagcttatcatgaaggacggcagaaagctcgtcgtcccctgccgcccccaggacgagctgatagggcgagcgcggatctcccaaggcgccggctggagccttaaggaaaccgcgtgcctcggcaaggcctacgcgcaaatgtggtccctaatgtacttccatcgccgggacctgcgcctcgcgtccaatgccatctgctccgccgtgccggtgcattggatccctaccagccggaccacatggagcatccacgcccaccaccagtggatgactacggaggacatgctgacggtctggaaccgcgtgtggatcgaagacaacccatggatggaagacaagacgcccgtgacgacttgggaggacgtcccgtatctaggtaagcgtgaggaccagtggtgcgggtccttgatcggcctcacgagccgcgctacctgggcccagaacatcctgaccgccatccagcaggtccggtccctcatcggggacgaggagttccttgattatatgccaagcatgaaacgctttcggaaggaagaggagtccgagggcgcgatctggtga

SEQ ID NO: 25752 - RNA, 9873 nt, synthetic construct
  misc_feature 1..9873: note = derived and/or modified CDS sequence (opt11) from DENV-3__GU131940__SS-prME
  source 1..9873: mol_type = other RNA
accagcctgtgcctcatgatgatgctgcccgcgaccctggcattccacctcacatcccgcgacggtgaaccgaggatgatcgtggggaaaaacgaacgcggcaagagcctgctgttcaagacagcgtcgggcatcaacatgtgcacattgatagccatggacctaggagaaatgtgcgacgacactgtcacgtataagtgcccccttatagcagaagtggaacccgaggatatcgattgctggtgcaacctcaccagcacctgggtaacctacgggacttgcaaccaggccggtgagcataggcgtgacaaacgctccgtcgccctggcgccccacgtaggtatggggctagatactcgcacccagacctggatgagcgccgagggtgcatggagacaggtggagaaggtcgagacatgggccctccgacaccccggatttaccatcttggcgctgttcctcgcacactacatcggcacctcactgacgcagaaggtggtgatcttcattctgctcatgcttgttacgccctctatgacaatgcggtgcgtaggggtgggcaatcgcgacttcgtcgagggcctgtctggcgccacctgggtggacgtggtgctcgagcatggcgggtgtgtgacaacaatggccaaaagcaagcccaccctggacatcgagctacagaaaacagaggccacccagctcgcgacactgcggaaactttgtattgagggcaagattaccaacataaccactgactcccggtgccccacgcagggcgaggccacgctcccggaggaacaggatcagaactacgtgtgcaagcacacgtatgtcgaccgcgggtggggcaacggttgcggcctcttcgggaagggcagcctggtaacgtgtgcgaagttccagtgcctggagcccatcgaggggaaagtggtccagtacgagaacctaaagtacactgtgataattactgtgcacacaggggaccagcaccaggtcggcaatgacacccaaggtgtgacggtcgagatcacaccccaggcttccacagtggaggccgtgctgcccgaatacggcaccttagggctcgagtgttccccgaggacaggcctggacttcaatgagatgatcctcctgacgatgaagaataaggcgtggatggtgcatcggcagtggttctttgacttaccgctcccctggacttccggcgcaaccacggagacgcccacctggaatcgcaaggagctgctggtaacctttaagaatgcacatgccaagaagcaggaagtggtcgtgctcggcagccaggagggcgcaatgcacaccgcgctgacgggggcaaccgagatacagaactccggtgggaccagcatcttcgccgggcacctgaagtgtcggctcaagatggacaagttggagctcaagggcatgtcttatgccatgtgcttaaataccttcgtcctcaagaaggaggtcagcgaaacccagcacgggaccatacttatcaaggtcgagtacaagggcgaggatgccccctgcaagatccctttcagcacggaggacgggcagggcaaggcgcacaatggccgccttattaccgctaatcctgtggtcacgaagaaggaggaacccgttaacatcgaggccgagcccccgtttggtgagtccaacatcgttatcggcatcggggacaaggccctcaaaatcaactggtacaagaagggcagctccattggtaagatgttcgaagcgaccgcccggggcgcccgccggatggctatcttgggcgataccgcctgggacttcgggagcgtcggcggtgtgctgaactctctcggaaaaatggtgcaccagatcttcggaagcgcgtataccgcgctgttctccggcgtaagctggatcatgaagatcggcatcggggtcctgctcacgtggatcgggttgaactcgaagaacaccagcatgtctttcagctgcatcgtgatcggcataattacactgtacctcggaaccgtcgtgcaggccgacatggggtgtgccatcaactggaagggcaaggagctgaagtgcggctccgggatcttcgtgacaaacgaggtccacacctggaccgagcagtacaagtttcaggccgacagccccaagcgcctggctacagccatcgccggcgcttgggaaaacggcgtctgcggcatccgcagtacaacccggatggagaacctcctgtggaaacagatcgcgaacgaactgaactacatcctttgggagaacaacatcaagctgaccgtggtcgtgggggatatcatcggggtgttagagcaggggaagcgcaccctcacgccccaaccgatggaattgaagtactcctggaagacctgggggaaggcgaaaatcgtcaccgccgaaacacaaaacagtagcttcatcatcgacggccccaacacgcccgaatgtccctccgccagccgggcctggaatgtgtgggaggtagaggactacgggttcggtgtttttaccactaatatctggctgaagctgcgcgaggtttacacccagtcgtgcgaccaccggctgatgtcagcggccatcaaggatgagagagccgtgcatgccgacatggggtactggattgagagccagaagaacgggtcctggaagctggagaaagccagcttcatagaggtcaagacctgcacgtggcccaagagtcataccctctggtccaacggcgtgctggaatccgacatgatcatcccgaaatcactggcgggtcccatttcccagcacaaccaccggccggggtaccacacccagacagctggcccctggcatctcggcaaactggagttagacttcaactattgtgagggcacgaccgtggtcatcacggagaactgcgggacccgcggccccagtctccggacgaccaccgtatccgggaaactcatccatgaatggtgttgtcgctcttgcacactgccacccttacggtacatgggcgaggacggttgctggtatggtatggaaatccgccctatcaatgagaaggaggagaacatggtaaagtcccttgtcagtgccggatccgggaaagtcgacaacttcactatgggcgtactctgcctcgcaatcctgtttgaagaggtaatgcggggcaaatttgggaagaagcacatgatcgccggggtgcttttcaccttcgtcctcctgcttagcggccaaattacatggcgagatatggcgcacaccctcatcatgatcgggtctaatgcctcggaccgtatggggatgggggtcacgtacctggccctgatagccacatttaaaatccagcccttcctggcccttgggttcttcttgcgcaagctaaccagtcgggagaacctgctactcggcgtcggtctggcgatggccaccacactgcagctccctgaggacatcgagcagatggccaacggcatagccctgggcctgatgacactcaaacttattacacaattcgagacctaccagctttggacagcgctcgtgtcactgacctgcagcaacacgatcttcaccttaacggttgcgtggcgcacggccactctcatcctggccggggtttccctgttaccgctgtgccagtccagttcgatgcggaagaccgactggctgcctatgacagtcgcagcgatgggcgttccgcccctcccgcttttcatcttcagcctgaaggacacccctaagcgccgctcttggcccctgaatgagggggtgatggccgtgggcctagtgagtatcctggccagctccttgctgcggaacgacgtgccgatggccggccctctggttgccgggggcctcctgatcgcgtgctacgtcataaccgggaccagcgcagacctgaccgtggaaaaggcggccgacgtcacctgggaggaggaggccgagcagaccggggtgtcccacaacctcatgattaccgtggatgatgacgggactatgcgcatcaaggatgatgagacagagaacatcctaaccgtcctgttaaagacggcgctgctaatcgtgagcggcatcttcccctactcgatccccgctaccctgctggtttggcatacgtggcagaagcaaacgcagcggagtggagtcctgtgggacgtaccctctccgcccgagacccagaaggccgagttggaggagggtgtttaccgtatcaagcagcaagggatcttcgggaagactcaagttggcgttggggtgcagaaggagggtgtgttccacaccatgtggcacgtaacccgtggcgccgtgctgacccacaacggtaagcgactggagcccaactgggcctctgtcaagaaggacctgatatcctacggagggggctggcggctgaacgcacaatggcagaaaggggaggaggtacaggtgatcgccgtggagcccggaaagaatcccaagaactttcaaacgatgccaggaatatttcagacgaccaccggggaaatcggcgccatcgccctagacttcaagcccgggaccagcggcagcccgatcatcaaccgggagggcaaggttgtggggctctacggtaacggcgtggtgacgaagaacggcggttatgtgagcggcatcgcccagaccaacgccgagccagatgggcccaccccggagcttgaagaggaaatgtttaagaagcggaatctgacaatcatggatcttcacccggggagcggaaagacgcgcaagtacttacccgcgatcgtccgagaggcgatcaagcgccggctgcgtactctgatcctcgcccccacccgggtggtggccgccgaaatggaggaggccctgaaggggttacccatccgctaccaaacaacggcgaccaaatccgagcacaccggtcgggagatcgtcgacctcatgtgccatgccactttcacaatgagactcttgagcccggtgcgggttcccaactacaacctcgttattatggacgaagcgcatttcaccgaccccgcctcaatcgctgcaagggggtacatcagcacccgcgtgggcatgggcgaggccgcggccatattcatgaccgccacgccccctgggaccgccgaggcattcccccagtcgaacgcccccatccaagacgaggagcgcgacatccccgagcggagctggaactccggcaacgaatggatcaccgacttcgtgggaaagaccgtatggttcgtgccgagcatcaaggcaggcaacgacatcgcaaactgcctaaggaagaatgggaaaaaggtgattcagctgtcccgcaagacttttgacaccgagtatcagaagacccggcttaacgactgggacttcgtcgtcaccacggacatcagcgaaatgggcgcgaactttaaagcggaccgcgtaatcgaccccaggcgctgcctaaagccagtcattctaacagacggccccgagcgggtgatcctcgccgggccgatgccagtgactgccgccagcgccgcgcagagacgggggcgcgtcgggcggaacccccagaaagagaacgatcagtacatattcaccggacagccattaaacaacgacgaggaccacgcgcattggaccgaggccaagatgctgttggacaacatcaacactcctgagggtatcatccccgccctgttcgaacccgagcgagaaaagagcgccgcgatcgacggcgagtacaggctgaagggtgagtcgcgcaagacatttgtagagctaatgagacgcggggacctgcccgtctggctggcctataaggtggcgagcgagggtatcaaatataccgatcggaagtggtgcttcgacggtgagcgcaacaaccagatactcgaggagaacatggacgtggagatctggaccaaggagggcgagcgaaagaagctgcgcccacgctggctagatgcacggacgtactccgaccccctcgcgttaaaggagtttaaggactttgccgctggccgcaagagcattgcactggacctcgtcaccgagatcgggcgggtccccagtcacctggcccaccgtacccggaacgcgttagacaacctcgtgatgctgcacacgagcgagcacggcggacgcgcctaccgtcacgccgtggaggagctgccggaaaccatggagaccctcctgctgctcggcctgatgatcctcctcaccgggggcgccatgttgttcctcatctctggcaaggggattggaaaaacctctatcgggctcatctgcgtgatcgtcagctccggcatgctttggatggccgacgtccccctgcaatggatagctagcgccatagtcttagagttcttcatgatggtgttactaatcccggaacccgagaaacagcgcacaccgcaagacaaccagctcgcctacgtcgtgatagggatcctaactctggctgccatcgtggcggccaacgagatggggctcctggagactaccaagcgagacttaggcatgagcaaggagcccggggtcgtgtcccccacatcctacctggatgtggacctgcatcccgcctccgcctggaccctgtacgccgtagcgaccaccgtgatcacgccgatgctacggcatactatagagaactccaccgccaacgtgagcctggccgccatagcgaaccaagccgtcgtgctgatgggcctcgataaagggtggcccatcagcaagatggacttgggcgtgcccttgctagccctcgggtgctactcgcaagtcaaccccctcaccttgaccgcagccgtccttcttctcgtgacccactatgcgatcatcggcccgggcctgcaggccaaggcgacccgggaggcccagaagcgcacagccgcggggataatgaagaatcccacggtcgatggcattatgaccatcgaccttgatcccgtcatctacgactccaagttcgaaaagcaattagggcaagttatgctgctggtgctctgcgcagtgcagctattgctgatgcggacgtcctgggccttgtgcgaggccctgaccctagccacgggccctatcaccaccctctgggaaggttccccggggaagttttggaacaccacgatagcagtaagcatggcaaacattttccgcggctcgtacctggcaggagccggcctcgccttttccataatgaagtccgtggggaccggccggcgcggtactgggtcccagggcgagaccctgggggagaaatggaagaagaagctgaatcaactcagccggaaggagttcgacctttacaagaagtctgggataaccgaggtagaccgcacggaggccaaggaggggctgaagcggggcgagaccactcatcatgctgtgagccgcggatccgccaaactgcagtggttcgtcgagcggaacatggttatccccgaggggcgggtcatcgacctgggctgtgggcgcgggggctggagctactactgcgcaggattaaagaaggtcacggaggtgcggggctacaccaaagggggccccggacacgaggagccagtgccgatgtccacctatggatggaacatcgtcaaacttatgagcgggaaggacgtattctatctgccacccgaaaagtgcgatacactgctgtgcgacatcggcgaatcaagcccctctccgaccgtcgaggagagccgcacaatccgggtcctcaagatggttgaaccctggcttcgcaacaatcagttctgcatcaaggtgctaaacccgtatatgcccactgtcatagagcatctagaacggctgcaacggaaatacggcgggatgctggtgcgaaacccgctctcccgaaacagtacccatgagatgtactggatcagtaacggcacaggaaatattgtaagctccgtcaacatggtgagccggctgctgctgaaccgcttcacgatgactcacaggaggcccaccatcgagaaggacgtcgatctgggtgccgggacccggcacgttaacgccgagcccgagacgccgaacatggacgtgataggagagcgcatcaagcggatcaaggaggaacactcctccacctggcactatgacgacgagaacccatacaaaacatgggcctaccacggctcatacgaggtcaaggccactggcagcgccagctccatgataaacggtgtggtgaaactgctgactaaaccctgggacgtggtgccaatggtcacccagatggcgatgaccgacaccaccccgttcggacagcagcgcgttttcaaggagaaagtggatacccggacccccaggcccatgccgggcacccgaaaggtgatggagatcacggccgagtggctatggagaaccctgggccgcaacaagaagccgcggctctgcacccgcgaggagttcaccaagaaggtccgcacgaacgccgccatgggagccgtgttcaccgaggagaaccagtgggacagcgcgagggcagccgtagaggacgaggagttttggaagctagttgaccgagagcgcgaactccataagctcggcaaatgcgggagttgcgtgtacaacatgatgggcaagagagagaagaaactgggtgagttcggcaaggccaagggctcgcgcgcgatctggtacatgtggctgggcgcccggtacctcgagtttgaggcacttgggttcctgaacgaggaccattggttctcccgcgagaactcctattccggggtggagggcgagggcctccacaaactgggctatatactgcgggatatctcaaagatccctggcggggctatgtacgccgacgatacagctggctgggacactcgcatcacggaggacgacctccacaacgaggagaaaataacccagcagatggatcccgaacaccggcaactggcgaacgccatcttcaagctgacctaccagaacaaggtcgtgaaagttcagcgccccaccccgaaggggaccgtcatggatatcatctcccgcaaggaccagcggggcagcggccaagttgggacgtatggcttaaataccttcaccaatatggaggctcaactggtgcgtcagatggagggtgagggcgtcctgtccaaggccgacctcgaaaacccccatctgctcgagaagaagatcacgcagtggttagagaccaaaggggttgaacgcctgaagcggatggcgatcagcggcgacgactgtgtagtcaagcccatcgacgaccgctttgccaatgccctactcgccctgaacgacatgggcaaagttcggaaggacatcccccaatggcagccgtccaaggggtggcatgactggcaacaggtgcccttttgctcgcaccacttccacgagcttataatgaaggacggccgcaagctcgtcgtgccgtgtcgcccccaggacgagcttatcggcagggctcgcatctcccagggcgctgggtggagcctcaaagagacggcctgcctcggcaaggcctacgcgcagatgtggtccttaatgtacttccaccggcgagatttacggctcgcaagcaacgccatctgtagtgcagtgccggtccactggattccgaccagcaggaccacttggagcattcacgcccaccaccagtggatgaccaccgaggacatgctaactgtgtggaaccgggtttggatcgaggacaacccctggatggaggacaagacgcccgtcaccacctgggaggacgtgccgtacctgggcaagcgtgaggaccaatggtgcgggtccctaatcggcctgaccagccgcgccacctgggcgcagaacatcttaaccgccatccagcaagtgcgcagcttgatcggggacgaggagttcctggactacatgcccagcatgaaacggttcaggaaggaggaagagtcggagggcgccatctggtaa

SEQ ID NO: 25753 - RNA, 9873 nt, synthetic construct
  misc_feature 1..9873: note = derived and/or modified CDS sequence (opt11) from DENV-3__GU131942__SS-prME
  source 1..9873: mol_type = other RNA
accagcctgtgcctcatgatgatgttccccgcgaccctggcgttccacctgacgtcacgcgacggggagccacggatgatagtggggaagaatgagcggggtaagagcctcctgttcaagaccgcttccgggatcaacatgtgcacgctgattgcaatggacctcggagaaatgtgcgacgacaccgtgacgtacaagtgcccattaatagccgaggtggagcccgaagacattgactgttggtgcaatctcacgagcacatgggtgacctacgggacgtgcaaccaggcgggcgagcaccggcgcgacaagaggtccgtcgccctcgcgccccacgtgggtatggggctggacacccgcacccagacctggatgtcggccgaaggcgcctggagacaggtggagaaggtcgagacgtgggctctgcgccaccccgggttcacgatcctcgcgctgttcctggcccactacatcggcacctccctcacccagaaggtggtaatcttcatcctgctgatgctcgtgacgcctagcatgacgatgcggtgcgtgggtgtagggaaccgcgacttcgtcgaggggttgtccggagccacttgggtggacgtggtcctggagcacggcggatgcgtgactactatggcgaagtcaaagccaaccttagacatcgagctgcagaagactgaggccacccagctggccacgctccggaagctctgcatcgagggcaaaatcaccaacataacgacggactccaggtgcccgactcagggcgaggctactctgccagaggagcaggaccagaactacgtctgcaagcacacctatgtcgaccggggatggggaaacgggtgcggcctattcggaaaggggagcttagtgacctgcgccaaattccagtgcctagagcctatcgagggcaaggtcgtacagtacgaaaacctcaagtacacggtgatcatcaccgtgcacaccggggaccagcatcaggtcggcaatgacacccagggggtgacggtagagattacgccccaggcctccaccgtagaggctgtcctgcccgagtacgggaccctggggcttgagtgcagcccacgcacgggactggactttaacgagatgattctccttacaatgaagaacaaggcttggatggtccaccggcaatggttcttcgacctgccactaccgtggaccagtggcgccactaccgaaacgcccacctggaaccgaaaagagctcctggtgaccttcaaaaacgcccatgcaaagaagcaggaggtggttgtgctcgggtcgcaagagggcgcaatgcacacagcgctcacaggagctaccgagattcagaactcgggcggcaccagcatcttcgccggccacctaaagtgccggttgaagatggacaagctggaactgaaaggcatgtcttacgccatgtgcctgaacaccttcgtgctcaagaaggaggtcagcgagacgcagcacgggaccatcctgataaaagtagagtacaaaggcgaggatgccccgtgcaagatccctttcagcaccgaggatgggcagggtaaggcgcacagtggccgcttaatcaccgccaaccccgtggtcacaaagaaggaggaacccgtgaatatcgaggccgagccgcccttcggggagagcaacattgtaatcggcatcggtgataaggccctgaagatcaattggtacaaaaagggttccagcatcgggaagatgttcgaggcgaccgcacggggcgcccgccggatggcaatcctcggcgacaccgcctgggacttcgggtctgtgggcggggtgctgaacagcctgggaaagatggttcatcaaattttcgggtcagcctacaccgcactcttctcaggcgtctcctgggtgatgaagatcggtatcggggtgctgctgacgtggatcgggctcaacagcaagaacacctccatgagcttctcatgcatcgtcattggaattataaccttatatctgggcgcggtggtgcaggccgacatggggtgcgtcatcaactggaaaggtaaggagctcaaatgcggcagcgggattttcgtgactaacgaggtgcacacgtggacggaacagtacaagtttcaggccgactcccccaagcgcctggcaaccgcgatcgctggggcgtgggagaatggggtgtgtggcatccgcagcaccacgcggatggagaatctgctatggaagcaaatcgccaacgagctcaattacattctgtgggagaacaacatcaagctcaccgtggttgtcggtgatataatcggcgtgctggagcagggaaagcgcaccctgacaccccaaccgatggaactcaagtactcctggaagacgtggggtaaggcgaagatcgtcactgccgaaactcagaatagctccttcatcatcgacggtccaaacacacctgagtgccctagcgcatcacgcgcatggaacgtctgggaggtggaggactacgggttcggcgtgttcacaaccaatatatggctcaaacttcgcgaggtctacacccagtcctgcgatcaccggctgatgagcgcggctataaaggatgaacgcgccgtgcatgcagacatgggctactggatcgagtcccagaaaaatgggagctggaagctggagaaagcctctttcatcgaggttaagacatgcacctggccgaagtctcacacgctatggtccaacggcgtgctcgaaagtgatatgattatccctaagtctctggcggggcctatcagccaacataaccaccggccgggctaccacacccagaccgccggtccctggcacctgggcaagctcgagctggacttcaattactgcgaaggcaccacggttgtgatcactgagaactgcgggacccgcgggccctccctccggacgacgaccgtgtccgggaaactcatacatgagtggtgctgccgatcctgcaccctgcccccgttgcggtacatgggagaggacgggtgttggtacggcatggagatcaggcccatcaacgaaaaggaggagaacatggtaaagagcctcgtgagtgccggtagcgggaaagtagacaacttcaccatgggcgttctgtgcctagctatcctcttcgaggaggtcatgcgggggaagttcggaaagaagcacatgatcgcgggagtcctcttcacgttcgtgctgctcttgtccggccagatcacttggcgcgatatggcgcacacgctgatcatgattggctcaaacgcctccgatcggatgggcatgggcgtgacctatctggccctgatagccacgtttaagattcagccctttctggcactcgggttcttcctaaggaagctgacatcccgcgagaacctcctgcttggggtggggctcgcgatggcaactacgttgcagctgcccgaagatattgagcagatggccaacggtatcgcactcgggcttatgacgctgaagttaatcacacagttcgagacctaccagctgtggaccgcgctagtgagcctaacctgctccaacaccgtattcaccctaaccgtggcttggcgaaccgccaccctgatcctggcaggggtgagcttactgccgctctgccagagcagctccatgcggaagacggattggttacccatgaccgtcgccgcgatgggcgtgccacctctaccgctctttattttcagcttgaaggacacgcccaagcgccgctcctggcccctgaacgagggggtgatggccgtcggactcgttagcatcttggcttcgagcctgctgcggaacgatgtgcccatggcaggcccgctggttgccgggggcttgctcattgcttgctacgttatcaccgggacctcagcagacctcaccgttgaaaaagcagccgacgttacgtgggaggaggaggccgagcagaccggcgtttcgcacaacttgatgatcactgtggatgacgacgggacaatgcggataaaggacgacgagaccgagaacattcttacggttctgctgaagactgcgctcttgattgtttccgggatcttcccctatagcattccagcaaccttgctcgtttggcacacgtggcagaaacagacgcagcggtccggcgtcctgtgggacgtgccttcgccgcccgaaacccagaaggccgaactggaggagggagtgtaccgcatcaagcagcagggaatcttcgggaagactcaggtcggtgtgggggtacagaaggagggcgtattccacaccatgtggcacgtgacgagaggcgccgtgctcacacataacgggaagcgtctggagcccaactgggcctccgtcaagaaggatcttatcagctacggcggagggtggcggctcaacgcgcagtggcagaagggggaagaggtgcaggttatagccgttgaacctggcaagaatccgaagaacttccagaccatgcccggtatcttccagacgacaacgggggagataggcgccatcgcactggacttcaagcccgggaccagcgggtccccgataatcaaccgtgagggcaaggtggtggggttgtatggcaacggcgttgtgaccaagaacggtggttatgtgagcggcatcgcgcagacgaacgccgaaccagatggccccaccccagagctggaggaggagatgttcaaaaagaggaacttgaccatcatggacttacacccggggtccggcaagacccgcaagtacctaccagcaatcgtccgagaggcgataaagagacggctccgcacgctgatcctggcccccacccgagttgtagcggctgagatggaggaggccctaaaggggctacccataaggtaccagaccacagccacgaagtcggagcacaccggccgggagatcgtcgacctgatgtgtcatgctaccttcaccatgcgcctgctgagtccagtgcgggtgcccaattacaacctggtgatcatggacgaggcgcacttcaccgatcctgccagtatcgccgcccgcggttacatctccacccgggttggcatgggtgaggccgcagctatcttcatgaccgccacacccccagggactgcggaggcgttcccacaatctaatgcccccattcaggacgaggagcgcgacatccccgaacgctcgtggaacagcggcaacgaatggatcaccgacttcgtgggcaaaaccgtctggttcgtcccgtcgatcaaggccggaaacgacattgcaaactgcctccggaaaaacggtaagaaggtgatccagctgtcgcgaaagaccttcgacacggagtaccagaagacgcgtttgaacgactgggactttgtcgtgaccaccgacatctccgagatgggggcgaacttcaaagcggatagagtgatcgacccccgtcgctgcctgaaacccgtcatcttgacggatggccccgagcgggtgatcctggccgggccgatgcccgtcacagccgccagcgccgcgcagcgccgtggccgcgtggggcggaatccccaaaaagagaacgaccagtatatcttcactggccagcccctcaataacgacgaggaccacgcacactggaccgaggctaagatgctgctggacaacatcaacacgccggagggcatcattcccgcattattcgagcctgagcgcgagaagagtgccgcgattgacggcgagtaccggctgaaaggcgaaagccgcaagacgttcgtggagcttatgcggcgcggggatttgcccgtctggttggcccataaggtagcctccgagggcatcaagtataccgaccggaaatggtgctttgacggcgaaagaaataaccagatcttggaggaaaacatggacgttgagatctggaccaaggagggcgagcggaagaagctacgccccaggtggctggacgcccggacctacagtgatccgctagctttaaaggagttcaaggattttgccgccggacgcaagtccattgccctagaccttgtcacagagattgggagggtgcccagccatctcgcccaccgcacccggaacgcgctggacaacctggtgatgctccacaccagcgagcacggcggccgcgcctaccggcatgcggtcgaggagctgccagagacgatggagacgctgcttctgctgggcttgatgattttgttaacagggggagccatgctctttctcatttccggcaagggtatcggcaagaccagcatcgggctcatctgcgtgatcgtgagctccggcatgctctggatggccgatgtccccctccagtggatcgcttcggccatcgtgctcgagtttttcatgatggttctccttatcccagagccagagaagcagcgcactcctcaggacaatcagctggcctatgtggtgatcggcattctcacgctggccgccatagtggcggctaacgagatgggccttctcgagacaaccaagcgggacctgggaatgagcaaggagcccggagtcgtttcccctaccagctaccttgacgtggacctccatcccgcctccgcctggacgctgtacgccgtcgcgaccactgtgatcaccccgatgcttcgccatacgatcgagaactcgacggcaaatgtatccctcgccgcaatagcgaaccaggccgtagtactgatgggcctggataaagggtggcccattagcaaaatggaccttggagtacctctgctggccctcgggtgctacagccaggtcaaccccctgaccctaaccgccgcggtgctgcttctggtaacgcactacgccatcatcggcccgggactacaagccaaggccacccgggaggcacagaagaggacggcagcggggatcatgaagaaccccaccgtcgatggcattatgacgatagatctggatcccgtgatctacgactcaaagttcgagaaacaactagggcaagtgatgcttctagtgttatgcgccgtgcaattgcttctgatgcggacgtcctgggccctgtgtgaggcattgaccttggccacgggcccgatcacgaccctctgggagggttctccgggaaagttctggaacaccaccatcgcggtgtccatggccaacattttccgcggctcctacctggccggagcgggcctagcgttctccatcatgaagtcagtaggcgcgggccgtcgcggcacgggcagccagggcgagaccctcggggagaagtggaagaagaagctgaaccagctaagtaggaaggagttcgacttatataagaaaagcggcatcaccgaggtggaccgtaccgaggccaaggaagggctgaaacggggagagaccacacatcacgcagtgtcccgaggaagtgccaagctgcaatggttcgtagagaggaacatggtgattcccgaggggagagttatcgacttggggtgcggacggggcgggtggtcctactactgcgcggggctgaagaaggtcaccgaagtgcggggctacaccaaaggcggaccagggcatgaggagcccgtcccgatgtcaacctacggctggaacatcgtcaagctaatgtccgggaaggacgtattctacctgcccccagagaagtgcgacaccttattatgcgatatcggcgagagctccccctcgcccaccgtggaggagtcccgcactatcagggtcctgaagatggtcgagccctggctaaggaacaaccaattctgcatcaaagtgctgaatccgtatatgcccacagtcatagagcacctggagcggctccagcggaagtacggcgggatgctggtccggaatcctctgagccgaaacagtacccacgagatgtattggatcagcaacggcaccgggaacatcgtctcgagcgtcaacatggtctcccggctcttgctgaacaggttcactatgacccaccggaggcccactatagaaaaggacgtcgacctaggggctggcacccggcacgtgaacgccgagcccgaaactccgaacatggacgtaattggtgagcggatcaagcggataaaggaggagcatagctccacgtggcattacgatgacgagaacccctacaagacttgggcctaccatggcagctacgaggtcaaagcaaccgggagcgcgtcctcgatgatcaacggcgtggttaagctgctgaccaagccctgggacgtcgtgcccatggtgacccagatggctatgacggacactacgccgttcgggcagcaacgcgtcttcaaagaaaaagtggacacacggacgccccgacccatgcccggcacccgtaaggttatggagatcacagccgagtggctctggcgcacgctggggcggaacaagaagccgagattatgtacgcgcgaagagtttaccaagaaggtccggactaatgcagccatgggggctgtcttcaccgaagagaaccagtgggacagcgcccgcgccgccgttgaggacgaggagttctggaagctggtcgatcgggagcgtgagctacataaacttggaaagtgcgggtcgtgcgtctacaacatgatgggcaaacgggagaagaagctcggggagttcggcaaagcgaagggctcgcgagccatctggtacatgtggctcggggcacggtatctggagttcgaagcccttggcttcctgaacgaggaccactggttctctcgcgagaacagttactcgggggtggagggggagggactccacaaactcggttacatactgcgggacatctccaaaatccccggcggggcaatgtacgcggacgacacggccggctgggacacccggatcaccgaggatgacctgcacaacgaggagaagattacccagcagatggatcctgagcacagacagctcgcaaacgccatcttcaaactgacataccagaataaagtcgtaaaggtgcagcgccctacccccaaagggaccgtaatggacatcatcagtagaaaggatcagcgcggctctgggcaagtgggaacgtacggcctgaacaccttcacgaacatggaggcacagttagtgcgtcagatggagggggagggcgtcctgagcaaagcagaccttgagaaccctcacttgctggagaaaaagattacacagtggctggagaccaaaggcgtcgagcgactcaaacggatggccatctccggcgacgattgcgtggtcaagcccatcgacgaccgcttcgccaatgctctgctggccctcaacgacatgggtaaggtgaggaaggacattccccagtggcagccaagcaaggggtggcatgactggcaacaggtgcccttttgctcccatcacttccacgaactgattatgaaagacggcagaaaacttgtcgtgccctgccgcccgcaggatgagttaatcgggcgggcacgcatcagccagggcgccggctggagcctgaaggagacggcctgcctggggaaggcctacgcccagatgtggagtctcatgtatttccaccgtcgagacctgcggctagcgtccaacgccatctgtagcgccgtgcccgtccactggatccccactagcaggacgacctggtctatccacgcccatcaccaatggatgaccacggaagacatgctgacagtgtggaaccgggtgtggatcgaagacaacccctggatggaggacaagaccccggtcactacgtgggaagacgtgccgtacctaggcaagcgcgaagaccagtggtgtgggagcctgatcggcttaacctccagagcgacctgggcgcagaacattctgaccgccatacagcaggtccgcagcctgatcggggacgaggagtttctagactacatgccctccatgaagcggtttcgcaaggaggaggagtctgagggcgccatttggtag

SEQ ID NO: 25754 - RNA, 9873 nt, synthetic construct
  misc_feature 1..9873: note = derived and/or modified CDS sequence (opt11) from DENV-3__GU131943__SS-prME
  source 1..9873: mol_type = other RNA
accagcctgtgcctcatgatgatgctgcccgcaacgctggccttccacttgaccagccgcgacggggagccgcggatgatcgtggggaagaacgagcgcggcaagagcctgctgttcaagacggcgtcagggatcaacatgtgcaccttgattgctatggatttaggggagatgtgcgacgacaccgtgacgtacaagtgccccctgatcgccgaggtagagccggaggacatagactgctggtgtaacctcaccagcacctgggtgacctacgggacctgcaatcaggccggcgagcaccggcgcgacaagcggtccgtggcactggcaccccatgttggcatggggctggacaccaggacccagacctggatgagtgcggaaggcgcctggcgacaggtggagaaagtggagacctgggccctccgccacccgggcttcactattctggctttattcctcgcccattacattggcacctccctcacccagaaggtggtgatctttatcctgctgatgctggtcacgccctcgatgaccatgaggtgcgtgggggtcggcaaccgcgacttcgtcgagggcctttccggagccacctgggttgacgtggtcctcgagcacggagggtgcgtgacgacgatggccaagagcaagcccacactggacatcgaattgcagaagaccgaggctacccagctcgcgacgctgcggaaactgtgcatcgaaggcaagatcaccaacataaccacggactcccgatgccccacgcagggcgaggccaccctgccggaggagcaggaccagaactatgtctgcaagcacacctacgtcgaccgggggtggggcaacgggtgcggcttattcgggaagggcagtctcgtgacctgcgccaagtttcaatgtttagaaccgatcgagggcaaggtagtccagtacgaaaacttgaagtacactgtgatcatcaccgtgcacaccggagaccagcaccaggtcggcaacgatacccagggggtgacggttgagattacgccccaggcctccaccgtggaggccgtgctgcccgagtacggcaccctcgggctggagtgtagcccacgcacgggccttgactttaacgaaatgatcttactgacgatgaagaacaaggcgtggatggtccaccggcagtggttcttcgatctgcccctcccctggacaagtggcgccaccaccgagacgccaatctggaaccggaaggaacttctggtgacattcaagaatgcccacgcgaagaagcaagaggtggtcgtgctcgggtcccaggagggcgccatgcacaccgcgctcaccggggccactgagatccagaactccggcgggactagcatcttcgcaggccacctgaaatgccggcttaagatggacaagttggagctgaagggcatgtcctacgccatgtgcctcaacacgtttgtactgaagaaggaggtcagcgaaacccaacacgggacgatcctgattaaggtggagtacaagggcgaggacgcgccttgtaagattcccttctcaaccgaggacgggcagggcaaggcgcacaacggacgcctaatcaccgccaaccccgtggtcaccaagaaagaggagcccgtgaatatcgaggccgagccgcccttcggggaatccaacatcgtgatcggcatcggggacaaggctctcaagataaattggtacaagaagggcagctccatcgggaagatgttcgaggccacggcccggggcgcccgccgtatggccatcctgggcgacacggcctgggacttcgggagcgtaggcggggtcctgaactccctcggcaagatggttcaccagatattcgggagtgcctacaccgccctgttttccggcgtcagctggatcatgaagatcggcataggggtattactcacctggataggcctgaactccaagaacacgagcatgtccttcagctgcatcgtgatcgggatcatcaccctatacctcggcgccgtcgttcaagccgatatggggtgcgccatcaattggaagggcaaggagctgaagtgcggctccgggatctttgtgaccaacgaggtccatacctggacagagcaatataagttccaagcggacagccccaagagactggccacagcgattgccggagcctgggagaatggggtgtgtggcattcgttccactacacggatggaaaacctcctatggaagcagatcgctaacgaactgaactacatcctctgggagaacaacatcaagctcacggtggtcgtgggggacattatcggcgtgttagaacagggcaagcggaccctcacgccccagccaatggagttaaagtacagctggaagacctgggggaaggccaagatcgtcacggccgagacccagaactcctctttcatcatcgatggccccaacacccccgagtgcccctcagcctctagggcgtggaacgtgtgggaggtagaggactacggatttggcgtcttcacgacgaatatctggttaaaacttcgcgaggtgtacacccagagctgtgaccatcgtttgatgtccgccgccataaaggatgagcgcgccgtgcacgccgacatgggctactggatcgagtcgcagaagaacgggtcctggaagctggagaaggccagcttcatcgaggtgaagacctgcacctggccgaagtcccacaccctctggagcaatggcgtgctggaaagtgacatgatcatcccaaagagcctggccgggccgatttcacagcacaatcaccggccgggctaccacacgcagaccgccggtccctggcacctcggcaaactggaactggactttaactactgcgaggggaccaccgtggtcattacagaaaactgcgggacacgtggcccctcactccgtaccaccacggtgtctgggaagctgatacacgagtggtgctgccgctcatgcaccttacccccgctccggtacatgggcgaggacgggtgctggtatggcatggagatccgcccgataaacgagaaggaggaaaacatggtaaaatcgctggtctctgccggctccggaaaggtggacaacttcaccatgggcgtgctgtgcctagccatcctgttcgaggaggtcatgcgggggaagttcggcaagaagcacatgatcgcgggggtactcttcaccttcgtcctcctgctgagcggccagatcacgtggcgcgacatggcacataccctcatcatgataggatccaacgcgagcgaccggatggggatgggcgtaacctacctagccctgatcgccaccttcaagatccagccttttctggcactggggttcttcctgcgcaagctcacgagccgggagaacctgctgctcggtgtgggtctggcgatggcaaccaccctgcagctccccgaggatatcgagcagatggcgaacgggatcgccctggggctgatgaccctcaagctgatcacgcagttcgagacctaccagctgtgggccgccctcgtatctctgacctgcagcaacaccatcttcacgctcaccgtggcctggaggaccgcgacactcatcctggccggggtttccctgctccctctgtgccagagtagctcaatgcggaagacggactggctgcccatgaccgtagccgccatgggcgtgcctcccctgccgctgttcatcttctctctgaaggacactcccaaacgccggagctggcccttaaatgagggggtgatggccgtcggcctggtgagtatcctggccagctccctcctgcggaacgatgtgcccatggcggggccgctagttgccgggggacttctgatcgcctgctacgtaatcacggggacgagcgccgatctgactgtggagaaagccgcggacgtaacgtgggaggaggaggcggagcagaccggcgtgtcgcacaatttgatgatcacggttgacgacgatgggacgatgcgtataaaggacgacgagaccgagaatatcctgaccgtcctgctcaaaacggccctactgatcgtcagcggcatcttcccctactccatccccgcaacgttgttagtgtggcacacctggcagaagcagacccagcggagcggtgtcctgtgggacgtgccctcaccgcccgaaacccaaaaggccgaactcgaggaaggggtgtaccgcatcaaacaacagggcatcttcgggaagacgcaagtcggcgtgggggtacagaaggagggtgtcttccacacaatgtggcacgtgacgcggggcgctgtgctgacccataacgggaagcgcttagagcccaactgggccagcgtcaagaaggacctcattagttacggcgggggctggcggctgaacgcacagtggcagaagggagaggaggtacaggtgatcgcagtcgagcccggcaagaatccgaaaaactttcagacgatgccgggcatcttccagaccacaaccggggaaatcggagcgatcgccctggacttcaagcccgggacgtccggcagcccgatcatcaaccgcgagggtaaggtggtggggctgtacggcaacggggtggttaccaagaacggcggatacgtgtccggcattgctcagaccaacgccgagcccgacggcccaactccagagctcgaggaagagatgttcaagaagaggaatctgactatcatggacctgcatcccgggagcggcaaaacccgcaagtatctccccgccatcgtccgggaggcaatcaagcgacggctgcgcacgctaatcctcgcccccacccgggtggtcgccgcggagatggaagaggccctaaaagggcttccaatccgctaccagacgaccgcgaccaagagcgagcataccggccgggaaatcgtcgacctcatgtgccacgcgactttcacaatgcgcctgctgagcccggtgcgggtgcctaactacaacctcgtcatcatggacgaggcccacttcacggaccccgcctccatagctgcgcgcgggtatatcagcaccagggtgggtatgggcgaggccgccgccatcttcatgaccgcgacgccgcccgggaccgccgaggctttcccccagtccaacgcccccatccaagatgaggagcgcgatatccccgagcggagctggaactccggcaacgagtggatcaccgacttcgttggcaagacggtctggttcgtgcccagcatcaaggccggcaatgatatagcaaactgcctgcggaagaacgggaagaaggtgatccagctgtcccgcaaaaccttcgacaccgagtaccagaagacccggcttaacgactgggacttcgtcgtgacaaccgacatatcggagatgggcgccaacttcaaggcagaccgggttatcgaccctcggcgctgcttgaagcccgtcatcctgacggacggccccgagcgagtgattctcgccgggccgatgcccgtgaccgccgcctccgcagcacagcgccggggccgcgtcggccggaacccccagaaggagaacgaccagtacatcttcacgggccagcccctgaacaacgacgaggatcatgcccactggaccgaggccaagatgctgctcgacaacatcaacaccccggagggcataatccccgcgctgttcgagccggaacgcgagaagtccgcggccatcgacggggagtatcggctgaaaggggagtccagaaaaaccttcgttgaactcatgaggcgcggtgacctacccgtctggttagctcataaggtggcgagcgaaggcattaagtatacagaccggaagtggtgcttcgacggggagcgtaacaaccagatcctcgaggagaatatggacgtggagatctggacgaaggaaggcgagcggaagaagctgagaccgcgctggctggacgcccggacctactcagacccactcgccttgaaggagttcaaggacttcgcagccggccgcaaaagcattgcgttagacctcgtcacggagatcgggagggtgccctcccacctggcccaccgcactcggaacgccctggacaacctcgtgatgctccacacgtctgagcacggcgggcgcgcatatagacatgccgtcgaggagctgccggagaccatggagaccctcctgttactcgggctgatgatcctgctgaccgggggtgcgatgctgttcctgatcagcggcaaagggatcggtaagacgtcgatcgggctcatctgcgtaatcgtgagctccggcatgctgtggatggccgacgtcccgctgcagtggatcgccagcgcaatcgttttagagttcttcatgatggtgctgctgattccggagccagagaagcagcgcaccccgcaggacaaccagctcgcctatgtagtgatcgggatcctgaccctggcggcaatcgtggccgcaaacgagatgggcctcctggaaacgacgaaacgggacctggggatgtccaaagagcccggcgtcgtgagccccaccagttacctcgacgtggacctgcacccagcttcggcgtggaccctgtacgcagtcgccaccacagtgatcaccccgatgctccgccacactatcgagaacagtacggccaacgtgagcctggcggccatcgccaatcaggcagtcgtgctgatgggcctcgacaagggttggcccatctctaagatggacctgggcgtgcccttacttgccctggggtgctacagtcaggtcaaccctctgacgctcaccgcagccgtgctgctgcttgtaacccactatgccatcatcgggccgggcctgcaggcgaaggcgactagggaggcccaaaagcgcacggcagcggggataatgaagaaccccaccgtcgacggcatcatgaccatcgacctggaccccgtgatctacgactccaagttcgagaagcagctcggccaggtgatgctgctggtcctctgcgccgtgcagcttttgctgatgagaacgtcttgggccctttgcgaggcgcttactctcgccaccggtcccatcaccaccctgtgggagggttccccggggaagttttggaacaccaccatcgccgtaagcatggccaacatcttccgaggttcctacctcgcgggggccggactcgcctttagcattatgaagtccgtcggaacagggagacgcggtaccgggagccagggcgagacgctgggggagaagtggaagaagaaactgaaccagcttagccggaaggagtttgacctgtacaagaagtccggcatcaccgaagtggaccgcaccgaggccaaggaagggctgaagagaggggaaaccacccaccacgccgtgagccgcggctccgcgaagctccagtggttcgtcgagcggaacatggtgatccccgaagggcgcgtgatagacctgggctgcgggcgaggaggctggagctactattgtgccggactgaagaaggtcacggaagtgcggggctacaccaagggcggacccggtcacgaggagcccgtgccgatgtccacctacggctggaacatcgtaaagctcatgtctgggaaggacgtgttctacctaccacccgagaagtgcgacacactgctgtgcgacattggcgagtccagcccctcccccacggtggaggaatcacgcacgattcgggtcttaaagatggtggaaccgtggctacgcaacaaccaattttgcatcaaggtcctgaacccctacatgcccaccgtcatagagcatctcgagcggctgcagcgcaagtacggcgggatgctggtgagaaatccgctctcccgcaatagcacccacgagatgtattggatctccaatggtacggggaacatcgtgagctcagtcaacatggtgagccggctcctcttgaaccgcttcacaatgacccaccggcgccccaccatcgagaaggacgtcgacctgggcgccggcacgcggcacgtgaacgccgaacccgagacaccgaacatggacgtcatcggggagcgaatcaagcggatcaaggaggagcactccagcacctggcactacgacgacgagaacccctacaagacctgggcctaccacggctcctacgaagtcaaggcgacggggagcgcatcatccatgatcaacggcgtggtgaagctgctcaccaagccctgggacgtcgtgcccatggtgacccagatggccatgaccgacacgaccccgttcgggcagcagcgagtgtttaaggaaaaggtggacacccggacgccccgccccatgcccggaacgcggaaggtgatggagatcaccgccgagtggctgtggcgaaccctgggccgcaacaagaagccgaggctctgcacccgcgaggagtttacgaagaaggtccggaccaatgccgcgatgggtgccgtgttcacagaggagaaccaatgggacagcgcgcgcgcagcggtcgaggacgaggagttctggaaactggtggaccgggagcgcgagctgcataaacttggcaagtgcgggtcctgcgtgtacaacatgatgggcaagagggagaagaagctgggggagttcggcaaggccaagggcagccgcgctatctggtacatgtggcttggggcccgttacctcgagtttgaagccctggggtttctgaacgaggaccattggtttagccgcgagaacagctactccggggtggagggcgaagggttgcacaagctgggctacatcctgcgggatataagcaagatccccggcggggcgatgtacgccgacgacaccgccggctgggacacgcgtatcaccgaggacgacctccacaacgaggagaagatcacccagcagatggacccagagcaccgacagctggccaacgccatctttaagttaacctaccagaacaaggtcgtgaaggtgcagcgccccacgcccaaggggaccgtcatggacatcatcagccgaaaagaccaacgcggcagcggccaggtggggacctacggactcaacacgttcactaacatggaggcgcagctggtgagacagatggagggcgagggcgtcctgtccaaggccgacctcgagaacccccatctcctggagaagaagatcacgcagtggctcgagaccaagggggtggagcgcttaaagcggatggccatcagcggtgacgactgcgtggtcaagcccatcgatgaccgctttgccaatgccttgctcgcgctaaatgacatgggcaaggtgcgaaaggacatcccccaatggcagccatcgaaagggtggcacgactggcagcaggtccccttctgcagccatcacttccatgagttgatcatgaaggacggtcgcaagttggttgtgccatgccgcccgcaggacgagctgatcgggcgggcccgcatctcccagggcgccggttggagcctgaaggagaccgcatgcctcggcaaggcgtatgcgcagatgtggtccctgatgtacttccaccggagagacctgcgccttgccagcaatgccatctgctccgccgtgcccgtccactggatccctaccagtcgcacgacctggtcaatccacgcgcaccaccaatggatgactaccgaggatatgctgacggtgtggaaccgggtgtggatcgaggacaacccctggatggaggataaaacacccgtaacaacctgggaggacgtgccgtacctgggcaagcgggaggaccagtggtgcgggtcactcatcggcctgacgagcagggccacatgggcccagaatattctgaccgccatccagcaagtacgctccctcattggggacgaggagttcctggactatatgccaagcatgaagcggtttcgcaaggaggaggagtccgaaggagccatctggtga

SEQ ID NO: 25755 - RNA, 9873 nt, synthetic construct
  misc_feature 1..9873: note = derived and/or modified CDS sequence (opt11) from DENV-3__GU131945__SS-prME
  source 1..9873: mol_type = other RNA
accagcctatgcctgatgatgatgctcccagcgacactcgcgttccacctcacatcacgcgacggtgaacccagaatgattgttgggaaaaacgaacgcggaaaatctctcctattcaaaaccgcgagtggcattaacatgtgcacgctcatcgcaatggatttgggcgaaatgtgcgacgacacggtcacctacaagtgtccgttaatcgcagaagtcgaaccagaagacatcgactgctggtgtaacctcacctcaacgtgggtcacctacggcacatgcaatcaggccggcgaacaccggcgggacaaaaggtccgtcgccctagcacctcatgtcggtatgggcctagacacccgaacacaaacgtggatgtcagccgaaggtgcgtggcgccaagtggaaaaagtagaaacatgggcattgaggcacccgggttttaccatactcgcgctctttcttgcacactacataggcactagcttaacccaaaaagtcgtcattttcatcctactcatgctcgtaactccgagtatgacaatgaggtgcgtaggcgtcggaaatcgcgacttcgttgaaggcctgagcggggccacttgggtggacgtggtgctagaacacggcggatgcgtcacgacaatggcaaagtcgaagccgacgctagatatcgaactacagaaaaccgaagcaacgcaattagcaactctgcggaagttgtgcatagaaggtaagatcactaacatcaccaccgactcacggtgtccgacccaaggtgaagcgacgttaccggaagaacaggaccaaaattatgtatgtaaacacacatacgtcgaccgtggctggggtaacgggtgcggtctcttcggtaagggctcgctagtcacatgcgccaaattccaatgcctcgaaagcatagaagggaaagtcgtgcagtacgaaaaccttaaatacacagttatcataactgtgcacacgggagaccaacaccaggtcggaaacgacacacaaggtgtgacggtcgagatcacaccgcaggcgagtacggttgaggctgttctccccgaatacgggacgttaggcctcgaatgcagccctcgaaccggactggatttcaacgaaatgatcctgttgacgatgaagaataaggcttggatggtgcaccgacaatggttcttcgacctacccctaccgtggacatcgggtgcaactacggagacccccacatggaaccgaaaggagcttcttgtaacgttcaagaatgctcacgcgaagaaacaggaagtagtggtgctcggctcacaggagggagcgatgcacacagctctcacgggcgcgacggaaattcagaactccggcggcacctcaatattcgcggggcacttaaaatgtagacttaaaatggataagctggagctaaaaggtatgtcatatgccatgtgcctgaacacgttcgtgttaaagaaggaagtgtccgaaactcaacacggaacgatcctcatcaaagtcgagtacaaaggagaggacgccccatgcaagataccattctcgacggaagacggacaaggcaaggcacataacggcagattgataacggcaaacccagtcgtaacgaagaaggaagaaccagttaacatcgaagctgagccacctttcggagagagcaacatcgttataggaatcggtgacaaagccctgaaaatcaactggtacaagaaaggctcctcaataggcaagatgttcgaagctactgctcgaggagcacgaagaatggcaatcttgggtgacacagcctgggactttggcagcgtaggtggagttctaaattcacttgggaaaatggtccatcagatattcggcagcgcttacacagccctattcagcggcgtttcctggatcatgaaaatcgggataggcgttctcctaacctggataggcctcaatagcaaaaatacgagcatgagcttctcatgcatcgtgatcggaatcatcacgctctacctgggggcagtcgttcaagcggacatgggatgcgtcattaattggaagggaaaagagctcaagtgcggaaacgggatatttgtaacgaatgaagttcatacatggaccgaacagtacaagttccaggctgactcaccaaagaggttggccacggcgatagcgggcgcatgggaaaacggggtttgcggaattaggagtaccacaagaatggagaacctactgtggaagcagattgctaatgaacttaactatatactctgggaaaacaatatcaagctaaccgttgtggtaggggatatcattggtgttttggagcaaggaaagagagcacttacaccccaaccaatggaactcaaatattcctggaaaacctggggtaaagcgaagatagtcaccgcggagacgcagaatagcagcttcataatcgacggacccaacaccccggaatgcccatccgcatcaagagcatggaacgtatgggaggttgaagattacggatttggggtatttacgacaaacatctggttgaagctgagagaagtctatacgcaatcatgcgaccaccgattgatgtccgcagccataaaagacgagagagcagtgcacgcagacatgggctactggatagaatcgcagaaaaacgggagctggaagttggagaaagcctccttcatcgaagtaaagacctgcacgtggccgaaaagccatacattatggtccaatggagtattggaatccgacatgataataccaaagagcctggcaggccccatttcgcagcacaaccacagaccggggtatcatacacaaacagcaggtccttggcacctcggcaagttggagctcgacttcaactattgtgaaggcaccaccgtagtcattgcggagaattgcggtaccagggggccgtcgttacgaacgaccacggtctcaggaaaacttatccatgagtggtgctgtcgttcctgcacgctgcctccactcaggtatatgggtgaggacggatgttggtacggcatggaaatccggccgataaacgaaaaggaggaaaacatggtaaaatcgctcgtcagcgcaggcagcggcaaagtggacaacttcaccatgggagtgctttgtctcgctatactctttgaagaggtcatgcgaggtaagttcgggaaaaagcacatgatcgcgggcgtccttttcacattcgtactgctgctttccggtcaaatcacctggcgggacatggcccacacattaataatgatcggatcaaacgcgagcgaccggatgggtatgggcgtaacctacctggcactaatagcaacgttcaagatccaaccattccttgcacttggattctttctcagaaaactcacgagccgagagaacctcctgctgggcgtaggactcgcgatggctacaacactgcaactaccagaagacattgaacaaatggctaacggtatagcactcggcctaatgacactgaaacttattacccagttcgaaacgtaccagctatggactgccctagtaagcctgacctgcagtaatacgatatttacgctaacagtcgcctggagaaccgcaaccctaatcctcgctggagtgtcactgctccctctgtgccaaagcagcagcatgaggaaaaccgactggctcccaatgacagtagcagccatgggagtacctcctctgccccttttcattttctccttgaaagacactccaaaaaggcgcagctggcccctaaacgaaggcgtcatggcggttggccttgtgagcatactagcaagttctctcctaaggaacgatgtaccgatggcgggaccactcgtcgccggagggctgctaatagcgtgttacgtcattactgggaccagcgcagacctaaccgtggagaaagcagccgacgtcacgtgggaagaagaggcagagcaaacaggagtaagtcacaatctgatgatcaccgtagacgatgatgggaccatgaagataaaggatgatgagacggaaaatatccttaccgttctgcttaagacagcgctgctgatagtatcaggaatttttccttactcaatcccagcaacgctcctggtctggcacacatggcaaaagcaaacacaaaggtctggcgtactttgggacgtaccgtccccgccagagacacagaaagcggaactcgaggaaggcgtataccgaataaagcagcagggaatattcgggaagacacaagtaggagtgggtgttcagaaggagggggtctttcatacaatgtggcacgtgacaaggggcgcagtgctcacccacaatggcaagagattagagcccaactgggcaagcgtaaagaaagacctcatctcgtatggtggcgggtggcgactcagcgcacagtggcaaaaaggggaagaagtccaagtcattgcagtagagccggggaagaaccccaagaactttcaaacgatgcccggaatatttcaaaccacgaccggagaaatcggagcgatagcactggacttcaaacccggaacatccggtagcccaatcatcaaccgagagggaaaagtcgtaggcctatacggaaacggcgtggttaccaaaaacggcggatacgtaagtgggatcgctcaaacaaacgccgagccggacggtcccaccccagaactagaggaagaaatgttcaaaaagagaaacttaacaataatggacctacacccaggatccggcaaaaccaggaaatacttgcctgcaatcgttcgggaggccataaaaagaaggctacgaaccctcatactggccccaacccgagtggtggcagcagaaatggaggaagctctcaaaggtctgcccatccgataccaaaccacagctactaaaagcgaacataccggccgggagattgtcgacctcatgtgtcacgccacattcaccatgaggcttttgtcaccagtcagagtgcccaactacaatctagtaattatggatgaagcacactttacggatccggcatctatagcggcaagaggttacatctctacgagggtaggcatgggcgaggccgcggcaatcttcatgactgcaacacccccaggcacagcggaagcattcccgcaatctaatgcgccgatccaagacgaagaacgagacatcccggaacgatcctggaactcaggtaacgaatggatcacggattttgtgggaaagacagtctggttcgtcccgagcataaaagccggaaacgacatagccaactgcctgagaaagaacggcaagaaggtcatacaactctcacgcaaaacgtttgatacagagtaccaaaagacgagactcaacgactgggacttcgtggtcacgacagacatctcggagatgggcgccaacttcaaggcagaccgtgtcatcgaccccaggagatgcctaaaaccagtcatccttacagacgggccggaaagggtgatcctagcgggccccatgcccgtgaccgccgcatccgctgcccaacggcgagggcgggtagggagaaatccacaaaaagagaatgatcagtacatattcatgggccaaccactgaacaacgatgaggaccacgcccattggaccgaagcgaaaatgcttctagacaacataaacactccagaaggaattatacccgcactctttgaaccagagagagagaaaagcgccgctatagacggagaatatcgcctgaaaggcgaatcacgcaaaactttcgtagagcttatgagacgcggagatttaccggtgtggctggcccacaaggtagcctcagagggaatcaaatacactgaccgcaagtggtgcttcgacggtgaaagaaacaaccaaatcctggaggagaacatggacgtggaaatctggaccaaggagggggaacgaaagaaattgcgaccaagatggctcgacgcacgaacctatagcgatccgcttgccctaaaagagttcaaggacttcgcagccgggagaaaatccattgcacttgaccttgtaaccgaaataggacgcgtaccatcacatctagcacatcgaacccgcaacgcactagataatctagtcatgcttcacacttcagaacacggcggccgcgcctaccgtcacgccgtagaagaactaccggaaactatggagaccctactattactgggcttgatgatccttctaacgggaggagctatgctatttctaatatctgggaaaggcataggaaagacctccatcggactcatctgcgtgattgtttccagcggtatgctatggatggccgatgtacccttgcagtggattgcgtccgccatagttcttgagtttttcatgatggtgctgttaatccctgaaccagagaagcagagaacaccacaagataaccagctagcgtacgttgtcataggcatccttacactcgcagccatagtggcagctaacgaaatgggcctactcgaaaccaccaaacgggacttggggatgtcgaaggagccaggtgtggtcagccccacgagctacctcgacgtcgacctccacccggcaagtgcgtggaccctgtatgccgttgcaacgaccgtgatcacccctatgctgagacacacaatagaaaacagtacggcaaacgtcagcctcgcagcaatagccaaccaggccgtcgtattaatgggccttgacaaagggtggccgatatcgaaaatggacctcggagtaccactacttgcattgggatgctactcccaagtaaaccccctgaccctaacagcagcagtactcctcctagtaactcactacgctatcataggacccggtcttcaagcgaaagcaaccagggaagcgcagaaacgcacggcggccggcatcatgaaaaacccaacagtcgacggaataatgacaatagacctagacccagtaatatatgacagcaaattcgagaaacagctgggccaagtcatgctcctcgtactctgtgccgtgcagctcctcttaatgcgcactagctgggccctctgcgaagcgctaacgctcgcaactggacctattaccaccctctgggagggcagccctgggaaattctggaacacaaccatcgctgtaagcatggccaatatctttcgaggcagctaccttgcaggagcgggcctggccttcagcataatgaaaagcgtgggaaccggacgcagaggcacaggctcacaaggcgaaactcttggagaaaagtggaagaagaaattaaaccaactcagccgaaaagagttcgacctatataagaagtcaggaattaccgaggtggaccgcactgaagcaaaagaagggctaaaaagaggggaaacaacacaccacgcagtaagcagaggctccgcgaaactgcagtggtttgtcgaacgcaatatggtaatacccgaaggaagggtaatcgacctcgggtgcgggcgtggaggctggagttactactgcgccggcctaaagaaagtaaccgaagtgagggggtacaccaagggcggcccaggccacgaagaacctgtaccaatgagcacatacggatggaacatcgtgaaactcatgtcaggaaaagacgtgttctacttaccaccagagaaatgtgacaccctcctgtgcgatatcggggaatcaagcccaagccccacagtcgaggaatcccgaacaatccgcgtactcaaaatggtcgagccttggctcaggagcaaccaattctgcatcaaagtcctaaacccctatatgccaacggtgatcgaatacttggaaagactacagcgaaaatacggcggtatgctggttcgaaacccccttagccgcaacagtacccacgagatgtactggatttcgaacggtaccggtaatatcgtcagctctgtaaacatggtgtcccgactcctactaaatcgtttcactatgacacacagacggccgaccatagaaaaagacgttgacctgggagccgggacgagacacgtgaacgccgaaccagaaacacccaacatggacgtcattggagagcggataaaaagaataaaagaagaacatagcagcacgtggcactacgacgacgaaaacccatacaagacctgggcatatcacggaagttacgaagttaaagccaccgggtcggcgagcagcatgatcaacggagtggtgaaactactcacgaaaccctgggacgtagttccaatggtgacccagatggccatgaccgacaccacaccatttggacaacagagagtcttcaaggagaaagtcgacacacgaacacccagacctatgccgggaacccggaaagtaatggagatcaccgctgaatggctctggagaactctcggaagaaacaaaaagcctcggctttgcacacgagaggagttcactaaaaaggtaagaaccaacgccgcaatgggagcagttttcacagaggaaaaccaatgggacagtgcccgagccgcagtagaggacgaggagttctggaaactcgtagacaaggaacgcgagcttcacaagttgggcaaatgcggaagttgcgtatacaacatgatgggaaaacgcgagaagaaattaggcgaatttggaaaagccaagggatcacgggctatatggtacatgtggctgggagcgagatacctcgagttcgaggcactcgggttcctaaacgaggaccactggtttagtagggagaatagctactccggagtggaaggagagggcctacataagctaggctacatcctaagggacatatcaaaaataccaggcggggccatgtatgcggacgatacagcgggatgggatacgcggatcaccgaggacgacctgcacaacgaggagaaaataacgcagcagatggatcccgaacaccgccaactagcgaacgcaatattcaaactaacgtaccagaacaaagtcgtcaaggtacaacgccccacacctaaggggaccgtcatggacataatctcccgcaaagaccagcgaggaagcggacaggtaggcacatacggacttaacacctttactaacatggaagcacagcttgtccgacagatggaaggagagggcgtactgtccaaggccgatcttgaaaatccccatctgctcgaaaagaaaataacccaatggctggagaccaaaggcgtagaacgcctaaagcgcatggcgattagcggcgacgattgcgtcgtcaaaccaatcgatgaccgcttcgcgaatgccctactagctctgaacgatatggggaaggtacgaaaagacataccacagtggcagccaagcaaaggatggcacgattggcaacaagtcccattctgcagccaccacttccatgaactcatcatgaaggacggaagaaaactcgtagtgccatgtcgacctcaagacgaactgataggtcgagcaagaatatcgcagggggcgggatggtccctcaaggaaacagcatgtctaggtaaggcgtacgcccagatgtggtccttaatgtatttccaccggcgagacctgcggctagcgagcaatgcgatatgcagcgcggtcccagtgcactggatccccaccagcaggaccacctggtcaattcatgcacaccatcagtggatgacaaccgaagacatgcttacggtatggaacagagtctggatagaagataatccctggatggaggacaagacccccgtaacaacctgggaagacgtaccatatctagggaagcgtgaggaccaatggtgcggttccctcatcgggctaacctcccgagcgacatgggcacagaacatactaaccgcaatccagcaagtgcgctcccttatcggcgacgaggagttcctagattacatgccgtccatgaaacgctttcgaaaagaagaggaaacagagggagccatttggtaa

SEQ ID NO: 25756 - RNA, 9873 nt, synthetic construct
  misc_feature 1..9873: note = derived and/or modified CDS sequence (opt11) from DENV-3__GU131946__SS-prME
  source 1..9873: mol_type = other RNA
accagtctgtgcctcatgatgatgctgccagccaccctggccttccatctcacaagccgagatggggaaccgcggatgatcgtggggaaaaacgaacggggtaaatccctgctctttaagaccgccagcgggatcaacatgtgcaccttgatcgccatggacctcggcgaaatgtgcgacgacaccgtgacctacaaatgccccctgatcgcagaagtggagccagaggacatcgattgctggtgcaacctgacaagcacctgggtgacatacggtacatgtaaccaggccggcgagcaccggcgcgacaaacggtctgttgccctggcccctcacgttgggatggggctggatacccgcacccagacctggatgagcgcggagggcgcgtggcgccaagtggagaaggtcgagacgtgggccttgcgccacccggggttcaccatcctggcgctattcctagcacactatattggcaccagtctaacccaaaaagtcgtgattttcattttgctcatgctggtgacgccaagcatgaccatgcggtgcgtgggggtcggcaaccgggactttgtcgaaggtctgtccggtgccacctgggtggacgtggtcctcgagcatggcggttgcgtgaccacgatggccaaatcgaagcccaccctggacatagagctacagaagaccgaggccacccagctcgcgacgctgcgtaaactgtgcatcgaaggtaaaatcaccaatatcaccaccgacagtcgctgccccacccaaggcgaggcaaccctaccggaggagcaggaccagaactacgtgtgcaagcacacctatgtcgatcgtgggtggggtaatggttgcggcctgttcgggaagggctccctggtgacctgcgccaaattccaatgcctcgaaccgatagagggcaaggtcgtccagtacgagaatctgaagtacacggtgatcatcaccgtgcacaccggggaccagcaccaggtcggcaacgacacacagggggtgacggtggagatcacgccccaggcatccactgtggaggccgtcctgccggagtacggcaccctcgggctggagtgcagcccgcgcaccggcttggacttcaacgagatgatcctcctgacgatgaagaacaaggcatggatggtccatcgacagtggttcttcgacctgcctctcccctggacctccggcgctaccaccgagacaccgacttggaaccgcaaggaactgttggtgaccttcaagaatgcgcacgccaaaaagcaagaggtagtcgtattgggtagccaggagggggcaatgcacaccgcgcttaccggggccacagaaatacagaactctggaggtacctcgatcttcgccggccacttaaaatgccgacttaagatggacaaactggagctgaagggcatgtcctacgccatgtgccttaacactttcgtgctgaaaaaggaggtcagcgagacacagcatgggaccatcctgataaaggtggagtacaagggcgaggacgcaccctgcaaaatacccttctccaccgaggacgggcagggcaaggcgcacaatggaagattgatcacggccaaccccgtggtgacgaagaaggaggagcccgtcaacatcgaagccgagccgcccttcggggagtccaacatcgtgattggaatcggagacaaggcattgaaaatcaactggtacaagaaggggtcttccataggaaagatgttcgaggcgaccgcccggggcgcacgcagaatggccatactgggcgacacagcctgggactttgggagcgtcggtgggatcttgaactccctcggcaaaatggtccaccagatcttcggtagcgcgtataccgccctgttttccggcgtgagctggattatgaagattggtataggggtattacttacgtggatcggcctaaactccaagaacaccagcatgagcttttcttgcatcgtaatcgggataatcaccctgtatctcggcgctgtggtgcaggccgatatgggatgtgtaataaactggaaaggcaaggagctgaagtgcgggtcgggcatattcgtcaccaacgaggtccatacttggacggagcagtacaagttccaggccgacagccccaagcgcctggcgaccgccatcgccggcgcttgggagaacggggtttgcggcattcgctccaccacccggatggagaacctactatggaaacagatcgccaacgagcttaactacatcctctgggagaacaatattaaactgacagtggtcgtgggcgacattatcggcgtgctggagcagggcaagcgcactctcaccccgcagccgatggagctaaagtactcttggaagacgtggggcaaggcccgaatcgtgaccgcagagactcagaactccagcttcatcatcgacggccccaatacacccgaatgcccgtccgcaagccgcgcttggaacgtgtgggaggtggaagattacgggttcggcgtatttactaccaacatctggctgaaacttcgggaggtctacacacaaagctgcgaccaccgccttatgagtgctgccatcaaggatgaacgtgctgtacacgccgacatgggctactggatcgagtcacagaaaaatggatcctggaagttagagaaggctagctttatcgaagtcaaaacctgcacctggccgaaatcccacacgctctggagcaacggcgtgctggagtccgacatgatcatccctaagagcctggccgggcctatctcgcagcacaaccaccgccctggctaccatacacaaaccgcgggaccctggcatctcgggaagctggagctggacttcaactactgcgaaggcaccacggtggtcatcaccgagaactgcgggactcggggcccctcgttgcgaaccaccacagtgtccgggaagctgatacatgagtggtgctgtcggagctgcaccctgcccccgctccgatacatgggcgaagacggttgctggtatggcatggaaatccgccccataaacgagaaggaagagaacatggtgaagtccttagttagcgcaggatccgggaaagtggataactttaccatgggcgtgctgtgcctcgccattttattcgaagaggtcatgcggggcaaattcggcaaaaagcacatgatcgccggggtcctttttacgtttgtgctactgcttagcggacaaatcacctggcgggacatggctcacaccctcatcatgataggctccaacgcctcagacagaatggggatgggggtcacctatctagcacttatagcgacctttaagatccagcccttcctcgccctcgggttcttcctacggaagctaaccagcagggagaacctgttgttgggcgtcggcctggccatggccaccacactgcagctacccgaagacatcgaacagatggcgaacggcatcgcactcggcctcatgacgctcaagttaatcacccagttcgagacctaccagctgtggaccgcgttagtctcattgacttgctccaacacgatattcacgctgaccgtcgcctggcgaacggccacactcatcctggccggggtgtccttgctcccgctgtgtcagagctcgagcatgcgcaaaactgattggctccctatgacggtcgctgcgatgggggtacctcccttaccgctatttatcttctccttgaaggacacgccaaagcgcaggagctggccgctcaacgaaggcgtgatggcggtaggcctagtctcgatcttggcctcttcccttctgcgtaacgacgtgcccatggccggccccctggtggccgggggcttattaatcgcgtgctatgtgattaccggcacgtctgccgatctgacagttgagaaggcggccgacgtcacctgggaagaagaggccgagcagaccggcgtgtcgcacaacctaatgatcaccgtggacgacgacggaacgatgaggataaaagatgatgagacggagaacatcttaacggtcctgctaaagaccgcgctgctgatcgtgagcggcattttcccctactctatccccgcgaccttgctcgtatggcacacgtggcaaaagcaaacgcagcgcagcggcgtactgtgggacgtgccctccccgccagaaacccagaaggccgaactcgaggaaggtgtgtaccggatcaagcagcaaggtatctttggaaagacccaggttggcgtgggggtgcagaaagagggcgtcttccacaccatgtggcacgtgacgcgcggcgccgtcctgacgcataacgggaagcggctagagcccaactgggctagcgttaagaaagaccttatctcctacggcgggggctggcgcctgagcgctcagtggcaaaagggggaggaggtacaggtgatcgccgtggagccaggcaaaaatcctaagaactttcaaaccatgcctggcatcttccaaaccacgacaggggaaattggcgccattgcactggactttaagcccggcaccagcggctccccaataatcaaccgagaaggcaaagtggttgggttatacggcaacggggtagtcaccaagaacggcgggtacgtcagcggcatcgcacaaacgaacgctgagcccgacggccccacgcccgagttggaagaggagatgttcaaaaagcgtaatttaactatcatggacctgcacccggggagtggcaagacacggaagtacctccccgccatcgtccgcgaagcaattaagaggcggctacgaactctcattctcgctcccacccgtgtggtggcggctgaaatggaggaggcgttaaaggggctgcccatccggtaccagaccaccgccaccaagagcgagcacaccggccgcgaaatcgtcgacctaatgtgtcacgcaacctttacgatgcggctgctgtccccggtgcgcgtccccaactacaatctagtgatcatggacgaggcgcactttaccgaccccgccagtatcgctgcacgggggtatatctccacccgcgtgggcatgggggaggccgcggctatattcatgaccgctacgccgcccgggacggccgaggcgttcccccagagcaacgcccccatccaggacgaggaacgcgacatccctgagcggtcctggaactccgggaacgagtggataaccgatttcgtgggaaagaccgtctggttcgtgccctccatcaaagctggcaacgacatcgccaactgtctacgcaagaacgggaaaaaggtgatccagctgtctagaaagacctttgacacggagtaccaaaagacccgcctcaatgactgggacttcgtcgtgaccacggacatctccgagatgggcgccaacttcaaagcggaccgggtaatcgacccccgccggtgcctgaaaccggtcatcctcacagatggccccgaacgggttatattagcaggcccgatgcccgtgaccgccgccagcgccgcgcagcgtcgcggccgggtagggcgaaacccccagaaggagaatgaccagtacatattcaccggccagcctcttaacaacgacgaggaccacgcgcactggaccgaagccaagatgttgctcgacaacattaatacgcctgaggggatcattcccgccctatttgagccggagcgggagaaatccgccgcgatcgacggcgagtaccgactgaagggcgagtcccggaagacgttcctcgaactgatgaggcgcggggacctgccggtgtggctcgcccacaaggtagcgtcggagggcattaagtataccgaccgcaagtggtgcttcgacggtgagcggaacaaccagatcttggaggaaaacatggacgtggagatctggaccaaggagggtgagcgcaagaaacttaggccgcggtggctcgatgcccggacgtatagcgaccccctggccctgaaagagttcaaggactttgccgccggtcggaagtccatcgcgctcgatctggtaaccgagatcggtcgcgtaccctcacacctggcgcaccggacccgcagcgccctcgacaatctggtgatgctgcatacctctgagcacggcggacgggcctacagacatgccgtggaggaactcccggagaccatggaaacgttattgctcctgggcctgatgatcctcttaaccggaggggcaatgctgtttcttatctctggcaaagggataggcaaaacctccatcgggcttatatgcgtcatcgtgtcatccggcatgctatggatggcggatgtaccactccaatggatcgcgagcgcgatcgtcttggagttctttatgatggtgttactcatacccgagcccgagaagcagcggacgccgcaagataaccagctggcatacgtagttatcgggattctgacgttggccgccatcgtcgcggctaacgagatgggcctgctggaaacgaccaagcgcgacctgggcatgtcgaaggagcccggggtggtctcccccaccagctacctagacgtggacttgcaccccgcctctgcttggacgttgtacgccgtagcgaccacggtcatcaccccaatgttacgacacacgatcgagaactccactgcaaacgtaagcctggccgccatcgcaaaccaggccgtggtcctcatgggtctggacaaggggtggcctatctccaagatggatctcggcgtgcccctcttggccctagggtgttacagccaggtgaacccccttaccctaaccgccgccgtcctgctactggtgacgcactatgcgatcattgggccggggctgcaggccaaggccacgcgtgaggcgcagaagcgtacagccgcggggataatgaaaaacccgacggtggacggcatcatgacgatagacctcgaccctgtcatttacgactccaagttcgaaaagcaactgggccaagtcatgcttctggtgctgtgcgctgtccagttgttgctgatgaggacctcgtgggccctgtgcgaggctttaacgctggccacggggcccatcaccaccctgtgggagggctcccccgggaaattctggaacaccaccatcgcggtgagcatggctaatatctttcggggctcctatctcgccggtgccgggctggcgttcagcataatgaagtccgtggggacgggccgtcggggcaccggatcccagggagaaacgctcggcgagaaatggaagaagaaattgaaccagctgagccgcaaggagttcgacctgtacaagaagagtggcattaccgaagtcgaccgcaccgaggccaaggaagggctgaagcgcggcgagacgacgcaccacgccgtaagcaggggctccgccaagttgcagtggttcgtagagcgtaacatggtaatccccgaaggtcgcgtgatagacctgggctgcgggcggggcggttggagctactactgcgccggactcaagaaggtgaccgaggtccgcggttatacaaaaggagggccggggcacgaggagcccgtgccaatgtcaacgtacggctggaacatcgtgaaactgatgtctgggaaggacgtcttctacctgccgcccgagaaatgcgacacccttctctgcgacatcggcgagtccagccccagccctaccgtagaggagagccgcaccattcgcgtgctgaagatggtcgagccgtggttgcggaataaccaattctgcatcaaggtgctcaatccctatatgcctacggtgatcgaacacctggagcgcctacagcgcaagtacggcgggatgttggtacgcaaccccctgtcccgcaacagcacccacgagatgtattggatctccaacggcaccgggaatatcgtgagctccgtgaacatggttagtcgacttttgctgaatagattcaccatgactcaccgccggcccacaatcgagaaggacgtggacttgggtgcgggcacccgtcacgtcaacgccgagcccgagacccccaacatggacgtgataggcgaaagaatcaaacgcatcaaggaggagcacagtagcacgtggcattacgatgacgagaacccctacaaaacttgggcctaccacggtagctacgaggtcaaagcgaccggctctgcttcgtccatgatcaacggcgtcgtgaagctcctgacaaaaccctgggacgtggtacccatggtgacccagatggcgatgaccgataccaccccgttcgggcagcagcgggtcttcaaggagaaagtggatacgcgcacgccccggcccatgcccgggactcgcaaggtgatggagatcaccgcggagtggctatggcgcacactcggccggaacaagaagccgcgactgtgtaccagagaggagttcactaagaaggttcgaaccaatgccgccatgggagccgtcttcactgaggagaaccagtgggacaacgctcgggccgcagtggaggatgaggagttttggaaacttgtggacagagagcgggagttacacaaactgggaaagtgcggctcttgcatctacaacatgatgggcaagcgcgagaagaagctgggcgagttcggcaaggcgaagggctcccgggcgatttggtacatgtggctgggggcgcgttacctggagttcgaggccctgggcttcctgaatgaggaccactggttttcacgggaaaattcctacagcggggttgagggcgaggggctgcacaagttaggctacatcctccgcgacataagtaagatacccggtggtgccatgtacgccgacgacaccgcgggctgggacacgcggattaccgaagacgatctacacaacgaggagaagattacgcaacagatggaccccgagcaccggcaactggcgaatgccatcttcaagctcacctaccagaacaaagtggtgaaggtccagagaccaactccgaagggtactgtgatggacatcatctcgcgcaaggaccagcgggggtccggacaggtggggacctacggattaaacacgttcaccaacatggaagcccagctggtccgccagatggagggggagggtgtgctcagcaaggcggatcttgagaacccccatctccttgagaaaaagatcacccagtggctggagaccaaaggcgtggaccggctgaagcgcatggcgatctccggcgacgattgcgtagtcaagcctatcgacgaccgcttcgccaacgccctcttggcgctgaacgacatgggcaaggtgagaaaagacatcccccagtggcagcccagcaaggggtggcacgactggcaacaggtccccttctgcagccaccacttccacgagttaatcatgaaagatggccgcaaactggtggtgccctgccgtccgcaggacgagctgatcgggcgcgcccggatctcacaaggcgcgggatggagcctcaaggaaacggcgtgcctgggcaaagcatacgcccagatgtggagcttgatgtacttccaccgccgggacctccgcctggcctccaacgcgatctgcagcgccgttccggtgcactggatccccaccagccggacaacctggtctatccacgcccaccaccaatggatgacgaccgaagacatgctgaccgtgtggaatagggtctggatcgaggacaacccctggatggaggacaagacccccgtgacgacctgggaagatgtgccctacctcggcaagcgggaagaccagtggtgcggtagcttgattggcctgacctccagagcaacctgggctcaaaacattctcacggccatccagcaggtccggtcacttatcggggacgaggagtttctggactacatgccctccatgaaaagattcaggaaagaggaagagagcgagggagccatttggtga

SEQ ID NO: 25757 - RNA, 9873 nt, synthetic construct
  misc_feature 1..9873: note = derived and/or modified CDS sequence (opt11) from DENV-3__FJ639712__SS-prME
  source 1..9873: mol_type = other RNA
accagcttatgcctcatgatgatgttccccgccaccttggcattccacctgacgagcagagacggcgagcctcggatgatagtggggaagaacgaacgcggcaagagcctcctcttcaaaaccgcgagcgggataaatatgtgcaccctgatcgccatggacctcggcgagatgtgcgacgacaccgtgacctacaaatgtcccctgatcgccgaggtcgagcccgaggatatcgactgctggtgcaacctgacaagcacctgggtaacctacgggacgtgcaaccaggccggcgagcatcggcgcgacaagcggtccgtcgccctcgcgccccacgtgggcatggggctggacacccggacacaaacttggatgagcgccgagggcgcctggcggcaggtcgagaaggtggagacgtgggccctgcgccatccggggttcaccatcctcgcactgttcctggcccactacatcggcacgtccctcacccagaaggtggtaatcttcatccttctgatgctcgtcacgcccagcatgaccatgaggtgtgtgggggtgggaaaccgggacttcgtcgagggcttgtcgggggccacctgggtggacgtggtcctggagcacggcgggtgcgtgaccacgatggccaagagcaagcccacactcgacattgaactacagaagaccgaggccacccagctggcgacgctccggaaactgtgcatcgagggcaaaatcacaaacatcaccacggactctcgatgtcccacgcagggagaggccaccctgccggaagagcaggaccagaactacgtctgcaaacacacctacgttgatcgggggtggggcaacggatgcggcctcttcgggaaagggagcctggtgacctgtgccaagttccagtgcctagagcccatagagggcaaggtcgtccagtatgagaacctcaagtacacggtgatcatcacggtgcacaccggggaccagcaccaggtcggcaacgacacacagggggtgacggtcgaaattacgccccaagcctccaccgtagaggccgttctgcccgagtacggcaccctggggctcgagtgcagcccgcggaccggtctggacttcaacgagatgatcctgctcaccatgaaaaacaaggcgtggatggtccaccggcagtggttctttgacctgccactgccctggactagtggtgccaccaccgagacgcctacatggaacaggaaagagttactggtgaccttcaagaatgcccacgccaagaagcaggaggtggtcgttctggggagccaggaaggcgccatgcatacagcactcacaggggccacagagatccagaactcaggcgggaccagcatcttcgccggccacctgaagtgtcgtctaaagatggacaagctcgagctgaagggaatgagctacgccatgtgccttaacaccttcgtactcaagaaggaagtcagcgagacgcagcatgggaccatcctgatcaaggtggaatacaagggcgaagacgccccgtgcaagatacccttcagcaccgaggacgggcaggggaaggcgcactccggacggctgatcaccgccaaccccgtggtcacgaagaaggaggagcccgtgaacatcgaggccgaaccgcccttcggggagagcaatatcgtgatcggcatcggggacaaggccctgaagattaactggtacaagaaggggtcctctattgggaagatgtttgaggcgaccgcccgaggtgcccgccggatggccattctcggcgacaccgcttgggacttcgggtccgtcggcggggtcctgaacagcctgggcaagatggtgcaccagattttcgggtccgcatatacggccctcttttctggcgtcagttgggtgatgaagatcggcatcggggtgctcctgacgtggatcggtctcaacagcaagaacacttccatgagttttagttgcatcgttatcgggatcatcaccctatacctcggcgccgtggtgcaggccgacatggggtgcgtcatcaactggaaaggcaaggagctcaagtgcggcagcgggatcttcgtgaccaacgaggtgcatacgtggacggaacagtataagttccaggcggactcccccaagcgccttgccaccgccatcgcgggcgcttgggagaatggagtctgcggtatccgctcgaccacgcggatggagaacctgctatggaagcagatcgccaatgagctgaactacatcctgtgggagaacaacattaagctcaccgtagtggtcggggacatcattggcgtgctggagcagggcaagcgcaccttgacgccccagccgatggagctcaagtactcctggaagacgtgggggaaggcgaagatcgtgaccgccgagacccagaacagctcattcatcatcgacggccctaacacccccgagtgtcccagcgctagccgggcctggaacgtctgggaagtggaggactacgggttcggcgtgttcacgaccaacatctggctgaagctgcgcgaggtgtacacccagtcctgcgatcaccggctcatgagcgcggccatcaaagacgagcgggctgtgcacgccgacatggggtactggatcgagtctcagaagaacgggtcgtggaagttggagaaggcctcttttatcgaggttaaaacctgcacctggcccaagagccacactctttggagtaatggcgtcctcgagagtgacatgatcatccccaagtccctggcggggccgatcagccagcacaaccaccggccgggctaccacacccagaccgccggtccctggcacctgggcaagcttgagctggactttaattactgcgaggggaccacggttgtaatcaccgagaactgtgggacccgcggcccctccctgcggacaacgaccgtcagcgggaagctcatccatgagtggtgctgcaggtcgtgcaccctgcccccgctgcggtacatgggcgaggatgggtgctggtacggcatggagataaggccgatcaacgagaaggaggagaacatggtcaaaagcctcgtatccgccggcagcggaaaagtcgacaatttcaccatgggcgtgttgtgcctggccatactcttcgaagaagtgatgcgtgggaagttcggcaagaagcatatgatcgccggagtcctgttcacgttcgtgctgttactgtccggccagatcacatggagagacatggcccataccctgattatgatcggtagcaacgccagcgaccggatggggatgggcgtgacgtacctcgccctgatcgccacgttcaagatacagcccttcctagccctcggtttcttcctgcgcaagctgacttccagggagaacctcctgctgggcgtcggcctcgcaatggccacaaccctgcaactccccgaagacatcgagcagatggctaacgggatcgccctcggcctgatgaccctgaagctcatcacccagttcgagacataccagctttggaccgcgctggtcagcctcacgtgctccaacaccatcttcaccctgaccgtcgcctggcgcacggcaaccctaatcctcgccggggtgagcctgctgccgctctgccaatccagcagcatgcggaagaccgactggctgcccatgactgtggccgcgatgggtgtgccgccactcccgctcttcatcttcagcctgaaggacacacctaagcgcaggtcctggcccctgaacgagggggtgatggccgtgggactcgttagcattctggcctcaagtttactccgaaacgacgtgcccatggccggaccactcgtggccgggggcctgttgatagcgtgttacgtgatcacagggacttccgccgatctgaccgtggagaaggccgcggatgtgacgtgggaggaagaggccgagcagaccggagtcagccacaacctgatgatcaccgttgacgacgacggcaccatgaggatcaaggacgacgagactgagaacatcctcacagtgctgctgaagactgcactcctgatcgtttccggaatattcccctacagcattcccgcaacgctgttagtgtggcacacctggcagaagcagacccagcggtccggcgtgctatgggatgtccccagcccgcccgagacccagaaagcagagctggaggagggggtgtaccgcatcaagcaacaggggatcttcgggaagacccaggtgggcgtcggggtgcagaaggagggcgtattccacaccatgtggcacgtcacgcggggcgccgtgctaacccacaatgggaagcgcctggagcccaactgggctagtgtgaagaaggacttaatcagttacggcgggggctggaggctcaacgcgcaatggcagaaaggggaggaggtccaggtgatagcagtggagccgggcaaaaacccgaagaacttccagaccatgcccggcatcttccagaccacgaccggggagatcggcgccatcgccctggactttaaacccgggacctccggatcccctatcatcaaccgcgagggcaaggtcgtagggctgtacggcaacggggtggtcaccaaaaacggcgggtatgtatccgggatcgcgcagacgaacgccgagcccgatgggcccaccccagagctggaggaggagatgttcaagaaacggaatttgaccatcatggacctacacccgggttctggcaagacccgcaagtacttacccgccatcgtgcgggaggccatcaaacggcggcttcgcacgttgatccttgcccccacccgggtcgtggcggccgagatggaggaggccctcaaggggctgcccatccgctaccaaaccaccgccaccaagagcgaacacaccggcagggaaatagtggacctgatgtgccatgccaccttcaccatgcgcctcctgagtccggtccgggtgcccaactacaacctcgtgatcatggatgaagcgcacttcacggatcccgccagcatcgccgcccgcggatacatcagcacccgggtaggcatgggcgaagctgcggccatcttcatgaccgccacgcccccgggtacggccgaggcgttcccccagagcaacgccccaatccaggacgaggagcgcgatatccccgagcgctcctggaacagcggcaacgaatggatcaccgactttgtggggaagaccgtgtggttcgtcccgtccatcaaagccggcaatgatatcgcaaactgcctccggaaaaatgggaagaaggtcatccagctgagccgcaagacattcgatacagagtaccagaagactagactaaacgagtgggacttcgtggtcaccacggacatctccgagatgggcgccaacttcaaggcggaccgcgtgatcgaccctaggcgctgcctcaagcccgtcatcctgacggacggccccgagcgtgtgatcctggccggcccgatgcctgtaaccgcggccagcgccgcgcagcgccggggccgcgtcgggcggaacccccagaaagagaacgaccagtacatctttaccggccagcccctcaataacgacgaggaccacgcccactggaccgaagcgaagatgctgctggacaacattaacaccccggaggggattatccccgccctgttcgagcccgaacgcgagaagtccgccgccatcgatggcgagtaccggctgaagggcgagagccgcaaaacgttcgtggagctgatgagaaggggggacctccccgtgtggcttgcccataaggtcgcctccgaggggatcaagtatgcggatcggaagtggtgtttcgacggggagcgaaacaaccaaatacttgaggagaacatggacgtggagatctggaccaaggagggcgagaggaagaaattacgcccgcgctggctggacgcgagaacctactcggatcccctggccctcaaggagttcaaggacttcgccgcaggccgcaagtctattgccctcgacctggtgaccgagatagggcgggtacccagccacctcgcgcaccgcacgcggaacgcacttgacaacctggtgatgctccacaccagcgaacacggcgggagagcctacagacacgccgtggaggagctgccggagaccatggagaccctgctcctgctaggcctcatgatccttctaaccggcggggccatgctcttcctgatctccgggaaggggatcggcaagaccagtatcggactgatctgcgttatcgtgtcgagcggcatgctctggatggctgacgtgcccctgcagtggatagcctccgccattgtactggagttcttcatgatggttctcctgatccccgagcccgagaagcagcgcacccctcaagacaaccagctagcctacgtggtcatagggatacttaccctggccgcgatcgtggccgccaacgagatgggtctgctggagacgaccaagcgggacctgggtatgagcaaggagcccggggtggtctcccccacctcatacctggacgttgacctccaccccgcgtccgcctggaccctgtacgcggtggccacgaccgtaatcacgccaatgctgcgccacactatcgaaaacagcacggccaacgtatcactggcagcgatcgccaaccaggcagtagtcctgatgggcctggacaaggggtggccaatcagcaagatggacctcggcgtgcccctgctggccctcggctgctactcccaggtgaaccccctgaccctgaccgccgcggtcctcctgctggtgacacactacgcgatcatagggccgggcctccaagcgaaagccacgcgtgaggcccagaaacgcaccgcggccgggattatgaagaaccccaccgtggacggcatcatgaccatcgacctggaccccgtcatttacgatagcaaattcgagaagcagctgggccaagtgatgctcctggtgctgtgcgccgttcagctcctcctgatgcggacgtcctgggcactctgcgaggccctgaccctggctaccggccccatcaccacgctctgggagggctctccggggaagttctggaacacgaccattgccgtgtccatggccaacatcttccgcggctcctacctggcaggggcaggcctcgccttctccatcatgaagtccgtgggtaccggcagacgcggcacagggagccagggagagaccctcggggagaagtggaagaagaagctaaaccagctctcccgcaaggagttcgacctctataagaagtccggcatcaccgaggtcgacagaacagaggccaaggagggcctcaagcggggcgagaccacgcaccacgccgtgtccaggggcagcgccaagctacagtggttcgtggagcgtaacatggtcatccccgaaggtcgcgtgatcgacctcggctgtggacgtggcgggtggtcctactactgcgcggggcttaagaaagtcaccgaggtccggggatataccaagggcgggcccgggcacgaggagcccgtgccaatgagcacctacggctggaacatcgtcaagcttatgtccgggaaggatgtcttctacctgccgcccgagaagtgtgacacgctgctgtgcgacataggcgagagctcacccagcccgaccgtggaggaatcccgcaccatcagggtgctgaagatggtcgagccctggctcaggaacaaccaattctgcatcaaggtgctgaatccctacatgcccaccgtgatcgaacacctggagcggcttcagcgcaaatacggcggaatgctggtccggaacccgctgagccgcaactccacgcacgagatgtattggatctcaaacggcacgggaaacatagtgtcctccgtcaacatggtctcacgactcctcctaaaccgtttcaccatgacccatcggcgcccaacgatcgagaaggacgtggacctcggggccggcacccggcatgtcaatgccgagcccgagaccccgaacatggacgtgatcggggagaggatcaagcggataaaggaggagcacagcagcacctggcactacgacgacgagaacccctacaagacgtgggcctaccacggcagctacgaggtgaaggccacggggagcgcgagcagcatgatcaacggcgtcgtgaagctgctgaccaaaccatgggacgtcgtcccaatggtgacccagatggccatgactgataccacgccgttcgggcaacagcgcgtgtttaaggagaaggtcgacacccggacgccccgccccatgccgggcacccggaaagtgatggagatcaccgcggaatggctctggcgcaccctgggccgcaacaagaagccgcggctctgcacgcgcgaagaattcaccaaaaaggtgcggacgaacgccgccatgggcgcggtgtttaccgaggagaaccagtgggatagtgcccgcgccgcagtggaggacgaggagttctggaagctcgtggatcgggagcgcgaactgcacaagctgggaaaatgcggtagctgtgtctacaacatgatgggcaaacgggagaagaagttaggggagtttggcaaggccaagggctcccgagccatctggtatatgtggctgggcgcccgatatctggaattcgaggccctcgggttcctgaacgaagaccactggttcagccgcgagaactcctactcaggggtggagggcgagggcctgcacaagcttgggtacatcctccgggacatctccaagatccccggcggtgcaatgtacgcggacgacacggccggctgggacacccgcattaccgaagatgacctgcacaacgaggagaagatcacccagcagatggaccccgagcacaggcagctcgccaatgccatcttcaagctgacgtaccagaacaaggtggtcaaggtccagcgccccaccccaaagggcaccgttatggacataatcagccggaaggaccagcgaggctctggccaggtggggacctacggcctgaacacgttcacgaacatggaggcccagctcgtgcgccagatggagggtgagggcgtgctgagcaaggcggacctagagaacccccacctcctggagaagaagatcacccagtggctggagaccaagggggtcgaaaggcttaagcggatggcaatctccggcgacgactgcgtggtgaagcccatcgacgatcgcttcgccaacgctcttctggcattaaacgacatgggcaaggtacggaaggacatcccccagtggcagcccagcaagggctggcacgattggcagcaggtacccttttgctcccaccacttccacgagctgatcatgaaagatggccgcaaactggttgtcccgtgccgcccccaagatgagctcatagggcgggcgcgcatcagccagggcgctggatggtcccttaaggaaacagcctgcctgggcaaagcctacgcccagatgtggagtctcatgtactttcaccgtcgcgacctgcggttagcgtccaacgccatctgtagcgccgtgccggtgcactggatcccgacgagcaggacgacttggtccatccacgctcaccaccagtggatgacaacggaggacatgcttaccgtgtggaaccgggtgtggattgaggacaacccctggatggaggataagacccccgtaacgacgtgggaggacgtcccgtacctgggcaagcgcgaggaccagtggtgtgggagcctgattggcctcacctcccgggccacctgggctcagaacatcctcaccgccatccagcaggtacgctcactgatcggggacgaggagttcttagactatatgcctagtatgaagcggttccgaaaggaagaggagtccgagggcgccatctggtga

SEQ ID NO: 25758 - RNA, 9873 nt, synthetic construct
  misc_feature 1..9873: note = derived and/or modified CDS sequence (opt11) from DENV-3__FJ639713__SS-prME
  source 1..9873: mol_type = other RNA
accagcctgtgtctcatgatgatgctgccggcgaccctggccttccacctcactagccgcgatggcgagccgcggatgatcgttggaaaaaacgagcgcggcaagtccctactgtttaagaccgcgtccgggatcaacatgtgcaccctgatcgccatggatctgggtgaaatgtgtgacgacaccgtcacgtacaagtgcccgctgatcgccgaggtagaacccgaggacatagactgctggtgcaatctcaccagcacatgggtgacctacgggacgtgtaaccaagcgggcgagcaccggcgcgataagcggtccgtagccttagcgccgcacgtgggcatgggcttagacacccgcacccagacctggatgagtgccgagggggcttggcgacaggtggagaaagtcgagacatgggcactccgccacccgggcttcacgatcctggcgctatttctcgctcactacatcggaaccagcttgacccagaaggttgtgatcttcatcctgttgatgctggtcacgcccagcatgaccatgcggtgcgtgggcgtgggtaacagagacttcgtcgagggcctgtccggggcgacctgggtggacgtcgtccttgagcatggcgggtgtgtgaccaccatggccaagagcaagcccaccctggacatcgagctgcaaaagactgaagccacgcagctcgctaccctgcgaaagctgtgcatcgagggcaagatcaccaacattaccaccgactcacgctgccctacccagggcgaagcgaccctcccggaggagcaggaccagaattacgtgtgcaagcacacctacgtggaccgggggtggggcaatgggtgcggcctgtttggaaagggcagcctcgtcacctgcgccaaattccagtgcctagagcccatcgagggcaaggtggtccagtacgagaacctgaagtacacggtgattatcaccgtgcacaccggggatcagcaccaggtcggcaacgacacccaaggggttacggtcgagatcaccccccaagcctccacagtggaggcagtactgcccgagtacggcaccctcgggctagagtgcagcccgcgcaccgggctggacttcaacgagatgatcctcctaacaatgaagaacaaggcctggatggtccatcgacagtggttcttcgacctgccactcccctggacctccggcgcgaccactgagacgcccacatggaaccgtaaggagttactggtgaccttcaagaacgcacacgcaaagaagcaagaggtggtcgtactcgggagccaagaaggagccatgcacaccgcgcttacgggggccaccgaaatccagaacagtggcggtaccagcatctttgccgggcatttaaagtgccggttgaagatggacaagctggagctgaagggcatgtcctacgcaatgtgcctcaacactttcgtgctgaagaaggaggtcagcgagactcagcacggaacgatcctaatcaaagtcgagtacaagggcgaagacgccccgtgcaagattcccttctcgaccgaggacgggcaaggcaaggctcacaatggccgtctgatcaccgccaaccccgtcgtcacgaaaaaggaggaacccgtgaacatcgaggctgagccgccgttcggggagtcgaacatcgtcatcggcattggggacaaggccctcaagattaactggtataagaagggaagctccatcgggaagatgttcgaggcgaccgcccgcggcgcccgtcggatggccatcctgggcgacaccgcctgggacttcgggtccgtcggcggggtgctgaacagcctaggcaagatggtccaccagatattcggaagcgcgtacactgctctgttttccggcgtctcttggataatgaagatcggcatcggcgtgctgctcacctggatcggcttaaattccaagaataccagcatgtctttcagctgcatcgtaatcggtataatcacactgtacctcggggccgtcgtgcaggccgatatggggtgcgttattaactggaaaggcaaggagctgaagtgcggaaacgggatctttgtgacaaacgaggtgcatacatggaccgagcagtacaagttccaggccgactcccccaagcgcctggcgaccgccatcgccggcgcctgggagaatggggtgtgcggcatccgcagcaccacacggatggagaacctcctatggaagcagatcgccaacgaactgaattacatcctctgggagaacaacattaagttaaccgtcgtggtgggggacatcatcggcgtcctggagcagggaaagaggaccctcacgccccagccgatggagctgaagtacagttggaagacgtgggggaaggcgaaaatcgtgacggcggagactcagaattcgtcgtttatcatcgacggtcctaacacccccgaatgcccgagcgcgtcccgggcctggaacgtctgggaggtcgaggactacggatttggcgtgttcacgacaaacatctggctgaaactaagggaagtgtacacccagagctgcgaccacagactgatgagcgcggcaataaaggacgagcgcgccgtccacgccgacatgggctattggatcgagtcacagaagaatgggagctggaagctggagaaggcctctttcatcgaggtgaagacctgcacctggcccaagagccacacgctgtggtccaacggggtactggagagcgatatgatcatcccaaagagcctggcgggaccgatctcacagcacaaccaccggcctgggtatcacacccagacagctgggccctggcacctaggcaagcttgagctagacttcaattactgcgagggcacgacggtcgtgatcgccgagaattgcgggacccgaggcccctccctcagaacgactacggtatctgggaagctgattcacgagtggtgctgccgatcctgcaccctgcccccactccgctacatgggcgaagacgggtgctggtacggcatggaaatccgccccatcaatgagaaggaggaaaacatggttaagagcctggtctccgccggcagtgggaaagttgataacttcacgatgggcgtgctgtgtttagccatcctgttcgaggaggtgatgcgggggaagtttgggaagaagcacatgattgcaggtgtgttattcaccttcgtgctcctgctgtccggacagatcacgtggcgagatatggcccacactttgatcatgattggcagcaatgcatccgaccgaatggggatgggtgtgacctacctggccctgatagcaaccttcaagatccagcccttcctcgcgttaggcttcttcctgcgcaagctcactagccgggagaacctgctgttaggcgtgggcctcgcgatggctaccacactgcagctccccgaggacattgaacagatggccaacgggatcgcgttaggattgatgacgctcaagctcatcacgcagttcgagacctaccagctttggaccgccctcgtcagcctgacttgttccaacacgatcttcaccctgaccgtcgcctggcggacagccacgctaatcctggccggcgtatctctgctccccctgtgtcagtccagctcaatgcggaagaccgattggctgcccatgaccgttgcggccatgggcgtgccgcccctgccgcttttcattttcagtctgaaggatactcctaagcgccgctcctggcctctcaacgagggcgtgatggccgtcggcctggtgtctatcctggcctccagcctcctgcggaacgacgtccccatggcaggaccgctggtagcaggagggctcctgatagcgtgctacgtgatcacggggacttctgcggacttaacggttgagaaagcggcagacgtgacctgggaggaagaggccgagcagacgggagtgagccacaacctcatgataacagtcgacgacgacgggaccatgcgcattaaggatgacgagacggagaacatcttaactgtgcttcttaagacagccctgctgattgtgagtggcatattcccgtactcaatccccgccacgctcctggtttggcacacatggcagaagcagactcagcggtcaggcgtgctgtgggacgtgccctcaccgccagagacgcaaaaggccgagttagaggagggtgtctaccgcattaaacagcaggggatcttcgggaagacgcaggttggcgtaggggtccagaaggagggggtgttccacacaatgtggcatgttactcggggcgccgtgctgacgcacaacgggaaacgcctggagccgaactgggcgtcggtgaagaaggacctcattagctacggcgggggctggcgcctgagtgcccagtggcagaaaggggaagaggtgcaggtgatcgccgtggagcccggcaagaatccgaagaacttccaaaccatgcccggcatattccagaccaccacaggagagatcggcgccatcgctctagattttaagccaggcacgagcggcagccctatcatcaaccgcgagggcaaggtggttgggctgtacggcaacggggtagtgaccaagaacggcggctacgtctcaggcatcgcccaaaccaacgctgagcccgacggccccacgccggagcttgaggaggagatgttcaagaagcggaacctgaccatcatggacctgcatccggggagcggaaaaacccgcaagtacttgcccgctattgtccgggaggcgatcaagcgcagattacgcacactgatcctcgcgcccacgcgggtggtcgccgcggagatggaggaggccttaaaggggcttcccatacgttaccaaaccaccgccacaaagagcgagcacactggccgggagattgtagacttgatgtgccatgcgacgttcaccatgcgcctactgagcccagtacgggtccccaactacaacctcgttattatggacgaggcccacttcaccgacccggctagtatcgccgcacgcgggtatatctccacacgggtgggcatgggtgaggcggccgccatttttatgaccgccacgccgcccggaaccgcggaggccttcccccagtccaatgccccaatacaggacgaggagagagacatccccgaacgtagctggaactccggcaacgagtggatcacggacttcgtcggcaagacagtgtggttcgtgcctagcatcaaagccggcaatgatatcgccaactgcctgaggaagaacgggaagaaggtcatacagctgtcccgcaagaccttcgacaccgaataccaaaaaacacgcctcaacgactgggatttcgtcgttaccaccgacatcagcgagatgggggcgaacttcaaggccgaccgagtcatcgacccgcggcgctgcctaaagcccgtgatcctaaccgacggtcccgagcgagtgatactcgccgggcctatgcccgtcactgccgcctccgcggcccagcgccgtggccgcgtagggaggaacccccagaaggagaacgaccagtacatctttaccggccagcctcttaacaacgacgaggaccacgcccactggacagaggccaaaatgctgctcgataacatcaacaccccggagggtattatccccgccctattcgagcccgagcgcgagaagtccgctgccatcgacggggagtatcggctgaagggtgagtcccgcaagaccttcgtagagttaatgcggcggggagacttacccgtgtggctagcccataaggtggccagtgaggggatcaagtacaccgatcggaagtggtgcttcgacggagagcgcaataaccagattttagaagagaatatggacgtcgagatatggaccaaggagggcgagcggaagaagctgcggccgcgctggctcgacgcccgcacctactccgaccccctcgccttaaaggagttcaaggactttgccgccggccgcaagagtatagccctggatctcgtaaccgagatcgggcgggttccctcccacctagcccaccgcactcgaaacgccctggacaacctcgtaatgctgcacaccagcgagcatggcgggagggcttaccggcacgccgtggaagagctgccggagaccatggagaccctcctgctgctcggcctgatgatcctgctcaccgggggcgccatgctgttcctaataagcggaaaggggatcggcaagaccagcatcgggctcatctgcgtgatcgtttcctccggcatgctgtggatggcggacgtgcccttacaatggatcgccagtgccatcgtgctcgagttcttcatgatggtcctgctgatacccgagcccgagaagcagcgaacgccgcaggacaaccagctcgcctacgtggtgattgggatcctgaccctggccgcgattgtcgccgcaaacgagatgggcctcttagagacgactaaaagagacctgggcatgagcaaggagcccggggtggtgagccccacctcctatctcgacgttgatttgcacccggccagcgcctggacgctgtatgcggtggcaacgaccgtgatcaccccgatgctacgccacaccatagagaactccacggctaacgttagcctggccgcgatcgctaaccaggcggtcgtgctcatgggcctcgacaagggctggcccatctccaagatggaccttggagtgccgctgctcgccctagggtgctacagccaggtaaaccctctaaccctcaccgcagcggtgctgcttctcgtcacccactacgccatcattggcccggggctgcaggccaaggccacgcgagaggcccagaaacgaaccgccgccggcataatgaagaaccccaccgtggatggaattatgaccattgacctggaccccgtaatctacgactccaagttcgaaaagcagctcgggcaggtcatgttactggtgctctgcgcagtgcagctgctcctcatgcgaacgagctgggcattgtgcgaggccctgaccctggcgactggccccatcacgacgctttgggaaggctccccagggaagttctggaatacaacgatagccgtgagcatggccaacatattccgcggctcttacctggcgggggcgggattggccttctccatcatgaagtccgtggggaccggacgtcgggggacggggagccagggcgagaccctgggggagaagtggaagaagaagctgaatcagctcagtcgtaaggagttcgacctgtacaagaagtccggcataaccgaggtggaccgcagcgaggccaaggaagggctgaagagaggagagaccacccaccacgccgtctcccgcggctctgccaagctccaatggttcgtggagcggaacatggtgatacccgaggggcgcgtcattgatctgggctgcgggcgtggggggtggtcctactactgcgcgggcctgaagaaggtgacggaggtgcggggctacacgaagggtggcccagggcatgaggaacccgtcccgatgagtacctacggatggaacatcgtgaagctcatgtccgggaaggacgtgttttacctgccgcccgagaaatgcgacaccctgctgtgcgacatcggcgaaagctcccccagcccgacggtcgaggagtcccgcaccatccgagtgctgaagatggtggaaccctggctgcgcaacaaccagttctgcatcaaagtcttaaatccctacatgcccacagtgatcgagcacctcgagcggctgcagcgcaagcacggtgggatgctagtgcggaacccgctctctcgcaactccacccatgaaatgtactggatcagtaacggcaccgggaacatagtcagtagcgtgaacatggttagccggctgcttctaaatcgcttcactatgacccaccgccggcccacgatcgaaaaagacgtggacctgggcgctggcacgagacacgttaacgccgaaccagagaccccgaacatggacgtcatcggggagagaatcaagcgaatcaaggaggagcactcgtccacctggcattacgacgacgagaacccttacaagacctgggcctaccacggcagctatgaggttaaggccacggggtcggcgtccagcatgatcaacggcgtggtcaaactgctcaccaagccgtgggacgtggtgcctatggttactcagatggccatgaccgacactacaccgttcgggcagcaaagagttttcaaggagaaggtggacacccgcacgccaaggcccatgccagggacgcggaaggtgatggagataaccgccgagtggctgtggaggacgctcggcaggaacaagaagccgcggctctgcactcgcgaagagtttacgaaaaaagtgcggaccaacgccgccatgggggcggtgttcaccgaggagaatcagtgggactccgcccgcgccgccgtcgaagacgaggaattctggaaattagtggacaaggagagggagttacataaactcgggaagtgcgggagctgcgtgtacaacatgatgggcaagcgagaaaaaaaactcggggaattcggcaaggcgaaggggtcacgggccatctggtacatgtggctgggcgcccgctacctcgagttcgaggcgctaggcttcttaaacgaggatcactggttcagcagagagaattcatactcaggggtcgagggtgaggggttgcacaagttaggctatatcttgcgggacatttcaaagattccagggggggccatgtacgcggatgacacggccggctgggacacgcggatcaccgaggacgatctccacaacgaagagaagatcacccagcaaatggatcccgagcaccgccaactggccaacgctatcttcaagctgacctaccagaacaaggtggtgaaagtccaacggcccaccccgaaaggtactgtgatggatatcatctcgcgcaaggaccaacggggatccggccaggtggggacttacggcctcaacaccttcacgaacatggaggcccagctggtccgccaaatggagggggagggcgtactgagcaaggcggacctcgagaacccgcacttactggagaagaaaattatccagtggctcgagacaaagggggtggagcggttgaagcgcatggcgatctcaggcgatgactgtgtcgtgaagcccattgacgaccgttttgcgaacgctctgctcgccttgaacgacatgggtaaggtccgcaaggatatcccccagtggcagccgagcaaggggtggcacgattggcagcaggtccctttttgctcccaccactttcacgagctgataatgaaggacggccggaagcttgtggtgccctgccgcccccaggatgaactgataggacgcgcgaggatcagccagggcgccgggtggtccctgaaagagacagcctgcctcggcaaagcctatgcccagatgtggagcctaatgtacttccaccgccgggatctacggctcgcgtcaaacgcgatctgctcggccgtccccgtgcactggatcccaaccagccggacgacctggtccatccacgcccaccatcagtggatgaccaccgaggatatgctgagcgtatggaaccgcgtctggatcgaggacaatccctggatggaggataaaacccccgtgacgacctgggaggatgtgccgtacctgggtaaacgggaggaccagtggtgcgggtcgttgatcggcctgacaagccgagcaacctgggctcagaacatcctgacggccatacagcaggtccggtccttgataggggacgaggagttccttgactacatgccgagcatgaagagattccggaaggaggaggagagtgagggcgccatctggtga

SEQ ID NO: 25759 - RNA, 9873 nt, synthetic construct
  misc_feature 1..9873: note = derived and/or modified CDS sequence (opt11) from DENV-3__FJ639714__SS-prME
  source 1..9873: mol_type = other RNA
accagcctgtgcttaatgatgatgctgcccgcgaccctggccttccacctcaccagccgagatggcgaaccccgaatgatcgtggggaagaacgaacgcgggaaaagcctgctgttcaaaaccgcgagcgggatcaacatgtgcacactcatcgctatggacctgggcgaaatgtgtgacgataccgtcacctacaagtgccccctgatcgcggaagtggagcccgaagacatcgactgctggtgcaacctcacctccacttgggtgacctacgggacatgcaaccaggccggcgagcaccggcgcgacaagcggtccgtggccctggcgccccacgttggcatggggctggacacccggactcagacctggatgagcgcggagggggcctggcgccaggtggagaaggtcgaaacgtgggccctccgccaccctgggtttaccatactggcgctgtttctcgcccactacattggcacctccctgacccagaaggtggtgatcttcatcctgctcatgttggtcacgcccagcatgaccatgcggtgcgttggggtgggcaaccgcgacttcgtcgagggcctgtccggggccacttgggtggatgtggtcctcgaacacggcgggtgtgtgaccacgatggccaaaagcaagcccaccctggacatcgagctgcagaagaccgaagccacccaactcgcgacactgaggaagctgtgcattgagggcaagatcaccaacatcaccaccgactccaggtgccccacgcagggcgaggcgacactgccggaagaacaggaccagaactacgtctgcaaacacacctacgtcgaccgggggtggggcaacgggtgcgggctgttcgggaaaggcagtctggtgacctgcgccaagttccaatgcttagagcccatcgaggggaaggtggtccaatacgagaacctgaagtatacggtgatcatcaccgtgcacaccggggatcagcaccaggttggcaatgacacccagggggtgacggtcgagatcacccctcaggcctccaccgtggaggccgtgctacccgaatacggcacgcttgggctcgagtgctcgccgcgcaccggacttgattttaacgagatgatcctcctgacgatgaagaataaggcgtggatggtccaccggcagtggttcttcgacctgccgctcccctggacctccggagccacgaccgagacgcccacctggaaccgcaaggagctgcttgtgaccttcaagaatgcccacgccaaaaagcaggaggtggtagtgctcgggagccaggaaggcgccatgcacaccgcgctgacgggggccactgagatccagaactccggcgggacctctattttcgccggccacctgaagtgccggctcaaaatggacaagctggagctgaagggcatgagttacgccatgtgcctcaacactttcgtgctgaagaaggaggtcagcgagacccagcacggaacgattctgatcaaggtggaatacaagggagaggatgccccgtgcaagatcccgttctccaccgaggacgggcagggcaaggcgcacaacggccgccttatcaccgccaaccccgtggtcactaagaaggaggagccggtaaatatcgaggccgaaccgcccttcggggagtccaatatcgtgatcggaatcggggacaaggcactcaaaatcaactggtacaagaagggtagctccatcgggaagatgttcgaggcgaccgcccggggcgccagaagaatggcgatactgggcgacaccgcttgggacttcgggagcgtcggcggggtgctgaactccctcggcaaaatggtgcaccagatcttcgggagcgcgtacaccgccctgttctccggcgtctcttggatcatgaaaatcgggatcggggtcctgttgacgtggataggtctgaactccaagaacacctcgatgtccttcagctgtatcgtgatagggatcatcaccctgtatctcggcgccgtcgtgcaggctgacatggggtgcgtgatcaactggaagggcaaggagctgaagtgcggcaacgggatcttcgtcaccaacgaggtgcacacgtggaccgagcagtacaagtttcaggccgactcccccaagcgcctggcgactgccatcgccggcgcatgggagagcggggtatgtggcatccgctccacaacgcggatggaaaacctcctgtggaagcaaatcgcgaacgagctaaattacatcttatgggagaacaacatcaagctgacagtcgtggtgggggacatcatcggcgtcctggagcagggcaagcgcactctcacgccccagccgatggaacttaagtacagctggaagacgtgggggaaggcgaagatcgtaaccgccgagacacagaactccagcttcatcatcgacggccccaacactcccgaatgcccctcggccagccgggcctggaacgtgtgggaggtcgaggactacgggttcggcgtcttcactaccaacatctggctgaagctgcgcgaagtgtacacccagagctgcgaccacaggctgatgtccgcggccatcaaggacgagcgcgccgtccacgccgatatgggctactggatcgaaagccagaagaatgggtcctggaagttagagaaggcctcgttcatcgaggtgaagacctgcacctggccaaagagccacacgctgtggtcgaatggcgtgctcgagtccgacatgatcatccccaaatctctggcggggccaatatcccagcacaaccacagaccgggataccacacccagacggcggggccctggcacctcggcaagctggagctggatttcaactactgcgaaggcaccacggtcgtgattgccgaaaactgcgggacccgcggcccctctctacggaccaccacggtgtcaggtaagctgatccacgaatggtgttgccgcagctgcaccctgcccccgctccgttacatgggtgaggacgggtgctggtacggcatggagatccgccccatcaacgagaaagaggagaacatggtcaagtccctggtcagcgccggctctgggaaggtggataacttcaccatgggcgttctgtgcctagccatactgttcgaggaggtaatgcggggtaagttcggcaagaaacacatgatcgcgggggtgctgttcaccttcgtccttctgctgagcggccagatcacatggcgcgatatggcccacaccctaatcatgatcggctccaatgcttcggacaggatgggtatgggcgtgacctacttggccttaatagccacctttaagattcaaccattcttggcgctggggttcttcctgcgcaagctcacgtctcgggagaacctgcttctcggcgtgggcttggccatggccaccactctgcagctccccgaggacatcgagcagatggccaacgggatcgcgctaggcctgatgaccctaaagctgattacgcagttcgagacgtaccagctgtggaccgccctcgtatccctgacttgcagcaatacgatcttcaccctgaccgttgcctggcgcaccgccaccctcatcctggccggtgtctccctcctcccgctgtgccagtcctcaagcatgagaaagactgactggctgcccatgaccgtggctgctatgggagttccgcccctgccgctgttcatcttctctctgaaggacactcccaaacgccgctcctggcccctcaacgaaggagtcatggcagtgggcctggtgtccatcctggccagctccttattgcgcaacgacgtccccatggccggcccgctggttgccggagggttactgatcgcctgctacgtgatcacggggaccagcgccgacctgacagttgagaaggctgccgatgttacctgggaggaggaggcggagcagactggtgtgtcccacaacctgatgatcaccgtggacgacgacggtaccatgcgcattaaggacgacgagacggagaacatcttgaccgtgctgctcaagacggcactgctgatcgtgagcggcatcttcccatactccataccggccactctcctggtctggcacacctggcagaagcagacccagcggtccggagtgctctgggacgtaccaagtccgcccgagacgcagaaggcagagctcgaggagggggtctatcgtatcaagcagcaagggatattcgggaagacccaggtgggcgtgggggtccagaaggaaggcgtcttccacaccatgtggcatgtcacccgaggcgctgtgctgacgcacaacgggaagagactggagcccaactgggcatcggtgaagaaggaccttatctcatacggcggcgggtggcggctgagcgcccagtggcagaaaggggaggaggtccaggtcattgccgtagagccggggaagaatccgaagaacttccagaccatgcccggcatcttccagacgacaacgggtgagatcggggccattgcactagacttcaaacccgggaccagcggctccccgatcatcaaccgggagggcaaggtggtagggctgtacggcaacggcgtggtgacgaagaacggcgggtacgtcagcggcatcgcgcagacgaatgctgagcccgacggccccacgccagagctcgaggaggagatgtttaagaagcggaacctgaccatcatggacctgcacccgggttccggaaagacccgtaaatacctccccgctatcgtgcgggaggccatcaaaaggcggctgcggaccctgatcttagcgcccactcgggtcgtcgctgcggaaatggaggaggctctgaaagggctgcccatccgctaccaaaccaccgccaccaagagcgagcacacgggacgggaaatcgtggacctcatgtgccacgcgaccttcaccatgcggctgctttcaccggtccgggttcccaactacaacctcgtgatcatggacgaggcccatttcaccgaccccgccagcatcgccgccagagggtacatctccacgcgggtgggcatgggcgaggcggccgccatctttatgacggccacgccacccggaaccgcggaggcatttccccagtccaacgcccctatccaggacgaggagcgcgacatccctgagcgctcctggaactcaggcaacgaatggataactgacttcgtcgggaaaacggtgtggttcgtaccctccatcaaagccggcaacgacatcgccaattgcctgcggaagaacgggaagaaggtcatccagttaagccgcaagacattcgacacggagtaccagaagacgcggctcaacgactgggacttcgtcgtcaccaccgatataagtgagatgggggcgaacttcaaggcagatcgcgtcatcgacccccggcgctgcctgaagcccgtgatcctgaccgacgggcccgagcgagtgatcctcgcgggcccgatgcccgtcacggccgccagcgcggcccagcgccggggccgcgtgggacgaaacccccagaaggagaacgatcagtacatattcacgggccagcctctgaacaacgacgaggaccacgcccactggaccgaggccaaaatgctgctcgacaacatcaacaccccagagggaatcatcccggccctgttcgagcctgagcgcgagaagtccgcggccatcgacggcgagtatcggctgaagggtgagagccgtaagacgttcgtcgaactaatgcggcgcggggacctgccggtgtggctggcccacaaagtggcctctgagggcatcaagtacacggaccggaagtggtgtttcgacggggagcgcaacaaccagatcttggaagagaatatggacgtcgagatctggaccaaggagggagagcggaagaagctgagaccgagatggctggacgcacgcacctatagcgaccccctggccctgaaggagttcaaggacttcgccgccggtcgcaaatccattgccctggacctcgtgaccgaaatcgggcgggtgcccagccacctggctcaccgcacccgaaacgccctagacaacctcgtcatgctgcacaccagcgagcacggcgggcgcgcctaccgtcacgccgtggaggaattacccgagacaatggagaccctccttctgctcggcctgatgatcctgctcaccggcggggccatgctgttcctcatctccgggaaggggattggcaagaccagcattgggctcatctgcgtgatcgtctccagcggaatgctgtggatggcggacgtgcccctgcagtggatagcttccgccatcgtgctcgagttcttcatgatggttctgctgatacccgagccagagaaacagcgcaccccgcaggataaccagctcgcctacgtggtgatcgggattctgaccctggcggcgatagtcgccgcgaacgaaatgggcctcctggagacgactaagcgggacctaggaatgagcaaagagccgggggtggtatctcctacctcttacctcgatgtagacctgcatcccgcatcagcctggactctgtacgcggtcgcaacgaccatcatcaccccgatgctccgccacaccattgagaactccacagccaacgtgtccctggccgcgatcgccaaccaggcggtagtgcttatgggcctcgacaaggggtggcccatcagcaaaatggacctgggcgtccccctgctcgcactggggtgctactcccaggtcaaccccctgacactcaccgccgcggtcttgctgctcgtcacccactacgccatcataggtccgggcctgcaggccaaggccactcgggaggcccagaaacgcaccgcggccgggatcatgaagaaccccaccgtcgacggcatcatgaccatcgacctggaccccgttatttacgacagcaagttcgagaagcaactcggccaggtgatgctgctggtcttatgcgctgtgcagctgctgctcatgcggacatcctgggccttgtgcgaggccctgacgctagcgaccggccccatcacgaccctgtgggaaggcagtccggggaaattctggaacacaaccattgctgtgtccatggccaacatcttccgtggctcgtacctggctggggcgggcctcgctttctccattatgaagtccgtcgggaccggaagacgcggaacaggaagccaaggcgaaacgctgggggagaagtggaaaaagaaacttaaccaactctcccggaaggagttcgacctgtacaaaaagtccggcatcacagaggtggaccggaccgaggcgaaggagggcctgaaacggggcgagaccacccaccatgcagtgtcgcgcggcagcgccaagctccagtggttcgtcgaacggaacatggttatccccgagggtcgcgtgatcgacctgggctgcgggcgcggcgggtggtcctactactgcgcgggcctgaagaaggtcaccgaggtgcggggctacaccaagggcgggcccgggcacgaagaacccgtcccgatgagcacctatggctggaacatcgtcaaactgatgtccgggaaggatgtgttttacctcccgccagagaagtgcgacactctgctgtgcgacattggcgagagctccccctcgcccaccgtggaggagtcccgcacaatccgggtactcaagatggtggagccatggctgcgcaacaaccagttctgcatcaaggtgctgaacccctatatgcctaccgtcatcgagcacctcgagcggctccagcgcaaatacggagggatgttggtgcggaatccgctcagtcgcaactccacgcacgagatgtactggatcagcaacggcaccgggaacatcgtgtcctctgtcaacatggtgtcccgattgctgctcaaccgcttcaccatgacccatcgacgaccaacgatcgagaaagacgtagacctgggcgctggcacccggcacgtgaatgccgagcccgagaccccgaatatggacgtgatcggggagagaataaagcggatcaaagaggagcacagctccacctggcattatgacgacgaaaacccctacaagacatgggcctaccatggaagctacgaggtcaaggccaccgggagcgcatcaagcatgatcaacggcgtggtgaagctgctcaccaagccctgggacgtcgtgcccatggttacccaaatggcaatgacggacaccacccccttcgggcaacagcgtgtcttcaaggagaaggtagacacccggacgccccgccccatgcccggaacccgcaaggtgatggaaattaccgctgagtggctttggagaacactgggccgaaacaagaaaccgcgcctctgcacaagagaggagttcaccaagaaggttaggaccaacgccgccatgggggccgtgttcaccgaggagaaccagtgggactccgcccgcgccgccgtcgaggacgaggagttctggaagctggtcgacaaggaacgggaactgcacaaactaggcaagtgcggtagctgcgtgtacaacatgatgggcaagcgggagaagaagctgggtgagttcggcaaggcgaaaggcagccgggccatctggtacatgtggctgggcgcacgttacctcgagttcgaggccctgggctttctgaacgaggaccactggttcagccgggagaactcatacagcggggtcgagggcgagggcctacacaaactgggctacatactgcgcgacatctccaagattcccggtggggccatgtacgcggatgacacggccggctgggacacccggatcaccgaggacgacctccacaacgaagagaagatcacccagcagatggaccccgggcaccgccagctcgccaacgccatcttcaagctgacttaccagaacaaagtcgtgaaggtgcagcggcccaccccgaagggcaccgtcatggatataatcagccgcaaagatcagcggggctccggccaggtgggaacctacgggctcaacaccttcacgaacatggaggcccagctggtgaggcagatggagggcgagggggtcctgagcaaggcggatttagagaacccccacctcctggagaaaaagatcacacagtggcttgagaccaagggtgttgagcggttaaagcgcatggcaatctccggcgacgactgtgtcgtcaagcccatcgacgaccgcttcgccaacgctctgctcgctctgaacgacatgggtaaagtccgcaaggacattccccagtggcagccctccaagggttggcacgactggcagcaggtcccgttctgctcccaccatttccacgagctgatcatgaaggacggtcggaagctcgtcgtgccctgccgcccccaggacgagctgataggccgcgcccgtataagtcagggggccgggtggtcactgaaggagaccgcctgcctcggcaaggcctacgcccagatgtggtcattgatgtacttccaccggcgggacctgcgcttggcatctaacgccatctgctcagcagtaccggtccactggatccccacgagccggacaacatggtccatccacgctcaccaccagtggatgacgacagaggacatgctgaccgtttggaacagagtgtggatcgaggacaacccctggatggaggacaagacacccgtcactacgtgggaggacgtgccgtacctggggaagcgggaggaccagtggtgtggctctctcatcgggctgacgtctcgggcgacctgggcccagaacatccttaccgcaatacagcaggtacggagcctcatcggcgacgaagaatttctggattacatgccctccatgaagagattccggaaggaggaggagacagagggggccatctggtga

SEQ ID NO: 25760 - RNA, 9873 nt, synthetic construct
  misc_feature 1..9873: note = derived and/or modified CDS sequence (opt11) from DENV-3__FJ639715__SS-prME
  source 1..9873: mol_type = other RNA
actagcctgtgcctcatgatgatgctgcccgcgaccttagcttttcacctcaccagccgggacggcgagccccgcatgatcgtcgggaagaatgagcggggcaagagtctgttgtttaagaccgcgagcggaatcaacatgtgcacactcatcgccatggacctaggcgagatgtgcgacgacacagttacctacaagtgtcccttgatcgccgaggtcgagcccgaggacatcgactgctggtgtaaccttacgagcacctgggtgacctacggcacctgcaaccaagccggcgaacacaggcgagataaacgttcggtggccctcgcgcctcacgtgggaatggggctcgatactcgcactcaaacatggatgagcgccgaaggcgcctggcgacaagtggaaaaggtggaaacgtgggccctgcgccacccgggcttcacaatcctggcgttattcctggcgcactacatcggaacctccctgacacagaaggtagtgatctttatcctgctcatgctggtcactcccagtatgaccatgcgctgtgttggcgtgggcaaccgcgacttcgttgaaggcttatctggggccacctgggtggacgtggtcctcgagcacggcggttgcgtgaccacgatggcgaagtccaaacccaccctggacatcgaactgcaaaagaccgaagccacccagctcgcaacgctgcgtaagctctgcattgaaggcaagatcaccaatataacaaccgactcccgctgcccgactcaaggcgaggccaccctcccggaggaacaggaccagaactacgtgtgcaagcatacctacgtcgaccggggttggggaaatggctgtggcctatttgggaagggtagcctggtgacctgcgccaagttccagtgcctcgaacctatcgagggcaaagtggtgcagtacgagaacctcaaatacactgtgatcatcaccgttcacaccggggaccagcaccaggtcgggaacgacacccaaggggtgacggtcgagatcacgccccaggcctccaccgtagaagccgtgttacccgagtacggcacgctcgggcttgaatgttctccacgcacaggccttgacttcaacgagatgatcctcctgaccatgaagaacaaggcatggatggtccaccggcagtggtttttcgacctccccttgccatggacctccggggccacaaccgagactccgacctggaaccgcaaggagctgcttgttacctttaaaaacgcccacgcaaagaaacaagaggtcgttgtgctcgggagccaggaaggcgcgatgcacactgcgctgacgggggccacagaaatccaaaactcaggcggcaccaacatctttgccggccacttgaagtgccggctcaaaatggacaagctggagcttaagggcatgagctacgccatgtgtctcaacaccttcgtgctgaagaaggaagtgtcggagacgcagcatggaaccatcctgataaaagtggaatacaagggagaggacgccccatgtaagattccttttagtacggaagacggtcagggcaaggcacataacggccgtctgataaccgccaaccccgtggtcaccaagaaagaggagcccatcaacattgaagccgagccgccttttggggaaagcaacattgtaatcggcatcggcgacaaggctctcaaaataaactggtacaagaagggctccagcatcgggaagatgttcgaggcaaccgcacggggcgcccgccgaatggccatactgggggacactgcatgggactttgggtcggtaggcggggtcctgaatagcctcggcaagatggtgcatcagatctttgggtccgcgtacacagccctgttcagcggagtgtcttggattatgaagattggcatcggggttttattaacctggatcggcctgaacagcaaaaacacgagtatgagcttcagttgtatagttatcgggatcatcaccctgtacttgggagccgtggtccaagcagatatggggtgcgtgatcaactggaagggcaaggagctaaagtgcggtaacgggatcttcgtcactaacgaagtccatacgtggaccgaacagtacaaattccaggccgacagccccaaaagactggctaccgccatagccggcgcgtgggaaaacggggtgtgcggaatacgctctacgacgcggatggagaaccttctctggaaacagattgctaacgagctgaactacatcctctgggaaaacaacattaagctgaccgtggtcgtgggggacatcatcggagtgctggaacaaggcaaaagaacccttacgccccagcctatggagctgaagtactcctggaagacgtgggggaaagcgaaaatagtaaccgcagagactcagaactcgtcctttatcatcgatggccccaacaccccggagtgtccatccgcttcccgtgcatggaacgtgtgggaagtcgaggactacgggtttggagtcttcacgacgaacatctggctcaagctccgcgaggtgtacactcagtcatgcgatcaccggctgatgagcgcggccataaaggacgagcgcgccgtccacgcagatatgggctactggatagaaagccagaagaacggaagttggaaactggaaaaggcctcatttatcgaggtcaagacatgcacttggccgaagtcccacacgctctggtccaacggcgtgctcgagtcggacatgataatccccaaaagcctggctggtcccatcagtcagcataaccaccgacctgggtaccatacccagaccgccggcccatggcacctcggcaagctagagttggactttaattactgcgaaggcaccactgttgtcatagccgaaaactgtgggaccagaggtccctctctccgtacgaccactgtctccgggaagctgatccacgaatggtgttgtcgctcgtgcacgctgcccccactacggtatatgggtgaggacgggtgctggtacggcatggagatacggcccatcaacgagaaggaagagaatatggtgaagtcgttggtgtcagccggctccggtaaggtagacaacttcactatgggcgtgttgtgcctcgcgatactgtttgaggaagtcatgcgggggaagttcggcaaaaagcacatgattgcgggggtgcttttcaccttcgtactgctgctgagcggccagataacgtggcgcgacatggcccacaccctaatcatgatcggctccaacgccagcgaccgaatggggatgggcgttacctacctggcattaatagccaccttcaaaatacagccgttccttgcgctaggtttctttttgcgcaaactcacgtcccgggagaacctgctgctcggcgttggtttagctatggcaacaaccctgcagctgcccgaggacatcgaacagatggccaacggaatagcgctgggcttaatgaccctaaagctgatcacgcaattcgagacttatcagctatggacggccctcgtgagtctgacttgcagcaacaccatcttcacgctgaccgtagcctggcgtactgccaccctcatcctggccggagtatctttgcttccgctgtgccagtcctcctccatgcggaagaccgactggctgcccatgaccgtcgctgccatgggggtgccccccctgcctctgttcatcttctctctaaaggacacgcccaagaggaagagctggccgctcaacgaaggcgtcatggccgtaggtctagtgtctatcctggccagctcactcctgcgcaatgacgtgcctatggccggcccgcttgtcgcgggcggcttgctgatcgcctgttacgtaatcaccgggacttcggcagacctgaccgtggaaaaggcagccgacgtcacatgggaggaggaagccgagcagacgggagtctcccacaacttaatgattaccgtggacgacgacggcacgatgcgcatcaaggatgacgagacagagaatatcctgaccgtcctcctcaagacagccctgctgatagtgtctggtatcttcccctacagcattcccgctacccttttagtgtggcacacctggcagaagcagacccagaggagcggagtcctgtgggacgtgccatccccgccggaaactcagaaagcggagctcgaggagggtgtgtaccgtatcaagcagcagggcatcttcgggaagacccaggtcggcgtaggggtccagaaagagggcgtcttccacacaatgtggcacgtgacccggggcgccgtactgacgcacaacgggaagcggctggaacctaactgggcgagcgtcaagaaagaccttatctcgtatggagggggctggcgtttgagcgcgcagtggcagaaaggagaagaggtccaagtaatagcagtggagcccggtaagaacccgaagaacttccaaaccatgcccggtatcttccagaccaccactggagagattggagccatcgctctggacttcaagcccggtacctccggcagcccgattatcaacagagaaggcaaggtggtgggactatacggcaacggggtagtcacaaagaatggtgggtatgtaagcggcatcgctcagaccaatgccgaaccagacggccccacgccagagttagaggaagagatgttcaagaaacgtaatctgactataatggacctgcaccctggatctggcaaaacccggaagtacctacccgctatcgttcgcgaggccatcaagcggcgtctgcggacccttatactcgcgcccacacgcgttgtggccgccgagatggaggaggccctgaagggactgcccataaggtaccagaccaccgccaccaagtcggagcacacggggcgcgagattgtcgatctcatgtgccatgccactttcacgatgcggctgttgtccccggtaagagtgcccaactacaacctcataatcatggacgaggcccacttcactgatcccgcctctatcgccgcacgggggtacatatccacgcgcgtcgggatgggagaagccgccgcgattttcatgaccgcaactccccccgggaccgcggaggcgttcccccagtccaacgcgccgattcaagacgaagagcgcgacatccccgagcgttcgtggaacagcggcaacgaatggattacggatttcgtaggaaagaccgtttggtttgtcccctccatcaaggctggcaatgacatcgccaattgcctgcgcaagaatgggaagaaggtaatacagttaagccggaaaacattcgacaccgaataccagaagacacgcctcaatgactgggacttcgtggtcacaaccgacatctccgagatgggagctaacttcaaagcggaccgggtgatcgacccccgccgttgccttaagcctgtgatcctgactgacggccccgagcgcgtcattctcgccgggccgatgccggtgacggcggcttctgcggctcagcgcaggggccgcgtgggtcgtaatccgcagaaagagaacgaccagtacatctttaccggacagcccctgaacaacgacgaagaccacgcccactggaccgaagccaagatgctgcttgacaacatcaacaccccggaagggattatccctgccctattcgaacccgagcgagagaagagcgcggccatcgatggagagtaccgactgaagggcgagagcaggaagacattcgtcgagctcatgcgacgcggggacctgcccgtctggctggcgcacaaggtagccagcgagggcatcaagtacactgataggaaatggtgcttcgacggggagcggaataaccagatcctagaagagaacatggacgtcgaaatctggaccaaagaaggcgagcgcaagaagttacggcctcgctggctggacgcgaggacctacagcgacccgctagccctgaaggagttcaaggatttcgccgcaggccggaagagtatcgcccttgacctcgtgaccgaaatagggcgcgtgcccagccacctggcgcacaggactcgcaatgccctggacaacctcgtgatgcttcacacttccgaacacgggggccgggcctaccgccatgccgtcgaggagctgcccgagaccatggagacgctcctactgctgggccttatgattctgctcaccggaggggccatgctgttcctcatcagcggaaaaggtatcggcaagacaagcattggactcatctgcgttatcgtgtccagcggcatgctctggatggcggacgtgccactgcagtggatcgcctccgctatagtcctcgaatttttcatgatggttctgctgatccctgagccagaaaagcagcggaccccgcaggataaccagttggcctacgtggttatcgggatcctgaccctggccgcgatcgttgcagccaacgagatgggcctcttagagaccaccaaacgcgatctgggcatgagcaaggaaccaggggtggtatcccccacgagctacctcgacgtagacttgcaccccgcttcggcctggacactctacgcggtggccacgaccgtaatcactccgatgctcagacacacgatcgagaacagcacggccaatgtgtccttggccgcgatcgccaaccaggccgtagtcctgatgggcctcgataaagggtggcccatatcaaagatggatctgggagtgcccctcctcgccctgggctgctactcccaggttaaccctctgactctcaccgccgcggtactactgctcgttacccactacgccatcattggaccgggcctacaggcaaaagccacacgcgaggcccaaaagcggactgcggccgggataatgaagaaccctaccgtggacgggataatgaccattgacttagatcccgtgatctacgattccaaattcgagaagcaattaggccaagtgatgctgcttgtcctctgtgctgtccaacttctgcttatgcgcacgtcctgggccctatgcgaggccttaaccctcgcaaccggccccataactacgctgtgggagggcagcccggggaagttctggaacaccacgatcgccgtgtccatggccaacatcttccgaggtagctacctagccggggcgggtctagccttctctataatgaaatccgtggggaccgggcgcagaggcaccgggtcccagggtgagacactcggtgagaagtggaagaagaagctcaaccagctatcacgcaaagagttcgatttgtataaaaagtccggcatcaccgaggtcgaccgtacggaggcgaaagaagggctgaagcgcggcgagaccacgcaccacgccgtgtctcggggcagcgccaagctccagtggttcgtggagcgcaatatggtcatcccagagggtcgggtgattgacctgggctgcgggcgcggcgggtggtcctactactgcgcgggcctaaagaaggtcaccgaggtccggggctacaccaagggcgggcccggtcatgaagagccggtaccgatgagcacctacggctggaacatagtgaaactcatgtccgggaaggacgtattctacctgccacccgaaaagtgcgatactctgctgtgcgatatcggcgagagctcccccagcccgaccgtggaagagagtcggacgatccgcgtgttgaagatggtcgagccctggctgcggaacaaccagttctgtatcaaggttctcaacccctacatgcctaacgtgatagagcacctcgaacggctgcaaaggaagtatggaggaatgctcgtacgcaacccgctaagccgcaacagtacccatgaaatgtactggatcagcaatgggacgggtaacatcgtcagcagcgtgaacatggtctcccgcctgctgttgaatcggttcaccatgacccaccgccggcccaccatcgagaaggacgtggacctgggcgcaggcacccgccacgtcaacgccgagcccgagaccccgaacatggacgtaatcggggagcgtatcaaacgaatcaaggaggaacacagctccacctggcactacgacgacgaaaacccatacaagacgtgggcctaccatggcagctatgaggtgaaggccacgggttccgcaagcagcatgatcaacggcgtcgtgaagctgcttaccaaaccctgggacgtcgtccccatggtgacccaaatggccatgaccgacacgacgccgttcgggcagcagcgggttttcaaggaaaaggttgacaccagaactcctcgacccatgcccggtacacgcaaggtgatggagataaccgcggagtggctgtggcggaccctgggccgcaacaagaaaccacggctgtgcacccgagaagagttcacgaaaaaagtgcgaaccaatgccgccatgggtgcagtctttaccgaagagaaccagtgggactccgcccgggccgccgtggaggacgaagagttctggaaactggtggataaggaacgcgagctgcacaagctcggcaaatgcggtagctgcgtctacaacatgatgggcaaaagagaaaagaaactgggagagtttggtaaagcgaaaggctccagagccatctggtacatgtggctcggggcccgatatctggagttcgaggccttaggcttcctgaacgaggaccattggttcagcagagagaattcctacagcggggtggagggcgaggggctacacaagctgggctacatactccgggacatctcgaagatccccgggggtgccatgtacgcggacgacacagccggttgggatactcgaatcactgaggatgacctccacaacgaggagaaaattacgcagcagatggatccagagcatcggcagctggccaacgccatcttcaagcttacttaccaaaacaaggtggtcaaggtgcagcgaccaacccccaaggggaccgtgatggacatcatctcacggaaagaccagaggggctcgggccaggtcgggacctatggcctcaacaccttcaccaacatggaggcgcagctggttcggcagatggaaggtgagggcgtgctgtccgaagccgacctagaaaatccccatctcctcgagaagaaaatcactcagtggctcgagaccaaaggggtcgagcgcttgaaaagaatggctatttcgggcgacgactgcgtagtgaagcccatcgacgataggttcgccaacgccctcctcgccctaaacgacatgggtaaggtccggaaggatatcccacagtggcagccgagtaaggggtggcacgactggcagcaggtgcccttctgctcccaccacttccacgaactgatcatgaaagacggtcgaaaactggtagtcccctgtcggccacaggatgaactgataggtcgtgcgcgaatcagccagggcgcaggatggtcactcaaagaaaccgcctgcctcggaaaggcctacgcacaaatgtggagcctgatgtatttccacagacgcgacctgaggctggcgtcgaacgccatctgtagcgctgtgccggtacactggatccccacctcaaggacgacttggagcatccacgcccaccaccagtggatgactaccgaagacatgctgacggtctggaacagagtatggatcgaggacaatccctggatggaggacaaaaccccggtgacgacctgggaggatgtcccgtatctgggcaagcgcgaggaccagtggtgcgggagcttgatcggcttaacgtcccgggcaacctgggctcaaaatattctgactgccatccagcaggtccgtagcctcatcggggacgaggagttcctggactacatgccctccatgaagcggttccgcaaggaagaggagtctgagggtgcaatctggtga

SEQ ID NO: 25761 - RNA, 9873 nt, synthetic construct
  misc_feature 1..9873: note = derived and/or modified CDS sequence (opt11) from DENV-3__KF955461__SS-prME
  source 1..9873: mol_type = other RNA
actagcctgtgcctcatgatgatgctgcccgccaccttggccttccacctcaccagccgggacggagagccgcgcatgatagtggggaagaacgaacgcggcaaaagcctgctctttaagaccgcttccgggatcaacatgtgcacgcttatcgccatggacctgggcgagatgtgcgacgacactgtcacttacaagtgccctcttatcgctgaggtcgagcccgaagacatcgactgctggtgcaaccttaccagtacttgggtgacatacgggacttgcaatcaggccggcgagcatcgacgcgacaagcggagtgtcgccctggccccccacgtgggcatggggctggacacccgcacccagacctggatgagcgccgagggcgcctggcgccaggtagagaaggtcgagacttgggctctccgccacccggggttcaccatcctagcacttttcctcgcgcactacatcggaacctcgctgacacagaaagtggttatcttcatcctgctaatgctggtcacacccagcatgaccatgcggtgcgtgggggtgggcaatcgagattttgtcgaaggcctttccggagccacctgggtggatgtggtcctcgagcacggtgggtgcgtgaccaccatggcgaagaataagcccaccctggatattgagctgcagaagaccgaggccactcaattagccacgctgcgtaagctgtgcatcgagggaaagatcaccaacatcaccaccgacagccgctgccctacgcaaggcgaggccaccctcccggaagaacaggatcagaactatgtgtgcaagcatacctacgtcgatcgggggtggggcaacgggtgcggtctgttcgggaagggctccctcgtgacctgcgctaaattccaatgcctcgagcccatcgagggcaaggtggtccagtacgagaacctgaaatataccgtaatcatcaccgtgcacaccggggaccagcatcaggtcggtaacgacacccagggggtgacggtcgagatcacgccccaggcgagcaccgtggaggccgtgttacccgagtacgggaccctgggtctggagtgctcgccgcgcaccggcctcgatttcaacgagatgatcctcctgacgatgaagaacaaggcgtggatggtacaccgacagtggttcttcgatttgcccctcccctggacctctggcgccaccaccgagacccccacctggaaccgaaaagagctattagtgaccttcaagaacgctcacgcaaaaaagcaagaggtggtcgtactcgggtcccaggagggcgccatgcatacagcactgacgggcgccaccgagatccaaaacagcggcgggacgtcgatcttcgccggtcatctaaagtgccggctcaagatggacaagctggagttgaagggcatgagctacgccatgtgcctcaacaccttcgtgctcaagaaggaggtctcagagacgcagcatggtactatactcataaaggtggagtacaagggagaggacgccccgtgtaagattcccttcagcaccgaggacgggcaaggcaaggcgcacaacggccgcctgatcaccgccaaccctgtggttacgaagaaggaagaacccgtgaacatcgaggctgagccccccttcggtgagagcaacatcgtcataggtatcggggacaaggccctaaagatcaactggtacaagaagggctcgtccatcgggaaaatgttcgaggctaccgcccggggagcccgccgtatggccattctgggcgacactgcgtgggactttggatcggtgggcggggtgctgaacagtctcggcaaaatggtgcaccaggtatttggatccgcgtataccgcactgtttagcggcgtgtcctggatcatgaagattggcatcggagtgctgctcacgtggatcggcctgaacagcaaaaacacatccatgtcgttctcctgcatcgtcatcggaatcatcactctgtacctcggtgctgttgtgcaggccgacatgggttgcgtaattaattggaagggcaaggagctgaagtgcggcagcggaatcttcgtgaccaacgaggtgcacacgtggaccgagcagtataaattccaagccgactcccccaagcgcctggcgactgccatcgcaggcgcatgggagaacggggtctgcggtatccgcagcactacgcggatggaaaacctcctttggaagcagatcgctaacgagctgaattacatcctctgggagaacaacatcaaactgacagtggtggtcggggacattatcggcgtgttggaacagggcaaacgaaccctcacgccccagccgatggagctgaagtactcctggaagacttgggggaaggccaagatcgtgaccgccgagacccaaaacagcagcttcatcatagacggccccaacacccccgagtgccccagcgcctccagggcctggaacgtctgggaagtggaggactacgggttcggcgtgttcacaaccaacatctggctgaagctgcgtgaggtctacacccagagctgtgaccaccggctaatgagcgccgccatcaaagacgaaagggccgttcacgccgacatgggttactggatcgagtcacagaaaaacgggagctggaaactggagaaagcctccttcatcgaggtcaagacatgcacttggccaaagtcacacacgctttggtccaatggcgtcttggagtccgatatgattatccccaagagtctggcgggacccataagccagcacaaccaccggccggggtaccacacccagacggccgggccctggcacctcggcaagctggagctggacttcaactattgtgagggcacgacggtggccataaccgagaactgcggcacgaggggcccctcactccggaccacgacagtgagcggcaagctgatccacgagtggtgctgccgctcctgcaccctaccgccactccgatacatgggcgaggacggatgctggtacgggatggagatccgccctatcaacgagaaggaagagaacatggtcaagagcctagtgtccgcaggttccggaaaggtggacaactttaccatgggagtattatgcctagccatcctgttcgaggaagtaatgcggggaaagttcgggaagaaacatatgattgcgggggtgctgtttaccttcgtcctcctactgtcaggccagatcacctggcgggacatggcccataccctcatcatgatcggcagtaatgcctcagaccgcatgggcatgggcgtgacttacttagccctgatcgctacgttcaagatacagcccttcctcgcgctggggttcttcctgcgcaagctcaccagccgggagaacctgttgctcggcgtgggcctggccatggccaccaccctgcagctccccgaggacatcgagcagatggccaatgggatcgccctgggcctgatgacgctcaagctgattacccagttcgaaacctaccagttgtggaccgccctcgtctcgctgacttgcagcaataccatcttcaccctgaccgtggcctggcgcacggccaccctcatactggccggagtcagccttctccccctgtgccagtcgtcttcaatgcggaagaccgactggctgcccatgaccgtggcggccatgggggtgccgcccctcccgctgttcatcttcagcctgaaggacacgcccaagcgccgctcctggcccctaaatgagggggttatggccgtgggcctggtgagcatactggcctccagcctcctcaggaacgacgtcccaatggccggcccgctggtagccggcgggttgctaatcgcttgctacgtaatcaccgggacctccgccgacctgaccgtcgagaaggctgccgacgtgacctgggaggaggaagcggagcagaccggggtgagccacaacctcatgatcaccgtcgacgacgatggtaccatgcgcatcaaggacgacgagacggagaacatcctgacagtgctgctcaagactgcactgctgatcgtctccggcattttcccgtacagcatcccggccaccttactggtctggcacacctggcaaaagcaaacgcagcggtccggggtgctatgggacgtgcccagcccacccgagacccaaaaggccgagctcgaggagggcgtataccgcatcaaacagcaggggatcttcgggaagacccaggttggcgtgggagtacaaaaagaaggcgtgttccacaccatgtggcacgtaacgcggggcgccgttctgacacataacgggaagcgcctggagcccaactgggcgagcgtgaagaaagatctgatcagctacggcgggggctggcggctttctgcccagtggcagaagggggaggaggtgcaggtcatcgccgtagagcccggaaagaaccccaaaaactttcagaccatgcccggcatcttccagaccacaactggcgagataggcgccatcgccctggacttcaagcccgggactagtggcagtccgatcatcaaccgcgagggcaaggtggtcggcctgtacggcaacggggtggtgaccaagaacggcgggtacgtctccggcatcgcccagaccaacgccgagcccgacggtcctacccccgaactcgaggaggagatgttcaagaagcggaacctgactatcatggacctgcaccctgggagtggcaagacccgcaagtacctcccagccatcgtgcgagaagccattaagcggcggctgcgtacactgatccttgcgcccacacgggtggtcgccgcagagatggaggaagcccttaaggggctccctatacgctaccagaccaccgccacgaaatccgagcacacgggccgggagatcgtggaccttatgtgtcacgcgaccttcaccatgcgcctgctgagcccggtgcgcgtccccaactataacctcgtgattatggacgaggcacacttcacagaccccgcatccatcgccgcgcgcgggtacatatccactcgggtcggcatgggcgaggcggccgccattttcatgaccgccactccgcccgggacggcagaggcctttccccagtccaacgcccccatccaggacgaggagcgcgacatcccggaacgcagctggaactcaggcaacgagtggataacggatttcgtcgggaagactgtctggttcgtgccctccatcaaggccgggaacgacatcgccaattgcctgcggaagaatgggaagaaggtaatccagttatcacgaaagaccttcgacacggaataccagaagaccaggttaaacgactgggacttcgtggtgactacggacatcagcgagatgggcgcgaacttcaaggccgaccgcgtcatcgaccctcggcgctgtctgaagccagtgatcctgacggatgggcctgagcgggtgatcttggccggcccgatgcccgtcaccgccgcttcggccgcccagcgtcggggccgcgttgggcggaacccccagaaggagaacgaccaatacatctttacgggccagcccctgaacaatgacgaggaccacgcacactggaccgaggccaagatgctgcttgacaacatcaatacaccggaggggatcatccccgcgttatttgaacctgagcgcgagaagtcagcggctatcgacggcgagtaccggctgaaaggagagtctcgcaagacgttcgtagaactcatgcggcgcggcgacctgcccgtgtggctggcccacaaggtggcaagtgagggcatcaagtacaccgatcggaagtggtgcttcgacggggagcgcaataaccagatcttagaagagaacatggacgtcgaaatttggaccaaggagggcgaacggaagaaactgcgcccgcgctggctggacgcgcggacctactccgacccccttgccctgaaggagttcaaggactttgcagcaggccgcaaaagcatcgccctggatttggtaacggagatagggcgggtaccttcccacctggcccatcggacccgcaacgcactcgacaacctcgttatgctgcacaccagcgagcacggcgggcgggcttaccggcacgcggtggaggagctgccggagaccatggagacgttactgctgcttggactgatgatcctgctcaccgggggcgcaatgctgttcctgatcagcggcaaggggatcggcaagacctccatcgggctcatctgcgttattgtaagctccggcatgctgtggatggcggatgtgccccttcaatggatcgccagcgccatcgtgctagagttctttatgatggtcttgctgatccccgagcccgagaaacaacgcactcctcaggacaaccaactcgcctacgtggttatcgggatcctgacgctggccgcgatcgtcgccgccaacgagatgggcctactggagaccactaaacgggacctcggcatgagcaaagagcccggggtggtttcgcccactagttacctcgacgtcgacctgcatcccgccagtgcctggaccctgtacgcagtggccaccaccgtgatcaccccaatgctccgccacacgatcgagaattcgaccgccaatgtttcactggcagctatcgccaaccaagctgtggtgctaatgggcctcgacaaggggtggcccatttccaaaatggacctgggtgtcccccttctcgccctggggtgctacagccaagtaaaccccttgaccctcaccgccgcggtgctgctgctcgtcacgcactacgccattatcggcccgggcctccaggcgaaagccacccgggaggcgcagaagcgcaccgcggccgggattatgaagaaccccaccgtggacggcatcatgaccatcgacctggaccccgtcatctacgactccaagttcgagaagcagctcggccaggtgatgctgctggtgctctgcgccgtgcagctgctgctcatgagaacgagctgggccctttgcgaggcactaaccctggctaccggtcccatcacgaccttatgggagggctctccgggtaagttctggaacaccaccatcgccgtcagcatggccaatatctttcgcggctcctatctggcaggggcgggtctcgccttcagcatcatgaagtcagtggggacgggccggcgcggcacgggtagccagggcgagacactgggggagaagtggaagaagaaactcaaccagctcagccggaaggagttcgacctgtacaagaagagcggcattacggaggtggacaggaccgaagccaaggaggggctaaagcggggagagacgacccaccacgccgtcagccgcggctccgccaagctccagtggttcgtggagcggaacatggtgatccccgagggtcgcgtgatcgacctgggctgtgggcgcggcgggtggagctactactgtgctggcctgaagaaagtcaccgaggtgagaggatacaccaagggcggcccggggcacgaggaacccgtcccaatgtccacgtatggctggaacatcgttaagctaatgagcgggaaggacgtgttctacctgccacccgagaaatgcgacaccctgctgtgcgacatcggcgagtcaagcccctccccgaccgtcgaagagagccgcaccatccgggtgctgaagatggttgagccctggctgaagaacaaccagttctgcatcaaggtcctgaacccctacatgcccaccgtgatagagcacctcgagcgcttacagcggaagtatggtggtatgctggtgcgcaatcctctctccagaaactctacccacgagatgtactggatctccaacggcaccgggaacatagtaagctccgttaacatggtcagccgcctgttactcaatcggttcactatgacgcatcgaagacccaccatcgagaaggacgtggacctgggagccggcacacgccacgtgaacgctgagcccgagaccccgaacatggacgtcatcggggagaggatcaagaggatcaaggaagagcactccagcacatggcactacgacgacgagaacccctacaaaacgtgggcctaccacggatcatacgaggtgaaggccaccgggagcgcgagctctatgatcaacggggtggtcaagctcttgaccaagccttgggacgtggtgcccatggtcactcaaatggccatgaccgacacgactccgttcgggcagcaacgggtgttcaaggaaaaagttgacacgcgcactccacggcccatgcccggcactcgcaaggttatggagatcaccgccgagtggctgtggcggacgctggggcgcaacaaaaagcctcgcctgtgcacgcgggaggaatttaccaagaaagttagaacgaacgccgccatgggcgcggtgttcacggaggagaaccagtgggactccgccagagcggctgtcgaggacgaggagttttggaaactggtggaccgcgagcgggaactacacaagttgggcaagtgcggctcctgcgtctacaacatgatgggcaagcgcgagaagaagcttggtgagttcggcaaggcgaagggtagccgggctatttggtatatgtggctgggggcccgctatctcgagttcgaggccttaggcttcctgaacgaagaccactggttttcccgggagaactcctacagcggggtcgagggtgaggggctccacaaattgggctacatcctccgcgacattagcaagattcccggcggggccatgtacgcggacgacaccgccggctgggacacacggatcaccgaagacgacctccacaatgaggagaagattacccagcagatggacccagaacatcgccaactggcgaacgccatatttaaattaacctaccagaataaggtggtgaaggttcagcggcccaccccgaagggcaccgtgatggacatcatttcccgcaaggaccaacggggcagcggacaggtgggcacctacggcctcaacacgttcaccaacatggaggcccagctcgtccgccaaatggagggtgagggcgtgctgtccaaggcggacctcgagaacccacatcagctggagaagaagataacacagtggctggagaccaagggggtcgaacggctcaagcgcatggccatcagcggcgacgactgcgtcgtgaagccgatcgacgaccggttcgccaacgccctcctggctctcaacgacatgggcaaggtgcgaaaggacatcccccagtggcagccgtccaaagggtggcacgactggcagcaagttcccttctgtagccaccacttccatgagctgatcatgaaggacggcagaaaactggtggtgccgtgccgcccgcaggacgagctcatcggacgagcgcggatctcccagggtgcgggctggagcctgaaggagacggcatgcctgggcaaggcctacgctcaaatgtggtccctcatgtatttccaccgcagagacctgcgcctcgcgagcaacgccatctgctccgccgtcccggtacattggatccccacgagccggaccacatggagcattcacgcccaccaccagtggatgacgactgaggacatgctcaccgtgtggaacagggtctggatagaggataacccctggatggaggacaagacccccgtgacgacctgggaggacgtgccttaccttggtaagcgggaggatcaatggtgcgggagcctgataggcctcaccagccgagccacatgggctcagaacatcctgacagcgatacagcaggtcagatcccttatcggggatgaggaattcctcgactacatgccatccatgaaacgcttccggaaggaggaagagtccgaaggcgccatctggtga

SEQ ID NO: 25762 - RNA, 9873 nt, synthetic construct
  misc_feature 1..9873: note = derived and/or modified CDS sequence (opt11) from DENV-3__FJ639719__SS-prME
  source 1..9873: mol_type = other RNA
acaagcctgtgcctcatgatgatgttgcccgcaaccctagccttccaccttaccagccgagatggggaaccccggatgatcgtagggaagaacgaacggggcaagagcctgctattcaagactgccaccgggattaacatgtgcactctcattgccatggacctgggcgagatgtgcgacgacaccgtgacttacaagtgccccctcatcgccgaggtggagcccgaggacatcgactgctggtgcaacctcacgtccacctgggtgacatacgggacctgcaaccaggccggcgaacacagacgcgacaagcggagcgtcgcacttgcgccccacgttggcatggggctggacacccgcacccagacgtggatgtccgctgaaggggcctggagacaggtggaaaaggtcgagacctgggctctccgccaccctgggtttaccatcctggccttattcctcgcccactacatcggcaccagcttgattcagaaggtggtgattttcatccttctcatgctggtaacgccctccatgaccatgcggtgtgtgggggtggggaaccgcgactttgtcgaagggctcagcggggcgacttgggtggacgtggtcctcgagcacggagggtgcgtcaccacaatggccaagaacaagcccacactagacatcgagctgcagaagacagaggccacccagttagcgacgttacggaagctctgcatcgagggcaagatcaccaacataaccaccgactcccgctgccccacgcagggggaggctatccttccggaagaacaggaccagaactacgtgtgcaagcacacctatgtcgaccgggggtggggtaacgggtgcggcctgttcgggaagggttccctggtgacctgcgctaagttccagtgcctcgaacccatcgagggcaaggtggtccagtacgagaacctgaagtacaccgttatcattactgtgcacaccggtgaccagcaccaggtcgggaacgatacccaaggggtgaccgtcgagatcacgccccaggcatccacggtcgaagccgtgctgcccgaatacgggacgctagggctggagtgcagcccgcggaccggcttagacttcaacgagatgatccttctgactatgaagaacaaggcgtggatggtccatcggcagtggttcttcgacctaccccttccctggacgtctggcgctaccaccgaaacgcccacgtggaatcgcaaggaactccttgtaaccttcaagaacgcgcacgccaagaagcaggaagtcgtcgtgctcgggtcccaggagggcgccatgcacactgcgctgacgggggccacggaaatccaaaactccggcggaacgtccatcttcgctggccacctcaagtgtcgcctcaagatggacaagctcgagctgaaaggcatgtcgtacgccatgtgtttaaacaccttcgtgttaaagaaagaggtcagcgagacccagcacggtacaatcctgataaaggtggagtacaagggcgaggacgccccgtgcaagatccccttctcaaccgaagacggccaaggcaaggcgcataatggccggctgataaccgctaaccctgtggtaactaagaaggaggagcctgtgaacatcgaggccgagccgccgttcggtgaaagcaacatcgtgatcggtatcggagacaaggccctcaagatcaactggtacaagaagggctctagcattgggaagatgtttgaggcgacggcacggggcgcccgcaggatggccatcctgggcgataccgcctgggacttcgggtcggtcggaggggttctgaacagtctcggaaagatggtgcatcaaatttttggcagcgcgtacacggccttgttttctggcgtcagctggatcatgaaaatcggtatcggggtgcttctcacgtggatcggcctgaactccaagaatacgagtatgtccttctcctgcatcgtgatcgggatcataaccttatacttgggcgccgtcgtccaggcagacatggggtgcgtgatcaactggaagggcaaggaactgaagtgcggctccggcatctttgtgaccaacgaggttcacacctggacggagcagtacaagttccaggccgacagcccgaagcgcttggcgacagccatcgccggcgcgtgggagaacggggtgtgtggcatccgctccaccactcgcatggagaaccttctgtggaagcaaatcgctaacgagctgaactacatcctatgggagaacaacatcaagctgacggtcgtggtcggggacatcataggcgtcttagagcaaggcaagcgcaccctcacgccccagccgatggagctcaagtactcttggaaaacctggggcaaggccaagatcgtgacggcagagacccagaactccagcttcatcatcgacggccccaacacccccgagtgcccctccgcctcgcgggcttggaacgtgtgggaggtagaggactacgggttcggtgtcttcaccaccaacatttggctgaagctccgcgaggtgtacactcagtcctgcgaccaccggctgatgtccgcggccatcaaggatgagcgcgccgtccacgccgacatgggctactggatcgagtcgcagaagaacgggtcctggaagctggagaaggccagcttcatagaagtgaagacgtgtacatggccgaaatctcatacactctggagcaacggtgtcctggagtccgacatgatcatccccaagagcctcgccgggcccatctcccagcataaccacaggccgggctaccacactcaaaccgccggcccctggcacttaggcaagctagagttggatttcaactactgcgagggaaccaccgtcgtgatcactgaaaactgcgggacccgtgggccgtccttacgtaccaccacagtgagcggcaagctgattcacgaatggtgctgccgcagctgcaccctgcccccgttgcggtatatgggcgaggacgggtgctggtacggcatggagatccgcccgatcaacgagaaggaagagaatatggtcaagtccctggtgtcagccgggtccgggaaagttgacaacttcactatgggcgtcctgtgtctcgcgatcctctttgaggaggtaatgcgggggaagtttgggaagaaacacatgatcgccggggtgctgtttactttcgtcctcctgctgagcggccaaatcacgtggcgcgatatggcgcacaccctcataatgattggttccaacgccagcgaccgcatggggatgggcgtgacccacctggccctgatcgccaccttcaagattcagccgttcctcgccctagggtttttccttcgcaaacttacgtcgagagagaatctgctgctaggcgtcggactggcgatggccaccaccctgcaactccccgaagacatcgagcagatggccaacgggatcgccctggggttgatgaccctcaagctgatcacccagttcgaaacataccagctgtggacagcgctcgtctccctaacctgttcgaacacgatcttcaccctgacagtggcctggcgcacagccaccctcatcctggcgggggtctccctcctcccgctgtgccaaagcagctccatgcgtaagacagactggctgcccatgacggtggccgctatgggagtgccgcccctgccgctctttatcttttcgctaaaggacacccccaagcggcgcagctggccgttgaacgagggggtcatggccgtggggttggtatcgatcctggcctcttccctcctgcggaacgacgtccccatggctgggccgctggtggccgggggtctcctgatcgcgtgttacgtgatcacgggtacctccgccgacctaaccgtcgagaaggcagccgacgtcacctgggaagaagaggccgagcagacgggcgtgtcccacaacctcatgataaccgttgacgacgatgggactatgcgtatcaaggacgacgaaactgaaaatatcctgactgtgttactcaagacggcgctgctgatcgtaagcggcatcttcccatattccatccctgcaactctcctggtgtggcacacctggcagaagcagacccaacggagcggagtgctgtgggacgtgccttccccgcccgagacgcagaaggccgagctcgaagaaggggtctaccgcatcaagcaacagggaatattcgggaagacacaggtgggtgtcggagtgcaaaaggagggggtgttccacaccatgtggcacgtgacccgtggtgccgtcctgacgcataacgggaagcggctggagcctaattgggcaagcgttaagaaggatctcatctcctacggcggcggctggagactgagcacccaatggcagaagggggaggaggttcaggtcatagcggtcgagcccggcaagaacccgaaaaacttccagaccatgcccgggattttccagactacgacgggagagattggcgccatcgcccttgacttcaagcccgggacctccggcagcccgatcattaaccgcgagggcaaggtagtcgggctgtacggcaatggcgtggtgacaaagaacggagggtacgttagcggcatcgcccagaccaacgccgagcccgatggccccacgccggaactcgaggaggagatgttcaagaagcggaacctcacgatcatggacctgcatccggggtccggtaagacccggaagtacctgcccgctatagtgcgggaagccatcaagcggcggctgcgcacgctgatcctcgcccccacccgggtggtcgccgcggaaatggaggaggcgctaaaggggctgcccatccgctatcagacgacagcaaccaagagcgagcacacgggtcgtgagatcgtggacctcatgtgccacgcaaccttcaccatgcgcctcctgtccccggtgcgtgtccccaactacaatctcataataatggacgaagcgcactttacggacccagcatcaatagccgccagggggtacatcagcaccagagtggggatgggcgaggccgccgccatctttatgaccgcgacgcccccaggcactgccgaggcctttccccaatccaacgcgccaatccaagatgaggagagagatattcccgagcgctcctggaacagcggcaatgagtggataacagactttgtggggaaaaccgtttggttcgtgccctcaatcaaggccggcaacgacatcgccaactgcctgcggaagaacgggaagaaagtaatacagttgagccggaagacattcgataccgagtaccagaagacccggctcaacgactgggacttcgtcgttaccaccgacatttccgagatgggcgctaacttcaaggccgatcgcgtgatcgacccccggcgctgcctgaagcctgtcatactcactgacggcccggagagggttatcctcgcggggccgatgcccgtgacggccgctagcgctgcccagcgtcggggccgcgtggggaggaacccacaaaaggagaacgaccagtatatctttaccggccagccgctgaacaacgatgaggaccacgcgcactggaccgaggccaagatgttactcgacaacatcaacaccccggaagggatcatcccggcccttttcgagccagaacgcgagaagtccgccgcgatagacggcgagtaccggctgaagggcgagagccgtaaaacctttgtggaactgatgcgtcgcggggacctgccagtctggctggcacacaaggtggcctccgagggcatcaaatataccgaccggaagtggtgctttgacggggaacggaataaccagatcctcgaggagaacatggacgtcgagatctggaccaaggagggcgagcggaagaagctgagaccgcgctggttggacgcgaggacgtacagcgacccccttgcactgaaagagttcaaggacttcgcggccgggcgcaaatccatcgccctggacttagtcacggagattgggagggtgcccagccacctggctcaccgcacgcggaacgccctggacaatctcgtgatgttgcacacttccgagcacggaggtcgcgcgtatcgtcacgccgtcgaggaactgccggagaccatggaaacgctcctactgctcggcctcatgatcctgctcactggtggcgccatgttattcctggttagcggtaaaggtataggcaagactaccatcgggctcatctgcgtcatagtcagctccgggatgctgtggatggccgacatccccttgcagtggatcgctagcgccatcgtactcgagttcttcatgatggtgctgctgatccccgagcccgagaagcagcgcactccccaggacaaccaactcgcttatgtcgtcattgggatcctgaccctggctgcaatcgtggccgcgaacgagatgggccttctggagactaccaagcgggacctgggcatgtccaaggaacccggggtcgtgtcacccacgtcctacttggacgtggacttgcacccagccagcgcctggaccctgtatgccgtcgcgaccaccgtgatcacgccaatgctaaggcacaccatcgagaactccacggcgaatgtaagcctcgccgcgatcgcaaaccaggctgtcgtgctgatgggactcgacaaggggtggcctatctccaagatggacctcggagtacccctgctcgcgctggggtgttactctcaggtcaatcccctgaccctcacggccgccgtactactgcttgtgacgcactatgccatcatcgggcccggcctgcaggcgaaggccacccgtgaagcccagaagagaaccgcggcagggatcatgaagaaccctacggtggacggcatcatgaccatagacctggaccccgtgatctacgactccaagttcgagaaacaactcggccaagtgatgctgctggtcctctgcgcggttcaattactgctcatgaggacctcctgggccttgtgcgaagccctcacgctcgcaacgggccccatcaccaccctgtgggaggggtcccccggaaagttctggaatacgacgattgccgtttcaatggcaaacatcttccgcggctcctacctggccggtgccggactcgcgttctcgatcatgaaatccgttggtaccggccggcggggcacaggtagccagggagagacgctgggagaaaagtggaaaaagaaactgaaccaactctcccggaaggagttcgacttgtacaagaagtccggtattaccgaagtcgacaggactgaggcgaaggaggggttaaagcggggcgagaccacccatcacgccgtcagccgcggctccgcaaaacttcaatggttcgtagagcggaacatggtcatccccgaggggcgcgtgatcgatttaggctgcgggaggggcgggtggagctattactgcgccggactgaagaaggtcaccgaggtgagaggctatacgaaaggagggccagggcacgaggagccggtgcccatgtccacatacggctggaacatcgtcaagctaatgagtgggaaggacgtgttctacctgccacccgagaagtgcgacaccctgttgtgcgatatcggcgagagtagcccgtcccccactgtggaggagagccgcaccatccgagtcctcaaaatggtggagccatggttgaagaacaaccaattctgtatcaaagtgctgaacccctacatgccgacagtcatcgagcacctcgagcgccttcagcggaagtacggcgggatgctggtacgcaatccgctctctcgaaacagcacccacgagatgtactggatctccaacggcacggggaatattgtgtcgtccgttaatatggtgagccggctgctgctcaacagattcacgatgactcaccgaaggcccacaatcgagaaggacgtcgacctgggcgccggaactcgccatgtaaacgcagagcccgagacgccaaacatggacgtgatcggggagcggataaaacgcatcaaggaggagcactccagcacttggcactacgacgacgaaaacccctataagacctgggcctaccacgggtcctacgaagttaaggccaccggtagcgcgtcctccatgataaacggcgtagttaagctgctcaccaagccctgggacgttgtgccaatggtgacccaaatggcgatgaccgacaccacgccgttcggccagcaacgggtcttcaaggaaaaggtcgatacccgcacgccccggcctatgcctggcacacgcaaagtcatggagatcactgctgagtggctctggcggaccctgggcagaaataagaaaccgcgcctctgcacccgggaggagttcacaaagaaggttcgcacgaacgccgccatgggtgccgttttcacagaggaaaaccagtgggactctgcccgggcggccgttgaggacgaggagttctggaagctggtcgaccgcgagcgggaactgcacaagctcgggaagtgcgggagttgcgtgtacaacatgatgggcaagcgggagaagaagctgggcgagtttggcaaggccaaaggcagccgggcgatttggtacatgtggctgggggcgcggttcctcgagtttgaggccctggggttcctgaatgaggatcactggttttctcgggagaacagctactccggggtggagggcgaagggctccacaagctcggttacatcctgcgcgacatcagcaagatacccggcggggccatgtacgccgacgacaccgccggatgggatacgagaattacggaagacgacctccacaacgaggagaaaattacccagcaaatggaccccgagcaccgccaactggcgaacgcaatctttaaacttacataccagaacaaggtcgtgaaggtgcaacgacccaccccgaaggggaccgtaatggatattatctcccgcaaggaccagcggggctctggccaggttgggacctacggactcaataccttcaccaatatggaagcccagctggtgaggcaaatggagggggagggagtcctctccaaagcagatctcgaaaacccccatctcctagaaaagaagatcacccagtggctcgaaaacaagggagtagagcgcctgaagcggatggccatctccggcgacgactgtgtcgtgaagccgatagacgaccggttcgcgaatgccctactcgcactgaacgacatgggcaaagtgcgcaaggatatcccccagtggcaaccgtccaagggttggcacgactggcaacaggtccctttttgcagtcaccatttccacgagctgatcatgaaggacggccgtaagctcgtcgtgccctgccgcccgcaggacgagcttatcgggagagcacggatctcccagggtgccgggtggagcctgaaagagacggcttgcctcggaaaagcctatgcccagatgtggtctctgatgtacttccatcggagagacctgagactcgccagcaacgcgatatgctcagctgtgcctgtccactgggtgcccaccagccgaaccacctggtctattcacgcacaccaccaatggatgacaaccgaggacatgctgactgtgtggaaccgcgtctggatcgaggataacccctggatggaggacaagacgcccgtgactacttgggaggacgtaccgtatctgggcaagcgggaggaccaatggtgcgggagcttgatcggactaacttcgcgcgccacctgggcgcagaacattttaacggcgatccagcaagtcaggtccctcataggagacgaagagttcctggattacatgccgagcatgaaacgctttaggaaggaggaggagagcgagggcgcgatctggtag

SEQ ID NO: 25763 - RNA, 9873 nt, synthetic construct
  misc_feature 1..9873: note = derived and/or modified CDS sequence (opt11) from DENV-3__KF955332__SS-prME
  source 1..9873: mol_type = other RNA
acctctttgtgtctgatgatgatgctgccagcgaccctagcgtttcacttaaccagcagggacggtgagccccggatgatcgtcggtaagaatgaacggggtaagtcactgcttttcaaaacggctaccgggatcaacatgtgcacgctgatcgccatggaccttggcgaaatgtgcgacgatacggtcacctacaaatgccctttaatcgccgaggtagagccggaagacatcgactgttggtgcaacctcaccagtacctgggtgacgtacggtacctgcaaccaggcgggggagcacaggcgcgataagcggagcgtcgccctggccccgcatgtggggatgggactagatacccgcacccagacgtggatgagtgccgagggcgcctggaggcaggtggagaaggtcgaaacctgggcgctgcgtcacccggggttcacgatcctggctctgttcttagcccactatatcggcacgagcctgatccagaaagtggtgatcttcattctgctgatgctggtcactccatccatgaccatgcggtgcgttggcgtcggaaacagggacttcgtcgagggcctgagcggggccacctgggttgacgtggtcctcgagcacggtgggtgcgttaccacgatggccaagaacaagccaaccctggacatcgaactgcagaagacagaggcgacccagttggcgacactgagaaagctatgcatcgagggcaagatcaccaatatcaccaccgactcaaggtgccccacgcagggggaagcgatcttacctgaagaacaagaccagaattacgtatgtaagcacacatacgtcgaccgggggtgggggaacgggtgcggcttgttcgggaaaggctcactggtcacatgcgccaaatttcagtgcctcgagcccatcgaaggaaaagtggtccagtatgagaatcttaagtacacagtgataatcacggtacacaccggtgatcagcaccaggtcggcaacgatacccagggggttaccgtcgagatcacgccacaggcgtccaccgtggaggctgtgttgccggagtacggcaccctaggtctggagtgcagcccgcggaccggcttagacttcaacgaaatgatcctcttgactatgaagaacaaagcctggatggtccatcggcaatggttcttcgacctgcctcttccctggacctccggcgccacgacagagacacccacctggaaccgcaaagagctgttagtgacattcaagaacgctcatgctaaaaaacaggaggtggtcgtgctcggaagccaggagggcgccatgcataccgcgctgaccggggccacggagatccagaacagtggaggtaccagtatcttcgccggccacctaaagtgccggttaaagatggataagctggaactgaagggcatgtcctacgcaatgtgtttgaacacttttgtgctaaaaaaggaagtcagcgaaactcagcatgggacaatcctcatcaaggtagagtacaagggcgaggacgcgccgtgcaagatcccgttctccaccgaggacgggcagggtaaggcgcacaatgggcgcctgatcaccgccaaccccgtggtcaccaagaaggaggagcccgtcaacatcgaggccgagccgccctttggggagagtaacatcgtgatcgggatcggagacaaggccctcaagatcaactggtataagaagggcagctctatcgggaaaatgttcgaggcgactgcacggggtgctcgccggatggccattctaggggatacggcctgggacttcgggtccgtcggcggggtgctgaactccctcggcaagatggtgcaccaaattttcggtagcgcgtacaccgccctcttctccggcgtcagctggatcatgaaaatcggcatcggagtgctgctcacctggatcggcttgaacagtaagaacacgagtatgtccttcagctgcatcgtgatcgggataataaccctgtatctgggagccgtcgtgcaggctgacatggggtgcgtgatcaactggaaggggaaggagctgaagtgcggctccggtatcttcgtaaccaatgaggttcacacttggacggagcagtataagttccaggccgacagcccaaagcgcttagcgaccgccattgccggcgcctgggagaacggggtctgtggcatccgtagcaccacccggatggagaacttgctgtggaagcaaatcgccaacgagcttaactacatcctctgggagaacaacatcaagttgacagttgtggtgggggacataatcggcgtcctggaacaaggtaagcgtaccttgacgccacagccgatggagctgaagtacagctggaagacctgggggaaggcgaagatcgtaacggccgagacacagaactccagcttcatcatcgacggccccaacactcccgagtgccccagcgcctctagagcctggaacgtgtgggaggtagaggactacggattcggtgtgttcacaacgaacatctggctgaagctcagggaggtgtacacgcagtcctgcgaccaccggctgatgagcgcggcaatcaaggacgagcgcgcagtacacgccgatatggggtactggatcgagtcgcaaaagaacgggagttggaagcttgaaaaggccagcttcatcgaggtaaagacctgcacctggccgaagagtcacaccctctggagtaacggagtgttagaatcggacatgatcataccaaagtccttagcggggccgataagccagcacaaccatcggcccggctaccacactcagaccgccggtccctggcacctcggcaagctagaactggactttaactattgtgagggaaccacggtggtgatcacggagaattgcgggacccgcggcccgagcttacgtaccacgacggtgtccggtaagctgatacacgagtggtgctgtcgctcctgcaccttgcccccgctccggtacatgggcgaagacgggtgctggtatggaatggagattcgccccatcaacgagaaggaggagaacatggttaagtccctcgtgagcgcaggatccgggaaggtagacaacttcacaatgggcgtactgtgcctcgccatcctattcgaagaggtgatgcgcgggaaattcggcaagaagcatatgatagccggcgtactgttcaccttcgtcctcctgctgtccgggcagatcacgtggcgcgacatggcgcatacgctcataatgatcggctcgaacgccagcgaccggatggggatgggcgttacctacctggccctgatcgccaccttcaagatccaacccttcctcgctctggggttcttcctgcggaagctcacatcccgggaaaacctactgctcggggttggcttagccatggccacgacgctgcaactacccgaggacatcgagcagatggccaacgggatcgccctaggcctgatgacgctcaaactcataactcaatttgagacctaccaactgtggaccgccctcgttagcctgacttgctcaaacacgattttcactctgaccgtggcctggagaaccgccacgctcatcctggccggggtcagcctactcccgctgtgtcagtcatccagcatgcggaagaccgattggctgccaatgaccgtggccgcgatgggtgtgccgccactgcccctgttcatctttagcttgaaggacgctcccaaacgccgctcatggcccctcaacgagggggtcatggccgtgggccttgtctccatcctggccagctcactcttgcggaacgacgttccgatggccggtccgctagtggctggcggcctcctaatcgcttgctacgtaatcacagggacgtctgccgatctaactgttgagaaggccgccgacgtgacatgggaggaagaggcggagcagacgggcgtgtcgcacaacttgatgatcacagttgatgacgacgggacgatgcggatcaaggacgacgagacggagaacatcctcaccgtgctactcaagaccgcgctgcttatagtctcgggcatcttcccctactccattcccgcgacgctacttgtctggcatacttggcagaagcagacccagcgttccggcgtgctgtgggacgtgccttctccgcccgagactcagaaggccgagttagaggaaggggtttatcgcataaagcaacagggaatcttcgggaagacccaggtaggtgtcggtgttcaaaaggaaggcgtgttccacaccatgtggcatgtgaccaggggagctgtattaacccacaatggaaaacggctagaaccaaattgggcgagcgttaaaaaggatctcataagctacggcggaggctggcggctgagcacgcagtggcagaaaggtgaggaggtgcaggtcatcgcagtggagcccggcaagaacccgaaaaacttccagaccatgcccgggatcttccagaccaccacgggtgagataggcgccattgctctggactttaagcccggcacatccggcagcccgattatcaacagagagggcaaagtggttgggctgtacggcaacggggttgtgactaagaatggagggtacgtcagcggcatcgcccaaaccaacgccgagcccgacggccctacgcccgagttggaggaggagatgtttaagaagcgaaatctgaccatcatggacctacaccctgggtccggcaaaacccgcaagtacctcccggccatcgtgcgagaagccatcaagcgcaggctgaggaccttgatcctcgcgcccacacgagtggtggcggccgaaatggaggaggctctaaaggggctgcccatcagataccagaccacggccaccaagagcgagcacacaggccgggagatcgtcgacctcatgtgccatgccacgttcaccatgcgcctgctcagccctgtgcgcgtccccaactacaatctcatcatcatggacgaggcgcactttaccgaccccgcatccatcgccgcccgggggtatattagtacgcgggtcggaatgggcgaagccgcggctatctttatgactgcaacgccgcccgggaccgctgaagcctttccgcagtcaaatgcccctatacaggacgaggagcgggacatccccgagcgatcctggaactctggcaatgagtggatcacagacttcgtgggcaagaccgtctggttcgtgccctccatcaaggcaggaaatgacattgccaactgcctgcgaaagaatgggaagaaggtcatccagctaagcagaaagaccttcgacaccgagtaccagaagacgcgactgaacgactgggattttgttgtcaccaccgacatctcagagatgggggcgaacttcaaggccgatcgcgtgatcgacccccgtagatgcctgaagcccgtcatactgaccgacgggccagagcgggtaattctggcaggcccgatgcccgtaacggctgccagcgccgcgcaacgccggggccgcgtcggacgcaacccccagaaggagaacgaccagtatatctttactggccagcccctaaacaacgatgaagaccatgcccactggactgaggccaagatgctgctagacaacatcaacaccccggaagggatcatcccagccctgtttgaaccggagcgcgagaagtccgccgcgatagatggagaataccggttaaaaggcgagtcccggaagacgttcgtagagctaatgcggcggggggacctgcccgtctggctggcccacaaggttgcctcagaaggcatcaagtatacggacagaaaatggtgcttcgatggagaacgcaacaaccagatcctcgaggagaatatggatgtggagatttggaccaaagagggcgaaaggaagaagctgcgccctcggtggctggacgccaggacttacagcgatcccttagcgctgaaagagttcaaggacttcgccgcagggcgcaagtccatcgccctggacctggtcaccgagattgggagagtacctagccacctggcgcaccgcacacggaacgcgctggacaacctggtaatgctacacacctctgagcacggcggccgtgcttatcggcacgccgtcgaggaactgccggaaaccatggagactttactgctgctcggcctgatgatcctgctcaccggcggagctatgctattcctagtcagcgggaaagggattggcaaaaccacgatcgggctcatatgtgtgatcgtctcctccggcatgctgtggatggcggacatccctttgcagtggatagctagtgcaatcgtgctcgagtttttcatgatggtgttattgatacctgagcccgagaaacagcggactccgcaggacaaccaactcgcatacgtggtgatcggaatcctgacgttggctgctatcgtggcggccaatgaaatgggcctgctggagaccaccaagagagaccttggcatgtccaaggagcccggcgtcgtgtctccgacctcctatctcgacgtggacctccaccccgccagcgcatggactctgtacgcggtcgcgactaccgtgatcacaccgatgctacgccatacgatcgagaactccaccgccaacgtgagcctagccgccatcgcgaatcaggccgtcgtactgatgggcctcgacaaggggtggcccatcagtaagatggaccttggagtgcccctgctcgccctggggtgctacagccaagtcaaccccctgaccctcaccgccgcagtactgctgctagtgacgcactacgctattatcgggccgggcctgcaagccaaggcgacccgggaagcccagaagcgcactgccgcggggatcatgaagaaccccaccgtcgacggtatcatgacgatcgacctagatcccgttatttacgacagtaagtttgagaagcagctcggccaagtaatgctcctcgtgctctgtgccgtccagctgctactcatgcggaccagctgggctctgtgcgaggccctgacccttgccaccggacccatcacgaccctttgggaaggctccccggggaagttctggaacacaaccatcgcggtgagcatggccaacattttccgcggctcatatctggcgggggccgggctcgcgttcagtattatgaagagcgtcgggacggggagaaggggcaccgggagccaaggcgagaccctgggcgaaaagtggaagaagaagctgaatcaactttcccggaaggagtttgacttatacaaaaagtccggcatcacagaggtagatcgcacagaagctaaggaggggctgaaacggggagagacaacccaccacgcagtgagccggggatccgccaaactgcaatggttcgtcgaaaggaatatggttatcccagaagggcgcgttatcgacttagggtgcgggaggggcgggtggagttactactgcgccggcctgaagaaggtcaccgaagtgcggggctacaccaagggcggcccggggcacgaggaacccgtgccaatgtccacgtacggctggaatatcgttaaactaatgagtgggaaggacgtcttttacctgcctccagagaagtgcgacaccctgctatgtgatattggcgagtcgtccccctctccaaccgtggaggagagccgcaccatacgggtcctaaagatggtggaaccctggctgaagaacaaccaattctgcatcaaggttctgaacccatacatgccgactgttatcgaacacctcgagcgcctgcagcggaagtacggcggcatgctggtgcgcaaccccctaagtcggaacagcacacatgagatgtactggatctccaatggcaccgggaacattgtgagctccgtcaacatggtaagtcgcctgttactaaaccggttcaccatgacacaccggcggcccacaatcgaaaaggacgtcgatctcggggcaggaaccaggcacgtgaatgccgagcccgagaccccgaacatggacgttatcggtgagcgtattaaacgcattaaagaggagcattccagcacgtggcactacgacgacgagaacccctacaaaacctgggcgtatcacggttcatacgaagtgaaggctacgggaagcgccagcagcatgatcaatggagtggtgaagttgctgactaagccctgggatgttgtgcccatggtcacgcagatggcaatgacggacaccaccccgttcgggcagcagcgcgtcttcaaggaaaaggtggatacccgcactccccggcccatgccaggaaccaggaaggtgatggaaattaccgccgagtggctctggcgcacgctgggccgaaacaagaaaccgcgcctctgtactcgggaggaattcaccaaaaaggtgaggaccaacgctgccatgggagcggttttcaccgaagagaaccagtgggatagtgcgcgggccgccgtggaggacgaagagttctggaagttggtggacagagagcgggaattacacaaactcgggaaatgcgggtcgtgcgtgtacaacatgatgggcaagcgcgaaaagaagctgggagagtttggcaaagcaaagggtagccgggcgatctggtacatgtggctgggggcccgcttcctcgagttcgaagccctggggttcctgaacgaagaccactggtttagtcgagaaaatagctactcgggggtggagggcgagggtctacacaaactgggctacatattgcgggatatctcgaagatccccggcggagcgatgtacgccgacgacacagccggctgggatacccggatcaccgaggacgatctccacaatgaggagaagatcacgcagcagatggaccccgaacaccgccagctggccaatgccatcttcaagctgacctaccaaaataaggtagtgaaagtccaacggcctacaccgaaaggcaccgtcatggacataatctcccgcaaagatcagcggggctcaggtcaggtagggacctacggcctgaacacgttcaccaacatggaggcacagttggtgcgtcagatggagggcgaaggtgtcctgtccaagaccgacctcgagaacccccaccttttggagaagaagatcacccagtggctcgagaataagggggtggaacgtctgaaacggatggccatcagcggcgatgactgtgtggtgaaacccatcgacgaccgcttcgcgaatgccctgttggccctcaacgatatgggcaaggtcaggaaggacatcccccagtggcagccttcgaagggctggcatgattggcagcaggtccccttctgctctcaccactttcacgagctgattatgaaagacggacgcaagctagtagtgccctgtcgcccacaagacgagttgatcggccgcgcccgcatttcacaaggcgccggctggagtctgaaagagacagcgtgcctcggcaaggcctatgctcagatgtggtcacttatgtacttccaccggcgtgatctgcgcctcgccagtaatgccatctgctccgcggtgcctgtccactgggtccccaccagccgtaccacctggtcgattcacgcccatcaccagtggatgacgaccgaagacatgttgaccgtgtggaatcgcgtctggattgaggacaacccatggatggaggacaaaacacccgtgacgacatgggaggacgtgccgtatctgggcaagagggaggatcagtggtgcgggagccttatcggcctcactagccgcgcgacgtgggctcagaacatactcacggccatccagcaagtccggtccctcatcggggatgaggagttcctggactacatgcccagcatgaagcgcttccgaaaggaagaagaatccgagggggctatttggtag

SEQ ID NO: 25764 - RNA, 9873 nt, synthetic construct
  misc_feature 1..9873: note = derived and/or modified CDS sequence (opt11) from DENV-3__FJ639720__SS-prME
  source 1..9873: mol_type = other RNA
accagcctctgcctcatgatgatgctccccgcaaccctggccttccacctcaccagtcgagacggggagccgcggatgatcgtgggcaaaaacgagcgtggcaaaagcctgctgttcaaaaccgcgaccgggatcaacatgtgcacgctcatcgccatggacctcggagagatgtgcgacgacaccgtcacgtataagtgccccttgatcgctgaggtggaaccggaggatatcgactgctggtgtaacctcacctccacgtgggtgacctacgggacctgcaatcaggccggcgagcaccggcgagacaaacggtccgtcgccctggcgccccacgtcggcatgggactggacacccgcacccagacctggatgtccgccgagggtgcttggcgccaagtggaaaaggtcgagacctgggccctccgtcacccagggttcaccatccttgcgttgtttctcgcccactacataggcacttctctgatccagaaagtggtgatcttcatcctcctcatgttggtgacgccttccatgaccatgcggtgcgtgggagtcggcaatcgcgacttcgtcgagggcttgagcggagctacctgggtcgatgtggtcctcgagcatggcggatgtgtgaccactatggccaagaacaagcccacactggacatcgagttacagaagactgaggcgacacaactcgcgacgctacggaaactgtgcatcgaagggaagatcaccaacataactactgactctcgctgtccgacccagggagaggcaatactcccagaggagcaggatcagaactatgtgtgcaagcacacatacgtcgacagaggctgggggaacgggtgtggcctgttcgggaaaggcagcctggtaacctgcgccaagttccagtgcctcgagcccattgaaggtaaagtggtccagtatgagaacctaaagtacaccgtaatcataaccgtgcacactggtgaccagcatcaggtcggtaacgacacgcagggagtcaccgtcgagatcactccccaagcctccaccgtcgaagccgtgttacccgagtacggcacactcgggctggagtgcagccctcgcaccggcttagacttcaacgagatgattcttctgaccatgaagaacaaggcgtggatggtccaccggcagtggttctttgacctgccgctcccgtggacatcaggcgccaccacggagacccctacgtggaatcgaaaggagctgctggtgacatttaagaacgcccatgctaagaaacaggaggtggttgtgctcggctctcaggagggcgccatgcatacggcgctcaccggcgccacggagatccagaactccggaggtacctccatcttcgccggccatctgaagtgccggcttaaaatggataagctggagctgaagggcatgtcctacgccatgtgcctcaacacctttgtactgaaaaaggaggttagcgagactcagcacgggacgattctgattaaggttgaatacaagggcgaggacgccccatgtaagattcccttctccactgaagatgggcaaggaaaggcgcacaacggccgcctgatcaccgcaaaccctgtggtcaccaagaaggaggagccagttaacatcgaggcagagccaccctttggtgaatcaaacatcgtgatcggcataggggacaaggccttgcggatcaactggtacaaaaagggaagctccatcgggaaaatgttcgaggcgacagccagaggcgcaaggcgcatggccatacttggcgacacggcatgggatttcgggagcgtcggcggggttttgaacagtctcggcaaaatggtgcaccagatcttcggttcggcgtataccgccctcttctccggcgtctcctggatcatgaagatcgggatcggtgtgctgctcacctggatcggactgaatagcaaaaacaccagcatgagcttctcgtgcatcgtcatcgggattatcacgctgtacttaggcgccgtcgtgcaggccgacatggggtgcgtgatcaactggaaagggaaagagctgaagtgcggctcgggcatctttgtcaccaacgaagtgcatacctggacggaacagtacaagtttcaggcagacagccccaagcggcttgcgaccgccatcgccggtgcctgggagaacggagtatgcggcatacgttccaccacccgcatggagaacttgctgtggaagcagatagccaacgagcttaactacatactctgggagaacaatatcaagctgacggtggtggtgggtgacattatcggggtcctggaacaaggcaagaggaccctcacgccccagcctatggagctgaagtactcgtggaagacctgggggaaggcgaagatcgtgacggctgagacccaaaactccagctttatcattgacgggcccaacacccccgaatgcccatcggcctctcgcgcctggaacgtgtgggaggttgaggattacgggttcggcgtgttcacaacaaacatatggctgaagctccgggaggtgtatacccagtcctgcgaccaccgcttaatgtctgcggccatcaaggacgagcgggccgtccatgcggacatgggctattggatcgagagccagaagaacgggagttggaaacttgagaaggcctcgttcatcgaggtgaagacctgcacctggccgaagagtcacactttatggagcaacggcgtgctggaatccgatatgatcatcccaaagtcgctggcggggcctatcagtcagcacaatcaccgcccgggctaccacacgcaaaccgccggtccctggcatctggggaagctggaattagatttcaactactgcgaaggcaccaccgtcgtgataacggagaattgtggcacccggggcccctcccttcgcaccaccacggtatcgggtaagctgatccacgagtggtgctgccggtcctgcaccttacccccgttacgctacatgggtgaggacgggtgctggtacggcatggaaatccgtcccataaacgagaaagaggagaatatggtcaagtccctggtctccgccggcagcggtaaagtagataactttaccatgggggtcctgtgccttgcgatactgttcgaggaagtgatgcgcggcaaatttggtaagaagcatatgatcgccggtgttctgttcacctttgtgcttctgttaagcggccagatcacttggagggacatggcacacaccctcatcatgattggatccaacgccagcgaccgcatggggatgggggtcacctatctcgccctcatcgccacctttaagattcagcccttcctcgccctaggctttttcctgaggaaactcacgagccgcgaaaacctgctgctcggagttggtctggcgatggcgactacgctgcaactccccgaggacatagagcagatggccaacggcatcgctctgggccttatgaccctcaagctcatcacgcaattcgagacctaccagctatggaccgcgctcgtatcgctgacctgcagcaacacaattttcacactcaccgtggcatggcgaactgctacgctcatattagccggggtctccctgcttccgctatgccagtcctcaagcatgcgcaagactgattggctgccgatgacggtggccgcgatgggcgtgccgccactcccgctgtttatcttctccctgaaggatacccccaagcgccgcagctggcctcttaatgaaggcgtcatggccgtgggcttggtgtctatcctggccagctcactgctgcggaacgacgtgcccatggccggcccactggtagccgggggcttattgatagcctgctacgtgattacggggacctcggcagatctgaccgtcgagaaggccgcagatgtaacatgggaggaggaggccgaacagaccggtgtgagccacaacttgatgataacagtggacgacgatgggaccatgcggatcaaagacgatgagaccgagaacattctgaccgtgctgctcaagacggcgctactgatcgtgagcggcattttcccctactccatcccagccaccctcctggtctggcacacctggcagaagcagacccagagatccggcgtgctctgggacgtcccttccccacccgagacgcaaaaggcggagctagaagaaggagtatacaggatcaagcaacagggcatcttcggaaagacacaggtaggcgtgggtgtccagaaggagggggtgttccacaccatgtggcacgtgacgcgaggagccgtcctaacccataacgggaagcggctggagccgaattgggcgagcgtgaaaaaggatctaatctcctacggcggcggctggcgcttgagcacccagtggcagaagggggaagaggttcaggtcatcgccgtggagccgggcaagaacccgaaaaacttccagaccatgccaggtatcttccagaccacgaccggggagatcggcgcaatcgccctggatttcaaacctggtacatccggcagtccgataatcaaccgggaaggcaaggtagtcggtctgtacggcaacggggtggtgaccaagaatggcgggtacgtcagcggcattgcgcagacgaatgcggaaccggacggcccgactcccgagcttgaggaggagatgttcaaaaagcggaacctgaccatcatggacctgcacccaggatcaggcaagacccgtaagtatctccccgccattgtccgcgaagccatcaaacgccgcctgcggaccctgatcctcgcccccacccgcgtagttgcagcggagatggaagaggcattgaaggggctgcccatacgctaccaaaccaccgccactaaatctgaacatactggacgtgagatagttgacctcatgtgccacgcaacgtttacgatgaggctcttgtcaccggtacgcgtgcccaattacaacctcatcatcatggatgaggcacacttcacggacccggcgagcatagccgcacggggctatatatccacccgcgtaggcatgggcgaggccgccgcgatcttcatgaccgccacacccccagggacggccgaggcgttcccccagtcaaacgcgccgatccaggatgaagaacgagacatacccgagcggagctggaacagcgggaacgagtggatcaccgattttgtggggaagaccgtgtggtttgtaccctcaatcaaggccggcaacgacatcgccaactgcctacgcaaaaatggtaagaaggtgatacaactgtcccgaaagaccttcgacacggaataccagaagacccgcctgaacgactgggacttcgtcgtaaccactgacatctccgaaatgggcgcaaacttcaaagccgatagggtgatcgatccacgccgttgcctaaagcccgtaatcctgacggacgggccggagagggtgattctggcgggcccgatgcctgtgacggccgcatccgcagcccaacggcgcgggcgggtcgggagaaacccccagaaggagaacgaccagtacatcttcaccggccaaccactgaataacgacgaggatcatgctcactggacggaagctaaaatgctgctcgataacatcaataccccggaaggaatcatccccgccctgttcgagcctgagcgcgagaagtctgctgccatagatggcgagtataggttaaagggcgagagcaggaagactttcgtggagctcatgcgccgcggggaccttcccgtctggctggcgcacaaggtggcctcggaggggatcaaatacaccgatagaaagtggtgcttcgacggagagcgaaacaaccaaatcctcgaggagaacatggacgtggaaatctggaccaaggagggcgagcgcaagaaactgcggccgcggtggctggatgcccggacatacagcgaccctcttgccctgaaggagttcaaggattttgcggccgggcgcaagtctattgctatcgacctcgtaacggagattgggcgcgtgccctctcacctcgcccaccgaacccgcaacgccctggataacctggtcatgcttcacaccagtgagcacggcgggcgagcttaccgccatgccgttgaggaactgccggagaccatggagacgctactcctgcttggtctaatgatcctgctgaccgggggcgcgatgttgttcctggtgagcgggaaagggatcgggaagaccaccattgggctgatatgcgtaatcgttagctccggcatgctctggatggcagatatccccctccagtggattgccagcgcaatcgtgctagagttcttcatgatggttctcctgattcccgagccagaaaagcaacggaccccgcaggacaaccagctggcctatgtcgtgatcgggatcttaaccttagccgccatcgtggctgcgaacgagatgggcttattagagacgacaaagcgcgacctgggcatgtctaaggaacccggggtcgtgagcccgacgtcctacctcgacgtggacctacaccccgccagcgcgtggacgctgtacgctgtggccaccaccgtgatcacccctatgctgcgtcacacaatagaaaactccaccgcgaatgtgtccctcgccgccattgccaaccaagcggtcgtgctgatgggtttggacaaggggtggcccatatccaagatggaccttggcgtacccctgctcgcgttgggctgttactcacaagtcaatccattgacgctcacggccgccgtgctactcctcgtgacccactatgcaataatcggcccgggcctccaagcgaaagcaacccgtgaggcccaaaagcgaacggcagcggggatcatgaaaaaccctacggttgatggaataatgacgatagacctggaccccgtgatttacgactccaagttcgagaagcagctgggtcaggtgatgctcctggtactgtgcgcagtgcagctcctgttgatgcgaacctcatgggccctatgcgaggcacttacattagccacgggcccaatcacgaccctctgggaaggatcccctggtaagttttggaatacgacaatcgcggtgagcatggccaacatcttccggggctcatatctggccggcgcgggcctggctttcagcatcatgaaatctgtggggaccggccgcagaggcaccgggtcccagggggagaccctcggggagaaatggaagaagaagctgaatcagctatctcgaaaggagttcgacctttacaagaagtctgggatcacggaagtggaccggacggaggcgaaggaggggctaaaacgcggagagaccacccaccacgccgtgagccgcggctctgcaaagctccagtggtttgtcgaacgcaacatggtgatcccagaggggcgcgtgatcgacctcggctgcgggcgaggcgggtggtcctattactgtgccggcctcaagaaggtcaccgaggtgcgcggctacacgaagggcgggcccgggcacgaagaacccgtgccgatgtccacctacggatggaacatcgtgaaactgatgagcggcaaggacgtgttctacctcccgcccgaaaaatgtgacaccctactatgcgacatcggcgaatccagcccgtccccgaccgtggaagagagccggacgatccgcgtactgaaaatggttgagccttggttaaagaacaaccagttctgcatcaaagtcctgaacccctacatgcctacagtgatcgagcatctagagcggctccagaggaagtacggcgggatgctagttcggaacccgttatcacgcaactcaacgcacgaaatgtactggatctccaacggcactggcaacatcgtcagctccgtcaacatggtgagccggttgctacttaataggttcacgatgacacatcggcgcccaaccatagagaaggacgttgatctcggggccggtacgaggcacgtgaatgcggagcccgagacgccgaacatggacgtgatcggagagcggatcaaacggataaaagaggaacactctagcacctggcactacgacgacgagaatccctataagacctgggcctaccacggctcctatgaggttaaagctacaggcagcgcctcgtcaatgatcaacggcgtcgtaaagctgctgacgaagccttgggacgtcgttcccatggtgacccaaatggccatgaccgacacgacgccgtttggtcagcagcgcgtattcaaggagaaggtggacacgcggacgcctcggcccatgcccggcacacgaaaggtgatggagatcacagccgaatggctgtggcgcaccttgggcagaaataagaagccgcggctgtgcaccagagaggagtttaccaaaaaggtacggacaaacgccgccatgggggcggtgtttaccgaggagaaccagtgggacagcgcccgagcggcggtcgaggacgaggagttctggaagctcgtcgaccgggaaagagagctacacaagttaggcaagtgcggtagctgcgtgtacaacatgatgggtaagcgagagaagaaactcggggagttcggtaaggcaaagggaagccgcgctatctggtacatgtggctcggggcgcgttttctggagttcgaggccctcggcttcctgaacgaggaccactggttttcaagggagaacagctactcgggggtggagggcgaggggctgcacaagttgggctacatcctgcgagacatcagcaagatcccaggcggggcgatgtatgccgacgataccgcaggctgggacacgcgcattacggaggacgacctgcacaacgaagagaagatcacccaacagatggaccccgagcaccgtcagctcgcgaatgccatcttcaagttgacgtatcagaacaaagtcgtgaaagttcagcgccccaccccgaaggggaccgtcatggacatcatttcccgcaaggatcaacgcgggtccggacaggtaggaacctacgggttaaatacgttcacgaacatggaggcccagctcgtgcgtcagatggaaggcgagggggtcctctccaaaaccgacttggaaaacccccacctcctggaaaagaaaattacgcagtggctggagaacaagggggtcgagcgcctcaagcgcatggcgatatcaggcgacgattgcgtggtcaagcccatcgacgatcgctttgccaatgcactgctcgcgttgaacgacatgggaaaggtgaggaaagacatcccccaatggcaaccgtccaagggctggcatgactggcaacaggtcccattttgtagccaccacttccatgaactcatcatgaaggacggccgcaagctggtcgtaccttgtcgcccccaggacgagttaatcgggcgcgcccgcatttctcagggtgcaggatggagcctgaaggagaccgcgtgtctgggcaaggcgtacgcccagatgtggtcccttatgtacttccatagacgcgacctgcgcttagcgagcaatgccatctgctcagccgttccggtgcactgggtccccaccagcaggactacgtggtccatccatgctcaccaccaatggatgaccaccgaggatatgctcaccgtgtggaaccgggtgtggatcgaggataacccctggatggaggacaaaacgccagttacaacctgggaggacgtgccgtacctggggaaacgagaagaccagtggtgcggaagtctgataggactcacaagcagagcaacgtgggcccagaacatcctcacggccatccagcaagtccgctccctcattggggacgaggagttcctcgactacatgccatctatgaaacgtttccgcaaggaggaagagtccgagggcgctatatggtag

SEQ ID NO: 25765 - RNA, 9873 nt, synthetic construct
  misc_feature 1..9873: note = derived and/or modified CDS sequence (opt11) from DENV-3__GQ868626__SS-prME
  source 1..9873: mol_type = other RNA
accagcctgtgcctgatgatgatgcttccggccaccctggccttccacttaacctcacgggacggggaacctaggatgatcgtgggaaagaatgaacgcgggaaaagcctgttgttcaagaccgcaaccgggattaatatgtgcaccctcatcgccatggacctcggcgaaatgtgtgacgacacggtgacctacaagtgccccctgatagcggaagtggagccagaggacatagactgctggtgcaacttaaccagcacctgggtgacgtacgggacctgcaatcaggccggcgaacaccgacgcgacaagcggagcgtggccctggcgccccacgtgggaatggggctggataccagaacgcagacgtggatgagcgcagagggcgcttggagacaggtcgagaaggttgaaacttgggcgctccgccatccggggttcaccatcctggcgcttttcttggctcactacatcggcacatcgttaatccagaaggtcgtgatcttcatactgctcatgcttgtcacgccatccatgaccatgcgatgcgtaggcgtgggcaaccgagatttcgtcgaaggcctgagcggggccacctgggtcgacgttgtactggagcacggcggttgcgtgacaacaatggctaagaacaagcccaccctggacatagagttgcagaaaactgaggcgacccagcttgcgactctgcggaaactttgcatcgagggcaaaattaccaacataacgaccgactcccgctgccccacgcagggtgaagcaattctcccggaggagcaagaccagaattacgtgtgcaagcacacctacgttgaccgggggtggggaaacggctgcggtctatttgggaagggctcgctcgttacctgcgctaagttccaatgtctagaacccatcgagggtaaggtagtacagtatgagaatctcaagtacaccgtaataatcactgtgcacacgggcgaccagcaccaggtcggaaacgacacccaaggggtgaccgtagagataacgccgcaggcgtcgaccgtggaggccgtgctgcccgagtacggcacactcggtcttgagtgcagccctcgcaccggcctagacttcaacgagatgatcctactgaccatgaaaaacaaggcttggatggtccaccgccagtggttcttcgaccttcccctcccctggacgtccggagccaccatcgaaactcccacctggaaccgaaaggaactgttagtgacgttcaagaatgcccacgccaagaaacaggaggttgttgttctaggatcccaagagggtgcaatgcacacagcgttaaccggagcgaccgaaatacaaaacagcggtgggacgagcatctttgccggacacttgaaatgccggctgaagatggacaagctggagctgaagggaatgtcctatgccatgtgcctcaacacctttgtgttaaggaaggaggtaagcgaaacccagcacgggacaattcttatcaaggtggagtataaaggcgaggacgcaccgtgcaaaatccccttttccactgaagacggccagggcaaggcgcacaacggacggctgatcaccgcaaatcccgtggtcaccaagaaggaggagccagtcaacattgaagccgaaccgccctttggggagtcaaacatcgtaatcggaatcggggacaaggccctcaagatcaattggtacaagaagggcagcagcatagggaagatgttcgaagcaaccgcacgcggcgctcggcgaatggcaattctgggcgacacggcatgggacttcggctccgtcggaggcgtgctaaattccttgggaaagatggtgcaccagatttttgggtcagcctatacggccctgttctccggcgtcagctggatcatgaagataggcatcggagtactgttgacctggatcggcctaaattctaagaataccagcatgtccttctcatgtatcgtgatcgggattatcacgttatacttaggcgccgttgtgcaggcggatatggggtgtgttatcaattggaaaggcaaagagctaaaatgcggttcgggcatcttcgtcacgaacgaggttcacacctggaccgagcagtacaagttccaggccgacagccccaagcggctggcgacggcgatcgccggcgcctgggagaacggggtgtgcggtatccggtcaaccacccgcatggagaacctcctctggaagcaaatcgccaatgagctcaactacatactctgggagaacaacatcaagttgaccgttgtggtgggtgatataatcggcgtgctggagcagggcaagagaacgctcacgccccagccgatggagctcaagtatagctggaagacctgggggaaagccaagattgtaaccgccgagacgcagaactcctcattcatcattgacggcccaaacacaccagagtgcccctctgcctcccgcgcctggaacgtatgggaggtagaggattacgggtttggcgtttttaccaccaacatctggctgaaattgcgggaggtgtacacgcagtcgtgcgaccaccgcctgatgagcgcagccatcaaggacgaacgggccgttcacgccgacatgggctattggatagaaagccagaagaatggctcctggaaactggagaaggcctcgttcattgaggtcaagacttgcacctggcccaaatcacacactctctggtctaatggtgtgcttgagtccgacatgattatccctaaatctctggcgggtcccatctcacagcacaaccaccgaccgggctaccacacacagacagccgggccctggcacctcgggaagctggagctggattttaactactgcgagggcaccaccgttgtgataaccgagaattgcggtacgcggggccctagcttaagaaccaccaccgtgagcggcaagctgatacacgagtggtgctgccggtcatgtacactgcccccattacgctacatgggggaagacgggtgttggtacggtatggaaataaggcccatcaacgagaaagaggagaacatggtaaagtccctggtctctgcagggtcaggtaaggttgataacttcacaatgggcgtcctgtgcttagccatcctgtttgaggaagtgatgcgcggaaaattcggcaaaaagcacatgatcgcgggagtgctctttaccttcgtcctcctgctttcggggcagattacatggcgggacatggcgcacacgctcataatgatcggctccaacgcgtctgaccgcatggggatgggagttacttacctagccctcatcgccacattcaaaatccaaccattcctcgccttggggttcttcctgcgcaaattgacctcccgcgagaacctactgttaggagtggggctggcaatggccacgaccctacaacttccggaggacatcgagcagatggccaacgggattgccctggggctgatgaccctcaagctcattacacagttcgagacgtatcagctgtggacagcgctcgtcagcctgacctgctccaacaccatatttacgctgacagtggcctggcgcacagcaaccctaatcttggccggagtctcactgctccctttgtgccaaagctcctccatgaggaagacggactggttgccaatgacggtagcagcgatgggcgtgcccccattaccgctgttcattttctccttaaaggataccccaaagagacgatcctggccgcttaacgaaggagtcatggccgtaggactggtttccatcttagcctcgtccctcctccgcaacgacgtgcccatggccggaccgctggtcgcgggcggcctcttaatcgcgtgctacgtgatcacaggtactagcgcagatctgacggtcgagaaggccgccgacgtgacgtgggaggaggaggccgagcagaccggcgtttcccacaacctaatgattacggtggacgacgacgggaccatgcggatcaaagatgacgaaacggagaacatcttaacagttctgctcaagaccgcgctgttaatcgtgagcggcatctttccgtactctatccccgccaccctcttggtctggcacacttggcagaaacagacccagcgcagcggagtactctgggacgtaccctcgccccctgaaacccagaaggccgaactcgaggaaggagtctaccggataaagcagcagggcatcttcggcaagacccaggtgggggtcggggtccagaaggagggggtcttccataccatgtggcatgtgacccgcggcgccgtcctgacccacaacggtaagcgactggaacccaattgggccagcgttaaaaaggacctcatttcctacggagggggctggcgactgtctacacagtggcaaaagggggaagaggtgcaggtcatcgcggtggagcctggcaagaaccctaagaactttcagacaatgccaggcatcttccaaaccaccactggcgagatcggcgctatcgccctggactttaagcccgggacctctggttcccccatcatcaaccgtgaaggcaaggtcgtcggcctctatggaaacggggtcgtgacgaagaacggcgggtacgtaagcggcatcgcccagacgaatgcggagcccgacggccctacgccggagctcgaggaagagatgtttaagaagcgcaacctgacgatcatggacctacacccggggtcggggaagacccggaagtatctccccgccatcgtgcgcgaggccatcaagcggcggcttcggactttgattctcgcccccacccgtgtggtcgcggcggaaatggaagaggccctgaagggtctgccgatccggtaccagaccacggccaccaagagcgagcacactggccgcgagatcgtagaccttatgtgccacgccacgttcaccatgcggcttctgtccccggtgagagtaccgaactacaacctaataatcatggacgaggcccacttcaccgaccccgctagcattgccgcccggggatacatatccacgcgcgtcggaatgggggaagccgcagcgatcttcatgactgcgactccgcctgggacggccgaggccttcccccagtcaaacgctcccattcaagacgaagaacgcgatatccccgagcggtcctggaactctggcaacgagtggatcacggacttcgtcgggaagaccgtttggttcgtgccctcgatcaaggcaggcaacgatatcgcgaattgcctcagaaagaacggcaagaaggtgatccaactttcccggaagacgttcgatacagagtaccagaagacgcgcctcaacgactgggatttcgtcgtgactacagacatctcagagatgggggctaacttcaaggccgaccgtgtaatagacccgcgtcggtgcttaaagcccgtcatccttacagatggacccgagcgcgtgattctagcggggccaatgcctgttacagccgcttccgccgcccagagacgcgggcgggttgggcgcaacccccagaaggagaacgatcagtacatcttcacaggtcaacccctgaacaacgacgaggaccacgcacactggaccgaggccaagatgttgctggacaacattaacaccccagaaggtataatccccgccctttttgagccggaaagagaaaagagcgccgcgatagacggcgagtaccgcctgaagggcgaaagcaggaagaccttcgtggagcttatgcgccgcggggaccttcccgtctggctggcgtacaaggtggcttccgagggcatcaagtacaccgaccgaaagtggtgcttcgacggggagagaaacaaccagatccttgaagaaaacatggatgtggagatctggacaaaggagggcgaacgcaaaaagctgaggccgcggtggctggacgcccgcacttattccgaccccctcgccctcaaggagtttaaagacttcgcagcgggccgcaaaagcatcgcgctggacctagtcacggagattggccgtgtccctagccacctagcccaccgtacgcggaacgccctggataacctggtcatgctgcatacatccgaacatggcggtcgggcttaccgccacgccgtcgaggagctgcctgagaccatggagaccctcctgctactcggcctgatgatcctgctcaccggtggggccatgctattcctgatttctgggaaggggatcggaaaaacaacgatcggactcatctgtgtcatagtgtcttccggcatgctgtggatggcggacataccactgcagtggatcgcaagcgcgatcgtgctggagttctttatgatggtactactgatccccgaaccagagaagcaacgtacaccccaggacaaccagctcgcatatgtggtgatcggaatcttaacactggccgccattgtggcagcgaacgagatgggcctcctggagacaaccaaacgcgacctgggcatgagcaaggagcccggtgtggtttcaccaacctcctacctggacgttgacctgcaccccgccagcgcttggacgctgtacgccgtggcgactacagtcataacccccatgctccggcacaccatcgagaactcaaccgctaacgtgtcgctggccgcaatcgccaaccaggctgtggtcctgatggggctcgacaagggctggcccatttccaagatggacctgggcgtgcccctgttggcgctagggtgctacagtcaggttaaccccctcaccctcaccgccgccgtgctgttactggtgacgcactacgccatcatcggcccggggttacaggcaaaggccactcgcgaggcccagaagaggacggccgccgggattatgaaaaaccccacagtggacgggattatgacaattgacctggacccagtcatctacgactctaaattcgagaaacaactaggtcaagtgatgctcctggtgctctgcgcggtccagctcctgctcatgcgcacctcatgggccctttgtgaggccctgactctcgccaccgggcccattacaaccctgtgggaagggtcccccgggaagttctggaacacaacaatcgctgtgagtatggcaaacatctttagggggtcctacctggccggggcaggcctcgcgttctcaataatgaagtccgtgggaacagggcgcaggggcacaggtagtcaaggtgagaccctgggtgaaaaatggaaaaagaaacttaaccaactctcccgcaaggagttcgacctgtacaaaaagtcgggcatcaccgaagtcgaccggaccgaagcgaaggaggggctaaagagaggcgagacgacccatcatgccgtaagccggggctcggccaaacttcagtggtttgtggaaagaaacatggttatacccgagggacgagtgatcgacctgggttgcggccgtggcgggtggagctattactgcgcaggcctgaagaaggtgaccgaggtccgcggctataccaagggtggacccggacacgaagaaccggtgccgatgtcaacctatggctggaacatcgtaaaattgatgagcgggaaggacgtgttttacctgcctcccgagaagtgcgacaccctgctgtgcgatatcggcgagtccagcccctctccgacagtggaagagtcacgaaccatccgtgtgcttaagatggttgagccctggctaaagaacaaccagttctgtataaaggttctgaatccttacatgcccacggtgatagagcacctggaacgacttcagaggaagtacggcggaatgctggtcagaaaccctctctcaaggaacagcacccacgagatgtactggatttctaacggcacagggaacatagtttcatccgttaacatggtcagtcgtcttctgctcaatcgcttcaccatgacccatcggcgccctaccatcgagaaggatgtcgacctgggcgccggtacacgtcacgtcaacgctgagcccgaaactccgaacatggacgtcataggcgagcgcatcaagagaatcaaggaggagcactcaagtacgtggcattacgacgatgaaaacccctacaagacttgggcttatcacggctcctacgaggtaaaggccaccggaagcgcttccagcatgatcaacggggtagtaaagctgttgaccaagccctgggacgtggtacctatggtgacgcagatggctatgaccgataccaccccgtttggtcagcagcgcgtgtttaaggagaaagtagacactaggacacccaggcccatgcctggcaccagaaaggttatggaaatcaccgcggaatggctgtggcgcacgctgggccgcaacaaaaagccacggttatgtacaagagaggagttcacaaagaaggttcggactaacgctgctatgggcgccgtctttacggaggagaaccagtgggatagcgcacgcgccgctgtagaggacgaggagttctggaagctggtggaccgggaacgcgagcttcacaagctcggcaagtgtgggtcatgtgtttacaatatgatgggcaagcgggagaagaagctgggggagttcggcaaggccaagggcagtcgcgccatctggtatatgtggttaggcgcgagattcttggagttcgaggccctgggcttcctcaacgaggaccattggttctcccgagagaatagctactcaggagtggagggagagggactccataagctgggatacatcctgcgggacatctctaaaatccccggcggcgccatgtacgctgacgataccgccggctgggacacacgcatcaccgaggacgacttacacaacgaggagaagataacgcagcagatggaccccgagcaccggcaactggcgaacgccatcttcaagctcacttaccagaataaggtggtcaaagtgcaacgcccgactcctaagggaactgtgatggacatcatcagtagaaaagaccaacgaggcagcggccaggtcggaacctacggcctcaacaccttcaccaacatggaggcacagttagtgcggcagatggagggggaaggcgtgctatccaaggccgatctagagaacccccacctactggaaaagaagatcacacagtggctcgaaaacaaaggggtcgagcggcttaagagaatggccataagcggcgacgactgtgtcgtcaagccgatcgatgaccgcttcgccaacgctctactcgcgcttaacgacatggggaaggtcagaaaggacatcccccagtggcaaccatcgaaggggtggcacgactggcagcaggttcctttctgctcacaccacttccacgagctgataatgaaagacggtaggaaactcgtagtgccctgtcgtccccaggacgagctgatcgggcgggcccgcatctcccaaggcgcagggtggagcttaaaagagaccgcatgcctcgggaaagcgtatgcccagatgtggtccctgatgtacttccaccggcgtgacttgcgtttggcaagcaatgccatctgctccgcggtacctgtgcactgggtcccaacgagcagaacaacgtggtccatccacgcccatcaccagtggatgaccacagaagatatgctggccgtttggaatagggtctggatcgaggacaacccctggatggaggacaagacgcccgtgacgacctgggaagacgttccgtaccttggaaagcgagaggaccagtggtgcggcagcctcatcggcttgacttctcgggccacctgggcgcagaacatcctgaccgccatccaacaagtcaggtcgctcataggtgacgaggaatttcttgactacatgccatccatgaagcgatttcgcaaggaggaggagtccgagggcgccatctggtaa

SEQ ID NO: 25766 - RNA, 9873 nt, synthetic construct
  misc_feature 1..9873: note = derived and/or modified CDS sequence (opt11) from DENV-3__GQ868627__SS-prME
  source 1..9873: mol_type = other RNA
actagcctgtgcctcatgatgatgctgcccgccaccttggctttccaccttaccagccgggatggggagccccggatgatcgtgggtaagaacgagcggggcaagagcctgctgttcaagaccgctactgggatcaacatgtgcaccctcatagccatggatttaggggaaatgtgcgatgataccgtgacctacaagtgtccactaatcgccgaggtggagcccgaagatatagactgctggtgcaacctcacatcaacctgggtgacgtatgggacttgcaaccaggccggcgagcacagacgcgacaagcggtcggtggccctggcgccccacgtgggaatgggtctggacacccgcacgcagacatggatgtccgcagagggtgcgtggcgccaggttgagaaagtcgagacttgggcgctcaggcacccggggttcactatcctagcgttattcctcgcccactacattggcaccagcctgatccaaaaggtcgtgatctttatcttgctcatgttagtcacgccctctatgaccatgcggtgtgtgggggtcggcaaccgcgacttcgtcgagggcctaagcggggcaacctgggtggacgtggtgctcgaacacggcggatgcgtaaccactatggccaaaaacaaacccaccctggacatcgagcttcagaagacggaagctacgcagctcgctacgctgcgcaagctgtgcatcgagggtaagatcacaaacatcaccaccgactcccgctgcccaacgcagggcgaggccatcctcccggaggagcaagaccagaactacgtgtgcaagcacacctacgtcgaccgcgggtggggcaacggttgcggcctattcgggaaaggcagcctggtgacgtgcgccaagttccagtgcctcgagccaatcgaaggcaaggtggtccagtacgagaatctgaagtataccgtgatcattactgtgcacaccggggaccagcaccaggtcggcaacgacacgcagggggtgaccgtggagataaccccccaggcctccaccgtggaggccgtgctgccagaatacggcactctagggctcgagtgtagcccgagaactggcctggacttcaacgagatgatcctcctgaccatgaagaataaggcctggatggtccatcggcagtggttcttcgacctgcccctcccctggacgagcggagcgaccacggagacccccacgtggaaccgcaaggagttgctagtgaccttcaagaacgcccacgccaagaagcaggaggtagtcgtgctagggagccaggaaggggcaatgcataccgcgctgaccggggccacggagatccagaactccggcgggacctctatctttgctggccacctgaaatgtagactcaagatggacaagttggagctgaaaggcatgtcctacgcaatgtgcctcaataccttcgtgcttcgcaaagaagtaagcgaaacacagcacgggacgatcctgatcaaggtggagtacaagggcgaggacgctccgtgcaagatacccttctccaccgaggacggtcagggcaaggcgcacaacggtaggctaatcaccgctaaccccgtggtcaccaagaaggaggagcccgtgaacatcgaggctgagccgcccttcggggagagcaacatcgtgatcggcatcggggacaaggccctcaagatcaactggtacaaaaagggcagctccatagggaagatgttcgaggcgacggcccgcggcgcgaggcgcatggctatcctgggcgacaccgcttgggatttcgggagcgtcggaggtgtgctgaactccctcggcaaaatggtgcatcaaatcttcgggagcgcttacactgccctgttctccggcgtcagctggataatgaaaattggcatcggggtgctgctcacttggattggcctcaactccaagaacacgtcaatgtcctttagttgcatcgtgattgggattattaccctgtacctcggcgcagtcgtgcaggccgacatggggtgcgtcatcaactggaagggaaaggagctgaaatgcggttccggtatcttcgtcactaacgaggtccacacctggacggagcagtacaagttccaggccgacagcccaaagcgcctggcgactgccatcgcgggcgcctgggagaacggggtgtgcggcatccggtccaccacccgcatggaaaacctcttatggaagcagatcgccaatgagctaaactacatcctctgggagaataacattaagttgaccgtcgtggtgggcgacatcatcggcgtcctggagcaaggcaagcggacactcaccccccagccaatggagctgaaatacagctggaagacctgggggaaggccaagatagtaactgccgagacccagaactccagcttcatcatagacggcccgaacacgcccgagtgcccttctgccagccgcgcgtggaacgtgtgggaggtcgaagattatgggttcggcgtcttcacaacgaacatctggttgaagttacgggaagtttacacccagagctgcgaccaccgcctgatgagcgcggccatcaaggacgagcgggcagtgcacgccgacatgggctattggatcgagagccagaagaacggatcctggaagttagagaaggccagcttcatcgaggtgaagacctgcacatggccgaagtctcataccttgtggagcaacggcgtgctggagagcgacatgatcatccccaagagcctggcggggccaatctcccagcacaatcaccggccgggctatcacacgcaaaccgccgggccctggcacctcggcaagctggagctggacttcaactattgcgagggcacaaccgtcgtaatcacggagaattgtgggacacgtggccccagcttacggactaccaccgtgtccggaaaactgatccatgagtggtgctgccggagctgcaccctgccccccctgcgctatatgggcgaggacgggtgttggtacggcatggaaatccggcccattaatgagaaggaggagaatatggtcaagtccctggtgagcgcaggatccggaaaggtggacaacttcaccatgggcgtcctgtgcctagccatcttgttcgaggaggtgatgcgcggcaagttcggcaagaagcacatgatcgcgggggtgttgtttaccttcgtcctccttcttagcggccagatcacgtggcgggatatggcgcacacactcatcatgatcggcagcaacgcaagtgaccgcatggggatgggcgtgacctacctggcgttgatcgccaccttcaagatccagccattccttgccttagggttcttcctgcggaagctcacgtctcgcgagaacctgctcctcggcgtgggcctggctatggccaccaccctgcagctcccagaggacatcgagcagatggccaatgggatcgccctgggtttgatgaccctcaagttgatcacgcagttcgagacgtaccagctgtggaccgcactcgtaagcctgacctgtagcaacactatcttcaccctgactgtggcctggcggaccgccacgctcatcttagccggggtctctctgctcccgctgtgccagagctcctcaatgcggaagaccgactggctgccaatgacggtcgccgcgatgggtgtaccacccctaccccttttcatattttccttaaaggacacccccaaacgccggagctggcctctcaacgagggggtcatggccgtgggactggtgtccatcctggccagttccctattacgcaacgacgtccccatggccggaccgctggtggccgggggcctcctgatagcatgttatgtgatcactgggaccagcgcggacctgaccgttgagaaggccgccgacgtgacctgggaggaggaggccgagcagacgggcgtgagtcacaatcttatgatcaccgtcgacgacgacggcaccatgcggatcaaggacgacgagacggagaatatcctgaccgtgcttttgaagacagcgctgctcatcgtgtctggcatcttcccatattccatccccgccaccctcctggtctggcacacctggcagaagcagacacaaagaagcggggtgctgtgggacgtgccctcccctcccgagacgcagaaggccgagctcgaggagggagtctaccggatcaagcaacaggggatctttgggaaaacccaagtgggagtaggcgtacagaaggagggggtcttccacaccatgtggcacgtgaccaggggcgccgtcctgacgcacaacgggaaacggctcgagcccaactgggctagcgtgaagaaagacctcatctcctatggcgggggctggcgcctgtcgacccagtggcagaaaggggaggaggtgcaggttatcgcggtggagccggggaagaacccgaagaacttccaaaccatgcccggcatctttcagaccacgaccggcgaaatcggtgccattgctttggatttcaagccaggaacttccggcagccctatcatcaaccgggagggcaaggtggtggggctgtacggcaacggggtggttaccaaaaacggcgggtacgtcagcgggatcgcccagacgaacgcggagcccgacggccccacaccagaattagaggaggagatgttcaagaagcgcaacctgaccatcatggaccttcaccctgggtccggcaaaacccggaagtacctccccgcaatagtgcgcgaggccatcaagaggcggctgcggaccctgatcctcgcacccacacgcgtggtcgccgcggaaatggaggaggccctgaaggggctgccaatcaggtaccaaaccaccgccaccaagtcagagcacaccgggcgcgagattgtagacctcatgtgccacgctaccttcacaatgcgactgctttccccagtgcgcgtcccaaattacaaccttataataatggatgaggcccatttcacggatcccgcgagcatcgctgcccgggggtacatctcaacccgcgtgggcatgggcgaagcggcagcgatatttatgaccgccacaccgcccgggacagccgaggccttcccccagagcaatgcgcccattcaggacgaggagcgagacatcccagagcgttcctggaacagcgggaatgagtggatcaccgacttcgtaggtaagaccgtctggttcgtgcccagcatcaaagcgggcaacgacattgccaactgtctccgcaagaacgggaagaaggtgatacagttgtctcgaaaaacattcgacacggagtaccagaagacccgcctcaacgactgggactttgtcgtgaccaccgacatctccgagatgggcgccaacttcaaggccgaccgggtgatcgacccccgccgctgtctgaagcccgtcatccttaccgacggtcccgaacgcgtaatcctagcggggccgatgcccgtgaccgccgccagcgccgcccagaggcgtggccgggtcgggcgaaacccccagaaggagaacgatcagtacatattcaccggccagccattaaacaacgacgaggaccacgcgcactggaccgaggccaagatgctgctcgacaacataaacaccccggaggggattatccccgccttgttcgagcccgaacgagagaaatccgccgccatcgacggggagtaccggctgaagggggagtcgcggaagacgttcgtggagctcatgcggcgtggggatcttcccgtctggctggcgtacaaagtggcctccgagggcatcaagtacaccgaccggaaatggtgcttcgatggggaacggaataatcagattctcgaggaaaacatggacgtggagatttggaccaaggagggcgagaggaaaaagctgaggccgcggtggctggacgcgcgcacttacagcgaccccctagcgctgaaggagttcaaggacttcgccgcaggaaggaaatccatcgccctggaccttgttaccgagatcggtcgcgtgcccagccatctggcccaccggacccgcaacgccttggacaacctagtgatgttacacacctccgagcacgggggacgggcgtaccgccacgccgtcgaggagctgccagagaccatggagacgctcctgctgctcggcctgatgatcctgctcaccgggggagccatgctgttcctaataagcggcaaggggataggaaagaccaccatcgggctcatctgcgtgatcgtgagctccggcatgctgtggatggccgacatccccttgcagtggatcgccagcgcgatcgtcctcgagttcttcatgatggtactgttgatccccgagcccgaaaagcagcggacgccgcaagacaaccagctcgcgtatgtggtcatcgggatactgacattagccgccatcgtggcggcgaacgaaatgggcctactggaaaccaccaagcgcgatctgggcatgtccaaggagcccggggtggtcagccccacgtcctacctcgacgtggacctgcacccagcaagcgcgtggaccctgtatgcggtagccaccaccgtcatcacgccaatgttacggcacaccatcgagaattcaaccgcgaacgtgagcctggccgccatcgcgaaccaggcggtggtcctgatgggtctggacaaggggtggcccatctccaaaatggacctgggggtcccgctgctcgccctggggtgctactcccaagtaaaccccctgaccctcacggccgcggttctgctactcgtgacccattacgccatcatcggcccgggccttcaggcgaaggccacacgcgaggcccagaagcggaccgcggccgggattatgaagaaccccacggtggacggcataatgaccattgacctggaccctgtcatctatgactccaagtttgagaaacaactcggccaagtaatgctactggtgctctgcgcggtccagctgctgctcatgaggaccagctgggccctgtgcgaggccctgaccctcgccacaggcccaattacaacgctgtgggagggctccccgggaaagttctggaacaccacgatcgcggtgagcatggcgaacatcttccggggctcctacctggccggcgccggcctcgccttctcaattatgaaatccgtggggactgggaggcggggcaccgggagccagggcgaaaccttgggagaaaagtggaagaaaaaactgaatcagctctcccgcaaggagttcgacttatataagaaatccgggattaccgaagtcgatcggacggaagcgaaggaaggattgaaacgcggcgagaccacccaccacgccgttagccgtggctccgcgaagctccagtggttcgtggaaaggaacatggtcatccccgaggggcgcgtgatcgacttgggctgtggtcgcggtgggtggtcttactactgcgccggactgaagaaagtgacggaagtacggggctacacgaagggcgggcccgggcatgaggagcccgtgccgatgtcgacctatggttggaacatcgtgaagttgatgagcggaaaggacgtcttctacctgccacccgagaagtgtgacaccctgttgtgcgacatcggcgagtcgagcccctccccaaccgtggaggaatcacgaacgatacgggtactaaaaatggtcgaaccctggttgaagaacaatcagttctgcataaaagttctgaacccctacatgcccacagtaatcgagcacctcgagcggctgcagcgcaagtacggcggtatgctggtccgaaaccctctatcccgtaactcaacccacgagatgtactggatcagcaacgggaccggcaacatcgttagctccgtgaacatggtcagcagactactgctcaaccgcttcaccatgacgcatcggcgtcccaccatcgagaaggacgtagacctgggcgccgggacccggcacgttaatgctgagcccgagactccgaacatggacgtaatcggggagcgcatcaagcggatcaaagaggagcattccagcacctggcactacgacgacgagaacccctataaaacgtgggcctaccacggctcctacgaagtgaaagccacggggagcgcatccagtatgatcaacggcgtcgttaagctgctcacgaagccatgggacgtggtccccatggtaactcagatggctatgaccgacactaccccgttcgggcaacagcgagtgtttaaggagaaggtcgatacccggacgcccagacccatgccgggcacccggaaggtgatggagatcacggcggaatggttgtggcgcaccctcggccgaaacaagaagccgcggttgtgcaccagagaggagtttaccaagaaggtgcggacgaacgccgccatgggcgccgtattcacagaggagaaccagtgggatagtgcccgcgcggccgtggaggatgaggaattttggaaactggttgaccgggagcgcgagctgcacaagctcggcaaatgtgggtcctgcgtctacaacatgatgggcaaacgggagaagaagctgggggagttcggcaaggcgaagggcagccgtgccatctggtacatgtggctgggggcgaggtttcttgagttcgaagccctaggcttcctaaatgaggatcattggttttcccgcgagaactcttactccggagtggagggcgaagggcttcataagttaggctacattctgcgggatatctcgaagatccctggtggggcaatgtacgccgatgataccgcgggctgggatactcgcattacagaggacgacctccataacgaggagaagatcacccagcagatggaccccgagcaccggcaactggcaaacgcaatattcaagttgacctaccagaacaaggtggtaaaggtgcagcgccccacacctaagggaaccgtgatggatattatctcccggaaggaccagcggggcagcggccaggtagggacgtacggtctcaacaccttcaccaacatggaggctcagctggtcagacagatggagggggagggggtactgtccaaagccgacctcgagaatccccacctcctcgagaagaaaattactcagtggctcgagaacaagggggtcgagaggctgaagcggatggccatcagcggcgacgactgcgtggttaaacccatcgacgaccgattcgcgaatgctctactcgccctgaacgacatgggcaaggtccgaaaggacatcccccagtggcagccatccaaaggctggcatgactggcagcaggtccccttctgcagccaccatttccacgagctgattatgaaggatggccgcaagctcgttgtcccatgccggccccaagacgagctgatcgggagagcccgcatatctcagggtgcggggtggtctctgaaagagacagcgtgcctcggcaaggcatatgcccagatgtggtccctgatgtacttccaccggagagacctgcggctcgcctcgaatgccatctgctccgcggtgccggtgcactgggtaccgacctctcgcaccacctggtccatacacgcacaccaccagtggatgacgaccgaggacatgctggccgtgtggaaccgggtgtggatcgaagacaacccctggatggaggacaagacccccgtcaccacgtgggaggacgtcccgtacctcggcaagcgcgaggaccaatggtgcgggagcctcatcggcctgaccagccgggccacctgggcgcagaatattttaaccgccatccagcaggtacgaagtctgataggggacgaggagttcctggactacatgcccagcatgaagcggttccgcaaggaggaagaatccgagggtgctatctggtga

SEQ ID NO: 25767 - RNA, 9873 nt, synthetic construct
  misc_feature 1..9873: note = derived and/or modified CDS sequence (opt11) from DENV-3__FJ639721__SS-prME
  source 1..9873: mol_type = other RNA
accagcctgtgcctcatgatgatgctgcccgcaaccttagccttccacctcacctcccgcgatggcgagccccggatgatcgtggggaaaaacgagcgcggcaagagcctgctgtttaagaccgccaccgggatcaacatgtgcaccctcattgccatggacttaggcgaaatgtgcgacgacaccgtcacatacaagtgccccctgatcgtggaggtcgagcccgaggacattgactgctggtgcaaccttacctccacttgggtcacctacgggacctgcaaccaggccggggaacaccggcgagacaaaagatccgttgcactggcgccccacgtgggcatggggctggacacccgtacacagacgtggatgtccgctgagggcgcatggcgacaggttgagaaagtggagacctgggccctccgccacccagggttcacaatcctggccctgttcctcgcgcactacatcgggaccagcctgatccagaaggttgtaattttcatcttactcatgctggtaacgccgtccatgaccatgcggtgtgtgggcgtgggcaaccgcgacttcgtggaaggtctgagcggcgctacctgggttgacgtcgtgctcgagcacggtgggtgtgtgaccacgatggccaagaacaagcccaccctggacatcgaactgcagaaaaccgaggccacccagctcgccacgctgagaaagttgtgcattgagggcaagatcactaacatcaccaccgactcccgctgcccgacgcagggcgaagcgatcctccctgaagaacaggaccaaaactacgtctgcaagcacacctacgtggaccgggggtggggcaacgggtgcggtctgttcgggaagggcagcctggtgacctgtgccaagttccagtgcctcgagcccatcgagggcaaagtcgtgcaatacgagaacctgaagtacaccgtcataatcacggttcatactggggaccaacaccaggtggggaacgatacccagggcgtcaccgttgagatcacgccccaggcctctacggtagaggcggtcctgcccgagtacggcaccctcggccttgagtgcagcccgaggactggcctggacttcaacgaaatgatcctactgactatgaagaataaggcctggatggtgcaccggcagtggttcttcgatctgcccctcccttggacttcgggcgctaccaccgagacccccacgtggaaccgcaaggaactgctggtcacattcaaaaacgcccacgccaagaagcaggaggtggtcgtgcttgggtcacaagagggcgcgatgcacaccgccctgaccggggcgaccgaaatccagaactccggcgggaccagcatcttcgctggccacctgaagtgccggctcaagatggacaagctggagctgaagggcatgtcctacgccatgtgtctcaacaccttcgttttaaagaaggaggtaagcgagacccagcacgggactatcctgataaaggtagaatacaaaggcgaggacgctccgtgcaagatccccttcagtaccgaggatggccaagggaaggcgcacaacggcaggctcatcaccgctaaccccgtagtaactaagaaggaggagcccgtgaacattgaggccgagccgcccttcggagagagcaacatcgttatcggcatcggggacaaggccctgaagatcaattggtacaaaaagggcagctccatcgggaagatgttcgaagccacggcccggggcgcccgccggatggctatcctgggtgacacagcttgggacttcgggagcgtgggcggggtgctgaactcgctcggtaagatggtgcatcagatcttcgggagcgcctacacagcgctgttctccggtgttagctggatcatgaagattggcataggggtgctgctaacatggatcggcctcaattccaagaatacaagcatgtcctttagctgcatcgtgatcgggatcattaccctgtacctcggggccgtggttcaggccgacatggggtgtgtcatcaattggaagggcaaggagttgaaatgcggctccgggatcttcgtaaccaacgaggtccacacctggacggagcagtacaagttccaggcggactcgcccaagaggctggcaaccgcgatcgctggcgcatgggaaaacggggtctgcggcatccgctccaccacgcgaatggagaacctcttatggaagcagatcgccaatgagctgaactatatcctctgggagaataacataaagctgacggtggtagtcggggatatcatcggcgtactggagcaaggtaagcgcacccttacgccgcagccgatggagctgaagtacagctggaagacctgggggaaggccaagatagtgacagcggagacccaaaactctagctttatcatcgacggtcccaacacccccgaatgcccctccgcctcgcgggcctggaatgtctgggaggtggaggactacgggttcggcgtttttaccacaaatatctggctaaaactcagagaagtctacacccagtcctgcgaccaccgcctaatgagcgcagcgatcaaggacgagcgcgccgtgcatgcagacatgggctactggatcgagagccagaagaacgggtcctggaagctggagaaggccagcttcatcgaggtcaagacttgcacctggccgaagtcccacactctctggagcaatggagttctggagtccgacatgataatccctaaaagccttgccgggcccatctcccagcacaaccaccgccctggctaccacacgcagaccgctgggccctggcacctaggcaagctggaactggatttcaactactgcgagggcaccaccgtggtgataacggagaactgcgggaccagaggccccagcctgcggaccacgacggtgagtggcaaactgatccacgagtggtgctgccgcagctgcaccctgccacccctccggtacatgggggaagacgggtgttggtacggtatggagattcgccccatcaacgagaaggaagagaacatggtgaagtccctggtgtccgctggctcagggaaggtcgacaactttaccatgggcgtgctgtgcctcgccatcctgtttgaagaagtgatgcgggggaaatttggcaagaagcacatgatcgcgggggtactgtttaccttcgtattactgttgagcggccagattacctggcgcgacatggcccacaccctcataatgattggctccaatgcgtctgaccggatggggatgggagttacctacctggcgttgatcgccacgttcaagatccagcccttcctcacgctggggttcttcctaagaaaactcacatcccgggagaacctgctgttgggcgtcggtctggctatggctaccaccttgcagttacccgaagacatcgagcagatggcgaacgggatcgcgctgggcctgatgacgctaaaactaatcacccagttcgaaacctaccagctgtggactgccctcgtcagcctgacgtgcagcaataccatattcaccctgacggtcgcttggcgcacggcgacactcatactggccggggtgagtctgttgccgctgtgccagagctcctcgatgcgaaaaaccgattggctgcccatgaccgtggccgccatgggggtgccgcccttgccgctgttcatattttccctgaaggacgcccccaagcgcaggtcctggcccctcaatgagggagtgatggcggtcggcctggtctcgatcctggcaagctccctcctgcggaacgacgtgcccatggccggaccgctggtggccggcggcctcctgatcgcttgctacgtcatcaccgggaccagcgctgacctgacggtggagaaggcggcagatgttacctgggaggaggaggccgagcaaacgggcgtctcccacaatctcatgatcaccgtggacgacgacggaaccatgcgcatcaaggatgacgagaccgaaaacatactgaccgtactgctcaagacggccctgcttatcgtcagcggcatcttcccctactcgattcccgcgaccttactggtgtggcacacctggcaaaagcaaacccagcggagcggcgtgttatgggacgttccctccccgcccgagacgcaaaaggcagagctcgaagagggtgtataccgcatcaagcagcagggcatctttgggaaaacccaggtgggcgtcggcgttcaaaaggagggggtgtttcacaccatgtggcatgtcacccgtggcgccgtgctaacgcacaacgggaagcgcctggagcccaactgggcctctgtgaagaaggacctcatctcttatggtggagggtggcggctgagcacccagtggcaaaagggggaggaggtccaggtgatcgccgttgaacctggcaagaacccgaagaacttccagaccatgcccggcatcttccagaccactactggggagataggagcgatcgccctggactttaagcccggcacttccggcagccccatcatcaaccgagaaggcaaggtcgtcggtctgtacggcaacggtgtggtcaccaagaacggagggtatgtgagcggcatcgcgcagacgaatgccgagcccgacggcccgacccccgagctcgaagaggagatgttcaagaagcggaacctgaccatcatggatctgcacccggggtccggcaagacccgcaagtacctccccgcgatcgtacgggaggcaatcaaacgtcggctaaggacgctgatcctcgcccccactcgggtcgtggccgctgagatggaggaagcgctgaaagggttacccatccgctaccagaccacagccaccaagagcgagcatacgggccgggagatcgtagatctcatgtgccacgccacctttaccatgcgcctactgagcccggtccgggtgccaaactacaacctcatcattatggacgaggcccacttcacggatcccgctagcatcgcggcccgcgggtacatttccacccgggtgggcatgggggaggccgccgcaatattcatgactgcgaccccgcccgggacggccgaggcgttcccccagtcaaacgcgcccatccaggacgaggagcgcgacatcccggagcgttcctggaacagcggcaacgagtggataaccgactttgtcggaaagaccgtgtggttcgtaccgtccatcaaggctggcaacgacatcgccaattgcctacggaaaaacgggaagaaagtcattcagctgagccgcaaaacctttgacacggagtaccaaaagacacggttgaacgactgggacttcgtggttaccaccgacatctccgagatgggcgccaacttcaaagcggaccgcgtaatcgatcccagacgctgcttaaaacccgtcatcctaacggacggccccgaacgggttattctcgccgggccgatgcccgtcaccgcggcctcagccgcccagcgcagagggcgcgtaggccgaaacccccaaaaggagaacgaccagtacattttcacaggacagcccctgaacaacgacgaagaccacgctcattggaccgaggcgaagatgctgttggacaacataaataccccggaggggattatccccgccctgttcgagccggagagagagaagagtgccgccatcgatggtgagtatcgcctgaagggggagagccgcaagacgttcgtcgagctaatgcggaggggtgacttgcccgtctggctcgcccacaaggtggcgtccgagggcataaagtacacagaccggaagtggtgttttgacggggagcgcaacaaccagatactcgaagaaaacatggatgtcgagatctggacaaaggagggcgagcggaagaagctgcgcccacgctggctggacgcccgaacctactctgaccccttagcgctgaaggagttcaaggacttcgccgcgggccgcaagagtatcgccctggatctcgtgacggaaatcgggcgggtgcccagccacctggcccaccgtacccggaacgccctggacaacctagtaatgctgcacacctccgaacacggtgggcgcgcttaccggcacgcggtggaggagctgccggagaccatggagacgctcctgctgctgggcctgatgatcttacttaccggcggcgcaatgctgttcttagtatcaggcaaggggatcggcaagaccaccatcgggctcatatgtgtaattgtgagctccggcatgctgtggatggccgacatccccctgcagtggatcgcctcagcgatcgtgctagagttcttcatgatggtcctgctgatccccgagcccgaaaaacagcgcacgccgcaggacaatcagctcgcgtacgtggtgatcgggatactcaccctggccgccatcgtcgccgccaatgagatgggcctcctggagaccaccaaacgggacctgggcatgtccaaggagcccggcgtggtgagccccacgtcctatctcgacgtcgatctgcaccccgcgtctgcctggaccctgtatgccgtggctacgaccgtgatcacgccgatgctaagacacacgatcgaaaactccaccgccaacgtctcactagctgccatagccaaccaagccgtggtcctgatgggccttgacaaagggtggcccatcagtaaaatggatctgggcgtccccctccttgcgttagggtgctactcacaggttaaccccctgacccttacggccgccgtgctgctgctcgtcacccactatgccattatcggacccgggctgcaggcaaaggcgacacgggaggctcagaagagaaccgccgccggcatcatgaagaaccccacggtagatggcatcatgacgatcgacctggatccagtgatctacgactccaagtttgaaaagcagctcggccaagtcatgctcctggtgctctgcgccgtgcagcttctgctcatgcgtactagctgggcgctgtgcgaggcactgaccctcgccacaggcccaatcactaccctgtgggagggttccccggggaagttctggaataccacaatcgccgtcagtatggccaacatctttcgcgggtcctacctggcaggcgccggcctagcatttagcatcatgaagtccgtggggactggacggcgcggcaccgggagccagggcgaaaccctgggggagaagtggaaaaagaaactgaaccagttgtcccgcaaggagtttgacctgtacaagaagtccggcatcacagaggttgaccgcactgaagccaaggaggggttgaagcgtggcgagaccacgcaccacgccgtcagccgcggctcagccaagctccaatggttcgtggagcggaacatggttatacccgaagggcgtgtcatcgatctgggctgcgggcgcggcgggtggagctactattgcgcaggactgaaaaaggtgaccgaagtgcgggggtacacaaagggcgggcccgggcacgaggagcccgtcccgatgtccacctacggctggaacatcgtgaagctcatgagcggcaaggatgtgttctacctaccgcctgaaaagtgcgacacactgttgtgcgacatcggcgagtcgagcccatccccgactgtcgaagagagccgcaccatacgggtgctcaaaatggtagagccctggctcaagaacaaccagttctgtatcaaagtgctgaacccctacatgccgaccgttatcgaacacctcgagcgactgcagcggaagtacggcgggatgttagttcgaaacccgctatcccggaacagcacccacgagatgtactggatctccaacggcacagggaacatcgtcagctccgttaacatggttagtaggcttctcctcaatcgtttcacgatgacccatcgccggcccactatagagaaggatgtggatctgggcgccggcacccggcatgtgaacgccgagccagagacgcctaatatggacgtcattggtgaacggattaagagaatcaaggaggagcactccagcacctggcactacgacgatgagaacccctacaagacctgggcgtatcacggctcttacgaggtgaaagcgaccgggtcagcctcctctatgatcaacggcgtggtcaagctgttaactaagccctgggacgtggttcccatggttacccagatggccatgaccgataccacgcctttcgggcagcagagggtgttcaaggaaaaagtggacacacgtacgccgcggccaatgcccggaacgcgcaaggtaatggagatcacggccgagtggctatggcggaccctgggtcgcaacaagaagccgcgcctctgcacccgggaggagttcaccaagaaagttcgcacgaacgccgccatgggagcggtttttaccgaggagaaccaatgggacagcgcgcgggccgcggtcgaggacgaggagttctggaagctggttgatagagagcgggagctccacaagctcgggaagtgcgggtcctgcgtgtacaacatgatgggcaagcgcgagaagaagctgggggagtttgggaaggctaaagggagccgggccatctggtacatgtggctgggggccaggttccttgagttcgaggcgctgggcttcctgaacgaggaccactggttctcgcgggaaaattcctactccggggtcgaaggcgaaggacttcacaagctgggctatattctgcgggacatcagcaagatccccggcggggctatgtacgccgatgacactgcgggctgggatacacgcatcacagaggacgacctccataacgaggagaagataacccagcaaatggatcccgagcacaggcaactggcaaacgctatctttaagctgacctaccagaacaaggtcgttaaagtccaacggcccacaccaaaggggaccgtgatggacatcatctcccgcaaggaccagcgggggtccggccaggtggggacctacggcctcaacactttcaccaacatggaggcccagctggtccgccaaatggagggtgagggcgtactgtccaagaccgatttggagaacccccatcttctggagaaaaagatcacgcagtggctcgagaataagggggtagagcggctgaagcgcatggccatcagcggcgatgattgcgtcgtgaagccaatagatgatcgattcgccaacgccctgctcgcgctgaacgacatgggcaaggtgcgcaaggatatcccccagtggcagccgtccaaaggttggcacgactggcagcaggtccccttctgcagtcaccacttccacgagctgatcatgaaagacggccggaagctcgtggtcccctgccgcccccaggacgagctgatcgggcgcgccagaatctctcagggcgccgggtggagtcttaaggaaaccgcctgcctcggcaaggcctacgctcagatgtggtccctcatgtacttccatcgccgcgacctccggctcgcctcgaatgcgatatgcagcgccgtcccggtgcactgggtacccaccagcaggacaacctggtcgatccacgcacaccatcagtggatgaccacagaggacatgctgactgtctggaatcgcgtgtggatagaggacaacccctggatggaagacaagacgcctgtgaccacttgggaagatgtcccgtacctgggcaagcgagaggaccaatggtgcggtagcctcatcggcttgaccagccgcgcgacgtgggcccagaatatcctgaccgccatccaacaggtacggagcctcatcggtgacgaggagttcctggactacatgcccagcatgaagcgcttccggaaggaggaggaatcggaaggtgcgatctggtaa

SEQ ID NO: 25768 - RNA, 9873 nt, synthetic construct
  misc_feature 1..9873: note = derived and/or modified CDS sequence (opt11) from DENV-3__FJ639722__SS-prME
  source 1..9873: mol_type = other RNA
actagcctgtgtctcatgatgatgctgccggcaacactggcattccacctaaccagccgggatggtgagccacggatgatagttgggaagaacgagcgcggtaagagcctgctgttcaagacagcgactggtatcaatatgtgcaccctaatcgccatggacctcggcgagatgtgcgacgacacggtgacatacaagtgccccctgatcgctgaggttgaacccgaggatatcgactgctggtgcaacctcaccagcacgtgggttacgtacggcacctgcaaccaggccggcgagcatcggcgcgacaagcggagcgtcgctttggcaccacatgtgggcatggggctcgacacacgcactcagacctggatgtccgcggagggagcctggcgccaggtcgagaaggttgagacctgggcactccgccatccggggttcacaatcttagcgcttttcctagcccactacatcggcacctctctgatccagaaggtggtgatcttcattctgcttatgctggtcacgccctctatgacgatgcgttgcgtgggggttggcaaccgggatttcgtcgaaggcctgtcgggggctacatgggtggacgtagttctcgagcacggcggctgcgtgaccactatggcaaagaacaaacccaccctggatatcgagctgcagaagaccgaggcgacacagctcgcgacgctgcggaaactgtgtatcgaaggtaagattaccaacatcaccaccgactcacgctgccccacgcagggggaggccatactcccggaggagcaggaccagaactacgtctgcaagcacacctacgtcgatcgggggtggggcaacgggtgcggcctgttcgggaagggctctctcgtgacttgcgccaagtttcagtgtttagaacctatcgaggggaaggtagttcagtatgaaaacttgaagtacacggtgattatcacggttcatacaggagaccagcaccaagtaggcaacgacacacagggggtgaccgtcgaaatcacgccccaggccagcaccgtggaagctgttcttcccgagtacggcaccctcggactggaatgtagcccgcgcaccgggctggatttcaacgagatgatcctcctgactatgaaaaataaggcgtggatggtccaccggcagtggtttttcgaccttccacttccttggacgtccggcgccaccaccgagacccccacgtggaaccgtaaagagctgctagtgacctttaaaaacgcccacgccaagaagcaggaggttgtcgtgctcgggagccaggagggggccatgcacacagcgctgaccggggctacagagatccaaaactccggcgggacttcaatctttgcgggacacctgaaatgccggctcaagatggacaagctggagctgaagggcatgtcctacgctatgtgcctcaacaccttcgtgctgaagaaggaggtgagcgagacccagcatgggacgatccttatcaaggtggaatataaaggtgaggacgccccatgcaagatccccttttccaccgaggacgggcagggtaaggcgcacaacggtcgcttaataaccgccaaccccgttgtcaccaagaaggaagagcccgtgaacatcgaggccgagccccccttcggggagagcaatatagtgattggcattggggagaaggcactcaagatcaactggtacaagaagggtagctccatcgggaaaatgtttgaggcaacggccagaggcgcccggaggatggcgatcctgggtgacaccgcatgggacttcgggagtgtcggtggggtactgaattcgctcggaaagatggtgcaccaaatctttggatctgcttacactgccctgttctcaggcgtcagctggatcatgaagattggcatcggggtgctattaacatggatcggcctaaactccaagaacaccagcatgtctttcagctgcatcgtaatcgggataattaccctgtacctaggagccgtagtgcaggccgacatggggtgcgtgatcaattggaagggcaaggagttaaaatgtggatcgggcatcttcgtcaccaacgaggtgcatacgtggactgagcaatacaagttccaagccgactctcccaagcgactggcgacggcgatcgccggcgcctgggagaatggagtgtgtggtatccgctcaaccacccggatggaaaacctcttatggaagcagatcgccaatgaattgaactacatcctctgggagaacaacatcaagttgacggtcgtggtgggggacatcatcggagtcctggaacaaggcaagcgcaccctcactccccagccgatggagctgaagtacagctggaagacatgggggaaggcaaaaatcgttacggctgagacccagaactccagcttcatcatcgacggcccaaacacgcccgagtgccccagcgcctcacgggcgtggaacgtgtgggaagtcgaagattacgggttcggcgtgttcaccacgaacatatggctgaaactccgcgaggtctacacgcagtcgtgcgaccatcggcttatgagcgcggccatcaaagacgaacgcgccgtccacgccgatatgggatactggatagagtcgcaaaagaacgggtcctggaagctcgagaaggccagcttcattgaggtgaaaacctgcacctggccgaaaagccacaccctctggagcaatggggtgctggaatcggacatgataatccccaagtctcttgccgggccgatctcccaacacaatcaccgtccgggctatcacacgcagaccgccggcccctggcacctcggcaagctggagttagactttaactactgcgaaggcactaccgtcgtgatcacggagaactgcgggacacgcggccccagcctccggaccacgacggtctcggggaaactgatccatgaatggtgttgccgctcttgcaccctgcccccgttgcggtacatgggcgaagacgggtgctggtacggtatggagatccgccctatcaacgagaaggaggagaatatggtgaagagtctcgtgagcgcgggctccgggaaggtggacaacttcaccatgggcgtcctctgcctcgccattctgtttgaagaggtgatgcgggggaagtttggtaagaagcacatgatcgctggggtgctcttcaccttcgtcctcttgctgagcggccagatcacatggcgcgacatggcacacacactcatcatgatcggctccaatgccagcgatcgtatggggatgggagtgacgtacttggcgttgatcgccaccttcaagatccagcccttcctcgcgctggggttcttcctgcggaaactcacatcccgggagaatctgctgctcggtgtgggcctggcgatggctaccacgcttcagttacccgaggacattgagcaaatggcaaacggcatcgccctagggctcatgaccttaaaactgatcacgcagttcgagacctatcaactgtggaccgcgcttgtaagcttaacctgcagcaacactattttcacccttacagtggcatggcgcacggccactctgatcctggccggtgtctctctgctccctttgtgccagagttcaagcatgaggaagacggactggctgcccatgaccgtagccgcgatgggtgtcccgcctctgccgctgtttatcttttccctgaaggacgccccaaaacgccgcagctggccgctcaacgagggggtgatggccgtgggcctggtgagcattctggccagcagcttacttcggaacgatgtcccaatggccggaccgctggttgccggcgggctgctgatagcgtgctacgtgatcacggggacgtccgccgacctgaccgtcgagaaggccgccgacgtgacctgggaggaggaggccgagcaaactggggtgtcccacaacttgatgataacggtcgacgacgacggcacaatgcgcatcaaagacgatgagaccgagaacattctgaccgtgctgcttaagacagccctgctaatagtcagcggcatattcccctactcaatccccgccacgctattagtctggcacacctggcagaagcagacccagcggagcggggtgctatgggatgtgccctctccgcccgagactcagaaggctgagctcgaagagggtgtataccgcatcaaacagcagggaatcttcgggaagacacaggttggcgtgggcgtccaaaaagaaggcgttttccataccatgtggcacgtgactagaggagccgtcctgacacataatgggaagaggctggagcccaactgggcgagcgtcaagaaggacctcatctcttacggtggggggtggcggttgtccacgcaatggcagaaaggcgaagaggtgcaggtcatcgcggtggaacccggcaaaaacccgaagaacttccaaaccatgccaggcatctttcaaaccaccacgggggaaatcggagccatcgccctggatttcaagccggggacctccggtagtccaatcatcaacagagagggcaaggtggtaggcctgtacggcaacggggtggtgaccaagaatggggggtacgtgagcggaatagcccagacaaatgccgagcccgacggccccacccctgaactcgaggaagagatgttcaagaagcgcaacctgacgatcatggacctgcacccgggttccggcaagacccgcaagtacctccccgccatcgtacgagaggcgatcaagcgccggctgcgtaccctgatcctagccccaacgcgggttgtcgcggccgaaatggaggaggccctgaaagggcttcccattaggtatcagaccacagccaccaagagcgagcacacggggcgggaaatcgtagatttgatgtgccacgccaccttcacgatgcggctgctgtccccggttagggtccccaattataatctcatcatcatggacgaagcgcacttcaccgaccccgccagcatcgccgcccgcgggtacatctccacgagggtaggcatgggcgaagccgcggcgatcttcatgaccgcgacgcccccagggacagccgaggcgttcccccaatccaatgcaccaatccaagatgaggagcgcgatatccccgagagatcctggaactcaggcaatgagtggattacggactttgtggggaagacagtctggttcgtcccatccataaaggcaggcaacgacatcgccaattgccttcggaagaatgggaagaaggttatacagctgagccggaagacgttcgatacggagtaccaaaagactcggttgaatgattgggacttcgtcgtaaccactgacatctccgagatgggcgcaaactttaaggcggatcgcgtgatcgacccacggcgctgccttaagcctgtcatcctcaccgacggccccgagagagtgatattagccgggccgatgcccgtgacagcagcctcagccgcgcagcgccgcggccgtgttgggcgaaacccccagaaggagaatgaccagtatatctttaccggccagcccctcaacaacgacgaggaccacgcccactggaccgaggcgaagatgttgctagacaacatcaacaccccggagggtatcatccccgccctgttcgagcccgagcgcgagaagtcagcagctattgatggcgagtaccggctgaagggcgagagccgcaagacctttgtggagctaatgaggcgcggggatctgcccgtctggctggcacataaggtcgcctccgaaggcatcaagtacacggatcgaaagtggtgtttcgacggcgagcgcaacaaccagatactcgaagagaacatggacgtggagatctggactaaggaaggggagcggaagaagctacgcccgcggtggctggacgcccggacctacagcgaccccctagctctgaaggagttcaaggatttcgccgcgggccgcaaatccatcgccttagacctcgtcacggagataggtcgggtgcccagccatctagcccaccgcacgcgtaacgcgctggacaatcttgttatgctgcacacctccgaacacggagggcgcgcctaccggcatgccgttgaagagttgccggaaaccatggagactctcctgctgctcggactgatgatcctgctcaccggcggggccatgctgttcctggtgagcgggaagggcatcggcaagaccacgattgggttgatctgcgtgatcgtctcttccggcatgctgtggatggccgacatccccttacagtggatagcgtcagccatcgtgctcgagttcttcatgatggtgctgctgatccccgaacccgaaaagcagcgaaccccacaggacaaccagctggcctacgtggtgatcgggatcttaacgttggccgccatcgtggcagccaacgaaatgggactcctggagaccaccaagcgggacttagggatgtcaaaagagccaggggtcgtgagccccacctcctacctcgacgtggacctgcaccctgcctcggcctggacactgtacgctgtcgcgaccaccgtgatcactccgatgctccgccatacgatcgagaactccacagcgaacgtgtctctggccgccatcgcgaaccaggccgtcgtactgatgggcctcgacaaaggttggcccatttcgaaaatggatctgggtgtgcccctgctggccctgggatgctacagccaggtcaatcccctgacactcaccgccgccgtgttgttactcgtgacgcactatgcgatcattgggcctggcctccaggctaaggctacccgggaggcccagaagcgtaccgccgccgggatcatgaagaaccccaccgtcgacggaattatgaccatagatctggaccccgtgatctacgactccaagttcgaaaagcagctagggcaggtcatgctactggtcctctgtgccgtgcaactgcttctcatgcggaccagctgggccctatgtgaagccctgactctcgccaccggcccgatcacgaccctgtgggaaggttccccggggaagttttggaacactactatcgcggtgagcatggccaacatcttccgcggctcgtacctggccggggctggcctcgcgttctcgatcatgaagagtgtcggaacgggccggcgaggcactggcagccagggcgagaccctgggggagaagtggaagaaaaagctgaaccaactctccagaaaggaattcgatttgtacaaaaagtccggcatcaccgaggtggatcgcaccgaagccaaggaagggctcaagcggggcgagacgacccaccatgccgtgtctcgcggttcggccaagctacaatggttcgtcgagcggaacatggtgataccagagggccgcgtgatcgaccttggctgcgggcgtggtggctggtcttactactgcgccggcctgaagaaggtaaccgaagttcggggctatactaaggggggccccgggcacgaggagccggtgccaatgtccacgtatggctggaacatagtcaaactcatgagcgggaaggacgtcttctacctgccccctgagaagtgcgacaccctgctgtgtgacatcggcgagtcctcgccctcccctacggtggaagaaagcaggaccatccgggttttaaagatggtcgagccctggcttaaaaacaaccaattctgcatcaaggtgctgaacccctacatgcccaccgttatcgagcacctcgagcgcttacaacggaagtacggcggtatgctggtacgaaaccctctctcccggaactcaactcacgagatgtactggatctccaatggcaccgggaacatcgtgagctccgtcaacatggtgtcccggctgctgctcaaccgctttactatgacgcatcgccgcccaacgattgagaaggatgtcgacctgggtgcgggcacccgacacgtgaacgccgagcccgagaccccaaacatggacgttatcggggagcggattaaacgcatcaaggaggaacatagtagcacgtggcactacgacgatgaaaacccctataagacctgggcataccacgggtcttatgaagtcaaggccaccgggagcgctagcagcatgattaacggcgtggtgaaactactaaccaagccatgggatgtcgtacccatggtgacacaaatggcgatgaccgacaccacgccgttcgggcagcagcgggtcttcaaggagaaggtggatacacgtacgcccaggcccatgcccggcacacgcaaggtgatggagatcaccgccgagtggctatggcggacgttaggccgcaacaagaagccgcgcttatgtacccgggaggagtttaccaaaaaggtccgcaccaatgccgccatgggcgcagtattcacggaggagaaccagtgggacagtgctcgggccgccgtggaggacgaggagttctggaagctggtcgaccgagagcgcgagctacacaagctcggaaagtgcgggtcctgcgtctacaacatgatgggaaaacgggagaagaagcttggtgaattcggcaaggctaagggcagccgtgcgatttggtacatgtggctgggggctcgcttcctcgagttcgaggccctgggattcctgaacgaggaccactggttctcgcgggagaactcctactccggggtggagggcgaggggctccacaagctgggctacatactccgcgatatcagcaagatccccggcggggccatgtacgccgacgataccgccggatgggacacccggattaccgaggatgacctccataacgaggagaagatcacgcagcagatggatccagagcacagacagctggccaacgccatcttcaagcttacataccagaacaaggtcgtaaaggtacagcggcccactccgaaaggaaccgtcatggatattatctcccgcaaggatcagcgaggcagcggtcaggtggggacatacggcctcaacacgttcaccaacatggaggcccagcttgtgcgccaaatggagggggagggggtcctgtccaagactgacctcgagaatccccacctcctggagaagaagatcacccagtggctcgagaacaaaggggttgagcgtctgaagcgaatggctatctcgggtgatgattgtgtggtcaaacccattgacgatagattcgcgaacgctctgctcgctctgaacgacatgggaaaggtgcgcaaggacataccccaatggcagccatccaaagggtggcacgactggcagcaggtccccttctgcagccaccacttccacgagctgatcatgaaagatgggcggaagctcgtcgtcccctgccggccccaagacgagctgatagggagagcccggatatcacagggcgccgggtggagtctaaaggagactgcttgtctcggcaaggcttacgcacagatgtggtccctaatgtacttccacaggcgagacctcagactcgccagcaacgccatctgcagtgcggtgccggtccactgggtgccaactagccgtaccacctggtccatccacgcgcaccaccaatggatgactaccgaggacatgctgaccgtgtggaaccgcgtctggattgaggacaatccatggatggaggacaaaacgcccgtgactacatgggaggatgtgccgtacctgggcaagcgagaggaccagtggtgcgggagtttgatcggcctgaccagccgcgcgacctgggcacagaacatactgacggcgatccagcaggtgcggtcgctcatcggggacgaggagttcctggactacatgcccagcatgaagcgctttcggaaggaggaggagtcggagggcgccatctggtag

SEQ ID NO: 25769 - RNA, 9873 nt, synthetic construct
  misc_feature 1..9873: note = derived and/or modified CDS sequence (opt11) from DENV-3__FJ639723__SS-prME
  source 1..9873: mol_type = other RNA
acctcgctgtgccttatgatgatgctgcccgccaccctggccttccacctaacatcccgggacggcgagcctcggatgatcgtaggtaagaatgagcgcggcaaaagcctactgttcaagaccgcgaccgggatcaacatgtgcaccctcatcgccatggatctgggcgagatgtgtgacgacaccgtgacatataaatgccctctgatcgccgaggtggagcccgaggacatcgactgctggtgcaacctcacctccgcctgggtaacctacgggacttgcaaccaagccggcgagcaccggcgcgacaagcgttccgtggccctggcgccgcatgttgggatggggctggacacccgcacacagacatggatgtccgccgagggcgcgtggcgccaggtggagaaagttgagacgtgggcgctaaggcacccgggcttcaccatcttagccctgttcctggcccattatatcggcaccagcctgattcagaaagtggtgatcttcattttgcttatgctcgtcaccccctcgatgacgatgcggtgcgtgggggtgggcaaccgcgacttcgtcgagggcttgtcaggggcgacctgggtggacgtcgtcctcgagcacggcgggtgcgtgaccacgatggccaagaacaagcccacgctggacatcgagctgcagaagacggaggcgacgcagctcgccaccctgcggaagctgtgcatcgagggcaagatcacgaacatcaccactgactcccgctgcccaacccagggcgaggctatcctcccggaggagcaggaccagaactacgtgtgcaagcacacgtacgtcgaccggggatggggcaacgggtgcggcttattcggcaagggcagcctggtgacctgtgccaagttccagtgcctcgagcccattgaaggcaaggtggtccagtacgagaacctgaagtacaccgtgatcatcactgtgcacaccggcgaccaacatcaggtcggcaacgacacccaaggcgtgaccgtcgagatcacgccccaggcctccacagtggaggcggtgctgcctgagtacggcaccctcgggctggagtgcagccctcgaactggcctggactttaacgagatgatactcctgaccatgaagaacaaagcctggatggtccataggcagtggttcttcgaccttcccttgccttggacctccggcgccactactgagacacccacctggaaccgaaaggaactgttggtgacgttcaagaacgcccacgccaagaaacaggaggtggtcgtactcgggtcgcaggagggcgcgatgcacaccgcactgaccggggccaccgaaatccaaaactccggcggcacgagcatcttcgccgggcacctcaaatgccggctcaagatggacaagctggagctgaaaggcatgtcctacgccatgtgcctcaacaccttcgtgctcaggaaggaggtcagcgaaacccaacacggcacaatcctgattaaagttgagtacaagggtgaggacgcgccgtgcaagatccccttttccacggaggacggacagggcaaggcccacaacggccggctgataaccgccaaccccgtggtcaccaagaaggaggaacccgtgaacatcgaggccgagccgcctttcggggagtctaacatcgtgatcggcatcggggacaaggcgctcaagatcaactggtacaagaagggttcctcaatcggcaagatgttcgaggccaccgcgcgcggcgcccggcgcatggccatactgggcgacactgcgtgggacttcgggagcgtcggcggggtgctgaactccctcgggaaaatggttcaccagatctttgggagcgcctacaccgccctgttctccggcgtctcttggatcatgaagattggcatcggagtgctgctgacctggatcggcttaaactccaaaaatacgtcgatgtccttctcgtgcatcgtaatcgggatcattacgctatacttaggcgcggtcgtgcaggccgacatggggtgcgtgatcaactggaagggcaaggagctgaagtgtggatccggcatattcgtcactaatgaggtgcacacctggaccgaacagtataagttccaggcggactcacccaagcgcctggcgacggccattgccggcgcctgggaaaacggggtgtgtgggatccgatcaaccacccgaatggaaaacctactgtggaagcaaatcgcgaacgagttgaattacattctctgggagaacaacatcaagctgaccgtcgtggttggggacatcatcggcgtcctggagcagggcaagcggacgctcacgccccagccgatggagctgaagtacagctggaaaacctgggggaaggccaagatcgttaccgccgagacgcagaacagcagtttcatcatagacggccccaatacccccgagtgcccctctgcctcccgagcctggaatgtgtgggaggtcgaggactacgggttcggcgtgttcacgaccaacatctggctaaagctccgggaggtgtacactcagtcctgcgaccaccgcctgatgagcgccgccatcaaggatgagcgggcagtccacgccgacatgggctactggatcgagagtcagaagaacggatcctggaagctagaaaaggcgagcttcatcgaggtgaaaacctgtacctggcccaagtcccacaccctctggagcaacggcgtcctggagtccgacatgattatccccaaaagcctcgcagggcccatatcccagcacaaccaccgcccgggctaccacacccagacggcagggccctggcatctcggcaagctggagctggacttcaactactgcgagggcaccaccgtcgtgataaccgagaactgcgggacgcggggcccctccctccgaacgaccacggtgtctgggaagctcattcacgagtggtgctgccggagctgcacgctgcccccgctccggtacatgggcgaggacgggtgctggtatggcatggagatccggcccactaatgagaaagaagaaaacatggtcaaatccctggtgagcgcaggttcggggaaggttgacaacttcaccatgggcgtcctgtgcttggctatcctgttcgaagaggtgatgcgcgggaagttcggaaagaagcacatgatcgcgggggtgctgttcaccttcgtcctcctgctgtctggccagataacctggcgcgacatggcccacacgttgatcatgatcggctcaaacgcgagcgaccggatggggatgggcgtgacctacctggccctgatcgccaccttcaaaatccaacccttcctcgcgctgggattcttcctgaggaaactcacgtcccgcgagaatctgctattaggcgtgggcctggcgatggccaccacgctgcaactccccgaagacatcgagcagatggcgaacggtatcgcactgggtctgatgaccttgaagctaatcacgcagttcgagacataccagctttggacagccctggtcagcctgacgtgcagcaacacaatattcaccctgaccgtggcctggaggacggccacacttattctggctggcgtctccctgctcccgctgtgccagagctccagcatgcggaagacagactggctgcccatgaccgtggcggctatgggcgtgccgcccctgccactcttcatcttctccttaaaggacacccccaagcgccgtagctggcccctgaacgagggggtaatggccgtgggcctcgtatccatcctggcctcttccctcctgcgcaacgacgttcccatggccggcccgctggtggccgggggcctcttaatcgcgtgctacgtgatcaccggcacgagcgccgacctgaccgtcgagaaggctgccgacgtgacctgggaagaggaggcggagcaaacgggggtgagtcacaacctcatgatcaccgtagacgatgacgggaccatgcggatcaaggacgacgaaactgagaatatcctgacagtactgctcaagacggccctcctgatagtgagcggcatctttccctactcaatccccgccaccttgctggtctggcacacctggcagaagcagactcagcggagcggcgtgctgtgggacgtgccttctccgcccgagacgcagaaggctgagctcgaggagggggtctaccgtatcaagcagcagggcatcttcgggaaaacccaggtcggcgtgggggtccagaaggaaggcgtgttccacaccatgtggcatgtgactcgcggtgctgtcctgacgcacaacgggaagcggctggagcctaattgggcgtcggtaaagaaagatctcatctcctacgggggcggctggcgcctcagcacccagtggcagaaaggggaggaggtgcaggtcatcgccgtggagcccggcaaaaatccgaaaaacttccagaccatgcccgggatcttccaaaccacgaccggggagatcggcgctatcgccctagactttaagcccgggacctccggctcaccgatcatcaaccgggagggcaaggtcgtagggctgtacggcaacggggtggtgaccaagaacggcgggtacgtctcaggtatcgcgcagacgaacgccgagcctgacggccccacccccgaattagaagaggagatgttcaagaagcgcaacctgaccatcatggacctgcacccggggtccggcaagaccagaaagtacctccccgccatcgtgagggaggccatcaaaaggcgcctccggacgttaatcctcgcccctaccagagtggtcgcggccgagatggaggaggccttgaagggcctgcccatacggtaccagaccacagccaccaagagcgagcataccggccgcgaaatcgtggacctcatgtgccacgccacctttaccatgagactgctgtcgcctgtgcgggtccccaactacaacctcatcatcatggacgaagcgcacttcacagatccggccagcatagccgcccgggggtacatctctacccgcgtgggcatgggcgaggccgcggccatcttcatgaccgcaacgccaccagggacagccgaggcttttccccagagtaatgcccccattcaggacgaggagagagacattcctgaacggtcctggaactccggcaacgagtggatcaccgacttcgtcgggaagaccgtatggttcgtgccctccatcaaggccggcaatgacatcgccaactgcctgcgcaagaacgggaagaaggtcatccagctgagccgcaagacgttcgacacggagtaccagaaaacccgcctcaacgactgggacttcgtagtgaccaccgacatttccgagatgggcgccaacttcaaggctgaccgggtgatcgacccccgccggtgcctaaagcctgtcatccttacggacggccccgagagggtgatcctcgctgggcctatgcccgtgaccgccgccagcgccgcgcagagacgcggccgggttgggcgcaacccccagaaggagaacgaccagtacatcttcactggacagcccctaaacaatgacgaggaccacgcgcactggactgaggccaagatgctgctggacaacatcaacaccccggaagggatcatccccgccctgttcgagccagagcgcgagaagtccgccgcgatcgacggcgagtacaggctaaagggcgagagccgtaagacgtttgtagaactcatgcgccgcggggacctaccagtttggctggcctacaaggtggcctccgaggggatcaagtacacagaccgcaaatggtgctttgacggggagcggaacaaccagatcctcgaggaaaacatggacgtcgagatctggaccaaagagggcgaacgcaagaagctccgcccgcggtggctagacgcccgcacatacagcgaccctctcgcactgaaggagttcaaggattttgccgccggcaggaagtccatcgccctggatcttgtcacggagatcgggcgcgtcccctcgcacctggcccatcggaccaggaatgctttagacaacctcgtgatgctgcacacctccgagcacgggggcagggcctatcgacatgctgtagaggagctgccggagaccatggagacgctactgctgctcggtctgatgatcttgctaaccgggggcgccatgctgttcctcattagcggaaaggggattggcaagaccaccatagggctcatctgcgtgatcgtaagctccggcatgctgtggatggccgacatccccttacagtggatcgcgtctgccattgtcctcgagttcttcatgatggtgctgttgatcccggagcccgagaaacagcggactcctcaggacaaccaactcgcctacgttgtcatcgggatcctgactctggccgcaatcgtggcggcaaacgagatgggcctactggagacgaccaagcgcgacctgggaatgtccaaggagcccggtgtggtcagcccgacttcctacctagacgtggacctgcaccccgcctccgcctggaccctgtacgccgtagcgaccaccgtcatcacgccgatgctccggcataccatcgaaaactccaccgctaacgtgtcgctggccgcaatcgcgaaccaagccgtggtcctgatgggcctcgacaaagggtggccaatctccaagatggatctgggtgtacccctgctcgccctggggtgctatagccaggtgaacccgctgaccctcacggccgctgtcctgctgctcgtcacccattacgcgatcattggaccgggcctgcaggccaaggccacccgcgaagctcagaagcggacagccgctgggatcatgaagaaccctacggttgacggcatcatgaccatagacctggatcccgtaatctatgactccaagttcgagaagcaactcggccaagtgatgctgctggtcctctgcgccgtccagttactactcatgcgtaccagctgggccctgtgcgaggccctgaccctcgccacgggtcccatcacgaccctgtgggagggctctccggggaagttctggaacaccactatcgcggtgagcatggccaacatatttcgaggctcctacctggccggggccggcctagcgtttagcattatgaagtccgtagggactggccgccggggcacagggagccagggtgagactctgggggagaagtggaagaagaagctgaaccagctctcccgcaaggagttcgacctgtacaagaagtcggggatcaccgaggtcgatcggacggaggcaaaggaggggctgaagcgcggcgagaccacccaccacgccgtgagccgggggtccgccaagctccagtggtttgtggagcgcaacatggtcatccccgaggggcgcgtgatcgacctgggctgcgggcgtggtggttggagctactactgcgccggcctgaagaaagtgaccgaggtccgcggctacacaaagggcgggcccgggcacgaggagcccgtgccgatgtccacctacggatggaacatcgtgaagctcatgagcgggaaggacgtgttctatctgcctcccgagaagtgcgataccctgctgtgcgacatcggggagtcgagcccctcaccgaccgtggaggagagccggaccatccgagtgctcaagatggtcgagccgtggctgaagaacaaccagttctgcatcaaggtgctgaacccctacatgcccaccgtgatcgagcacctcgagcggctgcagcgcaagtacggcgggatgctggtccggaacccgctctctcgcaacagcacccacgaaatgtactggatatcaaacggtaccggaaacatcgtgagcagcgtgaacatggtctcccggttactgctcaaccgcttcacgatgacccaccggcgccccactattgagaaagacgtggatctgggcgcgggcacccgccacgtcaacgccgaacccgaaacgccgaatatggacgtgatcggggagcgcatcaagcgtatcaaggaggaacactccagcacgtggcactacgacgatgagaacccctacaagacctgggcctaccacggctcctacgaagtgaaggccaccgggagcgcctccagcatgatcaacggcgtcgtgaagctactcacgaaaccctgggacgtcgtccccatggtgacccagatggccatgacagacacaacgccgtttgggcagcagagggtgttcaaggaaaaggtcgacacgaggacgcctcggcccatgcccggaacccggaaggttatggagatcacggccgaatggctgtggcgcaccctgggccgcaacaagaagccgcgtttatgcactagggaggagtttactaagaaggtgcggacgaacgccgccatgggggccgtcttcaccgaggagaaccagtgggacagcgcgcgcgccgcggtggaggatgaggagttctggaagctggtagaccgggagagggaactgcacaagctcggcaagtgcgggtcctgcgtatataacatgatgggcaagcgcgagaagaagctaggtgagttcggtaaggcaaagggcagccgcgccatatggtatatgtggctgggggcccggttcctcgagttcgaggcgcttggtttcctgaatgaagaccactggttctcccgcgagaacagctactccggggtagaaggcgaggggctacataaactgggctacatcctgcgggacatcagcaagatccccggaggggccatgtacgccgacgacaccgcgggctgggacacccgcatcacggaggatgatttgcataacgaagaaaagatcacccaacaaatggaccccgagcaccggcagctggctaatgccatcttcaagctgacttaccagaataaggtcgtaaaggttcagcgcccgacaccgaaggggaccgtgatggacatcatctcccggaaggaccaaagaggctctggccaggtcgggacgtatggcctcaacacttttacaaacatggaagcacagctggtacgacagatggagggcgagggcgtgttatccaaggccgacctcgagaacccccacctcttggagaaaaagatcacacagtggctcgagaacaagggagtcgagcgcctgaaacggatggcgatcagcggggacgactgcgtggtgaagcccatagacgaccgcttcgccaacgcccttctcgccctgaatgacatgggcaaggtccggaaggacataccccaatggcagccgagtaaggggtggcatgactggcagcaggtcccattctgcagccaccatttccacgagctgatcatgaaggacggacgcaagctagtagtcccctgtcggccgcaggacgagctgatcgggcgtgcccgcatctcccagggcgcggggtggagcctgaaggagacagcctgcctcggcaaggcctacgcccagatgtggtccctgatgtacttccaccggcgcgacctgcggctcgccagcaatgcaatctgcagcgctgtgccggtgcactgggtaccaacgagccgcaccacctggtccatccacgcccaccaccagtggatgacgaccgaggacatgctggccgtgtggaaccgggtgtggatcgaggacaatccctggatggaggacaagacccccgtcactacgtgggaggacgtgccgtacctgggcaaacgcgaggaccagtggtgcgggtccctcatcggcttaacctcgcgggcgacctgggcccagaacattctgaccgccatccagcaggtccgctccctaatcggggacgaggagtttttagactacatgccctctatgaagcggttcaggaaggaagaggagtccgagggcgcaatttggtga

SEQ ID NO: 25770 - RNA, 9873 nt, synthetic construct
  misc_feature 1..9873: note = derived and/or modified CDS sequence (opt11) from DENV-3__FJ639724__SS-prME
  source 1..9873: mol_type = other RNA
accagcctgtgccttatgatgatgctgcccgccactctggccttccacctcacttcccgcgatggcgagccgcggatgatcgttgggaagaacgagaggggcaaaagcctgctgttcaagaccgcgtccgggatcaacatgtgtaccctgatcgcgatggacctgggcgagatgtgcgacgacacggtcacgtacaagtgccccctgatcgcggaggttgagcccgaggatatcgactgctggtgtaatctcacaagcacctgggtgacctacgggacttgcaaccaggcgggcgagcaccgacgtgataagcggtccgtcgccttagccccccacgtgggaatggggctggacacccgcacccagacctggatgtctgcagagggtgcctggcggcaggtggaacgcgtcgagacgtgggcgctccggcatccggggtttaccatactggcgttattcctcgcccactacatcggcacctccctgacccagaaggtagtgatcttcatcctgctgatgctggtcactccctctatgaccatgcgctgcgtgggggtaggcaaccgggacttcgtcgagggcctgtccggggccacctgggtggacgtggtcctggagcacggcgggtgcgtgaccacgatggctaagagcaagccgaccctggacatcgagctgcagaagactgaggccacacagctcgcgacattgcgcaagctgtgcatcgagggcaaaattacgaatatcaccaccgactcccgatgccccacgcagggcgaggcaaccttgccggaagagcaagatcagaactacgtttgtaagcatacctacgtcgaccgcgggtggggcaacgggtgcggcttattcgggaagggcagcctggtcacctgcgctaaattccaatgcctcgagcccatcgagggcaaggtagtccagtacgagaacctgaagtacacggtaataatcacagtgcacaccggggatcagcaccaggtcggcaatgacacccagggggtgacggtcgaaatcaccccccaggcctcaacggtagaggccgtgctgcccgaatacggcacgctagggctggagtgcagcccccggactggtctggacttcaacgagatgatcctccttacgatgaagaacaaggcgtggatggtccaccgccagtggttcttcgacctgcccctcccctggacctccggcgccaccaccgagacgcctacatggaaccggaaggagcttctggtgaccttcaagaacgcacatgccaagaagcaggaggtagtcgttctagggagccaggagggcgccatgcacaccgcgttaactggggccaccgaaattcagaactccggcgggaccagcatctttgccgggcatctgaaatgcaggctcaagatggacaagctggagctgaagggcatgtcctacgctatgtgcttaaacaccttcgtgctgaagaaggaggtcagtgagacgcagcacggaaccatcctgatcaaggtggagtacaagggcgaggatgccccgtgcaagataccattcagcaccgaggacggacagggcaaggcgcacaacggccggcttatcaccgcaaaccccgttgtcacgaagaaggaagagcctgtgaacatcgaggccgagccgccctttggggagtccaacatcgtgatcggcatcggggacaaggccctaaaaatcaactggtacaagaaaggctcaagtatcgggaagatgttcgaggcgaccgcccgcggcgcacggcgaatggccatcctgggcgacacggcctgggactttgggagcgtcggcggggtgttaaattcccttggcaaaatggtacaccagatcttcggttccgcgtacaccgccctgttctcaggcgtcagctggattatgaagatcggcatcggcgtgctgttgacgtggatcggcttaaactcgaagaacaccagcatgtccttttcttgtatcgtgatcggaatcatcaccctgtacctcggcgccgtcgtgcaggcagacatgggttgcgtgatcaactggaaaggcaaagagctaaagtgtgggtccgggatctttgtcaccaacgaagtgcacacttggaccgaacagtacaagttccaggccgactctcctaagcgcttggcgaccgccatcgcgggtgcctgggagaacggggtttgcggcatccggtccaccactcgaatggaaaatctcctgtggaaacagatcgcaaacgagctaaactacatactctgggagaacaacatcaaactgacggtcgtggtcggggacatcatcggggtacttgagcagggcaagcggaccctcaccccccagccaatggagctgaaatatagctggaagacgtgggggaaggcgaagatcgtgaccgccgagactcagaactccagcttcatcattgacggccccaacacacccgagtgcccctcggccagccgcgcctggaatgtgtgggaggttgaggactacgggttcggcgtgttcacgaccaatatctggctgaagctccgggaggtgtacacccagtcgtgcgaccaccgcctgatgagtgcggcgattaaagacgaacgggcggtacacgccgacatgggctattggatcgaaagccagaagaatgggtcctggaagctggagaaggcaagcttcatcgaggttaagacctgcacctggccgaaatcccacacgctctggagcaacggcgtactggagtccgacatgatcatccccaagagccttgcgggacccatctcccagcataaccaccgcccgggttaccacacccagacaacagggccctggcatctcggcaaactcgagctggacttcaattactgcgaaggcacgactgtcgtgatcaccgagaactgcgggacccggggcccatcgttgcgtacgacaacagtgtcgggtaagctaatccacgagtggtgctgccgatcttgtaccctgcccccgttgcgctacatgggtgaggacgggtgctggtacggcatggagatccggccaataaacgagaaggaggagaatatggtcaagtccctggtcagcgcgggctccggaaaggtcgataacttcacgatgggcgtcctgtgcctcgccatcctgttcgaggaggtgatgcgcgggaaattcggcaagaaacacatgatcgccggggtgctgttcacctttgtcctactgttaagcggccagatcacctggcgggatatggcccacaccctcattatgataggctccaatgcgagcgaccgcatggggatgggcgtgacctacctggccctgatcgcgaccttcaagatacagcccttccttgccctggggtttttcctgcggaagctcaccagccgcgagaacctgctgctcggcgtgggactggccatggcgaccacgctgcagctccccgaggatatcgagcagatggccaacgggattgccctggggctgatgacactcaagctgatcacccagttcgagacgtaccagctctggacggcgctcgtctccctgacctgcagtaacacgatattcaccctgacggtggcgtggagaaccgctaccctcatcctggccggggtctcgctgttaccgctgtgtcagtcgagtagcatgagaaaaaccgactggctgcccatgacggtggctgccatgggggtgccgcccctcccacttttcatcttctccctgaaggatactcccaagcgacggagctggcccttaaacgagggggtcatggcggtaggcctggtctccatactggctagctccctcctgcgcaacgacgtcccgatggccggcccgcttgtggctgggggcctcctgatcgcctgctacgtgatcactgggaccagcgcggacctgacagtcgagaaggccgccgacgtgacctgggaggaggaggccgagcagacaggagtcagccacaacctcatgatcaccgttgacgacgacgggaccatgcggatcaaagacgacgagacggagaatatcctgaccgtgttactgaagactgccctgctgatcgtgagcggcatcttcccgtactccatcccggcgaccctgctggtctggcacacgtggcagaagcagacccagcgttctggcgtgctgtgggacgtgccctccccgcccgaaacccagaaagccgagctcgaagagggtgtctaccggatcaagcagcagggcatcttcgggaagacccaggtgggcgtgggggttcagaaggagggcgtgttccacacgatgtggcacgtgactcgtggggccgtactgacccataacggaaagcggctggagcccaactgggcctcagttaagaaggacctcatctcctacggagggggctggcgactcagtgcccagtggcagaaaggggaggaggttcaagtcatcgcggtggagcccggcaaaaaccctaagaacttccagaccatgcccggcattttccagacgaccacaggggagatcggcgccatcgcccttgattttaaacccgggactagcggctccccaattatcaaccgggagggcaaagtagtcgggctctacggcaacggggtggtgactaaaaacggcgggtatgtcagcggtatcgcccagaccaacgcggagcccgacggtcccacccccgagctcgaggaggagatgttcaagaaacgaaacttaacaatcatggatctgcatccaggatccgggaaaacccggaagtacctccccgcgatcgtccgcgaggccatcaagcggagacttcggaccctgatcctcgcccccacccgcgtggtcgccgcggagatggaggaggccctgaaggggctgcccatccggtaccaaaccacagcaaccaagtcagagcataccggccgcgagattgtggatctcatgtgccacgccacctttacgatgcggctgttatccccggtgagggtacccaactacaacctggtgattatggacgaggcccatttcaccgaccccgcgagcatcgccgcccgggggtacatctcaacccgcgtgggcatgggcgaggctgccgcgatatttatgaccgccacgccaccggggaccgctgaggccttcccccagtcaaacgctcccatccaggacgaggagcgcgacatccccgagcggtcctggaacagcggcaacgagtggatcaccgactttgttgggaagaccgtctggttcgtgcctagtatcaaggccggcaacgacatcgccaactgcctgcgcaagaacgggaagaaagtcatccagctaagccggaagacgttcgataccgagtaccagaagacccgcctcaatgactgggacttcgtggtgaccacggacatcagtgagatgggagccaacttcaaggccgaccgggtcatcgacccccgacggtgcctgaagcccgtgatcctgaccgacggacccgagcgcgtgattctcgcggggccgatgcctgtcacggcggccagcgccgcgcagcggcgcggccgggtggggaggaacccccagaaggagaacgaccagtatattttcacgggccagcccctcaacaatgacgaagaccacgcccactggaccgaggccaagatgctgctcgacaacatcaacacgccggagggaataatccccgcccttttcgagcccgagcgggagaagtccgccgccatagacggcgagtatcgcctgaaaggagaaagccggaagaccttcgtggagctcatgcgccggggggatctgccggtgtggctggcacacaaggtggcctccgagggcatcaagtacaccgacaggaagtggtgcttcgacggggagcggaacaaccagatcctcgaagagaacatggacgtcgagatctggacgaaggagggggagaggaagaagctgcgcccgcggtggctggacgcccgcacgtacagcgacccgctcgcgcttaaggagtttaaggatttcgcggccgggcggaagtccatcgccctggacctcgtgaccgagataggtcgcgtgccctctcaccttgcccaccggacccgtaacgctctcgacaatctcgtaatgctgcacacctcagaacacggcgggcgggcgtatcgacacgccgtagaggagctgccggagacgatggagaccctcctgctgctcggcctgatgatactgctcaccgggggcgcaatgctgtttttaatctcaggcaaggggatcggcaagaccagcattgggctcatctgtgttatcgttagcagcggcatgctgtggatggcggacgtgccactgcagtggatcgcctccgcgatcgtcctcgagttcttcatgatggtcttactgatccccgagcccgagaagcagagaacaccgcaggacaaccagctagcctatgtggtgatcggaatcttaaccctggccgccatcgtcgccgcgaatgagatgggcctcctggaaaccaccaagagagatctgggcatgagcaaagagcccggcgtggtgtctcccacgagctatttggacgttgacctgcacccagcctccgcgtggaccctgtacgctgtagctaccaccgtgatcacgccgatgctccgacacacgatcgagaactcaacagcgaacgtctccttagccgccatcgcaaatcaggcggtggttctgatgggcctcgacaaggggtggcccatcagcaagatggacctgggcgtccccctgctcgctctggggtgctactcccaggtgaatcctctgaccctcacggccgccgtgttactcctcgtaacccactatgccatcatcggcccgggccttcaggccaaggccacccgagaggcccaaaagcggaccgccgccgggatcatgaagaatcccactgtggacggcatcatgaccatcgaccttgaccccgtgatctacgacagcaagttcgagaagcagctcgggcaggtcatgctgctggtgctctgcgcggtgcagctgttgctcatgcgaacctcctgggctctgtgtgaggccctgaccctcgccacgggcccaatcaccaccctgtgggagggcagcccggggaagttctggaataccacgatcgccgtctccatggcgaacatcttccgggggagctacctggcaggggcaggcctcgctttttccataatgaagagcgtggggaccggtcgtcggggcaccggtagccagggcgaaaccctgggggagaagtggaagaagaagctgaaccagttatcccgcaaggagttcgacctatacaagaagagcggcataacggaggtggatcggacggaggcgaaagaggggctgaagcgcggcgagaccacccaccatgccgtttcccggggaagcgccaaactccagtggttcgtggagcgcaacatggtcatccccgaggggcgcgtcatcgacctgggctgtgggcggggcgggtggtcctactactgcgccggactgaagaaggtcaccgaagttcgcggctacacgaaggggggccccgggcacgaggaaccagtcccgatgagcacctacggctggaacatcgtgaagctcatgtccgggaaggacgtattctacctgccccccgagaagtgcgacaccctactgtgcgatatcggcgagagctcccctagccccaccgtcgaggaatcccggacgatccgcgtgctcaagatggtggagccatggttacgaaataaccagttttgcatcaaggtcctgaacccctacatgcccacggtgatcgagcatctcgagcgcctgcagcggaagtacggcgggatgctggtgcgcaacccgctcagcagaaactccacccacgagatgtattggattagcaacggcaccgggaacatcgtctccagcgtgaacatggtctctcgactgctgctcaaccggttcaccatgacccaccgcagacccaccatcgagaaggacgtggacctgggcgccggcacccgccacgtgaacgcggagcctgagacgcctaacatggacgtcattggggagcggatcaagcgcatcaaggaggagcactcgagtacctggcactacgacgacgaaaacccctacaagacctgggcgtaccacggaagctacgaggtgaaggctacagggtcagcctccagcatgatcaacggcgtggtcaagctgttaacgaagccctgggacgtggtgcccatggtcacccaaatggccatgaccgacaccactccgttcgggcagcagcgggtgttcaaggagaaggtcgataccagaaccccccggcccatgcccggtacccgcaaggtcatggagatcacggcggagtggctgtggcgcaccttaggccggaacaagaaaccgcgcttgtgcacccgtgaggagttcaccaagaaggtgcgtacgaacgccgccatgggggccgtgttcacggaggagaaccagtgggactccgccagggcggccgtagaagacgaggagttctggaagctggtggatcgcgagcgggagcttcacaaactgggcaagtgtgggagctgcgtgtacaacatgatgggcaagcgcgagaagaagctgggggagttcggcaaggcaaagggctcccgggcaatctggtacatgtggctgggggcgcgctacctcgaattcgaggccctaggattcttaaacgaggaccactggttcagccgcgagaactcgtacagcggggtcgagggggaggggctccacaagctgggctacatcctgcgcgacatctccaagatccccggcggtgccatgtatgccgacgacaccgccggctgggacacccggatcaccgaggacgacctccacaatgaggagaagatcacccagcagatggaccccgagcaccgccagctggcgaacgccatcttcaagctgacctaccagaataaggtagtaaaggtccagaggcccaccccgaaggggaccgtgatggatatcattagccgcaaggaccagcggggatccggccaggtggggacgtacggtctcaacaccttcaccaacatggaggcccagctggtgcgccagatggagggggagggcgttctgtcaaaggccgatctcgaaaacccccacctactggagaagaaaatcacccaatggctcgagacgaagggggtggagcgcttaaagcgaatggccatatccggcgacgactgcgtcgtcaagcccatcgacgaccggttcgcgaacgccctactcgccctgaacgacatggggaaggtccgtaaagatatcccccagtggcagccgtcaaagggctggcacgactggcagcaggttcccttctgctcccatcacttccacgagctgatcatgaaggatggccgaaagctcgtggtgccatgccggccccaggacgaactgatcgggcgagcacggatcagccaaggcgccgggtggtccctgaaggagaccgcctgcctcggcaaggcctatgcccagatgtggagcttaatgtatttccaccgccgggacctgcgcctcgcctccaacgccatctgctcagcggtacccgtgcactggattcccaccagtcggaccacgtggtccatccacgctcaccaccagtggatgaccaccgaggacatgctgaccgtgtggaatcgcgtctggatcgaggacaacccgtggatggaagacaagacgcccgtgaccacctgggaggacgtgccgtacctgggtaagcgggaggaccagtggtgcgggagcctcatcgggctgacctcccgcgccacgtgggctcagaacatactaaccgcgatccagcaggtccggtcgctcatcggggacgaggagtttctggactacatgccctccatgaagagattccggaaggaagaggagagtgagggcgccatatggtag

SEQ ID NO: 25771 - RNA, 9873 nt, synthetic construct
  misc_feature 1..9873: note = derived and/or modified CDS sequence (opt11) from DENV-3__FJ639725__SS-prME
  source 1..9873: mol_type = other RNA
accagcctgtgcctcatgatgatgctgcccgctaccctggcattccacctcacctcaagggacggggagcccagaatgatcgtcgggaagaacgagcgcggaaaaagcctgctcttcaagaccgctagcgggataaacatgtgcactctcatcgccatggacctgggcgagatgtgcgacgacaccgtgacttacaagtgccccctaatcgccgaggtggagcccgaggacattgactgctggtgcaacttaaccagcacctgggtgacgtacgggacctgcaatcaggccggcgagcaccggcgcgacaaacggtccgtggccctggcgccccacgtgggcatggggctggatactcggacccagacctggatgagcgccgagggcgcctggcgccaggttgagaaggtggagacatgggccctccgccacccgggttttaccatcctagcactctttctcgcgcactatataggtacctccctgacgcagaaggtggtgattttcattcttttgatgctggtcacgccctcaatgaccatgcgatgcgtgggggtgggcaaccgcgacttcgtcgagggcctgtcgggcgccacctgggtggacgtggttctcgagcacggcggctgcgtgactacgatggccaagagcaaacccacgctggacatcgaacttcagaagaccgaggcgacccagttagcgacactgcggaagctgtgcatcgagggcaaaatcaccaacatcaccaccgattcccgctgtccaacacagggcgaggcaactctccctgaagagcaggatcagaactacgtgtgcaagcacacatatgtcgaccgtgggtggggcaacggctgcggccttttcgggaagggaagcctagtgacctgcgcaaagtttcaatgcctcgagcctatcgagggcaaggtggtgcagtacgagaacctgaaatatacagtgatcatcaccgtgcacaccggtgaccagcaccaggtcggcaacgacacccagggggtgacggtggagattacgccacaagccagcaccgtggaagccgtgctgcccgagtatggcacactcgggctagagtgttcaccacgcacaggcctggacttcaacgagatgatactgctgactatgaagaacaaggcgtggatggttcaccggcaatggtttttcgatctgccgttgccctggacctccggagccaccacggagacgcccacgtggaatcgcaaagagttgctggtgaccttcaagaacgcacacgctaagaagcaggaggtggtcgttctagggagccaagagggcgctatgcacaccgctctgacgggggccaccgagatccagaactccggcggtaccagcatctttgccggccatctgaaatgccggctcaagatggacaaactggaactgaagggcatgtcttatgctatgtgtctcaacacgttcgtgctaaagaaggaggtaagtgagacgcagcacggtaccatcctgatcaaggtggagtataagggggaggacgccccctgcaagatccccttcagcaccgaggacggacaaggcaaggcgcataacggacgcctgatcaccgccaacccggttgttacgaaaaaggaagagcccgtgaacattgaggccgaaccgcccttcggggagtcaaacatcgtaataggtatcggggacaaggccctcaaaatcaactggtataaaaagggcagctcaatcgggaagatgttcgaggcgaccgcgcggggcgcccgccggatggcgatcctcggagacaccgcttgggactttgggagcgtcggcggggtgctgaattccctcggaaagatggtgcaccaaatctttgggagcgcgtataccgcactcttctccggcgtcagctggatcatgaagatcggcatcggggtactgctcacgtggatcgggcttaactccaaaaacacgagcatgagcttttcgtgcatcgtcatcgggatcataactctctacctcggcgcagtggtgcaagcagacatggggtgcgtgataaactggaagggcaaggagctgaagtgcggctccggtatcttcgtcaccaacgaggtgcacacgtggactgagcagtacaagtttcaggccgacagccccaagcgcctagcgactgccattgccggcgcctgggagaatggggtgtgcggcatccgctccaccacgcggatggagaacctcttatggaaacagatcgccaacgagctgaactatatcctctgggagaacaatattaagctgacagtcgtggtgggggatatcatcggcgtcctggagcagggcaagcggaccctcactccccagcccatggaactgaagtatagctggaaaacgtggggaaaggcgaagatcgtgaccgccgagacgcaaaattcctcgttcatcatcgacggccccaacacgcccgagtgcccctccgccagccgggcctggaacgtgtgggaagtcgaggattacgggttcggagtatttacaactaacatctggctgaagctgcgcgaggtgtacacccagagctgcgaccaccggctcatgtccgcggccatcaaggacgagcgtgcggtccacgccgacatgggttactggatcgagagccagaagaacgggtcctggaaattggagaaggcctcattcatcgaggtgaagacctgcacctggccgaagtcccacactctctggagcaacggcgtgctggagtccgacatgataatccccaagagcctagcggggcccatcagccaacacaaccatcgacctggatatcacacccaaaccgcggggccttggcacctcggcaagttggagctggatttcaattattgcgagggcactacggtcgtgatcaccgaaaactgcggcacccgtgggcccagcctcagaaccacgaccgtgtccggcaagctgatccacgaatggtgctgtcgcagctgcacactgcccccgctccggtacatgggcgaggacggttgttggtatggtatggaaattcgccccatcaatgagaaggaggagaacatggtcaagtctctagtgagcgccgggtccgggaaggtggacaatttcaccatgggcgtcctgtgcctcgcgatcctgtttgaggaggtgatgcgggggaaatttggcaaaaagcacatgatcgccggtgtgctgttcacgttcgtcctactgctgagcggccagatcacctggcgcgacatggcgcacaccctcatcatgatcggatccaacgcctccgaccggatggggatgggagtaacgtacctggccctaatcgcgacgttcaaaattcaacctttcctcgctctggggttcttcctgcgcaaactcactagccgggagaacctgctgctcggagtgggcctcgcgatggccaccacactacagctccccgaggacattgaacagatggcaaacgggatagccctaggtctgatgacgttgaagctaatcacccagttcgagacataccaattatggaccgcgttggtatctctcacgtgctcgaacaccatcttcaccctgaccgtagcctggcgcaccgccaccctcattctggccggagtgtccttattgccgctgtgccagagctccagtatgcggaagacggactggctacctatgaccgttgccgcaatgggagtgccgcccttgccactgttcatcttctcgctgaaggatacgccgaagcggaggagctggcccctgaatgagggggtaatggcagtcggcctggtctccatcctggccagctccctccttcggaacgacgtacccatggccggcccgctggtggcagggggcctcctgatcgcgtgttacgtgatcaccgggacgtccgccgacttaaccgtcgagaaggcagcggacgtgacgtgggaggaggaggccgaacagaccggcgtttcccacaacctcatgatcacagtagatgacgacgggacgatgcgcataaaggacgacgagactgagaatatcctgaccgtgctgttgaaaacagcgctgctgatcgtgagcggcatctttccctactccatccccgccactctgctggtctggcacacctggcagaaacagacgcagcgtagcggagtgctgtgggacgtgccctccccgcccgagactcagaaggccgagctagaggagggcgtttatcggatcaagcagcaagggatcttcgggaagacccaggtgggcgtgggggtccagaaggagggtgtgttccacaccatgtggcacgtgacacggggcgcagtcctaacccacaacgggaagaggttagagccgaactgggctagcgtgaagaaggacctcatctcctacggtgggggttggcggctgtcagcacagtggcagaaaggggaggaggtgcaagtcatcgcagtggagcccggcaagaacccgaagaacttccagaccatgcccgggatctttcagacaacgaccggggagatcggcgccattgcactggacttcaagcccgggacctctggctccccgatcattaaccgcgagggcaaggtggtggggctttacggcaacggggttgtgacaaagaacggcgggtacgtcagcggcatagcgcaaacgaacgccgagcccgacggccccacccccgaactcgaggaggagatgttcaagaagagaaaccttaccatcatggacctgcaccctggctccggcaagacccgcaagtaccttcccgccatcgtacgcgaggcaatcaagcgcagactacgcacgctaatcctcgcccctacccgggtggtcgcggcggaaatggaagaggcccttaaggggctgcctattagataccagacgaccgccaccaaaagcgagcacaccggccgggagatagtggatttaatgtgccacgccactttcactatgcgccttctttcacccgtgcgggtccccaattataacctcgtgatcatggacgaggcgcacttcacggatcccgccagcatcgccgcccgcgggtacatctccacccgggtaggcatgggcgaagctgcagcaatcttcatgaccgcaacgcctccagggactgccgaggcgtttccccagagcaacgcccccatccaggacgaggagcgcgacatccctgaacgctcctggaacagcggcaacgagtggatcacagacttcgtggggaaaaccgtttggttcgtgccctccatcaaggccggcaatgatatcgccaactgtctacggaaaaacgggaagaaggttatccaactgtcgcgcaagaccttcgacacggagtaccagaagacccggctcaacgactgggacttcgtggtgaccaccgacatctccgagatgggcgccaacttcaaggctgaccgcgtcatcgatccccgtaggtgcctaaagcccgtgatcctgaccgacggaccggagcgggtgatcctagccgggccgatgccggtcacagctgctagcgccgcgcagcgccggggccgcgtggggcggaaccctcagaaggagaacgaccagtacatctttactggccagcccctaaataatgacgaggaccacgcacactggaccgaggccaagatgctgctcgacaatatcaacactccggaggggatcatccccgccctgttcgagcccgagcgcgagaagtcggccgcgatagacggcgaataccgactgaaaggcgagagccgcaagacgttcgtcgagctcatgagaagaggggacctgcccgtatggctggcacacaaagtggcctccgagggtatcaaatacaccgaccggaagtggtgctttgacggtgaacgtaacaaccagatactcgaagagaatatggacgtcgagatctggaccaaagagggcgagcggaagaaactacgcccgcgctggttggacgcccgaacctatagcgacccgctcgcgctgaaggaattcaaggacttcgctgccggccgcaagtcaatagcactggacctcgtgacggagatagggcgggtgcccagccacctagcccaccgcacacgaaacgcactggacaatctcgtcatgttacataccagcgagcacggaggccgcgcctacaggcacgccgtggaggagctcccggagaccatggagacgctgctgctactcgggctgatgatattactcaccgggggcgctatgctgttcctgatctccggcaaggggataggaaagacatcgatcgggctaatctgcgtgatcgcctcaagcggcatgctgtggatggcggacgtacccctgcagtggatcgcctcggccatcgtgcttgagttctttatgatggtactgctgattcccgagcctgagaaacagcgcaccccacaggacaaccagctcgcctacgtcgtgattggaatactgacgctcgccgcgatagtggccgccaacgagatgggcctcctggagacaacaaagcgtgacctgggcatgagcaaggagccaggtgtcgtgtccccgacctcttacctcgatgtggacctgcatcccgcatccgcatggacgctgtacgcggtcgccaccaccgtgatcacccccatgctgagacatacgatcgagaacagcacagcgaatgtgtccctggccgcgatcgccaatcaggccgtcgtgctgatgggactcgataaggggtggcccataagcaagatggacctgggcgtgccccttctcgccctagggtgctactcccaggttaaccccttgacccttaccgctgcggtgctgctactcgttacgcactacgccatcatcggccctggactgcaggccaaggccacccgggaggcccagaagcgcaccgcggccgggatcatgaagaatcccacagttgacggcatcatgacgatcgacctggaccctgtgatctacgacagcaagttcgagaagcagctcggccaggtgatgctgctggttctctgcgccgtgcagcttcttctcatgcgaacctcctgggccttatgcgaagccctgaccctcgctactggcccaataacgaccctgtgggaggggtctccggggaagttctggaacaccaccattgccgtctccatggcaaacatattccggggctcgtacctggccggggccggcttggctttctccatcatgaagtccgtcggaacgggccggcgcggtacagggagtcagggcgagaccctgggggaaaagtggaagaagaagctgaaccagctctcccggaaggagttcgacctttacaaaaagtctggcattactgaggtggacaggaccgaggccaaggaggggctgaagagaggcgagacgacacatcacgccgtttctcgcggcagcgccaagctccagtggttcgtagagcggaacatggtgatacctgaggggagagtgatcgacctggggtgcgggcgcggcgggtggtcctattactgcgcgggactgaaaaaggtcactgaggttcggggctacactaagggcgggccagggcacgaggagcccgtgccgatgtcgacgtacggctggaacatcgtcaagctaatgtccgggaaggacgtcttctacctacctcccgagaagtgcgacaccctgctgtgcgatatcggggagtcatcccccagcccgaccgtggaggagtcccgtaccatccgggttcttaaaatggtggagccttggctgcggaacaaccagttttgcatcaaggttctgaacccgtacatgcccactgtcatcgagcacctcgaacggctgcaacgcaagtacggcgggatgctggtgcggaacccactcagccgcaactcgacacatgaaatgtactggatatctaacgggaccggaaatatcgtgtcgagcgtgaacatggtgtcccgcttgctgctcaaccgcttcaccatgactcaccggcgtcccaccatcgagaaagacgttgatttaggggccggcacccggcacgtgaacgccgagccggagaccccgaacatggatgtgattggggaaaggatcaagagaatcaaggaggaacacagctccacctggcactacgatgacgaaaacccttacaagacctgggcctaccatgggagctacgaggtcaaggccaccgggtcagcgtctagcatgatcaacggcgtggtgaaactgttgaccaaaccgtgggacgttgtgccaatggtgacgcagatggccatgaccgataccaccccgttcgggcaacagcgtgtcttcaaggagaaggtagacacgcggacccctcggccgatgcccggcacccggaaagtgatggagatcaccgccgagtggctgtggcgaacgttgggccgcaacaagaagccgcgcctctgtacccgcgaggagttcaccaagaaggtccggacaaacgccgccatgggggcggtgtttacggaggaaaaccagtgggactccgcccgcgctgccgttgaggacgaggagttttggaagcttgtagatcgagagcgcgagctgcacaagctcggcaagtgtggaagttgcgtgtacaacatgatgggcaaacgggagaaaaagctgggagagttcggcaaggcgaaggggagccgcgcaatttggtacatgtggctgggggcccggtatttggagttcgaggccctgggcttcctgaacgaggatcactggttctcgcgggaaaactcctatagcggggtggagggcgaagggctccacaagcttggctacatcctgcgggatatctccaagatccctggcggggccatgtacgcggacgacactgccggctgggacacgcggatcactgaagacgacctgcacaatgaggagaaaatcacgcagcagatggaccccgagcaccgacagctggccaacgccatctttaagctgacctaccagaacaaggtcgttaaagtgcagcgccccaccccgaaggggaccgtaatggatatcatcagccgcaaggaccagcgcggatccggtcaagtggggacctacggcctcaacacgttcaccaacatggaggcccagctggtgcggcagatggagggggagggcgtcctgagcaaggcggatctcgagaacccacacttattgggaaagaagatcacccagtggctcgagacaaagggagtggagcggctgaagcggatggccatatccggcgatgactgcgtggtcaaacccatcgatgaccgctttgccaatgccctgctcgccctcaatgacatggggaaggtgcggaaggacatcccccagtggcagccgagcaagggctggcatgactggcagcaggtcccgttctgttcccaccactttcacgaattgatcatgaaggacggccgcaagctggttgtgccctgtcggccccaggatgagctgatcggtcgggcacgcataagccagggggccggctggtccttgaaggagaccgcctgcctcggaaaggcctacgcacagatgtggagcctgatgtactttcaccggcgcgacctacggcttgcttccaatgctatctgctctgccgtgccggtccattggatccccaccagccgtaccacctggtccatccacgctcatcatcagtggatgacgaccgaggatatgctgaccgtgtggaatcgagtatggatcgaggacaacccctggatggaggacaaaacccccgtcacgacttgggaagatgtgccgtacctggggaagcgcgaggaccagtggtgcggcagcctcatcgggttgacctcccgggcaacgtgggcgcagaacatactgacggcgatccagcaggtccgcagccttatcggcgacgaggagttcctggattatatgccctccatgaagcgattccgaaaggaggaggagagcgagggcgcaatctggtga

SEQ ID NO: 25772 - RNA, 9873 nt, synthetic construct
  misc_feature 1..9873: note = derived and/or modified CDS sequence (opt11) from DENV-3__FJ639726__SS-prME
  source 1..9873: mol_type = other RNA
accagtctgtgtctcatgatgatgctacctgccaccctagccttccacctcacctcccgcgatggagaaccgcggatgattgtgggcaagaacgagcgcggaaagagcctgctattcaagacggcgtccggcatcaacatgtgcactctcattgcaatggacctgggggagatgtgcgacgataccgtcacctacaagtgtcctctgatcgccgaggtggaacccgaggatatagactgttggtgtaacctcaccagcacgtgggttacctatggtacgtgtaatcaggctggcgagcacaggcgtgacaaacgttccgtcgctctggctccgcacgtgggcatgggattagacacccgcacccagacgtggatgagtgccgagggcgcctggagacaggtggaacgcgtcgagacctgggccctccggcatcctgggttcaccatcttggcgctgtttctagcccactacattgggacgtccttaacacagaaagttgtaatcttcattctgctcatgttggtgacaccgagcatgacgatgaggtgtgtaggggtgggcaaccgggactttgtcgagggcctgtccggggctacctgggtggacgtagtcctcgagcacggcgggtgcgtaactacgatggccaagagcaaacccacacttgatattgagctgcagaaaaccgaggccacccagctcgctacgctacgcaagttgtgcatcgaggggaagatcaccaacattaccaccgactcccggtgccccacgcagggcgaggcaaccttgccggaggagcaggaccagaactacgtgtgcaagcacacctacgttgaccgagggtgggggaatggatgcggcctcttcgggaagggctcactggtgacatgtgctaaattccagtgcctcgaaccgatcgaagggaaggtggtccagtacgagaacctgaaatacactgtaatcatcaccgtgcacacaggtgatcagcaccaggtcggcaacgatacccagggagtgacggtcgagatcacaccccaggcgtccaccgtggaggcagtgctacccgagtacggaactctcggtttagaatgcagcccaaggaccggcttagacttcaacgagatgatcctcctgacgatgaagaacaaagcgtggatggtccaccgccagtggtttttcgacctgcccctgccgtggacctccggcgccaccaccgagacgcccacctggaaccgcaaggagctgctagttacgttcaagaacgcacatgctaaaaagcaggaggttgttgtgctcggctcgcaggagggggccatgcacaccgcgctgacgggagcaacagagatccaaaattccggcggtacctccatctttgccggtcacctgaagtgccgcctcaagatggataagttagagctgaaaggaatgtcctacgccatgtgtctgaatacgttcgtgctaaagaaggaggtcagtgaaacgcagcacgggactattctcattaaagtggagtacaagggcgaggatgccccttgcaagatccccttttcaaccgaagacgggcaaggcaaagcgcataacggccggttgatcaccgccaaccccgtggtgacgaagaaggaagaaccggtgaatatcgaggccgaaccgcccttcggcgagtccaacatcgtgatcggtattggtgacaaggccctcaagatcaattggtacaagaagggctcatcgatagggaagatgtttgaggcgaccgcccgaggcgcccgccggatggccatactgggagacaccgcctgggatttcgggagcgtcggcggtgttttaaactcgcttggcaagatggtacaccagatattcgggtcggcctacaccgccctgttctccggcgttagctggattatgaagatcgggatcggggtgttactcacgtggatcggactgaactccaaaaacacaagcatgtctttcagctgtatcgtgatcgggattatcaccttgtaccttggcgccgtcgtacaggccgacatgggatgcgtgatcaactggaagggcaaggaacttaaatgcggcagtggaatcttcgtgaccaacgaggtacacacgtggaccgagcagtacaagttccaggctgacagccccaagcgcctggcgaccgccatcgcgggcgcctgggaaaacggtgtatgcggcatccggtccaccacgcgcatggaaaacctcttgtggaaacagatcgccaacgaattaaactacattctatgggagaataatataaaactaaccgttgtggtgggagatatcatcggagtcctggagcaaggcaagcgtacgctcacaccccagcccatggagctgaaatacagctggaagacttgggggaaggcaaaaatcgtgacagccgagacccagaactccagcttcattatagatggcccgaacacccccgagtgcccctcagcaagccgcgcatggaacgtgtgggaggtcgaggactacgggttcggagtattcacgaccaacatctggctgaagctccgggaggtctatacccagtcctgcgaccaccgcttgatgtctgcggccatcaaggacgagcgggccgtccacgctgacatgggctattggatagagagccagaagaacggatcctggaaactggagaaggccagcttcatcgaggtgaagacctgcacctggccgaaatcgcatacactctggagtaacggcgtcctcgagtccgacatgatcatacccaagtccttagcggggcctatctcccaacacaaccacaggcctggctaccacactcaaacggccgggccttggcacctcggcaaacttgagctcgactttaactactgtgaagggaccacggtcgtgattaccgaaaactgcgggacccggggaccgtctctccggaccacgactgtgtccgggaaactgatccacgagtggtgctgcaggtcatgcaccctgcccccgctccgctacatgggcgaggacgggtgttggtacggcatggaaattagacccataaacgaaaaggaggagaatatggtcaagtccctggtcagcgctggctcagggaaagtggacaactttaccatgggcgtattgtgccttgccattctgttcgaagaagtgatgcgcgggaaatttggcaaaaagcatatgatcgcgggtgtattgttcacgttcgtcctcctcctgagcggccagataacctggagagacatggcccacacattaataatgataggcagcaacgccagcgaccgcatggggatgggcgtgacttacctggccctcatagccacgttcaaaatccagcccttcctcgccctcgggttctttctgcggaagctcaccagcagggagaacttgctgctcggcgtggggctggcgatggccaccaccttgcaactcccagaggacatcgaacaaatggcaaacggtattgccctgggcctgatgacgctcaagttgatcacccaattcgagacctaccagctgtggaccgcgttagtgtccttgacgtgcagcaatacaatcttcacacttaccgtggcttggcggacggccaccctcatcctggccggggtgtccctgctccccttgtgccagtcatcctcgatgcgaaaaacggactggctacccatgaccgtggccgctatgggcgttcctccgctccctctgttcatcttttccttaaaggacacgcccaagcgccgcagctggccactcaatgaaggggtcatggcagtgggcctggtgtccatcctggccagttccctcttacgtaatgacgtccccatggcaggcccgctagtggcgggtggcctactcatcgcttgctacgtgatcacagggacaagtgccgacctgaccgtggagaaggccgccgacgtgacgtgggaagaggaagcagagcagaccggcgtttcccacaacctcatgatcaccgtcgacgacgacggcaccatgcggatcaaggatgacgagacagagaacattcttacggtgctgctcaagaccgcactgttaatcgtctcgggcatcttcccctatagtatcccggccaccttactcgtctggcacacgtggcaaaaacagacgcagcggagcggcgtgctatgggacgtgccctccccgcccgagacccagaaggcagagctcgaggagggggtctaccgaatcaaacagcagggtatcttcgggaagacccaagtgggtgtgggggtccagaaggagggagtgttccacacaatgtggcacgtcacgcgcggagccgtactgacccacaacgggaaacggctggagcccaactgggctagcgtcaagaaggatctcatctcgtacggtggcggctggcgcctgtcagcccagtggcagaaaggtgaagaagtgcaggtcatcgcggtggagcccggcaagaacccgaaaaacttccagaccatgcccggcatatttcaaactacaaccggcgagatcggagccatcgccttagacttcaagccggggacgtcgggcagcccgattatcaaccgggaaggcaaggtggtgggtctgtacggcaatggggtagtaactaagaacggcgggtacgtctctggtatagcacagactaatgccgagcccgatggccccacccccgagcttgaggaggagatgttcaagaagcgcaacctgacgatcatggatttgcaccctggaagcggcaaaacacgaaaatatctccctgccatcgtgcgcgaagctattaaacggcgcctgcggactctgattctcgcccccactcgcgtcgtcgcggcagagatggaggaagccctcaaggggctacccatccgatatcagaccaccgccaccaaaagtgagcacacgggccgggagatcgttgacctcatgtgtcacgccacgtttacgatgaggctgctgtccccggtgcgcgtacctaactacaatttagtgataatggacgaggcgcacttcacggacccagccagcatcgccgcccgggggtacatatccacccgcgtgggaatgggcgaggccgcggccatcttcatgacagccactcccccaggtactgccgaagccttcccccagagtaacgcccccatccaggatgaggagcgagacatcccggagcggagttggaacagcggcaatgagtggataaccgatttcgtcgggaagactgtttggttcgttccgtcaattaaggcaggtaatgatatcgccaattgcctgcgcaagaacggcaaaaaggtcatccaacttagccggaagaccttcgacaccgagtaccagaagacacgcctcaatgactgggacttcgtggtgaccaccgacatctcagaaatgggcgcaaacttcaaggcggaccgcgtcattgacccacgacggtgcctgaagccggtgatcctgacggacggccccgaacgggtgatcctcgccgggccgatgcccgtaaccgccgccagtgccgcccagaggaggggccgggtgggacgcaacccccagaaggaaaacgaccagtacatctttactgggcagcctctgaacaacgacgaagaccacgcccattggaccgaagccaaaatgctcctcgataatatcaacacccccgaggggattatccctgccttattcgagcccgagcgggagaaatccgccgccatcgacggcgagtacaggctgaagggcgaaagccggaaaacgttcgtggaactcatgcgcagaggggatctgcccgtatggcttgcccacaaagtcgcgtccgagggcatcaaatacacggaccggaaatggtgcttcgacggggaaagaaacaaccagatcctagaagagaacatggatgtcgagatttggaccaaggaaggcgagagaaagaaattaaggcctcggtggctggacgcccgcacctacagcgaccccctcgcgctgaaagaatttaaagacttcgcagcaggccggaagtccatcgccttagacctggttacggagatcgggcgcgtccccagtcatctcgcccaccgcacccgcaacgctctcgataacttagtgatgctgcacaccagcgaacatggagggagagcctaccggcacgctgtggaggaactgccggagactatggaaaccctcctgctgctcggcctgatgattctgctcacagggggcgcgatgctgttcctgatcagtggcaagggcatcgggaagacctctatcgggttaatctgtgtgatcgtctcctccggcatgctgtggatggccgacgtccccctgcagtggattgcgtccgccatcgtattagagttcttcatgatggtcctgttgatcccggagcccgagaagcaacggacgccgcaggataaccagctcgcctacgtggtgatcggcatcctgacactggccgcaatcgtcgcggccaatgagatgggcctgctggagaccacaaagcgcgatctggggatgagcaaagagccaggcgtggtatcccccaccagctatttggatgtagacctgcacccggcctctgcctggactttatatgccgtggcaaccacagtaatcacgccgatgcttcgacatacgatcgagaacagcaccgccaacgtctccctggccgccatcgcgaaccaggctgtggttttgatgggactcgacaaggggtggccaataagcaaaatggacctgggcgtcccactactagccttagggtgctattcgcaggtaaatcccctgacccttacagccgccgtgcttcttcttgttacgcactatgcgatcattggcccgggccttcaggccaaggccacacgcgaggcccaaaagcgaacagccgcgggtatcatgaaaaatccaaccgtggacggcatcatgacgatcgacctcgacccagtaatctacgactccaaatttgagaaacagctcggtcaagtcatgcttctggtgctctgcgccgtacagctattactcatgcggacatcatgggccctttgtgaggctctgaccctggccaccgggcctatcacgacgctatgggagggcagcccgggcaagttttggaacaccactatagcggtcagtatggctaacatctttcggggcagttacctggccggggctggtctcgcgttctcaatcatgaaaagcgtggggacgggtcgccgggggacagggtcacagggcgagaccctgggtgagaagtggaaaaagaagctgaaccaactttcccgcaaggagttcgacctgtacaaaaagagcggaatcaccgaagtagatcggacagaggccaaagagggtttaaagcgcggggagacaacccaccacgctgtctcccggggtagcgccaaactccagtggttcgtggagcgcaatatggtgatcccggaaggccgcgtcattgacctggggtgtgggcgaggcggttggtcatactactgcgccggtcttaagaaagtgaccgaggtgcgcggctacacgaaagggggacccgggcacgaagaacctgtaccgatgagcacatacggctggaatatcgtaaagctcatgtccgggaaggacgtgttctacctaagccccgagaagtgcgatacccttctgtgcgacatcggtgagagcagcccaagtcctacagtggaggaatcgcgtaccattcgggtcctgaagatggtggaaccgtggctgcggaacaatcagttctgcattaaggtccttaacccctacatgcctactgttattgagcacctcgaacgcctccagcgaaagtatggcggtatgctggtgaggaatcccctctcccgaaattctacccacgaaatgtattggattagcaacggcaccggaaacatcgttagctcagtgaacatggtcagcaggttattgctcaaccggttcacgatgactcaccgccggccgacaatagagaaggatgtggatttaggagcgggcactagacacgtgaacgccgagcccgagactccaaacatggacgtcatcggggagcggattaaacgcatcaaggaggaacactcgagcacatggcactacgatgacgagaatccctacaaaacctgggcctaccacggatcgtatgaggtgaaggccacaggatccgccagctccatgataaatggtgtagttaaactgcttaccaagccctgggacgtggtgcccatggtcacgcagatggctatgaccgataccactccgttcggtcagcagcgcgtgtttaaagaaaaggttgacaccaggacgccccggcccatgcccgggacccgcaaggtcatggagattaccgccgaatggctgtggcgaacgctgggccggaataagaagccccgcttatgcaccagggaagagtttaccaagaaggtgcgcaccaacgccgccatgggggcggtgttcacggaagagaaccagtgggactcggcgcgggccgccgtcgaggacgaagagttttggaagctggtagaccgcgagagggagttacacaagttgggaaaatgcgggagctgtgtgtacaacatgatgggcaagcgggagaagaaactgggtgagttcggcaaggccaagggcagccgggcgatctggtacatgtggttaggagcccgatacctcgaatttgaggccctgggcttcctgaatgaggaccactggttctcccgcgagaacagctactcgggggttgagggcgagggcttgcacaagctgggctacattttgcgcgatatcagcaagattccgggcggggcaatgtacgctgacgacaccgcgggctgggataccagaataacggaggacgacctgcataacgaagaaaagatcacgcagcagatggaccctgagcaccgccagctggctaacgccatcttcaagctgacctaccagaacaaagttgtgaaggtccaaagacccacacccaaggggaccgtcatggacataatctccagaaaagaccaacggggcagcggtcaagtcgggacgtacggcctcaacactttcacaaatatggaggcccagttagtacgccagatggagggagagggcgtgctgtccaaggcagacctcgagaatccgcaccttctggagaaaaagatcacccagtggctcgagacgaagggggtcgagcgactgaagcggatggcgatcagcggcgatgattgcgtcgtgaaacctatcgacgaccgcttcgcgaacgcgctgctcgctctgaatgacatgggcaaggtgcgcaaggacattccccagtggcagcccagtaagggctggcacgactggcagcaggtaccgttctgttctcaccacttccatgagttaatcatgaaggacgggagaaagctcgttgtgccttgtcggccccaagatgagttaatcgggcgggcccgaatatcccagggtgcggggtggtctcttaaggaaacggcctgcctcggaaaggcctacgcccagatgtggtccctgatgtactttcaccgccgcgacctgcgcttagcgtcaaacgcgatctgcagcgctgtcccggtgcattggattccgaccagccgtactacctggtcgatccacgcccatcaccagtggatgacgaccgaggacatgttaaccgtctggaaccgcgtatggatcgaggataacccctggatggaggacaagacccccgtgaccacctgggaggatgtgccctacctgggcaagcgggaggaccagtggtgcgggtccctcatcggcctaacgtctcgcgccacttgggcgcagaacatattgaccgctattcagcaggttcggtcactcatcggcgacgaggagttcctggactacatgccgagcatgaaacgcttcagaaaggaggaggaatccgaaggcgccatttggtga

SEQ ID NO: 25773 - RNA, 9873 nt, synthetic construct
  misc_feature 1..9873: note = derived and/or modified CDS sequence (opt11) from DENV-3__KF955333__SS-prME
  source 1..9873: mol_type = other RNA
accagcctgtgtctcatgatgatgctgcctgcgaccctggccttccacctcacttcgagggacggggagcccaggatgatcgtggggaagaacgagcgcgggaaaagcctgctcttcaagaccgcgtccgggataaacatgtgcacacttattgctatggacctgggcgagatgtgcgacgacactgtgacctataaatgccccctgatcgccgaggtggagcccgaggacatcgactgctggtgcaacttgacgtctacttgggtgacttacgggacctgcaaccaagcaggcgagcaccggagggacaagcggtccgtggccctggcgccccacgtcggcatggggctggacacgcgcactcagacatggatgagcgccgagggggcctggcggcaggtagagaaagttgagacgtgggctctacgccatccggggtttaccatcctggcgctttttctcgcccactacattggtacaagcctgacccagaaggtagtcatcttcatcctgctcatgctggtcacccccagcatgaccatgagatgtgtgggggtgggcaaccgtgatttcgtcgagggcctctccggggccacttgggtggatgtggtcctcgaacacggcggatgcgtgaccactatggccaagtctaagcccaccttagatatcgagctgcagaagactgaggccacgcagctcgcgacgctgcgtaagctgtgtatcgagggaaagattaccaacatcaccacagactcccgctgtcccacgcagggcgaggctaccctgccggaggagcaggaccagaactacgtgtgcaagcacacgtatgtcgaccggggttgggggaacgggtgcggcctgtttgggaagggtagcctggtgacctgtgccaagttccagtgtctcgaacccattgaggggaaagtggtgcagtacgagaacctgaagtacacggtaatcattactgtgcacaccggggaccagcaccaggtcggcaacgacacgcagggggtgacagtcgaaattacgccccaggcgtccaccgtagaggccgtgcttccggaatatggcacactcgggttggagtgctcgccgcggaccggcctggatttcaacgagatgatactcctgacgatgaagaacaaggcgtggatggtccatcgacagtggtttttcgacctgcccttaccctggacctctggcgccaccactgagacacccacctggaaccgaaaagagctcctggtgaccttcaagaacgcccacgccaagaagcaggaggtggtggttctaggcagccaggagggcgctatgcacaccgccctgacgggggccacggagatacagaacagtggcgggaccagcatcttcgcgggacatctgaagtgtcggttaaagatggacaaactggagctcaagggcatgagttacgctatgtgcctcaataccttcgtcctgaaaaaggaagtcagcgaaacgcagcacgggaccattctgatcaaggtggagtacaagggcgaggacgccccgtgcaagatccccttctctaccgaggacgggcaaggcaaagctcacaacggccgcctgatcactgccaaccccgtggtcacaaagaaggaggagcccgtgaacatcgaggcagaaccgccgttcggcgagtccaacattgttatcggtatcggagacaaggcactcaagatcaactggtacaagaagggcagctcgatcgggaagatgtttgaggcgaccgcgcgtggcgcccggcggatggctatcctgggcgataccgcctgggacttcgggagcgtgggcggggttctaaacagtctcgggaaaatggtgcaccaaatcttcgggtccgcatataccgcgctgttcagcggcgtgagctggataatgaagatcggcatcggggtcctgctcacgtggatcgggctgaactccaagaacacctccatgtccttttcttgcatcgtgatagggattatcaccctgtaccttggtgccgtggttcaggccgatatggggtgcgcaatcaactggaagggcaaagagctgaagtgtgggtccgggatctttgtgaccaacgaggtccacacttggaccgaacagtacaagttccaggcggacagccccaagcgcctggcaacggccatagccggggcctgggagaacggggtctgcggcatccgctccaccacgcggatggagaacctcctgtggaagcagattgcgaacgagttaaactacatcttatgggagaacaacataaagctgacagtggttgtgggggacatcatcggcgtgctggaacagggtaagcgcaccctcacgccccagcctatggagctgaagtacagctggaagacgtggggcaaagcaaagatagtaaccgccgagacccagaactcctctttcataatcgacggccccaacacgcccgagtgcccctctgcgtcacgggcttggaacgtgtgggaggtggaagactatgggttcggcgtctttactaccaacatctggctgaagctccgcgaggtgtatacccagagctgcgaccaccgcctgatgtccgcagcgatcaaggatgaacgcgccgcccacgcggatatggggtactggatcgagagccaaaagaacggcagttggaagctggagaaggccagcttcatcgaggttaagacctgcacctggccgaagagccatacgctgtggtcaaacggcgttctagagtccgacatgatcattcccaaaagcctggccggccccatctcacagcacaaccaccgtccgggatatcacacccaaaccgccggcccctggcacctcggcaagctggagttagacttcaattactgcgagggcaccacggtggtgataaccgaaaactgcgggacccgcggtcccagcctccggaccacgaccgtctccgggaagctgatccacgagtggtgctgtcgcagttgcacgttgccgccattacggtacatgggcgaggacgggtgctggtacggcatggagatccggcccattaacgagaaggaagaaaacatggtaaaaagtctcgtgagcgccggctccgggaaggtcgacaacttcaccatgggcgtgctctgtctcgcgatcctcttcgaggaggtgatgagagggaaattcgggaaaaagcacatgatagccggggtcctgttcacgttcgtgctgctccttagcggccagatcacctggcgggacatggcccataccctcatcatgatcggctccaacgcctcagaccgcatggggatgggcgtaacttacctggccctcatagcgacttttaaaatacagccgttcctcgccctgggatttttcttacgcaagctcacctcccgggagaacttattgctcggcgtcggtctggccatggccaccactctgcagctcccagaggatatcgagcagatggcgaacgggatcgcgctggggcttatgacgctcaaacttattacccagttcgagacttaccagctttggacggccctcgtgtccctcacgtgtagtaataccatctttaccctgacggttgcttggcgcaccgccaccttgatcctcgcgggggtgtccctgctcccgctctgccaaagctccagtatgcggaagacagactggctgccgatgaccgtcgccgctatgggcgtgcctcctctgccgctgttcatattttccctaaaggacacgcccaagcgcagatcctggccgctcaacgagggggtgatggccgttggcctggtcagcatcctggccagctccctcctgaggaacgatgtgcccatggcgggtccgctggtggccgggggcctcctaatcgcctgctacgttataaccgggacgtcagccgacttaaccgtagagaagcctgccgacgtcccctgggaggaggaggcagagcagacgggtgtatcgcacaaccttatgatcaccgtagacgacgacggaccaatgcgtatcaaggatgacgaaacggagaacatcctgaccgtgctgctcaagacagcccttctgatcgtatccggaatcttcccgtactccatccccgcgacgctcctggtttggcatacctggcagaagcagacccaacgcagcggcgtgctttgggacgtgccaagcccgccggaaacccagaaggccgagttggaggagggggtgtaccgtatcaagcagcagggaatcttcggaaagacccaggtgggcgtcggggtgcagaaggaaggcgtgttccacaccatgtggcacgttactcgtggcgcagtcctgacccacaacgggaaacgtctggagcccaactgggcgagcgtaaagaaggacctcatctcttacggtgggggctggcgcctgaacgcccagtggcagaaaggggaggaggtccaggttatcgccgtagagcccggcaagaaccccaaaaactttcagactatgcccggcatcttccagaccaccaccggggagatcggcgccatcgcgctggacttcaagcctggaacgagcggtagccctatcatcaaccgcgagggcaaggtcgttgggctttacggcaacggggtcgtcaccaagaacggtgggtacgtttccggaatcgcccagaccaatgcagagccggacggcccaacccctgagctcgaggaggaaatgttcaagaagcggaatctgactataatggatcttcatccgggctcagggaagactaggaaatacctcccggccatagttcgtgaggccatcaagcggcggctacggaccctgatcctcgcacctacacgggtcgtggctgctgagatggaggaagccttaaaggggctcccaatccgttatcagacaacagcgaccaaatctgagcacacaggtcgggagatcgtggacctaatgtgccatgctacgttcacaatgcgactgctgagccccgttcgggtgccgaactacaacctcgtaattatggacgaggcccacttcaccgaccccgcctccatcgccgcccgcgggtacatcagtacccgagtcggcatgggcgaggcggcggccatcttcatgacggccactccgcccggaaccgctgaagccttcccgcaatccaacgcccccatccaggacgaggagcgcgacatcccagaacgcagctggaatagtggcaatgagtggatcaccgacttcgtggggaagacggtgtggttcgtgcccagtattaaggccggaaatgatattgcaaactgcctgcggaaaaacgggaagaaagtgattcagctgagtcgcaaaaccttcgacaccgagtaccagaagacacgactaaacgattgggacttcgtcgtaacgaccgacatatctgagatgggggcgaacttcaaggccgaccgcgtgatcgacccgagacgttgcttaaagcccgtgatcctgaccgacggacccgagcgggtcatcttagcggggcccatgccggtgaccgccgcctcagcggcacagaggcggggccgagtagggcggaatccccagaaggagaacgaccaatatatctttacaggtcagccattgaacaacgacgaagaccacgcgcactggaccgaggccaaaatgcttctcgacaatatcaataccccagaggggatcattcccgccttatttgagcccgagcgcgagaagtccgcggccatcgacggcgagtaccggctgaaaggcgagtcccgcaagacctttgtggaactcatgcggcgcggagacctgcccgtgtggctggcccacaaggtcgcaagcgagggcatcaagtacacagatcgtaagtggtgcttcgatggggagcgcaacaaccagatactcgaggagaacatggacgtggagatctggacgaaggagggggagcggaagaaactgcgcccaaggtggttggacgcgagaacctactctgacccgctagcgctgaaggagttcaaggacttcgccgccggcaggaaaagcattgcattggacctcgtgacggagatagggagggtgccgtcccacctggcgcaccgcacccggaacgcccttgataaccttgtgatgttgcacacgagcgaacacggcgggcgagcgtatcggcacgccgttgaggagctacccgagacaatggaaaccctactactgctcgggctcatgatcctgctcaccgggggggccatgctctttctgatcagcggcaaggggataggtaaaacgagcatcggactcatctgcgtaatcgtctcatccgggatgctgtggatggcggacgtgccgctgcagtggatcgcctcggcgatcgtcttagaattctttatgatggtgttattaatacctgaacccgagaagcagcgcactcctcaggacaaccagttggcctacgtggtcattgggatcctgaccctggccgctatcgtagccgccaacgaaatgggcctcttagagaccacgaagcgtgaccttggaatgtccaaggagccgggagtggtctccccaacctcctacctcgacgtcgacttacacccagcctctgcctggaccctctacgctgtggccaccacggtcattacgcccatgctccgccacacgatcgagaactccacggccaatgttagcctggccgcgatcgccaaccaggccgtggtactgatgggactcgacaaggggtggccgatctccaaaatggacctgggtgtgcccctgctcgcactggggtgctactcccaggtgaacccactgacgctcaccgctgccgtgctactgctcgtcactcactacgcgatcatcggccccggactgcaggccaaggctactcgggaagcccaaaagcgcacggcagccgggatcatgaaaaacccaaccgtggatgggatcatgaccatcgacttagatcccgtcatttacgatagtaagttcgagaagcaactaggccaggtgatgctgctcgtactctgcgccgtacagctgttgttaatgcgcacatcatgggccctatgcgaggccctgaccctggcgacgggccccataaccactctgtgggagggctcccccgggaagttctggaacacgaccatcgccgtgagcatggccaacattttccggggctcctacctggcaggggcgggcctcgcatttagcatcatgaagagcgtggggaccgggcggcgcggcaccgggagtcagggcgagacgctgggagagaagtggaagaaaaagttaaaccagctcagccgtaaggagttcgatctgtacaagaaatccggcattacagaggtggaccgcaccgaggccaaggaggggctgaaacggggtgagaccacccaccacgccgttagcaggggctccgcaaagctccagtggttcgtggaacggaacatggtcataccggaggggcgcgtgattgacctgggctgtggtcgcggcggttggagctactactgtgccggtttaaaaaaggtgacggaggtcagaggttataccaagggcggccccgggcacgaagagcccgtgcccatgtccacttacggctggaacatcgtgaagttgatgtctgggaaggacgtcttctacctgccgccagaaaagtgcgacaccttactgtgtgacatcggcgagtcctcaccttcccccacagtggaggagtcccgcaccatccgggtgctgaagatggttgagccgtggctgcggaacaaccaattctgcatcaaagtactgaacccctacatgcccaccgttattgagcatctggagcggctgcagcgaaagtacggcgggatgttagtccggaaccccttaagccggaacagcacccacgaaatgtattggatctctaacgggacggggaacatcgtgagctccgtcaacatggtaagccgtctgctactaaaccgcttcaccatgacccaccggcgacccactatcgagaaggacgtggatttaggcgcgggaacgcggcacgtgaacgccgagcctgagacccccaacatggatgttatcggggaaagaatcaagcgtatcaaggaggagcactccagcacttggcattacgacgacgagaacccgtataaaacctgggcctaccacggtagttacgaggtgaaggccacgggaagcgcgagctccatgatcaacggcgtagtgaaacttctcaccaagccgtgggatgtggtccccatggtgacgcaaatggccatgaccgacaccacgccgttcgggcaacagcgcgtgttcaaggaaaaggtagatacccggacaccgcgccccatgcccggcactcggaaggtgatggagatcaccgccgagtggctgtggagaaccctgggacgcaataagaagccaaggctctgcacccgcgaggagtttacgaagaaggttagaaccaatgcggccatgggggcggtcttcaccgaggagaatcaatgggactcggcacgcgccgccgtggaggacgaggaattctggaagctagtggatcgggaacgcgagctgcacaagctcggcaagtgcgggtcatgcgtttacaacatgatgggcaagcgggagaaaaagttaggagagtttggcaaggcgaagggcagccgcgccatctggtacatgtggctgggagcccggtacctcgagttcgaggccctcggcttcttaaacgaggaccactggttctcccgagaaaactcgtactccggggtggagggcgagggcctccacaagctgggctacatccttcgggatatttccaagatcccgggcggggctatgtacgcggacgataccgccggctgggacacgcgtatcaccgaagacgatctccacaacgaggagaagatcactgcccagatggaccccgaacatcggcagttggccaatgctatcttcaagctgacgtatcagaacaaggtagtgaaagtccagagaccgacgccaaagggaaccgttatggacattatctcccggaaagaccagcgcggtagcggccaggtgggaacatacggcctcaataccttcacaaatatggaagctcaactggtgcggcagatggaaggggagggagtgctgagcaaggccgatctcgagaacccccacctcctggagaagaagataacgcaatggttggaaaccaagggggtcgagaggctgaagcgaatggccatctcgggcgacgactgtgtggttaagcccattgacgaccgcttcgccaacgccctcttggcgctgaacgacatgggaaaggtacggaaggatatcccccaatggcagccctccaagggctggcacgactggcagcaggtcccgttttgcagccaccacttccacgagctgatcatgaaggacggccgcaagctcgtggtgccgtgtcgcccccaggacgagctgatcgggcgggcccgcatctcccagggcgccgggtggagcctgaaggaaacagcctgcctcggaaaggcctacgcgcaaatgtggtccctcatgtacttccacagacgcgacctgcggctcgcctcaaatgccatatgttccgctgtgcccgtgcactggatcccgaccagccgcacgacctggagcatccacgcgcaccatcagtggatgaccaccgaggatatgctgaccgtgtggaaccgggtttggatcgaggacaacccctggatggaggacaagaccccagtgaccacctgggaggatgtcccgtacctcggtaagcgcgaagaccagtggtgcggctcgctcattggactaacgtcacgggctacgtgggcccagaatatcctgactgcgatccaacaggttcgctccctaataggagacgaggaatttctggattacatgcccagcatgaaacgattccgcaaggaagaggagagcgaaggcgctatctggtga

SEQ ID NO: 25774 - RNA, 9873 nt, synthetic construct
  misc_feature 1..9873: note = derived and/or modified CDS sequence (opt11) from DENV-3__GQ868628__SS-prME
  source 1..9873: mol_type = other RNA
accagcctgtgcctaatgatgatgctgcccgcgaccctggcattccacctcaccagccgggacggcgagccacggatgatcgtggggaaaaacgagcgcggcaagtcactgctgttcaagaccgcgagcgggatcaatatgtgcactctcatcgccatggacctgggtgagatgtgcgacgacaccgtaacctacaagtgccccttaatcgccgaggtggagcctgaggatatcgactgctggtgcaacctcaccagcacatgggtgacctacgggacgtgcaaccaggccggagagcaccggcgagacaagcggtccgtcgccttggcgccacacgtgggcatggggctggacacccgcacccaaacctggatgagcgccgagggcgcctggcgacaagtggagaaggtagagacgtgggccctccgccacccggggttcaccatactggcgctgttcttagcccattatatcggcacctcactgacccagaaggtggtgatattcatcctgctcatgctggtcacgcccagtatgacaatgcggtgcgtgggggtcggcaaccgcgacttcgttgaaggcctgtccggggcaacctgggtggacgtggtcctcgagcacggcggctgcgtgacaacgatggctaagagcaagcccacgctggacatcgagctgcagaaaaccgaggccacccagctagcgacgctgcggaagctgtgcatcgagggtaagatcaccaatatcactaccgactcccgctgccccacgcagggcgaggccactctaccggaggagcaggatcagaactacgtttgcaagcacacctacgtagacagagggtgggggaacgggtgcggcctattcgggaagggcagcttggtgacctgcgccaagttccaatgcctcgagcccatcgagggcaaggttgtccagtacgagaacctgaagtacacggtaatcatcaccgtgcataccggggaccaacaccaggtcggcaacgacacccagggggtgacggtcgagataacgccccaggcctccaccgtggaggccgtcctgccagaatatggcaccctcgggctggagtgtagcccgcgaaccggcctggactttaacgagatgatcctcctgacgatgaagaacaaggcttggatggtccaccggcaatggttcttcgacctgccgcttccctggaccagtggcgccacaaccgaaacgccaacctggaaccgcaaggagcttcttgtgaccttcaaaaacgcccacgcaaagaagcaagaggtagtcgtgttagggagccaggagggcgctatgcacaccgcgctgacgggggctaccgagatacagaactccggcggaaccagcatctttgccggccacctgaagtgccggctcaaaatggataagttggagctgaagggcatgagctatgccatgtgcctcaacaccttcgtgctgaagaaggaagtcagcgaaacgcagcacggaaccatacttatcaaggtggaatacaaaggcgaggacgcaccgtgcaaaattcccttcagcacggaggacggacagggcaaggcgcacaacggtcgcctaatcaccgccaaccccgtggtcacgaagaaagaggagccagtgaacatcgaagccgagccgcccttcggggagtccaacatcgtcatcggtatcggggataaagcgctcaagattaactggtacaagaagggtagctccatcgggaagatgttcgaggcgaccgctcggggcgcccgccggatggccatcctgggcgacacagcctgggacttcgggagcgtcggcggggtgctgaactccctcggcaagatggtgcatcagatcttcgggtcggcgtacacggccctgttctcgggcgtcagctggatcatgaagatcggaatcggggtgctacttacttggatcggcctaaactccaagaacaccagcatgtccttcagctgcatcgtgatcggtatcattaccctgtacctcggcgccgtcgtgcaggccgacatgggttgcgtgatcaactggaagggcaaggaactaaagtgcggcagcgggatcttcgtcaccaacgaagtgcacacgtggaccgagcagtataaattccaggccgacagccccaagcgccttgcgactgccatcgccggcgcgtgggagaacggggtgtgcggcatccgctccaccacgagaatggagaacttactgtggaaacagatcgcaaacgagctaaactacatcctctgggagaacaacattaagctgaccgtcgtggtgggggacatcatcggcgtcctggagcagggcaagcgcaccctaacgccccaaccgatggagcttaagtacagctggaagacgtgggggaaggccaagatcgtgaccgccgagacccagaattccagcttcatcatcgatggccccaacacccccgagtgcccctccgccagccgggcctggaacgtgtgggaggtagaggactacgggttcggcgtgttcacgaccaacatttggctgaagctccgcgaagtgtatacccagagctgcgatcaccggctgatgtccgcggcgatcaaggacgagcgggccgtccatgccgatatgggttactggatcgagagccagaagaacgggtcctggaagttggaaaaggcgagcttcatcgaggtgaagacctgcgcgtggccgaagtcccacacgttatggtcgaacggcgtactggagtccgacatgattatccctaagagcctggccggtcccatctcccagcataaccaccggccgggctaccacacgcagaccgcggggccctggcacctcggcaagctggagctggacttcaactactgcgagggcaccaccgtcgtgatcaccgagaactgcgggacgcgcggccccagcctcaggaccaccacggtcagtgggaaactgatccacgagtggtgctgtcggagctgcacccttccgccgctccggtacatgggagaggacgggtgctggtacggcatggagatccgccctatcaacgagaaggaggaaaacatggtcaagtccctggtgagcgctggctcggggaaggtggacaacttcaccatgggcgtcctgtgcctcgcaatcctgttcgaggaagtaatgcgggggaagttcggcaaaaagcatatgatcgcgggtgtgctgttcaccttcgtcctcctgctgtctggccagatcacgtggagggatatggcccacaccctcatcatgatcgggtcaaacgccagtgaccggatggggatgggcgtgacctacctggccctgattgccacgttcaagatccagcccttccttgcgttagggttcttcctgcgcaagctcacttcgcgggagaacctgctgctcggcgtggggctggcaatggccaccaccctgcagctccccgaggacatcgagcagatggcaaacgggatcgcactgggcctgatgaccttaaagttaatcacgcaatttgagacctaccagttgtggaccgcgctcgtctcccttacctgctccaatacgatctttaccctgaccgtggcctggcgcaccgccacgctcatcctggccggggtctccctgctcccgctatgccagagctccagcatgcggaagaccgactggctgcccatgaccgtggccgccatgggagtgccgcccctgccgctgttcattttttccctgaaggacacccccaagcgtcgcagctggcccctcaacgaaggggtaatggccgtgggcctggtgtccatcctggccagctccctcctgcggaacgacgtcccgatggccgggcccctggtggccggcgggctcctgatcgcctgttacgtcatcacggggaccagcgccgacctgaccgtcgagaaagccgccgacgtgacctgggaggaggaagcggaacagacgggagtgagtcacaacctcatgatcaccgtggacgacgacgggaccatgcgcatcaaggacgacgaaaccgagaacatccttaccgtgctgcttaagacggccctgctgatcgtgagcggcatcttcccctactccatacccgccaccctcctggtctggcacacctggcagaagcaaacccagcggagtggcgtgctgtgggacgtgccctccccgcccgagacgcaaaaggcagagctcgaggagggggtgtaccgcattaagcaacagggcatcttcgggaagacccaggtgggggtgggggtccagaaggagggcgtgttccacaccatgtggcatgtgacccggggcgctgtcctgacgcataacggaaagcgcctggaacccaactgggccagcgtcaaaaaggacttgatctcctacggcgggggctggcgcctgagcgcccagtggcagaagggcgaggaggtacaggtcatcgctgtggagcccggcaagaacccgaagaacttccagaccatgcccggcatcttccaaactaccaccggggagatcggagccatcgcgcttgatttcaagccaggcaccagcggctccccgatcattaaccgcgagggcaaggtggtcgggctgtacggcaacggcgtggtgaccaaaaacggcgggtacgtctcgggcatcgcccaaaccaacgccgagcccgacggccccacaccagaactcgaggaagagatgttcaagaagcggaacctgaccatcatggatctgcacccggggtcaggcaagacccgcaagtacctccccgccatcgtgcgtgaggccattaagcgccggctgcgcaccctgatactcgcgcccacgcgggtcgtcgccgccgagatggaggaagcgcttaagggtctgcccatccgctaccagaccaccgctactaagagcgaacacacgggccgcgagatcgtggacctcatgtgccacgcgaccttcaccatgagactgctgagcccggtgcgtgtccccaactacaaccttgtgatcatggacgaggcacactttaccgaccccgcctctattgccgcccgcgggtacatctccacgcgggtgggcatgggcgaggcggccgccatcttcatgacagccacgccgcccgggaccgcggaagccttcccccagagcaacgcccccatccaggacgaggagcgcgacatccccgagcgctcctggaacagtggcaacgaatggattacggatttcgtcgggaagaccgtgtggttcgtgccaagcatcaaggccggcaacgacatcgccaactgcttgcggaagaacgggaagaaggtcatccagctgtcccgcaagaccttcgacaccgagtaccagaagacgcggctcaacgactgggacttcgtggtgaccaccgacatctccgagatgggcgctaacttcaaggccgaccgcgtgatcgacccccggcgctgcctgaagcccgtgatcctgacagacggccccgagcgggtgatcctcgccggcccgatgccggtcaccgcagccagcgctgcccagcgccggggtcgcgtggggcggaacccccagaaggagaacgaccaatatatctttaccggccagcccctgaacaatgacgaagatcacgcccactggaccgaggccaagatgctgctcgacaacatcaacaccccggaggggatcatacccgccctgttcgagcccgagcgcgagaagtccgcggccatagacggcgaataccggctgaagggggagagtcgcaagacctttgtagaattgatgcggcgcggggacctgcccgtgtggctggctcacaaggtggcctccgagggcatcaagtacaccgaccgtaagtggtgcttcgacggggagcgcaacaaccagatcctcgaggagaacatggacgtcgagatctggaccaaggagggcgagcggaagaaactgcgcccgcgctggctggacgcacggacctacagtgaccccctggccctgaaggagttcaaagacttcgccgctggtcgcaagtccatcgccctggacctcgtgaccgagatcgggcgggtgcccagccaccttgcgcaccgcacacggaacgcgctggacaacctcgtaatgttgcacaccagcgaacacggcggtcgcgcataccgccacgccgtcgaggagttaccggagaccatggaaaccctactgctgctcggcctgatgattctgctcaccgggggcgcgatgctgttcctgatctccggcaaggggatcggcaagaccagcatcgggctgatatgcgtgatcgtctccagtggcatgctgtggatggcggacgtgcctctacagtggatcgcatccgccatcgtgttggagttctttatgatggtactgctgatccccgagcccgagaagcagcgcaccccgcaggacaaccagctcgcctacgtggtgatcgggatactgaccctagccgcgatcgtcgccgccaacgagatgggcctccttgagacgaccaagcgggacctgggcatgagcaaggaacccggggtggtgtcccccaccagctacctcgacgtcgacctacaccccgcctccgcctggaccctgtacgcggtggccacgaccgtgatcacgccgatgctccgccatacgatcgagaactcgaccgccaacgtctccttagccgcgatcgccaaccaggccgtggtgctgatgggcctcgacaaggggtggcccatcagcaagatggatctgggagtccccctgctagccctggggtgttactcccaagtgaaccccctgacactcactgccgcggtgctgctgctcgtcacccactacgccatcattggcccgggcctgcaggccaaagcaacgcgggaggcccagaagcgcaccgcggccgggatcatgaagaaccccactgtggacggcatcatgaccatcgacttggatccagtgatctacgacagcaagtttgagaagcagctcgggcaagtcatgctgctggtgctctgcgccgttcagctgctgctcatgcggacttcctgggccctgtgcgaagccctgacactcgcgaccggccccatcacaactctgtgggaggggagcccggggaagttctggaataccaccatcgcggtctccatggccaacatcttccgtggctcgtacctagccggggcgggcctagccttctccatcatgaagtccgtcgggaccggccggcgaggcacggggagccagggagagaccctgggggagaagtggaagaagaagctgaaccagctatcccggaaggagttcgacctgtacaagaagtccgggatcaccgaggtggaccgcaccgaggcgaaggaggggctgaagcggggcgagaccacgcaccacgccgtctcccgtggcagcgccaagctccagtggttcgtggagcggaacatggtgattcccgaggggcgcgtcatagatctgggatgcggccgcggcgggtggagttactactgcgcgggcctgaagaaggtgacagaagtccggggctacaccaagggcggccccggtcacgaagagcccgtcccgatgagcacctacggctggaacatcgtgaagcttatgtccgggaaggacgtgttttacctgccgcccgagaaatgcgacacgctgctgtgcgacatcggcgagagctccccctctccgaccgtcgaggaatcccgcaccatccgggtgctcaagatggttgagccctggttacgcaacaaccagttttgcatcaaggtcctaaacccctacatgcctaccgtgatcgagcacctcgagcggctgcagcgcaagtacggagggatgttagtccggaacccgctcagccgcaactccacacacgagatgtactggataagcaacggcacggggaacatcgtctccagcgtgaacatggtctcccgtcttctgctcaaccgcttcaccatgacccaccggcgccccacgatcgaaaaagacgtggacctgggcgccggcacccggcacgtcaacgccgagcccgaaaccccgaacatggacgtcatcggggagcgcatcaaacggatcaaggaggagcattcctccacctggcactacgacgatgagaacccctacaaaacgtgggcctaccacggcagctacgaggtcaaggccaccgggagcgcgtccagcatgatcaacggcgtggtcaagctgctcaccaagccctgggacgtggtgccgatggtcacccagatggccatgacggacaccactccgtttgggcagcagcgcgtgtttaaagagaaggtggacacccggacgccccgccccatgcccggcacccgtaaggtcatggagatcaccgccgagtggctgtggcgaaccctgggccgcaacaaaaagccgcggctatgcacgcgcgaggagttcaccaagaaggtgcgtaccaacgccgccatgggggcggtgttcaccgaggagaaccagtgggactccgcccgcgccgccgtcgaggacgaggaattttggaagctggtggaccgggagcgcgagttacacaagctcggcaagtgcgggagctgcgtctacaacatgatgggcaagcgggagaagaagctgggagagttcggcaaggcgaaaggctcccgcgccatctggtacatgtggttgggggcgcggtacctagagttcgaagccctgggattcctgaacgaggaccactggttcagccgcgagaactcctacagtggtgtcgagggcgaggggctccacaagttaggctatatcctacgggacatatccaagatccctgggggggccatgtacgcagacgacacggccggctgggacacccgcatcaccgaggacgatctccacaacgaagagaagatcacccagcagatggaccccgagcatcggcagctggccaacgccatatttaagctgacttaccagaacaaggtggtgaaggtccagcgccccaccccgaaggggacggttatggacatcatctccagaaaggaccagcgcggcagtggccaagtggggacctacggccttaacaccttcacaaacatggaggcccagcttgtcagacagatggaaggggaaggtgtgctgagcaaggcggacttagagaacccccacctcctagagaagaagatcacccagtggctcgagaccaagggggtggagcgcctgaagcggatggccatctcgggcgacgactgcgtagtgaagcccatcgacgaccgattcgccaatgccctcctcgcgttaaacgacatgggcaaggtccggaaggacattccccagtggcagccgagcaaggggtggcacgactggcagcaggtccccttctgctcccaccacttccacgagctgatcatgaaggacggccgcaagctagtggttccctgccgcccccaggacgagctgatcgggcgggcgcgcatcagccagggcgcaggatggtccctgaaggagaccgcctgcctcggcaaagcctacgcccagatgtggtccctgatgtattttcatcggcgcgacctgcgtctggcgtccaacgcgatctgcagcgccgtacccgtgcactggatcccgacgagccgcaccacctggtccatccacgcccatcatcagtggatgacaaccgaggacatgttaacagtgtggaaccgggtctggatcgaagataacccctggatggaggacaagacccccgtgaccacgtgggaggacgtaccgtacctgggtaagcgcgaggaccagtggtgcgggagcctcatcggcctgacctcccgggcgacctgggctcagaacatcttaaccgctatccagcaggtccgcagcctcatcggggatgaggagttcttagattacatgccctcaatgaagcggttccgcaaggaggaggagagcgaaggtgctatctggtga

SEQ ID NO: 25775 - RNA, 9873 nt, synthetic construct
  misc_feature 1..9873: note = derived and/or modified CDS sequence (opt11) from DENV-3__FJ639727__SS-prME
  source 1..9873: mol_type = other RNA
actagcctctgcttgatgatgatgctgccggcgacgctagcctttcatctgacctcccgtgacggagagccgcggatgatagtggggaagaacgaacgaggcaagagcctgctttttaagaccgcgagcgggatcaacatgtgcaccctcatcgccatggaccttggcgagatgtgcgacgatacagtgacctacaaatgcccgctgatcgcagaggtggaaccagaggacatcgactgttggtgtaatctaacgtctacctgggtgacctatgggacgtgcaaccaggcgggggagcaccgtcgggataagcggtccgtcgcgttggcgccgcacgtgggtatgggcttagacactcgcacgcagacatggatgagcgccgagggggcctggcgtcaggtggagaaggtcgaaacttgggccctccggcatcctgggttcactatcctggcgttattcctcgcacactatatcgggacatcgttgacccaaaaggtggtaatcttcatactgttgatgctggtcaccccaagcatgactatgcggtgtgtgggagtagggaatcgggacttcgtcgaaggcttgtccggagcgacctgggtggacgtcgtcctcgaacacggggggtgcgtgaccacgatggccaagagcaaaccaacgctggatatcgagcttcagaagaccgaggccacccagctcgcgaccctccgaaagctgtgcatagaaggcaagatcaccaacattacaactgactccagatgcccaacgcaaggggaagccacactcccggaggagcaggaccagaactacgtgtgtaaacacacctacgtcgaccgcgggtggggtaatgggtgcggcctgttcggtaaaggctcgctggtgacctgcgctaaattccaatgcctcgagcccatcgaaggcaaggtggttcagtacgagaacctgaagtacacggtcatcataaccgtacacacaggggaccagcatcaggtcggcaacgacacccagggggtgacagtagagatcacgccccaggcgtccacggtggaggccgtgctcccagagtatggcactctcgggctggagtgcagcccacgcactggcttggacttcaacgagatgatccttctgacgatgaaaaacaaggcgtggatggttcaccggcagtggttcttcgacttaccactcccctggacctccggcgccaccactgaaacaccaacctggaaccgtaaggagctactagtgactttcaagaacgcccacgccaaaaagcaggaagtggtcgtactaggctcgcaggagggcgccatgcacacagcgttaacgggggctaccgagatccagaactccgggggtacgagcatattcgccggccatctgaagtgccggctcaagatggacaagctggagctgaaaggcatgtcctacgccatgtgcctcaataccttcgtgctgaaaaaggaagtcagcgagacgcaacatgggaccatcctcatcaaggtggagtacaagggcgaggacgccccgtgcaagatcccctttagcaccgaggacgggcaaggtaagtcccataacggtaggctgataacggcaaatcccgtggtcacgaagaaggaagaacccgtgaacattgaggccgagccgccattcggcgagagtaacatcgttatcggtataggggacaaggccctcaaaatcaactggtacaagaagggctccagcatcgggaaaatgtttgaagcaaccgcgcggggcgcacgccgaatggccattctgggcgacaccgcctgggacttcggctcagtcggaggtgtgttaaactcattaggcaagatggtgcaccagatctttgggtcagcctacacagcgctgtttagcggagtctcctggatcatgaaaattggcatcggagtgctgctcacctggattggtctgaacagcaagaacacctccatgagcttctcctgtattgtgatcggtatcataactctatacctcggggcagtagtccaagcagatatggggtgcgtgatcaattggaaagggaaggagctaaagtgcggatcggggatcttcgtcaccaacgaggtgcacacatggaccgagcagtacaaatttcaggcggattcccctaagcgactggccaccgctatcgctggcgcctgggagaacggggtttgcggcatccgcagcacgacacggatggaaaacctactgtggaaacagatagcaaacgagctgaactacatcctctgggagaacaacatcaagctgactgtcgtggtaggggacatcatcggcgtcctggagcaaggcaagcgcaccttaacgccccagccgatggagctaaagtactcatggaaaacatgggggaaggccaagatcgtcaccgcagagacccagaatagctcctttatcatcgacggccccaatactccggagtgcccgagcgcatctcgagcctggaatgtgtgggaggtcgaagactacggatttggggtgttcaccaccaatatatggctcaaactccgcgaggtgtacacacagtcctgtgaccaccggttgatgtccgccgcgatcaaggacgaacgggccgtccacgctgatatgggatactggattgaatctcagaagaacggttcttggaaactggaaaaggccagctttatcgaggtgaaaacctgtacgtggcccaaaagccataccctgtggtccaatggcgtgttagagagcgacatgatcattcctaagagcctggccggacccatctcgcagcacaaccacaggcctggctactatacacagaccgctgggccttggcatctcggcaagctggagctggactttaactattgtgagggcacaacggtcgtgatcaccgagaactgcgggacccggggtccctcccttagaactacgaccgttagcggtaagctgatccacgagtggtgctgccgctcctgcacgctgccccccctccgttatatgggcgaagacgggtgctggtatggcatggaaatccgccccatcaacgagaaggaagagaacatggtcaagtctttggtgtccgcaggatcggggaaggtggacaactttaccatgggggtcctgtgcctcgccatactgtttgaggaagtgatgcgggggaagttcggaaagaagcacatgatcgctggggcactcttcacattcgtgctgctgttatccggccagatcacgtggcgcgacatggcgcacaccctcatcatgatcgggagcaacgccagcgatcgaatggggatgggcgtgacctacctggccctaatcgccacgttcaagatccagcccttcctcgcgcttggtttcttcttgcggaagctcacctcccgggagaacctgctgttgggagtgggactggctatggccaccaccctgcagcttccggaagacatcgagcagatggccaacgggatagccctaggccttatgacgctcaagctgatcacccagttcgagacgtaccaactatggaccgcgttggtgagcctgacgtgttccaacacgatattcaccctgactgtggcatggcgaacggccaccctcattctggcaggggtgagcctgttgccgttgtgccagtccagctccatgcggaagacggattggcttcctatgaccgtcgccgccatgggcgtgccgcccctgccgctgttcatctttagccttaaagacaccccgaagcgccgcagttggcccttgaacgagggggtgatggccgttggcttagtctcaatccttgcgtcctctctgctgcggaacgatgtgcccatggccggacccctggtcgccgggggcctcctgattgcctgctacgtgataaccgggacttccgccgatctgaccgtggaaaaggccgccgacgtcacgtgggaggaggaggccgagcagaccggcgtcagtcacaatctaatgatcaccgtggacgatgacgggaccatgcgcatcaaggacgacgagaccgaaaacatcctaacggtcctgctcaagaccgcgctgctgatcgtttcaggcatctttccttactctatcccggccaccttacttgtgtggcacacctggcagaagcagacacagaggagtggagtcctgtgggacgtgccgagcccgcccgagacccaaaaagccgagctcgaagaaggggtctaccgcatcaagcagcagggcattttcgggaaaacacaggtcggcgtcggggttcagaaggagggcgttttccacaccatgtggcacgtgacacgcggcgccgtcctgacacacaacgggaaacggctggagcccaactgggcctctgtcaaaaaagacctgatcagctatggcgggggttggcgcctctccgcgcagtggcagaaaggtgaggaggtccaggtcattgcagtcgagccgggcaaaaacccgaagaacttccagacaatgcccggcatctttcagaccacgaccggggagatcggagccatcgccctggacttcaagcccggcacctccggcagcccgatcatcaaccgggagggtaaggtggtggggttatacgggaacggggtcgtgaccaaaaacggcggctatgtttccggcattgcacaaactaacgcagagcccgacggccccacccccgagttggaggaggagatgttcaagaaacggaatctcaccatcatggaccttcaccccgggtcaggtaagacccgcaagtacttaccggcaatcgtgcgggaggccattaagcgccggcttcgcaccctaatcctcgccccaacgcgggtggtggcggccgagatggaggaggcgttgaaggggttacccatccgataccagaccactgccacgaagtccgagcacacaggtcgggagattgtagacctcatgtgtcacgctacctttaccatgcgcctgctgtcaccagttcgcgtgccgaactacaatttggtagtgatggacgaggcgcacttcacggacccggcgtccatcgccgcgcgcggttacatctcaacacgagtgggcatgggcgaagccgcggctatattcatgaccgcgacgcctcccgggacagccgaggcgttcccacaatccaacgctccgatccaagacgaggagagggacatacccgagcgctcgtggaactcgggcaacgagtggatcaccgacttcgttgggaagaccgtgtggtttgtaccatccattaaggcgggtaacgacatcgccaactgcctgcgcaagaatggcaagaaggtcatccagctgagtcgcaaaaccttcgacacggagtatcagaagacccggctaaacgactgggactttgtggtaaccaccgacatcagcgaaatgggcgccaatttccgcgctgaccgggtcatcgacccccgacggtgcctgaaacccgtgatcctgacggacggacccgaaagagtgatcctcgccggcccgatgcccgtaaccgccgcctctgccgcgcagcggcgaggccgggttggacgtaacccccagaaagagaacgaccaatatatcttcaccggtcagcctctgaacaacgacgaagatcatgcccactggacagaagccaagatgctgctcgacaatatcaacacgccggagggtatcatcccagccctgttcgaacccgagagagaaaagagcgctgctatagacggagagtacaggctaaagggggagtctcgtaagacgttcgtcgagttaatgcgcaggggggacttaccggtctggctggcccacaaggtggccagcgagggtatcaaatacaccgaccgcaagtggtgcttcgacggggagcgaaacaatcagatactcgaagagaacatggacgttgagatctggaccaaagagggcgagcgcaagaagctgcgcccgcggtggcttgacgcccgcacctacagcgaccccctggcgctgaaggagttcaaggacttcgccgccgggcgcaagagcatcgcgctagacctcgtaacagagatcgggcgtgtaccctcgcacctcgcccaccggacccgcaatgccttggacaacctcgttatgttgcatacttctgaacacggagggcgggcctaccgccacgcggtcgaggaactaccggagaccatggagacgctcctcctgctcggcctaatgatactgctcaccgggggggcaatgctgttcctgatcagcggaaaaggtatcggtaagaccagcatcggattaatctgcgtcattgtgtcaagtgggatgctatggatggccgacgtgcccctgcagtggatagcgagtgccatcgtgctcgagttttttatgatggtccttctgatccccgaacccgaaaagcagcgtacgccacaagataaccaactcgcctatgttgtaatcggtattttaacgttagcagccatagtcgcggccaatgagatgggcctcctggagaccaccaagcgggatctgggcatgtctaaggagccgggggttgtaagccccacatcctatctcgatgtcgacctacaccccgcatcggcctggaccctgtatgcagtcgcgaccaccgtcatcacccccatgttacggcacacaatcgaaaattccaccgccaacgtaagcctggcggccatagcgaaccaggccgtggtcctgatgggtctcgacaaggggtggcctatcagcaagatggacttaggcgttcccctgctcgccctggggtgctacagccaggtgaacccactaaccctcaccgcggccgttctgctgttagtcacgcactacgcaatcatcggcccaggcctgcaggccaaggcaacgcgtgaggcccaaaaacggacggctgcagggatcatgaagaaccccaccgtagacggcatcatgacgatcgacctggaccccgtgatctacgactctaaattcgagaagcaactcgggcaagtcatgctgctggtgctctgcgccgtgcagctactgcttatgcgaaccagctgggctctctgtgaggctcttaccctcgccaccggccccatcactaccctttgggagggcagtccggggaagttctggaacaccaccatcgcggtcagcatggccaacattttccggggctcatacctggccggggccggccttgcgttcagcatcatgaagtccgttggtacaggccgccggggcacagggagtcagggcgaaaccctgggggagaagtggaagaagaagctgaaccagctctcgcgcaaggagttcgacctgtataagaaaagcggcattacggaggtggaccggaccgaggccaaggagggactgaagcgcggcgaaacgacccaccacgccgtcagccggggctccgccaagttgcaatggttcgtggaaagaaacatggtgataccggaaggccgcgttatcgacctgggatgcgggcggggaggatggagttactactgtgccggcttaaagaaggtgaccgaggttcgcggttacaccaagggggggcccgggcacgaggagccggtcccgatgtcaacgtacggatggaatatcgttaagctaatgagcggaaaggacgttttctacctcccgcccgaaaagtgtgataccctgttatgcgacatcggcgaaagttcccccagtccaaccgttgaggagagccgaacgatccgcgtcttaaagatggtggagccctggctgaggaacaaccaattctgtatcaaggtcttgaacccatacatgcccacggtgatagagcacttggagcgcctacagcgaaagtacggagggatgcttgtgcgcaaccccctctcccggaatagcacccacgagatgtactggatatccaacggcactgggaacattgttagcagtgtcaacatggtcagccgcctgttgctcaaccggttcaccatgacgcacaggcgccccaccatcgagaaggacgtcgacctgggcgcgggaacccgccatgtgaacgcagagcctgaaaccccgaacatggatgtgattggtgagcggatcaagcggatcaaggaagaacactctagcacctggcactacgacgacgagaatccgtataaaacctgggcctaccatgggtcgtacgaggtgaaggccaccgggtccgcttcttccatgatcaacggcgtagtcaagttactaaccaagccctgggatgtcgtccccatggtcacgcagatggcgatgaccgacacgaccccgttcgggcagcagagggtgttcaaagaaaaggtggacacacgcacaccccggcccatgccgggcacccgtaaagtgatggaaattaccgccgaatggctgtggaggacgcttggccggaacaaaaagccgcgcctctgcacccgggaggagttcaccaagaaggtacggacgaatgccgccatgggagcggtgtttaccgaggaaaaccagtgggactcggcacgggccgccgtcgaggacgaagaattctggaagctggtggacagggaacgggagctgcataagcttggtaagtgcgggtcctgcgtctacaatatgatgggcaaaagggagaagaagctgggtgagttcggcaaagcgaaaggctcgcgggcgatttggtacatgtggctgggggccaggtatttggagttcgaggccctgggcttcctgaatgaggaccactggttctcccgggagaacagctactccggggtcgagggggaggggctccacaagctggggtacatactacgcgacatctctaagatccccggcggggcaatgtacgctgatgatactgctggatgggacacccggataacggaggatgacctgcacaatgaggaaaagatcactcaacagatggatcctgagcacagacagcttgccaacgccatctttaagctaacctaccagaacaaggttgtcaaggttcagagacccacgcccaaggggaccgtgatggatataatcagccggaaggaccaacggggcagcgggcaggtgggtacctatggattaaacacatttacgaatatggaggcccagctagtccgccagatggagggggaaggcgttctaagcaaggccgacttagaaaacccccacctcttggagaagaagatcacccagtggctcgagacaaagggggttgagagactgaaacggatggctataagcggcgacgactgcgttgtaaaacccatagacgaccgttttgccaacgccctgctggccctgaatgacatgggcaaggtaaggaaggacatcccccagtggcagccctccaagggatggcacgactggcagcaggtacccttttgtagccaccacttccatgagctgatcatgaaggatggtcgtaaactcgtcgtgccctgtcggccccaagacgagctaatcgggcgcgcccggatcagtcagggcgccgggtggagcctgaaggagacggcatgcctcggcaaggcctacgcacagatgtggagcctgatgtatttccaccgccgggacctgcgcctcgcaagtaatgctatctgcagtgctgttcctgtgcactggatccctacttcccgaaccacctggagtattcacgcacatcaccagtggatgacgaccgaagacatgctgaccgtgtggaaccgcgtttggattgaagacaacccatggatggaggacaagacgcccgtgacgacctgggaggacgtgccctacctgggcaaaagggaagaccagtggtgcgggtcactaatcggcctgaccagccgtgccacatgggcacaaaacattcttacagcaattcaacaagtccgttccctaattggagatgaggagttcctggattacatgccctcgatgaagcgatttcggaaggaggaagagtccgagggcgccatctggtaa

SEQ ID NO: 25776 - RNA, 9873 nt, synthetic construct
  misc_feature 1..9873: note = derived and/or modified CDS sequence (opt11) from DENV-3__GQ868629__SS-prME
  source 1..9873: mol_type = other RNA
actagcctatgcctcatgatgatgttgcccgccaccctggcctttcacctcaccagcagagacggcgagccccgtatgatcgtgggtaagaacgagcgaggcaaaagcctgctgttcaaaactgcgagcgggatcaacatgtgcaccctaatagctatggacctgggcgagatgtgcgacgacaccgtcacctacaagtgccctttaatcgcggaggtggagcctgaagacattgattgctggtgtaacttgaccagcacctgggtgacctacgggacgtgcaaccaggctggcgagcaccgtagagacaagaggtccgttgccctggcgccacacgtggggatgggactggacacccgtactcagacttggatgtctgcagagggcgcatggaggcaggttgagaaggtcgaaacctgggccttgcgccacccggggtttaccatattggcactcttcctcgcccactacataggcacttccctgacccagaaagtggtcatcttcatccttctcatgctggtcacgcccagcatgaccatgcgttgcgtgggggtgggcaaccgcgacttcgttgaagggctgtccggggcgacctgggtggacgtagttctggagcacggaggttgcgtgaccacaatggccaagagcaagcccacactcgacatcgagctgcagaagactgaggcaacccagcttgcgacgctgcgtaagctgtgcattgagggcaaaatcacaaatatcaccaccgactcccgctgcccgacgcagggggaggccacactcccggaggagcaggatcagaactatgtgtgcaagcatacctacgtcgatcgggggtggggtaacggatgcggcctgtttggtaagggaagcctagtgacatgcgccaagttccagtgcctcgagcccatcgagggaaaggtggtccagtacgagaacttgaagtatacggtgatcatcaccgtgcacaccggggatcaacaccaggtcggcaacgatacccaaggcgtgacggtcgagatcacgccccaagcctccaccgtggaggccgtgctccccgagtacggcacattggggctggaatgcagcccgcgcaccggcctagacttcaacgaaatgatactcctgactatgaagaataaggcgtggatggtccatcggcagtggttcttcgacctgcccctaccgtggacgtccggggctattaccgagacccccacgtggaaccgaaaggagctgttggtgaccttcaaaaacgcccacgccaagaagcaggaggtggtcgtgctcgggagccaggagggcgccatgcacaccgcactgacaggggccactgaaatccaaaactccggcgggacctcgatctttgcgggacacctgaagtgccggctcaaaatggacaagttagagctgaaaggtatgtcctacgccatgtgcctcaacacttttgtgctgaagaaggaggtatcggagacacagcacggcacgatccttataaaggtggagtacaaaggcgaggacgccccgtgcaagatcccattcagcactgaagacgggcaaggcaaagcgcacaacggtcgcttaatcactgctaaccccgtggtcaccaagaaggaggagccggtgaatatcgaggccgagcccccattcggggagtcgaacatcgtaatcggcatcggcgataaagccctcaagatcaactggtacaagaagggaagttccatcggcaagatgtttgaggcgacggcccgaggcgcccgccggatggccatcctcggcgatacggcttgggattttggcagcgtcgggggtgtgctgaactccctcggcaagatggtgcatcagatattcggaagtgcgtacaccgccctgttctccggcgtgagctggataatgaagattggcataggagtgctgctcacctggatcggcctgaactctaagaacacaagcatgtcattctcgtgcatcgtgatcgggatcattaccctgtacctcggcgcggtggtccaggccgacatggggtgcgtgatcaactggaaggggaaggagctgaaatgcgggtccgggatattcgtcaccaacgaggtgcacacctggacggaacaatacaagttccaggccgacagtcccaagagactagcgaccgccatcgccggagcctgggagaacggtgtgtgtggcatcaggtcaaccactcggatggagaacctcctgtggaagcagatcgccaacgagctcaactacatcctgtgggagaacaacatcaaactgacggtagtagtgggggacatcataggtgtcttagaacaagggaagcgcacgctgactcctcagccgatggaactgaagtacagctggaagacctgggggaaggcgaaaattgtcacagccgagacacagaactctagcttcatcatagacgggcccaacactcctgaatgccctagcgcgagccgcgcatggaacgtgtgggaagtcgaagattacggcttcggcgtcttcaccacaaatatctggctcaagctcagggaggtgtacacccagagctgtgaccatcggcttatgtcggcggctatcaaggacgagcgtgccgttcatgcagacatgggctactggatcgagagccagaaaaacgggtcatggaaactggagaaggccagctttatcgaggtcaagacctgcacctggccgaagtcccacaccctctggtcaaacggggtgttggagtccgacatgatcatccccaagtctctggctggccctattagtcagcataaccaccggccaggctaccatacgcaaacggcggggccctggcatctcggcaagctggagctagatttcaactactgcgagggtaccacggtcgtgatcacggaaaactgcggcacgcgcgggcccagcctccggaccaccacggtgtcggggaagctcatccatgagtggtgttgtcgcagctgcaccctgcccccactgcggtacatgggcgaggatggttgctggtacggaatggagattcgccccatcaacgagaaggaagagaacatggtcaagtccctggtgtctgccggctcagggaaagtggacaacttcacaatgggagtcctgtgcctcgccatcctgttcgaagaagtaatgcggggcaagttcggtaagaagcacatgatagccggggtgttgttcacgtttgtccttctactgtctggccaaatcacatggcgagatatggctcataccctcataatgattggctccaacgcttcggatcggatgggaatgggcgtgacgtatctggccctgatcgccaccttcaaaattcagcctttcctagccctgggattcttcctgcgcaagttaacaagtagagagaatctgctgcttggtgtaggtctcgcaatggccaccacattacagctacctgaggacatcgaacaaatggccaacggtattgcccttggcttgatgaccctgaaactgatcacgcagttcgagacctaccagttgtggaccgctctcgtgtccttgacctgcagcaacacgatatttaccctgactgtggcatggcgcaccgcgacgctcatattagccggcgtcagcctgttaccgctgtgccagagctccagcatgaggaaaaccgactggctgccaatgaccgtggctgcgatgggcgtgcctccccttccgctgttcatattttccctgaaagacaccccaaagcgtcgcagctggcccctcaacgagggggtgatggcagtggggctggtgtccatcctggcctcctccctcctacggaatgatgtccccatggcaggcccgctggtcgccggagggttactgatagcctgttatgtgattacgggtacgagcgccgacctgacagtcgagaaggccgccgacgttacatgggaggaggaggccgagcagacgggcgtttcccacaatctcatgatcaccgtcgacgacgacgggaccatgcgcatcaaggacgacgagaccgagaacatcctgactgtgttactcaagacagccctactgatcgtgagcggcatcttcccgtactccatccccgccacactcctggtctggcatacctggcaaaagcaaacgcaacggagtggcgtactgtgggacgtgccaagcccgcccgagacgcagaaggccgagttagaggagggggtctatcgcatcaagcagcaaggcatctttgggaagacccaggttggcgtgggggtccaaaaggagggcgtgttccacaccatgtggcacgttacccggggtgctgtcctgacgcataatgggaaacgtctggaaccaaactgggcgtctgtcaagaaggaccttatatcctacggcggtggctggcggctttccgcgcagtggcaaaagggggaagaagtgcaggtcatcgctgtggagcctggcaagaaccctaagaatttccagaccatgccaggcatattccagactaccacgggtgagatcggcgccatcgccctggacttcaagcccgggaccagtggctccccgatcataaatcgagagggaaaggtggtagggctgtatgggaacggggtagtgacaaagaacgggggttacgtcagcggcatagctcaaaccaatgcagaacccgacggacccacgcccgagctagaggaagagatgttcaagaagcggaacttaaccatcatggacctgcacccgggaagcggcaagacccggaagtacctccccgccatcgtgcgggaggctatcaaacgacggctgcgcaccctgattcttgcgcccaccagagtggtcgcggcagaaatggaggaggccttaaagggcctgccgatccgctatcagaccaccgccaccaagagcgagcacaccggccgggagattgtcgacctgatgtgccacgcgaccttcaccatgcgcctcctgtccccggttcgtgttcccaattacaacttagttatcatggacgaggcacactttacagatcctgcaagcatcgccgcaaggggctacatctccacgcgggtgggcatgggagaggccgcggctatcttcatgacagccacgccgccggggaccgcggaggctttcccccagagcaatgcccccatccaggacgaggaacgcgacatccctgaaagaagttggaacagcggcaacgagtggatcacggatttcgtaggtaagaccgtatggttcgtaccctccataaaggccggcaacgatatagccaactgcctgagaaagaacgggaagaaagtgatccagctgagtagaaagacgtttgacactgagtatcagaagaccagacttaacgactgggacttcgtggtgaccaccgatatttccgagatgggcgccaatttcaaggctgaccgagtaatcgatcccaggcgctgtctgaaacccgtgattctgaccgacggtcccgagagggttatccttgcaggtcccatgcccgtcacggctgccagcgccgcacagcgccggggccgcgttggccggaatccacaaaaggagaacgaccagtatattttcaccggccagcccctaaacaacgatgaggaccatgcccattggaccgaggccaagatgttactcgacaacatcaatactcctgaggggatcatcccggccctgttcgaaccggagcgcgaaaaatcagcagctatcgatggagaataccggctgaagggcgaaagccggaagactttcgtcgagttgatgcggagaggggacctccccgtgtggctggcgcataaggtggcctctgagggcatcaagtacaccgatcggaagtggtgcttcgatggggaaaggaacaaccagatactggaggagaatatggatgtagaaatatggaccaaggagggtgaacggaagaagctgcgcccgcgctggctggacgccagaacttattcggaccccctcgcgctgaaagagtttaaggatttcgccgcgggcaggaaaagtatcgctttggacctcgtaacagagatcgggcgggtgcctagccacctggcccaccgcacccgcaacgcgctggacaatctggtcatgctgcatacctctgagcatggagggcgcgcctatcggcatgcagtggaggagctaccggagaccatggaaaccctcctactgctcgggctgatgattctgctaaccggcggggccatgctgttcctgatctccgggaagggaattgggaagacctcgatcgggcttatttgcgtgatcgttagcagcggcatgctgtggatggccgacgtgcccttacaatggatcgcgtccgccatcgtgttagagttcttcatgatggtgctgcttatcccagaacccgaaaagcagcgtaccccgcaggacaatcaattagcctatgttgttatcgggatactgacccttgctgccatcgtagcggctaacgagatgggcctcctagagacgacaaagcgggacttaggaatgtccaaggagcccggggtagtgtcacccacaagctacttagacgtggacctgcaccctgcctccgcgtggaccctgtacgccgtggcgacaaccgtaatcaccccgatgctcaggcacacaattgagaatagcaccgcaaacgtctcccttgcagctatcgcaaatcaagccgttgtgctgatgggcctcgataagggttggcccatttcgaagatggacctgggcgtaccactgttagcactgggctgctactcccaggtgaaccccctgaccctcaccgccgccgtgctgcttctcgtaactcactacgccatcatcggcccgggtctgcaggccaaggccacacgggaggcgcagaagaggaccgcagctggtattatgaagaaccctaccgtggacggcatcatgaccatcgatctggatcctgtgatttacgatagtaagttcgagaagcaactcgggcaggtcatgctgctggttctctgcgccgttcaactgttgctgatgcgtacctcctgggccctgtgcgaagcccttaccctcgctaccggcccgatcaccacgctgtgggagggcagcccgggcaaattctggaacaccaccatcgcggtttcgatggccaacatcttccgcggcagctacctggccggggccggcctcgcgttttccatcatgaagtcagtcggcaccggtcgtcgcggcaccgggtcccagggcgaaactctgggcgagaagtggaagaaaaagttaaaccagctgtccaggaaagagttcgacctttataagaagtccggcatcaccgaagtggacagaaccgaagcgaaggaagggctaaagagaggcgagactacacaccacgccgtgtctcgaggcagcgccaagctccagtggttcgtggaacggaacatggtgattcccgaggggcgcgtaatcgacctggggtgtgggaggggagggtggtcctactattgtgctggccttaagaaggtcaccgaggtgcggggctacacgaagggcgggcccgggcacgaggagcccgtcccaatgagcacatacggctggaacattgtgaagttaatgtcaggtaaggacgtgttctatttgccacccgagaaatgcgacacgctgctatgcgacatcggcgaatcctcccctagcccgacagtcgaagagtcgcgcaccatacgtgtactcaagatggtggagccctggcttaggaacaatcagttctgcatcaaggtcctgaacccctacatgcccaccgtgatcgagcacctcgagcggctgcagcgcaaatatggtggaatgctggtaaggaacccgttgagtcgcaactccacccacgaaatgtactggatcagtaacggcaccgggaacatcgtctcctccgtcaacatggtgtcccggctgctacttaaccgcttcaccatgacccatcgccgcccgactattgaaaaagatgttgacctgggcgccgggacgcgtcacgtgaacgcagagcccgaaaccccgaatatggacgtaatcggcgagcgcatcaagcggatcaaggaggagcatagttccacgtggcactatgacgacgagaacccctacaagacgtgggcctaccacggcagctacgaggtgaaggccaccggaagcgcctccagcatgatcaacggggttgtcaagttgctgactaaaccctgggacgtggtgccgatggttacacagatggcgatgacggataccacaccattcggtcaacagcgcgtgttcaaggagaaggtggacaccagaacgccccgccccatgccaggcactcgcaaggtcatggagattaccgctgagtggctgtggcgcaccctgggtaggaacaagaagccgagattgtgcacgcgcgaggagttcaccaagaaggttcggactaacgccgccatgggggcggtcttcactgaggagaatcagtgggactccgcacgcgccgccgtcgaggacgaggagttctggaagctggtggaccgcgagcgcgaactccacaagctcgggaaatgcgggtcatgcgtgtataacatgatggggaaacgggagaagaaattaggagagttcgggaaagccaagggctccagggcgatttggtacatgtggctaggggccagatacctcgaatttgaggcgttagggttcttgaacgaggatcactggttttcacgcgaaaattcctactcaggggtcgaaggcgaagggttacacaagctgggatacatactccgcgacatctccaaaatccccggcggggccatgtatgccgacgacacggcgggctgggacacccgcatcaccgaggatgacctccataacgaggagaagattacccaacaaatggaccccgagcaccgacagctggccaacgccattttcaagctcacataccagaacaaggtggtgaaggtccagcgacccaccccgaaggggacagtgatggacatcatcagcagaaaggaccagcgcgggagcggccaggtagggacatacgggctaaacacctttactaatatggaggctcagcttgtccgccagatggaaggggaaggggtgctgtccaaggctgacctcgagaaccctcacttgctggagaaaaagatcacccaatggctcgagacgaaaggggtggagcgcttgaagaggatggccatttccggcgacgactgcgtcgtgaagcccatcgacgaccggtttgcaaacgccttgctcgcgttgaacgatatgggcaaggtccgaaaggatatcccccagtggcaaccaagcaaggggtggcacgactggcagcaggtccccttctgctcccatcacttccatgaactgatcatgaaagacggcagaaagttagtggtgccctgcaggccccaagacgaactgatcgggcgggccaggatcagccagggcgcggggtggtccttaaaggagacagcctgtctcggaaaagcctacgcccagatgtggtctctaatgtacttccaccggcgtgatcttagactagcctcaaacgcgatttgcagcgctgtgccggtccattggattccaacctcgagaaccacttggtccatccatgcccaccaccagtggatgactacggaggacatgctgacggtgtggaaccgggtctggatcgaggacaatccctggatggaggacaagacccctgtgaccacgtgggaggacgttccctaccttgggaaacgcgaggaccagtggtgcgggagtctcatcggcctgacttcacgggccacctgggcgcaaaacattctgaccgcaattcagcaagtacgcagcctcattggcgacgaagagttcctggactacatgccctctatgaagcgtttccgcaaggaggaggagagcgagggcgctatttggtga

SEQ ID NO: 25777 - RNA, 9873 nt, synthetic construct
  misc_feature 1..9873: note = derived and/or modified CDS sequence (opt11) from DENV-3__FJ639728__SS-prME
  source 1..9873: mol_type = other RNA
acatctctgtgcctgatgatgatgttaccagcaacactggcattccacctcacatcaagagatggggaaccgaggatgatagtcggcaaaaacgaacgaggaaaatccctcttgttcaaaactgcgagcgggatcaacatgtgcacattaattgcgatggaccttggcgaaatgtgcgatgatacggtcacctataaatgtccgctcatagccgaagttgaaccagaagacatagactgctggtgtaatctaacatccacctgggtaacttacgggacctgcaatcaggcaggagaacatcggagggacaaacgcagcgtcgcgctagcgccgcacgtcggaatgggactcgataccagaacgcaaacatggatgagtgcggagggggcctggcggcaagtagaaaaagtggagacctgggctttgcgtcatccgggtttcacgattctcgccctctttctggctcactatatcgggacctcgctgacacagaaagtagtaatcttcatactcctcatgcttgtgacaccgtccatgactatgcgctgcgtaggcgtcggcaaccgggattttgtggaaggactcagcggggccacctgggtggacgtggtacttgagcatggagggtgcgtaaccacaatggccaaaagcaaacccacgctagacatcgaactccagaagacggaagcaacacagctagccaccctaaggaaattatgtatagagggcaagataacgaacataacaaccgatagtaggtgcccaacccaaggtgaggcgacactcccggaagaacaagaccaaaactatgtttgcaagcacacatacgtagaccgagggtggggaaatggatgtgggcttttcgggaaaggatccctggtgacatgcgcgaagttccagtgcctggagccgatagaggggaaggtggttcaatacgaaaacttaaagtacacggtgataatcactgtacacaccggagaccagcatcaagtaggcaacgatacacagggggtcacggtcgaaatcacaccccaagccagcaccgtcgaggcagtactcccagaatacggtactctggggctagagtgttcccctcgcacgggattggatttcaacgaaatgatcctgctcacaatgaaaaacaaggcctggatggtacaccgacaatggttcttcgatctaccgctgccctggacgagcggagcaacaaccgagaccccaacatggaatagaaaggaactattagtaacctttaaaaacgcccatgctaagaagcaggaggtagtggtgctcgggtcacaggaaggcgctatgcataccgcactcacaggagctactgaaatacaaaacagcggcggaacaagcatcttcgccggacacctaaaatgccggctgaaaatggacaagctagaactgaaaggaatgtcgtatgccatgtgcctgaacacgtttgtccttaagaaggaagtaagcgaaactcaacatggcacaatactaataaaagttgaatacaagggcgaagatgcaccctgcaagatcccgttttcaacagaagatggacaaggaaaagcgcacaatggcagactaatcacagcgaaccccgtggtaacaaagaaggaagaacccgtaaacatcgaggctgagccacctttcggcgaatccaacattgtcataggaattggcgacaaggccctgaaaattaactggtataagaaaggcagctcaattgggaaaatgttcgaagcaactgcgagaggtgcgaggcggatggcaatcctcggcgacacggcctgggacttcggatccgtcggaggagtacttaactccctcggaaagatggtacaccaaattttcggatcagcgtacaccgcactattctccggagtatcatggataatgaagataggaattggagtactcctaacttggattgggctaaactcaaagaacacgagcatgagtttcagctgcatcgtcataggtataattacgctataccttggcgcagtcgtacaagcggacatgggatgcgttatcaattggaaagggaaggagctaaaatgcgggagtggcatattcgttacgaacgaagtccacacttggacggaacaatacaaatttcaagcggattcacccaagcgactcgcaactgccatcgcgggagcctgggagaacggggtttgcgggattagatcaacaacaaggatggaaaacctcttgtggaaacaaatcgcaaacgagctaaactatatcctttgggagaataacatcaaattgaccgtcgtcgtcggagacatcatcggggtactggagcaaggtaaacgaactctcacaccccaaccgatggaactaaaatacagttggaaaacatggggcaaagccaaaatcgtgacggcagaaacacaaaacagctcttttataatagacggtcctaacactcctgagtgcccaagcgcgctcagggcgtggaacgtctgggaagtcgaggactacggcttcggcgttttcaccaccaacatatggctaaaactacgggaagtatacacccaatcatgcgaccaccgacttatgagcgccgcgatcaaagacgaaagagcagtccacgctgacatgggatattggatagaatctcagaaaaacggctcatggaaactagagaaggcttcgtttatagaagtcaaaacatgcacctggcctaaatcacacaccctgtggagcaacggcgtccttgagtcggacatgatcataccgaaaagccttgcggggccaatctcacagcacaaccatcggcccggataccacacgcagacagctggcccgtggcacttaggaaaactcgaattagactttaactactgcgaggggacgacggtcgtcattaccgagaactgtgggacgcgcggaccgagccttaggacgaccaccgtgtccggaaaactcatacacgaatggtgctgccgaagctgcacactacccccactacggtatatgggcgaagacggatgctggtacggaatggaaatacgacccatcaatgaaaaggaagagaatatggtcaaaagcctggtctccgcaggttctggcaaggtcgataactttacgatgggcgtgctgtgcctggctatactgttcgaagaagtcatgagggggaaattcgggaagaaacatatgatagcaggagtcctatttacattcgtattgcttttaagcggccagataacctggcgcgacatggcccacacgttaataatgataggcagcaacgcatccgaccgcatgggcatgggcgtaacctacctagcgcttatcgcgaccttcaagatacagccctttcttgctctcgggttcttccttagaaagctcaccagccgcgaaaacctgctactaggagtcggactggcgatggcgactaccttgcaactgccggaagatatcgaacagatggccaacggaatagccttgggcttaatgacactaaaactgataacccaatttgagacatatcagttgtggacggcgctcgtatcgctgacatgcagcaacacgatcttcacgcttaccgtcgcgtggcgcacagcgacgcttatactagcaggagtgtcactgctaccgctctgccagtccagctcaatgcgcaagacagactggctcccaatgacagtcgcggctatgggggtaccgcccctacccctcttcatcttctccctgaaagacacacccaaaaggaggtcctggccgctaaacgagggagtgatggccgtggggctcgtaagcatactagccagttcactactccgtaacgacgtgccaatggccgggccacttgtcgcaggaggcctcctgattgcatgctatgttatcacaggcacgagcgctgatctcactgttgaaaaggcagcagacgtcacctgggaggaggaagctgaacaaaccggggtctcacacaacctgatgataacggttgacgacgatggtaccatgaggatcaaagacgatgaaacagaaaacatcctaacggtgctcctcaaaacagccctacttattgttagtggcatctttccatactccatccctgcaacgttactcgtctggcacacttggcaaaagcaaacacagaggagcggcgtcctatgggacgtgccaagtcccccagagacgcagaaggccgaactggaagagggggtataccgaatcaaacagcaaggaatcttcgggaaaacgcaagtaggtgtgggagtgcagaaggaaggtgtcttccacacaatgtggcacgtaacacggggagccgtacttacgcataacgggaagaggctagagcccaactgggcatccgtgaagaaagacctcatctcctacggaggaggatggaggctctccgcgcagtggcaaaagggggaagaagttcaggtgatcgcagtagaacccggaaagaacccgaagaacttccagaccatgcccgggatcttccaaacaactacaggagagatcggggccattgcccttgactttaagcctggtacaagcggcagcccgataattaatcgagagggcaaagtggtggggctctacggaaatggagttgtaaccaaaaacggcgggtacgtcagtggtatagcgcaaaccaacgccgaaccagacggacccaccccagaattggaagaggaaatgttcaagaaacgcaacctgacgataatggacctacaccctgggagcgggaaaaccaggaagtacctccccgctattgttcgcgaagccataaaaagacgactcaggacgctgattttggcgccaactcgagttgtagcagccgagatggaagaggctctgaaagggctcccgatacgttaccaaacaactgcaacgaaaagcgaacacactgggcgcgagatcgtggacctcatgtgtcacgccacattcaccatgagactcctatcccctgtgcgggtccccaactataacttagtaataatggatgaggctcattttacagaccctgcgagcatagctgcgcgaggatacatatcgacccgagtcggcatgggagaggcggcagcaattttcatgacggcaacaccaccaggaactgccgaagccttcccacagagcaacgcaccaatccaagatgaagaacgtgacatccccgagcggtcgtggaactctggaaacgaatggatcacggacttcgtgggaaagactgtctggtttgtcccctctatcaaggccggcaacgatatcgccaactgtctaaggaaaaatgggaagaaagtgatacaactcagccggaaaaccttcgacacggagtaccagaagacccgacttaatgattgggacttcgtcgtaacgacagacatttcagagatgggagccaacttcaaagcagatagggtgatagacccgcgtcgctgcttaaaaccagtgatactaacggacggacccgaacgcgtcatactagcggggcccatgccggtgacagcggccagcgccgcacagaggcgagggagagttggccggaatccgcaaaaggagaacgaccaatacatcttcacgggccagcccctaaacaacgacgaagatcacgcacactggacggaagcaaagatgctgctcgacaatattaatacgcctgaggggataataccggccttattcgagccagagagggaaaagtccgccgcgatcgacggcgagtaccgactcaagggagaatcgcgcaagacgtttgtagagctaatgagacgcggcgacctaccagtatggctagcacacaaagtcgcgtccgagggtatcaaatacacagaccggaagtggtgcttcgacggagaacgcaataatcagatcttagaagagaacatggatgtagaaatatggacaaaggaaggcgaacgaaagaaattaagaccaaggtggctagatgcaaggacatatagcgacccgctcgctctaaaagaatttaaggacttcgccgccggacgtaaaagtatagcattagacctagtgactgaaatagggcgtgtaccaagccacctagcacacaggacgcgaaacgctctcgacaatctggtcatgctccacacgtcggaacacggaggccgagcctatagacacgccgtcgaggaacttcccgagactatggaaaccctcctgcttctcgggttgatgatcctgctaacgggaggcgccatgttattcctcatttccgggaaagggatcggaaaaacgagtataggactcatctgcgtcatagtcagcagcggaatgctatggatggcggacgtgcccctccaatggatagcctcagcgattgtcctagagttcttcatgatggtacttctaatccctgaacccgaaaaacaacgcacaccacaagacaatcaactagcctacgtagtcattggaatactcacgttagcggcgatagtggcagccaacgagatgggattactagaaacaaccaaacgggacttaggtatgagcaaagagcccggcgtcgtctcgcccacctcctacttggacgtagatctacaccccgccagtgcatggactctatacgcagttgccaccacggtaataactccgatgctaagacacacaatagagaacagtactgcaaacgtaagcctcgccgctatagcaaaccaagcggtcgtcttaatgggactggataagggctggccaataagtaaaatggacttaggcgtgcccttacttgccttggggtgttacagccaggtaaatccgctaacactcaccgcggcggtgcttctgcttgtaacccactacgcaataatcggccccgggttacaagcaaaggcgaccagagaagcacagaagcgcacagctgccgggatcatgaaaaatcccacggtcgatggcattatgaccatcgatctagatcccgtgatatacgacagcaaattcgagaaacagctcgggcaagtcatgcttctcgttctctgtgcggttcagctactgttaatgaggacatcatgggccctatgtgaagcgctcaccctcgcgacggggccaataacaacgctgtgggagggatctcccggcaaattctggaatacgacgatcgcagtgtcgatggccaacatattccgcggatcgtacctagcgggagcgggactggcgttcagcataatgaaaagcgtggggacagggcgtcggggaaccggctcgcagggcgagacattaggtgaaaaatggaagaaaaagctaaaccagctcagcagaaaggagttcgacctctacaaaaagagtgggatcacagaagtagaccgcacggaagcgaaagaaggtctaaaaaggggagagacgacccaccatgcagtaagtagagggtccgccaaattacaatggttcgtagagcgaaacatggtaatccccgagggaagagttatcgatctcggatgcggtagagggggatggtcttattactgcgcaggcctcaagaaagtaacggaagtccgagggtacaccaagggcggaccgggccacgaggagccggtcccgatgtcgacgtatgggtggaatatcgtaaagctaatgagcggtaaagacgtgttctatctaccacccgagaagtgcgatacgttattatgcgatataggtgaaagctcgccgtctcccacggtagaagagtcgcgcacaatccgggtcctaaaaatggtagaaccctggctacgcaacaaccaattctgtatcaaagtactaaacccgtacatgcctactgtaatagagcacctagagcgcctacaacgaaagtacggagggatgctcgtccgtaacccgctatccaggaactcgacccacgaaatgtactggattagtaacgggacaggtaacatcgtgagcagtgttaacatggtatcacgactattgctgaaccgattcacgatgacacaccgacgcccgacgatagagaaggacgtggacctgggagcgggtacacgccacgtgaacgcggaacccgagacgccaaatatggacgtaatcggggaacgaataaaacgaatcaaggaagaacactcctcaacgtggcactacgacgatgaaaatccatacaaaacctgggcctaccacggcagctacgaggtcaaagccacgggatccgcatccagtatgatcaacggagtcgttaaattgctcacaaagccatgggatgtcgtacccatggtcacacagatggccatgaccgatacaacaccgttcggtcagcaaagggtatttaaagaaaaagttgacacacggaccccgcgcccaatgccgggaacaagaaaggttatggaaataacagccgagtggctctggcgcacgctcggccggaataagaaaccgaggctctgtacccgggaggagttcaccaagaaagtgcgcacgaatgccgccatgggggctgtattcaccgaagaaaatcaatgggacagcgcgcgagcggcggtggaagacgaggagttttggaagctagtggatcgggaacgagaactccataagctaggcaaatgtggaagctgcgtatataacatgatgggtaagagggagaagaaactaggagaatttggcaaagcaaaagggtccagggcaatctggtacatgtggctgggggcacgatacctggagttcgaagccctcggcttcctaaacgaagatcactggttttcgcgggaaaattcctactcgggtgtcgaaggcgaagggctgcataaactcggttatatcctgagggacatcagcaagattccaggtggggccatgtacgcagacgacactgccggttgggacacgaggatcacggaggacgatctacacaacgaggaaaagatcacccaacagatggaccccgaacaccgacaactcgcaaacgcaatcttcaaactcacctaccaaaacaaggtagtaaaggtgcaaagacctacacctaaaggaaccgtgatggacataatatcacgaaaggaccaacgagggtcgggccaagtcggaacttacggccttaacacgtttactaatatggaagcacaactggtacgccaaatggaaggagaaggcgtactttcgaaagccgacctagagaacccccatctgctggaaaagaaaataacgcagtggttagagaccaagggggtggagagactgaagaggatggcgatatcaggtgacgactgcgtcgtcaagcccatagacgaccgcttcgcaaacgcgctcctagccctgaacgacatggggaaagtaagaaaagacatcccgcagtggcaaccatcaaaaggctggcacgactggcaacaagtgcccttctgttcacaccacttccacgaactgataatgaaggacggccgtaaactcgtagtaccctgcagaccgcaagacgaactaataggcagggcccgaatctcccaaggcgcagggtggtcactgaaagaaacggcctgcttaggcaaagcctacgctcaaatgtggtcactcatgtacttccacaggcgagacctacgtctagccagcaacgcaatttgttctgcagtgccagtacactggataccgacatcaagaaccacgtggagcattcatgcccaccatcaatggatgaccactgaggatatgctaactgtctggaacagagtatggatagaagacaacccgtggatggaagacaagacacctgtgacaacatgggaagatgtgccatatctaggaaaacgcgaggatcagtggtgcggcagtctcatcggcctcaccagcagagcaacctgggcccaaaacattttgacggcaatccaacaggtcagaagtctcatcggggatgaggagttcctagactatatgccctcaatgaagcgctttagaaaggaagaggaatccgagggggccatctggtag

SEQ ID NO: 25778 - RNA, 9873 nt, synthetic construct
  misc_feature 1..9873: note = derived and/or modified CDS sequence (opt11) from DENV-3__FJ639729__SS-prME
  source 1..9873: mol_type = other RNA
accagcttatgcctcatgatgatgctgcccgccaccctggccttccacctcacgtcgagagacggcgagccccggatgattgtgggaaagaatgagcgcgggaagagcttgctgttcaagacagcgagcggtataaatatgtgcaccctcatcgccatggatctgggcgaaatgtgcgacgacacggttacctacaagtgccccctgatcgccgaggtggagccggaagatatcgattgctggtgcaatctcacatcgacctgggtcacctacggaacgtgcaaccaggccggtgagcatcgtagggacaagcggagtgtcgccctggcgccccacgtgggcatgggactggacactcgcacccagacctggatgagcgcagaaggcgcctggcgtcaggtggagaaggtcgaaacgtgggccctccggcacccgggattcaccatcctggccctgtttcttgcccactacataggaacttccttaacacagaaggtggtcatcttcatcctgctcatgctggtcacacccagcatgaccatgcggtgcgttggggtaggcaaccgcgacttcgtcgaaggattgtcaggagccacctgggtagatgtggttctggagcacggcggttgtgtgactacaatggccaagagcaaacccactctggatatcgagctgcagaagaccgaggccacgcagctcgcgacgctgcggaagttgtgtatcgagggcaagattaccaacattaccacggacagtcgctgccccacacaaggcgaggcgaccctcccggaggagcaagaccagaattatgtgtgcaagcacacctacgtggacagagggtggggtaacggatgtgggttgtttgggaaaggcagcctcgtgacatgcgccaagttccagtgcctcgagcccatcgagggaaaggtggtccagtacgagaacctgaaatacaccgttatcatcactgtgcacaccggggaccaacatcaagtaggcaacgacacccaaggcgtgacggtcgagatcactccccaagcatcgaccgtggaggccgtcctccccgagtacggcacactcgggctagagtgcagcccgcgcaccggcctggactttaacgagatgatactcttaacgatgaagaataaggcatggatggtccaccggcagtggttcttcgacctgcctctcccctggacttcgggtgccatcaccgagacccccacttggaaccgtaaggagctactcgtaacgttcaagaatgcccacgccaagaagcaggaagttgtcgtgcttggttctcaagagggcgccatgcacaccgcactgactggggccacggagatacagaactccggcgggaccagcatctttgccggccacttgaagtgtcggcttaagatggataagctggagttaaaggggatgtcctacgctatgtgtcttaacacgtttgtcctgaagaaggaagtcagcgagacgcagcacgggacgatcttaataaaggtggagtataaaggcgaggacgccccctgcaagatccccttctcgactgaggacgggcagggcaaggcgcacaacggccgcctgattaccgcgaaccccgtcgtcactaagaaagaagaacccgtcaatatcgaggccgagccgcccttcggggagtccaacatagttatcggcattggggataaggcgttaaagataaactggtacaagaagggcagctccatcgggaagatgttcgaggcaacggcccggggcgcccggcggatggccatcctgggggacacagcctgggacttcggaagcgtcggcggggtgctgaactccctcggcaagatggtgcatcagatcttcgggagcgcgtacacagccctgttctccggggtcagctggatcatgaaaattggcatcggggtgctgttaacttggatcggactgaactccaagaacacgagcatgtccttcagctgcatcgttatcgggattatcacattatacctcggtgctgtcgtgcaagccgacatgggctgtgttattaactggaagggtaaagagcttaaatgtgggtcagggatcttcgtgaccaacgaggtgcacacctggacggagcagtacaaattccaggccgacagtcccaagcgcctagcaacggccatcgccggggcctgggagaacggggtgtgtggcatcagatcgacgacccggatggagaatctactgtggaaacagatcgccaacgagctgaactacatcctgtgggaaaacaacatcaagctgacggtcgtggtgggagatatcatcggcgtactggagcagggcaaacgcactctgacgccccagccaatggagctgaaatacagctggaagacctgggggaaggctaagatcgtgacggccgagactcagaacagcagcttcatcattgacggtcccaacaccccggagtgcccatccgccagccgtgcatggaacgtttgggaggtggaggactacgggttcggtgtgttcaccacgaacatctggctgaagcttagggaggtgtacacccagagttgcgaccaccgactgatgtcagcggcgataaaggacgagcgcgcggtgcatgctgacatgggatactggatcgagagccagaaaaatggctcgtggaagctggagaaagcatcattcatcgaggtgaaaacctgcacctggccgaagtctcacacactctggagcaatggcgtgctggagagtgacatgatcatccccaagagtctggcgggccccatctcacagcacaaccaccggccgggataccacactcagaccgctgggccatggcacctcggcaagctggagctggacttcaactactgcgagggcaccactgtcgtcatcacggagaactgcggtacccgcggacccagcctcagaaccaccacggtgagcgggaagctgatccacgaatggtgctgtcgcagctgcaccctgcccccactccgctacatgggtgaggatgggtgctggtacggcatggagatccggccaatcaatgagaaggaggagaacatggtcaaatcattagtgagcgccggatctgggaaggtagataacttcaccatgggcgtgctgtgccttgccatcctgtttgaagaggtgatgagagggaaattcggcaagaagcacatgatcgctggggttcttttcacctttgtcctgctgctgagcggccagatcacgtggcgcgacatggctcacaccctcatcatgatcggctccaacgccagtgatcggatggggatgggagtgacctatctggccctgattgccacctttaaaatccagccattcctcgccctgggtttcttcctgcgcaagctcaccagcagggagaacttactgctcggcgtaggcctagctatggccaccaccttacaactccccgaggacatcgaacagatggcaaacgggatcgccctaggcctgatgaccctcaagctcatcacccagttcgagacctaccagctgtggaccgcactcgtttccctgacctgtagtaacacgatcttcaccctgaccgtcgcgtggcgcaccgccacgctcatactggccggggtctccctcttgccgctttgccagagctcctctatgcgaaagaccgattggctgcccatgaccgtggccgcgatgggcgtgccgccactgccactgttcatcttcagtctgaaagacacccccaagcgccgcagctggcccctcaacgagggggtcatggccgtcggcctggtctccatcttggctagctcactcttaaggaacgacgttcctatggccggcccgctggtggccggggggttactgattgcttgttacgtgatcacgggtactagcgctgacctgacggtcgagaaggcagccgatgtgacttgggaggaggaagcggagcagacgggcgtctcccacaacctcatgatcactgtcgacgacgacggcactatgcgcataaaggatgacgaaaccgagaacatcctgaccgtgctgctcaagacggcgctgctaatcgtgagcgggatcttcccctacagcatccccgctacccttctggtttggcacacctggcaaaaacagacccagcgtagcggggtgctttgggacgtgccctccccgccggagacgcagaaggcagagctcgaggagggagtttaccgtatcaagcagcagggcatatttgggaagacccaggtgggcgttggggtccagaaagagggggtgttccacacaatgtggcacgtgacccgaggcgccgtcttgacgcacaacggcaagaggctggagcctaactgggcaagcgtgaagaaggaccttatctcatatggcgggggctggcggctgagcgcgcagtggcaaaagggcgaggaggttcaggtcatcgccgtggaaccgggcaagaacccaaagaactttcaaaccatgccgggcattttccagaccaccactggagagatcggcgccatagccctggactttaagcccgggacatcgggatccccgatcatcaaccgcgaggggaaagttgtcgggctttatggtaacggagtggtgaccaagaacggcgggtatgtcagtggcatcgcgcagaccaacgccgagcccgacggccccacccccgagttagaggaagagatgtttaagaagaggaacctgacaataatggacttacacccggggtcgggcaagaccaggaagtatctccccgccatagtgagggaggccatcaagcgccggctgcgcaccctcattctcgcccccacgcgggtggtggcggcggagatggaagaggcgctgaaggggctacccattcgctaccagaccacagcgaccaagtcagaacacacgggcagggagatagtggatctcatgtgccatgctaccttcacgatgcgcctgctgtcgcccgtccgggtccccaattacaacctggtgattatggacgaggctcactttaccgaccccgccagcatcgccgcccgcggatacatatccacgcgggtgggtatgggggaagccgcggccatcttcatgactgccacgccgcccgggaccgccgaggcgtttccacagagcaacgccccaatccaagacgaggagcgcgacatccccgagcgatcctggaatagcggcaacgagtggataacggactttgtcggcaagaccgtgtggttcgtgccctccatcaaggccggcaacgacatcgctaattgccttcggaagaacgggaagaaggtcatacagctaagccgcaaaaccttcgacacggaataccagaagacccgcctcaacgactgggattttgtcgtgacaaccgatatctccgagatgggcgcaaatttcaaggccgatcgcgtcattgaccccaggcgctgcctgaaacccgtgatcttaacagacggccctgagagggtgatcttggcggggccgatgcctgtcacagccgcatcggccgcgcaaagacgaggccgcgtggggcggaacccccagaaggagaatgaccagtacatcttcaccggccagccactcaacaacgacgaggatcacgcccactggacagaagccaagatgttgctcgacaacatcaacacacctgaaggcattatccccgccctgttcgagcccgagcgcgagaaatctgccgcgatcgacggcgagtaccgactgaagggcgagagtcgcaagaccttcgtcgagctcatgcgacgcggagacttacccgtgtggctggcccacaaggtagcctccgagggcattaaatatacggatcggaagtggtgcttcgacggggagcgaaacaaccagatcctagaagagaacatggacgtcgagatatggaccaaagaaggcgagcggaagaagttgcgcccgcggtggctggacgcccgtacttacagcgaccccctcgcgctgaaggagtttaaggacttcgccgccggacgtaagagtatcgcgctagacctcgtgaccgaaatcggacgagtgccgagccacctcgcgcacaggacgcggaatgcgttggacaatctcgtcatgctacataccagcgaacacggcgggcgcgcgtatcggcatgccgtggaggaattgccggagacgatggaaaccctcctcttactcggactgatgatcctgctcaccggcggagcgatgctgttcctgatttccggtaaagggatcggcaagaccagcatagggctcatctgcgtgatagtctccagcggtatgctttggatggcggacgtgccattgcaatggatcgcatccgccatagtcttggagtttttcatgatggtcttgctgatacccgagcccgaaaaacagagaactccccaggacaaccagttggcctatgtggtgatcggcatcttgaccttggccgcgatcgtcgcagccaacgagatgggactcctggagacgactaagcgggatttaggcatgagcaaggagcccggggtagtgtcgcccaccagctacttagacgtcgacctgcaccccgcatccgcctggaccctgtacgctgtggcgacgacagtaatcacaccgatgctccgccacacgatcgaaaattcaacggccaacgtttccctggctgccatagcaaaccaggcggtggtgttgatgggactcgacaaggggtggcccattagcaaaatggacctgggcgttcccttgttggccctagggtgctacagtcaggtgaaccccctgacgctcacagccgccgtgctgctgctcgtcacccattacgcgataataggaccggggctgcaggccaaggctacgagggaggcacaaaagcgcaccgccgcgggcatcatgaagaaccctaccgtagacggcatcatgacgatcgatttggaccccgtcatctacgatagcaagtttgagaagcagttgggccaggtcatgctgctggtgctctgcgctgtacagctcctgctcatgcggacgtcctgggccctgtgtgaggctctgacccttgccaccggcccgatcaccacgctttgggagggcagcccagggaagttctggaacacaaccatcgcggtatccatggcgaacatattccgcggcagttatctggccggagccggcttagcgttctccatcatgaagtccgtgggaaccggccggcgtggtactggcagccagggtgagaccctaggggagaagtggaagaagaagctgaaccagctctcccggaaggagttcgacctgtacaagaaatccggcatcaccgaggtggaccgaaccgaggccaaggaggggctgaagcggggggagacgacgcaccacgctgtctcccgcggctctgcgaagcttcagtggttcgttgagcggaatatggtgatccccgaggggcgcgtcatcgacctaggctgcgggaggggcgggtggtcctattactgcgcgggtctcaagaaggtgaccgaggtaagaggctataccaagggcggccccgggcacgaagagcccgtcccaatgagcacctatggctggaacatcgtgaagctaatgtccggaaaagacgtgttctacctgccgcccgaaaagtgcgacactctgctgtgcgacatcggcgaatccagccccagcccgaccgtagaagagtcccgcaccatccgggtgcttaagatggtcgagccctggctgaggaataaccagttttgtatcaaagtcctcaacccctacatgccgaccgtaatcgagcacctcgagcggctgcaacgaaagtacggagggatgctggtgcggaacccactcagccgcaattccacgcacgagatgtactggatctcaaatggcaccgggaacatcgtaagcagcgtgaacatggtctcccgcctcctgctcaaccgcttcaccatgacccatcggcggcccacgatcgaaaaagatgtggacctgggcgcgggcacccggcacgtgaacgccgagcccgagaccccgaacatggacgtcataggcgagcgcatcaagcggatcaaggaggagcacagctccacctggcactatgacgacgagaacccctataagacgtgggcttaccacggaagctacgaggtcaaggctactggttcagcctcgagcatgatcaacggcgtggtcaaattactcacgaagccttgggacgtggtgcccatggtcactcagatggctatgacggacaccaccccattcgggcagcagcgcgtgttcaaggagaaggtggacacccggacgcctcgccccatgcccggcacccggaaggtgatggagataaccgctgagtggttgtggcgcaccctgggccgtaacaagaagccgcgcctctgtacccgcgaggagttcactaagaaggtgaggaccaacgcagccatgggcgccgtgttcactgaagaaaaccagtgggactccgcgcgtgccgcggtcgaggacgaagaattctggaagctggtggaccgggagcgcgagctgcataagttaggcaagtgcgggagctgcgtgtacaacatgatgggcaagcgcgagaagaagctgggggagttcggcaaggccaagggctccagggcgatctggtatatgtggctaggggcaagatacttagagttcgaagcgctgggtttcctgaatgaggaccattggttcagccgtgagaactcctatagtggtgtcgaaggcgaggggcttcacaagttaggatacatcctgcgagatatctccaaaatcccgggcggagccatgtacgccgacgacacggcgggctgggacactcgcatcacggaagacgacctccacaacgaggagaaaatcacccagcagatggaccccgagcatcggcaactggcgaacgccatctttaagctgacgtaccagaacaaagtggtcaaggtacagcgccccactccgaaagggaccgtgatggacatcattagcagaaaggaccagcgcggcagcggccaggtgggcacctatggcctcaacaccttcacgaacatggaagcccagttagttcggcagatggagggggaaggcgtactgtctaaggccgatctcgaaaacccccatctcttagagaaaaagataacccaatggctcgagaccaaaggggtggagagactgaagcggatggctatcagcggcgacgactgcgtggttaagcctatcgatgaccgctttgccaacgccctgctagccctgaacgacatgggaaaagtgaggaaggacatcccccagtggcagccgagcaagggctggcacgattggcaacaggttcccttctgctcccaccatttccacgagctaatcatgaaggacggcaggaaactggtcgtgccctgccgtccacaggatgagctgattggaagggcgaggatctctcagggcgcggggtggtctctgaaggagactgcgtgcctcggcaaagcctacgcccagatgtggaacctgatgtacttccaccggcgcgatctgcggcttgccagcaatgctatctgcagtgccgtcccagtgcactggatcccgacatcgcgtaccacctggagcattcacgcccatcaccagtggatgacgacggaggatatgctcacagtttggaaccgggtctggattgaggataatccctggatggaggacaagaccccggtgacaacgtgggaagacgttccgtacttgggcaagcgcgaggaccagtggtgcggatccctcataggtttaacctcacgagccacctgggcacagaacatcctgaccgctatccagcaagtccgctccttaatcggggacgaggagtttctggactacatgcccagcatgaagcgtttcagaaaggaggaggagtccgagggcgccatctggtga

SEQ ID NO: 25779 - RNA, 9873 nt, synthetic construct
  misc_feature 1..9873: note = derived and/or modified CDS sequence (opt11) from DENV-3__FJ639730__SS-prME
  source 1..9873: mol_type = other RNA
acgagcctgtgcctcatgatgatgcttccagcgaccctggccttccacctcaccagccgggacggcgagccacggatgatcgtggggaagaacgagaggggcaaaagcctgctgttcaagaccgcatcaggcatcaacatgtgcacactgatcgctatggacctaggcgagatgtgcgacgataccgtaacctacaagtgtccgttaatcgcagaggtggagcccgaggacatcgattgctggtgcaatctcaccagcacatgggtaacctacgggacttgcaatcaggccggcgaacacagacgcgacaagagatccgtggcactggcgccccacgtgggaatggggctagacacacgcacccagacctggatgtcggctgagggcgcctggcgccaagtagagaaagtagagacttgggccctccgccacccggggttcactatcctggctctgttcctagcccactatattggcacatctctgacgcaaaaggtagtaatcttcatactgctgatgctggtgacgccctcaatgaccatgcggtgcgtgggggtgggcaatcgcgacttcgtggagggcctgtccggggccacttgggtggacgtggtcttagaacacggcgggtgcgtaaccacgatggccaaaagtaagcccactctggacattgagctccagaagaccgaggccacccaactcgccacactgcgtaaactgtgcatcgagggtaaaatcaccaacatcacgaccgactcgcgctgtcccacgcaaggagaggccactctcccagaggagcaggaccagaattacgtgtgcaagcacacatacgtcgaccgggggtggggcaacgggtgcggactattcggtaagggaagccttgtgacctgcgccaagttccagtgtttggagcccattgagggcaaggtcgttcaatatgagaatctgaagtacacggtgatcataaccgtgcataccggagaccagcaccaggtgggcaatgacacccagggggtgacggtcgaaatcacgccgcaggccagcacggtggaagcggtgctgccggaatacgggacccttgggctggagtgctccccacgcaccgggctggatttcaacgagatgatactcctgacgatgaaaaacaaggcgtggatggtccaccggcagtggttctttgacctacccctcccctggacctccggcgccaccaccgagacccccacctggaatcgcaaggaattgctggtgacctttaagaacgcccatgctaagaaacaggaggtggtcgtgctcggttcacaggagggcgccatgcacactgccctgacgggtgccaccgagatccagaattccggcggcaccagcatcttcgccggacacctgaagtgcaggctaaagatggacaaactggaactgaagggcatgagttatgccatgtgcctcaacacgttcgtgctgaagaaggaggtctcggagacgcagcatgggaccatcctcatcaaggtggagtacaaaggcgaggacgcaccgtgcaagatacccttcagtaccgaggacgggcagggcaaggcgcacaacggccgcttaatcaccgccaatcccgtggtcacgaagaaggaggagcccgtgaacatcgaggccgagccgcccttcggggagagtaacattgtaatcggtatcggggataaggccctcaagatcaactggtacaagaagggatcctcgatcgggaaaatgttcgaagctacagcccggggtgcgcgcaggatggccatcctaggcgacactgcgtgggacttcggaagcgtaggcggcgtcctgaacagtctcggcaagatggtccaccagatctttgggagcgcatatacagccctattctctggggttagctggataatgaagatcggcatcggggtgctgctcacgtggattggcctgaacagtaagaacaccagcatgtcctttagctgcatagtgatcgggatcatcacgctgtacctcggcgcggtcgtccaggccgacatggggtgcgccatcaattggaagggcaaggaactgaagtgcgggtccgggatattcgtaactaacgaggtgcacacatggaccgagcagtacaagttccaggcggactcacccaagcgactggccacggccatcgccggcgcctgggagaacggggtgtgcggcatccggagtacaacgcgcatggaaaacctcctgtggaaacagatcgccaacgaactgaactacatattgtgggaaaacaacattaaacttaccgtagtggtgggcgacatcatcggtgtgctggagcagggcaagcgcaccctcaccccgcagccgatggagctgaagtatagctggaaaacgtggggcaaggccaaaatcgtcactgccgagacccagaactccagcttcattatagacggccctaacacacccgaatgcccatccgcaagcagagcgtggaacgtgtgggaagtggaggactacgggttcggcgtattcaccactaacatttggttgaaactccgcgaggtgtatacccagtcctgtgaccacagactgatgtccgccgccataaaggacgagaaagctgtacacgccgacatgggatattggattgaaagtcagaagaacgggtcctggaaactggagaaggcgtcattcatcgaagtaaagacctgcacctggccgaaatcacacaccctctggagcaatggcgtgctggaatccgacatgatcatcccaaagtcgttagccggtcccatttcccagcacaatcaccgcccgggttatcacacccagaccgccgggccctggcacctaggcaagctcgagctggactttaactattgcgagggcactacagtggtaatcactgagaactgcggaacccgcggccccagcctcaggaccacgacagtttctgggaagctgatccacgagtggtgctgccggagctgcaccctgcctccccttcgctacatgggcgaggatggttgctggtacggcatggagatccggcctatcaatgaaaaggaagagaacatggtgaagtctttagtcagcgccggcagcgggaaggtggacaacttcaccatgggcgtcctgtgcctcgccatcttgtttgaggaagtcatgcgcggaaagtttggcaagaagcacatgatcgcgggggtgctcttcacgttcgttctgctgttatccggacagatcacctggcgtgacatggcccacacattgatcatgattggctcgaacgccagcgaccgaatgggcatgggcgttacctacttagccctgatcgctacctttaaaatccagcctttcctggcgctggggttcttcctgcggaagttaacttctcgggagaatctgttgctcggcgtgggcctcgccatggcaacaaccctgcagcttccggaagatatcgagcagatggctaacggaatcgcgcttggtctgatgacactcaaactcatcacccagtttgagacctaccagctttggaccgccctcgtctcccttacatgcagcaacaccatctttaccctgaccgtcgcctggcggactgccaccctaatactcgcgggggtttcattgcttcctctgtgccagagctccagcatgcgaaagaccgactggctgcccatgaccgtcgcagccatgggtgtgccccccctgccgctgtttatcttctccctgaaggacacgcctaagcggcgctcatggcccttgaacgagggggtcatggccgtgggcctggtgtccatcctggcctcttccctcctgcgcaatgacgtgccgatggccggtccactggtcgcaggcgggctcttaatcgcgtgctacgtgatcactgggaccagcgctgacctgaccgttgagaaggccgcggatgttacctgggaagaggaggcggagcagaccggtgtatcccacaatctcatgatcactgtggacgacgatgggaccatgagaatcaaggacgacgagacagagaacatcctgacggtccttcttaagacagccctgttgattgtgagcggcatcttcccatactccattcccgccacactcctggtgtggcacacttggcagaaacagacgcagcgaagcggcgtcctgtgggatgtaccatccccgcccgaaacccaaaaggccgagctcgaggaaggtgtgtaccgaatcaaacagcagggaatatttgggaaaactcaggtcggcgttggggtacagaaggaaggtgtgttccatactatgtggcatgtcacacgtggtgcggtactgacccacaatgggaaacggctggagcccaactgggccagcgtcaagaaggacctcatatcctatggcgggggctggcgcctaaacgcccagtggcagaagggggaggaagtccaggtgatcgccgtcgagcccggcaaaaacccgaagaacttccagacaatgccaggcatctttcaaacgaccaccggggagatcggcgccatcgccctagactttaagcccgggaccagcggatcgcctataataaacaaggaaggtaaggtggtggggttatacggcaacggagtggtgacaaaaaacggcgggtacgtgtctggcatcgcccagaccaatgcggagcccgacggccccacaccggagctcgaggaggagatgttcaagaagcggaacctgactatcatggacctgcacccggggagcggcaagacccgaaaatacctccccgcaattgtacgggaggccatcaagcgccggcttagaacgctgatcttagcgccgacccgggtggtggccgcggagatggaggaggctctgaaggggctgcccataaggtaccagacgactgcaacgaaatcagaacacaccggtcgtgagatagtagatttaatgtgtcacgcgacgttcacaatgcgcctgctgagcccggtacgtgtgcctaactataacctggtaatcatggatgaggcccacttcaccgatccggcctcgatcgccgccagaggctacatttcgacccgggtgggcatgggcgaggcggccgccatctttatgaccgccacgcctcccgggacggcggaggccttcccccagtccaatgcccccatccaggacgaggagcgcgacatccccgagcggagctggaactccgggaacgagtggatcacggacttcgtggggaagactgtctggttcgtcccgagcattaaggcgggtaacgacattgctaactgcctgcgcaagaacgggaaaaaggtgattcagctgtcccgcaagaccttcgacactgagtaccagaagacgcggcttaatgactgggactttgtcgtaacgacagacatctcggagatgggtgctaacttcaaggccgaccgcgtgatcgacccccgtcgctgcttaaaacccgttatccttacggacgggcctgagagagtcatcctcgcagggccgatgcccgtgacggccgcctccgcggcccagcgccggggccgcgtcgggcggaacccccagaaggagaacgatcagtacatcttcactggccagccgcttaataacgacgaggatcacgcccactggacggaggcaaagatgctgctggacaacataaacacccccgaggggattatacccgccttgttcgagcccgagcgagagaaaagcgcggctatcgacggcgagtaccggctgaaaggagaatcacgaaaaaccttcgtggagctcatgcggcgtggggacctgccagtctggctcgcccacaaggtcgccagcgaaggcataaagtacacagatcggaagtggtgcttcgacggggaacggaacaaccaaatactcgaggagaatatggacgtggaaatctggacaaaggagggcgagcggaagaagctccgtccgcggtggttggacgcgcgcacctactcggacccactcgccctgaaggaattcaaggatttcgccgccggccgcaagtcaatcgcgctcgacctggtcacggaaatagggcgggtgccctcccacctggcacataggacccggaacgcacttgataacttggtgatgctgcacacctccgagcacggggggcgcgcctaccggcacgctgtggaggaactgccggagacgatggagacgttgctattactcggcctgatgatcttgcttactggaggcgccatgctatttctgatcagcggaaagggaatcggcaaaacctccatcgggctcatctgcgttatcgtgagctccggcatgctttggatggcggacgtccctctgcaatggatcgctagcgcaatcgtactagagttcttcatgatggtcctgttgatccccgaaccagagaaacagaggacgccgcaggacaatcagctcgcctacgtagtgatcgggatactaaccctcgccgctatcgtggcggccaacgagatgggcttacttgagaccaccaagcgggaccttggaatgtccaaggaacctggggttgtctctcccacctcctacctcgacgtggacctacaccccgcgagcgcttggacgttgtacgccgtcgccaccaccgtgatcaccccgatgctacgccacactatcgagaactccacagccaacgtgtcgctggctgcgatcgccaaccaagccgtcgtgctgatgggcttggacaaggggtggccgatcagtaagatggacctgggtgttcccctgctcgccctaggttgctacagccaagtcaaccccctgaccttgacggccgcggtcctgctgctagtaacgcactacgccatcatcggccctggcctgcaggccaaggctaccagagaggcacagaagcgcaccgcggccgggatcatgaagaatcccaccgtcgacggaattatgacgattgacctggaccccgtcatctacgactccaagtttgagaaacagctcggccaggtaatgctgctcgttctctgcgccgtgcaactgctactaatgcggactagctgggccctgtgcgaggccctgaccctagcgaccggccctatcacgacactgtgggagggctccccggggaagttttggaacacgaccatcgctgtgtcaatggccaacatatttcgcggcagttaccttgccggtgcgggccttgccttcagtatcatgaagtccgttgggacggggcgccgggggacggggagccaaggcgagactttaggggaaaaatggaagaagaagttgaaccagctctctcggaaggagttcgagctgtacaagaagtccggcatcaccgaagtggacaggacggaagccaaggaagggttgaagcggggcgagacgacccaccacgccgttagccgcggctcagctaaattgcaatggttcgtcgagcggaacatggtgattcccgaggggagggtgatagacttaggctgtggtaggggcggctggagctactattgcgctggactgaaaaaggtgacggaggtgcgcggctacaccaagggtgggccaggtcacgaggagccagttccgatgtcgacgtacggctggaacatcgtaaagttaatgtcggggaaggacgtgttttacctaccgcccgagaagtgcgataccctgctgtgcgacatcggcgagtccagccccagtcccaccgtggaggagagcagaaccatccgcgtgctcaagatggtggagccctggctacgcaacaaccagttttgcattaaagtactaaatccctacatgccgacggtaattgaacatttggagaagttgcagaggaagtatggggggatgctggtccgtaatcccctctcccgcaattcaacgcacgagatgtactggatctccaacggcacaggaaacatcgtgagctccgtcaacatggtttcacgcctgctgctcaatcggttcaccatgacgcaccgccgtcccaccatcgaaaaagacgtcgaccttggcgccggcacacgccacgtgaacgcggagccagagaccccgaacatggacgtgatcggagaacgaattaagcgtatcaaggaagagcattcttctacgtggcactacgacgacgagaacccctacaaaacctgggcctaccacggttcctacgaggttaaggctaccggatcggctagctccatgatcaacggcgtcgtgaaattactgaccaagccctgggacgttgtccccatggtgacgcagatggccatgacagatactacaccgttcgggcagcagcgggtcttcaaagagaaagttgacacgcgtacgccccggccaatgcctggcacacgaaaggtgatggagattaccgccgagtggctgtggcggacgctgggtcgcaacaagaagcccaggctatgtacccgtgaggaattcaccaagaaggtcagaaccaacgcagcaatgggggctgtgttcacagaggaaaatcaatgggacagcgcacgcgccgccgtggaggacgaagagttctggaagctggtcgaccgcgagcgcgagctccacaaactcggaaagtgcgggtcctgcgtgtacaacatgatggggaagagggaaaagaaactaggggagttcggtaaggcgaaggggagccgggccatctggtatatgtggctcggtgcgcgctacctcgagttcgaggcgctgggctttctcaacgaggaccactggttctcccgggagaatagttattccggggtagagggtgaggggctccacaaactaggatacatactgcgtgacatctccaagatacccgggggggctatgtatgcggacgataccgccggctgggacacccggatcaccgaggacgacctccacaacgaggaaaagatcacgcaacaaatggaccctgagcaccgccaacttgccaacgccatcttcaagctgacctaccagaacaaagtcgtgaaggtccagcggcccactcccaaagggaccgtcatggacatcatttcccgcaaagaccagagaggcagcggccaagtaggcacatacggcctcaacactttcacaaacatggaggcccaactggtgcggcagatggagggggagggtgtcctgtccaaggcggatctcgagaacccccacttgttagagaaaaagattactcagtggctcgaaaccaagggggtggagcggctgaaacgcatggcgattagcggcgacgactgcgtagttaagcctatcgatgaccggttcgccaacgcccttctcgccttaaacgacatgggcaaggtacgcaaggatattccgcaatggcagcctagcaaggggtggcacgactggcagcaggtccccttctgcagccaccatttccacgagctgataatgaaagacgggcggaagctcgtagtgccctgccgcccccaggacgaactgataggccgggcgcggattagccagggcgccggttggagcctgaaggagactgcctgcctcggcaaggcctacgcgcagatgtggagtctgatgtacttccaccgccgggacctacgcctcgcctccaacgccatatgctccgccgtgcctgtccactggatccccacgtcgcggaccacctggtcgatccatgcccaccaccagtggatgacaacagaggacatgctgactgtatggaatcgcgtttggatagaggacaatccatggatggaagacaaaacacccgtcactacctgggaggacgtgccatacctgggaaagcgggaggaccaatggtgcgggtccctaatcggtctaaccagcagggcaacatgggctcaaaacattctgacggcaatccagcaggtccggagcttaatcggggacgaggagtttcttgactacatgcccagcatgaagagatttcggaaggaggaggaatctgagggcgctatctggtaa

SEQ ID NO: 25780 - RNA, 9873 nt, synthetic construct
  misc_feature 1..9873: note = derived and/or modified CDS sequence (opt11) from DENV-3__KF955464__SS-prME
  source 1..9873: mol_type = other RNA
acgtccctgtgcctcatgatgatgctgcccgcgaccctggccttccacctcacctctcgggacggcgagccccggatgatagtggggaaaaacgagcgcgggaaaagcctgctgttcaagaccgcaagcgggatcaacatgtgcactctcatcgccatggatttaggggagatgtgcgacgataccgtcacctacaagtgccccttaatcgctgaggtcgaacccgaagacatcgactgctggtgcaatttgaccagcacctgggtgacctacgggacctgcaaccaggccggcgagcaccggagagacaagcgctcagtggccctggcaccacacgtgggcatggggctggacactcgcacccagacctggatgagcgccgagggcgcctggcgccaagtggagaaggtcgagacttgggctctcagacaccccgggtttacgatactggcactcttcctcgcgcactacatcggcacttccctgacccagaaggtagtcatcttcatcctgctcatgctggtcactccttctatgaccatgcggtgtgtgggagtaggcaaccgcgatttcgtcgaggggctgtcaggggctacctgggtggacgtggtactcgaacacggcggctgcgtgaccacgatggccaaatccaagcctaccctcgatatcgagctgcagaaaacagaagccacccagcttgcgatcctgcggaagttgtgcattgagggcaagataacgaacattacgactgacagtcgctgccccacccagggcgaggctacgctcccggaggagcaggatcagaactacgtctgtaagcatacctacgtcgaccggggctggggtaacggctgtggacttttcgggaagggcagcctggttacctgtgctaaattccaatgcctcgagcctatcgagggcaaggtggtccagtacgaaaacctgaagtacaccgtgatcatcacggtgcacaccggtgaccagcaccaggtcggcaacgacacacagggtgttaccgtcgaaatcacgccccaggcgtccactgtggaggcggtcctgcccgagtacggcaccctggggctggagtgcagcccgcgcaccggcctggatttcaacgaaatgatcctcttgacaatgaagaacaaagcgtggatggtccaccggcaatggttcttcgatctaccccttccttggacgtccggagccaccacagagacccccacgtggaaccgcaaggagctgctggtgaccttcaagaatgcccatgccaaaaagcaggaggtggtcgtgctcgggagccaggagggtgccatgcataccgcgctgactggggcaacggagattcagaactccggcggcaccaatatattcgcaggtcacctaaagtgccggctcaagatggacaagttagagctcaagggcatgagttacgctatgtgccttaacacgttcgtcctgaaaaaggaggtcagcgagacccaacacgggacgattctgataaaggtagagtacaagggcgaagacgcgccgtgcaagatccccttcagcaccgaggacggccaaggcaaggcccacaacggtcgcctgatcacagcaaaccccgtcgtcaccaaaaaggaggagcccatcaacatcgaggccgagccgccatttggggaaagcaacattgtgatcggcatcggggacaaggccctcaagataaactggtacaagaagggctccagcatcggtaaaatgttcgaagcgacggcgcggggcgcccgcagaatggccatcctcggcgacaccgcctgggacttcgggtccgtcggcggggttcttaacagcctaggcaagatggtccaccagatcttcgggtccgcgtataccgcgctattcagcggcgtgtcctggatcatgaagatcggcatcggcgtcctgctcacctggattggcctgaacagcaagaacacgtctatgagcttctcctgcattgtaatcgggataatcaccctctacctcggagccgtggtccaagccgatatgggatgcgtgatcaactggaagggcaaggaactgaaatgcggtaacgggatcttcgtgaccaacgaggtccacacgtggaccgagcagtacaagtttcaggccgacagccccaagcgactggcgactgcaattgccggtgcctgggagaacggagtgtgcggcatccgctccaccacacgtatggagaaccttctgtggaagcagattgccaacgagctgaactacatcctctgggaaaacaacataaagctgacggtagtcgtgggggacatcatcggcgtgctggagcagggcaagcgcaccctcacaccccagccgatggagctgaagtacagctggaagacctgggggaaggcgaaaatcgtaaccgccgaaacgcagaacagttcattcatcatcgatgggcccaacacgcccgagtgcccctccgctagccgggcctggaacgtgtgggaggtggaagactacgggttcggcgttttcaccacgaacatctggctgaaactccgcgaggtgtacactcagtcctgcgaccaccggttgatgagtgccgccatcaaggacgagcgcgctgtgcacgccgacatgggttactggattgagtctcagaagaacggctcctggaagctggagaaggccagcttcatcgaggtcaagacttgcacctggccgaagtcccatactctctggagcaacggggtgctggaatccgacatgatcatcccgaaaagcctcgcggggcccatatcccagcacaaccaccggccgggctatcacacgcagaccgccggcccctggcatctcggcaagctggagctggacttcaattactgtgagggtaccaccgtggtcatcgccgagaactgtggaacgagaggccccagcctccggaccacgaccgtatccgggaagctgatccacgagtggtgttgccgcagctgcactctgcccccactccggtacatgggcgaggatgggtgctggtatggcatggaaatccgccccatcaacgagaaggaggagaacatggtgaagtccctggtcagcgccggctcagggaaggtagacaattttaccatgggcgtgctttgcctcgcaatcttgttcgaggaagtcatgcgggggaagtttggtaaaaagcacatgatcgcgggggtgcttttcaccttcgtgctcctgctgagcggacagatcacctggcgcgacatggcccacacgctcatcatgatcggctccaacgccagcgaccggatggggatgggcgtaacctacttggctctgatcgccacattcaagattcagcccttcctcgcgctgggattcttcctgcgcaagctcacatcccgtgagaacctgcttttaggcgtgggcctggccatggccacgaccctgcagcttccggaggacatcgaacagatggcaaacgggattgcgctggggctgatgaccctcaaactgatcactcagttcgagacgtatcaactgtggaccgcactcgtgagcctgacctgcagcaacaccatattcaccctgaccgtcgcatggcggaccgccaccctcatcctggccggggtgtcgctactcccgctgtgccaatcatccagcatgcgcaagactgactggctgcccatgaccgtcgccgccatgggtgtgccgcccctgccgttgttcatattctcactgaaggacacccccaagcgcaagagctggccactcaacgaaggagtgatggccgtcgggctggtgtccatcctggccagctccctcctgcgcaatgacgtacccatggccgggccgctggtcgccggagggctcctgatcgcctgttacgtgatcacgggcacaagcgccgatctgaccgtggagaaagccgccgacgtaacctgggaggaggaggcggagcagaccggggtgtcccacaacctcatgataacggtggacgatgacgggacaatgcgcatcaaggacgatgagaccgagaacatcctgaccgtcttacttaaaacagccctcctgatcgtgagtggcattttcccctattccatccccgccacgttgctggtgtggcacacatggcagaagcaaacccagcggagcggggtgctgtgggacgtcccgtccccgccagagacacagaaggctgagctggaggaaggcgtgtaccggatcaagcagcagggaatattcgggaagacgcaggtcggcgtgggggtgcaaaaggagggcgtcttccacaccatgtggcacgttacaagaggggccgtgctcacccacaacgggaagcggctggagcccaactgggcgtctgtcaagaaggacctcatctcatacggtgggggctggcggctgagtgcccagtggcagaaaggggaggaagtccaggtgatagccgtagaacccggcaagaacccgaagaactttcagacgatgccaggcatattccagaccacaaccggcgagattggcgcaatcgcactggacttcaagcctgggacgtccggcagcccgatcatcaatcgagagggaaaggtggtggggctttatggcaacggcgtcgtgacaaagaacggcggctatgtaagcggcatagcacagaccaatgccgaaccggatgggccgaccccggagctcgaggaggagatgttcaaaaagcgcaacctgacgatcatggacttgcatccggggtccgggaaaaccagaaagtacctccccgccatcgtccgcgaagccatcaagaggcgcctgcggactctgatcttggcgcccaccagagtggtggccgccgagatggaggaggcgctgaaggggctaccgatccggtaccagacgaccgccaccaagtccgagcacaccggacgcgagatcgtcgacctcatgtgccacgcgacctttaccatgcggctgctttccccagtgagggtacccaattacaacctcatcatcatggacgaggcccactttacagaccccgccagcatcgccgccagagggtatatcagcactcgcgtcggtatgggcgaggcggccgctatattcatgacggccacgccgccagggacagcggaggcctttccccagtccaacgcacccatccaggacgaggagcgggatatccccgagcgctcctggaatagcggcaacgagtggatcaccgacttcgtggggaagacggtgtggttcgtcccctccatcaaggccggcaacgacatcgcgaattgtctgcggaagaacgggaagaaggtgatccagctgagtaggaagacattcgacacggagtatcagaaaaccaggcttaacgattgggactttgtggtcacgaccgacatctccgagatgggcgcgaacttcaaggccgaccgggtgatcgaccctcgccggtgcctgaaacccgtaatcttgaccgacggaccagaacgcgtcatcctcgccgggccgatgcccgttaccgccgcctcagcggcccagaggcgcggtcgggtggggcgcaacccccaaaaagagaacgaccagtacattttcacgggccagcccttgaacaacgacgaggaccatgcacactggaccgaggctaagatgctactcgacaatattaacacgccggaggggataatacccgcccttttcgagcctgaacgagaaaagtccgcggccatcgacggtgagtataggctgaagggcgagagccggaagaccttcgtcgagctcatgcgacgtggcgaccttccagtgtggctggcccacaaggtggcctccgagggcattaagtacactgacagaaagtggtgcttcgacggtgagaggaacaaccaaatcctcgaagaaaacatggatgtcgagatctggacgaaggaaggcgagcgcaagaaactccggccgcgctggctggacgctcgtacctacagcgaccccctcgccctgaaagagttcaaggactttgcggccggccggaaaagcattgccctcgatctggtgaccgaaatcgggcgtgtccccagccacttggcgcatcgcacccgcaacgccttagataatttagttatgctgcacacttccgagcacggcgggcgggcgtaccggcacgccgtggaggagctgccggagacgatggagaccctcctactcctcggcctgatgatcctattaaccgggggcgccatgttattcctgatcagcggtaaggggatcggcaaaacgtcgatcgggttgatctgcgtcatcgtgtccagcggcatgctgtggatggctgacgtacccctgcagtggatcgcctcagccatcgttcttgagttctttatgatggtgctgttaattcccgagcccgagaaacagcggacccctcaggacaaccaattggcctacgtcgtcatagggatcctgactctggccgcgatcgtcgctgccaacgagatgggcctcctagagaccacaaagagggacctgggcatgagcaaggagcccggggtggtttcacccaccagctacctcgacgtggacctgcacccggcctcagcctggaccctgtacgcggtggccaccaccgtgatcacccctatgctccggcacaccatcgagaacagcaccgcaaacgtatccctcgccgcgatcgccaaccaggctgtggttctgatggggctagacaaggggtggccaatctcaaagatggacctgggcgtgccacttctcgcgctgggctgctactcccaggtgaaccccctgacgctcaccgccgcggtcctgctgctcgtcacccattacgccatcatcgggccgggcctgcaggccaaggctacccgcgaggctcagaaacggacggcggccggtatcatgaagaaccccaccgttgacggcatcatgaccattgacctggatcccgtcatctatgacagcaagttcgagaagcagctcggccaggtaatgctacttgtgctctgcgcggtccagctgctgctcatgaggacgtcatgggcgctgtgcgaggctcttacactcgccaccggccccataaccacgctgtgggagggcagcccggggaagttctggaatacgaccatagccgtctcgatggcgaacatcttccgaggcagctacctggcaggggcgggcctcgccttcagcataatgaagtccgtggggaccggccgtcgcggcaccgggtcccagggcgagacgttaggcgagaagtggaaaaagaagctgaaccagctcagccgcaaggaatttgacctgtataagaaatccggcatcacagaggtcgatcggaccgaggccaaggagggcctgaagcgcggcgagaccacccaccacgccgtgtcccggggcagcgccaagctccagtggttcgtggagcgcaacatggtcattcccgaggggcgggtgatcgacctgggctgtgggcggggaggatggtcttactactgcgcgggcctgaagaaggtgacggaggtaagaggctacacgaagggcgggcccgggcacgaggagcccgtgccgatgagcacctacggatggaacatcgtgaagctcatgtccgggaaggacgtcttctatctgccgcccgagaagtgtgacactctgctgtgtgatatcggcgagtcctcccccagccctacggtggaggaatcccggaccataagggtgctccggatggtcgagccctggctacgtaacaatcagttttgcatcaaagtcctgaacccctacatgcccaacgtaatcgagcacctagagcgccttcagcgcaagtacggcgggatgctggttcgtaacccgttatcgcgcaattcaacgcacgagatgtattggatctccaacgggaccgggaacatcgtgtccagcgtcaacatggtgtcccggctcctgctaaaccggttcacgatgacgcaccggcgcccaaccatcgaaaaagacgttgacctgggcgccggcactcggcacgtcaacgccgaacccgagacgccgaacatggacgtgatcggggagcgtataaaacggatcaaggaggagcactcatccacctggcactacgacgacgagaacccctacaagacgtgggcctatcacggcagctacgaggttaaggccaccgggagcgcgagcagcatgatcaacggagtcgtgaagctgctcaccaaaccctgggacgtggtcccgatggtgacccagatggccatgaccgacaccaccccgttcgggcagcaaagggttttcaaggagaaggtcgatacacggacgccgcggccgatgcccggcacccgaaaagttatggagatcacggccgaatggctgtggcgtaccctgggacgcaacaagaaaccgcggctctgcacccgcgaagagttcaccaagaaagtgcggacaaatgccgccatgggggctgtctttacagaggagaaccagtgggactccgcacgggccgccgtggaagacgaggagttctggaagctcgtggataaggagcgagaattgcataagttaggtaaatgcgggagctgcgtctacaacatgatgggcaaacgcgaaaagaaacttggggaatttggcaaggcaaagggctcccgggccatctggtacatgtggcttggggcccggtacctcgagttcgaggccttaggcttcctgaatgaggaccactggttcagccgggagaactcctactccggtgtggaaggcgaagggctccacaagctagggtatatcctgcgcgacatctctaagatacccggcggggccatgtacgcggacgacaccgccggctgggatactcgcatcacggaggacgacctgcacaatgaggagaagatcacccagcagatggaccccgagcatcgtcagctggccaacgccatcttcaaattgacctaccagaacaaggtggtcaaggtgcagcgccccacaccgaaaggtactgtgatggatattatcagcaggaaggaccagcggggctcgggccaggtcgggacctacggcctaaacaccttcaccaacatggaggcccagttagtgcgccagatggaaggggaaggcgtgctgagcgaggcggacctcgagaatccgcacctcctggagaagaaaatcacccaatggcttgagacgaagggggtcgagcggctgaagcgaatggccatctccggcgacgactgcgtagtgaagcctatcgacgaccggttcgccaacgcactgctcgccctgaacgacatgggtaaagtccgcaaggacattccacagtggcaaccgagcaaggggtggcacgattggcaacaagtcccattttgctcacaccacttccacgagctgatcatgaaggacgggcggaaactcgtggtcccgtgccgcccgcaggacgagctgatcgggcgcgcgaggatcagccagggcgcagggtggtcgcttaaggagacggcctgcctcggcaaagcctacgcacagatgtggagcctgatgtacttccacagacgagacctgcgcctcgcgtccaacgccatctgtagcgccgtccctgcccactggatccccacctccaggacgacgtggagcatccacgcgcaccatcagtggatgaccaccgaggacatgctgaccgtgtggaatcgcgtttggatcgaggacaacccttggatggaggacaagacgcccgtgacaacctgggaggacgtgccctacctgggcaaacgggaggaccaatggtgcggaagccttatcggcctgacctctagagccacgtgggcccagaacatcctgaccgccatccagcaggtccgctccctcattggggacgaggagttccttgactacatgcccagtatgaagcgcttccggaaggaggaagaatccgaaggcgccatctggtga

SEQ ID NO: 25781 - RNA, 9873 nt, synthetic construct
  misc_feature 1..9873: note = derived and/or modified CDS sequence (opt11) from DENV-3__FJ639731__SS-prME
  source 1..9873: mol_type = other RNA
acctcactgtgccttatgatgatgctcccggcaacactagcatttcatttaacgagccgagatggggaacctagaatgatcgtagggaaaaacgaacgcggtaaatcgctgctattcaaaacggcctcaggcataaacatgtgtacactgatcgcgatggatctcggagaaatgtgcgacgatacggtcacttacaagtgccctctaatagcggaagtagaacccgaagacatcgactgttggtgcaacctcacatcgacatgggtcacgtatggcacgtgcaaccaagctggagaacacaggcgggacaagagatcagtagccctcgcaccgcatgtcgggatgggattggacacacgaacacaaacttggatgagcgcggaaggtgcctggcgccaagtagaaaaggttgagacatgggcactcagacacccaggcttcactatattagccttgtttttggcacactacataggaacttccctcacgcaaaaggtcgtcatcttcatcctattgatgctcgtaacgccatccatgactatgagatgcgtaggcgtcggcaacagagacttcgtagagggcctctccggagctacttgggtagacgtagtcctagaacacgggggatgtgtcacaaccatggctaaatcaaaacccaccctcgacattgaactgcagaaaacagaggctacgcaattagcgacactacgaaagttgtgcatcgaaggaaaaataaccaacataaccaccgactctcgatgtccaacacaaggcgaggcaacactcccagaagaacaggaccagaactacgtctgcaaacacacctacgtcgacaggggatggggaaacggttgcggactattcggaaaaggatcgctcgtaacgtgtgccaagtttcaatgcctcgaaccaatagaaggaaaagtcgtccaatacgagaatctcaaatacaccgtcataataaccgtccacacgggagaccaacaccaagttggcaacgatactcagggcgtaacggtcgagatcacgccacaggcttcgacagtagaagcggtcttgcccgaatacggcacgttgggactagagtgctcaccgcggaccggattagacttcaacgaaatgatcctgttaacaatgaagaacaaggcctggatggtccatagacaatggttcttcgacctgccgctgccatggacaagcggcgcaacaacagaaacgccgacatggaaccgaaaagagctcctcgtaacatttaaaaatgcccatgccaagaaacaagaggtcgttgtactgggcagccaggagggtgctatgcacacggcactgacaggcgccacagaaatccaaaacagcggaggaacgtcaatcttcgccggtcacctaaagtgcagactgaaaatggataaactcgagctcaagggcatgtcgtacgcaatgtgtttaaacaccttcgtactgaagaaagaggtaagcgagacacaacacggtacggtgcttattaaggtggagtacaaaggggaggacgcgccatgcaaaatacctttttcaacggaagacgggcagggaaaggcgcacaacggccgactcataacggcgaaccctgtagtcaccaagaaagaagaaccagtaaacatcgaagcggagcctcccttcggtgagtcgaacatcgtaataggtatcggcgataaagcgctcaagataaactggtataagaagggctcatcaattgggaagatgttcgaagccacagctcggggcgcgaggagaatggccatcctgggcgatacagcatgggatttcggttcggtaggcggcgtcttaaatagtctcggtaaaatggtacaccagatcttcggctcagcatacaccgccctattctccggggtatcctggatcatgaaaatagggataggagtactcctaacatggatcggcctgaactcgaaaaatacaagcatgagcttcagctgcattgttatcgggatcatcaccctgtacttgggagcagtcgtccaagcggatatgggctgcgcgataaactggaaagggaaagagctaaaatgcggatcaggaatttttgtaactaacgaagtgcatacttggacagaacagtacaagtttcaagcggactcccccaaaagactagcaacggcaatagcaggggcatgggagaacggcgtctgcggcatccgctcaactacacgcatggaaaatctgctttggaaacaaatcgccaatgaactaaactacatactctgggaaaacaatatcaagctcaccgtggttgtgggagacataataggggttctagaacaaggaaagcggacactgactccgcagcctatggaactcaagtacagctggaaaacatgggggaaagctaagatcgtcaccgctgaaacccaaaacagcagtttcataatagacggcccaaatacgcccgagtgccctagtgcgtcccgtgcgtggaacgtttgggaggtagaagattacggattcggggtattcactacaaacatctggttgaaactgcgcgaagtatacacacaatcctgcgaccaccggcttatgtccgctgcaattaaagatgagcgggcggtacacgcagatatgggatactggatcgaaagccagaaaaacgggtcatggaagctagaaaaggcatcattcatcgaagtaaagacatgcacgtggcctaaaagtcacacactgtggtcaaatggagtattggaatctgacatgatcatacctaaaagtctagccggaccaattagccaacataaccatcgaccgggatatcacacgcagacggccggcccttggcacctcggaaaacttgaactggacttcaactattgcgaaggaaccaccgtcgtaatcacagaaaactgtggtaccagggggccaagcctacgtaccacaacagtcagcggtaaactcatccatgagtggtgctgtaggtcctgtaccctaccacccctgcgctatatgggagaagacgggtgctggtacggaatggagatcaggccaataaacgaaaaagaggaaaatatggtaaaatcgctcgtcagcgcgggctccggtaagatggacaacttcaccatgggcgttctatgcttggcaatattattcgaagaagtgatgagagggaaattcgggaagaagcacatgatagccggagtcctcttcacattcgtactcctactctcaggtcaaataacgtggcgtgacatggcccacacactcataatgatcggctcgaacgcgagcgaccgaatgggcatgggggtgacatacctagccctcatagctacgttcaaaatacaaccatttttggcccttgggttcttcctaagaaagctcacctcgagagagaacctacttctaggagtcggactcgccatggcgaccacactccaattgcccgaagacatagaacagatggcaaatggaatcgcactgggactcatgaccctgaagctaatcacgcaatttgaaacataccaactctggacagccctcgtaagcctcacatgcagcaatacaattttcaccctcacagttgcatggcggacagcgaccctcattctggcaggagtgagtctgctaccattatgccaaagttccagcatgcgcaagacggactggctgcctatgacagtggcggcgatgggagtccctccactacccctgttcatattcagcctaaaagacacaccgaagagaagaagctggcctctaaatgaaggcgtaatggcagtcgggttagtctcaatactggcatcgagcctcctccggaatgacgtgccaatggctggcccattggtcgcgggaggactcctcattgcttgttacgtaatcaccggcacgagcgcagacctgacagtagagaaggcggctgacgtcacatgggaagaagaagccgaacagactggggtctcccacaacctaatgatcaccgtggacgatgacgggaccatgagaatcaaagacgacgaaacggagaacatactgacagttctgctcaagactgcgttgctaatcgtaagcggcatatttccctacagcataccagcaacattgctcgtatggcacacatggcagaaacaaacccagagaagcggagtactgtgggacgttccctcgccgccggaaacacaaaaagctgaattggaagagggcgtctacaggataaaacagcagggcatcttcggaaaaacgcaagttggagtgggcgtacaaaaggagggcgtatttcacacgatgtggcacgtgacgcgaggcgcggtgctgacgcacaatgggaaaaggctagagccaaactgggccagcgtgaaaaaggacttaatctcttatgggggcggatggcgactaaacgcccagtggcaaaagggcgaagaagtacaggtgatcgccgtcgagcccggtaaaaacccgaaaaacttccaaacaatgcccggcatatttcagaccactacaggggagataggagctatcgccctcgacttcaaaccaggcacctccggatcgcctatcataaacaaagagggcaaggtggtaggattatacggaaacggggtggtcaccaaaaacggcgggtatgtctctggcatagcacagaccaatgccgaacctgatggcccaacacccgaattagaggaagaaatgtttaagaagaggaaccttacgataatggatctgcaccccggatcgggcaaaactcgtaaatacctcccagctatagtccgagaagcaatcaagagacgactgcggacgttgatactagcacctacacgagtagtagccgccgaaatggaggaagccctcaagggcctcccaataaggtaccaaaccacggccacaaagtcggaacacacaggccgggagattgtagacctgatgtgtcatgcaacctttaccatgaggttactctccccagtaagagtgcccaactacaacctggtcataatggacgaggcccatttcacggacccggcaagtattgcagcccgaggatacatctcaacgcgagtaggtatgggggaagcggccgccatattcatgacagctactcccccgggaaccgccgaagcattcccccagtcaaacgcccccatccaggacgaagaacgcgacatcccagaacggagctggaatagtggcaacgaatggatcacagacttcgtaggaaagacagtctggtttgtaccatccataaaggcgggcaacgacatagcaaattgcctaaggaaaaatggtaagaaagtaatacaactctcacggaagacattcgataccgaatatcagaaaacacggctaaacgactgggatttcgttgtaaccacggacatctccgaaatgggcgcgaacttcaaagctgatcgggtgatcgaccctcgccggtgcctcaaaccagtcatcctaacagacggccccgagcgagtcatcctcgccggaccaatgcctgtaacagccgcatccgccgcgcaaagaaggggcagggtgggccggaacccacaaaaagaaaacgaccagtatatattcactgggcaaccgcttaacaacgacgaagaccatgcccactggaccgaagccaagatgctgttagacaacataaacactcccgagggaatcatacccgccctattcgagccggaacgagaaaagtcggccgcgatagacggggaatataggctgaaaggcgaaagtagaaaaacgtttgtagagctaatgcggagaggcgacctccctgtgtggcttgcccacaaagtggccagtgaaggcatcaaatacactgaccggaaatggtgcttcgacggagagaggaacaaccagattctggaagagaacatggatgtagagatatggacgaaagagggtgaaagaaagaaactcagacctagatggctagacgcaagaacatactcggaccccctggcgctcaaagaatttaaagacttcgcagcggggcgaaaatccatagcgctagatctagtcacagagatcgggagagtcccgtcccacctcgcacacaggacaaggaatgcactggacaatcttgtcatgcttcacacatcagagcacggtggacgagcatacaggcacgccgtggaagaactgccagaaacaatggagacactcctgttgctagggcttatgatacttctgacagggggcgcaatgctttttctgataagtggcaaaggaataggaaagaccagcataggactaatatgcgttatcgtgtcttctgggatgctctggatggcggacgtaccgttacagtggatcgcttcggcgatagtgctggaatttttcatgatggtgctactaatcccagaaccagaaaaacaacggaccccgcaggacaatcaattagcttacgtcgtcatcggaatactaacactcgcagcaatcgtcgcagctaacgaaatgggcctgctagaaaccaccaaaagggacctcggtatgagcaaagagccaggggttgtgtctccgacatcataccttgacgtcgatctacacccagcctccgcctggacattatacgctgtagcaacgacagtaataacaccgatgctgaggcacacaatagaaaactccacggcgaatgtctccctggccgcgatagccaaccaggctgtagtgcttatgggcctagacaagggctggccgatctccaaaatggacctaggagtaccgcttctggcattgggatgctactcccaggtcaacccactaaccttaacggcagcagtgctactcttagtaacgcactacgcaataatcggtccgggccttcaagccaaggcaacaagagaagcacagaaaaggacagcggcgggaataatgaaaaatcctaccgtggacgggatcatgaccatagacctggatcccgtaatctacgactcaaaattcgaaaagcaactaggacaagtaatgttactcgtactgtgcgcggtacagttgcttctcatgcgaacttcttgggctctgtgcgaggccctaacactggcaaccggacccataacgaccttatgggaaggaagtccaggtaagttctggaatacaacaatcgcagtctcaatggcaaacatctttcgtggaagctacctagcaggagcaggcctagcgttttcgataatgaagtccgtgggcacagggcggagaggcaccgggagccaaggcgaaaccttgggagagaaatggaagaagaaactcaatcaactctcaagaaaagagttcgatctatacaaaaagagtggcataaccgaagtcgaccgaaccgaagcaaaggaagggctcaaacgtggcgagactacccatcatgccgtgagcagagggagcgccaagctacaatggtttgtagaacggaatatggtaataccggagggtcgagtcatcgatctagggtgtggccgcggtgggtggtcctattactgtgcaggactaaagaaagttactgaagtgcgcggctacacaaaaggcgggccaggacatgaagaacctgtacctatgtccacatacggatggaacatcgttaaactcatgtcaggaaaggacgtcttctatctaccgcccgaaaagtgtgacaccctgctctgtgacatcggcgaaagctcaccgagccccaccgtcgaggaatcccggacgatccgagtcctaaaaatggtcgagccatggctaagaaacaaccaattttgtatcaaggtgctcaacccttacatgccgacggtgatagaacacctggagaggctccaacgtaagtacggaggcatgctcgtccgaaaccccctcagccgaaatagcacacatgagatgtactggatttctaacggtacgggaaacatagtatcaagtgtaaacatggtatcgagactcctacttaaccgatttactatgacacacaggaggccgaccatcgagaaagacgttgacctaggcgccgggacaagacatgtcaacgctgaaccagaaacgcctaacatggacgtaataggagagagaataaagcgaatcaaggaagaacattcgtccacgtggcactatgacgacgaaaacccctacaaaacatgggcataccacggcagctacgaagtaaaagcgacgggctccgcaagttccatgatcaatggggtcgtgaagctcctcaccaagccgtgggatgtggttccaatggtgacccagatggccatgacagataccactccctttggccaacaaagggtctttaaagaaaaggtagacacccgtacaccccgcccaatgccggggaccagaaaagtcatggagatcactgccgagtggctatggcggactttaggacgcaataagaaaccgagactctgcaccagagaagagttcacaaagaaggtaaggacaaatgctgccatgggagccgtcttcactgaagaaaatcaatgggactccgcccgagccgctgtggaagacgaagagttctggaagctagtcgaccgcgaacgggaactgcacaaacttggtaaatgcggcagctgcgtctataacatgatgggaaagcgcgagaagaaactgggcgaatttggcaaagccaaagggagcagagcgatctggtatatgtggctaggcgcccgatacttagagttcgaggccttgggattcttaaatgaggaccattggttcagtcgcgaaaacagctactccggcgtcgaaggggaaggccttcacaagctcggctacatcttacgtgacatcagcaagataccaggcggcgcgatgtacgcggatgataccgcagggtgggacacgcgaattacggaagacgacctgcacaatgaagagaaaataacgcagcaaatggaccccgagcaccgacaattggcaaacgccatatttaaactaacctatcaaaacaaggtagtgaaggtccaaagaccaacgcctaaaggcacggtcatggacatcatcagcaggaaagaccaacggggatccggtcaagtgggcacgtatggattgaacacctttaccaatatggaagcccagttggtccgccaaatggaaggcgagggagtacttagcaaggcagacttggaaaaccctcacctcctggagaagaaaatcacgcagtggctcgagacaaaaggagtagagcgtctcaaaagaatggcgatatcaggcgacgactgtgtcgtaaagccaatcgacgaccgattcgcaaacgcgctactcgccctcaacgacatgggaaaagtcaggaaggacataccccaatggcaaccctcaaaaggatggcatgactggcaacaggtaccattctgctcccatcacttccacgagctgataatgaaagacggccgaaagctggtcgttccatgtaggccccaagacgagctgatcgggcgagcacgcatatctcaaggagccggatggagcttaaaagaaacggcgtgcctagggaaagcctacgcacaaatgtggtccctcatgtattttcaccggcgcgacctacgcctagcgagcaatgccatctgtagcgccgtgccagtgcactggatacctacgagtagaacaacctggtctatacacgcgcaccaccagtggatgacgaccgaggatatgctaacagtctggaacagagtgtggattgaagacaatccatggatggaggacaaaactcccgtcaccacgtgggaagatgttccttacttaggaaaacgcgaggaccagtggtgcgggagcctgatcggactcacatctcgggcgacatgggcacaaaacatcctcaccgcaatacagcaagtaagatctctgataggcgatgaggagttcctcgactacatgccaagtatgaagcgattccggaaagaagaagagagcgaaggcgccatctggtaa

SEQ ID NO: 25782 - RNA, 9873 nt, synthetic construct
  misc_feature 1..9873: note = derived and/or modified CDS sequence (opt11) from DENV-3__HM181933__SS-prME
  source 1..9873: mol_type = other RNA
acaagtctatgccttatgatgatgttaccggccactctcgcgtttcacctgaccagccgggacggcgaaccaagaatgatcgtaggcaaaaacgaacgggggaaaagcctactcttcaaaaccgctagcggaataaatatgtgcacgctaatcgctatggacttgggagaaatgtgcgacgacacggtcacatataaatgtccactgatcgcagaagtggaaccagaagacatagattgttggtgtaacctcacttcaacatgggtaacatacggaacctgcaaccaagccggggaacaccgtcgcgacaaaaggtcagtagcattagcgccgcacgtcgggatgggcctagatacacgtacccagacatggatgtccgccgaaggagcttggagacaggtggaaaaagtggaaacatgggcgctgcgccacccaggttttacaatcttagcactgttcctggcgcactatataggaacatccctcacacaaaaagtcgtgatcttcatactgctgatgctcgtgacgccttcgatgaccatgcgctgcgtgggggtcgggaaccgcgacttcgttgaaggattatcgggagccacgtgggtcgacgtagtactcgaacacggcggatgtgtgacgacgatggcgaaaagtaaacccaccctggatatagagctgcagaaaactgaagctacccaactggccacgttaaggaagctctgcatagagggcaagatcacaaacataacgacagacagcagatgcccaacccaaggggaggcaacactaccggaggaacaagaccaaaactacgtctgtaagcacacgtatgtggaccgaggctggggaaacggatgcggattatttggcaaaggaagcctcgtaacttgcgcaaaattccagtgtctagagccaatagaggggaaagtcgtccaatacgaaaacctaaagtatacagtaataatcacagtgcacacaggggaccaacaccaagtgggcaacgatacacaaggcgtgaccgtagagataaccccacaagctagcaccgtagaagcggttctacccgaatatggaacgctgggtctggaatgcagcccgcggacagggctagacttcaacgaaatgatactattaacgatgaagaataaagcgtggatggtgcaccgacagtggttcttcgatctcccacttccctggaccagcggggctacgactgagactccaacttggaaccgaaaggaattactggtgacttttaaaaacgcgcatgccaagaaacaagaagtagtggtcctcggcagccaagagggagccatgcatactgcactaaccggcgctaccgaaatccaaaactctggcggcacctccatatttgctggacacctgaaatgcagactgaagatggacaagctagagcttaaaggaatgagttacgcgatgtgcttaaacacgttcgtgctgaaaaaggaggtctctgaaacgcaacatggcacgatcttgattaaggttgaatacaaaggagaagacgcgccatgtaaaatcccgttctcgaccgaagacgggcagggcaaagcacataacggaaggctgatcaccgcaaacccagtcgtcacgaagaaggaagaacccgtaaacatagaggccgagccaccattcggagaatcaaacatcgtgatagggatcggagacaaagccctaaaaatcaattggtacaagaaagggagctctatcggaaagatgttcgaagccacagcccggggcgcccgtcgcatggctatcctcggagacacggcatgggactttggctccgtaggaggggttctgaacagcctgggaaaaatggtccaccagatttttgggtcagcttacacagcattatttagcggagtaagctggatcatgaaaattggaatcggcgtgctcctgacatggattggattaaactccaaaaacacctcaatgtccttctcctgtatcgtgatcgggatcatcacactctaccttggcgcggtcgttcaagccgacatgggctgcgcgataaactggaagggtaaagagctaaaatgtggtagcgggattttcgtgacgaacgaagtccacacctggacggaacaatacaagttccaagcggactccccgaaaaggcttgccacagcaattgccggagcgtgggagaacggggtatgcggtattcgctcaacaactcggatggagaatttgctttggaaacaaatagccaacgaactaaactacatactctgggaaaacaacatcaaacttacggtcgtggtcggagatatcataggcgtgctggagcaaggcaagcgaacactaaccccacagcctatggagctaaaatacagctggaaaacctggggtaaagcaaagatcgtgacagcagagacccaaaactcatccttcattatagacggacccaacactcccgaatgccccagtgcatccagggcgtggaacgtgtgggaagtagaggactacggcttcggcgtcttcacgacaaatatttggctcaaactgcgggaagtgtacacccaatcgtgcgaccacaggctgatgtcagcagcaataaaagatgagagggccgtgcacgcagacatgggctactggatagaaagccagaaaaatggaagttggaaactagagaaagcgtcattcatcgaagtaaaaacatgcacgtggcccaaaagccacacactctggtcgaacggcgtactggagagcgatatgataatacctaaatcgttggccgggcccatatcacaacacaaccacaggcctggctaccatactcaaactgctggcccatggcacttgggcaaactggaactggatttcaactattgtgaaggaaccactgtagttataacagaaaactgcggaacacgaagaccctcactccgcacgactacagtaagcgggaaattgatccacgaatggtgttgtagatcctgcaccttaccgccgctccgctacatgggcgaggacggatgctggtacggaatggaaataagaccaataaacgagaaagaggaaaatatggtgaaaagcctagtgtcagcagggagcggcaaagttgacaacttcaccatgggtgtgctgtgcttagctatcttatttgaagaagtcatgcgtggcaagttcggaaagaagcacatgatagcaggggtattattcacctttgtgctcctcttgagcggccagataacatggagagacatggctcatacgctaatcatgataggcagcaacgcctctgatagaatgggcatgggtgtcacctacctagctctcatcgcgactttcaaaatacaaccattcctggccctggggttcttcctcaggaaactcaccagtagagaaaacctactgctaggagtcggcctggcgatggcaaccaccctacaattacccgaagacattgaacagatggcaaatggaattgctctgggcctcatgacacttaaacttatcacacagttcgagacgtaccaattatggacggctttagtctctctcacatgcagcaacaccattttcactctgacagtggcctggaggactgctactttaatattagccggtgtttcgttactccccttgtgtcagtcgagcagtatgaggaagacagactggcttccgatgacagtagccgcaatgggggttccacccctgcctctcttcatattctccctgaaggatacaccaaaaagacggagttggcctctaaacgaaggggtcatggccgtaggcttggtctcaatactagcaagtagtctactgagaaacgacgtaccgatggccggccccctcgtggcaggagggctactcatagcgtgttacgtaatcacagggacatccgccgacctcacagtagaaaaggccgcagacgtaacgtgggaagaggaagccgagcaaacaggagtaagccacaacttaatgataacggtggacgatgacgggacgatgagaataaaggacgacgaaactgaaaacatcctaacggtgctcctaaaaacagcactactgatagtgagtggaattttcccctactctatcccagcgacgctacttgtttggcacacgtggcagaaacagacccagcgctccggagtgctatgggacgtgccaagcccacccgagacacaaaaagcagagctcgaagagggggtgtatcgtataaagcaacagggcatatttggtaagacgcaagtaggcgttggcgtacagaaagagggcgttttccacacaatgtggcacgttaccagaggggctgttctcacgcacaacggaaagcggctagagccaaattgggcgagcgttaagaaagacctcatatcatatggtggaggttggcgcttgaacgcgcaatggcaaaaaggggaggaagtccaggtgatagccgtcgagcccggcaaaaacccaaagaatttccaaacgatgcccggaatctttcaaacaaccacgggcgagatcggcgctatagcactcgatttcaagccaggtaccagtggatcaccaataatcaatcgcgagggtaaagtcgtaggtctgtacggcaatggagtagtaaccaaaaatgggggctacgttagcgggatcgcgcaaactaacgcagagccagacgggccgaccccagagcttgaagaggaaatgtttaagaaaagaaatcttacgataatggacctccacccgggatccggaaaaacaaggaaatacctgcccgctatagtaagagaagcaatcaaacgccgactgcggacactaatactagcaccaacgcgcgtagttgctgcggaaatggaagaagccctgaaaggattgccgatacgctaccaaaccaccgcgacgaaatccgagcacactggccgcgagattgtagacttgatgtgccatgcgacgttcacaatgcgcctcctatcccctgtaagagtgccaaattacaacctcgtgattatggacgaagcgcacttcaccgacccggccagtatcgctgccagaggttacatttcgaccagagtaggaatgggggaggcggcagccatcttcatgacagccacacccccaggaacggcagaagcattcccccagtccaatgcgccaatccaagacgaggaaagggacataccggaacgcagctggaacagcggtaacgagtggatcacagacttcgtaggcaaaaccgtctggttcgtgccatcaattaaagcaggcaacgacatcgccaactgcctgcggaaaaacggcaaaaaggtcatacaactatcaagaaaaacctttgacacagagtaccagaagacgcgtttgaacgattgggacttcgtcgtgacgaccgacataagcgaaatgggagcaaactttaaggcagacagagtaatagacccccgcagatgcctcaagccagtgatactgaccgacggaccagagagagttatcctcgcgggcccaatgcccgtaacagctgccagcgcagcccaacgccgcggacgagttggtcggaatccccaaaaggaaaacgaccagtacatcttcaccggtcagccgcttaataacgacgaagaccatgcacattggacagaagcaaagatgctgttagacaacatcaacaccccagaggggatcatcccagccctattcgagccggagagggagaaaagcgcagcaattgacggtgaataccgcctcaaaggggaatcgcgaaagactttcgtcgagctaatgcgaaggggagatcttccagtatggctagcccacaaggtagcatccgaagggattaagtacacggacagaaaatggtgttttgatggcgaaagaaacaaccagatactcgaggagaacatggacgtagaaatctggaccaaagaaggtgaaaggaagaaacttcgcccacggtggctcgacgcacgaacctactccgaccctctagcgcttaaagagttcaaggatttcgccgccggaagaaaaagcatcgcgctagatctagtaacagagatcggcagagtccccagccacttagcgcatcgtacaaggaatgcgctagacaacttagtcatgctacacacaagcgaacacggaggccgagcatacaggcacgctgtcgaggaattaccggaaactatggaaacacttctcctactcggattaatgatcttactaaccggcggagccatgcttttcctcatctctggaaagggtatagggaaaaccagcataggcctcatatgcgtcattgtaagcagcggaatgctctggatggcggatgtcccactgcagtggattgcgagcgcaatcgttctcgagttcttcatgatggtgctactgatcccagaaccggagaaacagagaactccacaagacaaccaactagcatacgtcgtaatagggatactaacgctcgcagcgatagtagcagcgaacgaaatgggcctactcgaaacgaccaagcgtgatttaggaatgtccaaagagcccggcgtcgtatcgccgacgtcctatctagacgtagacctccacccagcatcagcgtggacactatacgctgtcgccacaaccgttatcacccccatgttgagacacaccatagaaaactcgaccgcgaacgtcagccttgcggcgatcgctaaccaggcagtcgtgttaatgggactcgacaaaggttggccaatctcaaaaatggatctaggcgtcccgctactggccttagggtgttactctcaggtaaatccactcacacttaccgccgcggtactcctattggtcacacactatgcgataatcgggccaggcctgcaagcgaaagccacacgcgaggcccagaaacgtacagcagcgggcatcatgaagaatccaaccgtagatggaatcatgaccattgacctcgaccctgtcatctacgactctaaattcgaaaaacagctaggtcaggtcatgctcctagtcctatgtgcggtacagctactcctgatgcgaaccagctgggctctctgtgaggcattaacgctagccaccggaccaataaccacgttatgggaggggagcccgggcaaattttggaacacaacaattgccgttagcatggccaacatctttaggggcagctacctcgcgggagcgggactggcgttctcaataatgaagtccgtaggcacaggtagaaggggaacgggtagtcagggagaaacgttaggagaaaagtggaagaagaaattgaaccaactctcccgaaaagagttcgatctatacaagaaaagtgggataacggaagtagatcgcacggaagctaaggaaggcctaaagagaggcgaaacaacgcaccatgcggtaagcagaggctccgcgaagctccagtggttcgtagaacgaaatatggtgatccctgagggtcgggtaatcgatttagggtgcgggcgaggaggatggtcatactattgcgccggacttaaaaaggtaacagaagtccggggctataccaaagggggaccaggccacgaagaaccagtacccatgagcacatacgggtggaacatagtaaagttgatgagcggcaaggacgtattttacctcccacccgagaagtgcgacacgctgctctgcgacataggagaatcaagcccatcacctacagttgaggagtcacgtacgatacgagtcctaaaaatggtagaaccctggcttcgaaataatcagttctgtataaaagtgttaaacccttacatgccgaccgtaatagaacatttggagcggctccaacgaaaatacggagggatgctagtacgaaacccacttagccgaaattcaacacatgaaatgtattggattagcaacggcaccggaaacatagtaagctcagtcaacatggtatcaagactcctactcaacaggtttacgatgacgcatcgcagaccaaccatcgagaaagacgtcgacctaggagccggcacgcgtcacgtaaatgcagagcccgagacccccaatatggacgtgataggtgagcgcataaagcggataaaagaagaacactcgtctacatggcactatgacgacgaaaacccatataagacctgggcttaccatggctcatacgaggtaaaggcgacaggaagcgcctcgtctatgatcaatggggtggtaaagctgctaaccaaaccatgggacgtagtccccatggtgacccagatggccatgacggacactactccgttcggccagcaaagagtctttaaggaaaaggtagacacccggactccacgccctatgccgggcactcgaaaagtaatggaaataacagcggaatggctatggagaacactaggacgaaacaagaaaccacgcctgtgtactagggaagagttcacgaagaaagtcaggacaaacgccgcaatgggcgccgtcttcaccgaagaaaaccaatgggacagcgcgcgcgctgcagtcgaagacgaggagttctggaagctagtagacagagagagagagctacacaagttaggtaagtgcggcagctgcgtatacaatatgatgggcaaaagagaaaagaagctcggggagtttggcaaagcaaaagggtcaagagcgatatggtacatgtggctcggcgcccgatatctggaatttgaggccctaggcttcttgaacgaggaccactggttcagccgcgaaaattcctactcaggcgtcgagggcgaaggactacataaactaggctacatacttcgggacatctccaagataccaggaggcgcaatgtacgcagatgacactgctggctgggacacaagaattaccgaggacgacctacacaatgaagagaaaataacacagcaaatggatccagaacatcgccaacttgcaaacgccatattcaaattaacctaccaaaacaaagtggtaaaagtccaaaggccaacgcccaaaggaacagtaatggacataattagcagaaaagaccaacgagggagcggacaagtgggcacctacggtctcaacacgttcaccaacatggaggcccaactcgtacgccaaatggagggggagggtgtacttagcaaagcggacctggaaaaccctcaccttctggaaaagaagatcacgcagtggctcgagacgaaaggcgtagaacgactcaagaggatggccatatccggtgacgactgtgtggtaaaaccgattgacgacaggttcgcgaacgcgctgctcgcactgaacgacatggggaaagtcaggaaagacattccgcagtggcagccgtccaagggctggcacgactggcagcaagttccgttctgctctcaccactttcacgaactgatcatgaaagacggacgaaagctagtcgtaccatgtcggccccaagacgagctaatagggcgtgcacgtatctctcaaggagcagggtggtcactaaaagaaacagcatgcctgggcaaagcgtacgcccagatgtggagcctcatgtactttcaccgacgcgacctacggcttgcgagcaacgcaatctgtagcgcagtaccggttcattggataccaaccagccgcacaacgtggtcaattcacgctcaccaccaatggatgacgaccgaagacatgctaacagtctggaatcgtgtttggatagaagacaatccatggatggaggataaaacgccagtaacgacctgggaagacgtaccatatctagggaaacgcgaagatcagtggtgtgggtccctcataggtctaacctcccgggcaacctgggcccagaacatactaacagcgatacagcaggtccgcagcctcataggggacgaagagttcctggattacatgcctagtatgaagcgattcaggaaagaagaggaatcggaaggcgcgatctggtaa

SEQ ID NO: 25783 - RNA, 9873 nt, synthetic construct
  misc_feature 1..9873: note = derived and/or modified CDS sequence (opt11) from DENV-3__JF295012__SS-prME
  source 1..9873: mol_type = other RNA
accagcctgtgcctcatgatgatgctcccggccaccctggccttccacctcaccagccgggacggggaaccccggatgatcgtgggcaagaacgagcgcggcaaatccctgctgttcaagaccgctagcggcataaacatgtgcaccctgatcgccatggacctgggcgagatgtgcgacgataccgtgacctacaagtgccccctgatcgcggaggtggagcccgaggacatcgactgctggtgtaacctcacctccacctgggtgacctacggtacctgcaaccaggccggcgagcaccgacgcgacaagcggtccgtagccctggcgccccacgtgggtatggggcttgacaccaggacacagacctggatgtcagcagagggcgcctggagacaagtggagaaggtcgaaacgtgggccctccgccatccggggtttaccatcctggctctattcctcgcgcactacataggcacctcccttacccagaaagtggtgatcttcatcctgcttatgctggtcacgccgagcatgactatgagatgcgtgggtgtgggcaaccgtgatttcgtggaaggtctatccggggctacctgggtggacgtggttcttgagcacgggggttgcgtgactacgatggccaagagcaaaccgaccttagacatcgagctgcagaagacggaggccacccaactcgccactctgaggaaattgtgcatcgagggcaagatcaccaacatcaccaccgattcccgctgccccacgcaaggcgaggccaccctcccggaagagcaggaccaaaactatgtgtgtaagcacacctacgtcgatagagggtgggggaacgggtgtgggctgttcgggaaaggcagcctggtgacctgcgccaagttccaatgtctcgagcctatcgagggcaaggtggtccagtatgagaatctgaagtatacggtgatcatcactgttcacaccggggaccaacaccaggtcggtaacgatacccagggtgtgacggtcgagattacgccccaggcctccaccgtggaggccgtgctcccggagtacggcaccctcgggcttgagtgcagcccgcgcacagggctggattttaacgagatgatactcctgacgatgaagaacaaggcgtggatggtccaccggcaatggttcttcgatctgcccctcccatggacttccggcgccaccaccgagacgcccacctggaacaagaaagaacttctggtcaccttcaagaacgctcacgccaagaagcaggaagtggttgtcctcgggagccaggagggcgccatgcacaccgcgctgacgggtgccaccgagatccagaactccggtgggaccagcatcttcgccggccatctcaagtgccgcctaaagatggacaagctggagctgaagggcatgagttatgccatgtgcctcaacaccttcgtgttgaagaaggaggtaagcgagacgcagcacggcaccatcttgatcaaagtggagtacaagggcgaggacgctccgtgcaagatacccttctcaacagaggatgggcagggcaaggcacacaacggcagactaatcaccgccaatcccgtggtcactaaaaaggaggagccagttaacatcgaagccgagccgccattcggagagtccaacatcgtgataggcatcggggacaaggccctcaagatcaactggtacaagaaaggcagctccattggaaagatgttcgaggcgaccgctcgcggcgcgagacgcatggccatcctgggggacacggcctgggacttcggttcggttggtggagtgttgaacagcctcggcaagatggtgcaccaaatcttcggatcggcgtacaccgccctttttagtggcgtctcatggatcatgaagataggaataggggtgttactgacgtggattggactgaattccaagaacaccagcatgtccttcagctgcatcgtgatagggatcattacactctatctcggcgccgtcgtccaggccgacatggggtgcgtgatcaactggaagggcaaggagctgaagtgcggatcgggtatcttcgtcaccaacgaggtgcacacgtggaccgagcagtataagttccaggccgacagccccaagcggctggcgacagccatcgccggcgcctgggagaacggggtgtgcggaatcaggtccaccacgcgcatggagaacctcctgtggaagcagatcgccaacgagctgaattacatcctttgggagaataacattaagctgacagtcgtggtgggggacatcattggggttctggagcaagggaagaggaccttaacgccccagccgatggagctgaagtacagctggaagacgtgggggaaagccaagatcgtgacagccgaaacccagaactcatccttcataatcgacggacccaacacccccgagtgcccgtccgccagtcgcgcatggaacgtctgggaagtcgaggattacgggttcggggtcttcacgaccaatatatggcttaagctacgggaggtgtacacccagagctgcgaccaccgcctgatgtccgcggccatcaaggacgagcgggccgtacacgccgacatgggctactggatcgagagccagaagaacgggtcatggaagctcgagaaggccagctttatcgaggtcaaaacgtgtacctggccgaagtcccatacactctggtcaaatggggtactagaatccgacatgatcatccctaagagcctcgcgggtcccatctcccaacataaccaccgccccggttaccacacccagactgcggggccctggcatcttggcaagctggagttggatttcaactactgcgagggcaccacggtcgtgatcaccgagaactgcgggacgcggggcccgagcctccgcaccacgaccgtctccggcaagctgattcacgagtggtgctgtaggagctgtacgctgcccccgctccgctacatgggcgaggatgggtgctggtacggcatggagatccggcccattaacgagaaggaggaaaacatggtgaagtcgctggtgagcgccggctccgggaaggtggacaactttaccatgggcgtcttgtgcctcgccatcctgtttgaggaggtgatgcgagggaaattcggcaagaagcacatgatcgccggtgtgctgtttacgtttgtcctcctgctgagcggccagatcacctggcgggatatggcgcacaccctcatcatgatcgggtccaacgccagcgaccgcatggggatgggcgtgacctacctggcactgattgccacgttcaagatccaacccttcctcgccctgggatttttcctgagaaaactcactagccgagagaacctgctgctcggcgtcggcttagcgatggccaccaccctccagctccccgaggacatagagcagatggcaaacgggattgccctgggtctgatgacgttaaagctgataacgcagttcgagacctaccagctgtggacagcactcgtaagcctgacgtgctcaaacaccatcttcaccctaaccgtggcctggcggactgccaccctcatcttggccggagtctccctgctcccgctgtgccagagctccagcatgcgcaagaccgactggctgcctatgaccgtggccgcgatgggcgtgcccccgctaccgctgttcatcttctccctgaaggatacgcccaaaaggcgctcctggcccctaaatgaaggcgtcatggcagtgggtctagttagcattctggccagctctttactgcgcaatgacgtgcccatggccggcccgctggtcgcgggggggctcctcattgcgtgttacgtcataaccgggacctccgccgacctgaccgtcgagaaggccgccgacgtgacgtgggaggaagaggctgagcagaccggcgtctcccacaatctcatgatcaccgtcgacgatgatgggaccatgcggatcaaggacgacgagacagaaaacatcctcacggtgctgctcaagaccgcgctgctgatcgtgagcgggatcttcccctactccatccccgccacgttgttagtctggcacacctggcagaagcagactcagcgcagcggagttctatgggacgtgccctccccgcccgagacccaaaaggccgagctcgaggagggcgtctaccggattaagcagcaaggcattttcggcaagactcaagtgggtgtgggggtccagaaggagggcgtattccacaccatgtggcacgtgacgcggggtgccgtcctgacccacaacggtaagcggctggagcccaactgggccagcgtgaagaaggacctcatctcctacggcggcggctggcgcttatctgcgcaatggcagaagggggaggaggtacaagtcatcgcagtggagcccggcaaaaacccgaagaacttccagaccatgcccgggatattccagaccacaacgggggagatcggcgctatcgccctggattttaagccggggacaagcggatccccgattataaaccgggagggcaaagtcgtggggctgtatggaaatggagtagtgaccaagaacggcgggtacgtgtctggtatcgcacaaaccaacgctgagcccgacggtccgacccctgagctcgaggaggagatgttcaagaaaaggaacctgaccattatggacctgcaccccgggtccggaaagacccggaagtacctaccagccatagtgcgcgaggccatcaaacggagactgcggacgctgatactcgcccccacccgcgtggttgcggccgagatggaggaagctctgaaggggttacccatccggtatcagaccaccgccacaaaaagcgagcacaccggacgcgagatcgtggacctcatgtgccatgccaccttcactatgcgactactgtccccggtgcgcgtgcccaactataacctcgtcataatggacgaggcgcactttacggaccccgccagcattgccgcccggggttacatctccacccgcgtggggatgggcgaggctgctgccatctttatgaccgccacgcctcccgggacagcggacgcgttcccgcaaagcaacgcccccatccaggatgaggagcgggacatccccgagcgctcctggaatagcggcaatgagtggatcacggacttcgctgggaagaccgtctggttcgtgccctctatcaaggccggcaatgacatagccaactgtttacggaaaaacgggaagaaggtgatccagctaagccggaagacattcgatacggagtaccagaagaccaaactcaacgactgggacttcgtcgtgaccaccgatatctccgagatgggtgcgaactttaaggcagaccgcgtgatcgacccccgaaggtgcctgaaacccgtcatcctaactgacggccccgaacgggtgattctcgccgggccgatgcccgtgaccgcggccagcgcggcccaacgacgcggccgggttgggcggaacccacaaaaggagaacgatcagtacatcttcaccggccagcccttgaacaacgacgaagatcacgcccactggaccgaggccaaaatgctgctcgacaacattaatacccccgagggtatcatccccgccctgttcgaaccggaaagagagaagagcgccgcgatcgacggcgagtatcgcctgaagggcgagagccgcaaaactttcgtggagctaatgcggaggggtgatctgcccgtctggctggctcacaaagttgcctccgaaggcatcaagtacaccgatagaaaatggtgtttcgacggggagaggaacaaccaaatcctggaggagaacatggacgtcgagatttggaccaaggagggcgagcggaagaagctccgcccgcgatggctcgacgcacggacctacagcgatccgttagctttgaaagagttcaaggacttcgcagcgggccgcaagtctatcgctctggacttggtcacggagatcgggcgagtgcccagccacctggctcaccgcacccgcaacgcactcgataacctcgtgatgctccacacctctgagcatggcgggcgtgcctaccggcatgccgtcgaggaactgccggagactatggagacattgctgctgctcggcctgatgatcctgttgaccgggggcgccatgttgttcctgatctccggcaagggtatcggcaagacctccataggcctcatctgcgttatcgtgagcagcggcatgctgtggatggccgacgttcccctgcagtggatcgcatccgccatcgtcctcgagttcttcatgatggtcctgctgatccccgagccggagaaacagcgcaccccgcaggacaaccagctcgcgtacgtcgtgataggtatcctgacactggctgcaatcgtcgccgccaacgaaatgggtctcctggagaccacaaagcgggacttgggcatgagcaaggagccaggggtcgtttcccctaccagctacctggacgtggacctccaccccgcctctgcctggacactgtacgcagtcgccactacagtcataaccccaatgcttcgccataccatagagaacagtaccgccaacgtgtccctggccgcgatcgccaatcaagccgtagtgctgatgggtctcgataaggggtggccgataagcaagatggacctgggggtgcccctgctcgccctggggtgctactcccaggtcaaccctctgaccctcaccgccgcggtgctgctgttggtaacgcactacgccattatcggccccggcctgcaggccaaagccacccgagaggcccagaagcgcaccgcggccggtatcatgaagaatcccaccgtcgacgggatcatgacgatcgacctggaccccgtgatctacgacagcaagttcgagaagcagttaggacaggtgatgctgttagtactctgcgccgtgcagctgttactcatgcggacctcctgggccctgtgcgaggcactgacccttgcgactggccccatcacaacgctgtgggagggcagcccagggaagttctggaacaccacgatcgctgtgtccatggccaatatcttccgcggcagctaccttgccggcgccggcttggccttctccatcatgaagtcggtcgggacgggccgtcgcggcaccgggtcacagggagagaccctgggggagaagtggaagaaaaagctgaaccagctcagtcggaaggagttcgacctctacaagaagtctggcatcaccgaggtggacagaaccgaagccaaagagggcctgaagcggggcgaaacgacccaccatgccgtaagtcgcggctcggccaagctccagtggtttgtagagcgtaacatggtgatccccgaggggcgcgttatcgacctgggctgcgggcggggcgggtggtcctattactgcgctgggctaaagaaagtcaccgaggtgcgcggctacaccaagggtgggcccgggcacgaggagcctgtgccgatgagcacgtacggttggaacatcgtaaaactcatgtccggcaaggacgtgttctacctgccgcctgagaagtgcgacaccctgttatgtgatatcggggagagctccccctccccgacggttgaagagtcccgcaccatccgggtcttaaagatggtggagccctggctccgcaacaaccagttctgcatcaaggtgctgaacccgtacatgcccacggtcattgaacacctcgagcgcctgcaacgaaagtacggcgggatgctggtgcgcaacccgctctcacgcaactccacccacgagatgtactggataagcaacgggaccgggaatatcgtctcttcagtcaacatggtgtcacggctactgctcaatcgcttcacgatgacgcaccggcgccccaccatcgagaaggacgtcgacctgggcgccggaacccggcacgtgaacgctgagcccgagacaccgaacatggacgtgatcggcgagcgcatcaagcgaatcaaggaggagcatagctccacgtggcactatgatgacgagaacccctacaagacatgggcctaccacggcagctacgaagtcaaggcaaccggttcggcctcctctatgatcaatggcgtggtgaagctactgaccaagccctgggatgtggtccccatggtgacgcagatggccatgaccgacaccaccccgttcgggcagcagcgcgtcttcaaggagaaggttgacactagaacgccccgtcccatgcccgggacccgaaaggtgatggagataaccgcagagtggttgtggagaacgctgggccgaaacaagaagccgcgcctctgcactcgcgaggagttcaccaagaaggtccgcaccaacgccgccatgggcgcggttttcacagaggagaaccagtgggactccgcccgcgccgctgtggaggacgaggagttctggaagctggtcgaccgggaacgcgaactgcacaagctcggcaagtgcgggagctgcgtgtacaacatgatgggaaagagagagaagaagctaggcgagttcggcaaggcgaagggctcacgcgccatctggtacatgtggcttggggcgcggtacctcgagttcgaggccctgggcttcctgaatgaggaccactggttcagccgcgagaacagttactccggggtggaaggtgaagggcttcacaagctgggctacatcctcagggacatttccaagatccccggaggggctatgtacgcggacgacaccgccggctgggacacgcgcatcacggaggacgacctgcacaacgaggaaaagatcacgcaacagatggatcccgagcaccggcagcttgccaacgcgatcttcaagttaacctaccaaaataaggtggtgaaggtgcagcgccccaccccgaaggggaccgtcatggacattatcagccggaaggaccagcgcggctcgggtcaggtggggacctacggcctcaacacgttcaccaacatggaggctcagttggtgcggcagatggaaggggagggcgttctgagcaaggcggacctagagaaccctcacctcctggagaagaaaatcacccagtggttagagacaaagggggtggaaaggctgaagcggatggccatctccggcgacgattgcgtcgtcaagcccatcgacgataggttcgcaaacgccctgctcgcgctaaacgacatgggcaaagtgcggaaggatattccccaatggcagccgagcaaggggtggcacgactggcagcaggttcccttctgctcccaccacttccacgagctaatcatgaaggatgggcgtaagctcgtcgtgccctgccggccgcaggacgagcttatcgggcgcgcgcgcatttcgcaaggcgctggctggtccctgaaggagacagcgtgcctcggcaaggcctacgcccagatgtggagccttatgtacttccacaggcgggacttgaggcttgcgtccaatgcgatctgcagcgccgtgccggtccactggatccccacaagcaggaccacctggtccatccacgcacaccaccagtggatgacgaccgaggacatgctgacagtatggaatcgggtgtggatcgaggacaacccctggatggaggacaagacccccgtcacaacctgggaagacgtgccgtacctgggcaagcgggaagaccagtggtgcgggagcctcataggcctgacctctcgggcgacatgggcacagaacatcctgacggccatccagcaagtcagaagcctcatcggggacgaagagttcctggactacatgcccagcatgaagcggttcaggaaggaagaggagagcgagggagccatctggtga

SEQ ID NO: 25784 - RNA, 9873 nt, synthetic construct
  misc_feature 1..9873: note = derived and/or modified CDS sequence (opt11) from DENV-3__FJ898463__SS-prME
  source 1..9873: mol_type = other RNA
accagcctctgcctcatgatgatactgcccgccgctctggcgttccacctcaccagccgggatggggagccgcggatgatcgtggggaagaacgaacggggtaagtcgctgctcttcaaaaccgccagtgggatcaacatgtgcacactcatcgccatggacctcggagagatgtgcgacgacaccgtgacctataagtgtccccacatcaccgaggtggagcctgaggacatcgactgctggtgcaacctgaccagcacctgggtgacctacggaacctgcaaccaggccggagagcacagacgcgacaagcggtccgtggccctcgcgccgcacgtaggcatggggcttgacacgcggacccaaacctggatgagcacggaaggagcatggcgccaagtcgagaaggtggaaacctgggccctgcgccacccggggttcactatacttgccctgtttctggcgcactacatcggcacctccctcacgcagaaggtcgtcatcttcatactgctgatgctcgtcacacccagcatgaccatgcggtgcgtgggggtaggaaaccgcgacttcgtggagggcttgagcggcgccacctgggttgacgtggtcctggaacatggcgggtgcgtgacaactatggctaagaacaaacccaccctcgacatcgagctgcagaagaccgaggccacgcagctggccaccttgcgcaagctgtgcatagaaggcaagatcaccaacattactacggacagcagatgtcccacgcagggtgaggcagtgctgccggaggagcaggaccagaactacgtgtgcaagcatacctacgtcgaccgggggtggggcaacggatgcggcttattcgggaagggctccctggttacctgcgcaaaattccagtgtctggagccgatcgagggcaaggtagtgcagtacgagaacctaaagtacacggtcataatcaccgttcacaccggcgaccagcaccaggtgggtaacgagacccagggggtcacggccgagatcactccccaggcctccaccaccgaggcaatcttgcccgagtacggcaccctgggcctcgagtgctccccacgcacgggcctggacttcaacgagatgatccttctcaccatgaagaacaaggcctggatggtacaccggcagtggttcttcgatctgcctctgccctggacaagcggggccaccaccgagactcccacctggaaccggaaggagttactggtaaccttcaagaacgcccacgccaagaagcaggaagtggtggtgctggggtctcaggagggcgccatgcacacggctctcaccggtgctacagagatccagaacagcggcgggacctccatcttcgctggccacctaaagtgccggctgaagatggataaattagaactgaagggcatgagctacgcgatgtgcacgaataccttcgtcctgaagaaggaggtgtccgagacccaacacgggaccatactcatcaaggtggagtacaagggcgaggacgccccgtgtaagattcccttctcaactgaggacgggcagggcaaagctcataacggcaggctgattacagcaaaccctgtcgtaaccaagaaggaggagccagtgaacatcgaagcagagccgccctttggggagagcaacatcgtcatcggcatcggggacaatgccctcaagataaactggtacaagaaagggtcctcgatcgggaagatgttcgaggcaaccgcaagaggcgcacgccggatggccatcttgggcgatacggcctgggacttcgggtccgtggggggggttcttaacagcctggggaagatggtccaccaaatcttcggtagtgcctataccgccctcttcagcggcgtgtcctgggtgatgaagatcgggatcggggtcctcctcacctggatcggcctgaatagcaagaacacttccatgagcttctcctgtatcgcgattgggatcatcacgctctatctgggcgccgtggttcaggctgacatgggatgcgtgatcaactggaagggtaaggagttgaagtgtggctccgggatcttcgtgaccaacgaggtgcacacctggaccgagcaatataagttccaggcggactcccctaagcgcctcgccacggccattgccggcgcctgggagaacggggtctgcggaatccgcagcaccaccaggatggagaacctgctgtggaagcaaatcgccaacgagttgaattacatcctgtgggaaaataatattaaactgaccgtggtcgttggggacataatcggcgtgctcgagcaaggcaagcgcactctgacgccacagccgatggagctgaagtactcttggaagacgtgggggaaagccaagatcgttaccgcggagacacagaacagttctttcatcatcgacggccccaacaccccagaatgccccagcgcctccagggcgtggaatgtctgggaggtggaggactacgggtttggcgtgttcaccacgaacatctggttaaagttacgcgaagtatacacccaactgtgcgaccaccggttaatgagcgctgccgtaaaggatgaacgcgccgtccatgcagacatgggatattggatcgagtcgcagaagaacgggtcttggaagctggaaaaggcgagcctgatcgaggtgaagacgtgcacctggccgaaatcccacacgctctggagcaatggcgttctggagtccgacatgattattcccaagagcctggccgggcccatctcacagcacaaccacaggccgggctaccatacccaaacggccggcccctggcacctcggcaagcttgagctggacttcaactactgcgagggcaccaccgtggtcatcactgagaactgcgggacgcgcggtcccagcttgcggaccactaccgtgtccgggaagctgattcacgagtggtgctgccggagctgcacgctgcccccactccggtacatgggagaggatggctgttggtacggaatggagatccggcccatatccgagaaggaggagaatatggtcaagtcgttggtatccgccggcagcgggaaagtggacaacttcaccatgggcgtgctatgcttagcaatcctgtttgaggaagtcatgcgggggaagttcggtaagaagcacatgatcgcgggggtgttcttcaccttcgtgctgctcctatccggacaaatcacctggcgcgacatggctcacaccctgatcatgatcggtagcaacgcgagtgaccggatggggatgggcgtcacctacctagccttaatcgccaccttcaagatacagcctttcctggcgttagggttcttcctgcgcaaactaaccagccgcgaaaacctcctgctaggcgtgggactggccatggctacaacccttcagctgcctgaggacatcgaacagatggcgaacgggatcgcgctcggcctgatggccttaaaactaatcacccagttcgagacataccagctgtggacagccctaatcagcctaacctgcagcaataccatgttcactctaacagtggcatggcgcaccgccaccctgatactggcgggggtgagcctgctgccggtgtgccaaagtagctccatgaggaaaaccgactggctacccatggcggtcgccgccatgggcgttccgcccctcccgctgttcatcttcagcctcaaggacacactgaagcgccgctcctggcccctcaacgagggggtaatggccgtcggcctcgtgagcatcttagcgagtagcctgctcagaaacgacgtgccaatggccggccccctggtcgccggcggactgctcatcgcctgctacgttatcaccgggacgtccgccgacctgactgtagaaaaggctgccgatatcacgtgggaggaggaggcggagcagacgggcgtcagccacaatctgatgatcaccgtggatgacgacggcaccatgcggatcaaggacgacgagaccgagaacatcctcacggtcctgttgaagaccgccctcctgatcgtctccggagtgttcccgtacagcatccccgccacgctgctcgtgtggcacacttggcagaaacagactcagcgtagcggggttctgtgggatgttcccagcccgcccgagacccagaaggctgagctggaggagggggtgtatagaatcaagcagcaaggcatctttgggaagactcaggtcggggttggggttcagaaggagggagtcttccacacaatgtggcacgtgacccggggtgccgtgctcacctacaacgggaagcgcttagagcccaactgggcttccgtaaagaaggatctgattagctacggcgggggttggcggctctccgcccagtggcaaaagggtgaagaagtccaggtgatcgccgtagagcccgggaaaaaccccaagaacttccaaaccatgcccggcaccttccagacgaccacgggcgagatcggcgccatcgccctggatttcaagcccgggaccagcggcagccccattatcaaccgcgagggcaaggtggtcgggctgtacggcaacggggtcgtgacgaagaacgggggatacgtgagtggcatcgcccagacgaacgcagaaccggacggtccgactcccgagcttgaggaggagatgttcaagaagcgtaacctcaccattatggacttgcatccagggagcggcaagacgcgcaaatacctgcctgcgattgtccgagaggcaatcaagagacggctccgcaccctgattcttgcccccaccagggtggtcgccgccgagatggaagaggcgctcaagggtctccctatccgctatcagaccacggccactaagtccgagcatactggacgggaaatcgtcgacctgatgtgccacgctaccttcacgatgcgcttgttatcgccagtgcgggtgccgaactacaatctcattatcatggacgaggcgcacttcactgatcccgcctccatcgcggcccgcggctatatatcaacgcgggtcggcatgggcgaggccgccgcgatcttcatgactgccacgccgcccgggacagccgacgcattcccgcagtccaacgcccccatccaagacgaagagcgcgacatccccgagcgcagctggaactccggcaatgagtggattaccgatttcgcgggtaagaccgtgtggttcgtgcccagcattaaggccggcaatgacatcgccaactgcctccggaagaacgggaagaaggtcatccagttgtcccgcaagacgttcgacaccgagtaccaaaagaccaagctgaacgactgggacttcgtggtgaccacggacatcagcgagatgggcgccaactttaaggccgaccgggtaatcgacccgcgccggtgtctcaagcccgtgattctgacggacgggccggaacgtgtcatcctggcagggcccatgccggtcaccgcagcgtccgctgcccaacgacgtggccgggtggggcgcaacagccagaaggagaacgaccaatacatcttcaccggtcagcccctaaacaacgacgaggatcacgcccactggacagaggccaagatgctactggacaacatcaacacgcccgaggggataatccccgcacttttcgaaccggaacgtgagaagtccgccgcgatagacggcgagtaccgcctgaagggcgagagccgaaagacttttgtggaactgatgcgccgcggggacctacccgtctggctggcgcataaggtggcctccgagggaatcaagtacaccgatcgcaaatggtgcttcgatgggcagaggaacaaccaaatccttgaagagaacatggacgtcgaaatctggaccaaagaaggcgagaagaagaagctccgcccacggtggctggacgcccgcacgtacagtgatcccctggccctcaaggagttcaaggatttcgcggccggtcgaaaatccattgccctggatctggtgacagagattggacgggtgccgagccacctcgcccatcgtacccggaacgcacttgacaatctggtcatgctccacaccagcgaacatggcggccgcgcgtaccggcacgcggtcgaggagctgcccgagacgatggagacccttcttctgctggggctcatgatacttttaaccggaggcgcgatgctgttcctgatctccggcaaaggtatcggcaagaccagcatcgggctgatctgcgtgattgcctccagcggcatgctctggatggccgagatcccccttcagtggatcgcgtccgccatcgtcctggagttcttcatgatggtgctcctgatcccggagcccgagaaacagaggactccacaggacaaccagctggcctacgtggtcatcggtatcctcaccctggccgccatcatcgcggcgaatgagatgggcctgctcgagaccaccaagcgcgaccttggcatgtcaaaagaaccaggtgtggtttccccaacgagctacctggacgtcgacctccaccctgcctccgcctggaccctgtacgcggtagccacaaccgtcataactcccatgctccgccacactatagagaacagtaccgccaacgtctccctcgccgccatcgccaaccaggccgtcgttctgatggggctggacaaggggtggcccatcagcaagatggacctcggcgtgcccctgctggccttgggatgctactcccaagtgaatcccctgaccctgacggctgccgtgctgctgttgatcacccactacgcgatcatcgggcctggcctccaggcaaaggccacgcgggaggcccagaagagaaccgcggcgggaatcatgaaaaaccccacggtcgacggcattatgacaatagacctggatccggtgatctatgatagcaagttcgaaaaacaactgggccaagtaatgctcttagtcttgtgcgccgtgcagctccttctgatgcggacctcctgggccctttgcgaggccttgaccctagctacgggccctatcaccacactgtgggagggcagcccggggaagttctggaacaccacgatcgccgtgtcgatggccaacatcttccgaggcagctacctcgccggggccggcctggcgttttccatcatgaagtccgtaggaaccggcaagcgcggtaccgggagccaaggcgagaccctcggggagaagtggaagaagaagctgaaccagctttcccgcaaggaattcgacctctacaaaaagtcaggcattaccgaggttgaccggacggaggccaaggaggggctgaagaggggcgagaccacccaccacgctgtctcgcgggggagtgctaagctgcagtggttcgtcgagaggaacatggtgatccccgaggggcgggtgatcgacctcgggtgtggacgcgggggttggagctactactgcgctggactgaagaaggtgaccgaggtgcgaggctacacaaagggagggccagggcacgaggaacccgtgccaatgagcacctacggctggaacatcgtaaagctgatgagtgggaaggatgtgttctacctcccgcccgagaagtgcgacaccctgctgtgcgacatcggcgaaagctcccccagccccacagtggaggagagtcgcacgatacgcgtactcaagatggtagagccctggctcaagaacaaccaattctgcatcaaggtcctgaacccctacatgcccaccgtcattgagcacctggaaagattgcagcgcaagcacggcgggatgctggttaggaaccctctgagccgtaactccacccacgagatgtactggatctcaaatgggacaggcaacatcgtggcttccgtcaacatggtaagccgcctcctgctgaatcgcttcacgatgacccacagacgcccgaccatcgaaaaagatgtagacctcggagccggaacaaggcacgtcaacgccgagccggaaacgcccaatatggacgtgatcggggaacgcattaagcggatcaaggaggaacacaactcaacctggcactacgacgacgagaacccgtacaagacttgggcctatcacggcagctacgaggtgaaggccaccgggagcgcgagctctatgatcaatggcgtcgtgaagctccttacgaaaccgtgggacgtcgtgcccatggtgacgcagatggcaatgaccgacaccactcccttcgggcagcaaagggtctttaaggaaaaggtggacacccgcacgcccagatccatgccgggcacgcggcgcgtaatgggcatcacggccgaatggctctggacgaccctggggcggaacaagaagccccgcctgtgcaccagagaggagttcacaaagaaggtccgcaccaacgccgcgatgggcgccgtattcacagaggaaaaccagtgggatagcgccaaggccgccgtggaggacgaggacttctggaagctcgtcgaccgcgagcgggagctgcacaagctggggaagtgtggctcttgtgtgtataacatgatggggaagcgcgaaaaaaagctcggtgagttcggcaaggcgaagggtagccgggccatctggtatatgtggctgggcgctcgctacctagagttcgaggccctcgggttcctgaacgaagaccactggttcagccgcgagaacagctactctggcgtggagggtgagggcttacacaagctcggctacatactgcgcgacatcagcaagatccccggcggggctatgtacgccgacgacacagcagggtgggacacacggatcacagaggatgacctgcacaacgaggaaaagatcacccagcagatggaccccgaacaccgccagctcgctaacgccatttttaaactgacataccaaaacaaggtcgtgaaggtgcagaggccgactccgacgggcaccgtcatggacatcatctcccgcaaagaccaacggggatcaggtcaagtgggcacctacgggctgaacacttttactaacatggaggcgcagttgattcgtcagatggaaggcgagggggtgctgagcaaggcggatctggagaacccccacctccccgaaaagaagatcacccaatggctggaaaccaagggcgtcgaaaggcttaagcgaatggccataagcggcgacgactgtgtggtaaagccgatcgatgaccggttcgccaatgcgctccttgccctgaacgacatggggaaggtacgcaaagacattccccagtggcaacccagcaagggctggcacgactggcagcaggtccccttctgttctcaccacttccacgagctcatcatgaaggatggtcggaaactggtggtcccttgccgcccccaggacgaactgatcgggcgggcgcgcatctctcagggagccggctggagcctccgtgaaaccgcctgcctgggaaaggcctacgcgcagatgtggtcgctaatgtacttccaccgccgcgacctaagactagcaagcaacgccatctgctccgccgtgccggtgcactgggtccccacgagcaggaccacgtggtcaattcacgcccatcaccagtggatgacgactgaggatatgctgaccgtgtggaatcgggtgtggatcgaggataacccatggatggaagacaaaacgcccgttaccacgtgggagaacgtgccctatctgggtaagcgcgaggatcagtggtgcggctccctgattgggctgacctctcgggccacctgggcacagaacatcccgactgcaatccagcaagttcggtccctcatcggcaacgaggagttcctagactacatgccctccatgaagcgcttccgcaaagaggaagagtcagagggggccatctggtga

SEQ ID NO: 25785 - RNA, 9873 nt, synthetic construct
  misc_feature 1..9873: note = derived and/or modified CDS sequence (opt11) from DENV-3__GQ868616__SS-prME
  source 1..9873: mol_type = other RNA
accagcctctgcctcatgatgatcctgcccgcagccctggcgttccacctcacctcgcgggacggggagccacggatgatcgtcggcaaaaatgagcgcggtaagagcctgctgttcaagaccgccagcgggatcaacatgtgcaccctcatcgccatggatctgggggaaatgtgtgacgacaccgtgacatacaagtgcccacacatcaccgaggttgagcccgaggacatcgactgctggtgcaatctgaccagcacttgggttacctacgggacgtgtaatcaggccggcgagcaccggcgcgacaagcggtccgtagccctcgcacctcacgtgggcatggggcttgacacccgcacccagacctggatgagcacggagggcgcctggcgccaggtggagaaggtggagacgtgggccctgcgccaccctgggttcaccatcctcgccctgttcctggcgcactatatcggcacctccctcacgcagaaggtggtgatcttcatcttgctgatgctcgtgacccccagcatgaccatgagatgcgtgggggtcggcaaccgagatttcgtcgagggcttatccggggccacctgggtggacgtggtcctggagcacggcgggtgcgtgacgaccatggccaaaaacaagcccaccctcgacattgagttacagaagaccgaagcgacgcagctggccaccctccggaagctgtgcatcgagggaaagatcaccaacatcaccacggacagtcggtgccccacccaaggcgaggcggtgctgccggaggagcaagaccagaactatgtctgcaagcacacctacgtggacagaggttggggcaacgggtgtggcctcttcggcaagggcagtctggtgacctgcgccaagtttcagtgcctggaacccatcgagggtaaagttgtgcagtacgagaacctgaaatacacggtgatcatcactgtccacaccggggaccagcatcaagttggcaatgagacacagggggttacggccgagatcacaccccaggccagcactacagaggccatactgcccgagtacggcaccctggggctcgagtgctccccgcgcacgggtctggattttaacgagatgatcctgctcaccatgaagaacaaggcatggatggttcaccggcagtggttcttcgacctgcccctaccctggacctcgggggcgaccacggagaccccgacctggaaccgaaaggagttgctggtgaccttcaagaacgcccacgccaagaagcaggaggtcgtggtactggggtcccaagagggagccatgcacacagcgctcacgggagccaccgagatccagaacagcggcgggacatccatcttcgccggccacctgaagtgccggttaaagatggacaagctggagctgaagggcatgagctacgccatgtgcactaacaccttcgttctgaagaaggaggtgtccgagacccaacacggaaccatactcatcaaggtggagtacaagggcgaggacgccccgtgcaagattcccttcagcacggaggacgggcagggcaaagcccacaacggtcgcctgatcaccgccaaccccgtcgtaaccaagaaggaggagccggtgaacatcgaggccgagccgcccttcggggagagcaacatcgtcatcggtatcggggacaacgcactgaagatcaactggtacaagaaaggctcaagcatagggaaaatgttcgaggcgaccgcccggggagcgaggaggatggccatcctgggcgacacggcatgggacttcgggtctgtcggcggggtgctcaactcactaggcaagatggtccaccagatcttcgggtccgcgtacaccgccttattcagcggcgtgtcctgggtgatgaaaatcggcatcggagtactcctgacctggatcggtctgaacagcaagaatacctctatgagtttctcctgcatcgccatcgggatcatcactctctacctgggtgccgtggtgcaggcagacatggggtgcgtcatcaactggaagggcaaggagctgaagtgcggctcagggatcttcgtgaccaacgaggtgcacacctggaccgaacagtacaagttccaggctgactcccccaagcggctcgccacggccatcgccggggcctgggagaacggggtctgcgggatccgctcaacaacccggatggagaacctgctgtggaagcagattgcgaacgagctcaactacatcctgtgggagaacaacatcaagctgaccgtggtggtcggagacatcatcggcgtgctcgagcagggcaagcgcacgctgacgccccagccgatggagctgaagtactcttggaagacctgggggaaggccaagatcgtgactgccgagacgcagaacagcagcttcatcatcgacggccccaacacccccgagtgccccagcgcctcccgggcgtggaacgtatgggaggtagaggattacgggttcggcgtgttcaccaccaacatatggctcaagctgcgcgaagtctacacccagctgtgcgaccaccggctcatgagcgcagccgtgaaagacgagcgcgccgtgcacgccgacatgggctactggatcgagagccaaaagaacgggagctggaagctggagaaggcgagcttaatcgaggtcaagacgtgcacatggccaaagtcccacaccctctggagcaacggcgtgctggagagtgacatgatcatccccaaaagcctggcggggcccatttcccagcacaaccaccggccgggttatcatacccagacggccgggccctggcacctcggtaaactcgagctggacttcaactactgcgaggggaccacggtggtcatcaccgagaactgcgggacgcgcgggcccagcctccggaccaccaccgtgtccgggaagctgatccacgaatggtgctgccggagctgtacgctgccgccgctccggtacatgggcgaggacgggtgctggtacggcatggagatcagaccaatatccgagaaagaggagaacatggtcaagagcctagtctccgccggcagcgggaaggtggacaacttcaccatgggcgtgctgtgcctcgccatcctcttcgaagaggtcatgcgggggaagttcggcaagaagcacatgatagcgggagtgttcttcaccttcgtgttactcctgtcaggccagatcacatggcgcgatatggcccatacgctaatcatgatcgggagcaacgctagcgaccggatgggcatgggcgtcacctacctcgccttaatcgccacctttaagatccagcccttccttgcgctcgggttcttcctgcgcaaactgacttcacgggaaaacctcctgctgggtgtgggcctcgccatggccacgactctgcagctgccagaggacatcgagcaaatggccaatgggatcgcgctcggcctaatggccctgaagctcattacgcagttcgagacctaccagctgtggactgctctgatcagcctgacctgcagcaacacaatgttcactctgacggtcgcctggcggaccgccaccctaatcctcgcgggggtctctctgctgccggtgtgccagtcgagcagtatgcggaagaccgactggctccccatggccgtcgccgccatgggcgtgccgcccctcccgctgttcatcttcagtctcaaggacacgctgaagcgccgatcctggccccttaacgagggggtgatggctgtcggcctcgtgagtatcctggcgtccagcctgctccggaacgacgtgcccatggccggccccctggtcgccggtggcctcctcatcgcctgctacgtgattaccggcacctccgccgatctgaccgtggaaaaggcggccgacatcacgtgggaggaagaggctgagcaaaccggcgtcagccacaacttgatgatcaccgtggacgacgacggtacgatgcgcatcaaggacgacgagacggagaacatcctcacggtgctgctgaagaccgccctcctgatcgtctccggcgtgttcccgtactcaatccccgccaccctgctcgtgtggcacacctggcagaagcagacgcagcggtccggcgtcctgtgggacgtgcccagcccgcccgagacccaaaaggcggagctggaggagggggtctataggatcaagcagcagggcatcttcgggaaaacccaggtcggcgtgggtgtccagaaagagggcgtgttccataccatgtggcacgtgacgcggggcgcagtgctcacatacaacgggaagcgcctggagcccaactgggccagtgtcaagaaggatctgatcagctacggagggggctggcggctctccgcccagtggcagaagggggaggaagttcaggtgatcgcggtcgagcccggcaagaatcccaagaacttccagaccatgcccggcaccttccagacgaccactggggagatcggcgccatcgccctggacttcaagcccgggaccagcggttctcccatcatcaaccgcgagggcaaagtggtggggctttatggcaacggggtcgtgacgaagaatggcgggtatgttagtggtatcgcccaaaccaacgccgagccggacggccccacccccgagctagaagaggagatgtttaagaagcggaacctcacgatcatggaccttcatcccgggagcggcaagacgcgcaagtacctgcccgcgatcgtacgggaggccatcaagagacggttgcgcaccctgatcttggccccaacccgtgtagtagccgccgagatggaggaggcgctcaagggattacccatccgctaccagaccactgccaccaagtcggagcacaccggccgggagatagtcgacctgatgtgccacgccaccttcacgatgcgcctcctgagccccgtgcgggtaccaaactacaacctgatcatcatggacgaggcccacttcaccgaccccgcctccatcgcggcacgcgggtacatcagcacacgggtcggaatgggcgaggccgccgcgatcttcatgaccgccacgccgcccgggacagccgatgcattccctcagtccaacgcccccatccaggacgaggaacgggacatccccgagcgcagctggaactccggcaacgagtggataaccgacttcgcggggaagaccgtgtggttcgtgccctcaatcaaggccgggaacgacattgccaactgcctccggaagaacgggaagaaggtcatccagctgtcccgcaaaaccttcgacaccgaataccagaaaaccaagctgaacgattgggacttcgtggtgaccaccgatatcagcgagatgggcgccaatttcaaggcagaccgagtcatcgacccccgccggtgcctgaagcccgtgatcctaacagacggtcccgagcgcgtaatcctcgcggggcccatgccggtcaccgccgcctccgctgcccagcggcgcgggcgggtggggcgcaactcccagaaggagaacgaccagtacatcttcaccggccagccccttaacaatgacgaagaccacgcgcactggaccgaggccaagatgctgctggacaacattaacacgcctgaagggatcatccccgccctcttcgagccggagcgggagaaatccgccgcgatagacggcgaataccgcctgaagggcgagagccggaaaaccttcgtggagctgatgcgcagaggggatctgcccgtctggctggcccacaaggtggcctccgaaggcatcaagtacaccgaccgaaaatggtgcttcgacggacagcggaacaaccaaattctggaggagaacatggacgtcgagatctggacgaaggagggggaaaagaagaagctccgaccccggtggctagacgcgcgcacgtacagcgaccccctggccctcaaggagttcaaggacttcgcggccgggcgcaagtccatcgccctggacctggtgaccgagatcggccgggtaccgagccacctcgcccaccgcacccggaacgccctggacaacctggtgatgctccacaccagcgaacacggcgggcgcgcgtaccggcacgcggtcgaagagctgcccgagacgatggagaccctgctcctgctaggcctcatgatcctgcttactgggggcgccatgcttttcctgatctctggcaaggggatcggcaagaccagcatcgggctgatctgcgtgatcgcgtccagcggcatgctctggatggccgagatccccctgcagtggatcgcgtccgccatcgtcctggagttcttcatgatggttctcctgatcccggagcccgagaagcagcgcacgccccaggacaatcagctggcctacgtagtcatcggtatcctcacactggccgccatcatcgcggccaacgagatggggctgctcgagaccaccaagcgggacctgggcatgagcaaggagcccggggttgtgtccccgacgagctacctcgacgtcgacctgcatcccgcttccgcctggaccctgtacgcggtggcaaccacggtgatcacgcccatgctgcgccacacaattgaaaacagcaccgccaacgtctccctcgcggccatcgctaaccaggccgttgttctgatggggcttgataagggatggcccatcagcaagatggacctgggagtcccgctgctggccctcgggtgctactcgcaggtgaaccccctgaccctgacggccgccgtgctcctgctgattactcactacgcgatcatcggccccggcctccaggccaaggccacccgggaggcgcagaaaagaacggcagcggggatcatgaagaaccccacggtcgacggcatcatgaccatcgccctggacccggtgatatacgacagcaagttcgagaagcagctgggccaggtgatgctcctggtcctgtgcgcggtccagctcctgctgatgcggacctcgtgggccctctgcgaggcgctgacccttgccacgggccccatcacgaccctctgggagggcagcccagggaagttctggaacaccactatagccgtgtccatggctaacatctttcggggcagctacctggccggggcaggtctggccttctccatcatgaagtccgtgggtaccggcaagcgaggcaccgggagccagggcgagaccctcggggaaaagtggaagaagaagctgaaccagttgtcccgcaaggagttcgacctctacaagaagtcaggcatcaccgaggtggaccggacggaggccaaagaggggttaaagcgcggcgagaccacccaccatgccgtgtcccgaggcagcgccaagctgcagtggttcgtggagagaaacatggtgattcccgagggacgggtgatcgacctcgggtgcgggagaggcgggtggtcctactactgtgcggggctgaagaaggtcaccgaggtgcggggctacacgaagggcgggccggggcacgaggagcccgtgcccatgtccacctacggatggaatatagtcaagctgatgtccgggaaggacgtgttctacctcccgcccgagaagtgcgacaccctgctgtgcgacatcggcgagagctcgccctcgcccaccgtggaggagtcgcgcacgatccgcgtcctgaagatggtggagccctggctcaagaacaaccagttctgtattaaggtactgaacccctacatgcccaccgtcatcgagcacctggagcggctccaacgcaagcacggggggatgctggtacggaaccccctgagcaggaactccacccatgagatgtactggattagcaacggaaccgggaacatcgtggcatccgtcaacatggtgtcacggttactgcttaatcgcttcacgatgacccaccggcgccccacaatcgagaaggacgtggacctcggtgccgggactcggcacgtgaacgcagagccagagacgcccaacatggacgtgatcggggagcgcatcaagcgtataaaggaggaacacaactccacgtggcactacgacgacgagaatccctacaagacatgggcctaccatggaagctacgaggtaaaggcgaccggctccgcgagctctatgatcaatggcgtcgtgaagctgctgacgaagccttgggatgttgtcccaatggtgacccagatggccatgaccgacaccacacccttcgggcaacaaagggtcttcaaggagaaggtggacacccggacgccccggtccatgccgggcacccggcgcgtaatgggcatcactcccgagtggctctggcggcccctggggcgcaataaaaagccacggctgtgcccgcgcgaggaattcacaaagaaggtgcgcaccaacgctcccatgggcgcggtgttcaccgaggagacgcagtgggccagcgccaaggccgctgtggaggacgaggacttctggaaactcgtcgaccgggagcgcgagctgcataagctggggaagtgcggctcctgcgtgtataatatgatggggaagcgggagaagaagctcggggagttcggcaaggcgaagggcagccgcgccatatggtacatgtggcttggagcccgttacctggagttcgaggccttggggttcctgaacgaggaccactggttctcccgcgagaacagctactcgggcgtggagggtgagggcctgcccaagctcggctacatcctgcgggacatcagcaagatacccgggggggccatgtacgcggacgacaccgccgggtgggacacccgcatcaccgaggacgacctgcacaacgaggagaaaatcacacaacaaatggatcctgagcatcggcaactggccaacgccatcttcaaattaacctaccagaacaaggtcgtgaaggtgcagcgccccacccccaccggcaccgtcatggacatcatcagtcggaaggaccagcgcggctcaggccaagtgggcacctacggtctgaataccttcaccaatatggaggcccagctgatccggcagatggaaggcgagggggtgctttctaaagccgacctggaaaacccccacctcccggagaagaagatcacacagtggctggagacgaagggcgtcgagcgactgaagcgtatggccatcagcggcgatgactgcgttgtcaagcccatcgacgaccgcttcgccaacgccctcctggccctgaatgacatggggaaggtccggaaggacataccccagtggcagccctccaagggctggcacgactggcagcaggttccgttttgcagccaccacttccacgagctcatcatgaaggacgggcgcaagctggtggtcccctgccggccccaggacgagctgatcggcagggcgcggatcagtcaaggggccggctggagcctccgggaaaccgcctgtctgggcaaggcgtacgcgcagatgtggtccctgatgtacttccaccggcgggacctcagactggccagcaatgccatatgctccgccgtgcccgtgcattgggtccccacgagccggaccacttggagcatccacgcccaccaccagtggatgaccaccgaagacatgctcaccgtgtggaaccgcgtttggatcgaggacaacccatggatggaggacaaaactcctgtcaccacctgggagaacgtgccgtaccttgggaaacgggaggaccagtggtgcggctccctgatcgggctgacctcacgcgcgacgtgggcccagaacatccccaccgccatccagcaggtacggtccctcatcggcaacgaggagttcctggactacatgcccagcatgaagcgcttccggaaggaagaggagtctgagggtgccatctggtga

SEQ ID NO: 25786 - RNA, 9873 nt, synthetic construct
  misc_feature 1..9873: note = derived and/or modified CDS sequence (opt11) from DENV-3__GQ199887__SS-prME
  source 1..9873: mol_type = other RNA
accagcctgtgtctcatgatgatcctgcccgcagccctcgcatttcacctcacctcaagggacggggagccgcggatgatagttgggaagaacgaacgcggaaaaagcctactgttcaagaccgccagtgggatcaacatgtgcaccctcattgcaatggatctgggagagatgtgcgacgataccgtcacctataagtgcccccacataaccgaggtagagcctgaagacatcgactgttggtgcaaccttacctcgacctgggttacctacggtacgtgcaaccaggccggcgagcaccgacgcgacaaacggtcagtcgcccttgcaccccacgttggaatggggttggacacccgcacccagacctggatgtcggcggagggcgcctggcgtcaggtggagaaggttgagacttgggcgctgcggcatcccgggttcactatcttagcgctgtttctagcccactacattggcacctctcttacccagaaggtggttatcttcatcctgctgatgctagttacacccagcatgaccatgcggtgcgtcggggtgggcaatcgcgatttcgtcgagggtctgagcggagccacctgggtggacgtggtcctggagcatggagggtgcgtcaccacaatggcaaagaacaagcctacactcgacattgagctgcagaagaccgaggcaacccagctggcgacgctcaggaagctgtgtatagaggggaagataacgaacattacaactgacagccgctgccccacgcagggcgaagccgttctgcccgaggagcaggaccaaaattacgtctgcaagcacacatacgtggaccgggggtggggcaacgggtgcggcctattcgggaagggctccctggtcacgtgtgcaaagttccagtgcctggagtctatcgaaggcaaagtcgtgcaatacgagaacctcaaatacacggtaatcatcacagtgcacacaggggaccagcatcaggtgggcaacgagacgcaaggcgtcacggccgagatcacgccgcaagcctccacaaccgaggcgattcttcccgagtacggcacactggggctcgagtgctctccacgcactggcctggactttaatgaaatgatcttattaacgatgaaaaacaaggcctggatggttcaccggcagtggtttttcgatctcccgcttccctggacatccggcgccaccacggagacgcctacatggaatcgtaaagagctcctggtgaccttcaagaatgcccatgccaagaagcaagaagtcgtggtgctggggagccaggagggcgccatgcacaccgcactaaccggcgccacagagatccaaaactccggcgggacgagcatctttgcaggacacctgaagtgccgactgaagatggacaagctagagctgaagggcatgtcctacgccatgtgcaccaatacgttcgtcttaaagaaggaagtgtctgagacccagcacgggacaattctcgtgaaagtggagtacaaaggcgaggacgcgccctgtaaaatccctttcagcaccgaagacgggcaaggcaaggcccacaacggccgtctgataacggcaaatcccgtggtaactaagaaagaggagccggtaaacatcgaggctgagcctccgtttggggagtccaacatcgtgatcggtatcggggacaacgcacttaagatcaactggtacaagaaggggtcttctatcgggaaaatgttcgaggccaccgcccgcggcgcccgccggatggctatccttggcgatacagcgtgggactttgggtctgtaggtggggtcttgaactccctgggcaagatggtgcatcaaatctttgggtcagcatacacagccctgttctccggcgtgagctgggtcatgaagatcggcataggcgtgctcctaacctggataggcctgaacagtaaaaatacgtcgatgagcttcagctgcatcgcaataggcatcatcaccctctacctgggtgccgtggtgcaagcggacatgggctgcgtcattaactggaagggtaaggaactgaaatgcggctccgggatcttcgtcacgaacgaggtccacacctggaccgagcaatacaagttccaggccgatagcccgaagcgcctcgccacagctatcgccggcgcgtgggagaatggggtgtgtggtatccgctcgacgacccgaatggaaaatctgttatggaagcagatcgccaacgagctcaactacatactctgggagaacaacataaagttaaccgtggtggtaggagacaccatcggcgtcctagagcaaggcaagcgcacgcttacaccccagcccatggagttaaagtacagctggaagacctgggggaaggcgaagatcgtcaccgcagagatccagaactctagcttcataatcgacggcccgaacacgcccgagtgcccctccgcgtctcgggcctggaacgtctgggaggtggaggactacgggttcggcgtgttcactacgaacatttggctcaagctgcgtgaagtctacacacagctgtgcgaccaccggctcatgagcgcggccgtgaaggacgagcgcgccgtccatgcggatatgggctattggatcgagtcccagaagaacgggagctggaagctcgagaaggcctccttcattgaagtgaagacctgtacgtggcccaagagccacactctttggagtaacggcgttctcgaatcagatatgattattcctaaatccctggccgggcccatctcccagcacaattaccggcccggctaccacacccagaccgccggtccctggcacctgggcaagttagagctggacttcaactactgcgagggcaccaccgtggtgatcaccgagaactgcgggacccgaggtccgtccctgcggacgaccaccgtgtccggcaagctcatccacgagtggtgctgcagatcatgcaccttaccgccgctgcggtatatgggcgaggatggatgctggtatggtatggaaattcgcccgataagcgagaaggaggagaatatggtgaaatcactcgccagtgcgggatccgggaaggttgataatttcaccatgggcgtgctgtgtctggccatcctcttcgaagaggtcatgcggggcaagttcggcaagaagcacatgatcgccggggtgttcttcaccttcgtactactgctctctgggcaaatcacctggcgggacatggcccatacccttataatgatcggctccaacgcctctgaccggatgggaatgggggtcacgtatctggcgctcattgccacgttcaagatacagcctttcctggccctcggcttctttctccgaaagctgaccagccgggagaaccttctcctgggtgtgggtctggccatggcaaccaccttgcagctgcctgaagacattgagcagatggccaacggaatcgccctgggcttgatggccttgaagttgattacccagttcgaaacctatcagctttggaccgcactggtatccctgacgtgcagcaacaccatgttcacactcaccgtcgcgtggcgcacggccaccctgatcctggctggggtgtccctcctgccggtctgccagagctcctcgatgaggaagaccgactggctgcccatgaccgtggctgccatgggcgtgccgcccctccccctattcatcttcagcctgaaagacacgctcaagcgccgcagctggcccctgaatgagggggtcatggctgtgggtctggtgtccatccttgcttcgagcctgcttcggaacgacgtccctatggccggtcccctcgtggccggtggcttgcttatcgcatgctacgtcatcactgggacgtccgctgacctcactgtggaaaaggctgcggacgtgacctgggaagaggaagccgaacagactggcgtgtcacacaacctgatgataaccgtagacgacgacggaactatgcgcattaaggacgacgagaccgagaacatcctgaccgttcttctgaagacggccctgctaatcgtgagcggtatattcccctactccattcccgcgactctgctcgtctggcatacctggcagaagcagactcagcgtagcggcgtgttatgggacgtgcctagcccgcccgagacacagaaagcggagctcgaggagggggtctatcgtattaaacagcagggaatactgggcaagacccaggtgggggtgggtgttcagaaggaaggcgtgtttcacactatgtggcacgtgacgcggggcgcagtcttaacgcataacgggaaacgcctggagccgaactgggcgagcgtgaagaaggacctgatcagttacgggggaggctggcggctatccgcgcaatggcagaaaggggaggaggtacaggtcatagcggttgagcctggcaaaaatcccaaaaatttccagacaatgcccggaacctttcagactacaaccggcgagatcggcgccatcgccctggacttcaaacctgggaccagcggcagtccgatcatcaaccgcgaagggaaagtagtcgggctgtacggcaacggggtggtgacaaagaacggtgggtacgttagcggaatcgcgcagactaacgctgagcccgacggcccgacgcccgagctggaggaggagatgttcaggaaacgaaatttaaccattatggatttacacccggggtcaggcaagacgcggaagtacttgcccgccatcgtgagagaggctattaaacgccgcctccggacccttatcctagccccaacacgcgtggtggccgcggaaatggaagaggcccttaaagggctccctatccggtatcagacgactgccaccaagagcgaacacactgggcgtgagattgtggatctgatgtgccacgcaaccttcaccatgcgactcctgtcccctgtacgggtgcccaactacaacctgatcatcatggacgaggcccactttaccgacccggcgtctattgccgcccgcggctacatctccacccgcgtgggcatgggcgaagcagccgccattttcatgaccgccacgccgcccgggacggccgacgcctttccccagagcaacgcgcccatccaggacgaggagcgagacattcctgagcgcagttggaacagcgggaacgagtggattaccgacttcgccggaaaaaccgtgtggttcgtcccttccataaaggctggcaacgacatcgccaactgccttcgcaagaacgggaagaaggtgatccaactgtcgcggaagacgttcgacaccgagtaccagaagaccaagttgaatgactgggacttcgtggttaccaccgacatatccgagatgggggctaacttcaaggccgaccgcgtaattgaccctcgccgctgcctcaagccggtcattctgacggacggccccgagcgggtcatcctggccggacccatgcccgtaactgcggctagcgccgcgcaacgccggggccgcgtgggccggaacccgcagaaggagaacgaccaatacatcttcacaggccagcccctgaacaacgacgaggaccacgcccactggaccgaggccaagatgctgctcgacaacataaatacccccgaggggatcatacccgccttgttcgaaccggagcgcgaaaagtccgcggcaattgacggggagtatagactcaagggcgagtctaggaagaccttcgtcgaactgatgcgcagaggggacctccccgtgtggttggctcacaaggtcgcctccgagggcataaaatacaccgaccggaagtggtgcttcgatggtcaacggaacaaccagatcctggaagaaaatatggacgtggagatctggacaaaggaaggcgaaaagaagaagctccggccccgttggttggacgctcgcacgtacagcgatcctctggccctcaaagagttcaaggacttcgccgcgggtcggaagtccatcgcgcttgatctggtgaccgaaattgggagggttccgtcgcacctcgcccatcggacccgcaatgcgttggacaacctggtgatgctacacacctctgagcatggcggtagagcatatcgccacgccgtggaggaactgccagaaacgatggagactttgctgttattgggcctcatgatccttttgacgggtggcgtcatgctgttcctgatctccggaaagggtatcggcaaaacctccataggattgatctgcgttatcgcctccagtgggatgctctggatggcggacgtgcccctccaatggatcgcgagtgcgatcgtgctcgagttcttcatgatggtgttgctcatccccgagccagagaagcagcgaactccccaggataatcagttggcctatgtggtcatcgggatactcaccttggccgccatcatcgctgccaatgaaatgggccttctcgaaaccaccaagcgagacctgggcatgagcaaggagcccggggtggtgtccccgacgagctacttagacgtcgatctacaccctgcatccgcctggactctgtacgccgtggccacaaccgtcatcactcccatgttgcggcacaccatcgagaacagcactgccaacgtatccctcgccgccatcgcgaatcaagccgtggtgctgatggggctagataaggggtggccgatttcaaagatggacctcggagtccctctgctggccctcggctgttacagtcaggttaaccccctgactctgacggccgctgtgctcctgctgatcacccactacgcgatcattggccctggcctgcaggccaaagccacacgtgaagcccagaagcggacggccgcggggataatgaagaacccaacggtggacggcatcatgaccatcgacctggaccccgtgatctacgactctaagtttgaaaagcagctgggccaggtgatgctcctcgtgctatgcgccgtgcagctcctgctgatgcgcaccagctgggccctctgcgaggccctgaccctggcgaccggtcccatcaccaccttatgggagggctcgcctgggaagttctggaacaccacgatcgccgtatccatggccaacatcttccggggcagctacttggccggggccggcctggctttctccatcatgaaatccgtaggcaccggaaagcgcggcaccggtagccagggcgagaccctcggggagaagtggaagaagaaactgaaccagctgtcacgtaaagagtttgacctctacaagaagtccggcataacggaggtagaccgcacggaggccaaggagggcctcaagcggggcgagaccactcaccatgccgtttcccgcggcagcgcaaagctgcagtggttcgtcgaacgcaatatggtaatccccgaggggcgcgtgatagacctcggttgcggtcggggcggttggtcttactactgtgcggggctgaagaaggtcaccgaggtgcgcggctacacgaaaggaggaccgggccacgaggaacccgttcccatgagtacctacgggtggaatatcgtcaagctcatgtccgggaaagacgtgttttacctaccccctgagaaatgcgataccctgctgtgcgacatcggcgagagctcccccagccctaccgtggaggagtcccgcaccatccgtgtactgaaaatggtggagccctggctaaagaataaccaattctgcatcaaggtgctgaacccctatatgcccacagtcatcgaacacctggagcgcctccagcggaaacacggcggtatgctggtgagaaaccccctttcgcgaaactccacccacgagatgtactggatctcgaacggcacggggaacatagtgagtagcgtcaatatggtcagtcgactactactgaaccgttttaccatgacccaccgtaggccaaccatcgaacgagacgtggacctcggggcgggcacgcgtcacgtgaatgccgagccggaaatcccgaacatggatgtcatcggggagaggataaagcgaatcaaggaggagcataacagcacgtggcactacgacgatgagaatccctacaagacctgggcctaccacggctcctacgaggtcaaggcaaccggaagcgcgagttcgatgatcaacggcgtggtgaagctactaaccaagccgtgggacgtggtgccgatggttacgcagatggcaatgaccgacaccacacccttcgggcaacagcgcgtcttcaaagagaaagtcgacacacgcacgccccggccgatgcctggcactcggaaggtgatggaaattacagccgaatggctgtggcgcacgctgggcagaaataagcgcccccgcctgtgcacccgcgaagagtttactaagaaagtccggaccaacgcagccatgggagcggtgttcacggaagaaaatcaatgggactcagccaaggccgccgtggaagacgaggagttttggaaactcgtcgaccgcgaacgtgagctgcacaagttgggcaagtgcggctcctgtgtgtacaacatgatgggaaagcgagagaagaaactcggagagttcggcaaagcaaagggctcacgcgcaatatggtacatgtggctgggggctcggtacctggagttcgaggcactaggcttcctgaacgaggaccactggttctctcgggaaaactcatactccggcgtggagggggaaggtttgcataagctcggctatatcctgcgggatatcagtaaaataccgggcggagcgatgtacgcggatgacaccgcgggttgggacacacgcataaccgaagatgatttacacaatgaggagaagataacgcagcagatggacccggagcatcggcagctggcaaacgccatctttaaacttacataccagaacaaagtcgttaaggtacagcgccccacaccaaccggcactgtcatggatattatctcccgaaaggaccaacgcggttctggccaagtcgggacatacggcctgaacaccttcaccaatatggaggcccagctcgtacgtcagatggaaggagagggcgtcctgtccaaggccgaccttgaaaacccacatctcctggagaagaagatcacccagtggctggagaccaaaggtgtggagcgcttgaagcggatggcgatctcaggcgatgactgtgtggtcaagccgatcgacgacaggtttgccaacgcgttgctggctctcaacgacatggggaaagtacgaaaagacattccacagtggcagccctctaaggggtggcatgactggcaacaggtgccgttttgttcgcatcactttcacgagctgatcatgaaggacggcagaaaattagttgtgccgtgccgtccccaggacgagctcatcgggcgcgcacgcatatcccagggcgcgggttggagcctgcgtgagaccgcttgcctgggcaaagcctacgcccagatgtggtccctcatgtacttccaccgccgggacctgcgccttgcgagcaacgccatctgctccgcggtgcccgtacactgggtgcccactagccggacgacttggagcatccacgcccaccaccagtggatgacaaccgaagatatgctcaccgtatggaaccgcgtctggattgaagacaacccgtggatggaagacaaaacgcccgtgaccacttgggagaacgtcccctacctgggcaagcgagaggaccagtggtgtgggtccctgataggcctcacatctcgcgccacttgggcgcagaacatccctactgcgatccagcaagtccgctcattgatcgggaacgaggagttcctggactacatgcctagcatgaagagattccggaaggaagaagaaagcgagggcgccatctggtag

SEQ ID NO: 25787 - RNA, 9873 nt, synthetic construct
  misc_feature 1..9873: note = derived and/or modified CDS sequence (opt11) from DENV-3__GQ199888__SS-prME
  source 1..9873: mol_type = other RNA
accagcctgtgcctcatgatgatcctgcccgccgcgctggcgttccacctcacaagtcgcgacggggaacccaggatgatcgtcgggaagaacgagcgcgggaaatcgctgctgttcaagacggcctccgggatcaacatgtgcaccctcatagccatggatctgggtgaaatgtgcgatgataccgtgacctacaagtgtccacacatcactgaggtcgagcccgaggacatcgactgctggtgcaacctgaccagcacctgggtgacctacgggacctgcaaccaggccggggagcaccgtagggacaaacggtccgtcgctctcgcgcctcatgtgggcatgggactggacactcgcacccagacctggatgtcagccgagggggcctggcgacaggtggagaaggttgagacctgggccctgaggcaccccggattcaccattctcgcgctgttcttggcccactacataggcacctcgctcacgcagaaagtagtcatcttcatcctgctgatgctggtcacgccctcgatgaccatgcggtgtgtgggggtgggcaaccgcgactttgtcgagggcctgtccggagccacctgggttgacgtggtgctggagcacggcgggtgcgttacgacgatggccaagaacaagcccaccctcgacattgaactgcagaaaaccgaggccacccagctggcgaccttacgaaaactctgcatcgaaggcaagatcaccaacatcaccaccgattcacgctgccccacgcagggcgaggccgtgctgcccgaagaacaggaccaaaactacgtctgcaagcacacctacgtggaccggggatggggcaacgggtgcggcctcttcgggaaaggctccctggtgacctgcgccaagttccagtgcctggagtcgattgaaggcaaggtggtgcagtacgaaaaccttaaatacaccgttatcattacggtccacaccggggaccagcaccaggtggggaatgagacccagggggtcaccgccgagatcacaccccaggcctccacgaccgaggcgatcctccccgagtatggcaccctggggctcgagtgcagcccccgcaccgggttggacttcaacgagatgatactgctcacgatgaagaacaaggcttggatggtgcaccgacagtggttctttgacttgccgctaccctggacctccggcgccacaaccgagacgcccacctggaaccgcaaggagctgctggtaaccttcaagaatgcacacgccaagaagcaggaagtcgtcgtactggggagccaggagggcgcgatgcatacagccctcactggcgccaccgagatccagaactccggcgggacgagcatcttcgcaggccacctgaagtgccggttaaagatggataaactcgagcttaagggcatgtcttacgccatgtgcacgaatacattcgtcctgaagaaggaggtatccgagacccagcatgggaccattcttgtgaaggtcgaatacaaaggtgaggacgcgccttgcaagatcccgttcagtaccgaggacgggcaaggtaaggcacacaacggccggttaatcaccgccaatcccgtggtcaccaagaaggaggagcccgtcaacatcgaggccgagcccccgttcggggagtccaacatcgtcatcggcaccggggacaatgcgctgaagattaactggtacaagaagggcagctccataggaaagatgttcgaggccacggcccggggcgccaggcgcatggccattctgggtgatactgcgtgggatttcgggagcgtgggcggagtcctcaactccttgggcaagatggtgcaccagatattcgggagcgcatacaccgccctgttctccggtgtgagctgggtcatgaagatcggcattggagtgctcttgacatggatcggcctgaactccaagaacaccagcatgtcctttagctgcatcgccattggaatcatcacgctctatctgggcgccgtggtccaggcggatatggggtgcgtcatcaattggaaaggcaaggagcttaagtgcggctccgggatctttgtgaccaacgaagtccatacctggaccgagcagtacaagttccaagccgatagccccaagcgcctcgcgacggctatcgccggcgcgtgggaaaatggggtgtgcggcatccgctccaccacgagaatggagaatctgctgtggaaacaaatcgccaacgagctcaactacatcctgtgggagaacaacatcaagctgacggtggtcgtaggggacacgatcggggtcctcgagcagggcaagcgcaccctgacgcctcaacccatggagctcaagtacagctggaagacctgggggaaggcgaagatagtcacggccgaaatccagaactcaagtttcatcatcgacggcccgaacacccccgagtgcccctccgcgagccgtgcctggaatgtgtgggaggtggaagactacgggtttggcgtgttcaccaccaacatctggctcaagctgagggaagtgtacacccagctgtgcgaccaccggctcatgagcgccgccgtgaaagacgaaagagcagtccacgccgacatggggtactggatcgaaagccagaagaatgggtcatggaaactagagaaggcgagcttcatcgaggtgaagacgtgtacctggcccaagtcccacaccctgtggagtaacggcgtcctcgagagcgacatgattatcccgaagtccttggccggaccgatcagccagcacaactaccggcccggctaccatacgcagacagccgggccttggcacctaggcaaactcgagctggacttcaactactgcgagggaaccaccgtagtgatcaccgagaactgtgggacgcgcggcccatccctgaggaccaccaccgtgtccgggaagttgatccacgaatggtgctgccgctcgtgcacgctgccacccctccggtacatgggcgaggacgggtgctggtatggcatggagatccggccgatttcggaaaaggaggagaatatggtcaaaagcctcgccagcgcgggctctggaaaggtggataattttaccatgggtgtgctgtgtctggcaatccttttcgaggaagtcatgcgggggaagttcgggaagaagcacatgatcgccggggtcttctttacgttcgtgctgttgctaagcggacaaatcacctggcgcgacatggcccataccctgataatgatcggaagcaacgccagcgaccgtatggggatgggcgtcacctatctggcgttgatcgccacgttcaagatccagcccttcctggccctgggcttctttctccgcaaactgacaagcagggagaacctgctcttgggcgtggggctggccatggcgacgacactccagctgccagaagacatcgagcagatggccaatggaatcgccttagggctcatggccctgaaattgatcacccagttcgagacataccagctctggactgccctcgtgtccttaacctgcagtaataccatgtttaccctcacggtcgcgtggcgcacagccaccctgatccttgccggggtgtctctgctccccgtctgccagtcaagtagcatgaggaaaacagactggctccccatgactgtggcggccatgggggtcccgcccctccctcttttcatcttctcactgaaggatacgctcaagcgccgcagctggcctctgaatgagggggtcatggcggtgggcctggtgtccatcctcgccagctccctattacgaaacgatgtgcccatggccggacccctcgtggccgggggcttgctcatcgcctgctacgtcatcaccggtaccagcgcggacctcacggttgagaaagccgccgacgtgacgtgggaagaggaggccgagcagaccggcgtatcccacaatctgatgatcaccgtggacgacgacgggaccatgcgcattaaggacgatgaaacggagaacatcctgacagtactcctgaagaccgccctgctcatcgtgagcgggatattcccctactccatcccggcgacgctgctggtctggcacacatggcaaaagcaaacccagcgaagcggcgttctctgggacgttcccagcccgcccgagacccagaaggccgagctggaggaaggggtctacagaatcaagcagcaagggatcctcgggaagacccaagtgggtgtgggtgtccaaaaggagggcgtgttccacacgatgtggcatgtgacccggggtgccgtcctcacccacaacgggaagcgcctggaaccgaactgggccagcgtgaaaaaggatttaattagctacggagggggctggcgcttaagcgcgcagtggcagaagggggaagaggttcaagtcatcgccgtagagcccggcaaaaaccccaagaacttccagaccatgcccggcacgtttcagaccaccaccggagagataggcgccatcgccctcgacttcaagccggggacgtcgggcagccctattatcaacagagagggcaaagttgtcgggctgtacggcaacggggtcgtgaccaagaacggcgggtacgttagcggcatcgcccaaacaaatgcggagccagatgggcccacgcccgaattagaagaggagatgttccggaagcgtaatctcaccatcatggacctgcatcctggatctggcaaaacccggaaatacctgccggccatcgtgcgcgaggctatcaagcggcgcctccggaccctgattcttgccccgacccgcgtggtcgccgccgagatggaggaggctcttaaggggctccccatccggtatcagacgaccgccaccaagagcgagcatactggtcgcgagatcgtggacctgatgtgtcacgccacgttcaccatgcggctcctctctcccgtgcgcgtcccgaactacaatctgatcattatggacgaggcccacttcacagacccggcgagcatcgcagcccgggggtacatctccactcgggttggaatgggagaggcagcggcaatctttatgacggcaacgccgcccgggactgccgatgcattcccccagagcaacgcgcctatccaagacgaggagcgggatatccctgagcggagttggaacagcggaaacgaatggatcacggacttcgccggtaagacggtatggttcgtacctagtatcaaggcgggcaacgatatcgccaactgtttacgcaagaacggtaagaaggtgatccagctcagcagaaagaccttcgacacagagtaccagaagaccaaattaaacgactgggactttgttgtaacgaccgacatctccgagatgggggcgaattttaaagcggaccgcgtgattgacccgcgtcgatgcctaaagccggtcatcctgaccgacggccccgagcgggtcattctggccgggcccatgccggttaccgccgccagcgccgcgcagcgcagaggaagggtgggccggaatccgcagaaggagaacgaccaatacatcttcaccggccagccactcaacaacgacgaggaccacgcgcactggacggaggccaaaatgcttctggacaacataaacacaccagaggggataatccctgccctcttcgaaccggagcgggagaaaagcgcggccattgacggagaatacaggcttaagggcgagagccgaaagaccttcgtcgagctcatgcggcgcggggatctccccgtgtggcttgcccataaagtcgcctccgagggcatcaagtacaccgatcgcaagtggtgcttcgacgggcagaggaacaaccagattttggaggagaacatggacgtggagatatggacgaaggagggcgagaagaagaagctccggccacgctggctggacgcccgcacatacagcgaccccctagcgctcaaggagttcaaggacttcgcagccggcagaaagtcgatcgccctcgacctggtgaccgagatcggtcgcgtcccgtctcatcttgcgcatcggactcgcaacgcgctggataatctggtgatgttacacacgagcgaacacggcggacgggcatatcgccacgcagtggaggagttacccgagaccatggagaccctgctcctgctgggtctcatgatcctgctgaccgggggcgcgatgctgttcctgatctccggcaaggggatcggcaaaactagcatcgggctcatctgcgtcatcgcatccagcggaatgctctggatggcggacgtccccttgcagtggatcgcctctgccatagtgctggagtttttcatgatggtattgttaatcccggagcccgagaagcagcggacacctcaggacaaccaactggcctacgtggtgatcgggatcctgaccctggccgctatcatagccgcaaacgagatgggcctgctcgagaccaccaagcgcgacctggggatgagcaaggaacctggggtcgtgtccccgacctcttacctggacgttgatctccaccccgcctccgcgtggaccctgtacgcagtagccaccacggtgatcacccccatgctacggcacacaatcgagaacagcaccgcaaacgtgtccctcgcggcgatcgcgaaccaggcggtcgtgctgatgggtcttgataagggatggccaattagcaagatggacctcggagtacctctgctggccctcgggtgctattcccaggtcaaccccctgacgctgaccgccgccgtgctcctgctaatcacccactatgccatcatcggccccggcctccaggccaaggccacccgagaagcccagaagcgcacggcggccggcatcatgaagaaccccaccgtggatggcatcatgacaatcgacctggaccccgtcatctacgacagtaagttcgagaagcagctgggacaggtaatgctcttagtgctctgcgcggtccagctcctgttaatgcgcacctcctgggcactgtgcgaggctcttacgttagccaccggcccaataaccaccctctgggagggcagccccgggaagttctggaatacgaccatcgccgtgtccatggccaacatattccggggcagctacctggccggggcgggcctggccttctcgatcatgaaatccgtgggaaccggcaagagaggcacagggagccagggcgagaccctcggggagaagtggaagaagaagctgaaccaactgagccggaaggagttcgatctctacaaaaagtccggcatcacggaggtagatcgtacagaggctaaggaggggctgaagaggggtgagaccacccaccacgccgtgtcccgcggctcagctaaactgcaatggttcgtggagcggaacatggtcatccccgaagggcgggttatcgacctcggctgtgggcggggcgggtggtcctactactgcgccggcctgaagaaggtgacagaggtacgcggctacactaaaggcgggccggggcacgaggagcccgtacccatgagcacttacggctggaacatcgtgaagctgatgtccggcaaggacgtcttctacctcccgcccgagaagtgtgacacacttctgtgtgatatcggtgagtcgtccccctcccccacagtggaagagtctcgcacgatccgggtgctgaagatggtggagccgtggctcaagaacaaccagttctgcatcaaggtactgaacccgtacatgcccactgtgatagagcacctggagcgcctccagcggaaacacggtgggatgctggtccgcaaccccctgtcccgtaactcgacccacgagatgtattggatcagcaacggcacggggaacatagtttccagcgtcaacatggtctcacgcctcctgctgaaccgtttcaccatgacccaccgccggccaaccattgagcgcgatgtggacctcggcgccgggacgcgccacgtgaacgcggaaccggagatccccaacatggacgtcatcggagagcgtattaagcggataaaggaggagcacaacagcacatggcattacgacgacgaaaacccgtacaagacttgggcctaccacggatcctacgaggtgaaggccaccggcagcgcgagtagtatgatcaacggggtagtgaagctgttgacgaagccgtgggacgtggtccccatggtgacgcagatggccatgactgacaccacgcccttcgggcaacagcgcgtattcaaggagaaggtcgacacccggacaccccgtccgatgcccggtacccggaaggtgatggagatcactgccgaatggctctggcgcactttgggacggaacaagcgcccccgcctgtgcacccgggaggagttcaccaagaaggtccgcacgaacgcagcgatgggggccgtcttcaccgaggagaaccaatgggacagcgctaaggccgctgtagaggacgaggagttctggaaacttgtcgatcgagagagggagttacacaagctgggcaaatgtgggagttgcgtctacaacatgatgggcaagagagagaagaagttgggggagttcggcaaggcgaaaggctcccgcgccatctggtacatgtggctaggggcacggtaccttgagttcgaagcgctcggcttcctgaacgaggatcactggttctcccgcgagaatagctattccggggtggagggtgaggggctgcataagctcgggtatattctgcgggacatcagcaagatccccggcggggccatgtacgcagacgacaccgccggctgggacacacggatcacggaggatgacctgcacaacgaggaaaagatcacgcaacagatggacccggagcaccggcagctcgctaacgccatcttcaaactcacctaccagaacaaggtcgtcaaggtgcagcgccccaccccaacagggacggtgatggacatcatctcccggaaggatcagcgaggctctggccaggtcggtacctacggcctgaacaccttcaccaatatggaggcgcagcttgtgcggcagatggagggggaggatgtgctgtcaaaggccgatctggagaacccacacctcttggagaagaagataacgcagtggctggagacaaaaggcgtggagcgcttaaagcgtatggccatcagcggggacgattgcgtggtgaaaccgattgacgaccgcttcgcgaacgccctactggccttgaacgatatgggcaaggttcgaaaggacatcccccagtggcagccctccaagggctggcacgactggcagcaggtcccgttctgtagccaccacttccacgagctgatcatgaaggacggacgcaagctggtggtcccgtgcaggccccaggatgagctgatcggtcgcgcccgcatctcgcagggggccggctggagcctgcgggagacagcgtgcctggggaaggcgtacgcgcagatgtggtccctcatgtacttccataggcgggacctgagactggccagcaacgctatatgctccgccgttcccgttcactgggttcccacctctcggacgacctggagcattcacgcccaccaccagtggatgactacagaagacatgctcacggtgtggaaccgcgtctggatagaggataacccgtggatggaggataagacccctgtcactacctgggagaacgtcccttaccttggcaagcgggaggaccagtggtgcggctccttgatcgggcttacgtctcgcgcgacctgggcccagaacatccccaccgctatacagcaggtccggtccctgatcggtaacgaggagtttctggactacatgccgagtatgaaacgcttccggaaagaggaggaaagtgaaggggccatctggtag

SEQ ID NO: 25788 - RNA, 9873 nt, synthetic construct
  misc_feature 1..9873: note = derived and/or modified CDS sequence (opt11) from DENV-3__GQ252674__SS-prME
  source 1..9873: mol_type = other RNA
acgagcctgtgcctcatgatgatcctgcccgcggctctggcgttccatctcaccagccgggacggggagccgcgcatgatcgtgggtaagaatgagaggggcaagagccttctgttcaaaaccgcatccggtatcaacatgtgtaccttgatcgccatggacctgggggagatgtgcgacgataccgtgacatacaagtgcccccacattactgaggtggaacccgaggacatcgactgctggtgcaacctaaccagcacctgggttacatacggcacgtgcaaccaggccggcgaacataggcgagataagcggagtgttgccttggcgcctcacgtcggaatggggctggataccagaacccagacctggatgagtgccgagggtgcttggaggcaagtcgaaaaagttgagacgtgggcgctgcgtcacccgggcttcaccatattggcgctttttcttgcacactatataggtacctcactcacccagaaggtggtaatcttcatactgctgatgctagttacgccttctatgaccatgcgttgtgtgggaataggcaaccgcgacttcgtcgagggcctgtccggcgccacctgggtcgacgtggtgctggagcacggggggtgtgtcaccactatggccaaaaacaagccgaccctcgatatcgaattacagaagaccgaggccacccaactggctacgctccgcaagctgtgcatagagggcaaaattacaaacatcaccacggacagccgctgcccgacgcagggcgaagccgtgctgccggaagagcaggatcagaattatgtttgcaaacatacctacgtcgatcgggggtggggcaacgggtgcggcttgtttggtaaagggtccctggttacctgcgccaaattccagtgcctggagcccatagaagggaaggtggtccaatacgaaaacctcaagtacaccgttatcattacggtgcacacaggggatcagcaccaggtcggcaacgaaacccagggggtgaccgccgaaatcacgccacaggccagcaccacagaggctatcctgcccgagtacggcaccctggggctcgagtgctccccgcgaaccggcctggacttcaacgagatgatcttactcacgatgaaaaacaaggcctggatggtccatcggcagtggtttttcgacctgcccctgccttggactagcggcgcgacgacggagactcccacctggaaccgcaaggaactactagtgacgttcaaaaatgcccacgccaagaaacaggaggtggtagttctggggtcccaggagggcgcgatgcacaccgccctcacgggggccaccgagattcagaacagcggcgggaccagcatcttcgccgggcacctgaagtgccggctgaagatggataagctggagctgaaggggatgagctacgccatgtgtaccaacacgttcgtgctgaagaaggaagtctccgaaacccaacacgggacaatcttaatcaaagtggagtacaaaggcgaggacgcgccgtgcaaaatccccttcagcacagaggacggtcagggcaaggcacacaacggcagattaataacggccaacccagtagtcaccaagaaggaggagccagtgaacatagaggccgagccgcctttcggcgagtctaatatcgtgataggcattggagacaacgcgctgaagatcaactggtacaagaaaggctcctcgatcggcaaaatgttcgaggccaccgcccgtggcgcccgccggatggccatcctgggtgacaccgcgtgggattttgggtccgttggtggtgtgctcaatagcctgggcaaaatggtgcatcagattttcgggtccgcgtacacggcactgttcagcggcgtctcctgggttatgaagattggcatcggggtgctcctgacctggatcggcctgaactccaagaatacctccatgagcttctcctgcattgccatagggattatcaccctatacctgggggccgtagttcaggctgacatggggtgtgtgatcaactggaagggcaaggagctgaagtgcggcagcggaatctttgtcaccaacgaggtacatacttggacggagcaatacaagttccaagcggactccccgaagcgcctcgcgacagcaattgccggagcgtgggagaacggcgtgtgcggcatccgcagcactacccgcatggagaaccttctgtggaagcagatcgccaacgaattaaactatatcttatgggagaacaacataaagctgacggtggtggtgggagacaccatcggcgtcctcgaacaaggcaagcgtacactgacaccccagccgatggagctgaaatactcatggaagacatgggggaaggccaaaatcgtgactgccgagacacagaactcatcattcattattgacggacccaacacccctgagtgcccgtcggcgtctcgggcctggaacgtgtgggaggtcgaggactacgggttcggcgtgttcaccaccaacatctggctcaagctgcgcgacgtttacacgcaactatgcgatcatagactcatgagcgctgcagtcaaggacgaacgcgcggtgcacgcggacatgggctactggatcgaaagccagaagaatgggtcctggaagttggagaaagcgtctcttatcgaagtgaagacttgcacctggccgaagtctcatactctctggagcaacggcgtcttggagagcgacatgataatccccaaatctctggcagggccaatatcgcagcacaattatcgccctgggtaccacacccaaacggcggggccctggcacctcggcaagctggagcttgattttaactactgcgaaggtaccaccgttgtaataacagagaactgcgggacgcgggggccaagtttgcggaccactacagtttctgggaagctgatccacgaatggtgctgccgcagctgcaccctgccgccgctccggtacatgggcgaggacgggtgctggtacggcatggagatccgccccatctccgaaaaggaggaaaacatggtaaaaagcctagtatccgccggctctgggaaggtcgacaactttacaatgggcgtattgtgcctggcgattctgttcgaggaggtcatgcggggcaaattcggcaagaaacacatgattgcaggggtactgttcacgttcgtcttattactgtcgggccagatcacctggcgcgatatggcccacacgctcattatgataggatcgaacgcctccgaccggatgggaatgggcgttacatatctggcgctgatagcaacatttaaaattcagcccttcctcgccttagggttcttcctgcggaaattaaccagccgggagaatttgctactaggcgtaggcttagccatggccacgacgctgcagctgcccgaggatatcgaacaaatggcaaacggtatcgccctgggcctgatggctctcaaactgatcactcagtttgagacttaccagctatggacggcgctcgtgtcacttacatgctccaatactatactaaccctcactgtggcctggcgcaccgcgactttgatcctggccggcgtaagcctattaccggtctgccagtctagctcgatgcggaagaccgactggctgcccatgacagtggccgcaatgggggtgccacccctccctctgttcatcttctccctgaaggacacgttaaagcgccggtcctggccactgaatgagggcgtgatggccgtcggcctggtttcaatcctcgcttccagcctgttgcggaacgacgtccccatggccggtcccctcgtcgccgggggcctgctgatcgcttgctatgtgatcactgggacctccgccgacctcacggttgagaacgccgctgatgttacctgggaggaagaagccgagcagaccggagttagccacaatctgatgatcacagttgacgacgacggaaccatgcgaatcaaggacgacgaaaccgagaacatcctgactgtgctcctcaagaccgcattgctgattgtttccggcatttttccatacagcattcccgccaccctgcttgtgtggcatacatggcagaagcagacccagcggtccggagtcctctgggacgtacccagcccgccggagacccaaaaggcggagctcgaagagggcgtgtaccgtataaagcaacagggcatcttcggtaagacacaggtgggcgtgggggttcagaaggagggcgtcttccacacgatgtggcatgtcactcggggcgcagtactgactcacaacggcaaacgcctcgagcccaattgggccagtgtaaagaaggacctgataagttatggagggggctggcgcttgtccgcccagtggcaacgcggggaggaagtccaagtcatcgccgtcgagcccggcaagaaccccaagaacttccagactatgcccggtacgttccagaccaccaccggggaaatcggcgcaatcgccctggacttcaagcccgggacgtctggcagcccgatcattaaccgtgagggcaaagtggtggggctctacgggaacggggtcgtcaccaagaacggcgggtatgtgagcggcatcgctcagacaaacgccgagccagacggacccacccctgagctagaagaagagatgttcaagaagcgcaacctgacgatcatggacttacacccggggagtggcaagacacggaagtacctgccagcgatcgtccgcgaggccataaagcggcgcctgcggaccctaatcctggcccccacgcgcgtcgtggcagccgagatggaagaggcgctaaaggggcttccgatccgttaccaaacgaccgccacaaagagcgagcacactggccgcgagatcgtcgacttaatgtgtcatgccacgttcaccatgcgcctcctcagccccgtgcgcgtgcctaactacaacttaatcataatggacgaggcccatttcactgaccccgcaagcatcgcggcccgggggtatatctccacccgcgtaggcatgggtgaggctgccgcgatcttcatgacagcgacaccacccgggactgctgatgccttccctcagtccaacgcccccatccaagacgaagagcgggacatccccgagcggtcctggaattccggaaatgagtggattaccgatttcgcagggaagacagtgtggttcgtccccagcatcaaggccgggaacgacatcgccaactgcttacgcaaaaacgggaagaaggtcattcagctctcccggaagaccttcgacaccgagtaccagaagacaaaactgaatgactgggacttcgttgtgacgaccgacatcagcgaaatgggagccaactttaaggcagaccgggtcatcgatcctagacgctgtctgaagcccgtgatccttaccgacggtcccgagcgggtaatcctggcgggtcccattccggtcacagcagcaagcgccgcccaacgccggggccgcgtcggacggaacccccaaaaagagaatgaccagtacattttcaccggccagccgctaaacaacgacgaggaccacgcgcattggacggaagccaagatgctcctcgacaacatcaacacccccgaggggataatcccggccctcttcgaacccgagagggagaagtccgctgcgatagacggcgagtatagactcaagggggagtcacgtaaaactttcgtcgagctgatgcggcgcggggacctgcccgtgtggctcgcccacaaggtggccagcgaggggattaagtacacagaccggaaatggtgctttgacgggcagcgcaacaaccaaatcctggaagagaacatggatgtcgagatctggactaaggagggcgagaaaaagaagctgcggccgagatggctggacgctagaacgtattcggacccgctggcgctgaaagagttcaaggacttcgcggccggcaggaagtctatcgccttggacctagtcaccgagatcgggcgcgtaccatcccacctggcccaccggacgcgaaacgctctcgacaacctcgtgatgctgcacacgtcggagcacggcgggcgcgcgtaccggcacgcggtggaggaactccccgagacaatggagacgctactgttactcggcctaatgattctcctgacgggcggagccatgctgttcctcatcagcgggaaggggataggcaagacgtccattggcctgatctgcgtgatagcgagctccggcatgctgtggatggccgaaatcccgctacagtggatcgcgagcgccatcgtcctggagttttttatgatggtgctgctcatcccagagcccgagaagcaacggacgccccaagacaaccaactggcctacgtggtcattgggatcctgaccttggccgccatcattgcggctaacgagatgggcctgctggagaccacaaagcgcgatctcgggatgtccaaggagccgggggtggtgagccccacctcgtacctcgacgtcgatttgcaccctgccagcgcctggacgctatacgcggtggctacgacggtgataacacccatgctgcggcacaccatcgagaacagtaccgccaacgtctctttagcagccatcgcgaatcaagccgtagtactaatggggctggacaaggggtggccgatttctaagatggacctgggcgtccccttgctggccctggggtgttactctcaggtgaatcccctcacgctgaccgccgccgtgctattactaataacccattatgcgatcattggaccagggctgcaggccaaggccacccgcgaggcccagaagaggacggcggcgggaatcatgaagaaccctacggtcgacgggataatgaccatcgacctcgaccccgtgatatatgactccaagtttgaaaaacagctgggccaagtcatgctgctcgttttgtgtgccgtccaactgttactaatgcgcacctcatgggctctgtgcgaggccttaacgctggcgaccggtcccatcactaccctctgggaagggtctcccggcaagttctggaacacgacaatcgcggtcagcatggctaacatcttccggggctcatatctcgcaggggccggcctggcgttctcgataatgaagtctgtagggaccggcaagcgcggcacaggcagccagggggagaccctgggtgaaaagtggaagaaaaagctaaaccagttgagccggaaagagttcgacctgtataaaaagagtggcataacggaggtggatcgcaccgaagccaaggaggggctgaaacggggcgaaatcacccaccacgccgtgagccgaggttcagccaagctgcagtggttcgtcgaaaggaacatggtgattcctgaggggcgcgttatcgacctgggttgcgggcggggcgggtggtcctactactgcgcaggtctgaagaaggtcaccgaggtgcgcggttacacgaagggagggcccggacacgaggagcctgtgccaatgtccacctatggctggaacatcgtcaagttgatgagcgggaaggacgtgttctacctgcctcccgaaaagtgcgataccctgctctgcgatatcggggagtcatcccccagccccaccgtggaggaaagccgcacgatccgcgtcctgaagatggtggaaccgtggctcaaaaacaaccagttttgcattaaagtgcttaacccctatatgcccaccgtcattgagcacttggagcgcctccagcggaagcacgggggcatgctcgtgcgcaatcccctgtcccggaacagtacccacgagatgtactggatctccaacggcaccgggaacatcgtgagctccgtgaacatggtgagccgcctgcttctaaatcgcttcacgatgacccaccgccggccgactatcgagaaggacgtggacctgggagcgggcactcgtcacgtgaacgcggaacctgagacgcccaatatggacgtgattggggagcggattaaacgcatcaaagaggaacacaacagcacctggcactatgacgatgaaaatccatataaaacctgggcgtaccacggcagctatgaggttaaggccaccggtagcgcctctagtatgatcaacggcgtcgtgaagctcctgacgaagccgtgggacgtcgtgcccatggtcacacagatggcgatgaccgataccaccccattcgggcaacagcgcgtcttcaaggaaaaagtggacactcgcaccccgagatctatgccgggcacccgcaaggtgatggggatcacggctgagtggttgtggcgaaccctcggacgcaacaaacggccgcgcctgtgcacccgagaggagttcacaaaaaaggtccgtacgaacgccgccatgggcgcggtctttacggaggagaatcaatgggacagcgccaaggccgccgtggaggatgaggagttctggaagctggtagaccgcgagcgggagctacataaacttggaaagtgtggctcctgcgtgtataacatgatggggaagcgcgagaagaagttaggcgagttcggcaaagctaaggggagccgggcgatctggtacatgtggttaggcgcccggtacctggagttcgaagctcttgggttcctcaacgaggatcattggttctcccgagacaacagctattccggcgttgagggcgagggcctgcacaaactgggctacatcctgcgcgacatatcaaaaatcccagggggggccatgtacgccgacgatactgcggggtgggacacccggattacggaggacgatctgcacaatgaggagaagatcacacaacagatggatccggaacatcgccagttggcgaacgctatcttcaagctcacctaccaaaataaggtcgtgaaagtccagcggccgacccccacaggtactgtcatggacataatctcgagaaaggaccagcgaggaagcgggcaggtaggcacctatgggctgaacacattcacaaacatggaagtacagctcgtccgccaaatggagggtgaaggagttctgtcaaaagccgatctggagaatccccacctccccgagaaaaaaatcacccagtggctggagaccaagggcgtggagcggcttaaaaggatggccatcagcggtgatgactgcgtcgtaaagcccattgacgaccggttcgcgaacgccctgctagcccttaacgacatggggaaggtgcgcaaggatatcccacaatggcagcccagcaagggctggcacgactggcaacaggtaccgttctgtagtcaccacttccacgagctgatcatgaaggacgggcggaagctcgtggtcccctgtcgcccccaggatgaactcatcggccgcgcccgcatctcgcaaggggccggctggagcttacgcgagaccgcgtgccttggcaaggcctatgctcagatgtggagcctgatgtacttccaccggcgcgatttacgactagcctcaaacgctatctgctccgccgtccccgtacactgggtcccgacaagccgaacgacctggtcgatacacgcccaccaccagtggatgaccaccgaggacatgctgacggtctggaatagggtttggatcgaggacaatccctggatggagaacaagactcccgtgaccacctgggagaacgtcccctacctggggaaaagagaagaccagtggtgcggctctctcataggacttacgagccgggccacctgggcccagaacataccgacggccatccagcaggtccgcagcttgatcggtaacgaagaattcctagattacatgccctcaatgaagcgcttccgcaaggaagaggagtccgagggggcgatctggtga

SEQ ID NO: 25789 - RNA, 9873 nt, synthetic construct
  misc_feature 1..9873: note = derived and/or modified CDS sequence (opt11) from DENV-3__GQ199889__SS-prME
  source 1..9873: mol_type = other RNA
accagcttatgcctcatgatgatactccccgccgccctggcgttccacctcactagccgggatggtgagccacggatgatcgttgggaagaacgaacgcggtaagagcctgctgttcaagaccgcatccgggatcaacatgtgcacgctcatcgccatggacctgggggagatgtgcgacgacacagtgacatacaagtgcccccacatcaccgaggtggagcccgaagacattgactgctggtgcaatctgaccagcacctgggtcacctacgggacttgcaaccaggccggcgagcatcggagagacaagcggtccgtggccctcgcgcctcacgtgggcatggggctggacacccgcacccagacctggatgagcgcagagggcgcctggcgccaggtcgagaaggtcgagacatgggcactgcgccaccccgggttcaccatcctcgccctgttcctggcccactacatcggcacctccctcacccagaaggtggttatctttatcctactgatcctcgtcacgcccagcatggccatgcggtgtgtgggggtgggcaaccgcgatttcgtcgagggcctgtcaggggccacttgggttgacgtggtcctagagcacggcggttgcgtgaccaccatggccaagaacaaacccacgctcgacatcgagctgcagaagaccgaggcgacccagctcgccaccctccggaaattatgcatcgagggtaagatcacgaacatcacgaccgacagcagatgccccacccagggcgaggccatactgcccgaggagcaggaccagaactacgtgtgtaagcacacgtacgtcgaccgagggtggggcaacgggtgcggcttattcggtaagggcagcctggtgacatgtgccaagttccagtgcctggagtccatcgagggcaaggtggtccaatacgagaacctcaagtacaccgtgataatcacggtgcacacgggcgaccagcaccaagtcggcaacgagacccagggggtgaccgccgagatcacgccccaggcgtccactaccgaggccatactgcccgagtacggcacccttgggttggagtgcagcccccgcaccggcctggacttcaacgagatgatcctgctcaccatgaagaacaaggcatggatggtccaccggcagtggttcttcgacctcccgctaccttggacgtccggcgcgaccactgagacccctacgtggaaccgcaaggagctcctggtgacctttaagaacgcccacgcgaagaagcaggaggtggtggttctggggagccaagaaggcgccatgcacaccgccctcaccggggccacggaaatccagaactccggagggacgagcatctttgccgggcacctgaagtgccggctgaaaatggacaagctggagctgaaaggcatgtcctatgcgatgtgtaccaacacctttgtgctgaagaaagaggtcagcgagacgcagcacgggaccatcctcatcaaggtggagtacaagggcgaggatgccccctgcaagatccccttcagcacagaggacgggcagggcaaggcccataacggccgcctgatcaccgcgaatcccgtagtcacgaagaaggaggagcccgtgaacatcgaggcggagcccccgttcggggagtccaacatcgtgataggtatcggggacaacgctctgaagatcaactggtacaagaagggcagctccatcggtaagatgttcgaggccaccgcccgcggcgcacgccggatggcgatcctgggcgacaccgcctgggacttcgggagcgtcggcggggtgctgaactccctgggcaagatggtgcaccagatcttcgggagcgcctacaccgccctgttttccggcgtcagctgggtgatgaagattggaatcggggtgctcctgacatggatcggccttaactccaaaaacacaagcatgtccttcagctgcatagccatcgggatcatcaccctatacctgggtgcagtcgtgcaggcggacaccggctgcgtgatcaactggaagggcaaggagctgaagtgcggctccgggatattcgtcacgaacgaggtacacacctggacagagcagtacaaattccaggccgacagccctaagcgcctcgccaccgccatcgcgggcgcctgggaaaatggggtgtgtgggatccggtccacgacgcggatggagaacctgctatggaagcaaatcgccaacgagctcaactacatcctgtgggagaacaatatcaagctgactgtcgtggtgggggacaccatcggcgttctcgaacagggcaaaagaacgctaacgcctcagcccatggagctaaagtacagctggaagacctgggggaaggccaaaatcgtgactgcggagatccaaaattccagcttcatcatcgacggacctaacacgccagagtgcccctccgccagcagagcctggaacgtgtgggaggtcgaggactacggattcggcgtgttcaccaccaacatctggctcaagctgcgcgaggtgtacacccagctgtgcgaccaccggctcatgagcgccgccgtcaaagacgagcgcgcggtacatgcggacatgggctattggatcgagtcccagaagaacgggagctggaagctagagaaagcctccttcatcgaagtgaagacctgcacgtggcccaagagccacaccctgtggagcaacggcgtcctcgagtctgatatgatcatcccgaagtccttagcggggcctatctcacagcacaactaccggcccggctaccacacccagaccgccgggccgtggcatctgggcaagctcgagctggacttcaattactgcgaggggaccaccgtagtgatcaccgagaactgtgggactcgcggcccctccctgcggacgaccaccgtctctggtaaactcatccacgaatggtgctgccgttcatgtacgctgccgcccctgcggtacatgggcgaggacgggtgctggtacggcatggaaatccgcccgatcagcgagaaggaggaaaacatggtgaagtccctcgcgagcgccggcagcgggaaggtggacaacttcacaatgggcgtcctctgcctcgccattctcttcgaggaggtgatgcgggggaagttcggcaagaagcacatgatcgcgggagtgttctttacgtttgtcctcctgctcagcggccagattacctggcgcgacatggcccacaccctgatcatgatcggctccaacgcgagcgaccggatggggatgggcgtgacctacctggccctcatcgccaccttcaagatccagcccttcctggccctggggttctttctccgtaagttaaccagccgggagaacctgctcctgggagtggggctggcgatggccacgaccctccagctgcccgaggatatcgagcagatggcgaacggcatcgccctgggcctcatggccctaaagttgatcacccaattcgagacctaccagctctggaccgcgctgatatccctgacgtgcagcaacaccatgtttacgctgaccgtcgcctggcgcacggccaccttaatcctagccggcgtgtccctcttacccgtgtgccagagctccagcatgcggaagaccgactggcttccgatgacagtcgccgcgatgggcgtgccgcccctgcccctgttcattttctccctgaaggatacgctcaagcgccgcagctggccgctgaacgagggggttatggctgtgggcctggtgtccatcttagccagctccctgcttcggaacgatgtccccatggccggccccctggtggccgggggcatgctcatcgcgtgctacgtgatcaccgggaccagcgccgacctgaccgtcgaaaaagccgccgacgtgacatgggaggaggaggcggagcagacaggcgtgtcccacaaccttatgattaccgtcgacgacgacgggaccatgcgcatcaaggacgacgagaccgagaacatcttgacggtgcttttgaagacagcgctgctgatcgtgagcggcatcttcccctactccatcccagccacactcctggtctggcacacctggcagaagcagacccagcggtctggcgttctgtgggacgtccccagtcccccggagacccagaaggccgagctcgaggaaggggtctaccgcattaaacagcagggcattcttggaaagacccaggtgggcgttggggtccagaaggagggcgtgttccacaccatgtggcacgtgacgcggggcgccgtcctgacccacaacggcaagcgcctcgagcctaactgggcgagcgtaaagaaggacctgatctcctacggagggggatggcggcttagcgcccagtggcagaagggggaggaggtgcaggtcattgccgtggagcccggcaagaaccccaagaacttccagaccatgccaggcaccttccagacgacaaccggggagatcggcgccatcgccctcgacttcaagccgggcaccagcggcagtcccatcatcaaccgcgagggcaaggtggtcgggctttatggcaacggtgtggtgacgaaaaacggcgggtacgtcagcggcatagcccagacctccgccgagcccgacggcccgacccccgagctggaagaggagatgttccggaagaggaacctgaccatcatggatttgcacccagggagcggcaagacgcggaaatacctgcccgctatcgtgcgcgaggccatcaagcggcgcctgcggactctcatactggccccgactcgggtggtagcagccgagatggaagaggccctgaagggactccccatccggtaccagaccacggccaccaagtccgagcacacaggcagggaaatcgtggacctgatgtgccatgcgaccttcacaatgcggctactcagtcccgtgagggtcccgaactacaacctgatcattatggacgaggcgcatttcaccgacccggcctccatcgccgcccggggatacatctcgacccgcgtggggatgggggaggcggctgccatcttcatgaccgccacgccgccaggcactgccgacgcgttcccccaatctaacgccccgatccaggacgaggaacgcgacatccccgaaaggagctggaactcgggcaacgagtggatcacggacttcgccgggaagaccgtgtggttcgtccccagcatcaaggccggaaacgacatcgccaactgcttaagaaagaacgggaagaaggtgatccagctctcccggaagacgttcgacaccgagtaccagaagaccaagttaaacgactgggacttcgtggtgaccaccgacatctccgagatgggcgcgaacttcaaggcagaccgtgtgatcgatcccagacgctgcctgaagccggtgatactcaccgacggccccgagcgtgtcatccttgcagggccaatgcccgtgaccgcggcctccgcggcccagcgtcggggccgcgtggggcggaaccctcagaaggagaacgaccagtacatcttcaccggccagcccctgaataatgacgaagaccatgcgcactggacggaggccaagatgctcttagacaacatcaatacgcccgaagggatcatccccgcgctgttcgaaccggagcgcgagaagagtgccgccatcgatggcgagtatcggctcaagggcgagagccgcaagaccttcgtagagctgatgcggcgcggtgacctgcccgtgtggcttgcccacaaggtggccagcgagggcatcaagtacaccgacagaaagtggtgtttcgacgggcagcgcaacaatcagatcctggaggagaacatggacgtcgagatctggaccaaagagggtgaaaagaagaaattgcggccccgctggctagacgcgcgcacgtactccgaccctttagctctgaaggagttcaaggatttcgccgccggccggaaatccattgccctcgacctggtgaccgagatcgggcgcgtcccgagccacctggcgcaccggacccgcaacgccctcgacaacctggtaatgctgcacacctccgagcacggcgggcgggcctaccgccacgccgtggaggagctccccgagacgatggagaccctgctcctactgggcctgatgatcttgttgactggtggcgccatgctgttcctcatcagcggcaaggggatcggcaagacctccatcgggctgatctgcgtcatcgcgagctccggcatgctgtggatggccgacgtgcctctccagtggatcgcctccgccatcgtgctcgagttcttcatgatggtcctgctcatcccggagcccgagaagcagcggacaccccaggacaaccagctggcctacgtggtaatcgggatactaacgctcgcggcaatcatcgccgccaacgagatgggcctgctggagaccacgaagcgagatctcggcatgtccaaggagcctggcgtcgtgagcccgacgtcctacctcgacgtggacctgcaccccgcgagcgcctggacactctacgccgttgccacaaccgtcatcacgcccatgctgcggcacaccatcgagaactccaccgccaacgtgtcactggcggctatcgctaaccaggccgtcgtgctcatgggcctggacaagggatggccaatcagtaagatggacctgggtgtgccgctcttagcccttgggtgctacagccaggtcaatccccttactctgacggcggccgtgctgctcctgatcacccactacgctatcatcggccctggcctacaggccaaagccacccgcgaggcgcagaagcggacggccgccgggataatgaagaatcccacggtggacggtatcatgacgatcgacctggacccagtaatctacgactccaagttcgagaagcagctgggccaggtgatgctcctcgtgctgtgtgcggtccagctgctcctgatgcgcaccagctgggccctgtgtgaggccctcaccctggccacgggacccattaccaccctgtgggagggctcccccgggaagttctggaacaccacgatcgcagtgagcatggccaacatcttcagagggtcctacctcgcgggggccggccttgcctttagcattatgaagtccgtggggaccggcaagcgcggcaccgggtcccagggcgagaccctgggagagaagtggaagaagaagctcaaccagctcagccggaaggagttcgacctgtacaaaaagtccggcatcaccgaggtcgaccgaacggaggccaaagaggggttgaagagaggcgagacaacccgccacgccgtgagccggggctccgcgaagctgcagtggttcgtggagcggaacatggtcatccctgaggggcgggtgatcgacctgggctgcggtcgcggcggttggagctactactgcgcaggcctcaagaaggtgaccgaggtccgcggctacacgaagggcgggccagggcacgaggagcccgtgcccatgtccacctacggctggaacatcgtgaagctgatgagcgggaaagacgtcttctacctgcccccggagaagtgcgacaccttgctgtgcgacatcggcgagtcctctccctcccccactgtggaggagagccggacgatccgcgtgctgaagatggtcgagccctggctgaagaacaaccagttttgcatcaaggtgctcaacccgtacatgcccaccgttatcgagcatctggagcggctgcagcgcaagcacggcgggatgctcgtccggaaccccctgtcccggaacagcacccacgagatgtactggatctccaacggcaccgggaacattgtgtcctccgtgaacatggtgagccggctgctcctgaacagattcacaatgacacaccgtcgccctaccattgagcgggacgtggatctgggcgccggcacccgccacgttaacgcggagccggagatacccaacatggacgtcatcggggagcggatcaagcgcatcaaggaggagcacaactccacgtggcactacgacgacgagaacccctacaagacttgggcctaccacggctcctacgaggtaaaggcgaccgggagcgcctccagcatgatcaacggggtggtgaagctcctgaccaagccgtgggacgtggtccccatggtgacgcagatggccatgaccgacaccacccccttcggtcagcagcgggtgttcaaggagaaggtcgatacgcgcacgcctcggccgatgcccggcaccaggaaggtgatggagatcaccgccgagtggctttggcggacgctcgggcgcaacaaacgcccccggctttgcacccgtgaggagttcaccaagaaggtacggaccaacgcggccatgggggccgtcttcacggaagagaaccagtgggactcagccaaggccgcggtggaggacgaggagttctggaaactggtggaccgcgagcgggagctccacaagctgggtaagtgtggcagctgcgtctacaacatgatgggcaagcgagagaagaagctgggggagttcggcaaggccaagggctctcgggccatctggtacatgtggctcggtgcccgctatctggagtttgaggccctgggcttcctcaacgaggaccactggttcagccgggaaaattcctacagcggggtggagggcgaggggctgcacaaactgggctacatcctccgtgacatatccaagatccccggcggggctatgtacgccgacgacaccgccggctgggacacccggatcacagaggacgacctccataacgaggagaagatcacgcagcagatggacccggaacaccgccagctggccaacgccatcttcaagctcacctaccagaacaaggtggtcaaagtgcagcggcccacccccaccggtaccgtgatggacatcatcagcaggaaggaccagagggggtccggccaggtagggacgtacggcctgaacaccttcaccaacatggaggcacagctggtgcgccagatggagggggagggcgtactcagcaaagccgatctggagaacccccacctcctcgagaagaagatcacccagtggctggagacaaagggggtcgagcggctgaagcgcatggccatctccggcgacgattgcgtggtgaagccgatcgacgaccggttcgccaacgccctcctggcgctgaacgatatgggcaaggtacgcaaggacatcccccagtggcagcccagcaaggggtggcacgactggcagcaggtccccttctgctcccaccacttccatgagctcatcatgaaggacggccgaaagctggtggtcccctgcaggccccaggacgagctaatcgggagagcccggatcagccagggcgccgggtggtccctccgcgagaccgcctgcctgggcaaggcgtacgcccaaatgtggagcctgatgtactttcatcggcgcgacctccggcttgcttccaacgctatctgcagcgccgtacccgttcactgggtacccaccagccgcaccacgtggtccatccacgcgcaccaccagtggatgaccactgaggacatgctgaccgtgtggaaccgggtctggatcgaggacaacccgtggatggaggacaagacgcccgtcaccacctgggagaacgtgccctacctcggcaagcgcgaggaccagtggtgcgggagcctaattggcctgacctcccgggccacgtgggcccagaacatccccacggccatccagcaggtccgcagcctcatcgggaacgaggaatttctggactatatgccgtccatgaagcggtttcgcaaggaggaggagagcgagggcgccatctggtga

SEQ ID NO: 25790 - RNA, 9873 nt, synthetic construct
  misc_feature 1..9873: note = derived and/or modified CDS sequence (opt11) from DENV-3__FJ882571__SS-prME
  source 1..9873: mol_type = other RNA
acatcgctatgccttatgatgatccttcccgcagcgctagcgttccacctcactagtcgggatggcgagccccggatgatcgtcgggaagaatgagcggggcaagagcctgcttttcaaaaccgcctctgggatcaacatgtgcaccctgatcgccatggatctgggggagatgtgcgatgacactgtcacctataagtgtccccacatcacggaggtcgagcccgaggacatagactgctggtgcaacttgaccagcacatgggtgacctatggtacgtgtaaccaagccggcgaacataggcgcgacaagcggtccgtcgccttggcaccccacgtgggcatggggctcgacacccgcactcaaacctggatgtctgccgagggagcctggcgacaggtggagaaggtggagacgtgggccctccgccatccggggttcaccatcctggcgctctttctggcccactatatcggaacctccctcacccagaaggttgtgatctttatccttctgatgctcgtcacccccagtatgaccatgaggtgcgtgggggttggcaacagagacttcgtcgagggcctgtccggtgccacctgggtcgacgtagtcctggagcacggcgggtgtgttaccacgatggccaagaacaagcccaccctcgacatcgagctgcagaagacagaggctacccagctggcgaccctacgaaaactgtgtattgaggggaagatcaccaatatcaccaccgacagcaggtgtccgacgcagggcgaagcagtgctgcctgaggagcaggaccaaaattacgtctgcaagcacacctacgtagaccgggggtggggaaacggatgcggccttttcggtaagggcagcctggtgacctgcgccaagttccagtgcttggagcccatagagggcaaggttgtgcagtacgagaatcttaaatacactgtgatcattacggtgcacaccggggaccagcaccaggtgggaaacgagacgcagggggtcaccgccgaaattacgccccaggcctcaaccaccgaggcgatcctgccagaatacggcacgctggggttagaatgctccccgaggaccggtttggacttcaacgagatgatactgctcaccatgaaaaacaaggcgtggatggtccaccggcagtggttcttcgacttaccactgccctggaccagcggtgccacgacggagaccccaacctggaaccgtaaggagctgctcgtcaccttcaagaatgcacacgccaagaagcaggaggtcgtggtgctgggatcgcaggagggcgcgatgcacacggccttaaccggggctacagagatccagaattcaggagggacgtccatcttcgccggccaccttaagtgccgcctgaagatggataagctcgagctaaagggcatgtcctacgcaatgtgcaccaacacgtttgtcctgaagaaggaagtatcggaaacccagcacgggacgattcttatcaaggtcgagtacaaaggcgaggacgctccgtgtaaaatccccttcagcaccgaagacgggcagggaaaggcccacaacggccgcttaataacggcgaaccccgtcgtaaccaagaaagaggagcccgttaacatcgaagcagagcccccgtttggagagagtaacatagtcataggcatcggcgacaacgctctgaaaatcaattggtacaagaagggcagctcgataggtaagatgttcgaggcaaccgcccgcggcgctcgtagaatggccatcctcggcgacaccgcgtgggacttcggctcggtcgggggggtgctcaactcgctaggcaagatggtccatcagatattcgggtccgcctacacggcgctgttcagcggcgtgtcgtgggtgatgaaaataggaattggggtcctactaacctggatcggcctgaactctaaaaacacatcaatgtcgttctcctgcatagcaatcgggatcatcaccctttatctgggcgccgtagtacaagcggacatggggtgcgttattaactggaagggcaaagagctgaaatgcgggagcgggatcttcgtgacgaacgaggtccacacctggaccgagcagtacaagttccaggccgactcccccaagcgcttggcaaccgctatcgcaggcgcctgggagaacggtgtctgcggcatccggagcacgacccggatggagaacttgctgtggaaacaaatcgccaatgagctcaattacatcctgtgggagaataatattaaactcaccgtggtggtcggtgacacaatcggcgttttggagcaaggcaagcgcacgctcacgccccagcctatggagcttaaatattcctggaagacctggggaaaggccaagatcgtgaccgccgagacacaaaatagtagtttcatcatcgacgggcccaatacacccgagtgccccagcgcgtcccgggcctggaacgtatgggaagtagaggactacggatttggagtgttcaccaccaacatctggctcaagctgcgcgacgtttacacccagctctgtgatcacaggctcatgagtgccgccgtcaaggacgagcgcgccgtgcacgctgacatgggctattggattgagagccagaagaacggatcctggaaacttgaaaaggccagcctcatcgaggtcaagacgtgcacctggcccaagtcgcacaccctctggagcaatggagttctggagtccgatatgataatccccaaaagcctggccggccctatcagccagcacaactacagaccggggtaccacacccagacggccggtccctggcatctcggaaagctggagctagactttaactactgtgagggcaccacagttgtcataactgagaactgcgggacacgcggcccgtctctccggactaccacagtttccgggaagctgatccacgaatggtgctgtcgaagttgcacgctgcccccgctccggtacatgggcgaagacgggtgttggtatggcatggaaatccggcccatatcggaaaaagaggagaacatggtcaagagtctagtgtccgccggcagcggaaaggtggacaacttcacgatgggtgttttgtgcctcgccattttgttcgaggaggtgatgcggggcaagttcgggaaaaagcacatgatcgccggagtgcttttcacctttgttttgctattgtccgggcaaataacatggcgcgatatggcccacacactgattatgataggaagcaatgcctccgaccggatgggtatgggcgttacctacctggctctgatagcgacgttcaagatccagcccttcctggcactggggttcttcctgcgcaagctgacttctcgggagaacctgctgttgggcgttggcctggccatggccacgaccctacaactccccgaggacatcgagcagatggcgaacgggatagccctggggctcatggccctaaagctgattacccagttcgagacataccagctgtggaccgcgctagtgagcctgacctgtagcaacaccatcctaacactaacggtcgcctggcgcaccgcgacgctgatcctggccggcgtgagcctgctgcccgtgtgccagagtagctccatgcggaaaaccgactggctgcccatgacggtagccgccatgggcgttcctcccctccctctgttcatcttcagcctgaaggacaccctcaagcgccgctcctggccgttaaacgagggggtgatggccgtgggcctagtgagcattctcgcctcgagcctattaaggaacgacgtccccatggcaggacccttagttgcggggggccttctgatcgcatgttatgtgatcactggtaccagcgctgatctcattgtagagaaggcggccgacgtcacgtgggaagaggaggccgagcagacaggcgtctctcacaacctcatgatcacagtcgatgatgatgggaccatgcgaatcaaggacgatgagaccgagaacatcctgaccgttttgctgaagacagccctgttaatcgtaagcggtatattcccttacagcatccccgccactttactggtctggcacacctggcaaaagcagacccagcgctctggggtgctctgggacgtcccttcaccgccggaaacccaaaaggcggagctggaagagggagtctacaggatcaagcagcagggcatcctcggaaagacccaggtgggggtgggtgtccagaaggagggagtcttccacaccatgtggcacgttaccagaggcgccgttttgacccacaatgggaaaagacttgagcccaactgggcctcggtgaagaaggacctgattagctacggcgggggctggcgtctgagcgcgcaatggcaaaaaggggaggaagtgcaggtcattgcggtagagcccggcaagaacccgaagaacttccaaaccatgcccgggaccttccagacgactacgggcgagatcggagccatcgccctcgacttcaagcctgggacaagcggcagccccatcatcaaccgcgagggcaaggtggtggggctgtacgggaacggcgtcgtgaccaaaaacggaggttacgtctctggcatcgcgcagacgaacgccgagccggatggccccacccccgaactagaggaggagatgttcaagaagcggaacctcacaattatggacctccacccggggagcggcaagactcgcaaatacctgccggcgatcgtgcgcgaggccataaagagacgtctacgaaccctgatactggcacccacaagggttgtagccgccgagatggaagaggcactcaaggggctccccatccgctaccagaccacggccaccaagagtgagcacaccggccgagaaatcgttgatctgatgtgtcacgccactttcacgatgcgcctgctcagccccgtgcgcgtcccgaactataatctgatcatcatggacgaggcacattttacagaccccgcatccatcgctgcacgcgggtacataagcacccgagtcggcatgggggaggcggccgctatcttcatgaccgccacgccacccgggacagccgacgccttcccgcagtccaacgcgcccatccaggacgaggaacgagatatccccgaacgcagctggaactcaggcaacgaatggatcaccgacttcgcgggcaagaccgtgtggttcgtccccagcatcaaggcgggcaacgatatcgcaaactgcttaagaaaaaacgggaagaaggtcatccagctaagccgcaagaccttcgacacagaataccagaaaactaagctgaacgattgggacttcgtcgttaccacggacataagcgagatgggggccaacttcaaagccgatagggtgatagacccaagacggtgcctcaagcccgtgattctgacagacggccccgaacgcgtaatcctagcgggaccgatgccggtaaccgccgcgtccgcggcacagcggcgcggccgggtgggccgcaacccccagaaggaaaacgaccaatacattttcaccggccagccactgaacaacgatgaggatcacgcccactggaccgaggccaagatgctgctggacaacatcaacacgcccgaggggatcataccagcattgttcgagcccgagcgggagaaatccgctgcgatcgacggtgagtaccggctgaagggcgagtcccgtaaaaccttcgtcgagctgatgcgccgcggggacctccccgtgtggctggctcacaaagtagccagcgaaggtatcaagtatacagaccggaagtggtgcttcgatgggcagaggaacaatcagatccttgaggagaacatggacgtggagatatggaccaaagagggcgagaaaaagaagcttagaccccgttggctggacgcccgcacgtacagcgacccgctggccctgaaggaatttaaggatttcgcggcaggacgcaaaagcatcgccctggacctggtgacggaaatcggtcgggtaccatcccacctggcccaccgcacgagaaacgcgctcgataacctcgtgatgttacacaccagtgagcacggcgggcgagcttacaggcacgctgtcgaggagcttcctgagacgatggagaccctcctcctcctgggcctcatgatcctgctgaccgggggagccatgctttttctgatcagcggcaaggggatcggcaagacctccatcgggctcatctgtgtcattgcaagctccggcatgctctggatggccgagatacccctacagtggatagcgtccgccatcgtgctggaattcttcatgatggtgctcttgatccccgagcctgagaaacagcgtacgccccaggacaatcagctggcctacgtcgtgatcggaattctcacgctggccgccatcatcgcggccaacgaaatggggctgctcgaaaccaccaagcgggaccttggcatgtcaaaggaacccggggtcgtttcacccacatcatacctagatgtggacttgcaccccgccagcgcctggacactgtatgcggtggccacgacagtgattacgcctatgctgcgccacacgatcgagaattccaccgccaatgtgtccctcgccgccatcgctaatcaagccgtggtcctgatgggactggacaaggggtggccgatctccaagatggatttaggagtgcccctgctggcactcggctgttacagccaggtcaaccccctgaccctgaccgccgccgtcctcctgctgatcactcactacgcgataataggccctggcttacaggccaaggccacgcgggaggcccagaagcgaaccgccgcggggatcatgaaaaacccgactgtggacggcattatgactatcgatctggaccccgtgatctatgactccaaatttgagaaacagctggggcaggttatgctcctggtgctgtgcgcggtgcagctcttactgatgcggacctcgtgggctctttgcgaggcattgaccctggccacaggcccgattaccaccctctgggagggctcccccgggaaattctggaatacgacgatcgcagtctccatggccaatatcttccgcggctcctacttagctggggctggcctggccttcagcatcatgaagtccgtgggcaccggcaagcgggggaccggcagccagggtgagaccctcggagaaaaatggaagaagaagctcaatcagctttcacgcaaggagtttgacctctacaaaaaatccggcataaccgaggtcgatcggacggaggctaaggaggggctgaagcgcggtgagatcacccaccacgcggtcagccgaggcagtgcgaagctgcagtggtttgttgaacgaaacatggtaatcccggaggggcgggtcatcgacctcggttgcgggcgcggcggatggagctattactgcgccggcctaaaaaaggtgacagaggtccggggctacactaaaggcgggcccgggcatgaggagcctgtaccaatgtccacgtacggctggaacatcgtgaagctgatgagcgggaaggatgtgttctacttacctcccgagaaatgcgacacgttgctgtgcgacatcggcgaatccagccctagtccaacagtggaggagagccgtaccatccgcgtgctgaagatggttgagccgtggcttaagaataaccagttctgcattaaggtcttgaatccctacatgccaactgtaatagagcacctagagcggctgcagcgcaaacatggtgggatgttagtccggaaccctctgtctcgcaatagcacgcacgagatgtattggatctccaacggcaccgggaacatcgttagctccgtcaacatggtgagccggctcctgctgaaccgcttcactatgacgcaccgccggccgacaatagaaaaagacgtagacctcggcgcggggacgcggcacgtgaacgcggagccagaaaccccaaatatggacgtaatcggggagcgcatcaagagaataaaggaggagcacaacagtacttggcactacgacgacgaaaacccgtacaaaacatgggcctaccacggcagctatgaggtcaaagctaccgggagcgccagcagcatgatcaacggcgtagtcaaactgctcaccaaaccctgggacgtggtgccaatggtgacgcaaatggcgatgactgatacgactcctttcgggcagcagcgcgtgtttaaggagaaggtggacacgcgaacgcctcgcccgatgcccgggacccgtaaggtcatgggcatcaccgcagagtggctgtggcgcacactggggagaaacaaacgaccccggctgtgtacccgcgaggagttcactaagaaggtgcgcactaatgccgccatgggcgcggtgttcaccgaggagaaccagtgggactcggccaaagccgccgtagaggacgaggagttctggaagctcgtggatcgagagcgggaactgcacaagcttgggaagtgtggcagctgcgtatacaacatgatgggtaagagggaaaagaagctcggggagtttggtaaagcgaagggctcccgcgcaatctggtatatgtggctgggtgcccgatatctagagttcgaagcgctcggtttcctgaatgaggaccactggttttctcgggacaactcctactctggggtggagggggaggggctgcataagctcggatacatcctgcgcgacatctccaagatccccggcggggcgatgtacgcggacgacaccgccggttgggatacccgcatcaccgaggacgacctgcacaatgaggagaagatcacccagcagatggatcccgaacaccggcagctggctaatgccatctttaagctgacgtaccagaacaaagtagtgaaggtccagcggcccactcctaccggtaccgtcatggacatcatcagccggaaggaccagcggggcagtgggcaggtgggcacatacggtctaaatacattcaccaacatggaggttcagctcgtgcggcaaatggagggcgagggagtgttaagcaaggctgacttggaaaacccgcacctacccgagaagaaaatcacccagtggctggagacgaagggagtggagcgcctgaaacggatggccatcagcggggatgattgcgtggtgaagcccatagacgaccgcttcgcgaacgctctgttagccctgaacgacatggggaaggtgaggaaagacattccccaatggcagcctagcaagggaatgcacgactggcagcaagttccgttctgctcccatcacttccacgaactcatcatgaaagacgggcgcaagctagtggtcccgtgccgtcctcaggacgagctgatcggccgcgcccggataagccagggagccgggtggtcactccgcgagaccgcgtgcctcggaaaggcttacgctcagatgtggagcctgatgtacttccaccgccgggacctccgcctggcatccaacgcgatctgtagcgccgtgccggtgcattgggtccccacatccaggactacctggtctatccacgcccatcaccagtggatgacgacggaggacatgctggccgtgtggaatagggtgtggatcgaggacaatccctggatggaggataagacccccgtcacgacctgggaggacgtcccttacctcggaaagcgcgaggaccagtggtgcggctcgctgatcgggctgacttccagagccacgtgggctcagaacatcctcacggcgatccaacaggtccgtagcctgatcggcaacgaggagtttctagactatatgccctccatgaagcgcttccggaaggaggaggagtctgagggggcgatatggtga

SEQ ID NO: 25791 - RNA, 9873 nt, synthetic construct
  misc_feature 1..9873: note = derived and/or modified CDS sequence (opt11) from DENV-3__FJ882572__SS-prME
  source 1..9873: mol_type = other RNA
accagcctatgcttaatgatgattctgcccgccgctctggcctttcacctcaccagccgcgacggggaaccccggatgatcgtggggaagaacgagcgcggcaagtcgttactctttaaaaccgcctccgggatcaacatgtgcactctcatcgccatggacctcggggagatgtgcgacgacaccgtgacctacaagtgcccccatatcaccgaggtggagcccgaagacatcgactgctggtgtaacctaaccagcacctgggtaacctacgggacctgcaaccaggccggcgaacaccgtcgcgacaagcggtccgtcgccctcgcgccccacgttggcatgggcttagacacccgcacccagacctggatgagcgccgagggcgcttggcggcaggttgagaaggtcgagacctgggccctgagacaccccgggttcaccatcctcgcgctgttcttagcccactacatcggcacttccctcacccagaaggtggtgatcttcattctgctgatgcttgtcacacccagcatgactatgcgctgcgtgggcgtgggcaaccgcgacttcgtcgagggcctgtccggggccacgtgggtggacgtggtcctggagcacggcgggtgcgtgaccacgatggcaaagaacaagcccaccctcgacatagagctgcagaagaccgaggccacccagctggcgactctcagaaagctgtgcatcgagggcaagatcaccaacatcaccaccgacagccgctgtcccacgcagggcgaggccgtgctgcccgaggagcaggaccagaactacgtctgcaagcacacctacgtggacagagggtggggcaacggatgcggcctcttcgggaagggatccctggtgacctgcgccaagttccagtgtctggagagcatcgagggcaaggtcgtgcagtacgagaacctcaagtacaccgtgatcattacggtccacaccggggaccagcaccaagttgggaacgagacccagggggttaccgccgagatcacgccccaggcttccaccactgaggctatcctgcccgagtacggcaccctggggctcgagtgcagcccccgcacgggactcgacttcaatgagatgatcctgctcactatgaagaacaaggcctggatggtgcaccgccagtggttcttcgacctaccgttaccttggacctccggcgccaccacagagacgcccacctggaaccgcaaagagctcctggtgactttcaagaacgcccatgccaagaagcaggaggttgtcgtgctggggagccaggagggcgcgatgcacacagccctgacgggggccacggagatccagaactccggtgggaccagcatcttcgcaggccacctaaagtgccggctgaagatggacaagctcgagttgaaaggcatgtcctacgccatgtgcaccaatacgttcgttctgaagaaggaggtgagcgagacccagcacgggaccatcctcatcaaggtggagtacaaaggcgaggacgcgccctgcaagatccccttcagcaccgaggacgggcagggcaaagcccacaacggccgcctgatcacggctaaccccgtcgtgacaaagaaggaggagcccgtgaacatcgaggccgagcccccgttcggtgagagcaacatcgtcatcgggatcggggacaacgcgctgaagatcaactggtacaagaagggcagctccattgggaagatgtttgaggccaccgcccggggcgcccgccggatggccatcctgggagacaccgcgtgggacttcgggagcgtcggcggggtcctcaactccctgggcaagatggtccaccagatcttcgggagcgcctacacggccctgttctccggcgtcagctgggtcatgaagatcgggatcggggtcctcctgacctggatcggcctgaactccaagaacaccagcatgtccttctcttgtatcgccatcgggataatcaccctctacctgggcgccgtggtgcaagcggacacggggtgcgttatcaactggaagggcaaggagctgaaatgcggctccgggatcttcgtgaccaacgaggtgcacacctggaccgagcagtacaagttccaggccgacagccccaagcgcctcgccaccgccatcgccggagcgtgggagaatggggtctgcggcatacgatccaccacccggatggagaacctgctatggaagcagatcgccaacgagctcaactacatcttatgggagaacaacatcaagttaaccgtcgtggtcggggatacgatcggcgtgctcgaacagggcaaacgcaccctgacgccccagcccatggagctgaagtacagttggaagacctggggtaaagccaagatcgtgacggccgagatccaaaactccagcttcatcatcgacggtccgaacacccccgagtgcccctccgcgtcgcgggcatggaatgtctgggaggtcgaggactacggcttcggcgtgttcactaccaacatctggctcaagctgcgcgaagtctacacccagctatgcgaccaccggctcatgagcgccgcggtgaaggacgaacgcgccgtgcacgcggacatgggctactggatcgagtcccagaagaacgggagttggaagctggagaaggcctcattcatcgaggtcaagacgtgcacctggcccaagagccacacactgtggtctaacggcgtactcgagagcgacatgatcatcccgaagtccctggccgggccaattagccagcacaactatcggcccggctaccacacgcagacggcggggccgtggcacctgggcaagctcgagctcgacttcaactattgcgagggcaccaccgtggtgattaccgagaactgcgggacgcgcggcccttccctgcggaccactaccgtgagcgggaagctcatccacgagtggtgctgccgatcctgtactttaccgcccctgcggtatatgggggaggacgggtgctggtacggcatggaaatccgtccgatcagcgagaaggaggagaacatggtgaagtccctcgcgagcgcgggctccgggaaggtcgataatttcaccatgggggtgctgtgcctggccatcctcttcgaggaggtgatgcgggggaagttcggcaagaagcacatgatcgccggggtcttcttcaccttcgtgctgctgctcagcggccagatcacctggcgcgacatggcccacacgctgattatgatcggctcaaacgccagcgaccggatggggatgggtgtgacttacctggcgctcatcgcgaccttcaaaatccagccattcctggcccttgggttcttcctccgcaagctgaccagccgggagaacctgctcctgggcgtcggcctggccatggcgaccaccctccagctgcccgaggacatcgagcagatggccaacgggatcgccctgggcctcatggccctgaagctgatcactcaatttgagacctaccagctctggacggcgttaatctcgttaacctgtagcaataccatgttcaccctcacggtggcgtggcgcactgctaccctgatcctggccggggtgtccctcctacccgtctgccagagctcctcgatgcggaagaccgactggctgccaatgacggtggccgccatgggcgtcccgcccttaccactgttcatcttctcccttaaagataccctcaagcgccgcagctggccgctgaacgaaggtgtgatggcagtgggactggtctccatcttagcaagctccctgctgcggaatgacgtgcccatggccggccccctcgtggccgggggaatgctgatcgcctgctacgtcatcaccgggaccagcgcagaccttacggtggaaaaagccgccgacgtaacctgggaggaggaggccgagcagaccggcgtctcccacaacctcatgattaccgtggacgacgacgggactatgcgtatcaaggacgacgagacggagaatatcctgaccgtgcttctcaagaccgccctgctgatcgtcagcggaatcttcccctactccatcccggcgaccctcctggtgtggcacacatggcagaagcaaacccagcggagcggagtgctgtgggacgtccccagcccgccggagacccagaaggccgagctcgaggagggggtgtaccgcatcaagcagcagggcatcctgggcaagacccaggtgggcgttggggtgcagaaggagggagtgttccatacaatgtggcacgtcaccaggggcgccgtgctgacccacaacgggaagcgactcgagccgaactgggcctctgtaaagaaggacctgatctcctacggcgggggctggcgactgagcgcgcagtggcagaagggggaagaggtccaggtgatcgccgtggagcccggcaagaaccctaagaactttcagaccatgcctggcactttccagaccaccaccggggagatcggcgcaatcgctctcgacttcaagccggggacgagcggctcccctatcatcaacagagaaggcaaggtcgtggggctgtacggcaacggggtggtcaccaagaacggcgggtacgtgagcggcatcgcgcaaacgtccgcggagcccgacggcccgacccccgagctggaggaggaaatgttccggaagcgcaacttaacgattatggatctccaccccgggagcggcaagacccggaaatatctgcccgccatcgtgcgcgaggctatcaagcggcggctgcgaaccctcattttagctccgacccgcgtcgtggccgcggagatggaggaggccctgaagggactccccatccggtaccagacgaccgccactaaatccgagcacaccggccgggagatcgtagacctgatgtgccacgccacgttcaccatgagactgctcagccccgtccgcgttcccaattacaacctcattatcatggacgaggcccacttcaccgacccggcctccatcgccgcccgggggtacatcagcactcgcgtgggcatgggcgaggccgcggccatcttcatgacggccactccgcccgggaccgccgacgccttcccccagtccaacgcaccgatccaggacgaggagcgcgacatccccgagagaagctggaactccggaaacgagtggatcaccgatttcgccggaaagacggtctggttcgtgcccagcatcaaggccggcaacgacatcgccaactgtctgcgcaaaaacgggaagaaggtgatccagctgagccggaagacattcgataccgagtaccagaagaccaagttgaacgactgggacttcgtcgtaacgaccgacataagcgagatgggcgccaacttcaaagcggaccgagtgatcgacccacggcgctgcctgaagccggtaatcctcaccgacggccccgagcgggtgatcttggccgggcccatgcccgtgaccgccgcatcagccgcgcagcgacggggccgcgtcgggcggaacccacagaaggagaatgaccagtacatcttcaccggccagcccttgaacaacgacgaggaccacgcacactggacggaggcgaagatgctcctagacaacatcaacacccccgaggggatcattcccgcgttattcgagcccgagcgcgagaagtccgcggccattgatggcgagtaccggctaaagggagagagccgcaagaccttcgtggaactgatgcggagaggggacctgcccgtttggctcgcccacaaagtcgccagcgagggcatcaagtacaccgatcggaagtggtgcttcgacgggcagcgcaacaaccagatccttgaggagaacatggacgtggagatctggacgaaggagggcgagaagaagaagttgcggcccagatggctcgatgcccgcacctactccgaccccctggctctgaaggagttcaaggacttcgccgccggccggaagtccatcgcccttgacctggtcaccgagatcgggcgtgtgccgtcccacctggctcaccggacccgcaacgcgctcgacaacctcgtgatgctgcatacgtccgagcacggcggacgggcgtaccgccacgccgtcgaggaactccccgaaaccatggagacccttctgctactgggcctgatgatcttactgactgggggggccatgctgttcctcatctccggcaaggggatcggcaaaacgtccattgggctgatctgcgtgatcgccagctccgggatgctgtggatggcagatgtgcccctccagtggatcgccagcgccatcgtcctggagttcttcatgatggtgctgctcataccggagccggagaagcagcggacgccccaggacaaccagctggcctacgttgttattgggatccttaccctcgccgcgatcattgccgccaacgagatgggcctgctggagaccactaagcgcgacctcggcatgtcgaaggaacccggggtggtgtctccgacctcctatctggacgtcgacctgcaccccgccagcgcgtggaccctctacgccgtggccacaacggtgataacccccatgctgcggcacacgatcgagaactccactgcgaacgtcagcttagccgccattgccaatcaggccgtggtgctgatgggcctggacaaggggtggcccatcagtaagatggacctgggcgtccccctcctggccctggggtgctactcacaggtaaaccccctcacgctgaccgccgcggtgctgctcctgatcacccactacgccataattggccccggcctgcaggccaaggccacccgcgaggcccagaagcgaacggcggccggtatcatgaagaaccccaccgtagatggcatcatgactatcgacctcgacccggtgatctacgactccaagttcgagaagcagctcggccaggtgatgctgctggtcctgtgcgccgtgcagcttctcctcatgcgcaccagctgggctctgtgtgaggcgttaacgctggctactggccccatcactaccctgtgggagggctcccccggtaagttttggaacacgacaatcgccgtgagcatggccaacatcttccggggctcatacctcgctggggcgggcctggcctttagcatcatgaagtccgtcgggaccggcaagcgcggcaccgggtcccagggcgagaccctgggggagaagtggaagaagaaactcaaccagttatcgcggaaggagttcgatctgtacaagaagtcgggcatcactgaggtggaccgaaccgaggccaaggaggggctcaaacggggcgagaccacccaccacgccgtgagccgcggctccgccaagcttcaatggttcgtcgagcgaaacatggtgatccccgaggggcgcgtgatagaccttggctgcggaagaggcgggtggagctactactgcgcgggcctcaagaaggtgacggaggtgcgcgggtacaccaagggcgggccggggcacgaagagcccgtgcccatgtccacctacggctggaatatcgtcaaactgatgagcgggaaggacgtgttctacctgcccccggagaagtgcgacaccctgctgtgcgatatcggggagtccagcccctcccccacggtggaggagagtcgcaccatccgcgttcttaagatggtggagccctggctgaagaacaatcagttctgcatcaaggtccttaatccgtatatgcccaccgtcatcgagcatttggagcgtctacagcggaagcacggcgggatgctcgtgcgcaacccactgtctcggaatagcacccacgagatgtactggatttccaacggcacggggaacattgtgtcatccgtcaacatggtgtctcgcctgctcctgaaccggttcaccatgacccaccggagacccaccattgagcgcgacgtagacctgggcgcgggcacgcggcacgtaaacgccgagccggagatccccaacatggacgtgatcggtgagcgaataaagcggatcaaggaggagcacaactccacctggcactatgacgacgagaacccctacaagacgtgggcctaccacggcagctacgaggtgaaggccacggggagcgcgtccagcatgatcaacggcgttgtaaagctcctgacgaagccctgggatgtcgtgcccatggtgacccagatggccatgaccgacaccacgcccttcgggcagcagcgcgtcttcaaagagaaggtggacacccggacaccccgcccgatgcccggcacccgcaaggtgatggagatcacggccgagtggctgtggcgcactctcggccggaacaaacgcccccgcctgtgcacccgggaggagttcaccaagaaggtccgcacgaacgccgcgatgggggccgttttcacggaggagaaccagtgggactccgctaaagccgccgtggaggatgaggaattctggaagctggtcgaccgggagcgcgagctccacaagctgggcaagtgtggcagctgcgtgtataatatgatgggcaagcgggagaagaagctgggggagttcggcaaggcgaagggctccagggccatatggtacatgtggcttggggcccggtacctggagttcgaggccctgggtttcctcaacgaggatcactggttcagccgcgagaactcctacagcggtgtggagggcgaggggctgcacaagttaggctacatcctgcgggacatctccaagatccccggcggggcgatgtacgctgacgacaccgccggctgggacacccggatcacggaggacgacctgcacaacgaggagaagatcactcagcagatggacccggagcaccggcagctggccaacgccatcttcaaactcacctaccagaacaaggtcgtgaaggtgcagcgccccacgcctaccgggacggtaatggacatcatcagccggaaggaccagcgcggatccggccaggtagggacctacggcctgaataccttcaccaacatggaggcccagctggtgagacagatggagggggagggcgtcctcagcaaggcggacctcgagaacccccacctcctcgagaagaagatcacgcagtggctggaaaccaagggggtggagcgcctgaagcggatggccatcagcggagacgactgtgtggttaagccaatagacgacaggttcgccaacgcactcttggccctgaacgatatgggcaaggttcggaaggacataccccagtggcaaccctcaaaggggtggcacgactggcagcaggtccccttctgctcacaccacttccacgagctcatcatgaaggacggccgcaagctcgtcgttccgtgccggccccaggacgagctgatcgggcgcgcgcgaatctcacagggggccgggtggtccctccgggagactgcctgcttaggcaaagcctatgcgcagatgtggagcctgatgtacttccaccgcagggacctccgcctggcatcgaacgcgatctgcagcgccgtgcccgtccactgggtgcccaccagccggacgacctggtccatacacgcccaccaccagtggatgacgaccgaggatatgctgaccgtgtggaaccgcgtatggatcgaggacaacccgtggatggaggacaagactcccgtgaccacctgggagaacgtgccctacttgggcaagcgggaggaccagtggtgcgggagcctgatcggcctgacgtcccgcgccacctgggcccaaaacatccccaccgcaatccagcaggtccggagcctcatcgggaacgaggaattcctggactatatgccgtccatgaagcgcttccggaaggaggaagagagcgagggggccatctggtga

SEQ ID NO: 25792 - RNA, 9873 nt, synthetic construct
  misc_feature 1..9873: note = derived and/or modified CDS sequence (opt11) from DENV-3__FJ882573__SS-prME
  source 1..9873: mol_type = other RNA
acctccctatgcctaatgatgatccttcccgccgcgctggccttccacctcacttctcgtgacggggagccgcggatgatcgtggggaagaacgagcgcggcaagtcgctcctttttaagacggccagcggaatcaacatgtgcacgctcattgccatggatctgggcgagatgtgtgatgatactgtgacctataagtgcccccacatcacagaggtggagcccgaagacatcgactgctggtgcaacctgaccagcacatgggtaacgtacgggacgtgtaaccaggccggcgagcaccggcgcgataagcggtccgtcgccctcgcgccccacgtgggcatgggactggacacccgcacgcagacttggatgtctgccgagggagcctggcgacaggtcgagaaagttgagacgtgggccctgcgccacccggggttcaccatactggccctgttcctggcccactacataggcacctccctgacccagaaggtggtgatcttcatcctgctgatgctggtgaccccttctatgaccatgcggtgcgtgggggtaggcaatagggatttcgtggaggggctgtctggggccacatgggtggacgtggtactggagcacggcggatgcgtcaccactatggccaagaacaaacccaccctcgacatcgagctgcagaaaacagaggctacccagctggcgacgctccggaagctatgtatcgaaggcaagatcaccaacatcaccaccgactcccgctgccccacgcagggcgaggccgtgctgccggaggagcaggaccagaactatgtgtgtaagcatacatacgtggaccgtgggtggggcaacggctgcggcctcttcgggaagggctccctggtgacctgcgccaagttccaatgcctggagcctatcgagggaaaggtcgtgcagtacgagaacctcaagtacaccgtgatcatcacggttcacaccggcgaccagcaccaggtgggcaatgaaacccagggggtaaccgcggagatcacgccgcaagccagcacgaccgaggcgatccttcccgagtacggaactctggggctcgagtgctccccgaggaccggcctcgacttcaacgagatgatcttacttacgatgaagaacaaggcttggatggttcaccggcaatggtttttcgacctgcccctgccctgggccagtggagccaccaccgagacacccacgtggaaccgcaaggagctcctggtgaccttcaagaacgcccacgccaagaaacaagaggtcgtggttctgggttcccaggaaggcgccatgcacactgccctaaccggggcgacggagattcaaaattccgggggtaccagcatcttcgccggccacctgaagtgcaggctcaagatggacaagctggagctgaaaggaatgtcgtacgcgatgtgcaccaacactttcgtattaaagaaggaagtcagtgagacgcaacacggcaccattctcattaaggtggagtacaaaggcgaggacgccccgtgcaagattccgttcagcactgaagacgggcagggcaaggcacataacggccgcctgatcaccgctaatcccgttgtaaccaaaaaggaggaacccgtgaacatagaggcggagccgcccttcggggagagcaacatcgtcatcggtattggagacaacgccctcaagatcaactggtacaagaagggctcctctataggtaaaatgtttgaggccaccgcccggggcgctcgtagaatggcgatcctgggcgacaccgcatgggatttcgggtccgtgggcggtgtgctcaacagccttgggaagatggttcaccagatatttgggtccgcatacaccgccctgttctccggagtgtcctgggtgatgaagataggcatcggggtccttttgacgtggatcgggctgaacagcaagaacacgcccatgtcgttttcgtgtatcgcgatcggaatcatcactctctacctcggggcggtggtccaagccgatatggggtgtgtcatcaactggaagggcaaggagctgaaatgcggaagcggtatcttcgtcacgaacgaggtgcacacttggaccgagcagtacaagtttcaggccgacagccccaagcgtctggcgaccgctatcgctggcgcctgggagaacggggtttgcggtatccgctcaaccacgcgtatggagaacctgctttggaagcagatcgccaacgaattgaactatatcctgtgggagaacaacatcaagttgaccgtagtggtcggggacaccaccggagttctcgagcagggcaagcgcacgctaaccccgcagcccatggaattaaagtacagctggaagacctgggggaaggccaaaatcgtgactgccgagacgcagaacagctcattcatcatcgacggtcctaacaccccagagtgcccgtccgccagccgggcatggaacgtatgggaagtggaggactacgggttcggcgtgttcaccacgaatatttggctcaagttgagagaagtatacacccagttatgcgatcaccgtctcatgtcagccgcagtcaaggacgagcgcgctgttcacgccgacatgggttactggatcgagagccaaaagaacgggagctggaagttagagaaggcctcactgatcgaagtcaagacatgcacctggcccaagagccacaccctctggtccaacggcgtactggagtcagacatgatcatccccaagagcctggcggggccgattagccagcataactatcggcccggataccacacccagacggcggggccgtggcacctcggcaaactggagctggacttcaattactgcgaggggaccactgttgtcatcaccgagaattgcgggacacgcggcccctccctacgaaccaccaccgtcagcgggaaactaatccacgagtggtgctgccgctcctgcacactgccgcccctccggtatatgggagaggacggttgctggtacggtatggagatccgccctatcagcgagaaagaggagaatatggtgaagtccctagtcagcgcgggcagtgggaaggtggacaacttcaccatgggagtgctatgccttgccattctgttcgaggaagtgatgcgcgggaagttcggcaagaaacacatgattgctggggtgttcttcaccttcgtgttactcttgtctggccagatcacctggcgcgacatggcccacaccttaataatgatcgggtcaaatgccagcgatcgaatgggaatgggcgtcacctacctcgcgctgatcgccaccttcaagattcagcccttcctggccttggggttcttcctgcgcaaattaacatcacgggagaacttactactgggtgtgggcctggccatggccacgaccctacagttaccggaggacatcgagcagatggcgaacgggatcgccctcggcctgatggccctgaagctcattacacagttcgaaacataccagctgtggactgccctggtgagcctgacctgtagcaataccatctttaccctgacggttgcttggcgcacggccaccctgattctggccggggtatccctgctgcccgtgtgtcaaagctcctcgatgcggaaaaccgactggctccccatgacggtcgctgctatgggagtcccgccgcttcccctgtttatcttttcattgaaggacaccctgaagcgtcgatcttggcctctgaacgagggggtgatggcggtgggcctcgttagcatcctggccagtagccttctccgtaatgatgtcccgatggccggcccgttagtggccggcggcctgctcatcgcgtgctacgtgatcaccgggacgagcgctgacctcactgtcgaaaaggccgcggacgtgacctgggaggaggaggccgagcaaaccggcgtgtcccataacctcatgatcactgtcgatgacgacggcaccatgcgcattaaagacgacgagacggagaacatcctcactgtgctgttaaaaaccgctttgctgatcgtcagcggcatcttcccctactccatccccgcgaccttattggtatggcacacctggcaaaagcagacccaacggagcggcgtgctctgggacgttcccagcccacccgagacccagaaggcagagctggaggaaggggtctatcgaataaaacaacagggcatcctcgggaagacccaggttggcgtgggagtccagaaggagggcgtgtttcacacgatgtggcacgtcacccggggcgccgtcttgacccacaacggaaagcgcttagagcccaactgggccagcgtgaagaaagacctcatcagctacggcgggggctggcgcctgagcgcgcaatggcaaaaaggggaggaagtgcaggtcatagcggtagagccggggaagaatccgaagaactttcagaccatgccgggtacgttccagaccaccaccggcgagataggagctatagccctggacttcaaacccggaacgtccggcagcccgattattaatcgggagggcaaggttgtcgggctttacggcaatggggtggtgaccaaaaacggtgggtacgtctccggcatcgcccaaaccaacgctgagcccgacggtccaacccccgagctggaggaggagatgttcaaaaagcggaacctgacgataatggacctgcacccagggtccggaaagacccgcaagtaccttcccgcaattgtgagggaggcgatcaagcgccggctgcgcaccttaatcttagccccaaccagggtggtcgccgcggagatggaggaggccctgaaagggctgcccatccgctatcagacgaccgctaccaaaagtgagcacaccggccgggaaatagtggatttaatgtgccacgccacgttcaccatgcgcctgctgtccccggtccgggtccccaactacaacttaatcatcatggacgaggcccatttcaccgaccccgcgagcatcgccgcccgcgggtatatcagtacccgggtgggcatgggcgaggccgcggccatcttcatgacggcaactccgcccgggacagcggacgccttcccccagagcaacgcgcccatccaggacgaggaacgggacatccccgagcgctcctggaacagcggcaacgagtggatcaccgacttcgctgggaagacagtgtggttcgtgccctccatcaaagccggcaacgacatcgccaattgcctgcgaaagaacgggaagaaggtgatccaactaagccgcaagacgttcgacacggagtatcaaaagaccaagctcaacgactgggacttcgtggtcacgacagacatatccgagatgggggcaaacttcaaggcggatcgggtgatagacccccgccggtgccttaagcccgtcatcctcacggatggccccgagcgcgtgattttggcagggccaatgcccgtgaccgccgccagcgccgcccagcgccgtggtagagtggggcggaacccccagaaggagaacgaccagtacatatttacaggacagcccctgaataacgacgaggaccatgcccattggaccgaggccaagatgctgctcgacaatataaacactcctgagggtatcatccctgccctgttcgagccggaacgagaaaagtccgcggcaatagatggcgaataccggctgaagggcgagagcagaaagaccttcgtggagctgatgaggcgcggggatctgcccgtatggctcgcccacaaggtcgccagcgagggcatcaagtacaccgatcgcaagtggtgcttcgacggccagcggaacaatcagatactggaagagaacatggacgtggaaatctggacgaaggagggcgagaaaaagaagctgcgcccgcgatggctggacgcacgcacctacagcgaccccctcgcgttgaaggagttcaaagatttcgccgcaggccgcaagtccatcgcactggacctcgtaaccgagattggtcgggtccctagccacctggcccacaggacccggaatgcgctcgacaatctcgtaatgctgcacacctcggagcatggcgggcgcgcctaccggcacgccgtggaggaattaccggagaccatggaaacactcctgctcctgggactgatgatcctcctcaccgggggcgctatgctgttcctgatctccggcaagggaattggcaagacgagcatcgggctcatttgcgtcatagcctcgagcggcatgctgtggatggcggaggtccccctgcagtggatcgcatccgcaatcgtgctcgagtttttcatgatggtcctattaatccccgagcccgagaagcagcgcaccccacaggataaccagctagcctacgtggtgattggaatcttaaccctggccgcgatgatagccgcgaacgaaatgggcttgctagaaaccacgaagcgggacctgggcatgtcaaaggagcccggggtcgtgtccccgacttcatatctagacgtggacctgcaccccgccagtgcgtggactctctatgcggtcgccactacggtcatcacaccgatgctccgacacaccatcgagaacagcaccgccaatgtgtccctggccgcgatcgccaaccaggccgtcgtactgatgggcctcgacaagggctggcctatctcaaagatggacctgggcgtgccactgctcgcgttaggatgctactcacaagtaaacccccttacgctcaccgccgcggtgttactgctcattacccactacgccatcatcggcccagggctacaggccaaggccacccgggaggcccaaaaacgcacggcggctggaatcatgaagaaccccaccgttgatggcatcatgaccatcgacctggaccccgtcatatacgacagcaagttcgagaagcagctcggccaggtgatgctgctggttctctgcgccgtccagctgcttctcatgcgaacctcatgggccctgtgcgaggcgttaacgcttgccaccgggcccatcaccaccctgtgggagggctcaccgggaaaattttggaacacgaccattgctgtgtccatggccaacatcttccgcggcagctacctagccggggccgggctcgccttctcgatcatgaagtccgtggggaccggtaagcggggcacggggtcccagggcgaaacgctgggtgagaagtggaagaagaaactgaaccagctgagccgcaaagagttcgatttgtataaaaagtccggcattactgaggtagacagaaccgaagcaaaagaggggctgaagcgcggcgaaatcacgcaccatgccgtgtcccggggcagcgctaagttacagtggttcgtggagcgcaacatggtcgtgcccgaagggcgggtgatcgatctgggctgcgggcggggcgggtggagttactactgcgccggcttaaagaaagtgaccgaggtccggggctacacgaaaggcggtcctgggcacgaggaacccgtcccgatgtcaacctacggctggaacatcgtcaagctcatgtcagggaaggacgtgttctacttaccgccggagaagtgtgacaccctgctgtgcgacatcggcgagagctccccctcaccaaccgtggaggagtccaggacaatccgcgttctcaagatggtagagccctggctcaaaaacaaccaattctgcatcaaggtgttaaacccttacatgccaaccgtcatcgaacacctcgagcggctgcagcggaagcacggagggatgctggtgcgcaacccattaagccgcaacagcacccacgagatgtactggatctccaatggtaccgggaacatcgtgtccagcgtcaacatggtgtcccggttactcttaaatcgcttcactatgacccaccggcgccccactatcgagaaggacgtggacttgggcgccggtaccagacacgtcaatgccgagcctgagactccgaacatggacgttattggggaacgcgtgaagcgcatcaaggaggagcacaacagcacctggcactacgacgacgagaacccctacaagacgtgggcctaccacggctcctacgaagtcaaggccaccggtagcgcgtccagcatgatcaacggtgtggtaaagctgctcacaaagccctgggacgttgtgcccatggtcacgcagatggccatgaccgataccacccctttcgggcagcagcgggtgtttaaggagaaggtggacacgcggacgccccggccgatgcccggtactcggaaggtaatggaaataaccgccgagtggctgtggcggaccctgggccgcaacaagagaccgcggctctgcacccgcgaggagtttaccaagaaggtgcggacaaatgccgcgatgggagccgtattcaccgaggagaaccagtgggacagcgctaaggcggccgtcgaggacgaggagttttggaagttagtcgaccgggaaagggagttgcacaagctcggcaaatgtgggtcctgcgtgtacaacatgatgggaaagagggaaaagaaattgggggagttcggcaaggcgaagggaagccgcgccatctggtacatgtggttgggggcacggtacctcgagttcgaagccctgggtttcctgaacgaggaccactggttctcccgggagaacagctactccggggtcgagggggaggggcttcataagctcggctacatactacgggatatatccaagatccctggcggggccatgtatgctgacgacaccgcgggctgggacactcgcattacggaagacgaccttcacaacgaagagaaaataatccaacagatggaccccgagcaccggcagctcgctaacgccatcttcaagctcacatatcagaacaaggtcgtgaaggtccagaggcccacccccaccgggactgtaatggatatcatcagccggaaggaccagcgcggcagcggccaggtggggacgtacggcctcaacacatttaccaacatggaggcccagttagtccgccagatggagggcgaaggcgtgctaaccaaggccgacttggagaacccgcacttactggaaaagaaaattacgcaatggctcgaggccaaaggggtggagagactgaagcgaatggccatttccggagacgactgtgtagtgaagcccatcgacgatcgctttgccaacgccctcttggcgttaaacgacatgggcaaggtccggaaggacatcccccagtggcagccgagcaaaggctggcatgactggcaacaggtgccattctgtagtcaccacttccacgagctgattatgaaggacggacgcaagctcgtggttccctgccggccgcaggacgagctgatcggtcgcgcccgtatcagccagggcgccggttggtccctgcgcgagaccgcctgtctcggcaaggcgtacgcgcagatgtggtctctaatgtacttccaccgccgggacctaagactagcatcaaacgccatctgtagcgcggtcccggtgcactgggtgcctacctcccggaccacgtggagcatccatgcgcaccaccagtggatgacaaccgaggacatgctgacggtctggaaccgagtatggatcgaggagaacccctggatggaggataagactcccgttaccacctgggagaatgtcccttacctgggaaaacgggaggaccagtggtgcggttccctcattggcttaacgagccgcgccacatgggcgcagaacatccccactgccattcaacaggtgcggtctttgatcgggaatgaggagttcttagattacatgcccagtatgaagagatttcggaaggaggaggagagcgagggagccatctggtga

SEQ ID NO: 25793 - RNA, 9873 nt, synthetic construct
  misc_feature 1..9873: note = derived and/or modified CDS sequence (opt11) from DENV-3__FJ898440__SS-prME
  source 1..9873: mol_type = other RNA
accagcctatgtctcatgatgatccttccagcagccctggcgtttcacctcacgagcagggatggtgaaccccgcatgatcgtggggaagaacgaaagagggaaaagcctgctgttcaagaccgccagcgggatcaacatgtgcacgctaatcgctatggatctgggcgagatgtgtgacgataccgtgacctacaagtgcccccacatcaccgaggtggagcccgaggatatcgattgctggtgcaacttgacctcgacctgggtgacctacggtacctgcaaccaggccggcgagcaccggcgcgacaagcggagtgtcgccctcgcaccccacgtgggaatggggttagatacccgcacccagacctggatgtctgccgagggcgcctggagacaggtagaaaaggtcgagacttgggccctgcgccacccggggttcaccatcctcgcgttgttcctggcccactacatcggcacttccttaactcagaaggtggtcattttcatcttactgatgctcgtaacgccgagcatgaccatgcggtgcgtaggggtggggaaccgcgacttcgtcgagggcctgtccggggccacctgggtggacgtggttctggagcacggcgggtgcgtgaccacgatggccaagaacaagcccaccctcgatatcgagcttcagaagaccgaggccacccagctggcgacgctccggaagctgtgtatcgaaggcaagattactaacattactaccgacagtaggtgccccactcaaggcgaggccgtgctgccggaggagcaggaccaaaactacgtctgcaagcacacctacgtggataggggatggggaaacgggtgcggcctcttcgggaagggctccttggtgacctgcgccaagttccagtgcctggaacccatcgagggcaaggtcgtgcagtacgagaacctcaagtataccgtgatcatcacggtccataccggggaccagcaccaggtcggcaacgagacccagggggtcactgccgagatcacgccccaagccagcatcaccgaggcgattttacccgagtacggcacgctgggcctcgaatgcagcccgcgaaccggcctggactttaacgagatggtgctgttaaccatgaaaaacaaggcctggatggttcaccggcagtggtttttcgatcttcccttaccctggacaagcggagctacgaccgagacacccatctggaaccgcaaggagcttctggtcacgttcaagaacgcccatgccaagaagcaggaggttgtagtcctggggtcgcaggagggggcgatgcacaccgccctcacgggggccaccgagattcaaaacagcggcggcacctccatcttcgccggccacctgaagtgccggcttaagatggataagctcgaactgaagggcatgagctacgccatgtgcaccaacacctttgtgctgaagaaggaggtgtccgagacccagcacgggacgatcctaatcaaagtcgagtataagggagaggacgcgccgtgcaagatccccttcagcaccgaagacggtcagggcaaggcacacaacggccgcctgatcaccgccaaccccgtggttaccaagaaggaggagcccgtcaatatcgaagcggaaccgcccttcggggagtcaaacatcgtgatcggcattggcgacaacgcgctgaagatcaactggtataagaagggctccagcatcgggaagatgtttgaggccacggcccggggcgcccgacggatggccattctcggcgacacggcatgggacttcgggtccgttggcggggtactaaactccctgggcaagatggtgcaccagatcttcgggtcggcctacaccgccctgttcagcggcgtgtcctgggtaatgaagatcggcatcggtgtcctcctcacctggatagggctgaactctaagaacacgtctatgagcttctcctgcatcgccatcgggatcataaccctctacctcggtgccgtggtacaagctgacacagggtgcgtgatcaattggaagggcaaggagctgaagtgcggcagcgggatctttgtgaccaacgaggtccacacgtggaccgagcagtataagttccaggctgactccccgaagcgcctcgccaccgccatcgccggggcgtgggagaatggggtgtgcggtatccgctctaccacgcgtatggagaacctgctgtggaagcagatcgccaacgagctcaattacatcctgtgggaaaacaacatcaagctgaccgtggtcgtaggggacatcattggcgtgctcgagcaagggaagcgcacactgacgcctcagccgatggaactaaagtactcctggaagacgtgggggaaagcaaagatcgtcaccgccgagacacagaacagctccttcatcatcgacggccccaacacccccgagtgccccagcgcgtcccgtgcctggaacgtgtgggaagtggaagactacgggttcggcgtctttacaaccaatatctggctcaagttgagagaagtgtacactcagctctgcgaccaccgcctaatgagcgccgccgtgaaggacgagcgcgccgtacatgcggacatgggttattggattgagagccagaaaaacggatcgtggaaacttgagaaggctagcctgatcgaagtgaagacctgtacttggccgaagtcccacacgttgtggtcgaacggcgtgctagagtccgacatgatcatccccaagagcctggccgggcccatctcccagcataactatcggccgggctaccatacccaaaccgccgggccctggcacctcgggaagttagaactggactttaactactgcgagggcaccacggtcgtgatcaccgagaactgcgggacacgcggcccctccctccggacgacgaccgtctcagggaagctgatccatgagtggtgctgtcgtagctgcaccctgcccccgttgcgttatatgggcgaggacgggtgctggtacggcatggagatccggcccatttctgagaaggaggagaacatggtcaagagcctagtttctgccggtagcgggaaggtggacaacttcaccatgggagtcctgtgcctcgccatcctgttcgaggaggtgatgcgggggaagttcggcaagaagcacatgatcgccggtgtgttctttacttttgtcctgctcctgtccggccagatcacttggcgcgacatggcccacaccctgatcatgatcggctcgaacgcctccgacaggatgggtatgggcgtgacgtacttggccctgatcgcgacgttcaagatccaacccttcctggccctcgggtttttcctgcgaaaactgaccagccgggagaatctcctgctgggcgtgggactcgccatggccaccaccctgcaactgcccgaggacatcgaacagatggccaacggaatcgccctcggtctgatggcattaaagctcataacgcagtttgagacgtaccagctgtggaccgctctgatcagcctgacctgctcaaacacgatcttcacgctaacagtcgcctggcgcaccgcgacgctgatcctcgccggggtgagccttctaccggtctgccagtccagctccatgcggaagacggactggctgcccatgaccgtggccgccatgggcgtgcagcccctgcccctgtttatcttcagcctcaaggataccctgaaacgccgctcctggccgctgaacgagggggtcatggccgtcggcctcgtgagcatcctagcgtccagcctgctccggaacgatgtccccatggccggccccctggtggctgggggactgctcatcgcgtgctacgtgatcacgggtacgtccgccgacctgaccgttgagaaagcggccgacgtgacctgggaggaagaggccgagcagacgggcgtgtcccacaatctgatgatcaccgtagacgacgacggtactatgcgcatcaaagacgatgagaccgaaaacatcctcaccgtgctgctgaagacggccttactgatcgtgtccggcatctttccatacagcatcccggcgaccttactcgtctggcacacctggcaaaagcaaacccagcggtccggcgtgctgtgggacgtaccctcaccgccagaaacgcaaaaggcggagctggaggagggggtttacaggatcaagcagcaaggcatattcgggaagacccaagtgggggtgggagtccagaaggagggcgtgttccacaccatgtggcacgtgacaaggggagccgtcctaacgtataacgggaagcgacttgaaccgaactgggcctccgtgaagaaggacctgatcagctatggagggggctggcggctctccgctcaatggcagaaaggggaggaggtgcaggtcatcgcggtggagccaggcaagaatcccaagaactttcagaccatgcccggtaccttccagaccacgaccggggagatcggcgcgattgcccttgacttcaagccgggtaccagtggctcgcccatcatcaaccgcgaaggaaaggtggtagggctgtatggtaacggggtggtgaccaagaacggcggctacgtctcaggcatcgctcagacgaacgccgagcccgacggccctaccccagagctggaggaggagatgttcaagaagcgcaacctcaccataatggatctgcacccaggtagcggcaagacccgcaagtacctgcccgcgatcgtgcgggaggccatcaagcgccggctccgtaccctgatcctggccccaaccagagtggtcgctgcagagatggaggaagcgttaaaggggctgcccatccgttaccagaccactgcaacaaagtcggagcatacgggtcgggagattgtggacctgatgtgccatgccaccttcaccatgcgcctgctaagccccgtgagagtcccgaactataacctgatcataatggatgaggcccactttacggacccggcctccatcgcggcacgtggctacatctcaacccgggtgggcatgggcgaggcagcagcgatcttcatgactgccacgccgcccgggacggccgacgctttcccgcagtccaacgccccgatccaggacgaagagagagacatccccgagcgcagctggaactccggcaatgagtggattacagacttcgcgggaaagaccgtgtggttcgtacccagcatcaaggcaggcaacgacattgccaactgcctacgtaagaacgggaagaaggtcattcagctgtcccgcaagaccttcgatacggagtaccagaagaccaagctgaacgactgggactttgtcgtaactaccgacatttccgaaatgggagccaatttcaaggccgaccgggttatagatccacgccggtgcctcaaaccggtgattctcacggacggaccggaaagggttatcttagcagggccgatgcccgtgacagccgcctccgccgcacagcggcgcggacgggtggggcggaacccgcagaaggagaacgatcagtacatcttcacaggacagcctctcaacaacgacgaggaccacgcgcactggaccgaggcaaagatgctgctggacaacatcaacacgcccgaggggatcatccccgccttatttgagccggagcgggagaagtccgccgcaatagatggcgagtaccgtctgaagggcgagagccggaagacgttcgtcgagctgatgcgtcgcggcgacttaccagtgtggctggcccacaaggtcgcctcagagggcatcaagtacaccgaccgcaaatggtgcttcgacgggcagcggaacaaccagattctggaggagaacatggacgtggagatctggaccaaggagggcgagaagaagaaactccgcccccggtggttagacgcacgcacctacagcgatcctctggccctaaaggagttcaaggacttcgcggccggccgaaagagcatcgccctggacttggtgacggagatcggaagggtcccgtcccacctcgcccatcgcacccggaacgccctggacaacctggtcatgctccacaccagcgagcacggcggccgcgcgtaccggcacgccgtggaggaactacccgagaccatggagactcttttactgctgggcctcatgatattgctgacagggggtgccatgctgttccttatctctggcaaaggcatcggcaagacctccataggactgatctgtgtcatcgcaagctccggcatgctctggatggccgagatccccctgcagtggatcgcgagcgccatcgtacttgagtttttcatgatggtgctcctgatccccgagccggagaagcagcggacgccacaagataaccagctggcctacgtggtgatcggaatcctcacgctggcggccatcatcgcggccaacgagatgggcttactcgagactaccaagaaggacctgggcatgtccaaggagcccggggtagtatctcccacgtcctacctggatgtcgatctccatcccgccagcgcctggacgctttatgccgtggccaccaccgtcattacccccatgctgcgccacacgatcgaaaattccaccgccaacgtgagcctcgccgccatcgcgaaccaagccgtggtcctgatgggcctagacaaggggtggcccatcagtaagatggacttaggcgtgccgctgcttgccctcggatgttacagccaggtgaaccccctaaccctgaccgcggccgtcctcctgctgattacgcactacgcgatcatcggtcccggcctacaggccaaggcgacccgggaggcccagaagcggaccgccgcggggattatgaagaaccccaccgtggacggcatcatgacgatcgacctggaccctgtgatctacgattccaagttcgagaagcagctggggcaggtcatgcttcttgtgctgtgcgccgtgcagctactgctgatgcgcaccagctgggccctctgcgaggccctgactttggcgaccggccccattacgaccctctgggagggctctcctgggaagttctggaacaccaccatcgccgtcagtatggccaatatcttccggggctcctacctggcgggggccggcctggcattcagtataatgaagtccgtggggacgggcaagcggggcactgggtctcagggcgaaaccctcggggagaagtggaagaagaagctgaaccagcttagccggaaagagttcgacctctacaagaagtcaggcatcaccgaggtggaccggacggaagccaaggaggggctgaagcgaggcgagatcactcaccacgcagtaagccgcggcagcgccaagctgcagtggttcgtggagcggaacatggtgatccccgaggggcgcgtaatcgacttagggtgcgggcggggcgggtggagctactactgcgccggtctgaagaaggtgaccgaggttcgcggctacaccaagggcgggccggggcacgaagaacccgtccccatgtccacctacggctggaatatcgtgaaactgatgagcggaaaggacgtgttctacctcccgcccgaaaagtgcgacacgctgctgtgcgatatcggtgagtccagcccctcccccaccgtcgaggagagccggactatccgtgtgttgaagatggtggagccctggctcaaaaacaaccagttctgtatcaaggtcctgaacccctatatgcccaccgtgatcgagcacctggaaaggctccagcggaagcacggcggaatgctggtgcgcaaccccctctcccggaatagcacacacgagatgtactggatttcgaatggcactgggaacatcgtggccagcgtgaacatggtgtcccgcctcctgctaaaccgtttcaccatgacccaccgcaggcccacgatcgagaaggacgtcgacctcggagccggcaccaggcacgtgaacgccgagccggaaacccccaacatggacgttatcggggagcggatcaagcgcatcaaggaggagcacaacagcacctggcattacgatgacgaaaacccctacaagacgtgggcctaccacggatcatacgaggtgaaggccacagggagcgcgtccagcatgatcaacggcgtggtcaaacttctgaccaaaccatgggacgtggtccccatggttacccagatggccatgactgacacgaccccctttggtcagcagcgggtcttcaaggaaaaggtggacacccgcacgccccggagcatgccgggcacccgacgggtcatgggcattaccgccgagtggctctggcgcaccctggggcggaacaagaaaccacgcctgtgcacgcgtgaggagttcaccaagaaggtgcgcacaaacgccgcgatgggcgccgtgttcaccgaggagaaccagtgggactcggccaaggcagcggtcgaggacgaggatttctggaagctagtggaccgcgaacgggaactgcacaaactggggaagtgcggcagctgcgtgtacaatatgatggggaaaagagaaaagaagctcggcgagttcggcaaggcgaagggctctcgggccatttggtatatgtggctgggtgccaggtacctggaatttgaggcgctcgggttcttaaacgaggaccactggttttctcgggagaacagttatagcggggtcgagggggagggcctgcataagctcgggtacatcctgcgcgacatatccaagatccccgggggcgccatgtacgcggacgacaccgccgggtgggacacccggatcaccgaagacgatctacacaacgaggagaagatcacccaacagatgaatcccgagcaccgccaactcgcgaacgccatcttcaagctgacgtaccagaacaaggtggtgaaggtccaacggccgacccctaccggcaccgtgatggatatcatcagccgaaaggaccagaggggatccggccaggtgggcacctacgggctgaacacattcaccaacatggaggcccagctcatccgccagatggagggcgagggggtgctgagcaaggcggacttagagaacccccacctccccgagaaaaagatcacccagtggctggagaccaagggcgtggagcgtctgaagcgcatggccatctccggagacgactgcgtggtgaagccaatcgacgatcggttcgctaacgccttactggccctgaatgacatggggaaggtgcgcaaggatatcccccagtggcagcccagcaagggctggcacgactggcagcaggtacccttctgctcccaccacttccacgagctcattatgaaggatggacgtaagctcgtcgtgccttgtcgcccccaggatgagctgatcggccgggcgcgaatatcccagggcgccgggtggtccctcagagaaacggcctgcctgggcaaagcctacgcgcaaatgtggagcctgatgtacttccacaggcgcgacctgcggctggcctccaatgccatctgctcagccgtgcccgtccactgggttcccaccagtcgcacgacctggagcattcatgcccaccaccagtggatgacgaccgaggacatgctgaccgtgtggaaccgggtctggatcgaggacaacccttggatggaggacaagacccccgtgacaacctgggagaacgtaccttacctcgggaagcgtgaggatcagtggtgcggtagcctgatcgggctcacctcccgggcaacctgggctcagaacatccccaccgccatccagcaggtccgtagcctcatcggcaacgaagagttcctggattacatgccgagtatgaagcggttccgcaaggaggaagaaagcgaaggcgccatctggtga

SEQ ID NO: 25794 - RNA, 9873 nt, synthetic construct
  misc_feature 1..9873: note = derived and/or modified CDS sequence (opt11) from DENV-3__FJ898441__SS-prME
  source 1..9873: mol_type = other RNA
accagcttgtgcctcatgatgatcttacccgcagccctggcgttccatctcaccagccgcgacggcgaaccgaggatgattgtggggaaaaacgagcgcggcaagagcctgctgttcaaaacggctagtgggatcaacatgtgcaccctcatcgctatggacctgggtgaaatgtgtgacgatacggtcacctacaagtgcccccacatcacggaggtggagcctgaggacatcgactgctggtgcaacctgaccagcacctgggtgacttacggtacgtgcaaccaggccggggagcaccggcgcgataagcgatccgtagctctcgcgccccacgtagggatggggctggacacccgcacccagacctggatgagcgccgaaggcgcctggagacaggtggagaaggtcgagacgtgggccctgcgacatcctggcttcaccatcctggcgttattcctggcccactacatcggcacgtcccttacccagaaagtggtgattttcatcctgctcatgctcgtcacgccgagtatgacaatgcggtgcgtgggggtggggaaccgcgacttcgtcgaaggcttatccggggccacctgggtcgacgtggtcctggagcatggcgggtgcgtgaccactatggccaaaaataaacccacactagatatcgagctgcagaagaccgaggccactcaactcgccacgctccggaagctgtgcatcgagggtaagatcaccaacatcaccaccgactcccgctgtccgacgcaaggcgaggctgttctgccagaggagcaagaccagaactacgtctgcaagcatacatacgtggaccgggggtggggcaacgggtgcggcctattcgggaagggctctttggtaacctgcgcgaaattccagtgcctggagccgattgagggcaagatggtacagtacgagaaccttaagtataccgtgatcatcacggtgcataccggggaccaacaccaggtcggcaacgaaacccaaggggtgacagctgaaatcacaccccaggcgtcaatcacagaggcgatcctgcccgagtacggcaccctgggcctagagtgctccccgcgcaccggcctggacttcaacgaaatgatcctgctcactatgaagaacaaagcctggatggtccaccggcagtggttcttcgatcttcctctgccctggacgagcggcgccacgaccgaaactcccacgtggaaccgaaaggaactgctggtcactttcaagaacgcacacgccaagaagcaggaggtcgtcgtgctggggtctcaggagggcgccatgcacaccgcccttacgggcgccacggagatccagaactcaggcgggacaaccatcttcgcggggcacctgaagtgccgtctgaagatggacaagctagagctcaagggtatgtcctacgccatgtgtaccaacacgtttgtcctgaaaaaggaggtcagcgaaactcagcacgggaccatcctcatcaaggtggagtacaagggggaggacgcgccgtgcaagatccccttctccaccgaggacggtcagggcaaggcacacaacggacgcctgatcacggctaacccggtggtcaccaagaaggaggagcccgtgaacatcgaggctgagccaccattcggggaatccaacattgtgatcggaatcggggacaacgcgctaaaaataaactggtacaagaaaggatcttctatcgggaaaatgttcgaagcaaccgcccgcggggcacggcggatggctatcttaggcgacaccgcgtgggacttcgggtcagttggaggggtgcttaacagtctaggcaaaatggtgcaccaggtgttcggtagcgcctacacggctctgttcagcggcgtgtcgtgggtgatgaagatcggaatcggggtcctacttacctggatcggactgaactccaaaaatactagcatgtcctttagctgcatagccatcgggatcatcaccctctacctgggtgctgtggtgcaggcggacacggggtgcgtaatcaattggaagggcaaggagcttaagtgtggctccgggatcttcgtcactaatgaagtgcacacctggaccgagcagtacaaattccaggctgattcccccaagcgcctcgccacggccatcgccggcgcgtgggagaacggtgtctgcggaatccgctccaccacccgaatggagaatctgttgtggaagcagatcgcaaatgaactcaactacattctgtgggagaacaacatcaagttaaccgtggtggtcggggacatcatcggcgtcctcgagcagggcaaaagaactcttaccccgcagccgatggagctgaagtacagctggaaaacctgggggaaggccaagattgtgaccgccgaaacgcagaactcctcgttcatcatagacggccccaacacccccgagtgcccaagcgcgagcagagcatggaacgtctgggaggtggaggactatggcttcggagtgtttaccaccaacatttggctcaaactgcgcgaagtctacacccagctatgtgatcaccggctcatgagcgccgccgtgaaggacgagagggccgtccacgcggacatgggctactggatagagagccaaaagaatgggagctggaagctggagaaggcctcactaatcgaagtaaagacgtgtacatggccgaaaagccacactctttggtccaacggtgtgctggagtctgatatgatcattcccaagtccctggccgggcccatcagccagcacaactaccggcccggttatcacacgcagacggctgggccctggcacctcggaaagctggagctggacttcaactactgcgagggcacgactgttgtcatcacggagaattgcgggacgcgcggcccctcgctccggactaccaccgtgtcggggaagctgattcatgagtggtgctgccgctcctgcactctgcccccgctccggtacatgggagaggacgggtgctggtacgggatggagatccgcccaatatcagagaaggaagaaaacatggtgaagtccctggtctctgccggctcagggaaggtcgacaattttaccatgggcgtgctgtgcctcgcgatcctgttcgaggaggtcatgcgggggaagttcggcaagaagcacatgatcgtgggcgtgttctttaccttcgtcctccttctgtcaggccagatcacctggcgagacatggcacacactttgatcatgatcggcagcaacgccagcgatcggatggggatgggcgtcacctacctcgcacttatagccacctttaagatccagcctttcctggcgctcgggtttttcctgcgcaagctgacctcccgggaaaacctcctgctaggcgtgggattagccatggccacgaccctgcagctgccggccgacatcgaacagatggcgaacggtatcgcactcggcctgatggccctgaagctcatcacccagttcgagacataccagctgtggacggctctgatctccctaacctgcagcaacacgatcttcaccctgacggtcgcctggcgcaccgcgacactgatcctcgcaggagtgtccctcctaccggtctgccagtcatcctcgatgcgtaaaaccgactggctcccaatgacggttgccgccatgggcgtgcagcccctacccctgttcatcttcagtttgaaggacaccctaaaacgccgcagctggccgttaaacgagggggtcatggcggtggggctcgtgtccatactggcgagctccctactccggaacgacgtccccatggccggcccgctggtggccgggggcctgctgatcgcctgctatgtcatcaccgggacctcggcagacctgactgtcgagaaggcggccgatgtgacctgggaggaggaggccgagcagacgggcgtgtcccacaaccttatgatcactgtagacgacgacgggactatgcgcatcaaagacgatgagactgagaacatcctcacagtgctgctgaaaaccgccttactgatcgtcagcggtatctttccttacagcatcccggccaccctattagtctggcacacgtggcagaagcagacccagcggtcgggcgtgttatgggacgtgcctagtccacccgaaacacaaaaggcggagctggaggagggggtctaccgcatcaagcaacagggaatcttcggcaagacccaggtgggggtgggagtccagaaagagggcgtctttcacacgatgtggcacgtcacccggggcgccgtcctcacctacaacgggaagcgcctggagcccaactgggccagcgtgaagaaggacctgatctcctacggtgggggatggcggctcagcgcccaatggcagaaaggggaggaggtgcaggtcatcgccgtggagccaggcaagaaccccaagaacttccaaaccatgcccggcacattccaaaccaccacaggggagataggcgcaatcgcgcttgacttcaagccggggacgtctggcagccccatcatcaaccgcgagggtaaggtagtcggcctgtacggcaacggagtggtcaccaagaacggcgggtacgtatctggcatcgcacagacgaacgccgagcccgatgggccgacgcctgagctggaagaggagatgttcaaaaagcgcaaccttacgatcatggacttacaccccggaagcggcaagacccgcaaatacctgcccgcgatcgtacgggaggccatcaagcgcagacttcgcaccctcatcctggccccgacccgggtggtcgcggccgagatggaggaggccctcaaggggctgccgatccgctaccagacgaccgccaccaagagcgagcacaccggccgggaaatcgtggacttaatgtgccacgcgacgttcaccatgcgcctgctgagtcccgtgcgggtccccaactacaacctgatcataatggacgaagcccatttcacggaccccgcgagcatcgcggcccgcgggtacatctccacccgcgtgggcatgggagaagccgccgcgatcttcatgaccgccaccccgcccgggaccgccgacgccttcccccagagcaacgccccgatccaggacgaggagcgggacatccccgagcgctcctggaacagcgggaacgagtggatcaccgatttcgcgggtaagaccgtctggtttgtcccctccatcaaggcgggcaacgatatcgctaactgcctccggaagaacgggaagaaggtaatccagctgtctcgtaaaaccttcgacaccgagtaccagaaaaccaaactgaacgactgggacttcgtggttacaaccgacatcagtgagatgggcgccaacttcaaggccgaccgcgtgattgaccctcgtcggtgtctcaagccggtgatcctgaccgatggacccgagcgcgtgatcctggcggggcccatgcccgtgaccgccgccagcgccgcccagcggagaggccgggtcgggcgtaacccacagaaggaaaacgaccaatacatattcaccggccaacctctaaacaatgacgaagaccatgcacactggacagaggccaagatgctgctggacaacatcaacacccccgagggaattatcccagccctcttcgagccagaacgggagaaatccgctgctatcgacggcgagtacagactgaagggcgagagcagaaaaactttcgtagagttaatgagacgcggagacctccccgtgtggctcgcacataaagtcgcctccgagggcatcaaatacacagatcgcaaatggtgcttcgatgggcagcggaacaatcagatactggaggagaacatggacgtagagatctggacgaaggagggcgagaagaagaagctacgccctcggtggctggacgccagaacatacagcgaccctttggccctgaaggagttcaaggacttcgcggccggccgcaagtccattgcactggacctagtcaccgagatcgggcgggtcccgtcgcatctagcgcatcggacccggaatgccctggacaacctggtcatgctccacacgtccgagcacggagggcgcgcgtacaggcacgcagtggaggaactgcccgagaccatggagactctgctcctgttgggactcatgatcttactgaccgggggcgcaatgcttttcctgatatcaggcaaggggattggcaagacgtcgatcgggttaatctgcgtcatcgcctccagcggcatgctctggatggccgaaatccccctgcaatggatcgcctccgccatagtgctggaatttttcatgatggtgctcctgatccccgagcctgaaaagcaacgcaccccacaagacaaccagctggcatacgtcgtcatcgggatcctcactctcgccgccatcatcgcggccaacgagatgggtctgctcgagacaacgaaaaaggacctgggcatgagcaaggagcccggggtggtctcctcgacctcctatctggatgtggacttgcatccggcctcggcgtggaccctgtatgcggttgccaccacggtcataaccccaatgctgcggcataccatcgaaaactccaccgcaaatgtgtcgcttgcagccatcgcgaaccaggccgtggtcctgatgggattagataagggctggcccatctccaagatggacctgggcgtgcccctgctagccctcgggtgctatagccaggtgaacccgctgacgctgaccgccgccgtactcctactgatcacgcattacgcgatcataggccctggcctccaggccaaggccacgcgcgaggctcagaaacggacggccgcgggcatcatgaagaaccccaccgtggatggcatcatgacgatagacctagaccccgtgatctacgactccaagtttgagaagcagctggggcaggtcatgctcctggtactgtgtgccgtgcagctcctgctgatgcgcaccagctgggccttgtgtgaggcgctgacgctggcgaccggcccgataaccaccctctgggagggtagccccgggaagttctggaacacaacaattgccgtctctatggctaacatattcagaggctcctacctggccggggccggcctagcgttcagcattatgaaaagcgtggggaccgggaagcgcggcaccggcagccagggcgagacccttggggagaaatggaagaaaaagctgaaccagctgtcacggaaggagtttgacctttacaagaagtccggcatcacggaggtggatcgcaccgaggctaaggaggggctgaaacggggcgagatcacccaccacgcggtcagccgcggatccgcgaagctacagtggttcgtggagcggaatatggtgatccctgaggggcgcgtcatcgacctcggctgcggacggggcgggtggagctactactgcgccggcctgaagaaggtaaccgaggtgcgaggatacacgaagggaggcccgggacacgaggagcccgtccccatgtccacctatggctggaatattgttaagctgatgactgggaaggatgttttctacttaccacccgagaaatgcgacaccctgctgtgcgacataggcgagagctccccgagccccaccgtcgaggagtcccggaccatccgagtgctaaagatggtagagccctggctgaaaaacaaccagttctgtatcaaggtcctaaacccctacatgccaaccgtgatcgagcacctggagcgccttcagcgaaaacacggcgggatgctggtgagaaatccccttagccggaactccacacacgagatgtactggatcagcaacgggacggggaatatcgtcgcctccgtgaacatggttagccgcctcctgttgaaccggtttacgatgacccaccgacggcccacaatcgaacgtgacgtcgacctcggcgccggcacccggcacgtgaatgccgaacccgagaccccgaacatggacgtaatcggggagaggatcaagcggatcaaagaggagcacaactctacttggcactacgacgacgaaaacccctacaagacctgggcctaccacggcagctacgaggtcaaggctacggggagtgcgagctccatgatcaacggggttgtcaagctgctgactaagccgtgggacgtggtgccgatggtcacacaaatggccatgaccgatactaccccctttgggcagcagcgcgtcttcaaggagaaggtggacactcggaccccgagaagcatgcccggcacgcgtaaggtcatgggcatcacggccgagtggctctggaggacactggggcggaacaagaagcctcgcctgtgcacccgggaggagttcacgaaaaaggtgcgcacgaatgccgcgatgggcgcggtattcaccgaagagaaccagtgggacagcgcgaaggccgcagtcgaggacgaggacttctggaaactggtggaccgcgaacgggaactgcacaaacttgggaagtgcggatcctgtgtctataacatgatgggaaagcgtgagaagaaactcggcgagttcggcaaggcaaaggggtcccgggccatctggtatatgtggttgggcgcccgctacctagagttcgaagcgctcgggttcctaaatgaggaccactggttctcccgggagaacagctactcaggcgtggagggggaaggcctgcacaagctcggctacattctgcgcgacatcagcaccatccccggcggagccatgtacgcggacgacacggccgggtgggacactcgaattaccgaggacgacctgcataacgaggagaaaatcacacagcagatggatcccgaacatcgccaattagccaatgccatctttaagctgacctaccagaataaggtggtgaaggtacagcggcccactcccaccggtaccgtgatggacatcatatcccgcaaggaccagcggggctcgggacaggtgggcacctacgggctgaacacgtttactaacatggaagcccagctcatccgccagatggagggcgagggggtccttagtaaggcggatctggagaacccccacctccccgagaagaaaatcacccagtggctggagaccaagggcgtggagcggctgaagcgcatggccatcagcggcgacgactgcgtagtcaagcccatcgatgacagatttgccaacgccctcctggccctgaacgacatggggaaagtgcgcaaggacataccgcaatggcagcctagtaaggggtggcacgactggcagcaagttcccttctgttcgcaccatttccacgagctcataatgaaggacgggcggaagctagtcgtcccctgtcgcccgcaggatgagctgatcgggcgggcgcgtatatcccagggggccggatggagcctccgggagacagcctgcttgggcaaggcgtacgcgcaaatgtggtccctgatgtacttccaccgccgcgacctccggttggccagcaatgcgatttgctccgccgtacccgtccactgggtccccaccagccgtaccacctggtcgatccacgcacaccaccaatggatgacgaccgaggacatgttgaccgtatggaaccgggtctggatcgaagacaacccttggatggaggacaagactccggtgacgacctgggagaacgtgccctaccttggtaagcgagaggaccagtggtgcggcagcctgataggactgactagccgagcgacctgggcccaaaacataccaacggccatccagcaggttaggtcccttatcggaaacgaggagttcctggactacatgccctcaatgaagcgatttcgcaaggaggaggagtccgagggcgctatctggtaa

SEQ ID NO: 25795 - RNA, 9873 nt, synthetic construct
  misc_feature 1..9873: note = derived and/or modified CDS sequence (opt11) from DENV-3__FJ898442__SS-prME
  source 1..9873: mol_type = other RNA
acttccctctgcttaatgatgatcctcccggccgcactcgctttccatctcacctccagagacggcgagcctagaatgatagttgggaagaatgagaggggcaagtccctactgttcaagaccgcatcggggattaacatgtgcacccttatcgccatggacctgggggagatgtgcgatgacacggtgacatataaatgcccccacatcacggaagtggagccagaggatattgactgctggtgcaacctcacttcaacctgggtaacgtatgggacctgtaaccaggcgggcgagcaccggcgcgacaaacggtctgttgcgctcgcgccacacgtaggcatggggctggatacacgaacccagacgtggatgtcagccgagggcgcttggcgtcaagttgaaaaggttgagacatgggccctgcgccacccaggttttacgatactcgctctgttcctggcccattatatcggaacctccctcacccaaaaagtggtcatctttatcctgctgatgctcgtgacaccatccatgacgatgcgctgtgtgggggtgggcaatcgggatttcgttgagggcctgtccggtgccacgtgggtggatgtagtgctggagcatggcgggtgcgtgaccacgatggcaaagaacaagcctaccctagacattgagttacaaaagactgaggccacccagctggcaacactccggaagctgtgcatcgaaggcaagatcaccaacattaccaccgattcacggtgccccactcagggcgaggccgtactccctgaggagcaagatcagaattacgtctgtaagcacacctacgtggatcgagggtggggcaatggatgcgggctcttcggcaaaggctccctggtgacgtgtgccaagttccagtgcctggagcctatagagggcaagatggtacagtatgagaatctcaaatataccgtgatcatcacggtacataccggtgaccaacaccaggtaggaaacgaaactcaaggggtgaccgccgaaatcacaccacaagccagcatcactgaggcgattctgcccgagtacggcaccttaggtctagaatgctccccgcgcaccggcctagattttaacgaaatgatcctgctcaccatgaagaacaaagcctggatggtacacaggcaatggttctttgacttgccactgccctggacgtcgggcgcgaccaccgaaactcccacgtggaatcgaaaagagctcctcgtaacctttaaaaacgcgcacgccaagaagcaggaagtcgtcgtgctgggaagtcaggagggtgcgatgcacacggccttaaccggagccaccgagatccagaacagcggcggaaccaccatattcgccggtcacctgaagtgccggcttaagatggataaactagagttaaaagggatgtcctacgccatgtgcacgaatacgttcgtgttgaagaaagaagtcagcgagacgcaacacgggacgatcttaatcaaggtggagtacaagggcgaggacgcgccgtgcaagatccctttctcgaccgaggatgggcagggcaaggcccacaacgggcgcctcattacggctaatccggttgttaccaaaaaggaagagccagtgaatatcgaagctgagcctccgttcggcgagagcaatatcgtaatcggcattggggacaacgcgctcaaaatcaattggtataagaagggctcgtctatcggtaaaatgttcgaggccaccgccaggggtgcacgtcgcatggccatcctcggcgacaccgcgtgggacttcggtagcgttggcggggtgctaaattcgctggggaagatggtgcaccaggttttcgggagtgcctacactgccctgttctcgggggtctcctgggtgatgaagatcgggataggtgtattactgacctggattggcctgaattcaaagaataccagtatgtcgttcagttgtatcgccattggaatcatcaccctttacctgggcgcggtggttcaggcggacacgggctgtgtcatcaactggaagggcaaggagctaaagtgtggtagcgggatcttcgtcacgaatgaggtgcatacctggaccgaacagtacaaattccaggccgatagtccaaagcgcctcgcgacagccatcgccggcgcttgggaaaacggggtctgcggcatccgctcaaccaccaggatggagaatctcctgtggaagcagatcgctaatgaactcaattacattctgtgggagaacaatataaagctaacggtggtggtcggagacatcatcggcgtgctcgagcaaggcaagcggacgctgacgccccagccgatggagttgaagtatagctggaagacttggggaaaagccaagatcgtgacggccgaaactcagaacagttcattcatcattgacggacccaatacccccgagtgcccatccgcgagcagggcctggaacgtatgggaagtagaggattacgggtttggagtgttcactaccaatatctggctcaagttacgagaggtctacacgcagctctgcgaccacagattaatgtcagccgccgtgaaagacgagcgtgcagtccacgcagatatgggctattggatcgagagtcagaagaacgggagctggaagttggagaaggcctctctcatagaggtaaaaacgtgtacctggcccaagagccacaccctttggtccaatggcgttctggagagtgacatgatcatacccagatccctggccggtcctataagccagcacaactatcgcccgggttatcatacccagacggccgggccctggcacctggggaagctcgagctggacttcaactactgcgagggcaccactgtagtcataaccgagaactgtgggacccgcggccccagtctccgcaccacgacagtgagcggaaagctcatacacgagtggtgctgccgttcatgcactttaccacccctgcgatatatgggagaggacggttgttggtacggcatggaaatccggcccatcagcgagaaagaagagaatatggtaaaatccttagtatccgccggctcgggaaaggtggacaattttaccatgggagtgctgtgcctggcgatcctatttgaagaggtgatgcgcgggaagttcggtaagaaacacatgatcgccggggtcttcttcaccttcgtgcttctgctgtccggccaaatcacctggcgggatatggcgcataccctgataatgataggaagcaacgccagcgaccgcatggggatgggcgtcacttatctagccctaatcgcgaccttcaaaatccaacccttcttagcattgggtttcttcctgcggaagctcacaagccgcgagaacttattgcttggcgtgggccttgccatggctacgacactgcagctacccgcagacatagagcagatggccaacggcatcgcgttgggactgatggccctgaagctcatcacccagttcgagacctatcaactttggacggcgcttataagtctgacttgctcaaacaccatcttcaccctcacagtggcgtggcgtacagcaacgctgatactcgcgggtgtctctctactaccggtgtgccagtctagctcgatgaggaaaacggactggttacccatgaccgttgccgcaatgggggtgcaacccctgccgctgttcatcttctccttaaaagacaccctgaaaagacggtcttggccgctgaacgagggtgtaatggccgtcggcctcgtgtccatcctggctagctctcttctccggaacgacgtgccaatggccggcccgttggtcgccgggggactgctcatcgcttgttacgttatcaccgggaccagcgcggacctcacggtggaaaaggccgccgacgtcacctgggaagaggaggcggagcagaccggcgtgtcccacaacctgatgatcaccgtggacgatgatgggactatgcgaataaaggacgacgagacggagaacatcctaaccgtgttactgaaaaccgcactgctcatcgtgtccggcatcttcccatactccataccggcgacattgctcgtctggcatacgtggcagaagcaaacacagcgcagcggagtgctctgggatgttccaagcccgcctgaaacccagaaggccgagctggaggagggagtatacagaatcaagcagcaaggcattttcgggaagacccaggtcggcgtaggtgtgcaaaaagagggtgtctttcatacgatgtggcatgtgactcgcggggccgttctaacctataacggaaagagactcgagccaaactgggcctccgtcaaaaaggacctgatctcctacggcggcggctggcgactttcggcgcagtggcaaaagggagaggaggtccaggtcatcgcggtcgaacccggcaagaatcccaagaacttccagaccatgcccggcacgtttcagaccaccacaggagagatcggagccatcgcactggacttcaagccgggaacgtccggctcaccgatcattaatcgggaaggtaaggtcgtcggcctgtatgggaacggggtcgtgaccaagaacggcggctacgttagcggcatcgcacagacaaatgcggagcccgatggtcctaccccggagctggaggaagagatgttcaagaaacgtaatctcacgattatggacctgcacccggggagtgggaaaacacgaaagtacttgcccgccattgtccgggaggcaatcaagcggcgtctccgtaccttgatcctagccccaacccgagtagtggcagctgaaatggaggaagccttaaagggtctgcccatccgttaccagacgacggcgacgaagtctgaacacaccggacgagaaatcgtcgacctaatgtgccacgccacattcacaatgaggctccttagtcccgtccgcgtacccaattacaatctgatcatcatggacgaggcccacttcaccgacccggcgagcattgccgccagggggtatatatcaacccgcgttggtatgggcgaggccgcggccatcttcatgacggccactccgcccgggaccgccgacgccttcccccagagcaacgcgccaatccaggacgaggaaagggatatccccgaacggtcctggaacagtggtaacgaatggatcaccgacttcgcgggtaagacggtctggttcgtgccatcgatcaaggccggcaacgacattgctaactgccttcgaaagaacggaaagaaggttatacagctatctcggaagaccttcgacactgagtaccaaaaaaccaagttgaatgactgggactttgtggtcacgactgatatcagcgagatgggcgccaacttcaaggcggacagagttatagacccacgccgctgcttaaagccggtgatactgacagacgggccagagcgcgtgatcctggctgggccaatgcctgtgacggcagccagtgctgctcagcgtcggggccgcgtggggcggaaccctcagaaggagaacgaccagtacatcttcaccgggcagcccctcaacaacgacgaggaccacgcgcactggaccgaggctaaaatgttattggataatatcaatacccccgaggggatcattcccgcgttattcgaacctgagcgagagaagtccgcggccatagacggcgaatatagattaaaaggcgagagccggaagacattcgtggaactgatgcggcgcggggaccttcctgtctggttagcgcacaaggtagcctccgagggcattaagtacaccgataggaaatggtgcttcgacgggcagaggaacaaccagatacttgaggagaacatggacgtagagatatggaccaaggagggtgagaaaaagaagctccggccccgttggctggacgccagaacctatagcgatccactggctttgaaggagtttaaagacttcgccgccggccggaaaagtatcgcactggaccttgtaacggagatcggacgcgtgccgtctcatttagcccaccggacaagaaacgcgctagacaacttagtgatgctccacacgtcggaacacggagggcgagcctaccgccacgctgtagaggagcttcctgaaaccatggagacattgctcttactaggcttgatgatactccttaccgggggggcaatgctatttctgataagcggcaagggaatagggaagacatcgatcgggctgatatgcgtgattgcaagcagcggcatgctctggatggcggagatccccctacaatggattgcctccgcgatcgttctggagttcttcatgatggtgctcctgattccggagcccgagaagcagcgtactccccaggataaccagttagcctacgttgttatcggcatcctgactcttgcggcaataatcgccgcaaatgaaatgggtttactggagaccaccaagaaagacctgggcatgagcaaagagcccggggttgtgtcctcgacctcttaccttgacgtcgacctccatccggccagcgcctggaccctgtatgccgtggccactacagtcatcacccccatgctgcgccataccatcgaaaattccaccgctaacgtaagtctagcggcaatcgctaatcaggcagtggtgctcatgggactggacaaggggtggcccatctccaagatggacctcggcgttccgctgttagcccttgggtgctacagccaggtaaatcccctgacgctgaccgccgcagtgctcttactcatcactcattacgccataatcggcccaggcctgcaggctaaagcaaccagagaggcgcaaaagcgcactgctgcggggatcatgaagaaccccaccgtcgacggtattatgacaatagacctcgacccggtgatctatgacagtaaattcgagaagcagctgggtcaggtgatgctgcttgtcctctgcgcagtccagctcctgctaatgcggaccagctgggcgctctgtgaagcacttaccctggctacggggcctatcaccactctctgggagggctctcccggaaagttttggaacacaacgatcgcagtgagcatggccaatattttccgcggctcatacttagccggggccggccttgctttttccatcatgaagtccgtcgggacgggcaagcgggggacggggagccagggcgagacgcttggggagaaatggaagaaaaagctgaaccagctatcccgcaaggagttcgacctctacaagaaatcgggtatcacggaagtggaccggactgaagccaaggaagggctgaagcgcggggaaataacccatcacgccgtgtcacggggctccgcgaagctacagtggtttgtagagcgcaatatggtgattcccgaaggacgggttatagacctgggctgcgggcgcggcgggtggagttactactgtgcaggcctaaaaaaggtcacagaggtgcggggctataccaagggcggtcccggacacgaggagcccgtgccaatgagcacttacggatggaacatagttaagcttatgaccgggaaggacgttttctacttgccaccagagaaatgcgataccctgctgtgcgatatcggcgaatcttcgccgagcccgacggtggaggagtcccgcaccatacgcgtccttaaaatggtagagccctggctgaagaacaaccaattctgcatcaaggtgttgaacccatacatgccgactgtaattgagcaccttgagaggctccagaggaagcatggcggaatgctggtgcggaatcctcttagccgcaattccacacacgagatgtattggatttccaacggcacggggaacattgtcgcctctgtcaacatggtgtcgcggcttttactcaacaggttcaccatgacccatcggcggccgaccatagagcgggacgtggatctcggggccggcacgcgccatgtgaacgctgagcccgaaaccccgaatatggatgtgataggagagagaataaaacgcatcaaagaagagcataactcaacgtggcactacgatgacgagaacccctacaaaacctgggcatatcatggttcttacgaggtcaaggcgacgggatcggcctcctccatgataaacggtgttgtgaaactgcttacaaagccatgggatgtcgtaccgatggtcacccaaatggccatgaccgacacgacccccttcggacagcagagggtcttcaaggagaaagtagatacgaggacgccgcggagcatgcccggcacgcgcaaggtgatgggcattactgccgagtggctctggagaacattgggtcggaacaagaagcctcggctgtgcactcgagaagaattcacaaaaaaggtcagaactaacgcggccatgggcgctgtctttactgaggaaaaccagtgggactccgccaaagcggcggtggaagatgaggaattctggaagctagtcgaccgggagcgcgagctccacaaactgggaaaatgcgggtcctgcgtgtacaatatgatgggcaagcgggaaaagaagctcggagagtttggtaaggctaagggttcccgcgctatttggtacatgtggctgggcgcccggtacctcgaattcgaggccctcgggttcctaaatgaggaccactggttctcgagagagaacagttactccggcgtggaaggggaggggctgcacaaactcggctatatcttaagagacattagcactatccccgggggcgcaatgtacgcagacgacacggcagggtgggacacgcgaatcacggaggacgacttacacaacgaggaaaaaatcacccagcaaatggaccccgagcaccggcagttagccaacgcaatcttcaagctgacgtatcaaaacaaagtggttaaggtgcagcgcccgacgccgacagggacggtcatggacatcatatccagaaaagaccaacgcggctccggtcaagtaggcacctacgggctgaacacgttcaccaacatggaagcgcagctaatccggcaaatggagggcgagggcgtgctaagcaaagctgaccttgaaaacccccacctcccagagaaaaagatcacacaatggctggaaaccaagggggtagagcgcctgaagcgaatggctataagcggcgacgactgtgtggtcaagccaatagatgaccgattcgcgaacgcccttctggccctaaacgatatggggaaggtacggaaggacataccgcagtggcagccttcgaaaggctggcatgactggcagcaggtccccttctgttcgcatcacttccacgagctcatcatgaaggatggtcgcaagttggtggtaccttgccggccgcaggacgagctcattggccgggcgcggatatcccagggggccggctggagccttagggaaactgcctgcctcggcaaggcgtacgcccaaatgtggtctctcatgtacttccaccggcgggacttgaggctggcatccaatgctatatgttcggccgtgccggtgcactgggtaccgacgagtagaactacctggtctattcacgcccaccaccaatggatgacgaccgagaacatgctaacggtgtggaaccgcgtgtggatagaagacaacccttggatggaagacaagaccccggtcacaacttgggagaatgtgccctacctcggtaagagagaagaccagtggtgcggctcactgatcgggctgacaagtagagcgacttgggcacaaaacatcccgactgctattcaacaagtgcggtccttgatcggcaacgaggaattcctcgactatatgcccagcatgaagaggttccgtaaggaagaggagtccgagggcgccatctggtga

SEQ ID NO: 25796 - RNA, 9873 nt, synthetic construct
  misc_feature 1..9873: note = derived and/or modified CDS sequence (opt11) from DENV-3__FJ882575__SS-prME
  source 1..9873: mol_type = other RNA
acaagcctctgcctcatgatgatccttccggcgaccctggcctttcaccttacatcgcgcgacggagagccgcggatgatcgtggggaagaacgaacgcggcaagtccctgctgttcaagacagcctccgggatcaacatgtgcaccctcattgccatggacttgggtgagatgtgtgacgacaccgtgacctacaagtgcccccacatcaccgaggtggaaccggaggacatcgattgctggtgcaatctgactagcacgtgggtgacgtacgggacttgtaatcaagctggagagcaccggcgcgataagcggtccgtggcactagcgccccacgtaggcatggggctggacactcggacgcagacgtggatgagcgcggagggcgcctggcggcaagtcgagaaggtggagacctgggccctgcggcacccggggttcaccattttagcgctgttcttagcgcactatatcggcacctcactcacgcagaaggtggtaatcttcatcctgctgatgctcgtcaccccgagcatgaccatgcgttgcgtaggggtgggcaaccgcgacttcgtcgaaggcttatccggggcgacatgggtggacgtggtcctggagcacggcgggtgcgtgacgaccatggctaaaaacaagcccaccctcgacatcgagctgcaaaagaccgaagccactcagctggccaccctccgtaaactgtgcatcgagggcaagattaccaacattaccaccgacagccgctgccccacgcagggggaggcggtactaccggaggaacaggaccagaattacgtctgcaagcacacctatgtggatcgggggtggggcaacggttgcggactcttcgggaagggttccctggtgacttgcgctaagttccagtgcctggagccaattgaaggcaaggtcgtgcagtatgagaacctcaagtatacggtgatcataacagtccacaccggggatcagcatcaggtaggcaacgagactcagggggtcacggccgagatcacgccacaggcctctacaaccgaggcaatcctgcccgagtacggtacactgggtctcgagtgctccccgcgcacgggcctggatttcaacgagatgatcctgctcaccatgaagaacaaggcgtggatggtgcaccggcagtggttctttgacctgcccctgccgtggacctcaggcgccaccacggagaccccaacttggaacagaaaggagctgctggttaccttcaagaatgcccacgccaagaaacaggaggtcgtggtgctggggtcccaggagggcgccatgcacacggcgctcacgggggccacagagatccagaacagcggcggaacctctatcttcgcaggccacctgaagtgccggctgaaaatggacaagttggagttgaagggaatgagctacgccatgtgtaccaacaccttcgtcttaaagaaggaggtttccgagactcagcacgggaccatcctcataaaggtagagtacaagggcgaggacgccccgtgcaagatacccttcagcactgaggacgggcagggtaaggcgcacaacgggcgcctgataaccgctaaccccgtcgtgaccaagaaggaggagcccgtcaacatcgaggccgagccgccgttcggggaaagcaacatcgtcatcggcattggagacaacgcattaaagatcaactggtacaagaagggatccagcatcgggaagatgttcgaagcgaccgcccggggcgccaggagaatggcgatactgggcgatactgcgtgggacttcgggagcgtgggggggatcctcaacagcctgggaaagatggtgcatcagatcttcgggtccgcgtacaccgccctgttcagcggcgtctcgtgggttatgaaaatcggcattggggtgctcctcacgtggattggcctgaacagcaagaacaccagcatgagcttcagttgcatcgccatcgggatcatcacgttgtacctgggagcagtcgtgcaggccgatatggggtgcgtgattaattggaaaggcaaggagcttaagtgcggcagcgggatcttcgtcaccaacgaggtgcatacctggacagaacagtacaaattccaggcagactccccaaagcgcctcgccacggccatcgctggcgcttgggagaatggggtgtgcggcatccgttcaaccactcggatggagaacctgctatggaagcaaatcgcgaacgaactcaactacattctgtgggagaacaacatcaagctgactgtcgtggtaggggatacgatcggcgtgctcgagcagggaaagcgcaccctgactccacaacctatggagttgaagtacagctggaagacgtgggggaaggccaagatcgtgacggctgagacacagaacagctccttcatcatcgacggccccaacactcccgagtgccccagcgcctcccgggcgtggaacgtgtgggaggtggaggactacgggttcggcgtgttcacaacaaacatctggctgaagttacgcgaggtctacacgcagctgtgtgaccatcggttaatgtcagcagccgtcaaggatgagcgcgccgtgcacgccgacatgggctattggatcgagtctcagaagaatgggagttggaagctggagaaagctagcctgatcgaggttaagacctgcacctggcctaaatcccacaccctctggagcaatggcgtccttgaatccgacatgatcatcccgaagagcctagccggacccatttcccagcacaattacaggccgggctaccacacgcagaccgccgggccctggcacctaggcaaactggagctggatttcaactactgcgagggcaccaccgtggtgatcacggagaactgcgggacccgcggccccagcctccggaccaccacggtctccgggaaactgatccacgagtggtgctgccggtcctgcaccctgcccccgctccggtacatgggcgaggacgggtgctggtacggcatggagattcgccccatcagtgagaaggaagaaaatatggtcaagagcctggtgtccgccggctccggcaaggtcgacaactttacaatgggcgtgctgtgcctcgccatcctgttcgaggaggtgatgcgggggaagttcggcaaaaagcacatgatcgccggtgtcttcttcacgttcgtgctgctcctgtccggccaaatcacgtggcgcgacatggctcataccttgataatgattggttctaacgcctccgaccgaatggggatgggagtgacatacctcgccttaatcgccacctttaaaatccaacccttcctggcgttagggttcttcctccgcaaattgacgagccgggagaacctcttgttaggcgttggcctcgcaatggccactaccttgcagctgcccgaggacatcgaacagatggccaacggtatcgctctcgggcttatggctctgaagctaatcacacaattcgagacgtatcagctgtggacggccctgatcagtctaacctgctccaacaccatattcacgttaaccgttgcttggagaaccgcgactctgatcctcgcgggagtgtccctgctgccggtgtgtcagtccagctccatgcggaagacggactggctccccatgaccgtggccgccatgggggtgccgcccctcccgctattcatcttcagcttaaaggacacgctgaagcgccggtcctggcccctaaatgagggcgtgatggccgtgggactcgtcagcatcctggcctccagcctgctccggaacgacgttcccatggcaggccccttagtggccggggggctactcatcgcctgctatgtcatcaccgggacgtctgccgacttgaccgtggagaaggcagcggacgtgacctgggaggaagaggcagagcagaccggcgtcagtcacaacctaatgatcacagtggatgacgatgggactatgcgcatcaaggacgacgagacggagaacattctcacagttttactaaaaaccgccctcctgattgtctccggcatcttcccgtacagcatccccgccacgctgctcgtgtggcacacctggcagaagcagacgcagcggtccggcgtcctgtgggacgtccccagcccgcccgaaacccaaaaggcggagctagaagaaggagtgtaccgcattaagcagcagggaatcctcgggaagacccaggtgggggtcggggtgcagaaggagggtgttttccacacgatgtggcacgtcacccgaggtgcggtgctcacacacaacggcaaacgcctggagcccaactgggcctccgtaaagaaggacttgatctcctacggaggaggttggcggttatccgcccaatggcagaagggggaggaagtccaggttatagcagtggagccgggcaagaaccccaagaactttcagacgatgcccggcaccttccagaccactacgggggagataggcgcgatcgccctggatttcaaaccgggaaccagcggcagccctatcatcaaccgggagggcaaagtggtgggtctatacggcaacggtgtggtcaccaaaaacggcggatacgtgtccggcatcgcccaaactaacgccgagccggacggccctacgccagagctcgaggaggaaatgtttaagaagcggaacctgaccatcatggacctgcatcccgggtccggaaaaacccgcaagtacctcccggccatcgtaagagaggcgatcaagcgccggctgagaaccttgatcctcgcccccacgcgtgtcgtggcggccgagatggaggaggctctaaagggactccccatccgctaccagacaaccgcaaccaagtccgagcacacgggcagagagatcgtggacctgatgtgccacgccaccttcaccatgcgattactgagccccgtccgggtgccgaactacaacctcatcatcatggatgaggcccacttcaccgaccccgctagtatcgcagcacgcgggtacatcagcacgagggtgggtatgggcgaggccgccgccatcttcatgaccgcgaccccgcctgggaccgccgacgccttcccgcagtccaacgcccccatacaggacgaagagcgtgacatcccggagaggagctggaacagtggcaacgaatggatcacggacttcgcaggtaagaccgtctggttcgtgcccagcatcaaggcgggcaacgacatcgccaattgtctgcggaagaacgggaagaaggtcatccagctgtcccgcaagaccttcgacaccgaataccaaaagacgaagctcaacgactgggacttcgtcgtcaccactgacatcagcgaaatgggagcaaactttaaggccgaccgagttatcgacccgcgccggtgcctgaagcccgtcatcctgaccgacggccccgagcgcgtgatcctcgccgggcccatgccggtgacagcggcctccgccgcgcagcggcgcggtcgggtcgggcgcaatccgcaaaaggagaatgaccagtacatattcactggccagcccctcaataacgacgaggaccacgcccactggaccgaggcgaagatgctgctcgacaacatcaacactccagaggggatcatccctgccctgttcgagcccgagcgggagaagtccgcagctatcgatggcgagtatcgcctgaagggcgagtcccggaagaccttcgtcgagttaatgcgtcggggggacctgccggtgtggttggcgcataaagtggcgtcagagggcattaagtacacggaccgcaagtggtgcttcgacgggcagcggaataaccaaatacttgaggagaacatggacgtggaaatctggaccaaggagggcgagaagaaaaaactgcgcccacggtggctggacgcccgcacctactcggacccgctcgccctgaaggagttcaaggacttcgccgcggggcgcaagagcatagccttggacctcgtcaccgagattggccgggtgcccagccacctggcccatcgcacgaggaatgccctggacaatctcgtgatgctgcacactagcgagcacggcgggcgtgcttatcggcacgctgttgaggagttgcccgagaccatggaaaccctcctgctgctcggcctgatgatcctgctcacgggtggggccatgcttttcctgatcagcggcaaaggcatcggtaagacatccatcgggctgatatgcgtgatagcgagcagcggtatgctgtggatggctgagataccgctgcagtggatagccagcgcaatagtgctcgagttctttatgatggttctgctgatccctgagcccgagaaacagaggacgccacaggataaccagctcgcctacgtggtgatcgggatactgaccctggccgcaatcatcgccgcgaatgagatgggcctcctggagacaacgaagcgggacctcggcatgtccaaagagccaggggtagtgagccccacatcctacctcgacgtggacctgcaccccgcctccgcctggacgctgtacgcagttgctactaccgtgatcaccccgatgctcagacacaccatcgagaattccacggctaatgtgagcctagctgcaatcgccaaccaggcggtcgtgctgatgggcttagacaaggggtggccgatttcgaagatggatcttggcgtaccccttctcgctctggggtgctatagccaggtaaaccccctgaccctcaccgccgccgtgctgttgctcattacgcactacgccatcatcgggcccgggctgcaggcgaaggccacgcgggaggcccagaagcgcacagccgccgggatcatgaaaaacccaaccgtggacggcatcatgaccatcgacttggatccagtcatctacgactctaagttcgagaagcagctcggccaggtaatgctgctggtgctctgcgcggtgcagctgcttttgatgcggacgtcttgggctctgtgcgaggctctgaccctcgccactggccccataacaaccctgtgggagggctcccccgggaagttctggaacaccaccatcgcggtgagcatggctaatatctttcgtggctcgtacctagccggggccggcctcgcgtttagcatcatgaaatccgtggggaccggcaagcggggcaccggaagccaaggcgaaacgctgggggagaagtggaagaagaaactgaaccaactcagccgcaaggaattcgacctgtacaagaagtccgggatcacggaggtcgaccggaccgaggcgaaggaggggctgaaacgcggcgagatcacccaccacgccgtgagccggggctccgccaagctccagtggttcgtggagcgcaacatggttatccctgaggggcgggttatcgacttaggatgcgggcgcggcgggtggagctactattgcgccggccttaagaaggtgaccgaagtccggggctacaccaagggtgggccggggcacgaggagcccgtccccatgtccacgtacggctggaacatagtcaagctcatgagcggaaaggatgtattttatctgccgcccgagaagtgcgacaccctgctgtgcgacatcggcgagtcctccccttccccaacggtggaggagagccggacaattagagtcctcaagatggtcgagccttggctgaaaaacaaccagttctgcatcaaggtgctgaacccttacatgccaactgtgatcgagcatctcgaacggctgcaacgcaagcatgggggcatgctggtccggaatcccttgtcacgcaacagcacccacgagatgtactggatctccaacggcacagggaacatagtgtcatcggtgaacatggtcagccggctgctcctcaaccgcttcaccatgactcaccggcgcccgaccatcgaaaaggacgtggacctgggcgccgggacgcggcacgtggacgcggagcccgagacaccaaatatggacgttataggggagcgtatcaagcggatcaaggaagagcacaactccacctggcattacgacgacgagaacccgtataagacctgggcataccacggtagctacgaggtgaaggccactggctccgccagcagcatgatcaacggagtcgtcaagctgttgaccaagccttgggatgtggtccccatggtgacccagatggccatgaccgacactaccccctttgggcagcagcgcgtattcaaggaaaaggtcgacaccagaaccccgcgccccatgcccggcacgcggaaggtgatgggcatcaccgcggagtggttgtggcgcaccctagggcggaacaagcgccctcggttgtgcacaagggaggagttcactaagaaggtgcgcaccaatgccgccatgggagccgtctttacagaggagaaccaatgggactcggcgaaagcggccgtggaggacgaggagttttggaagctagtggaccgggagcgtgaactgcacaagctggggaagtgcggcagctgcgtatataacatgatggggaagcgggagaagaagctgggcgagttcggcaaggccaaaggctcccgcgccatctggtacatgtggctaggtgcgcggtacctcgagttcgaggccctggggttcttgaacgaggaccattggttcagccgcgagaactcctacagcggcgtggagggtgaggggctccacaaactgggatacatcctgcgcgacatctccaagataccagggggtgcgatgtatgccgacgacaccgccgggtgggacacgcgcatcaccgaggacgacctccacaacgaggagaagataacccaacagatggaccccgagcaccgccagctggcgaacgcaatctttaagctgacctaccagaataaagtcgtcaaggtacagcgccctacccccactggaaccgtcatggacatcatcagtcggaaggaccagcgcggctctgggcaggtcggcacctacggcctcaacaccttcacgaacatggaggcgcagctggttagacaaatggagggagagggcgtattaagcaaggccgacctcgagaatccgcacctccccgagaagaaaattacccagtggctagaaaccaaaggcgtcgaacgcctcaagagaatggctatcagtggagacgactgcgtggtcaagcccatagatgaccgtttcgcgaatgcgctgctggctttgaacgacatgggaaaagtccggaaagacatcccgcagtggcagccgtcaaagggctggcacgactggcagcaggtacccttctgttcccatcacttccacgagctgatcatgaaggacgggcgcaagctggtggtcccctgccggccccaggacgagctcatcggccgagcccggatcagccagggggccggctggtccctgagggagaccgcgtgcctgggcaaggcctacgcacagatgtggagccttatgtatttccaccggcgggacctgcgtctggccagtaacgcgatctgcagcgccgtgccggtgcattgggtccccacgtcccggaccacatggtccatccacgcccaccaccagtggatgaccacggaggacatgctcactgtgtggaaccgcgtttggatcgaggacaatccctggatggaggacaaaacgcccgtcaccacttgggagaacgtcccgtacctggggaaacgggaagaccagtggtgtggcagtcttatagggctcacctcccgcgcgacctgggcacaaaatatccccaccgcgatccagcaggtccgcagcctgatcggcaacgaagagttcctcgactacatgccctcgatgaagcgctttcggaaggaggaggagagcgagggcgcaatctggtga

SEQ ID NO: 25797 - RNA, 9873 nt, synthetic construct
  misc_feature 1..9873: note = derived and/or modified CDS sequence (opt11) from DENV-3__GQ199886__SS-prME
  source 1..9873: mol_type = other RNA
accagcctctgcctgatgatgatcttacccgcagccctggcctttcacctcacaagtcgtgacggggagccccggatgatcgtggggaaaaacgagcgcggcaagagtctgctgttcaaaaccgcctctgggattaacatgtgcaccctaatcgccatggacctgggggagatgtgcgacgatacggtcacatacaagtgcccccacatcaccgaggttgagcccgaggacatcgactgctggtgtaaccttaccagcacttgggtgacctatgggacttgcaaccaggcaggcgagcaccggcgcgacaaacggtccgtcgccctcgcgccccacgtgggcatggggttggataccaggacccagacctggatgagcgccgagggcgcctggcgccaggtcgagaaggtcgagacttgggccctgcgccaccccgggttcacaatcctagcgctgttcctggcccattatatcggaacctccctcacccagaaggtggttatcttcatcctgctgatgctcgtcacgccatccatgactatgcgttgcgtgggtgtgggtaaccgagacttcgtcgagggcctgtccggggcaacctgggtggatgtggtccttgagcacggtgggtgcgtgaccactatggcaaagaacaagccgaccctcgacatcgagttacagaagaccgaggccactcagttagcgacgctcaggaagctgtgtatagagggaaagatcaccaacatcaccaccgacagccgctgcccgacgcaaggcgaagcggtcctgccggaggagcaggaccaaaactacgtgtgcaagcacacctatgtggatcgggggtggggcaacggctgcggcctctttgggaagggatcactggtgacctgtgccaagttccagtgtctggagcccattgaggggaaggttgtgcaatacgagaatctcaaatacaccgttatcataacagttcacaccggggatcagcaccaggtgggcaacgagactcagggggtcacagccgaaattacgccccaggccagcaccaccgaggcaatcctgcccgagtacggcactctgggcctcgagtgcagtccgcgaaccggcctggacttcaacgagatgatcctacttacgatgaaaaacaaggcttggatggtgcaccgacagtggtttttcgatctgcccctgccctggacaagcggcgccaccaccgagacgccaacatggaaccgcaaggagctactggtgacctttaaaaacgctcacgccaagaagcaggaggtcgtggtcctggggtcgcaggagggcgcaatgcacaccgccctcacgggggctaccgagatccagaacagcggaggaacctccatcttcgccggacacctgaagtgccggctgaagatggacaagcttgaattgaagggcatgagctacgccatgtgcactaacacgttcgtactgaagaaggaggttagcgagacccaacatgggaccattctgataaaagttgagtataagggagaggacgtcccttgcaagatcccctttagcaccgaagacgggcagggtaaagcgcacaacggccgcttaattacggcaaatccggtggtaaccaaaaaggaagaacccgtgaacatcgaagccgagccgcctttcggagagagcaacatcgtcataggcatcggggacaacgctcttaagatcaactggtacaagaagggttcgagtatcgggaagatgttcgaggcgaccgcccggggcgcgcgccggatggctatattaggcgacaccgcctgggacttcgggtccgtgggcggcgtcctcaacagcctgggaaagatggtgcaccagatattcggctcggcgtacacggccctattctcgggagtgtcctgggtcatgaagataggcatcggggttctccttacttggatgggcctcaactcgaaaaacacatccatgagtttttcctgcattgcgatcgggattatcaccctctacctcggcgccgtcgtccaggccgacatgggatgtgttatcaactggaagggcaaggagcttaagtgcggcagcgggatcttcgtgactaacgaggtccatacctggaccgagcagtacaagttccaggcggactcacccaagcgccttgccaccgctatcgccggggcctgggaaaacggggtttgcggcatccgtagcacgacccggatggagaatctgctctggaagcagatcgcgaacgagctcaattacattctatgggagaacaatatcaagctgaccgtggtcgtgggggatacaatcggcgtgctcgagcagggcaagagaacactgacgccccagccgatggagctgaagtacagctggaaaacctggggcaaggcaaagattgtcaccgccgagacgcagaacagctccttcattatagacggcccgaacactcccgaatgcccaagcgcctctcgcgcgtggaatgtgtgggaagtggaagattatgggttcggtgtcttcaccaccaacatctggctcaaactgcgggaagtctatacccaactttgcgaccatcggctgatgagtgctgcggttaaggacgagcgcgccgtccacgccgatatgggttactggatcgagagccagaaaaacgggtcctggaagctggaaaaggcgagcctgattgaagtgaagacgtgcacatggccgaagtcccacaccttatggagcaacggggtgctggaaagcgacatgattatccccaagtcactggcggggccgatttcccaacacaactaccggccgggctaccacactcaaacggccgggccctggcacctaggcaagcttgagcttgacttcaactactgcgagggcacaaccgtcgttatcaccgagaactgcggtacacgcggccccagcctccggaccaccaccgtgtccggtaagctgatccacgagtggtgctgtcgcagttgcacgctgcccccactccggtacatgggggaggacggatgctggtacggcatggagatccggccaatctccgagaaggaggaaaatatggttaaaagcctagtgagcgctggcagcggtaaggtggacaacttcaccatgggtgtcctctgcctcgcgatcctattcgaggaggtgatgcggggaaagttcggaaaaaagcacatgatcgctggggtgttctttaccttcgtcctgctcctgagtggccagatcacctggcgcgacatggcccacacgctgataatgataggtagcaacgcctccgaccgtatgggaatgggcgtaacttatctcgccctgattgccaccttcaagatccaaccctttctcgcgcttgggttcttcctgcgcaagctgacctctcgggagaacctcctactgggagtgggtctcgccatggccacgacgctgcagctgcccgaggatatcgaacagatggctaacgggatagctctcggcctgatggcactgaagctcatcacccagttcgagacctaccaactgtggactgccctgatcagcttaacctgcagcaacactatcttcaccttaacggtcgcctggcgtaccgccacattaatcctcgcgggagtcagcctgctgcccgtctgccaatcaagctcaatgcgtaagaccgactggctccccatgacggtggccgccatgggagtgccccccctcccgctctttatttttagcctgaaggacaccctgaaacgcaggtcctggcccctgaatgagggggtcatggccgtgggtctcgtgagcatcctggcctcgtctctcttacgaaacgacgttcccatggcaggccccctagtggccgggggactgctcatcgcctgctacgtgatcaccggtacctccgcagacctgacggtcgagaaggctgccgacgtgacttgggaggaggaagccgaacaaactggtgttagccacaacctgatgatcaccgtcgacgacgacgggacgatgcgcattaaggacgacgagacggagaatatcctaaccgtgcttctgaagactgccctactgatcgtctccggcatcttcccgtatagcatccccgccaccttgctcgtttggcacacgtggcaaaaacagacgcagaggtccggcgtgctgtgggacgttccgagcccccccgaaacccagaaggccgagttagaggaaggggtctaccgcatcaagcaacagggtatttttgggaagacccaggtgggtgtaggggtccagaaggagggagtcttccacacgatgtggcacgtaacccggggggctgtgttaacgtacaacggcaagcgcctggagcccaactgggcctctgtgaaaaaggacctgatcagttacgggggggggtggcggctcagtgctcagtggcagaagggggaggaggtgcaggttatcgccgtggaacctggcaagaaccccaagaactttcaaacaatgccagggacattccagactaccaccggagagattggcgcgatcgcgctggacttcaaacccgggactagcggcagccccatcatcaatcgcgagggtaaggtggtcgggctgtatggcaacggggttgtgaccaagaatggcggctacgtatcaggcatcgctcaaaccaacgccgagccggacggcccaactcctgagctggaggaagagatgtttaagaagcgtaacctcacgatcatggacctgcacccgggatcaggcaagaccaggaagtacctgccggccattgttcgggaggcaattaagcgccgactccgaaccctgatcttggcccccacccgggttgtcgccgccgagatggaggaagcccttaagggccttcccattcgctaccaaacgaccgcaaccaagtcagaacataccggcagagaaatcgtggacctgatgtgccatgcaaccttcaccatgcgcctcctgagccccgtgcgggtcccgaactacaacctcatcataatggacgaagcgcacttcacggaccccgcgtcgatcgccgcgcgtgggtacatcagcacccgtgtgggaatgggggaggccgccgccatcttcatgactgctacgccgcctggcactgccgacgccttcccacaatccaacgcgcccatccaagacgaagagaaagatatacccgagcgctcttggaactccggcaacgaatggattacggacttcgcggggaagacggtgtggttcgtacccagcataaaggcgggcaacgatatagcgaattgcctccgcaagaacgggaaaaaggtgatccagctaagccgtaaaaccttcgacaccgagtatcagaagaccaagctgaacgactgggacttcgtggtaacgaccgacattagcgagatgggagccaacttcaaggccgaccgcgtgatcgacccgcggcgctgtctcaagccggtgatcctgactgacggccccgaaagggtaatcctggcggggcccatgccggtgaccgcggcctcggcggcccagcgccgaggccgtgtgggacggaatccccaaaaggagaacgatcaatacatcttcaccggccaacccctcaacaacgacgaggaccacgcccactggacggaggccaagatgttactggacaacattaacacccccgaaggcatcattccggcgctgttcgagccagaacgggagaaatccgcagcaatagacggcgagtaccggctgaagggcgagtccagaaaaaccttcgtggagctgatgagacgaggggacttacccgtttggctggcacacaaggtagccagcgaaggtatcaagtatactgatcgaaagtggtgcttcgacgggcagcgcaacaaccagatcctcgaggagaacatggatgtcgagatctggacgaaggagggcgagaagaagaagctacggccccgctggctggacgcccggacctactcggacccgctggccctcaaggaattcaaggactttgctgcgggcaggaagagtatcgcgctcgatctggtcaccgaaatcgggcgtgttccgtcgcaccttgcccacagaacccgcaacgccctcgacaatctggtgatgctccacacgtcagagcatggcgggcgagcctaccggcatgcggtggaggagctgcccgagacgatggagaccctgcttctgctgggcctaatgatcctgctgactggaggggctatgctgttcctgatctcgggcaagggaatcggcaagacgtccatcggtctgatatgcgtaatcgcgagctcaggtatgctctggatggccgagattccgctgcagtggatcgccagcgcgatcgtgctggaattcttcatgatggtgctcctgatcccggagccagagaagcaaagaacgccacaagataatcagttggcctacgttgtgatcgggatcctcacactggctgccatcatagcagcgaacgagatgggtctgctagaaaccaccaaacgagacctgggcatgtccaaggagccgggggtggtcagccccacctcctacctggacgtggacctccacccagcctcggcctggaccctgtatgccgtggcgaccactgttatcaccccaatgctccggcacaccatcgagaactcaaccgcaaacgtgtcgttagcagccatagccaaccaggcggtggtgctgatgggcctggacaagggttggcctatttccaagatggacctcggggtccctctgttagccctcgggtgctattcgcaggtgaatccccttacgctgacagcagctgtcctcttactgataacccattatgcgatcattggcccgggcttgcaggcgaaggccactcgcgaggcccagaagcgaacggccgccggaatcatgaagaacccgacggttgacggcataatgaccatcgacttggaccccgtgatctatgacagcaagttcgaaaagcagctggggcaggtcatgctcctagtattgtgcgcagtgcagcttctgctgatgcgcactagctgggctctctgcgaggcactgacattggctaccggccccatcacgacgctgtgggaaggctcccccggaaagttctggaacacgacaattgctgtcagcatggccaatatcttcagaggttcttacttagcgggagcgggcctggcctttagcattatgaagtccgtagggacaggtaaacggggcaccgggagtcagggggagacccttggggagaagtggaaaaagaagttaaaccagctgagccggaaggagttcgacctctacaagaagtcaggcatcacggaagttgataggaccgaagcgaaagaagggctgaaacgtggggagatcacccaccacgccgtctcccgcggctccgcaaagctgcagtggttcgttgagcggaatatggtgatccctgaagggcgagtcatagacctcggatgtgggagaggagggtggagctactattgcgccggcctgaaaaaggtcaccgaggtgcgtggctacaccaagggcgggcccgggcatgaagagcctgtccccatgtccacttacggctggaacatcgtgaaacttatgagcgggaaagacgtgttttacctcccacccgagaagtgcgacacgctgctgtgcgacatcggcgaatcctcaccgtcccccaccgtcgaggagtcgcggacaatacgcgtgctgaaaatggtcgagccatggctcaaaaacaaccagttctgcatcaaggtcctgaacccctacatgcccactgtgatcgagcacctggagcgcctccagcggaagcatggtggaatgctggtgcgcaaccccctgtctcggaacagcacgcacgagatgtactggatcagtaacggcaccgggaacatcgtcgcctcagtgaacatggtgtcccggttactgctcaatcggtttacaatgacccaccgccggccgacgatcgagaaggacgtcgacctcggcgcgggcacccgccacgtgaacgcagaaccggagacgccgaatatggacgtgatcggggagcggatcaagcgcatcaaggaggagcacaacagcacatggcactatgacgacgagaacccgtataagacttgggcgtaccacggctcgtatgaggtaaaggctacggggagcgccagcagcatgattaacggcgtggtgaagctactgacgaagccctgggatgtggttcccatggtcacccagatggcgatgaccgacacaacaccattcggccagcagagggtgtttaaggagaaggttgacacccgcactccacggagcatgcccggtaccaggcgtgtcatgggcatcaccgccgaatggttatggaggaccctgggacgaaacaagaaaccccgactgtgcacccgcgaggaattcaccaagaaggtgcgaacaaatgccgccatgggcgcggtgttcaccgaagagaaccaatgggactcggccaaggccgccgtcgaggacgaggacttctggaaacttgttgacagagagcgcgagctgcacaagctgggaaagtgcggcagctgcgtgtataacatgatggggaagcgagagaagaaactcggcgaattcggcaaggccaagggctcaagggcgatttggtacatgtggctgggggcaaggtatctagagttcgaggccctcgggtttttgaacgaggaccattggttctcaagggagaactcctacagcggcgtcgagggggaaggcctacataaactcggctacatactgcgcgacatcagcaagatccccgggggcgccatgtacgccgacgatactgcgggatgggacaccaggatcacagaggacgacttgcacaacgaagagaagatcactcagcagatggacccggaacatcgccagttggccaacgctatcttcaagctgacttaccagaacaaggtggtgaaggttcagagaccgacgcctaccggcaccgtaatggacatcatcagccgaaaggaccagcggggctccggccaagtgggcacctacggcctgaatactttcaccaacatggaggcccaattgatcaggcagatggagggcgagggggtcctgtctaaggcagacctggagaacccccacctcccggaaaaaaagatcacgcagtggctggagacaaagggcgtcgagcggctgaagcgcatggcgatcagcggagacgactgcgtcgtgaagcccatcgacgatcggttcgccaatgccctcctggccctgaacgatatgggtaaggtacgcaaggacatcccccagtggcagccgagtaaaggttggcacgactggcaacaagtgcctttttgctcccaccacttccacgagctcatcatgaaggatggccggaagctggtcgtaccgtgcagacctcaggacgagcttatcggacgggctcgaatatctcaaggggccggctggtcgctccgggagaccgcctgccttggcaaggcctacgcccagatgtggagcctgatgtatttccaccgccgcgatctccggctggcgtctaatgccatttgtagcgcggttcccgttcactgggttccgacctcccgcacgacctggagcatacatgcccaccaccaatggatgaccaccgaggatatgctaacggtatggaaccgggtctggatcgaagacaatccttggatggaggacaagactcccgttacgacctgggagaacgtgccctatttagggaagcgggaagaccaatggtgcggcagcctgatcgggctgacttcccgggcaacctgggcgcagaacatccccaccgccatccagcaagtccgctcgctcataggcaacgaagagttcttggactacatgccgtccatgaagcggtttcgcaaggaggaggagagtgagggggccatctggtag

SEQ ID NO: 25798 - RNA, 9873 nt, synthetic construct
  misc_feature 1..9873: note = derived and/or modified CDS sequence (opt11) from DENV-3__FJ882576__SS-prME
  source 1..9873: mol_type = other RNA
acatccttatgcctcatgatgatactacccgccgccctggcctttcacctcactagccgggatggcgaaccgcggatgattgtggggaagaacgagcggggtaagtcactgctgttcaagacggcctccgggatcaacatgtgcacgctcatcgccatggaccttggagaaatgtgtgacgacacagttacatacaaatgcccgcacatcaccgaggtggaacccgaagacatcgactgctggtgcaacttaacctcaacctgggtgacctacggtacctgcaaccaggccggcgagcatcggcgcgacaaacggtccgtcgccctcgcgcctcatgtaggcatggggctggacacgcgcacccagacctggatgtctgccgagggtgcctggcgccaagtagaaaaggttgagacgtgggccctgaggcaccctgggttcaccatcctcgccctgttcttagcccattacattgggaccagcctgacccagaaggtagtaatattcatcctgctgatgctcgtcactccctctatggccatgcggtgcgtgggagtgggcaaccgcgactttgtcgagggcctttcgggggctacctgggtagatgtggtcctggaacatggcgggtgcgtgactaccatggccaagaacaagccgacgcttgatatcgagctgcagaagacggaggccacccagctggccacactccgcaaattatgcatcgagggcaagatcacgaatatcacaaccgatagccgctgccccacgcagggcgaggccgtgttaccggaggaacaggaccagaactatgtgtgcaagcacacatacgtcgacagggggtggggcaacgggtgcggcctcttcgggaagggctccctggtcacgtgtgcgaagttccagtgcctagaacccatcgagggcaaggtcgttcagtacgaaaacctcaagtatacagtgatcatcaccgtacacacgggggaccaacaccaggtaggcaacgaaacacaaggtgtcaccgccgaaataacgccccaggctagcacgaccgaggctatattgccggagtatggcactctggggctggagtgttcccccagaaccggcctggatttcaacgagatgatactgctcaccatgaagaacaaggcctggatggtgcaccggcagtggttcttcgacttacccctgccctggacgtctggcgccacgaccgaaaccccgacatggaaccggaaggagcttttagtgaccttcaagaacgcgcacgcgaagaagcaggaggtcgtggtcctgggatctcaggagggcgctatgcacactgcccttaccggggcgacggagatacaaaacagcggtgggaccagcatcttcgccggccacctgaagtgccggctgaagatggacaaactcgagctgaagggcatgagctacgcgatgtgcactaacaccttcgttctgaagaaggaggtctccgagacacagcacgggaccatactcatcaaggtggaatacaagggagaggacgtcccgtgcaagatccccttcagcacagaggacgggcagggcaaggcccacaatggccgactgatcacagccaatcccgtggtgacgaagaaggaggaacccgtcaacatcgaagccgagccaccctttggggaatcaaacatcgtgatcggcataggggacaacgctttgaagataaactggtataagaagggctccagcatcggcaaaatgttcgaggcaacggccaggggcgcgcgcagaatggccatcctgggcgacacggcgtgggacttcgggtcggtgggaggagtcctcaacagcttaggcaagatggtgcaccagatcttcggttccgcctacaccgccctgttcagtggagtttcgtgggtcatgaagatcggcatcggggtgttactgacgtggatcggcctgaacagcaagaacacgtcaatgagcttctcctgtattgccatagggatcataaccctctaccttggcgccgtggtccaggcggacatgggttgcgtcatcaactggaagggaaaggagcttaaatgtggcagcggcatcttcgtgacgaacgaggtccacacatggaccgagcaatacaaattccaggccgactcaccgaagaggttggcgacagcaatcgctggcgcgtgggagaatggagtgtgcgggatccgcagcaccacgcggatggagaacctgctgtggaagcaaatcgccaatgagttaaattacatcctgtgggaaaacaacatcaaactgaccgtggtggtgggagacatcatcggggtgctcgagcaagggaagaggaccctgacgccccaaccgatggagttaaagtactcatggaagacatgggggaaagccaaaatagtgaccgccgaaacccaaaattcgagcttcataatcgacggccccaacacccccgaatgtcccagcgcgtcccgggcctggaacgtatgggaggtggaggactatggtttcggcgtcttcaccaccaacatctggctgaagctgcgcgaggtgtatacccagctgtgtgaccaccggttgatgagcgccgccgtgaaggacgagcgcgccgtgcacgcagacatgggctactggatcgagtctcagaagaacgggagttggaaactggagaaggccagcctgatcgaggtgaagacatgcacctggccaaagtcgcacacgctttggagcaacggcgtgctggagtcagacatgataatccccaagagcctggctggtcctataagtcagcacaattaccggccgggctaccacacccagacagccgggccctggcacctcggcaagctggagctggacttcaactactgcgaaggcaccacggttgtgatcaccgagaactgcgggacacgtggccctagcctacggactaccaccgtttccgggaagctgatccacgagtggtgctgtcgcagctgcaccctgccccctctccggtacatgggcgaggacggttgttggtatggtatggagatacgccccatctccgagaaggaggagaacatggtcaagagcctggtgtccgccggcagtgggaaagtggataacttcaccatgggtgtcctgtgcttggccatcctgttcgaggaggtgatgcgggggaagttcgggaagaagcatatgatcgctggggtctttttcacgtttgtcctgctcctttccggccagattacctggagggacatggcccacaccctaatcatgatcggctctaacgcctcagaccgcatgggtatgggcgtaacctatctggccctgattgcgacattcaaaatccagccattcctggccctcggcttcttcttacgcaaattgacaagccgggagaacctcctgttaggcgtgggcctcgccatggcaactactctacagctgcctgaggacattgagcagatggcgaatggaatcgcccttggcctgatggcccttaagctcattacgcagttcgagacctatcagttgtggactgccctaatcagcttgacttgctccaacacgatctttacgctaaccgtcgcttggcggaccgcgacgctgatactggcaggggtgagccttctgccggtctgccagtccagctcaatgcggaagaccgattggctccccatgactgtggccgccatgggagtgccgcccttgccgttattcatcttcagtctcaaggacaccctgaaacggcgctcctggcccctgaacgaaggggtcatggccgtgggactcgttagtattctggcgtcctccctgctccggaacgacgtccccatggccggacccctggttgccggtggcctgctcatcgcctgctatgtgataacggggacatcagccgaccttaccgtcgagaaagcggcggacgtgacctgggaggaggaggccgagcaaaccggcgtgtcccacaacctgatgatcaccgtcgacgacgacgggaccatgcgaataaaggacgacgagaccgagaacatactcaccgtactgctcaagacggccttgctgatcgtgtccggcatcttcccatacagcatcccagctacactgttggtctggcatacctggcagaaacagacgcagcggtctggcgtgttatgggacgtgcccagcccgcctgagacgcaaaaggcggagcttgaggagggggtctaccgtatcaagcagcagggcatattcgggaagacccaagtgggcgtgggagtccagaaggagggcgtgttccacaccatgtggcacgtgaccaggggcgccgtactggcatacaacgggaagcgcctcgagcctaactgggccagcgtgaagaaggacctgataagctacggcgggggctggcgactctcggcacagtggcagaagggggaggaggttcaagtcatcgccgtggagcccgggaaaaaccccaagaattttcaaaccatgcccggaaccttccagaccaccacgggggagatcggcgccatagctctagattttaagcccgggacctctggctctcctatcatcaaccgcgaaggcaaggtggtgggactgtacggcaacggtgtggtgaccaaaaacggcggatacgtctccggcattgcccagacaaatgcggagccggacggccccacgcccgaactggaggaggaaatgttcaagaagcggaacctcaccatcatggacttacatcctgggagcggtaagacgcgcaagtatctgcccgcaatcgtgcgggaggccatcaagcggcgcctccgcacactgatcctggcccccacgcgggtggtcgctgcggaaatggaggaggccctcaagggtctgccaatacgctaccagacgaccgccaccaagtccgaacacacgggccgggagattgtggacttgatgtgccatgccaccttcaccatgcgcttactgagccctgtgagagtccctaactataacctgattatcatggacgaggcccattttacggatcccgcgtccatcgccgcccgcggttacattagcacgcgagtgggcatgggcgaggcggcggcaatctttatgaccgccacgccgcccgggactgcagacgcctttccgcagtccaatgcgccgatccaggacgaggagcgcgatatccccgagcgctcgtggaactcgggcaatgagtggatcacagactttgcggggaagaccgtctggttcgtcccctcaatcaaggccggtaacgacatcgccaactgtctccggaagaacggcaagaaggttatccagctttctagaaagacatttgataccgagtatcagaagacgaaactgaacgactgggacttcgttgtcaccaccgacatctccgagatgggcgccaacttcaaggcggatcgggtgatcgacccgcgccgatgcctcaaacccgtgatcctgaccgacggacccgagcgcgtcatcctggccgggcccatgccggtgactgccgccagtgccgcccagcggcgcggccgggtagggcgaaacccccagaaagagaacgaccagtacatcttcaccggccagcccctgaacaatgacgaggaccacgcccactggaccgaggcgaagatgctgctggacaacattaatactcccgaggggatcatcccggccctattcgagcctgagagggaaaagtccgcggcgatcgatggcgagtacagactgaagggcgagagccggaaaaccttcgtagagctgatgcgccgcggggatttacccgtgtggcttgcccacaaggtcgccagcgaggggatcaagtacacggatcgcaaatggtgtttcgatggggagcggaacaaccagatcttagaagagaacatggacgtggaaatatggaccaaagagggtgagaagaaaaagctccgcccccggtggctggacgcgcgcacctactccgatcccctagctctaaaggagtttaaagacttcgccgcgggccgcaagagcatagccctggacctggtaaccgagatcgggcgagttccgtcccacctcgcgcatcgcacgcggaacgctcttgacaacttggtgatgctccacactagcgagcacggcgggcgcgcctaccgccacgccgtggaggagctacccgaaacaatggagaccctgctcctgctgggactcatgatcctgttaaccggcggggccatgctgttcctcatctccggcaaggggatcggaaagacctctatcgggctaatctgtgtcatcgctagcagcggcatgctctggatggcggagatcccactgcagtggatcgccagcgctatcgtgctagagttctttatgatggtgctcctgatccccgaacccgagaaacagcgcacaccacaggacaatcaactcgcctatgtcgtgatcgggattcttaccctggcggcgatcatcgccgccaatgagatgggcctgctcgagactaccaagagagacctgggcatgtccaaggaaccgggggttgtcagccccactagctacctagacgtcgacctccaccccgcctccgcgtggaccctgtacgccgtcgcaaccactgtgatcacccccatgctgcgacacacgatcgagaacagcacggccaatgtctccctcgccgcgatcgctaaccaggccgtggtcttgatgggcctggacaagggatggccgatctccaagatggacttgggcgtgcccctactggccctcgggtgttacagccaggtgaatcccctgaccctgacagccgcggtcctcctactgatcacccactacgctataataggacccggactccaggccaaggcaacgcgggaggcccagaagcggaccgcggccgggattatgaagaacccgaccgtggacggcattatgactatcgacctggaccccgtgatctacgactccaagttcgagaagcagctggggcaggtcatgctcctggtgctatgcgccgttcagttactcctgatgcggacgagctgggccctctgcgaggcactgacgctggctaccggcccgatcaccacactgtgggaagggtcccccgggaagttctggaacaccaccattgccgtaagcatggccaacatcttccgtgggtcatacctggctggggcgggactcgcgttctcgataatgaagtccgtgggaaccggcaaacggggcacggggagccagggcgagaccctcggggagaagtggaagaagaagctcaaccagctaagccgcaaggagttcgatctctataagaagtccggcattaccgaggtggaccggaccgaggccaaagagggtcttaagcgtggagaaattacccaccacgccgtaagccgaggctccgccaagctgcagtggttcgtagagcgcaacatggtgattccggaggggcgggtcatcgacctgggctgcggtcgcggtgggtggagctactactgcgcgggcctcaagaaggtgacggaggttcggggttacactaaagggggtcccgggcacgaggagcccgtccccatgtccacctacggctggaacatcgtgaagttgatgagcggaaaggacgttttctacctgccgcctgaaaagtgtgataccctgctgtgcgacattggtgagtcctcaccatcccccacggtagaggagagtcgcaccatccgcgtgctgaagatggtggagccgtggctgaagaacaatcagttctgtatcaaagtattgaacccctacatgcccactgttatcgaacacttagaacggctccagcggaagcacggcgggatgctggtgcgcaaccccctgtcccgtaacagcacccatgagatgtattggatctcaaacggcacgggcaacatagtcagctccgtgaatatggtctcgcggctcctgctgaaccgcttcaccatgacccaccggcgtcctacgatcgagaaggacgtcgatctcggcgccggcacgcggcacgttaatgccgagcctgagaccccaaacatggacgtgatcggggagcgcatcaagaggatcaaggaggagcataactcaacttggcactacgacgacgaaaacccatacaaaacgtgggcctatcacggcagctatgaggtcaaggccacgggaagtgcctccagcatgatcaacggcgtggtcaagctgctgaccaaaccatgggatgtcgtgcccatggtaactcaaatggccatgactgatacgacccccttcgggcagcagcgcgtgttcaaggaaaaggtggacacacggacacctagatccatgcccggcacaagacgcgttatgggtataaccgccgagtggctttggcggaccctgggccgcaacaagaagccccggttgtgcaccagagaggagttcactaagaaagtgcgtaccaatgcggcgatgggcgccgtgttcactgaggagaaccagtgggatagtgccaaggccgccgtagaggatgaggatttctggaagctcgtggaccgggagagggagctgcataagctggggaaatgcgggtcctgtgtgtacaatatgatggggaagagagagaagaagctcggcgagttcggcaaggcgaagggaagcagagccatctggtacatgtggctaggggcccggtacttagagtttgaggcgctagggtttctcaatgaggatcattggttctccagagagaacagctactccggcgtagagggggagggcctgcacaagctcggctacattttgcgggacatcagcaagatcccaggaggggcgatgtacgcggacgacaccgccgggtgggacacgcgcataacggaagacgacctccacaacgaggagaaaataacccagcagatggacccggagcaccgacagctcgccaacgcaatcttcaaattaacctaccagaacaaagttgtaaaagtccaaaggcccacgcccaccggcaccgtgatggacatcatatcccggaaggatcagcgcggcagcggccaagtgggaacctacggcctgaacacgtttacgaacatggaggcccagctcatccggcagatggagggagagggcgtgttatccaaggcggacttagagaatccccacctccccgagaagaagatcactcagtggctggagacaaaaggtgtagagcgcttgaagagaatggctataagcggggacgactgcgttgtaaagcctatagacgaccgtttcgccaacgccttactggcgttaaacgacatgggtaaggtgcggaaggacatcccccagtggcagccctccaagggctggcacgactggcaacaagtccccttctgtagccaccactttcacgagctgattatgaaggacgggaggaagctggtggtgccctgtagaccccaggacgagctgatcggccgcgcacggatctcgcagggagctggctggtcgttgagagagaccgcatgtctagggaaggcgtacgctcagatgtggtccctgatgtactttcaccgtcgggacctcagactggcgagcaacgccatctgcagtgccgtcccggtccattgggtgccgacgagccggaccacctggagcatccacgcccaccatcaatggatgaccacggaggatatgctcacggtgtggaacagagtctggattgaagacaacccctggatggaggacaagacccccgtgaccacctgggagaacgtgccctacctcggtaagcgagaagaccagtggtgtggcagtctgattgggctaactagccgggcgacttgggcacagaatatcccaacagccatccagcaggtccggtccctcattgggaacgaggagtttctggactacatgcccagcatgaagcgcttccggaaggaggaggagtccgagggggcaatctggtga

SEQ ID NO: 25799 - RNA, 9873 nt, synthetic construct
  misc_feature 1..9873: note = derived and/or modified CDS sequence (opt11) from DENV-3__FJ850052__SS-prME
  source 1..9873: mol_type = other RNA
acgtcgctctgcctaatgatgatactgcctgccgccctagctttccatctcaccagccgggacggcgagccgcggatgattgtggggaaaaacgaacggggcaaatccctgctgttcaaaaccgcttccggtatcaacatgtgcaccctcatcgccatggacctgggcgagatgtgcgatgataccgttacctataaatgtccgcacattactgaggtagagccagaagacatcgactgctggtgcaacctgacctctacgtgggtgacctacgggacgtgcaaccaggcgggtgaacaccggcgcgacaagcggtccgtagccctcgcgccccacgtaggcatggggttggacacacgcactcaaacctggatgagcgccgagggcgcctggcgccaggtggagaaggtggagacttgggcattgcgccacccgggttttacgatcctggcgctgttcctggcgcattacatcggaacctccttgacccagaaggtggtgatctttattctgctgatgctggtcacgccctctatgaccatgcgatgcgtgggtgtgggaaatcgtgacttcgtcgaaggcctgtccggggccacgtgggtggacgtggtactcgagcacggcgggtgcgtgacgacgatggcaaagaacaagccgaccctggacatcgagctacagaagacggaggcaacccaactcgcgacgctgcgaaagctgtgcattgagggcaagattaccaacattaccactgatagccggtgccccacccagggtgaggccacgctgcctgaggaacaggatcagaattacgtatgtaagcacacttacgtggaccgtgggtggggcaacggctgcggcctcttcgggaaaggaagccttgtgacctgcgccaagttccagtgcctggagccgatcgagggcaaggttgtccagtacgagaatctcaagtacaccgtgatcatcacggtgcataccggggatcagcaccaggtcgggaacgagacccagggggtaacggccgaaatcacgccccaagcgagcactactgaggcgatcctgccggagtatgggacgctggggctggagtgctccccccgaacaggcctggatttcaacgagatgatcctgctcaccatgaagaataaggcctggatggtccaccgccagtggttcttcgatctgcccttgccctggacctcaggcgctaccacagagacgcccacctggaaccgcaaggagctcctcgtgaccttcaagaacgctcacgccaagaagcaggaggtggtggtgctggggtcccaggagggggctatgcatacggcgctcaccggggccactgagatccagaacagtggcggcacctccatcttcgccggacacctgaagtgcagactgaagatggacaagctcgagctgaaggggatgagctacgcgatgtgcacgaacactttcgtgctgaagaaggaggtctccgagacccagcatgggacaatcctcatcaaggtcgaatataagggcgaggatgtgccgtgtaagatcccctttagcacggaagatgggcaggggaaggcgcacaacggccgcctaatcacagccaaccccgtcgttaccaaaaaggaggaacccgtgaacatcgaggccgaaccgccctttggtgagagcaacatcgtcatcggaatcggggacaacgccttgaaaatcaactggtacaaaaagggatccagcattgggaagatgttcgaagcgacggcccggggagctcgccgcatggcgatcctgggcgacacagcctgggacttcgggtccgtgggcggggtgctcaattcgctgggcaagatggtccaccaaatcttcgggtcggcttacaccgcgctgttcagcggcgtttcctgggtgatgaaaatcggcatcggcgtcctcctgacctggataggcttgaacagcaagaacacctccatgtcattttcgtgcatcgccatcggcattatcactctctatcttggcgccgtggtgcaggccgacatgggttgcgtaatcaactggaagggcaaagagctgaagtgcggctcagggatcttcgttacaaacgaagtacacacctggaccgagcagtacaagttccaagcagactcccccaagcgcctcgcaacagcgatcgccggcgcttgggagaatggggtctgcggcatcaggagcacaacccggatggagaacctgctgtggaagcagattgccaacgagctcaactacattctgtgggagaataacataaagctgacggtggtagtcggggacataatcggcgtgctggaacagggcaaacgcacgcttacgccccagccgatggagctaaagtactcctggaagacctggggtaaggccaagatagtgaccgccgagacacagaacagttccttcatcattgacgggcccaataccccagaatgcccctcggtgtcccgggcctggaacgtgtgggaggtcgaggactatgggttcggcgtatttaccacaaatatttggcttaagctccgggaggtgtacacccagctgtgcgaccatcgattgatgtcagcggccgtgaaggatgaaagagccgtccatgccgacatggggtactggatcgagagccaaaagaacggctcctggaaactcgagaaggccagcctcatagaggtgaagacctgcacgtggccaaagtcccacaccctgtggtcaaacggcgtactggagtccgatatgatcatccccaagagcctggcggggcccatttcccaacataaccaccggccgggatatcacacccagactgccgggccctggcacctcggtaagctggagctggacttcaactactgcgagggcaccaccgtggttatcaccgagaactgcgggacgagaggccccagcctcaggaccaccaccgtctccggcaagctgatccacgagtggtgctgcagatcttgcactctgcccccgttgcggtacatgggtgaggacgggtgctggtacggcatggaaatcagacccatctcggagaaggaggagaacatggtcaagagcctggtctccgcgggaagcgggaaggtggacaacttcaccatgggcgtcctgtgccttgccatcctgtttgaggaagttatgcgggggaagttcggtaagaagcatatgatagcaggtgtcttcttcacctttgtcctgctcctgtccggccagatcacctggcgcgacatggcgcacaccctgatcatgataggctctaacgcctccgaccggatggggatgggggttacgtacttggccctgatagctacgttcaagattcagccgttcctggccctcgggtttttcctgcgaaaactgacctccagagagaacctcttgttgggagtaggactcgctatggccacgaccctgcagctgcccgaggatatcgagcagatggccaacgggatcgcgttagggctcatggcgctgaagctaattacgcaattcgagacctatcagctgtggacggcactgataagcctgacctgctcgaacaccatcttcacgctgacggttgcctggcgaacagccaccttaatcctcgccggggtgagcctgctaccggtctgccaatccagctctatgcgaaagacagattggctccccatggcggttgccgcgatgggcgtgccgcctctcccgctgttcatcttcgggctcaaggatactctgaagcgccgcagttggcccctgaacgagggagtcatggctgtgggcctagtgtcaatcctcgcaagctccctgttacggaatgacgtccccatggcgggtccacttgtggcaggcggtttactaattgcctgctacgtgatcaccggcaccagcgccgatttaaccgtcgagaaggctgcggacattacgtgggaggaggaggcggagcagacaggggtgtcccacaacctgatgatcaccgttgacgacgacggcaccatgcgaatcaaggatgacgaaaccgagaacatcctcacggtccttctgaaaaccgccctcctgatcgtgagcgggatcttcccgtatagtatccccgcgaccctgctcgtgtggcatacctggcaaaaacagacccagcgaagcggggtcctgtgggatgtccccagcccacctgagacccagaaggccgagctcgaggagggcgtgtatcgcatcaaacaacaaggtatcttcggcaagacgcaggtcggggtcggggtgcaaaaagaaggcgttttccacaccatgtggcatgtgacgaggggggctgtgctcacctacaacgggaagcgcctggagcccaactgggcctccgtcaagaaggaccttatttcgtacgggggggggtggcggctaagtgcgcaatggcagaagggagaggaagtccaggtcatcgccgtcgagcccggcaagaaccccaagaactttcaaaccatgcccgggaccttccaaacgaccaccggcgagatcggtgcgatagccctggacttcaagcccgggacctcaggcagtcctatcatcaaccgcgagggaaaagtggtgggcctttacgggaacggcgtcgtaactaagaacgggggctacgtgtcgggcatcgctcagactaacgctgaaccggatggacctaccccagaactggaagaggagatgttcaaaaagcggaacctcaccataatggacctccatccaggttccgggaagacacgcaagtacttaccggcaatcgtccgggaggctatcaagcgccgcctccgcaccctgatacttgcccccacgcgggtggtggcggcagagatggaggaggcccttaagggcctgcccatccgctaccagaccacggcgaccaaaagcgagcacaccgggagggagatagtcgacttaatgtgtcatgctaccttcacgatgcgcctcctgtcaccggtacgggtgccgaattataacctgatcattatggatgaagcgcactttaccgacccggcctcaatcgccgcgcgcggctatatctccacacgggtcggcatgggggaggccgccgccatattcatgaccgcgacgccgccgggcaccgccgacgccttcccccagtctaacgcccccatccaggacaaggagcgcgacataccagaacgctcctggaatagcgggaacgagtggataaccgactttgccggcaagaccgtgtggttcgttccctccatcaaagcgggaaacgacatcgcgaattgcctccggaagaacggcaagaaggtcatccagttaagccgcaagacgttcgacaccgagtatcagaagacgaaattgaacgactgggacttcgtagtgaccactgacatctccgagatgggcgcgaatttcaaggccgaccgggtcatcgacccgcgcaggtgcctaaagcccgtgatcctgaccgacggccccgagcgcgtgattctggcaggcccgatgccggtcacggcggccagcgccgcccaacggcgcgggcgggttgggcgcaacccccaaaaggagaacgaccagtacatcttcaccggtcagcccctcaataacgacgaggaccacgcccactggactgaggccaagatgctgcttgacaacatcaacacgcccgagggcataatacccgccctctttgagcccgagcgagagaagagtgccgccatcgacggcgaataccgcctgaagggggaaagccgaaaaaccttcgtggagctgatgcgaagaggcgacctcccagtttggcttgcgcataaagtggcctccgaggggataaagtacactgacagaaagtggtgcttcgacggccagcggaacaaccagatattggaggagaacatggacgttgagatatggaccaaggagggcgagaaaaagaagctccgcccccggtggctggacgcccgcacgtactcggacccgctggccctcaaggagttcaaggaattcgccgcagggaggaagagtatcgccctggacctggtaacagaaattggtcgggtgcccagccacctcgcccatcgtactcggaacgctctggacaacctagtcatgctccatacctccgagcatgggggcagagcctataggcacgccgtggaggagttgcccgagacgatggagacactgctcctgctggggcttatgatcttgctgaccggtggtgccatgctgttcctgatcagtgggaagggcatcgggaagacctcgatcggcctaatctgcgtgatcgcttcctctgggatgctctggatggccgagatccccctgcagtggatcgcgtctgcgatcgttctggagttttttatgatggtattactgatccccgagccagagaagcagcgcacgcctcaggacaaccagctggcctacgtcgtgatcggtatactaaccttagccgcaatcattgccgcgaacgagatgggtctactcgagaccaccaagcgggacctggggatgagcaaggaaccgggcgtggtgtcccccacgagctacctggacgtcgacctccaccccgcctccgcctggaccttgtatgcggtggctacaaccgtgataacgcccatgctgcgccacaccatcgagaactcaaccgccaatgtatccctcgcggccatcgcaaaccaagcagtggtgctgatggggctggacaaggggtggcctattagcaagatggatctcggggtccctctgctggcactcggctgctactcccaagtcaatcccctgacgctgacggccgccgtgctcctgctgatcacccactatgccattatagggcccggcctacaagcgaaggccacacgggaggcacagaagaggaccgccgccggcatcatgaagaacccgacggtggacggtatcatgacaatcgatctggatcccgttatctacgacagcaagttcgaaaaacagctggggcaggttatgcttctggttttgtgcgcagtgcagctgcttcttatgcggacctcctgggcactctgcgaggccttaaccctggccacaggccccatcaccaccctctgggagggaagccccggcaagttttggaacaccacgatcgcggtgtccatggcgaatattttccgcgggagctacttggccggcgctgggctggcattttccatcatgaagtccgtcggcacgggaaagaggggtaccggcagccagggggagacactcggcgagaagtggaagaagaagctgaatcagctgtcacgcaaggacttcgacctctacaagaagtccggcataaccgaggtcgatcgtacggaggcgaaggagggccttaagcggggtgaaataacccaccacgccgtgtcccgggggtcggccaagttgcaatggtttgtggagcgtaatatggtaatcccggagggccgagttatcgatctcgggtgcggccgtggcggctggtcatattactgtgccggcttgaagaaggtgacggaggtgcgggggtacaccaagggcgggcctggtcacgaagagccagtccccatgagcacctacgggtggaacatcgtcaagttaatgtccgggaaggacgtgttctacctcccgcccgagaagtgtgacaccttgctgtgcgatatcggcgagtcctcccccagccccaccgttgaggagtcccgcaccatcagggtcctgaagatggtagaaccgtggctcaagaacaaccagttctgcatcaaggtcctgaacccctacatgcccacggtaatcgagcacctggagcggcttcaacgaaaacacggtggcatgttggtacggaaccctctgtcccgcaactccacccacgagatgtattggatcagcaacggcaccggaaacatcgtggcctctgtaaacatggtgagccggctcctgctgaatcgctttaccatgacgcatcgccggccaaccatcgagaaggacgtagacctaggagctgggaccaggcacgtcaacgccgaaccggagacccccaatatggatgtgataggcgagcgcatcaagaggatcaaagaggagcacaattccacgtggcattatgacgacgagaacccgtataaaacttgggcctaccacgggagctacgaggttaaagccaccggatccgctagctccatgatcaatggggtcgtgaagctgctgaccaagccttgggatgtcgtgcctatggtaacacagatggccatgaccgacaccacccccttcggccagcaacgtgtcttcaaggagaaggtggacacgcggaccccgcgcagtatgcccggaactcgccgcgtgatggggattaccgccgaatggctctggcggacgctcggccgaaacaagaagccccgcctgtgcacacgcgaggagttcaccaagaaggtccgcacaaacgccgccatgggggcagtgttcacggaggaaaaccagtgggacagcgccaaggccgccgtggaagacgaggatttctggaagttggtcgaccgggagcgtgagctccataagctgggcaagtgcgggagttgcgtgtacaacatgatgggtaagcgggaaaagaagctaggcgagttcgggaaggcaaagggcagccgagcgatctggtacatgtggctgggggcccggtatctggagttcgaagccctcggcttcctgaatgaagaccactggttctcccgcgagaactcttattccggggtagagggtgaaggcttgcacaaactcgggtacattctcagggacataagcaaaatccccggcggggctatgtatgccgacgacaccgcaggatgggacacgcgcattactgaggacgacctgcataatgaggagaagatcacgcagcagatggacccagagcaccggcagctcgcgaatgccatcttcaagctgacctaccaaaataaggttgtaaaagtgcaacgccccaccccaaccgggaccgtcatggacattatcagccggaaggaccaacgggggagcggccaggtgggcacgtacgggctgaataccttcaccaatatggaggcccaacttatccggcagatggagggggagggcgtgctgtctaaagcggatctagagaacccccacctcccggagaaaaaaatcacccagtggttagaaacgaagggcgtcgagcgcctgaagcggatggcaatcagcggggacgactgcgtggtgaagcccatcgacgatcgcttcgccaacgctctactagcactgaacgatatgggcaaggttagaaaggacattccacagtggcaaccctccaaagggtggcatgactggcagcaggtccctttctgtagccaccattttcacgagctcatcatgaaagacggccgcaagctggtcgtcccgtgccggccccaagatgagctaatagggagggccaggatatcccagggggcgggatggagcctcaaggagaccgcttgcctgggaaaggcctacgcacagatgtggtcactcatgtacttccaccggcgcgacctccggctggcgagtaatgccatctgctccgccgtgcccgtgcactgggtccctactagccgcaccacgtggtccattcacgcccaccaccagtggatgaccaccgaggatatgctgacggtgtggaaccgcgtgtggatcgaagacaatccctggatggaggacaagacgcccgtcacaacttgggagaacgtaccctacctcggtaagcgcgaagaccaatggtgcgggagcctaattggcctgacttctcgggccacttgggcgcagaacattcctaccgcgatccagcaagtacgctcccttatcgggaacgaggagttcctggactacatgccgtcaatgaagcggttccgtaaagaggaggagagcgagggcgccatctggtga

SEQ ID NO: 25800 - RNA, 9873 nt, synthetic construct
  misc_feature 1..9873: note = derived and/or modified CDS sequence (opt11) from DENV-3__FJ873812__SS-prME
  source 1..9873: mol_type = other RNA
actagcctgtgcctcatgatgattctgcccgcagcactggctttccacctcacgtcccgggacggggagccccggatgatcgtgggaaaaaacgagcgaggcaagtcactgctgttcaagacagccagtgggatcaacatgtgcactcttatcgccatggacctgggcgagatgtgcgacgataccgtgacctacaagtgccctcacattacggaggtggagcctgaggacatcgattgctggtgcaacctgacaagcacgtgggtgacctacgggacatgcaatcaggccggtgagcaccggagggacaaacgatccgtggctctggccccccacgtgggaatgggattagacacacgtactcaaacctggatgagtgcggaaggggcctggcgacaggtggagaaggtggaaacttgggccctgcgccatccaggattcaccatcctagcgctgttcttagcccattacataggcacgtccttgacccagaaggtcgtcattttcatccttctgatgctcgtcaccccgagcatgactatgcggtgcgtgggggtgggtaacagggacttcgtagagggcctaagcggagcgacctgggtggacgtagttttggagcatggcggatgcgttacgacgatggccaagaacaagccaaccctcgacatcgagctacagaagaccgaggccactcagcttgcaacactcaggaagttgtgcatcgaggggaagatcaccaacatcacaactgactcacgctgccccacgcagggcgaagccactctacctgaggagcaggatcaaaattacgtgtgcaaacacacatatgtcgaccggggatggggcaatgggtgtggtttgttcgggaaaggctccctagtgacctgcgcgaagttccagtgcctggagcccatagaaggtaaggtggtccaatacgagaatctcaagtatacggtgatcatcaccgtgcacacgggcgaccagcaccaggtcggcaatgaaacccagggggtaaccgccgagataacgccacaggcgtcaaccaccgaggcgatcctgcccgaatatggcacactggggttagagtgctccccgcgtacgggactggacttcaacgagatgatcctactcaccatgaagaacaaagcgtggatggtccaccggcagtggttcttcgatttacctttaccctggacgagtggcgctaccacggagacccccacttggaaccgcaaggagttgctagtcaccttcaaaaacgcgcacgccaaaaaacaggaggttgtcgtgttagggtcccaggagggtgcgatgcacacggccctcaccggcgccactgagatccagaatagcggcgggacctccatttttgcgggccatcttaagtgtcgactaaagatggacaagctcgagttgaagggcatgagctatgcaatgtgcactaacacattcgtgctaaagaaggaggtctccgaaacccagcatgggaccatcttaatcaaggtggagtacaaaggcgaggacgttccatgcaagatccctttcagcacggaagacggacagggcaaggcgcacaacggtcgcctgatcaccgccaacccagttgtgaccaagaaggaagagcccgtaaacatcgaggccgagccacccttcggggagagcaacattgtcatcggcattggggacaatgccctgaagatcaattggtataaaaaaggctcctcaatcgggaagatgttcgaggctactgcccggggcgcgcgcagaatggcgatccttggcgacacggcctgggattttggttcagtggggggtgttctgaacagcctgggcaagatggtacatcagatcttcggatccgcgtacaccgcattgttcagcggagtgtcttgggtgatgaagatcggaatcggtgtgctcctcacctggataggtttaaacagcaagaacacatcgatgtctttcagttgcatcgccatcggcatcatcacgttatacttgggggccgtggtgcaggccgacatggggtgcgtaatcaactggaagggcaaagaactgaagtgcgggagcgggatcttcgtgacgaacgaggtgcacacatggaccgaacagtataaattccaggcagactccccgaagcgcctcgccacggccatagcgggcgcctgggagaacggagtatgcggtatccgcagcacgacacggatggaaaacctgctttggaagcagatctccaacgagctcaactatatactgtgggagaacaacatcaagctgacagttgtcgtcggggacatcatcggcgtgctggagcaggggaagcgaacattaacgccccagccgatggagctgaagtacagctggaagacctgggggaaagccaaaatcgtgacggcagagacccagaattcctcgttcatcatcgacggtccaaacactcccgaatgcccatcagtcagccgggcatggaatgtttgggaagtggaggattacgggttcggagttttcaccaccaacatctggctcaaactgcgtgaagtgtacactcagctgtgcgatcaccggctcatgtcggccgcggttaaggatgagagagccgtccacgccgatatggggtactggatcgagtctcagaaaaatgggagttggaaactcgagaaggcctcactaatagaggtgaagacctgtacctggcccaaaagccacaccttgtggtccaacggtgtgctggagtctgacatgatcatcccaaaatccctggctgggccgattagccagcacaatcaccggccggggtaccacacccagactgcgggcccctggcacttaggcaagctggagctggattttaactactgcgaggggaccacggtcgtaatcacagagaactgcggcacgcgcggaccctcccttcggactacaacagtctcggggaagctgatccatgagtggtgttgtcggtcctgcaccctacccccgctccggtacatgggcgaagatgggtgctggtacggcatggagatcagaccgatcagtgaaaaggaagagaacatggtcaagtcccttgtgtccgcaggctccgggaaggtggacaacttcacgatgggtgtcctctgcctcgccatattgttcgaagaggtgatgagagggaagttcggcaagaagcacatgatcgccggggtgtttctgaccttcgtactcttgctgagcggacagatcacgtggcgtgatatggcccacaccctcatcatgatcggcagcaacgcgagcgatcggatgggcatgggcgttacctacctggccttaatagccacgttcaagatccagccatttctcgcattggggttcttcttacgcaaactcacctcgcgggagaatctgctccttggagttggcctggctatggcgacaactctgcagctgcccgaggacatcgagcaaatggccaacggaatcgcgctcgggctgatggccctcaagctcatcacacaattcgagacctaccaactgtggaccgcgttaatctccctaacctgctctaacacaatcttcaccctgacggtcgcctggcgcacagccacgcttatcctcgccggggtatccctgctcccagtatgtcagagcagcagcatgcgaaagactgattggttgcctatggcggtcgcagcgatgggcgtccccccgctgccactgttcatcttctccttgaaggacactctaaagcggcgtagttggcctttaaacgagggggttatggccgtgggcctggtctccatcctcgcatcatccctgcttcggaatgatgtgcccatggccggccccttggttgccggagggctcctaatcgcctgttacgtgattacggggacctccgctgaccttaccgtcgagaaggccgcagacatcacttgggaggaggaggccgagcagacgggggtctcccataatctcatgatcacagtagatgacgatgggaccatgcgcattaaggatgacgagaccgagaatatcctgacggtcctgctcaagaccgccttactgattgtgtcagggatttttccctacagtatcccggctacacttctcgtgtggcatacttggcagaagcagacgcagcggtctggcgtcctgtgggatgtgccgtccccgcctgaaacccagaaggccgagctcgaggagggggtctatcgcatcaagcagcagggaatcttcggtaagacccaggtaggagtaggggtccaaaaggagggcgttttccacaccatgtggcacgtgacccggggcgccgtgttaacctacaatggaaaacgactggaacctaactgggccagtgtcaagaaggacctcatttcatacggcggcggctggcggctgtccgcccaatggcagaagggggaagaagtccaggtgatcgccgtagagcctggcaagaaccccaagaactttcaaaccatgccgggcaccttccagacaacaaccggggaaataggggccatcgcgctcgatttcaagccagggacgagcgggtcccccatcataaaccgcgaggggaaagtcgtgggcctatacgggaacggggtcgtgacgaagaacggcgggtatgtgagcggcatcgcacaaactaacgccgagcctgatggaccaacccctgagcttgaagaggagatgtttaagaagagaaacttaacaatcatggacctgcaccccggttcgggcaaaactcgcaagtacctaccggccatagtcagggaggccatcaagcgcaggctgcgcacattaatcctcgcgcccaccagggtggtggcggccgagatggaggaagctttaaaggggcttccaatccgctatcagaccacggccaccaagagcgagcacaccggtcgggagatcgtcgatctcatgtgccacgccacctttacaatgcgcctgctaagtcccgtgcgggtgccaaactacaacctcatcatcatggacgaagctcacttcactgaccctgcctccatcgccgcacgggggtatatctccacccgggtaggcatgggcgaggcggcagcgatctttatgactgccacgccgccaggtaccgccgacgcgttcccacaaagcaacgcacccatccaggacgaggagcgcgacataccagagcgttcatggaacagcggcaatgagtggatcacggacttcgctgggaagaccgtgtggttcgtgccctcgattaaagctggcaacgacattgcgaattgcctccggaagaatggcaagaaagtcatccagctgagcaggaagacgtttgacaccgagtaccagaaaacgaagttgaacgactgggacttcgtggtgaccacagacatatccgagatgggggccaactttaaagctgaccgggtaatcgacccgcgccggtgtttaaaacccgtgatactgaccgatggccctgaacgcgtgatcttggccgggccgatgccggtcaccgccgcgagcgccgcccagcggcgaggccgggtgggccgcaacccccagaaggagaacgaccagtacatcttcaccggtcagcctctgaacaacgacgaggaccatgcccactggaccgaggccaagatgctgctggacaatattaacacccccgaaggtatcattccggcgcttttcgagcccgagcgtgaaaaatccgcagccatcgatggcgaatacaggctaaagggcgagtcccggaagaccttcgtagaactcatgcgccgcggtgacctccccgtctggctggcccacaaggttgcttccgaaggtatcaagtacacggacaggaagtggtgtttcgatgggcagcgtaacaatcagatcctcgaggaaaatatggacgtagaaatctggaccaaggagggcgagaagaagaagctgcgtccccggtggctagatgcccgcacatactcggacccactcgccctgaaggagtttaaagaattcgcagccggccgcaagtccatcgcgctggacctcgtaacagagatcggccgggtgccctctcacttggcccaccggactaggaatgccctggacaatctcgtaatgctgcacaccagcgaacatggcggacgcgcctacagacatgccgtcgaggagctccccgagacgatggagacgctcctcctgctcggtctcatgatactgttgacaggaggcgccatgctgttcttaatttcaggaaaagggatcggcaagaccagcatagggctcatctgtgtgatcgcttcgagtggtatgctttggatggccgaaatcccgctacagtggattgcctcggccattgtactggagttttttatgatggtgctgttaattcctgagcccgagaagcaacgcacgccccaggacaaccagctcgcgtacgtggtcatcgggattctgaccctggccgccatcatcgcagccaacgaaatgggtttactcgagaccactaaacgggacctgggaatgtccaaggagccgggagtagtatcgcccacgagctacctcgacgtcgacctgcaccccgcatccgcatggaccctgtacgcggtggccaccaccgtgataacgccaatgttgcgccacaccatcgagaatagcaccgcgaacgtatctcttgcagccatcgctaaccaggccgtggtgctgatggggctcgacaagggttggccgatctctaagatggacctgggcgtcccactcctcgctttagggtgctactcccaagtgaatcccctaacactaacggcagcggttctgctgctcattacgcactatgcaataataggacccggactgcaggccaaagcgacccgggaggcacagaaacgcaccgccgctggtataatgaagaatccaacggtcgacggcatcatgaccatagatctggacccagtaatatacgacagcaaattcgagaagcagttaggtcaggtgatgcttcttgtcctatgcgccgtgcagctgctgctcatgcggacctcttgggcgctgtgcgaagccctcaccttagcaaccggccccatcacgacgctgtgggagggcagtcccgggaagttctggaataccacgatagccgtgtccatggcgaacatcttccgtggtagctacctggccggcgccggcctcgccttctccattatgaagagcgtggggaccggcaagcgcggtaccgggagccaaggggaaaccctaggagagaagtggaagaaaaagctaaaccaactcagccgcaaggacttcgatctgtacaagaagtccggcatcaccgaggtggacagaacggaagccaaggaagggctgaaacgcggcgagataacccatcacgcggtatcacggggatcagctaagctccagtggttcgttgagcgcaacatggttatcccggaagggcgggtgatcgacctcggctgtgggcgaggcggatggtcctattactgcgccggcttgaaaaaggtcaccgaggtgaggggctacaccaagggggggcccgggcacgaggaacctgtgcccatgagcacctatggatggaacatcgtaaagctcatgtccggtaaggacgtgttctacctccctcccgaaaagtgcgatactctgctgtgcgacataggagagagctccccctcgcccactgtggaggagtcacgtaccatccgagtactcaagatggtggagccatggcttaaaaacaatcagttctgtatcaaggtcttgaacccctacatgccaaccgtcatcgagcacctcgaacggctgcaacgaaagcacggcgggatgctggtaagaaatcctctctccagaaattcgacccatgagatgtattggatcagcaacggcaccgggaacatcgtggcctcagttaacatggtgagccggttactgctcaatcgcttcaccatgacccatcggcgccctactatcgaaaaggacgtggacctgggcgcgggcacgcggcacgtcaacgcggaacccgagaccccgaatatggacgtaataggcgagcgtatcaagcggataaaggaggagcacaactccacgtggcactacgacgatgagaatccgtataagacctgggcctaccacggtagctacgaggtgaaggccaccgggtccgcttcgtctatgattaacggggtcgtgaagctgctcacgaagccctgggacgtcgtgcccatggtgactcaaatggccatgaccgacactacccctttcgggcagcagcgcgtattcaaggagaaggtggacacgcgaaccccaagatccatgccgggaacccgacgcgtgatgggcatcaccgcggagtggttatggcggaccctgggacgtaataagaagccgcggctctgcacgcgcgaggagtttacgaagaaggtcagaacaaacgctgctatgggcgccgtgtttacggaagagaatcagtgggacagcgccaaagccgccgtggaagacgaggatttctggaaattggtcgaccgcgaacgagagctgcacaagttagggaagtgcggctcatgcgtgtacaacatgatggggaaacgtgagaaaaagctgggtgagttcggcaaagcgaaagggagccgggccatatggtacatgtggctgggggcgaggtaccttgagttcgaggcactagggttcctcaacgaggatcactggttctcacgcgaaaacagctacagtggtgtggagggtgagggcctccacaagttaggctatatccttcgagacatctcaaagatccccggaggcgccatgtatgccgatgacactgcggggtgggacacccgcatcaccgaagatgatctccataacgaggagaagatcacgcagcagatggacccggagcaccggcaattagcgaacgcgatcttcaaacttacctaccagaacaaagtcgtgaaagtacaacgccccacaccaaccggtaccgtcatggacatcataagccgaaaggatcagcgcggctcaggccaggtaggcacgtacggccttaacacgtttaccaatatggaagcccaacttattcggcagatggagggtgagggggtgctctccaaagccgaccttgagaacccccacttgccagagaagaagataacccagtggctcgagacgaagggcgtcgagcgcctaaagcggatggctatcagcggggatgactgcgtggtgaaacctatcgacgataggttcgcgaacgccctgctggccctcaacgacatgggtaaggtgaggaaggatattcctcagtggcagccctcgaagggctggcatgactggcaacaagtcccgttctgctctcatcacttccacgagttgatcatgaaggacgggcgcaagctggtggtcccatgccggccccaggatgagctaatcggacgtgctcggatctcgcagggggctggctggagtctgaaggagaccgcctgcctgggcaaggcctacgcccaaatgtggtctctcatgtatttccatcgcagagacctcaggctggccagcaacgccatctgctccgcagtgcccgtgcattgggtaccgactagccgcaccacgtggagcattcacgcccaccaccaatggatgaccaccgaagacatgctcacagtctggaaccgtgtgtggattgaggacaatccctggatggaggacaaaacgcccgtgaccacctgggaaaacgtgccctacctggggaagcgtgaagaccagtggtgtggatctttaatcggtctcactagcagagccacatgggcccagaacataccgacagcaatccaacaggtccgctcgctaatcggcaacgaagaattcctggactacatgccgagcatgaagcggttccgaaaggaggaggagtcagagggtgcgatctggtag

SEQ ID NO: 25801 - RNA, 9873 nt, synthetic construct
  misc_feature 1..9873: note = derived and/or modified CDS sequence (opt11) from DENV-3__FJ873813__SS-prME
  source 1..9873: mol_type = other RNA
acctccctgtgcctgatgatgatcctcccagcggccctggcttttcacctaacaagccgggatggcgaaccccgaatgattgtgggaaagaacgagcgaggcaaaagcctgctgttcaaaactgcctcaggtattaacatgtgtaccctaatcgcaatggacctaggcgaaatgtgcgacgatactgtcacatacaagtgtccccacataaccgaagtagaaccagaggatatcgactgctggtgcaacctcacctcgacatgggtaacgtacggcacatgcaaccaggccggcgaacaccgtcgagacaagagatcggtcgcgctagcaccccacgtgggcatggggttagacacaaggactcaaacatggatgagtgcggaaggcgcctggcgtcaggtggagaaagtagaaacatgggccctccggcacccagggtttaccatcttagcactattcctagcacactatattgggacctccttaacgcaaaaggtcgtaatattcatacttctaatgctggtcaccccctccatgaccatgcgctgcgttggagtcggaaaccgggactttgttgaaggcctatcgggagccacatgggtagacgtcgtactcgagcacggaggctgcgtgacgacaatggcgaaaaataaaccgactctggacatagaacttcaaaaaaccgaagcgacgcagctcgccactttgcgcaagctatgcatagaagggaagatcacgaacataactacggattcgcggtgtccaacacaaggggaagcgaccctacccgaagagcaggaccagaattacgtctgcaaacacacctacgtggaccgaggatggggaaacggatgcggacttttcggcaaaggatccctcgtaacgtgcgccaaattccaatgccttgagcctatagaagggaaagtagtgcaacacgagaacctgaagtacaccgtgataataacggtccacacaggagatcaacatcaagttggcaacgagacacagggtgtaacggccgaaattacgccgcaggcatctacaacagaggcaatactgccagagtacggcacactaggtctggagtgcagcccgcgtacagggctcgactttaacgaaatgatcctgctcacgatgaagaacaaagcgtggatggttcaccgacagtggttcttcgatttaccgctaccttggaccagcggagcgacaacagaaacaccgacatggaaccggaaagaactccttgtaaccttcaaaaatgcccacgcaaaaaaacaagaggtggtcgtactgggatcccaagagggcgcgatgcatactgcactaaccggtgcgacagaaattcagaactcgggaggaacctcaatcttcgcgggacacctgaagtgccgacttaaaatggacaagctagagcttaagggcatgtcatatgcaatgtgcaccaacacattcgtgctaaagaaagaagtctctgaaacacagcatggaacgatcttgataaaggtagagtacaagggggaggacgtcccatgtaaaataccattcagcacagaagatggtcaaggcaaagctcacaacggcagactgatcactgccaaccccgtggtgactaaaaaagaagaacccgtcaatatagaagcggaaccacccttcggagagtctaacatcgtcatcgggatcggggacaacgccctcaaaataaactggtacaagaaaggcagcagtatcgggaaaatgtttgaggccaccgcccgcggcgcacgtcggatggcaatactgggcgacacagcatgggacttcggaagcgtgggaggagtcctgaactccctaggtaagatggttcaccagatcttcgggagcgcttacaccgcactattttcaggtgtaagctgggtcatgaaaatagggataggagtactccttacctggatagggctgaacagtaagaacacttccatgagtttcagttgcatcgccatcggaatcatcacactctacctcggagcagtcgtccaagcggacatgggatgtgtaattaactggaaagggaaagagctcaaatgcggctccggaatttttgtcactaacgaagtccacacatggaccgagcaatataaattccaggccgacagcccaaagcgacttgccacagcgatagccggagcctgggaaaacggagtgtgcggaatacgcagtaccacacgaatggaaaacctactgtggaaacaaattgcaaacgaactaaactacatactatgggaaaataacatcaaacttacagtcgtagtaggagacataataggggtgctcgaacaagggaaacgtaccttaacgccgcagccaatggaacttaaatactcctggaagacctggggaaaagccaaaatcgtaaccgcagaaacccaaaacagtagctttataattgatggacccaacacacccgaatgcccctctgttagcagagcgtggaacgtgtgggaagtagaggattacgggttcggcgtcttcacaacgaatatctggctaaagctccgggaagtctacactcaattatgcgaccaccggctgatgtccgccgctgtgaaagacgaacgagcagttcacgcggacatgggctactggatcgaatcgcaaaagaacggcagctggaaactcgaaaaagcgagcttaatcgaagtaaaaacatgcacgtggccaaagtcacacaccctctggagtaacggtgtacttgaatcagacatgatcatcccaaagagtttagcgggacccatctcgcaacacaaccaccgcccgggctaccacacacagactgctggtccctggcatctggggaagctcgagctggacttcaactattgcgaaggtacaacggtcgtcataaccgaaaactgcggaacaaggggcccaagtctcagaaccacaaccgtgagcggaaaactaatacatgaatggtgctgtcgaagttgcacgctccctcccctgcgctatatgggcgaagacgggtgctggtacggaatggagatccgacccataagcgagaaagaggaaaatatggttaaaagtctcgtcagcgcaggatccggaaaggtcgacaatttcactatgggcgtgctatgcctcgccatactgttcgaagaggtaatgcgggggaaattcggcaagaagcatatgatagctggggttttttttacttttgtactgctgctatctgggcagattacatggcgcgacatggctcacacactgataatgatagggagcaacgcaagtgatcgaatgggtatgggggtaacctatctcgccttaattgcaacgtttaaaattcaaccgttcctggctcttggattcttcctacgaaagctcacgtcacgcgagaacctactcctgggcgtaggcctagcaatggcgacgacgctccaactccccgaggacatagagcaaatggccaacggaattgctcttggactaatggccctcaagttaattacccaatttgagacgtaccagctttggaccgccttgatctcattgacttgctccaatacaatattcactctgacagtagcctggcgtactgcgacactcattctagcaggagtcagtctgttaccagtctgccaatcaagttccatgcgaaagacggattggctccccatggccgtagcagctatgggagtaccaccactcccgctttttatcttcagcctaaaagacaccctcaagagacgatcatggccattaaatgagggagtaatggcagttgggctggtgagcattctagcaagcagcctgctgcggaacgacgtacccatggctggaccgctggtcgccggggggctactcatagcgtgctacgtcataacaggaacgtcagcggatctaaccgtcgagaaagcagcggacataacatgggaagaagaggcggaacaaaccggtgtaagccacaacctaatgatcactgtggatgacgacggcactatgaggatcaaagatgacgagaccgaaaacatactgactgtgcttctaaaaaccgcactactaatcgtcagcgggatcttcccatacagtatcccggccacacttctagtttggcacacctggcagaaacagacacagcggtccggagtcctctgggatgttcctagcccgccggagacgcagaaagcggaacttgaggagggagtgtaccgcattaagcagcaggggatcttcggaaaaacacaagtgggcgtaggggtacaaaaagagggcgtctttcataccatgtggcacgttaccagaggagccgtactaacttataacggtaaacgtctagaacccaactgggccagcgtcaaaaaggacctcatatcgtacggcggagggtggagactttcagctcaatggcaaaagggggaggaagtccaggtaatagcagtcgagccgggcaagaatcctaagaacttccaaacgatgcctggcacatttcagaccacaacaggcgaaattggcgctatagcgctggatttcaaaccgggaaccagcgggagtccaatcatcaaccgggaggggaaagtcgtgggcttgtacggtaacggagtggtaaccaaaaacggcggatacgtcagcggcatagcacaaaccaacgcagaaccagacgggccgaccccggaactagaagaggaaatgttcaaaaagagaaatctcactataatggacctccacccgggatcaggaaaaacccgtaagtacttaccagccatagtacgcgaggcgatcaagcgtagactacgtacactaattctcgcgcccacaagggtcgtggcagccgaaatggaagaggcgctgaaaggcctccccatccgataccaaaccacagccaccaagtctgaacacacaggccgagaaatagtagaccttatgtgtcatgcgacctttacgatgcgcctactaagcccagtccgggttcccaactataacctaataatcatggacgaggcccacttcacagatccggcaagtatcgctgcacgcgggtatataagcaccagagttggcatgggtgaggcggcggcgatatttatgacagcaaccccaccaggtaccgcagatgcgtttccccaaagcaacgccccgatacaggacgaggaacgtgacatccccgaacgcagctggaacagcggcaacgagtggataactgacttcgcgggaaagaccgtctggttcgtgccaagcataaaggctgggaatgacatagccaattgtctaaggaagaacgggaagaaggtcatacagctgtcacgaaagaccttcgacaccgaataccaaaagactaagctaaacgactgggacttcgtggtaactacagatatatcagagatgggggccaacttcaaagcggaccgcgtcatagacccacgccgatgcctgaaaccagtaatcctcacagatggacccgagcgagtaatactagcaggcccaatgccagtcacagcagcgtccgcggcgcaacggcgcgggcgcgtgggccgaaacccacaaaaagaaaacgatcaatatatattcaccggtcaaccactaaataatgacgaagatcacgcccactggaccgaagcaaagatgctcctagacaacataaacacccctgaaggcatcatcccagccctattcgaacctgaacgagagaaaagcgctgccatagacggggagtatcgtttaaaaggtgaaagtcgcaagaccttcgtcgaactaatgcgacggggagatctccccgtgtggctcgcacacaaagttgcatccgaagggatcaaatatacagaccgcaaatggtgctttgatgggcaaagaaataatcaaatcttagaggaaaacatggacgtagagatatggacaaaagagggagaaaagaagaagcttcgaccgcgctggcttgatgcgagaacatacagcgaccccttagctctcaaagagttcaaggagttcgcagccggcagaaagtcaatcgcactagacctagtaaccgagataggacgagtaccgagccacctcgcgcatcgcacgcgtaacgcattagataacctcgtaatgcttcacacatcggagcatggcggccgagcgtaccggcacgcggtggaagaacttccggaaacaatggaaacactgctgctcctgggactgatgattttgctcacaggaggcgctatgctcttcctgatctccggaaaggggataggaaagacctcaataggactaatttgtgtgatagcctcatctggcatgctatggatggcagaaatccccctacaatggatagccagcgcgattgtattagaattctttatgatggtactgctgataccagaacccgaaaagcagcgaacaccgcaagacaatcagctcgcctatgtagtcatcgggattctaaccttagccgcaataattgcagccaatgaaatgggactcctagagacgacaaaacgagacctaggaatgagcaaggagccgggagttgtctcaccgaccagctacttagacgtcgatctccacccagccagtgcatggactctatacgcagtcgcaaccacagtaataacgccaatgctcaggcacactatagagaacagcaccgcaaatgtcagcctcgccgctatagccaatcaggcagtggtcctaatgggcctagacaaagggtggcccatctcaaagatggatctcggagtccccctcctcgcacttggctgctattcccaagtgaatccactaacactgacagccgcagtcctcttactaatcacccactacgcaattataggacctggactccaagccaaagcgacgagagaggcgcaaaagcggacagcagcaggtataatgaaaaaccccacggtcgacggcataatgacaatagacctggatccagtaatatacgattccaagtttgagaagcaactggggcaagtgatgctattagtactttgcgcggtgcaattactgctgatgcgcacgagctgggcactctgcgaagcccttacactggccaccggtcccataacaacgttatgggaagggtcgcctgggaaattctggaatacgacgatagccgtatcgatggccaacatattccgcggaagctacctcgcaggcgcgggcctggccttctccataatgaagtcagtgggaaccggcaaacgcggaaccggaagccaaggagaaacactcggggaaaaatggaagaaaaaactgaaccagctcagccggaaggacttcgatctgtacaaaaagagcggcatcacagaagtagatagaaccgaggctaaggaagggctcaagaggggagaaataactcaccacgccgtcagccgcggttccgccaaattgcaatggttcgtcgaacggaacatggtgatacccgagggacgtgtaatagacctggggtgcggccgaggaggctggtcatactactgcgcgggtttaaagaaagtcaccgaagtacgtggatataccaagggtggaccgggacacgaggagccggttccgatgagcacgtacggatggaacatcgtaaagctgatgtcaggaaaagacgtattctacctccccccagagaaatgcgatacattactatgcgatatcggagaatcttccccctcgccaactgtagaggagtcaaggaccattcgtgtcctaaagatggtggagccatggcttaaaaacaaccaattttgcattaaagtattaaacccatacatgccgacggtaatcgagcacctagaacgactacaacgaaaacacggcggaatgctcgtgcgatacccactatcgaggaattcaacacacgagatgtactggatcagtaacggtacagggaacatagttgcaagcgtgaacatggtttcacgactgctcctcaaccggttcacaatgacacaccggagacccaccatagagaaagacgtcgacttaggagcgggcacgaggcacgtaaacgccgaaccggaaaccccaaatatggacgtgataggggaacggataaaacgaatcaaggaagagcacaactcaacatggcattatgacgacgaaaacccctacaaaacatgggcgtaccacggcagctacgaggtcaaggcgacgggctcagcctcgtctatgatcaatggcgtcgtaaagttacttacaaaaccatgggacgtagtgccgatggtaactcagatggcaatgacagacacgactcctttcgggcaacaacgcgtattcaaggaaaaggtcgatacacgaacacccagatccatgccagggacgcggagggtgatgggcatcacagccgaatggctctggcggaccctgggccgtaacaagaagccgaggctctgtacacgggaggaattcacgaaaaaagtaagaaccaatgctgcgatgggggccgtattcacggaagagaaccagtgggatagcgctaaggcggccgtcgaagacgaagacttctggaagttagtcgacagggagcgcgagctacataaactagggaaatgcggaagctgcgtctacaacatgatgggaaagcgagagaagaagctcggagagttcggaaaagcaaagggatccagagccatatggtacatgtggctgggggcaaggtatctcgagttcgaggccctaggtttcctaaacgaggaccactggttctcccgcgagaactcatactctggagtagagggcgagggtctacacaaactgggatacatcctacgggacatatccaagatacctggcggggcaatgtacgctgatgacacagctgggtgggacacaaggatcacagaggacgatcttcacaacgaggagaaaataactcaacaaatggaccccgagcatcggcagttagccaatgcaatattcaagctcacgtaccaaaacaaggtggtaaaagtccagcggcctacccccacagggacggtaatggacattatctcacgcaaagaccaacgcggctccggacaagtagggacttatgggctgaatacgtttacaaatatggaagcacaacttatacgccagatggaaggcgagggcgtcctatccaaagccgacttagagaacccgcacctaccggaaaagaagattacacagtggcttgaaacaaaaggagtcgaaagactaaaacgaatggcaatatcgggggacgattgcgtagttaagcctatagacgaccggttcgctaacgccctcctggcattgaacgacatggggaaagtgcggaaagacataccacaatggcaaccatctaaagggtggcacgactggcagcaggtgcccttctgcagccaccacttccacgagctaatcatgaaggacggtcgcaaactcgtcgtaccatgtcgcccccaggacgagctcataggacgagcgcgcatttcacaaggggcgggttggagcctgaaggagacagcatgcctcggaaaggcatacgcacaaatgtggtcactcatgtacttccacagaagggatctacgattagcgtcaaacgcaatctgctcggcagttcccgttcattgggtgccgacctcacgcacaacatggtcgatacacgcacatcaccaatggatgaccactgaggatatgctcacggtatggaacagggtgtggatagaagacaacccgtggatggaagacaagacccccgtcacgacgtgggagaatgtaccatacttaggcaaacgagaggatcaatggtgcgggtcactcataggcctgacctcacgagctacgtgggcacaaaacattcctaccgcaatccaacaagtccggtcgctaatcgggaacgaggaatttttagactacatgccttccatgaagcgattcaggaaagaagaggagagcgaaggcgcaatatggtga

SEQ ID NO: 25802 - RNA, 9873 nt, synthetic construct
  misc_feature 1..9873: note = derived and/or modified CDS sequence (opt11) from DENV-3__FJ850048__SS-prME
  source 1..9873: mol_type = other RNA
accagcctctgcctcatgatgatcctgcccgccgcgctggccttccatttaaccagccgagacggggagccccggatgatcgttgggaagaacgagcgaggcaagtcgctgctgttcaagactgcatccgggatcaacatgtgcactctcatcgcgatggacctcggggagatgtgcgacgacaccgttacctataagtgcccccacatcaccgaagtggagcccgaggacatcgactgctggtgcaacctgaccagcacctgggtaacgtatggaacgtgcaaccaggccggcgagcaccggcgcgacaagcggtccgtggccctcgcgccacacgtggggatgggactggacacccgcacccagacctggatgagcgcggagggcgcctggcgccaggtggagaaggtggagacttgggccctgcggcacccgggattcaccattctcgcgttattcttggcacattacatcggcacctcgctcacccagaaggtagtgatcttcatcctgctgatgctcgtaacgcctagtatgacaatgcggtgcgtaggggtgggaaaccgcgacttcgtcgaaggcctgtccggcgccacctgggtggacgtggtcctggagcacggcgggtgcgtgaccacgatggccaagaacaagcccaccctcgacatcgaactgcagaagaccgaggccacccagcttgcgacgctccggaagctgtgcatcgagggcaagatcaccaacattaccaccgacagcagatgccccactcaaggcgaggccaccctgccggaggagcaggatcagaactacgtatgcaagcacacctacgtcgacagagggtggggcaacgggtgtggcctctttgggaagggctccctggtaacgtgcgccaagttccagtgcctggagcccatcgagggcaaggtggtccagtacgagaacctcaagtacacggtgatcattaccgtgcataccggagatcagcaccaagtcggcaacgagacccagggggtgacggctgagatcacgcctcaggcgagcaccacggaagcgattctgcccgagtacggcactctggggctcgagtgctccccgcgaacgggtctggacttcaatgagatgatcttactaaccatgaagaataaggcctggatggtccaccggcagtggttcttcgacctgcccctgccctggacgagcggcgcaaccacggagaccccgacctggaatcgtaaggagctcttagtgaccttcaagaacgcccacgccaagaagcaggaggtggtagtattggggtcccaggaaggcgcgatgcacacggcccttaccggggccaccgagatccagaactcaggcgggacgtccattttcgcaggccacctgaaatgccgtctgaagatggacaaacttgagctgaagggcatgagctacgccatgtgcacgaacacttttgtgctgaaaaaggaggtctccgagacacagcacgggaccatcctcataaaggtcgagtataagggcgaggatgtgccatgcaagatccccttcagcacggaagacgggcagggcaaggcgcacaacggacgcctgatcaccgccaacccagtcgtgaccaagaaggaggagcccgtgaacatcgaggccgagccgcccttcggggagagcaatatcgtcattggtatcggcgacaatgccctgaagatcaactggtacaagaagggctcctcaattgggaagatgttcgaggcgaccgcgcggggcgctcgacggatggccatcctgggcgacacggcctgggacttcgggtccgtgggcggggtcctcaacagcctgggcaagatggtccatcagattttcgggtccgcgtacaccgcactgtttagcggcgtgtcctgggtgatgaagatcggcatcggggtgctcctaacatggatcggcctgaacagtaagaacacctccatgagcttctcgtgtatcgccataggtataatcacgctctaccttggcgccgtggtacaagccgacatggggtgcgtcattaactggaagggcaaggaactgaagtgcggcagcggcatcttcgtgaccaacgaagtgcacacctggaccgagcagtacaagttccaagcggactcccccaagcgcctcgccacggctatcgccggcgcttgggagaatggggtctgtggcatccgaagcaccacccggatggagaacctgctgtggaagcagatcgctaacgagctcaactacatcttgtgggagaacaacatcaagctcaccgtggttgttggggacattatcggcgtgctcgagcagggcaaacggacgctgacgccccagccgatggagctgaaatactcatggaagacctgggggaaggctaaaatcgtcaccgccgagacgcagaacagctccttcataatcgacggccccaacacgcccgagtgccccagcgtctcccgagcatggaacgtgtgggaggtggaggactacgggtttggcgtcttcacgactaacatctggctcaagctgcgcgaggtgtacacccagttatgcgaccaccgtttgatgagcgcggccgtgaaggatgagcgcgccgtccacgccgacatgggctactggatcgagagccagaagaacggatcctggaagctggagaaggccagcttgattgaagtgaagacgtgcacatggccgaagtcgcacaccctctggagcaacggcgtgctggagtccgacatgatcatccctaagagcttggcggggccgatctcccagcataaccaccggccgggctatcacacccagacggccggcccctggcatctcggcaagctagagttagacttcaactattgcgaaggcacaaccgtcgtgatcaccgagaactgtgggacgcgcggccccagcctccggaccacaaccgtgtccgggaaactgatccacgagtggtgttgtcgcagctgcacgctacccccgctccgttacatgggcgaggacggttgctggtacggcatggaaatccgccccatctccgagaaggaggaaaacatggtaaagagcctggtgtccgccggcagcgggaaggtcgacaacttcaccatgggcgtcctctgcctcgccatcctttttgaggaggtcatgcgggggaagtttggcaagaagcacatgatcgccggggtgttcttcactttcgtcctgctcctgagcggccagataacctggcgcgacatggcgcacacactgatcatgatcggcagcaatgcttccgataggatggggatgggcgttacgtacttggccctgattgccaccttcaagatccaacctttcctggccctcgggtttttcctgcgcaagctgaccagtagggagaacctactgctgggcgtgggcttggctatggccacaacactgcagctgccagaggacatcgagcagatggctaacggcatcgctcttggcctgatggcgctgaaacttataacccagttcgagacctaccagctgtggacggcactgatcagcctgacctgttccaacaccatcttcaccctaacggtcgcctggagaactgctaccctgatcctcgccggggttagcctactgccggtctgtcagtcctcatccatgaggaaaaccgactggctccccatggcggtagccgcgatgggcgtgccgcccctaccgttattcatcttcagcctgaaggacacgctgaagcgccgttcctggcccctgaacgagggggtcatggccgtgggcctcgtgagcatcctagcatccagcctgctccggaatgacgttcccatggcggggcccctggttgccgggggcctcctcatcgcatgctacgtgatcaccgggacctccgccgacctgaccgtcgagaaagccgcggacatcacttgggaggaggaagctgagcagacaggcgtgagccacaacctaatgatcaccgtcgacgacgatgggaccatgcgcatcaaagacgatgagacggagaacatcttaacggtcctgctgaagaccgccctcctgattgtgtccggtatattcccgtacagcatccccgccacactgctcgtgtggcatacctggcagaaacaaacgcagcggtccggcgtcctgtgggacgtgcccagcccgccagagacccagaaagccgagctagaggagggggtgtatcgcatcaagcagcagggcatctttgggaagacccaagtcggagttggggtgcagaaggaaggcgtcttccacaccatgtggcatgtgaccagaggggcggtgctcacatataacggtaagcgcttggagccaaattgggcgtccgtcaagaaggacctgatctcatacggcgggggctggaggctgtcagcacagtggcagaaaggggaggaggtccaggtgatagccgtggagcccggcaagaaccccaaaaatttccagaccatgcccggcaccttccagacgaccaccggggagattggcgcgatcgccctggactttaagcctgggaccagtggcagtcccattatcaaccgcgaaggaaaggtggtgggcctgtacggcaacggggtggtgacgaagaacggcgggtacgtgtcaggcatcgcccagaccaacgccgagccggacggcccaaccccagagctggaggaggagatgttcaagaaaaggaacctcaccatcatggacctgcaccccgggagcggaaagacgcgcaagtacctgccggctatcgtccgggaggcaatcaagcgtcggctccgcaccctgattctggctcctacacgggtggtggccgcagagatggaggaggccttaaaggggttgcccatccgttaccagaccacggcgaccaagtccgagcacaccggccgggagatagttgacttaatgtgccacgccaccttcacgatgcgcctcctgagccccgtgcgggtgccgaactataacctgataattatggacgaggcccacttcaccgacccggcctcgattgccgcgcgcgggtacataagcacccgggtcggcatgggcgaggccgccgcaatcttcatgacagcaacgccaccaggaactgcagacgccttcccgcagagcaatgcccccatccaggacgaggaacgcgacatacccgagcgcagctggaactccggcaacgagtggatcaccgatttcgccgggaagaccgtgtggttcgtgcccagcatcaaggccggcaacgatatcgccaactgcctccggaagaacggaaagaaggtcattcagctgtcccgcaagacgtttgacaccgagtaccagaagactaagctgaatgattgggacttcgtcgtgaccacggacatcagcgaaatgggcgctaacttcaaggcggaccgggtcatcgacccgcgccggtgtttgaagccggttatcttaaccgacggacccgagcgcgtgatactggccggtcccatgccggtcaccgcggcctccgccgcccagcgacgcggccgggtgggtcgcaatcctcagaaggagaacgatcaatacatctttaccggccagcccctcaacaacgacgaggaccacgctcactggaccgaggcgaaaatgctgctggacaacatcaacactcccgaggggataatcccagccctctttgagccggagagagagaagtccgccgcaatcgatggcgagtacaggttaaagggggagtcccggaagacgttcgtggagttgatgcgccgcggggaccttccggtctggctagcgcacaaggtggccagcgagggcattaagtacaccgaccgcaagtggtgcttcgacgggcagcggaataaccaaatcctggaggagaacatggacgtcgagatctggaccaaggagggcgagaaaaagaagctccgaccccggtggctcgacgccagaacgtacagtgacccgctggcactcaaggagtttaaggagtttgccgcgggccgcaagagcatcgccctggatctggtgaccgagatcgggcgggtgccatcccacctcgcccacaggacccggaacgccttggacaaccttgtgatgctccacaccagcgagcacggcgggcgcgcctaccggcacgcggtggaagaactgcccgagacgatggagactctgttgttactggggctcatgatcctattgaccggaggggccatgctgttcttaatctcaggcaaggggatcggcaagacatccatcggtctgatatgcgtgattgccagctcaggcatgttgtggatggctgaaatccccttgcagtggatcgccagcgcaattgtcctggagtttttcatgatggttctcctgattccagagcccgagaagcagcgtacaccccaggacaaccagctcgcctacgtggtaatcgggatcctcacgctggccgccatcatcgccgcgaacgagatgggcctgctcgagaccaccaagcgggacctcggcatgtccaaagaaccgggggtggtcagccccacgtcctatctggacgtcgacctccacccagcgagcgcctggaccctgtacgccgtggcgaccaccgtgatcacgcccatgttacgccacaccatagagaactccaccgccaatgtcagcctagccgccatcgctaaccaagccgtggtgctgatgggcctggataagggatggccgatctccaaaatggacctcggggtccccctgctggcattaggatgctacagccaggtgaaccctctgacgctgactgccgccgtgctcctgctgatcacccactacgcaatcatcggcccgggcctccaggcgaaggccacccgggaggcccagaagcgcacggctgccgggatcatgaagaacccgaccgtagacgggatcatgaccattgacctggacccagtgatctatgactccaagttcgaaaagcagttgggccaggtgatgctcctggtcctatgcgcggtgcagttgctgctgatgcggaccagctgggccctctgcgaggccctcacactggccacagggcctatcaccaccctctgggagggctccccagggaagttctggaacaccacgatcgcggtgagcatggcgaacatcttccgcggcagctacctggccggggccggtctggccttctcaataatgaaatccgtggggactggaaagcggggtactgggagccaaggtgagacccttggagagaagtggaagaagaagctgaaccagctatcccgcaaagattttgacctatacaagaagagtgggatcacagaggtcgaccggacggaggcgaaggagggtcttaagcgcggcgagatcacccaccacgctgtaagccggggctccgctaagctgcaatggttcgtcgaacgcaacatggttataccggagggccgggtgatcgacctcggctgcggacgcggtgggtggagctactactgcgccggactgaagaaggtcacggaggtgcggggctacaccaagggcgggcccgggcacgaggaacccgtgcccatgtccacgtacggatggaacatcgtcaagctgatgagcgggaaggacgtgttctacctcccgcccgagaagtgtgacaccctgttgtgcgacatcggcgagtccagtccctcacccaccgttgaggaaagccgcaccatccgcgtcctgaagatggtggagccgtggctcaagaacaatcagttctgcatcaaggtgctgaacccctacatgcccaccgtcatcgaacacctggagcggttacagcgaaagcacggcgggatgcttgtgcggaaccccctgtcacggaatagcacccacgagatgtattggatcagcaatggcaccgggaacatcgtggcaagcgtcaacatggtgtccagactcttactgaaccgcttcaccatgactcaccgcaggccgaccatcgagaaggacgtggacctcggcgcgggcacccggcacgtgaatgccgaacccgagaccccaaacatggatgttataggcgaacgcattaagcgcatcaaggaggagcataattcgacgtggcattacgacgacgagaatccgtacaagacctgggcctaccacggctcctacgaagtgaaggccaccgggagcgcctccagcatgatcaacggggtagtgaaacttctgaccaagccctgggatgtcgtgcccatggtgacgcagatggcgatgaccgacacgacgccctttgggcaacagcgggtcttcaaggaaaaagtcgacacccggactccacgcagcatgcccggcacccggcgcgtgatgggcatcacagccgaatggctctggcgtacgctcgggcgcaacaagaaaccccggctgtgtacccgcgaagagttcactaagaaggtcaggacaaacgccgccatgggcgcggtgttcacggaggagaaccagtgggactccgccaaagccgccgtggaggatgaggacttctggaagctcgtcgacagagagcgcgagcttcacaagttagggaaatgtggctcgtgcgtgtacaacatgatggggaagcgggagaagaagttaggcgagttcggcaaagcaaaaggatcgagggctatctggtacatgtggctcggtgcccggtatttggagttcgaggccttggggttcctcaacgaggaccactggttctcacgcgaaaattcctacagcggcgtggagggggaaggcttacacaagctcggctacattttgcgggatatctccaagatccccgggggcgccatgtacgccgatgacaccgcggggtgggacacaaggatcaccgaggatgacctgcacaatgaagagaagatcacacagcagatggaccccgagcaccggcagctcgctaacgccatctttaagctgacctaccagaacaaggtagtgaaggtacagcgccccacgcccaccggcacagtcatggacataatcagccggaaggaccagcgaggatccggccaagtgggcacgtacgggctgaacacattcaccaacatggaagcccagcttatccggcagatggagggggagggggtgctgagcaaggccgacctagagaacccccacctcccggagaagaaaatcacccagtggctggaaacgaaaggggtcgagcgcctgaagcggatggcgatatccggcgacgattgtgtggtgaaaccgatcgatgatcgcttcgcaaatgccctcctggcccttaacgacatggggaaggtccggaaagacatcccacagtggcagcccagcaagggctggcacgattggcagcaggtccccttttgctcccaccacttccacgagctcatcatgaaggacggtcgcaagctggtcgttccctgccggccccaggacgagttaatcggccgcgcccggataagccaaggggcgggctggtccctcaaggagaccgcctgcttaggcaaggcctatgcgcagatgtggtccctgatgtatttccaccgccgcgacctccgtttggcgtccaacgcaatctgttcggccgtacccgtgcactgggtaccgacgtcccgaaccacgtggagcatccacgcccaccaccagtggatgaccaccgaggacatgctaaccgtctggaaccgtgtttggatcgaggacaacccgtggatggaggacaaaacgcccgtcaccacctgggagaacgtgccctaccttgggaaacgcgaagaccagtggtgcggcagcctgatcgggcttacctcccgggcgacgtgggcgcagaacatccccaccgccatccagcaggtcagaagcctcatcggcaacgaggagttcctggactacatgccctccatgaaacggtttcgcaaggaggaagagagcgaaggtgccatctggtga

SEQ ID NO: 25803 - RNA, 9873 nt, synthetic construct
  misc_feature 1..9873: note = derived and/or modified CDS sequence (opt11) from DENV-3__FJ850049__SS-prME
  source 1..9873: mol_type = other RNA
actagcctctgcctcatgatgatcttacccgccgccctggcgtttcatctcaccagccgcgacggtgagccccggatgatcgtggggaagaacgagcggggcaagagcctgctattcaagaccgcatctggtataaacatgtgcaccctgattgcaatggacctgggcgagatgtgtgacgacactgtgacgtacaagtgtccccacatcacagaggtggagcccgaggacatcgactgttggtgcaacctcaccagcacctgggtgacatacgggacgtgcaaccaggccggcgagcatcggcgcgacaagcggtccgtcgccctcgctccccacgttggcatggggctcgacacccgcacccagacttggatgagcgccgagggtgcttggcgccaggtggagaaggtagagacgtgggccctgcgtcaccccgggttcaccatcctcgcgttattcctggcacactacatcggcacctccctaacacagaaggtagtgatcttcatcctgctgatgctcgtcactccaagcatgaccatgcgttgcgtgggggtcggaaatcgcgacttcgttgagggtctgtccggggccacgtgggtcgacgtggtccttgagcacggcgggtgtgtaaccacgatggccaaaaataagcctaccctcgacatcgagctccagaagaccgaagcaacccagctggctacgctccggaagctgtgcatagaggggaagatcactaacattaccacagactcccgctgccccacgcaaggcgaggctaccctgccggaggagcaggatcagaactacgtgtgcaagcatacctacgtagaccgggggtggggcaacggttgtggtctcttcgggaagggctccctggtcacctgcgcgaagttccaatgtctggagcccatcgagggcaaggttgtccaacacgagaacctcaagtacacggtgatcatcaccgtgcacacaggggaccaacatcaggtcggcaacgagacccagggggtcacggccgagataacgccccaagccagcaccaccgaggcgatcctgcccgaatacggcaccctggggctcgagtgttcaccgcgcacgggcctcgacttcaacgagatgatcctgcttaccatgaagaacaaggcctggatggtccaccgacagtggttttttgatctgcccctcccctggacctctggcgccaccacggagacccccacctggaacagaaaggagctcctcgtgacattcaaaaatgcccacgcaaagaagcaggaggtggtggtgctagggtcccaggagggtgccatgcatactgctctaaccggagccaccgagatccagaacagcggcgggacctccatcttcgccggccacctgaagtgccgactaaagatggacaaactcgagctgaagggtatgagctacgccatgtgcactaacaccttcgttctgaagaaggaggtatccgaaacccagcacgggacaatcctcatcaaggtcgagtacaagggcgaggacgtgccgtgcaaaatcccattcagcactgaagacgggcaaggcaaggcccacaacggacgcctgatcaccgcgaaccccgttgtcaccaaaaaggaggagcccgtgaacatagaggccgaaccgccttttggtgagagcaacatcgtcatcggcattggggacaatgccctgaagatcaactggtacaagaagggctctagtatcgggaagatgttcgaggcgaccgcccggggcgcccgccggatggccattctgggcgacacggcctgggacttcggttccgtcggcggggtcctcaacagtttagggaaaatggtacatcaaatctttgggtccgcctacaccgcactgttcagcggcgttagctgggtgatgaaaatcggtattggcgtcctcctcacctggatcggcctgaactcaaagaataccagtatgtccttcagttgcatcgccatagggatcatcaccctctacctgggcgccgttgtgcaggccgacatggggtgcgtaatcaactggaagggcaaggagctgaagtgcggcagcgggatcttcgtgaccaatgaggtgcacacctggaccgagcagtacaaattccaggcggactcccccaagcgcctcgcgacggccatcgctggcgcgtgggaaaacggagtttgcggcatccgtagcactacgcggatggagaacctgctgtggaagcagatcgcgaacgagctcaactacatcctgtgggaaaacaatatcaagctgaccgtagtggtcggcgacatcatcggcgttctcgaacagggaaagaggactctgacaccgcaaccgatggagctgaagtactcctggaagacctgggggaaggccaagatcgtgaccgccgagacgcagaacagctccttcattatcgacggccccaacacccccgaatgccccagcgtcagccgggcctggaatgtgtgggaggtggaggactacggtttcggcgtcttcaccacgaatatctggctcaagctgagagaagtgtacactcagctgtgcgaccaccggctcatgagcgcggcagttaaggacgagcgcgccgtccacgcggatatgggctactggatcgagagccaaaagaacgggtcctggaagctggaaaaagccagcctgatcgaggtgaaaacgtgcacctggccaaagtcccacaccctctggtccaacggtgtgttagagtccgacatgataatccccaagagcttagcggggcccatctcccagcataaccaccggccgggctaccatacccaaacggcaggcccgtggcacctcggcaagttagagctggacttcaattactgcgagggcactacagtcgtgatcaccgagaactgcgggacccggggtcccagcctaagaacgaccactgtgtccggtaaactgatccacgagtggtgctgccgcagctgtacgctgcccccgttgcgctacatgggggaagacgggtgctggtatggcatggagatccgtcccatctccgagaaggaggagaacatggtcaagagcctggtctccgccgggagcgggaaggtggacaatttcaccatgggagtcctgtgccttgccatcctatttgaggaggtaatgcgggggaaatttgggaagaagcacatgatcgccggtgtcttcttcaccttcgtcctgctcctgagcgggcagatcacctggcgcgacatggctcacactctgatcatgattggcagcaacgcgtccgacaggatggggatgggcgtgacgtacctcgccctgatcgccactttcaagattcagccctttctggccttaggatttttcttacgtaagctaaccagcagagagaacttgctgctgggcgtagggctcgcgatggccacgaccctgcagctgcccgaagacatcgagcagatggctaacggcatcgccctcggactgatggccctgaagctcatcactcagttcgagacctaccagttatggaccgccctgatcagcctgacttgttccaacaccatcttcaccctgacggtcgcctggcgcaccgccaccctcatccttgccggggtgtcgttgctgcccatgtgccagtccagcagcatgcggaagaccgattggctccccatggcggtggccgcgatgggcgtaccaccactcccgttattcatcttctccctgaaggatactctgaaacgccgctcctggccgctgaacgaaggcgtcatggcagtcggcctcgtgtctatcctggccagcagcctgctcagaaatgatgtgccgatggcgggccccctggtcgctgggggcttactcatcgcatgctacgtgatcaccggtacgtccgccgacctgaccgtggagaaggctgcgaacatcacgtgggaggaggaagctgagcagactggcgtatctcacaaccttatgataaccgttgatgacgatgggaccatgcgcatcaaagatgacgagaccgaaaacatcctcacggtactgctaaagaccgccctcttaattgtctccggaattttcccgtacagcatccccgccaccctgctcgtgtggcacacctggcagaaacagactcagcggtccggcgtgctgtgggacgtccccagcccacccgagacccagaaagccgagctagaagaaggggtgtaccgcatcaagcagcagggcattttcgggaagacccaggtaggcgtcggcgtgcagaaggagggagtcttccacaccatgtggcatgtgactcggggcgcggtgctgacctacaacgggaagcgcctggagcccaactgggcctcggtcaagaaagatctgataagctatggaggtggctggcggctctccgcacagtggcaaaagggggaggaggtccaagtgatcgccgttgagccgggcaagaaccccaagaacttccagacgatgccaggtaccttccagactactactggggaaattggcgcgatcgccctggacttcaagcccgggaccagcggcagccccatcatcaatcgcgagggaaaggtcgtcgggttatacggcaacggggtggtcacaaagaacggcggttacgtgtccggtatcgcccaaaccaacgccgaacctgatggccccacccccgagctggaagaggagatgttcaaaaagcgaaatctcacgatcatggacctgcaccccgggtctggaaagactcgtaagtacctgccggccatcgtgcgggaggcgatcaagaggcggctccgcaccctgatcttagccccgacccgagtagtggccgccgaaatggaggaagccctcaaggggctgcccatccgctatcagaccacggcgaccaaatctgagcacactggacgggagatcgtggacctgatgtgccacgccaccttcacgatgcgccttctgagccccgtccgggtgccgaactacaacctgattatcatggacgaggcgcactttacagaccccgccagtattgccgcgcgcgggtatatcagcacccgggtgggtatgggtgaggccgccgctatcttcatgaccgctacgccacccggtactgccgacgcgttcccacagtccaacgcccccattcaggatgaggagcgtgacatccccgagcgcagttggaactcaggtaatgagtggatcactgacttcgccgggaagaccgtctggttcgtaccctcaataaaggcgggcaacgacattgccaactgcctccggaagaacgggaagaaggtaatccagctatcccgcaagacgttcgacaccgagtatcagaagaccaagttaaatgactgggactttgtcgtgaccacggatatcagtgagatgggagccaacttcaaagccgaccgtgtgatcgaccctcgccggtgtctcaagccggtcatcctcacggatggccccgagcgcgtcatcctggccgggcccatgccggtgaccgcagcatccgccgcacagcgacgcggccgggtcggtcgcaacccgcaaaaggagaacgaccagtatatcttcaccggccagcctttgaacaacgacgaggaccacgcccactggaccgaggccaagatgttactagacaacataaatacgcccgaggggatcatcccggcgctcttcgagcccgagcgagagaagtccgcagccatcgacggcgaataccgcctgaagggcgagtcccggaagactttcgtggagctgatgaggaggggcgacctccctgtgtggcttgcgcacaaggtagccagcgaggggatcaaatacaccgaccgcaagtggtgcttcgacgggcagcgtaacaaccagatcctcgaggagaacatggacgtcgagatctggaccaaggagggcgagaagaaaaagctacgcccgcggtggctagacgcccgcacgtactctgatccgctggcgctcaaggagttcaaggagttcgctgccggccgcaagtctatcgctctggatcttgttaccgaaatcgggcgggtgccctcccatctggcacaccgcacccggaacgccctggacaacctggttatgctacacaccagcgagcacggggggcgcgcctaccggcacgcggttgaagagctccccgagactatggagacccttctcctgctgggcctcatgatcctgctgacggggggcgctatgctgtttctgatcagcggcaaggggattggtaagacgtccatcgggctgatctgtgtgatcgcctcctccggcatgctctggatggccgagataccgctgcagtggatcgcctccgccattgtcctggagtttttcatgatggtcctgctgattccggagccagaaaaacagcgcacgccccaggacaatcagctggcctacgtggttatcggcatcctcaccctggcagccataatagcagcgaacgagatgggcctattggagacaaccaagcgggacctgggaatgtcaaaggagccgggggtcgtgtcccccacttcttacctcgatgtagacctccaccctgccagtgcctggaccctgtacgccgtcgcgaccaccgttatcacccccatgctacgccataccatcgagaactcaaccgcaaacgtgagcctcgcagccatcgccaaccaggcggtcgtgctgatggggctggacaaggggtggccgatctccaagatggacctcggtgtcccgctgctggccttggggtgctactcgcaggtcaacccactgaccctaacggccgccgtgctattgctgatcacgcactacgccattatcggccccggcctccaggcgaaggcaacccgggaggcccagaagcgcactgccgccggaattatgaagaacccgaccgtggacggtattatgaccatcgacctggaccccgtcatttacgactccaagttcgagaaacagcttggccaggtgatgttgctggtgttatgcgcggtgcagctcctgctgatgcggaccagctgggcgctctgcgaggcccttaccctggcgaccggccccataaccaccctctgggaaggctcccccggcaagttttggaacaccacgatcgcggtgtccatggccaacatctttcgcggctcctacctggcaggggccggcctggcttttagcatcatgaaatccgttgggaccgggaagcgcggaactggatcacagggcgagacccttggggagaagtggaagaagaagcttaatcagctgagcaggaaagatttcgacctctataagaagtccggaatcacagaagtcgaccgaacggaggcgaaggagggcctgaagcgcggcgagatcacgcaccacgccgtctcgcgtggctccgcaaagctgcagtggttcgtcgaacgcaacatggtgataccggaggggcgggtgatcgacctcggctgcgggcgcggcgggtggagctactactgcgccggcctgaagaaagtgaccgaggtccggggttataccaaaggcgggccggggcatgaggagcccgtgcccatgtccacttacggctggaacatcgtgaagctcatgagcgggaaggatgtcttctacctccctcccgaaaagtgcgacaccctgctgtgtgacattggggagtcaagcccctcccccaccgtggaggaaagccgcaccatccgtgtgttaaagatggtcgagccctggttaaaaaacaaccagttctgtatcaaagtgctgaacccctacatgccgacggtgatcgaacacctggaacggctccagcgcaagcacggtggaatgttggttagaaaccctctctcccgcaacagcacccacgagatgtattggatctccaacggcaccgggaacatagtcgccagcgtcaacatggtttcccggctcctgctgaaccgcttcacgatgactcaccggcgcccgaccatcgagaaagacgtggacctcggagcgggcacccggcacgtgaacgccgagcccgagaccccgaacatggacgtcatcggagagcgcataaaaagaataaaggaggagcacaatagtacatggcactacgatgacgaaaatccgtacaagacctgggcctatcacggctcctacgaggtaaaggccaccgggagcgcctccagcatgatcaacggcgtggtcaagttactaaccaaaccttgggacgtggtgccaatggtgacccagatggctatgaccgacaccacgcccttcggtcagcagagagtgttcaaggagaaggtagacacgcggaccccgcgcagcatgcccggcactaggagggtgatggggatcaccgccgagtggctctggcggaccttggggcgcaacaaaaagccccggctgtgcacccgggaagaatttaccaagaaggtacgcacgaacgccgcaatgggcgcggtcttcacggaggagaaccagtgggactccgctaaggccgcggtggaagacgaggatttctggaagctcgtggaccgcgagcgcgaactgcacaagctggggaagtgcggcagctgcgtctataacatgatggggaagcgggagaagaagttgggcgagttcggtaaggccaaggggtctcgcgccatctggtacatgtggctgggtgcccggtatttagagttcgaggccctcggattcctgaacgaggaccactggttcagccgggaaaactcttacagcggggtggagggggaggggctgcacaagctgggttacatactccgggacatctctaagatccccgggggcgctatgtatgccgacgacaccgccgggtgggacacccgcataaccgaggacgacctgcataatgaggagaagataacccaacagatggaccctgagcaccggcagctcgctaatgcgatcttcaagctgacctaccaaaacaaagtggtcaaggtgcaacgccccacccccaccggcacggtgatggatatcatcagccgtaaggaccaacgcggctccggtcaggtcggcacatacggcctgaacacattcaccaacatggaggcccaactcatcagacagatggagggagagggggtgttgagcaaggccgacctagagaacccccacctcccggaaaagaagataacccagtggctggagacgaagggcgtggaacgcttaaagcggatggcgatctccggcgacgattgcgtcgtgaagcctatcgatgatcgtttcgcgaacgccctcctggccctgaatgacatgggtaaggttcgcaaggacatcccccagtggcagcccagcaagggctggcatgattggcagcaggtaccgttttgctcccaccacttccatgagttgatcatgaaggacgggcgcaagctagtggtgccgtgccggccgcaggacgagctgatcggccgcgcccggatttctcagggggcgggttggtccctcaaggagaccgcctgcctgggcaaggcctacgcccaaatgtggagcctgatgtatttccaccgccgcgatctccggctggcgtctaacgccatctgtagcgcggttcctgtgcattgggtaccgacctcccgcaccacgtggagcatacacgctcaccatcaatggatgacgacggaggacatgctaaccgtctggaatcgggtgtggatcgaggacaatccttggatggaggacaaaacgcccgtgaccacctgggagaacgtgccctaccttgggaagcgtgaggaccagtggtgcggcagcctgatagggctgacctcccgggcaacgtgggcgcagaacatcccgaccgccatccagcaggtccgcagcctcattggcaacgaggagttcctggattacatgccatccatgaagcggtttcgcaaggaagaggagtccgagggggccatctggtag

SEQ ID NO: 25804 - RNA, 9873 nt, synthetic construct
  misc_feature 1..9873: note = derived and/or modified CDS sequence (opt11) from DENV-3__FJ898476__SS-prME
  source 1..9873: mol_type = other RNA
acctcgctctgcctcatgatgatcctgcccgcagccctggcttttcacctcaccagccgggacggcgagccccggatgatcgtggggaaaaacgagcggggcaaatctctgcttttcaagaccgcctccgggatcaacatgtgcactctcatcgccatggaccttggcgagatgtgcgacgacaccgtgacctacaagtgcccccacataaccgaggtggagccggaggacatcgactgctggtgcaatctgaccagcacctgggtgacatacgggacgtgcaaccaggccggcgagcacaggcgcgacaagcggtccgtggctctagcgccccacgtaggcatggggctggacacccgcacacagacctggatgagcgcggaaggcgcctggcggcaagtagagaaggtagagacgtgggccctccgccacccgggcttcaccatcctcgcgctgttcctggctcactacatcggtacctccctcacccaaaaggtggtgatctttatcctgctgatgctcgtcacgcccagcatgacaatgcggtgcgtgggggtgggcaaccgcgacttcgtcgagggcctgtccggggccacatgggtagacgtggtcctggagcacggcgggtgcgtaaccacgatggccaagaacaagcccacccttgacatcgagctccagaaaaccgaggccacccagctcgcgacgctccggaagctgtgcatcgagggcaagattaccaatatcaccaccgacagccgctgtcccacgcaaggcgaggccaccctgcccgaggagcaggatcagaattacgtctgcaaacacacgtacgttgaccgggggtggggcaatggttgcggcctcttcgggaagggctccctggtgacctgcgccaagttccagtgcctggagcctatcgagggcaaggtggtacagtatgagaaccttaagtacacggtcatcatcaccgttcacaccggggatcaacaccaggtcggcaacgagacgcagggggtgactgccgagataacgccccaggccagcaccaccgaagcgatcctgccagagtacggcaccctggggctcgagtgctcaccgcgcacgggcctggacttcaacgaaatgatcctactcactatgaagaacaaggcgtggatggtgcatcggcagtggttcttcgacctgcccctgccctggaccagcggagcgaccacggagaccccaacctggaaccgaaaggagcttctggtgaccttcaagaacgcccacgctaagaagcaggaggtggtcgtattggggtcccaggagggagcgatgcacacggccctcactggggccaccgagatccagaacagcggcgggacctccatcttcgccggtcacctgaagtgtcggctgaaaatggataagctagagctcaagggcatgagctacgccatgtgcacgaacacattcgtcttaaagaaggaggtctccgagacgcagcacggcacgatcctcatcaaggtggaatacaagggtgaggacgtgccgtgcaaaatccccttcagtacagaggacgggcaagggaaagcgcacaacggccgcctgatcacagccaaccccgtcgtgaccaagaaggaggagcccgtaaacattgaggcagagccgcccttcggggaaagcaacatcgtcatcggcatcggggacaacgccctgaagatcaactggtacaagaagggttcaagcatagggaagatgttcgaggcgacagccaggggcgcccggcggatggctatcctgggtgacacggcctgggacttcgggtcagtgggcggagtgctcaacagcctgggcaaaatggtccatcagatcttcggatcggcatacaccgccctgttcagcggtgtgtcctgggtgatgaagatcggtattggggtccttctgacctggatcggactgaacagcaagaataccagcatgagcttctcctgcatcgcgatagggatcatcacgctctacctgggcgccgtggtgcaggccgacatggggtgcgtaatcaactggaagggcaaggagctgaagtgtgggagcgggatcttcgtgaccaacgaagtgcacacctggaccgaacagtacaagttccaggcggactccccaaaacgccttgccaccgccatcgccggagcttgggagaacggagtatgcggcatacgctcgacaactcggatggagaacctcctgtggaagcagattgccaacgagcttaactacatcttatgggagaacaacatcaagctgaccgtcgtggtcggggacatcattggcgtgttggagcagggcaagaggacgctgacgccacaaccgatggaactgaaatactcatggaagacctgggggaaggccaagatcgtgaccgctgagactcaaaacagctcgttcatcatcgacggacctaacacgccagaatgcccttccgtctcccgggcttggaacgtgtgggaggtggaggactacggtttcggggtattcacaacaaacatctggttaaagctgcgcgaggtgtacacccagttatgcgaccaccgcctcatgagcgcggccgtgaaggacgagcgcgccgtacacgccgacatgggttactggatcgagagccagaagaacgggtcctggaagctggagaaggccagcctgattgaagtgaagacgtgcacatggccaaagtcccatacactctggagcaacggcgtcctggagtccgacatgatcatccccaagtctctggcggggcccataagtcagcacaaccatcgacccggctaccacacccagacggctgggccctggcacctcggaaagctggaactggatttcaactactgcgaaggcaccaccgtcgtgatcaccgagaactgcgggaccagaggtcccagcttacgaaccaccaccgtgtccgggaagctgatccacgagtggtgctgccgcagctgcacgctgccccctctccggtacatgggggaggacggttgctggtacggcatggagatccgccccatctccgagaaggaggagaatatggtcaaaagcctggtgtccgccggcagtggtaaggttgacaacttcaccatgggcgtcctgtgcctcgcaatccttttcgaggaggtgatgcgggggaagttcggcaagaagcatatgatcgccggggtgttcttcaccttcgttctgttgctgtccggccagatcacctggcgcgacatggcgcacacgctgatcatgatcggcagcaacgcctccgaccggatgggcatgggagtcacctacctcgccctgatcgccaccttcaaaatacagccattcctggccctgggttttttcctgcgcaagctaactagccgagagaacctcctgctgggagtgggcctcgcgatggccacgaccttacagctgcccgaggacattgagcagatggccaacgggatcgccctcgggctcatggcgttgaagctcatcacccaattcgagacctaccagctgtggacggccctgatcagcctgacctgctccaacaccatcttcaccctgacggtcgcctggcggaccgccaccctgatcctcgcaggggtgagcttgctaccggtctgccagtccagctccatgcggaagaccgactggctccccatggccgtggccgccatgggcgtgccgcccctcccgctgttcatcttcgggctcaaggacacgctgaagcgtcggagttggcccctgaacgagggcgtaatggccgtgggcctcgtttcaatactggcctcttccttattgcggaacgacgtcccaatggcggggcccttagtggccggcggccttctcatagcctgctacgtgatcaccggcacctcagccgacctgaccgttgagaaggccgcggacatcacgtgggaggaggaggccgagcagaccggggtgtcgcacaacctgatgatcacagtagacgacgacggcaccatgcgcatcaaagatgacgagaccgagaacatcctcacggtcctgttaaagaccgccctcctgattgtcagcggcatcttcccgtactccatccccgccaccctgctcgtgtggcatacctggcagaaacagacacagcggagcggggtactgtgggatgtgcccagccctcccgagacccagaaggccgagctggaagagggcgtgtaccgcatcaagcagcaggggatcttcggcaagacacaggtcggggtgggcgtccagaaggagggtgtcttccacactatgtggcatgtgacccgcggggcggtgctcacatacaacggcaagcgcttggagcccaattgggcctcggtcaagaaggacctgatatcctacgggggcggatggcggcttagcgcccagtggcagaagggggaggaggtccaggtgatcgccgtcgagcccggaaagaaccccaagaacttccagaccatgccagggacatttcaaacgactactggcgagatcggagcgatcgccctggacttcaagcccggcacctccggcagccctataatcaaccgcgaggggaaggttgtgggcctgtacggaaacggtgtcgttacgaagaacgggggctacgtgagcggcatagcccagacgaacgccgagcccgacggccccacccctgagctagaggaggagatgttcaagaagagaaacctcaccatcatggacctgcacccgggatccggcaaaactcgcaagtatctaccggccatcgtacgggaggcgatcaaacgccggctacgcaccctgatcttagctcccacgcgggtggtggccgccgagatggaggaggccctcaaaggactccccatccgctaccaaaccacggccaccaagtccgagcacaccgggcgggaaatcgtcgacctgatgtgccacgccacctttacgatgcgcctcctcagccccgtgagggttcccaactacaacttaattatcatggacgaggcccattttaccgaccctgccagcatcgccgcgcgcgggtacatctccacgagagtcggaatgggggaggccgcagccatcttcatgaccgcaaccccgcccggaaccgccgacgccttcccgcagtccaacgcgcccatccaggacgaggagagggacatccccgagcgctcatggaacagtgggaacgagtggatcaccgatttcgccggcaagaccgtgtggttcgtgccctctatcaaggcggggaacgacatcgccaactgcttgcggaagaacggcaagaaggtcatccagctgtcccgcaagacgttcgacacggagtaccagaagaccaagcttaacgactgggacttcgtcgtgaccacggacatttccgagatgggcgccaacttcaaggctgaccgggttatcgacccgcgccggtgcctcaagccggtgatcttgaccgatggaccggagcgagtcatcctggcaggaccaatgccggtcaccgcggccagcgccgcccagagacgcgggcgcgtgggacgcaacccccagaaggagaacgaccagtacatcttcaccggacagcccctcaataacgacgaggaccacgcccactggacagaggcgaagatgctgctggacaacatcaacacgcccgagggcatcatcccggccctttttgaacccgaacgggagaagtccgctgccatagacggtgaatacagactgaagggggagagccggaagactttcgtggagctgatgcgccggggggacctccccgtctggctggcgcacaaggtggcctctgaggggatcaagtacaccgaccgcaagtggtgtttcgacggccaacggaacaaccagatcctggaggagaacatggacgtcgaaatctggaccaaagaaggcgagaagaagaagttaaggccccggtggctggacgcccgcacgtacagcgacccgttagccctcaaggagttcaaggaattcgccgcagggcgcaagtccatcgccctggaccttgtgaccgagattggccgggtgcccagccacctcgcccatagaacccggaacgcccttgacaacctggttatgctgcacaccagtgagcacgggggacgtgcttaccggcacgcggtcgaggagctgcccgaaaccatggagaccctgctcctgctcggcctcatgatcctgctaaccggaggcgccatgctgttcctgataagcgggaagggcatcgggaagaccagcatcggcctgatctgcgtgatcgcctcgagcgggatgctatggatggcagagataccgctgcagtggatcgcctccgcgatcgtactggagttcttcatgatggtgctacttatcccagagcccgagaaacagcgcacgccccaggacaatcagctggcttacgtagtcatcggcatcttgacccttgcggccatcatcgcagcgaatgagatgggcctgctcgagacgaccaaacgggatctggggatgagcaaagagccgggcgtggtttccccaaccagctacctggatgtcgaccttcatccagcctccgcttggaccctgtacgcagtggcaaccaccgtgatcacgcccatgctgagacacaccatcgagaacagcaccgccaacgtcagcctggccgccatagccaaccaggcggtggtactgatgggactggacaagggctggccgatcagcaagatggacctaggtgttcccctgctagccctcggctgctactctcaggtgaaccccttgacactgacagcagcagtgttactgctgatcacccactacgccatcatcggccccgggctccaggcgaaggccacccgggaggcccagaaacgaaccgccgccggcataatgaagaacccgacagtcgatgggatcatgaccatcgacctggaccccgtgatatacgacagcaagtttgagaagcagctgggccaggtgatgctcctggtcttatgcgctgtgcaactccttttgatgcgaacctcctgggccctctgcgaggccctgaccctggccacgggccccatcaccaccctctgggaggggagccccggcaagttctggaacaccacgatcgctgtgtccatggcgaacatcttccgggggagctacctggctggcgccgggctggccttctccattatgaaatctgtcggcactggcaagcgggggacgggttcccagggggagaccctcggcgagaaatggaagaagaagctgaaccagctgagccgcaaggacttcgacttgtacaagaagtcggggattaccgaggtagaccgtacggaggccaaggagggcctaaagcgaggcgagatcacccaccatgccgtgtcccgggggagtgccaagctgcagtggttcgttgagcgcaatatggtgatcccggaaggccgggtcatcgacctcggctgcggccgcgggggatggtcgtactactgcgcaggcctgaaaaaggtcaccgaggttcgggggtacactaagggcgggcccggccacgaggagcccgtgcccatgagcacctacggttggaacattgtcaagctgatgtccggcaaggacgttttctacctcccgcccgaaaagtgcgataccctactgtgcgacattggagaaagctcgcccagccccaccgtggaggagtcccgcaccatccgcgtgctgaagatggtggagccctggttaaaaaacaaccaattctgtatcaaggtgctgaacccctacatgcccactgtcatcgagcaccttgaacggctgcagcgtaaacacgggggcatgctggtacgtaaccccctgagccgaaactccacccacgagatgtattggatcagcaacgggaccggcaacatcgtggccagtgtcaacatggttagccggctcctgctcaaccgcttcacaatgacgcaccggcgcccgacaatcgagaaggacgtggatctcggggctgggacgcgacacgtcaacgcagagccggagacccccaacatggacgtgatcggcgagcgcatcaaaaggataaaggaggagcacaattccacctggcactacgacgacgagaacccctacaagacgtgggcctaccacgggagctacgaagtgaaagccaccggctccgccagttccatgatcaacggggtcgtgaagctgctgactaaaccctgggatgtcgtgccgatggtgacgcaaatggcaatgaccgacaccacgccgttcggccagcagcgcgtcttcaaggagaaggtggacacccggaccccgcgcagcatgcccggcacccggcgcgttatggggatcaccgctgagtggctgtggcggacgctgggcaggaacaagaagccccggttatgcacccgcgaggagttcaccaagaaggtcaggaccaacgccgcaatgggtgcggtgttcacggaggagaaccagtgggacagcgctaaggccgccgtggaggacgaggacttctggaagctcgtcgaccgggagcgcgaattgcacaagcttggcaagtgcggatcatgtgtgtacaatatgatgggcaagcgggaaaaaaagctcggcgagttcgggaaggccaagggcagccgcgcgatctggtacatgtggttaggggccagatacctggagttcgaggccctcgggttcttgaacgaggatcattggttctcgcgcgagaactcgtactccggggtggagggcgagggcttgcacaagctcgggtacatcctgcgtgacatatctaagattcccggcggggccatgtacgccgacgacacagcaggctgggacacccgcatcactgaggacgatctgcacaatgaggagaagatcacccagcagatggacccggaacaccggcaactcgccaacgctatttttaagcttacctaccagaacaaggtcgtcaaggttcagagacccaccccgaccggcactgttatggacatcatctcccggaaagaccagcgcgggagcggtcaggtggggacgtatggcctgaacactttcacgaacatggaggcccagctcattcgacaaatggagggggagggagtgctttccaaggccgacctggagaacccccacctcccggagaagaagattacccagtggctggagacgaagggtgtcgagaggctgaagagaatggcgatcagcggggacgactgcgtggtgaaacccattgacgacagattcgccaacgccctcctggcgctgaatgacatgggaaaggtccggaaggacatccctcagtggcagccctccaaggggtggcacgactggcagcaggtcccattctgcagccatcacttccacgagctcatcatgaaggacggccgcaagctggtggtcccctgccggcctcaggacgagctgatagggcgcgcccggatttcccagggcgcgggctggagcttaaaggagaccgcctgcctggggaaggcctacgcccagatgtggtccctgatgtacttccatcgccgcgaccttcggctggcgagcaacgccatctgttccgccgtacccgtgcactgggtcccaaccagccgcaccacgtggagcatccacgcccaccaccagtggatgaccaccgaggacatgctgaccgtctggaaccgcgtgtggatcgaggacaacccctggatggaagacaagacccccgtcaccacatgggagaatgtgccctacctcggcaagcgtgaagaccagtggtgcgggagcctgatcggactgaccagccgggccacgtgggcgcagaacataccgacggccattcagcaggtccggtccctcatcggaaacgaggagttcctggactacatgccctctatgaagcggttccgcaaggaagaagagtccgagggcgccatctggtga

SEQ ID NO: 25805 - RNA, 9873 nt, synthetic construct
  misc_feature 1..9873: note = derived and/or modified CDS sequence (opt11) from DENV-3__FJ898475__SS-prME
  source 1..9873: mol_type = other RNA
accagcctctgcctcatgatgatacttcccgctgccctagcattccatctaactagtagagacggtgagccgcggatgatcgtagggaagaacgagcggggcaagagcctgctgttcaagaccgcctccgggatcaacatgtgcaccctcatcgccatggatttaggggagatgtgcgacgacacggtaacctataagtgcccccatatcaccgaagtagaacctgaggacatcgattgctggtgcaatctgaccagcacctgggtgacctacgggacgtgtaaccaggccggcgagcaccggagagataagcggtcagtggcactcgcgccgcacgtaggcatggggctggacacgcgcacccagacctggatgagcgccgaaggcgcctggcgccaagtcgagaaggtggagacttgggctctgagacatccggggttcactattttagcgctgttcctggctcattacataggaacctcattgacccagaaggttgtgatcttcatcctcctgatgctggtcacaccctcaatgacgatgcggtgcgtgggagtggggaaccgcgatttcgtcgaagggctatccggcgccacttgggtggacgtagtgctggagcatggcggatgtgtcaccacaatggccaagaacaagccgaccctcgatatcgagctgcagaagaccgaggctacccagctagcgacgctacgtaaactgtgcattgagggcaagatcactaatatcacgaccgatagccgatgcccaacgcaaggagaggccacactgccagaggaacaggaccagaactacgtctgtaagcacacatacgtcgaccgcggatgggggaatgggtgcggcctattcgggaaggggtcgttagtgacatgcgcgaagttccagtgtctcgaaccgatcgaaggcaaggtggttcagtacgagaatctcaaatacacggtgataattaccgttcacacaggagaccagcaccaggtcggcaacgagactcaaggggtcactgccgagatcactccccaagccagcaccactgaggcgatcctaccagagtacggaaccttgggtctcgaatgttccccgcgcacgggcctcgactttaacgaaatgattcttctgacaatgaagaacaaggcctggatggtccaccggcagtggtttttcgacctgcctctgccgtggacaagcggcgccactacggagacaccaacatggaaccgcaaggagttactggtgacgttcaaaaacgcccacgccaagaagcaggaagtggttgtattaggcagccaggaaggcgcgatgcacactgccctcaccggggccaccgagatccagaatagcggtgggacttccatttttgctggccacctgaagtgccggttaaagatggacaagttagagctcaaggggatgagctacgccatgtgcaccaacaccttcgtgttgaagaaggaggtctccgaaactcagcacgggacgatattaatcaaggtggagtacaagggcgaggatgttccgtgtaagatcccattcagcacggaggacggccagggcaaagcgcacaatggtcggctgatcaccgccaaccccgtcgttaccaagaaggaggagccagtgaatatcgaagccgagccacccttcggggagagcaacattgtgatcggcatcggcgacaacgctttaaagataaactggtacaagaaggggtccagcatcgggaaaatgtttgaggcgaccgcacggggcgctcgacggatggccatcctgggcgacacggcgtgggactttgggagcgtgggtggcgtcctcaacagcctgggcaagatggtccaccaaatcttcggatccgcgtacaccgccctattctcaggcgtatcttgggtgatgaaaatcggcattggggtcctactgacctggatcggcttgaacagcaagaacacctccatgtcgttcagttgcatcgctatcgggataatcactctctatctgggtgctgtggttcaggcagatatggggtgcgtcatcaactggaaaggcaaagagctgaagtgcggctcggggatcttcgtgaccaacgaagtacacacctggaccgagcaatacaaattccaggcggactcccccaagcgactcgccactgcaatcgccggcgcatgggaaaacggggtgtgcggcatccggtcaaccacgcgaatggagaacctcctgtggaagcaaatcgccaacgaactcaattacatactctgggagaacaatatcaaactaaccgtggtggtcggtgacatcatcggcgtactagagcagggcaagcgaacgttaacccctcagccaatggagctgaagtacagctggaaaacttggggcaaggccaaaatagtgactgcggaaacgcagaacagctcctttataatagacgggcccaacacccccgagtgccctagcgtatctcgggcctggaacgtgtgggaggtggaggattatgggttcggcgtcttcaccaccaacatctggctcaagctgagagaggtatatactcaactgtgcgaccatcggctcatgagtgcggctgtgaaggacgagcgcgccgtacatgccgatatgggctattggatcgagagtcagaaaaacgggtcatggaaactggagaaggctagcctgatagaggtgaaaacgtgcacgtggcccaagtctcacaccctctggtctaatggcgtgcttgagtccgacatgatcatccccaagagcctggccgggcccatttcccagcacaaccaccgaccgggttaccatactcagacggctgggccctggcacctcggcaagcttgagttagactttaactactgcgagggaaccaccgttgtcatcactgagaactgcgggacccgtggccccagcctccggaccaccaccgtgagcgggaagttgatacacgaatggtgctgcaggtcctgcaccctgcccccgctccggtacatgggcgaggacggctgctggtacggcatggagatccggcccatctccgaaaaagaagaaaacatggtgaagtcgcttgtgtccgctggtagcggaaaggtagacaacttcaccatgggcgtactgtgcctcgcgatcctgttcgaggaggtgatgcgggggaagttcggaaagaagcacatgatcgccggggtgttcctgacctttgtcctcctgctgtcggggcagatcacctggcgcgatatggcgcacacgctcatcatgatcggcagcaacgcgtctgacagaatggggatgggcgtcacctacttggccctcatcgctaccttcaagatccagcccttcctcgcgcttggcttcttcctgcggaagctgaccagccgggaaaacctgctactcggtgtggggctggcaatggcgaccaccctgcagctccccgaggacatcgagcaaatggccaacggaatcgccctgggcctgatggcactaaagctgataactcagttcgaaacctaccaactgtggacggcactcatcagtctgacctgctcgaacaccatcttcaccctgaccgtagcctggagaaccgcgaccctcatcctggctggggtgagtctactcccggtgtgccagtcgtcttcaatgcggaagaccgactggctgccgatggctgtagccgccatgggagtgccgcccctgcccctgttcatctttagcctcaaggacacgctgaagcgtcgttcttggcccctcaacgaaggggttatggccgtaggcctggttagcatcctggcctccagcctcctgcggaacgacgtccccatggctgggcccctagtggcggggggtctattaatcgcctgctacgtaattactggaacatccgccgatctgacggtcgagaaggccgcggacatcacgtgggaagaggaagcggagcagaccggcgttagccacaacctaatgatcactgtagacgacgacggcactatgcgcataaaggacgatgagaccgaaaatatcctgacggtcctgctcaagacagccttgctgatcgtgtcaggaatcttcccgtactctatccccgccaccctcctggtgtggcatacgtggcagaaacagacgcagcggagcggcgtactgtgggatgttcccagcccgcccgagacccagaaagccgagctcgaagaaggagtctaccggatcaaacaacagggaatctttgggaaaacccaagtcggcgtgggggtccaaaaagagggcgtcttccatacaatgtggcacgtgacgcggggggcggtgctcacttacaacggtaaacggctagagcccaactgggcctccgttaagaaggatttaatttcgtacggggggggctggagactcagcgcgcaatggcagaagggagaggaggtccaagtgattgcggtcgagcccgggaagaaccccaagaactttcagaccatgcccggtacattccagacaaccaccggggaaatcggtgcgatagccctggacttcaaaccaggtacctcaggatcccccatcatcaaccgcgagggaaaagttgtggggctttatggcaacggggttgtgacaaagaacgggggctacgtgtcagggatcgctcagaccaacgcggaacccgatggccccacccccgagctcgaggaggagatgttcaaaaagcggaaccttacaatcatggacctgcatcctgggagcggtaagacgcgtaaatacttaccggcgattgtccgtgaggcgatcaagcgccggctgcgtaccttgatcctcgctccaacccgcgtggtcgcagctgagatggaggaggccctgaagggcctccctatccgctatcagaccacggcgaccaagtccgaacacaccggacgggagatcgtcgacttgatgtgccacgccaccttcacgatgcgcttactgagccccgtccgggtgccgaactacaacctgatcatcatggacgaagcccactttacggacccggcgtcgatcgcagcgcgagggtatatctccacccgggtcggcatgggagaggccgcggccatcttcatgaccgcgacgcctccagggaccgcggacgccttcccacagtctaacgcccccatccaggacgaggaacgcgacatccccgaacggagctggaacagtggcaacgagtggataacggacttcgccgggaagacagtatggttcgtgccctcgattaaggcgggcaacgacattgccaactgcctgcggaagaacgggaaaaaggtcattcagctgtcccgtaagacgtttgacactgagtaccaaaagacaaagctaaacgactgggatttcgtggtgaccacggacatctcagaaatgggcgctaacttcaaggccgaccgggtcatcgatccgagacggtgtctcaaaccagtcattctgaccgacggtccggagagagtgatcctagccggccccatgcctgtcacggccgcctccgccgctcagcggcgcgggcgggtgggccgcaatccccagaaggagaacgaccagtatattttcaccggtcaaccgctgaacaacgatgaggaccatgcacactggaccgaggcgaagatgctgctcgataacatcaatacgcctgaaggaatcatcccggccttgtttgagccagagcgggagaagtccgccgcgattgatggcgagtaccggttgaagggcgaatcccggaagaccttcgtggagctcatgcgccgcggggacctgcccgtctggctggctcacaaggtagccagcgagggcatcaagtacacagaccgaaagtggtgcttcgatgggcagcggaacaaccagatcctcgaggagaatatggacgtcgaaatctggacaaaggagggcgaaaagaagaagctgcggccccgttggcttgacgcccggacgtattcagatcctctcgccctgaaggaattcaaggagttcgccgcgggccgcaagagcatcgcgctggacctcgtcactgagatcgggcgggtgcctagccatctggctcatcgcacgcggaacgccctggacaaccttgtcatgctgcacaccagcgagcacggtgggcgcgcgtacagacacgcggttgaagagctgcccgaaacgatggaaacactcctgctgctaggccttatgatcctgcttaccgggggtgcaatgttattcctgatcagcggcaagggtattggaaagacctccatcggcctcatctgcgttatcgcgtcctccggcatgttgtggatggctgagatcccgctgcagtggatcgcatccgcaatcgtcttggagttctttatgatggtcttactgatccctgagcccgaaaagcagcgtacgccgcaggacaaccagttagcctacgtggtaattgggatccttacgctggccgccattatcgctgcgaacgagatgggcctactggagacgaccaaaagagaccttggtatgtccaaggaacccggggtggttagccctacgtcctatttagacgtcgacctgcaccctgcgtcagcatggaccctatacgcggttgctaccactgtgatcacgccgatgttacggcacaccattgagaattcgaccgccaacgtttctctagccgccatcgcaaaccaggcggtggtgctgatggggttggacaaagggtggccgatctcgaagatggacttgggagtccctctgttagctttggggtgctatagccaggttaaccccctaaccctcacggccgccgtactccttctcatcacccactatgccattatcggacccggtctgcaagctaaggcgacccgggaggcgcagaaacgcaccgcagccggcataatgaagaacccgacggtcgacggcatcatgactatagatttagaccccgtgatctacgattccaagttcgagaagcagctgggccaagtgatgctgttagtcctttgtgcggtgcaactgctgctcatgaggaccagctgggccttatgcgaggcgctgaccctcgccaccggtcccattaccaccctgtgggagggatcccccgggaagttctggaacacgacaatcgctgtctctatggcgaacatcttccgcgggtcctatctagccggtgcaggcctggccttctccatcatgaagtccgtcgggaccggcaaaagaggcacggggagtcaaggcgagaccttgggtgagaagtggaagaagaaactgaaccaactcagccgtaaggactttgatctgtacaagaaatccggtatcactgaggtggaccggacggaagccaaagagggcctcaagcgcggggagattacccaccacgccgtgagccggggctccgcaaaactccagtggttcgtcgagcgcaacatggtgatcccagaggggcgggtaattgacctggggtgcgggcggggagggtggagctattattgcgcagggctgaagaaggtcaccgaggtgcgcggctacaccaagggcgggccaggtcacgaggagcctgtgccaatgtcaacgtacggctggaatatcgtcaaactaatgagcgggaaggacgttttctacctgccgcccgagaaatgtgacaccttactgtgtgatatcggcgagtcctctccctccccgaccgttgaggagagcagaactatccgcgtattaaagatggtggagccgtggttgaagaataatcaattctgtatcaaggtattaaatccatacatgccaacggtgatcgagcacctcgagaggttacagcgcaaacatggagggatgctggtacggaatcccctctcacggaacagcacacacgagatgtactggatctccaacggcaccggcaacatagttgcctctgtaaatatggtttcccgtctgttgctcaaccgcttcacgatgacccaccggagaccaaccattgagaaggacgtagacctgggagcgggcacccggcacgtcaacgcggagcccgagacgcccaacatggatgtgatcggggagcgtatcaaacggattaaagaggagcacaacagcacgtggcactacgacgacgagaatccgtacaagacatgggcgtaccacggcagttacgaagtcaaagcgacagggagcgcctcctctatgatcaacggcgtcgtgaaactgctaaccaagccctgggacgttgtgcccatggtgacccaaatggcgatgacggacaccaccccgttcgggcaacaacgagtcttcaaggagaaggtggacacgagaacaccgcgttctatgcccggcacccggcgcgtgatgggcattaccgcagagtggctgtggcggacactggggcgtaacaagaagccgcgtctgtgcacacgcgaggagttcaccaaaaaggtgcgaaccaacgccgccatgggcgcagtgtttacggaggagaatcaatgggattccgccaaggccgcagtggaggatgaagacttctggaaattagtagaccgggaaagagagctgcacaagttggggaagtgcggcagctgcgtgtataatatgatgggtaaacgggagaaaaagctgggcgagtttggcaaggcaaaagggagtcgtgctatttggtatatgtggcttggagcccggtacctcgagttcgaggccttggggttcctgaatgaggaccactggttttcgcgcgagaacagctactctggagttgagggagaggggctccacaagctaggctacattctgcgcgatatctccaagatacccgggggtgccatgtacgcagatgacacggcgggttgggacacgcgcataaccgaagacgacctccacaacgaagagaagatcacgcagcagatggacccggaacatcggcagctagccaacgccatcttcaagctcacctaccagaacaaggtcgtgaaagtacagcgacccacccctaccggcactgttatggacatcatctctcggaaagaccaacgggggtccggccaggtcggaacgtacggcctgaacacattcactaacatggaggcccaactcatccgacagatggagggagagggggtgctgtccaaggcagacctcgagaaccctcatctcccagagaagaagatcacccagtggttagagacgaagggggtcgagagacttaagcgaatggcaatatccggcgacgattgcgttgtcaagcccatcgacgaccgcttcgctaacgccctgctggccctcaacgacatgggcaaggtacggaaggatatcccccagtggcagccttcgaaaggatggcacgactggcagcaagtacccttctgctcccaccatttccatgagctaatcatgaaagacggacgcaaactggtggtcccctgcagaccccaggatgagctcatcggcagagcgagaatatctcagggggcgggctggtccctgaaagaaacggcgtgcctcggtaaggcttacgctcaaatgtggagcctcatgtatttccaccgccgggacttacgcctcgcgtccaatgccatctgcagcgcagttccagtccattgggtccctacctctcgtacgacgtggtctatccacgctcaccatcagtggatgaccaccgaagacatgctgaccgtgtggaatcgcgtgtggatagaagacaacccctggatggaagacaagacgccggttactacatgggagaacgtgccctacctggggaaacgcgaagaccagtggtgcggttccctgatcgggctcacatcgcgcgccacgtgggcgcaaaacatccctaccgctatccagcaggtccgctctctgatcggcaatgaagagttcctggactacatgccctccatgaaacgcttccgcaaggaagaggagagcgaaggggccatctggtag

SEQ ID NO: 25806 - RNA, 9873 nt, synthetic construct
  misc_feature 1..9873: note = derived and/or modified CDS sequence (opt11) from DENV-3__GQ199861__SS-prME
  source 1..9873: mol_type = other RNA
acatctctgtgcctcatgatgatcctgccggccgccctggcgtttcaccttacatcacgggacggtgaaccccggatgatcgtcgggaagaacgagcgtggcaagagcctgttatttaaaacggccagcggcatcaatatgtgcaccctcattgcaatggacctgggcgagatgtgcgacgataccgtgacttataagtgcccccacatcactgaggtggagccggaggacatcgactgctggtgcaacctaaccagtacatgggtgacctacgggacgtgcaaccaggccggcgagcacaggcgtgacaaacggtccgtcgccctcgctccccatgtaggcatgggtctggacacccgcacccaaacatggatgagcgcagagggcgcatggcgccaagtcgaaaaggtagagacgtgggccctgagacacccggggtttaccatcctcgcgctattcctcgcccactatatcggcacctccttaacccaaaaggtggtgatcttcatcctcctaatgctggtgacgcccagcatgactatgcggtgcgtgggggtgggcaaccgtgacttcgtcgagggcctgtccggggccacctgggttgacgtggtcttggaacacggagggtgcgtcaccacgatggccaaaaacaagcccaccctcgatatcgagctccagaagaccgaggccacccagctggcaacgctccgcaagctgtgcatcgagggcaagataaccaacatcactaccgacagtagatgccctacgcagggtgaagccaccctgccggaggagcaggaccagaattatgtgtgtaagcatacatacgtcgaccgcggctgggggaatgggtgcggcctcttcgggaaaggctcccttgtaacctgcgccaagtttcagtgcctggagccgattgaaggcaaggtcgtccagcatgagaacctcaagtacacggtcataatcacggttcacaccggcgaccaacaccaggtcggcaatgaaacccagggcgtgacggccgagatcacgcctcaggcaagcaccactgaggcaatcctgcccgagtacgggaccctagggttggaatgctctccgaggacaggtctagacttcaacgaaatgatcctgcttactatgaagaacaaggcgtggatggtacaccggcagtggttcttcgacctgcctctgccctggaccagcggcgccactaccgagacccccacttggaaccgcaaggaactcctggtgacgtttaaaaacgcccacgccaagaagcaggaggtggtcgtgctggggagtcaagagggcgcgatgcacacagcgctaaccggggccaccgagatccagaacagcggcgggacctcgatattcgcgggacacctcaaatgccgactgaagatggacaaactcgagctgaagggcatgtcttacgctatgtgcacgaacaccttcgtgctcaagaaggaagtttccgagacccagcatggcaccatcctcatcaaagtggagtacaagggtgaggacgtcccgtgcaagatcccgttcagtacggaggatggccaaggcaaggctcacaacggcagactgatcaccgccaaccccgtggtaactaagaaggaagaacccgtcaatattgaggcggaaccgcccttcggggagagcaacatcgtcatcggtatcggggacaacgcccttaaaattaactggtacaagaagggcagtagcattgggaaaatgttcgaggcgaccgcccggggagcccgccggatggctatcctgggcgacacggcctgggattttggctccgtgggtggggtgctcaacagcctggggaagatggtacaccaaatatttgggtccgcctacaccgccctgttcagcggagtgtcctgggtgatgaagatcggcatcggggtcctcctgacatggattggtctgaacagcaagaacaccagcatgagcttttcctgtatcgccatagggatcatcacgctctatctgggcgcagttgtgcaggccgatatgggctgcgtaatcaactggaagggcaaggagctgaaatgcggcagcgggatcttcgtgaccaacgaggtgcacacctggaccgagcagtacaagttccaggcggactcccccaagagacttgctacggcgatcgccggcgcgtgggagaacggtgtctgcggcattcgcagcacaactcggatggagaacctgctgtggaaacagatagctaacgaactcaactacatcctgtgggagaacaacatcaaacttaccgtggtggtcggggatatcatcggcgtgcttgaacagggcaagaggacgcttacgccacaaccgatggagttgaagtacagctggaagacttgggggaaagccaagatcgtgacagccgagacgcagaacagttcgttcatcatcgacggacccaacacacccgagtgccccagcgtctcccgggcctggaacgtatgggaggtggaagactacggcttcggcgtatttaccacgaatatatggctcaaactgcgcgaggtatatactcagctgtgcgatcaccggttaatgagcgcggccgtcaaagacgagcgggccgtgcacgccgacatggggtactggatagagagccaaaagaacgggtcctggaaactggaaaaggccagcttgatagaggtgaagacttgcacatggccgaaatcccacaccctctggtcgaacggcgttttagagtccgacatgatcatccccaagagtctagcggggccgatctcccagcataaccaccgaccgggctaccacacccaaacagccggaccctggcatctcggtaagctggagctggatttcaactactgcgagggcacgaccgtcgtgatcaccgagaattgcgggacacgcgggccaagcctccggaccacgacagtgagtgggaaacttatccatgagtggtgctgcagatcctgcacgttgccaccccttcggtatatgggtgaagacgggtgctggtacggcatggaaattagacccatctcagagaaggaggagaacatggtcaagagcttagtatccgccggaagcgggaaagtggacaacttcaccatgggcgtcttatgtctggccatcctgtttgaggaagtgatgaggggcaagttcggcaagaagcacatgatcgcgggtgtgttcttcactttcgtcctacttctgtcgggccagatcacctggcgcgacatggcgcacacgctcatcatgatcggcagcaacgcatcagaccggatggggatgggcgtcacttatctggccttgatagccaccttcaagatacagcccttcctggctctcgggtttttcttacgcaaactcacttcgcgtgagaatctcctgcttggcgtgggacttgcaatggccacaacgctgcagttacccgaggatatcgagcagatggcaaacggaatagccctcggcctgatggctctgaaacttatcacccaatttgagacctaccaactgtggaccgccctgatctctctgacctgctctaataccatcttcacattgacggtagcatggcgcacggcgaccctgatccttgccggtgtatcactcctcccgatgtgccaatcgagctcaatgcggaagaccgactggctcccaatggcggtcgccgcgatgggagtgccgcccttacctttgttcatcttcagcctcaaggatacgctgaagcgccgctcctggcccctgaacgagggggtgatggcggttggcttggtgagcattctggcctccagcttactccgaaacgacgtgcccatggcgggcccgctagtggccgggggtctgcttatcgcctgttacgtgataaccgggacctccgccgatctgacggtggagaaggcggcggacataacgtgggaggaagaggccgagcagaccggggtcagccataacctgatgatcaccgtggacgacgacggcacgatgcgtatcaaggacgacgagaccgagaacatcctaacagtactgctgaagaccgcccttctgatcgtctcgggcattttcccgtacagtatccccgctacactacttgtgtggcacacctggcagaaacaaacgcagaggtccggcgtgctgtgggacgtccccagcccgccggagacccagaaggccgagctggaggagggggtgtacaggatcaagcagcagggaatcttcgggaagacacaggtcggagtcggggtgcagaaggagggcgtgttccatacgatgtggcatgtcacacggggcgcggttctcacgtacaacgggaagcgcctagagccgaattgggccaatgtgaaaaaggatctgatctcctatggcgggggctggcggctcagcgcccagtggcagaagggggaagaggtccaggtcatcgcggtagagcccggcaaaaatcctaagaactttcagaccatgccgggcacgttccagaccaccactggggagatcggtgctatcgcgctcgactttaagccggggacatccggcagcccgatcatcaacagggagggcaaagtcgtggggttgtacggcaacggggtagtcaccaagaatggagggtacgtgtcgggcattgcccagactaacgccgagccggatggccccactccagaactggaggaggaaatgttcaagaagcggaacctcactatcatggatctacatcccgggtcaggcaaaacgcgaaaatacctcccggccatcgtgagggaggctatcaagcgccggttaagaaccttaatcctcgcgcccacccgggtggtggctgcagagatggaggaagcactcaaagggctgcccatccgttaccaaacaacggcgaccaagagcgaacacaccggacgagaaatagtggaccttatgtgtcacgcaactttcacaatgcgcctgctgtcccccgtccgggtaccgaactacaacctgatcattatggatgaagcccacttcaccgaccccgccagcatagccgcccgcggttacatatccacacgcgtgggcatgggcgaggcagccgccatattcatgaccgcgaccccgcccgggaccgccgacgccttcccgcaaagtaacgcgcccatccaggacgaagaacgggacatacccgagcgcagctggaacagtggaaacgagtggatcacggacttcgcaggcaagaccgtgtggttcgtgccctctattaaggcggggaacgacatcgcgaactgcctccgtaagaatggaaagaaggtgatccaactgagccgcaagacgttcgacacggagtaccaaaagacgaagctgaatgactgggacttcgtcgtgaccactgacatatcggagatgggcgccaacttcaaagcggaccgggtgatcgatccgcgccgatgcctcaagcccgtcatcctgaccgacggtcccgaacgcgttattctggccggacccatgccggtgacggccgcctctgccgcccagcggaggggccgggtcgggagaaaccctcagaaagagaacgaccaatatatctttaccggccagcccctcaacaatgacgaggaccacgcccactggaccgaggcaaagatgctgctcgataacatcaacactcctgagggaatcatccctgcactcttcgagcccgagcgggagaagtccgccgccatcgatggcgagtaccgcctcaaaggcgaatcccggaagaccttcgtggagctgatgagacgtggggacctccccgtttggctggcgcataaggtcgcctctgaaggaatcaagtacacagaccgcaagtggtgttttgacggacagagaaacaaccagatcctggaggagaacatggacgtggagatttggaccaaggagggtgagaagaagaagctccgcccccggtggctggacgcacgaacatacagcgacccgctggccctgaaggagttcaaggagttcgccgcaggaagaaagagtatcgcactggacctggtgacggagatcgggcgtgtacccagccacctcgcccacagaacaagaaatgccctggacaacctggtgatgctccacacgtccgagcatggtgggcgagcctaccggcacgcggtcgaggagctgcccgagaccatggaaaccttactcctgttaggactcatgattctgctaaccgggggcgccatgctgttcttgattagcggcaagggcataggcaagactagcattggtctcatctgcgttattgcttcctccggaatgttatggatggcggagatcccgctccagtggatcgcctcggctatcgtgttagagttcttcatgatggtcctgctgatcccggaacccgagaagcagaggacgccgcaggacaaccaattggcctatgtggtgattgggatactcacgctagccgccatcatagccgcgaacgagatgggcctgctcgaaaccaccaagcgggacctgggtatgagcaaggaaccgggggtcgtgtcccccacgagctacctggatgtggacctgcatcctgcttccgcgtggacgctgtatgccgtcgcaacgaccgtgataacgcccatgctgagacataccatcgagaacagcactgccaacgtgtccctcgcggccatcgccaaccaggcggtggttctgatgggcctggacaaagggtggccgatttctaaaatggacctcggagttccattactggccctcgggtgctactcacaggtgaaccctctgacgttgaccgccgccgtgctcctgctgatcacccactacgccatcatcgggcctggcctgcaggcgaaagccacccgggaggcacagaagagaacagccgccgggattatgaagaacccaacggtggacggcatcatgaccattgacctagaccccgtgatctatgacagcaagtttgagaagcagctgggccaggtgatgctattggtgttgtgcgcggtccagctcctgttaatgcggactagctgggctctatgcgaggcccttaccctggccacgggtcccatcaccaccctctgggagggcagccccgggaagttctggaacaccaccatcgcagtctccatggcgaatatctttcgcggcagctacctggccggggcaggcctagcgttctccatcatgaagtcggtggggaccggcaaacggggcaccgggtcccagggcgagaccctcggggaaaagtggaagaagaagctgaaccagttaagccgcaaagacttcgacctctataagaagtccgggataactgaggttgaccgcacggaagcgaaggagggcttgaagcgcggcgagatcacccaccacgccgtgagtcggggcagcgccaagttgcagtggtttgtagagcgcaatatggtaatcccggagggacgggttatcgacttaggctgcgggcgcggcggttggtcgtattactgcgccggactgaaaaaggtgactgaggtgcgaggctataccaagggcggacccgggcatgaggaaccggttcctatgtctacctacggctggaacatcgtgaaactgatgtccgggaaagatgtattttatctgccgcccgaaaagtgtgacaccctgctgtgcgacatcggcgagagctccccatccccaacggtggaggagtcgcgcaccatacgcgttcttaagatggtcgagccgtggctaaagaataaccagttctgcatcaaggttttaaatccctatatgcccaccgtgatcgaacatctggagaggctacagcggaagcacggcggcatgctcgtccgcaaccctctgtcacggaactccacgcacgagatgtactggatttccaatggcaccgggaatatcgtggcctccgtgaatatggtcagccgcctcttgctgaaccgctttaccatgacacacaggcgcccgactattgagaaggacgtagacctcggcgcgggcacacggcatgtcaatgctgagccagagaccccaaacatggacgtcatcggggagcgcatcaagcgtattaaggaggagcataactccacttggcactacgacgatgaaaacccgtacaagacctgggcttaccacgggtcctacgaggtcaaagccaccggttccgcaagctccatgatcaacggcgtggtcaagttgctgaccaagccctgggacgtggtccccatggtaacgcagatggcgatgaccgacaccacacctttcggccaacagcgcgttttcaaggagaaagttgacacgcgaacgccgcggtccatgcccggtacccggcgtgtaatgggcatcacggctgagtggctttggcgcacgttggggcgcaacaagaaaccccggttgtgcactcgcgaggagttcaccaagaaagtgcgcactaatgccgccatgggagcagtgttcacggaggagaatcaatgggactcagccaaggctgccgtggaggatgaggacttctggaaactcgtggacagagagcgtgagctgcacaagctggggaaatgcggctcatgtgtctacaacatgatggggaagcgagagaagaaacttggcgagttcggcaaggctaaggggagccgagccatctggtacatgtggctgggcgcccgatacctagagttcgaagcgttggggttcctgaacgaggaccattggtttagccgcgaaaactcctactccggcgtggaaggggagggcctccacaaacttggatacatcctgcgggatatcagcaaaatccccggtggcgccatgtacgctgacgacaccgcggggtgggacacccgcattactgaggatgacctgcacaacgaggagaaaataacgcagcagatggaccctgaacaccggcagctcgcgaacgcgattttcaagctcacctaccagaacaaggttgtcaaggtccagcgcccaacccccacaggaaccgttatggacatcatatccaggaaggaccagcgcggcagcgggcaggtcggaacatacgggcttaacaccttcaccaacatggaggcccagctcatccggcagatggaaggcgaaggggtgctgtccaaagccgatctggagaacccgcacttgcccgagaagaagatcacccagtggctggagacgaagggcgtggaacgcctgaagcggatggcgatcagcggtgatgattgcgtcgtgaagcccatcgacgaccgctttgcaaatgctctattagccctgaatgacatggggaaagtcaggaaagacatcccccagtggcagccctccaagggctggcatgattggcagcaagtgccgttttgcagccaccacttccatgagctcataatgaaggacggccgcaagctggtggtcccttgccgaccccaagacgagctaatcgggcgcgctcggatctcccagggggcgggctggagcctgaaagaaacggcctgcttgggcaaggcctacgctcagatgtggtccctgatgtacttccaccgccgcgacctccgactggcaagcaatgccatctgctcagcggtcccagtgcactgggtgccgactagccgcactacttggagtatccatgctcatcaccaatggatgaccaccgaggacatgctgacggtctggaacagggtgtggatcgaggacaacccctggatggaggataagacccccgttaccacctgggagaatgtcccgtacctcgggaagcgcgaggaccagtggtgcggatcgctgatcggtcttacgagccgggccacgtgggctcagaacataccgaccgccattcagcaggtaaggagtctcataggcaacgaggagtttctggactacatgcccagcatgaaaagattccggaaggaggaggagtccgagggggccatttggtaa

SEQ ID NO: 25807 - RNA, 9873 nt, synthetic construct
  misc_feature 1..9873: note = derived and/or modified CDS sequence (opt11) from DENV-3__GQ199862__SS-prME
  source 1..9873: mol_type = other RNA
accagcctttgcctcatgatgatattacccgcggccttagcgttccaccttacctcaagggacggggagccgcgtatgatcgtgggtaagaacgagagggggaagagcctgctgttcaagaccgcctcggggatcaacatgtgcaccctcatcgcaatggacttgggagagatgtgcgacgacaccgtgacctacaagtgcccccacatcaccgaagtggagcctgaagatatcgactgctggtgtaacctgaccagcacctgggtgacctacggtacgtgcaaccaggccggcgaacacaggcgcgacaaacgatcggtggccctcgcgccccacgtgggcatgggtctggatacccgcacccagacatggatgagcgccgaaggcgcctggcgccaggtggagaaggtagagacgtgggccctgcgccacccggggtttaccatcctcgcgttattcctggcccattacatcggcacctccctcacccagaaagtggtgatctttatcctgctaatgttggtcacacccagtatgaccatgcggtgcgtgggggtgggcaatcgcgatttcgtcgagggcctgtccggcgcaacgtgggtggacgtggtcctggagcatggcggctgcgtgacgacgatggccaagaacaagcctaccctcgacatcgagctgcaaaagaccgaggccacccaactggcgacgctacggaaactgtgcatcgaaggaaagatcaccaacatcaccaccgacagccgctgcccaacgcagggcgaggccaccctgccagaggagcaggaccaaaactacgtgtgcaagcacacctacgtcgaccggggttggggcaacgggtgtggcttgttcggcaaaggctccctggtgacctgcgccaagttccagtgtctggagcccatcgagggcaaggtggtccagtacgaaaacctcaagtacacggtgatcatcaccgtgcataccggggaccagcaccaggtcggcaacgaaacccagggagtaaccgccgagatcactccgcaggccagcaccaccgaagccatcctgcccgagtacggcaccctgggactcgagtgctcccctcgcacaggcctggactttaacgagatgattctgcttaccatgaagaacaaggcctggatggtccaccggcagtggttcttcgatctgcccttaccctggacctctggcgctaccacggagacacccacctggaaccgcaaggagctcctggtgaccttcaagaacgcccacgcgaagaagcaggaggttgtcgtactggggagccaggagggcgcgatgcacacagccctgaccggggccaccgagatccaaaacagcggcgggacctccatcttcgccggccacctgaagtgccgtctgaaaatggacaagctagagctaaagggtatgtcatacgccatgtgcacgaataccttcgtgttgaagaaagaggtctccgagacccagcacgggaccatcctcatcaaggtggagtacaagggcgaagacgtcccgtgcaaaatccccttcagcacggaagacgggcagggcaaggcgcacaacggcagactgataaccgccaaccccgtcgtgaccaagaaagaggagcccgtgaacatcgaggccgagccgccgttcggggagtcgaatatcgtcatcggcatcggtgataacgccctgaagatcaactggtacaagaagggctccagcatcggtaagatgttcgaggcgaccgcccggggcgcccgccggatggccatcctgggcgacaccgcctgggacttcgggtctgtggggggggtgctcaactcactgggcaaaatggtccaccagatcttcgggtccgcgtacaccgctctctttagcggtgtgtcctgggtgatgaaaatcggcatcggtgtgctcctcacctggatcggcttgaactctaagaatacctccatgagcttcagttgtatcgccatcgggatcatcacgctctatctcggcgcggtcgtccaggccgacatggggtgcgtcatcaactggaagggcaaagagctgaagtgtggcagcgggatttttgtgaccaacgaagttcacacctggaccgagcagtacaagttccaagcggactccccgaagagattggccacggccatcgccggcgcctgggaaaacggtgtatgcggcatccgcagcaccacccggatggagaacctgctctggaagcagatcgctaacgagctcaactacatcttatgggagaacaacattaaactgaccgtggtggtcggggacatcatcggcgtcctcgagcagggtaagcgcacgctgacgccccagccgatggagctgaaatactcctggaaaacctgggggaaggcaaagatcgtgaccgccgaaacgcagaacagctccttcatcatcgacggccctaacacccccgaatgtcccagcgtctcgagagcgtggaacgtatgggaggtggaagactacgggttcggcgtcttcactaccaacatctggctcaagctgcgtgaggtgtacacccagctgtgcgaccatcggctcatgagcgcggccgtgaaggacgagcgcgccgtccacgctgacatgggctactggatcgagagccaaaagaacgggtcctggaagctggagaaggcctctctaatcgaggtgaagacgtgcacctggccgaagtcccacactctctggtcgaacggcgtgctggagtccgacatgatcatacccaagagcctggcggggcccattagccagcataaccaccggccgggctaccacacccaaacggccgggccctggcacctcggcaagctggaactggacttcaactattgtgagggcaccaccgtcgtgatcaccgagaactgcgggacacgcggccccagtcttaggacaaccactgtgtccggaaagcttatacacgagtggtgctgccgcagctgcactctgcccccgctccggtacatgggcgaggatgggtgctggtacggtatggagatccgccccatctccgagaaagaggagaacatggtcaaaagcctggtatccgccggcagcgggaaagtggacaacttcaccatgggcgtgctgtgcctcgcaatacttttcgaggaggtgatgcgagggaaattcggcaagaagcacatgatcgctggggtgttcttcaccttcgtgctgctcctgtccggccaaattacctggcgcgatatggcgcacacgctgatcatgatcggcagcaatgcctccgaccggatggggatgggggtgacgtacctcgccctgatcgcaacattcaagatccagcccttcctggccttggggttcttcttgcgcaagctgaccagcagggagaacctcctgctgggcgtcggactcgcgatggccacgactctgcagctgcccgaagatatcgagcagatggccaacggcatagcactcggcctgatggccctgaagctcattacgcaattcgagacctaccagttatggacggccctgataagcctgacctgctccaacaccatattcaccttaacggtcgcctggcgcaccgccacactcatcctcgccggggtgagcttgctgccggtctgtcaatcctcgtccatgcggaagactgattggctccccatggcggtggccgccatgggcgtcccgcccttgccgctgttcatcttctctctcaaagacaccttaaagagacggtcctggcccctgaacgagggggtcatggcggtaggactcgtgagcatcctcgcgtcctcactgctcaggaacgatgtccccatggccggacccctagtggccggtggcctgctcatcgcctgctacgtgatcaccgggacctccgcagacctgactgtcgagaaggccgcggacatcacgtgggaggaggaggcagagcagaccggggtgtctcacaacctgatgatcaccgtcgacgacgacggtaccatgcgcattaaggacgatgagaccgagaacatcctaacggtcctgctcaagaccgccctcctgatcgttagcggcatttttccatacagcatcccggccaccctgctcgtatggcacacctggcagaaacagacgcagcggtcaggcgtcctgtgggacgtgcctagcccgcccgaaacccagaaagcagagctggaggaaggggtgtacaggatcaagcagcagggcatcctcgggaagacccaggtgggcgtgggagtgcagaaggagggcgttttccacacaatgtggcacgtgacgaggggcgccgtgctgacttacaacgggaagcggctggagcctaactgggcctccgtcaagaaagacctaatctcgtacggcgggggctggcggttatccgcccaatggcagaaaggggaggaggtccaggtaatcgccgtggagcccggaaagaaccccaaaaacttccagaccatgcccggcaccttccagacgacgaccggggagataggcgcgatcgctcttgattttaagcccgggacgagcggcagccccatcattaaccgcgagggtaaggtggtggggctgtacggaaacggggtggtgacgaagaacggcggctacgtgagcggcatcgcccagaccaacgccgagccggacggacctacccccgagctcgaggaggagatgttcaaaaaacggaacctgaccatcatggacctacacccagggagcggcaagacgcgcaagtacctcccggccatcgtccgggaggctatcaagcgccggctgcgcacactgatcctggcccctacgcgggtggtagccgctgagatggaggaggccctgaaggggcttccgatccgctaccagaccacggcgactaagagcgagcacaccggccgggagatcgtcgacctcatgtgccatgctaccttcacgatgcgattattatcacccgtgcgagtaccgaactataacctaatcatcatggacgaggcccacttcaccgacccagccagtatcgccgcgcgcgggtacataagcacccgggtcgggatgggcgaggccgcggccatcttcatgactgcgaccccccctgggaccgcggacgctttcccgcagtccaacgccccgatccaggacgaggagagggacatccccgagcgctcatggaactccgggaatgagtggatcacggacttcgcggggaagacagtgtggttcgtcccctcaatcaaggcaggcaacgacatcgccaactgcctgcggaagaacggcaagaaggtcatccagctcagcaggaaaacattcgatactgaataccagaagaccaagcttaacgactgggacttcgtcgtaacgaccgacataagcgaaatgggcgcgaatttcaaagcggatcgggtaatcgacccgaggcgctgcctgaagcccgtgatcctaaccgacggccctgaaagggtgatcctcgccgggcccatgccggtcaccgctgcctcagccgcccagcggcgcggccgcgtggggagaaacccccagaaagaaaacgaccagtacatattcaccggccagcccctgaacaacgacgaggaccacgcacactggaccgaggccaagatgctgctcgacaacatcaacacgccagaggggataattcccgccctattcgagcccgaacgcgagaagtccgccgccatcgatggcgagtaccgtctgaagggcgagtcccggaaaacctttgtggaactcatgcgccgcggggacctgcccgtctggctggcgcataaggtggcctccgagggcatcaagtataccgaccgcaagtggtgcttcgacggacagcggaacaatcagatcctcgaggagaatatggacgtcgagatctggacaaaggagggggagaagaaaaagttgcgcccgcgatggctggacgcccggacgtacagcgacccgttagccctgaaggagttcaaggaattcgctgcggggcgcaagagcatcgccctggacctcgtgaccgagattgggagggtgccctcccacctggctcaccgcacacggaacgccctggacaatctcgtcatgctgcacaccagcgagcatggaggtcgcgcctaccgccacgctgtggaggagctgccggagacgatggagaccctcctgctactcggcctgatgatcctgctcaccgggggcgcaatgctgtttttgataagcggcaagggaatcggcaagacctccatagggctgatctgcgtgatcgccagctccggcatgctatggatggccgaaatcccgctgcagtggatcgccagcgcgatcgtacttgaattcttcatgatggtgctactgatacctgaacctgagaagcagcgcacaccccaggacaaccagttggcctacgtggtcatcgggatccttaccctagcagccataatcgcggcgaacgagatgggactcctggagactacgaagcgggacttaggcatgtcgaaggagccgggggtggtttcacccacgagctacctcgacgtcgacctgcaccccgcctcggcttggaccctgtacgccgtggcgaccaccgtgatcacgcccatgctacgccacaccatcgagaactccacggccaacgtcagcctggccgccatcgccaaccaggcggtggtgctgatgggcctcgacaaggggtggcccatttccaagatggacctgggcgtccccctcttggctctggggtgctactcgcaggtgaaccccctgacccttaccgcggctgtgctgctgctcatcacgcactatgccatcatcggccccggcctccaggcgaaggccactcgagaggctcagaaacgcaccgccgccggcatcatgaaaaacccgactgttgacggcataatgacgatcgacctggaccccgtgatctacgactccaaattcgagaagcagttagggcaggtgatgctgctggtcctctgtgcggtgcagctgctgctcatgagaaccagctgggcactgtgcgaggccttgacgctcgcgacgggccccgtgaccaccctctgggagggctcccccgggaagttctggaacaccacgatcgcggtcagcatggccaatatattcagaggttcctacctggccggagccggcctcgccttcagcatcatgaagagcgtcgggaccgggaagcggggcaccgggtcccagggcgagacattaggggagaagtggaagaagaagttaaaccaattaagccgcaaggacttcgacctgtacaagaagagcggcatcaccgaagtggacaggacggaggcgaaggaggggctgaagcgcggcgagatcacacaccatgcggtctcccggggctcggccaagctccagtggttcgtcgagcgcaatatggtgatcccggagggacgggtcatcgatctgggctgcgggcgcggcgggtggtcgtactactgcgccggcctgaagaaagtgaccgaggtacggggctacacaaagggcgggcccggccacgaggagcccgtgcccatgtccacgtacggctggaatatcgtgaagctaatgagcgggaaggacgtgttctacctgccacccgagaaatgcgacacacttctgtgcgacatcggcgaatccagcccctcccccacagtcgaggagagccgcaccatcagagtgctcaagatggtcgagccgtggctgaagaacaaccaattctgcatcaaggtcttgaatccctatatgcccaccgtgatcgagcatctcgagcggctgcaacgcaagcacggtgggatgctcgtgcggaatcccctatcccgcaacagcacccacgagatgtattggatctccaacggcactggcaacatcgtcgccagcgttaacatggtgtcacggctgctgctcaaccgcttcaccatgacgcaccggcgccctaccatcgaaaaggacgtcgacctgggcgcgggtacccgacatgtaaacgcggaacccgagacccccaacatggacgtgatcggggagcgcatcaagcgtatcaaggaggagcacaattctacgtggcactatgacgacgagaacccgtacaagacctgggcctatcacggctcctacgaggtcaaggccaccgggagcgcctcctcaatgatcaatggcgtggtaaagctgctcaccaagccctgggacgtggtgcccatggtcacccagatggcaatgaccgacaccacccccttcggacaacagcgcgtgttcaaggaaaaagtggacacacggaccccgcgcagcatgcccggcaccaggcgcgtaatgggcatcaccgccgagtggctgtggcgtacgctgggaagaaacaagaaaccccggttatgcacccgcgaagaattcacaaagaaggtccgcaccaacgccgccatgggcgcggttttcacggaggagaaccagtgggacagtgccaaggccgccgtcgaggacgaggacttctggaagctagtggaccgggagagggagctgcacaagctcgggaagtgcggcagttgcgtgtacaacatgatggggaagcgggagaagaagctgggcgagttcggcaaggccaaggggtcgcgcgcgatctggtacatgtggctgggggcccggtacctagagttcgaggccctggggttcctgaacgaggatcactggttcagccgcgaaaactcctattccggggtcgagggggagggcctccacaagctgggctacatcctccgcgacatctcaaaaatacccggcggcgccatgtacgccgacgataccgcggggtgggacacccgtataaccgaggacgacctccacaacgaggaaaagataacgcagcagatggacccagagcaccggcagctcgccaacgccatcttcaagctgacgtaccaaaacaaggtggtaaaggtccagcgccccacccccaccggcactgttatggatatcatcagccggaaggaccagcggggcagcgggcaggtgggtacgtacgggctcaacaccttcaccaatatggaggcccagctgatacggcaaatggaaggcgagggtgtcctgagcaaggccgacctcgaaaacccccacctccctgagaagaagatcactcagtggctggaaacgaagggagtggagcgcctgaaacggatggcaatctccggagacgactgcgtggtcaagcccatcgacgaccggttcgccaacgccctgctggccctcaatgacatggggaaggtgcggaaggatattccgcagtggcagcccagcaagggctggcacgactggcagcaggtcccgttctgctcccatcactttcacgagctgatcatgaaggacgggcgcaagctggttgtgccctgtcggccccaggacgagctcatcggtcgtgcccggatcagccaaggggcgggctggtccctgaaggagaccgcctgcctcggcaaagcctacgcccagatgtggagcctcatgtacttccaccgccgcgacctgcgtctagcctcgaacgctatatgcagcgcggtgcccgtccattgggtgcccacctcccgcaccacgtggagcatccacgcacaccaccagtggatgaccacagaggacatgttaacggtctggaaccgcgtctggatcgaggacaacccctggatggaggacaaaacgccggtgaccacctgggagaacgtgccctacctggggaagcgcgaggaccagtggtgcggcagcctgatcggacttacctcccgggcgacgtgggcgcagaacatcccgaccgccatacaacaggtccgcagcctgattggcaacgaggagttcctggactacatgccctccatgaagcggtttcgcaaggaggaggagagcgagggggccatttggtaa

SEQ ID NO: 25808 - RNA, 9873 nt, synthetic construct
  misc_feature 1..9873: note = derived and/or modified CDS sequence (opt11) from DENV-3__GQ199863__SS-prME
  source 1..9873: mol_type = other RNA
acttcactctgtctgatgatgatcctccccgcggcgttagcgttccatctcaccagccgggatggcgagccccggatgatcgtggggaaaaacgaacgcggcaaaagcctgctctttaagacagcttccgggataaacatgtgcacactcattgccatggacctgggcgagatgtgtgacgacaccgtgacctacaagtgcccccacatcaccgaagtagagccagaggacatcgactgctggtgtaacctcaccagcacttgggtcacgtatgggacctgtaatcaggcgggcgagcaccggcgcgacaagcgctccgtggccctcgcaccccacgtgggcatgggattagacacgcgaacccagacctggatgagcgcggagggcgcctggcgccaagtcgaaaaggtagagacgtgggccctgcgccacccgggtttcaccatcctagccctgtttctggcccactacataggcaccagtctaacccagaaggtggtgatcttcatcctgctgatgctagtcacgcccagcatgaccatgaggtgcgtaggggtgggcaatcgcgacttcgtggagggcctgtccggagccacgtgggtcgatgttgtcctggagcacggaggttgcgtgacgacgatggccaaaaacaagcccaccctcgatatcgaattacagaaaaccgaggcgacccagctcgccactctgcggaaactgtgcatcgaggggaagataaccaacatcacaacagacagccgctgtcccacgcagggcgaggccactctgcctgaagagcaggaccagaactacgtgtgcaagcacacctacgtcgaccgtggctggggcaacggatgcggcctcttcgggaagggatccctggtaacctgcgccaagttccagtgtctggagcccatcgagggcaaggtcgtccagtacgagaatcttaaatacaccgtgatcatcactgtgcacaccggggaccagcatcaggtcggaaacgagacgcagggggtgacggccgagatcacgccccaagcctcgaccaccgaggtcattttacccgagtacggcacactggggctcgagtgctccccgcgtaccggcctggacttcaacgagatgatccttctcaccatgaagaataaggcatggatggtacaccggcagtggttctttgacttacccctaccctggacctcaggggccacgacggagacccccacctggaaccgaaaggagctcttagtgaccttcaagaatgcccacgccaagaagcaggaggtcgtggtgctggggtcccaggagggcgctatgcacacggcgctaaccggtgccaccgaaatccagaactcaggcgggacctctatcttcgctggtcacctaaagtgccggttaaagatggataaactcgaactaaagggcatgtcttacgccatgtgcacgaacaccttcgtcctcaagaaggaagttagcgaaacccagcatgggaccatcctcattaaggtcgagtacaagggtgaagacgtcccgtgcaagatccccttcagcacggaagacgggcagggaaaggcccataatgggcgcctgatcaccgcgaaccctgtggtgacaaagaaggaggagcccgtgaacatagaggccgagccaccctttggggagagcaacatcgttatcggcatcggggataacgccctgaagatcaactggtacaagaaaggcagttcgatcgggaagatgttcgaggccaccgcgcggggcgctcgacggatggccatcctgggcgacacggcttgggacttcgggtcagtaggtggtgtcctcaacagcctgggcaagatggtgcaccagatctttggatccgcctacaccgccctgttctcgggcgtgtcctgggtcatgaagatcggcatcggggttttgcttacatggattggcctgaacagcaagaatacgagtatgagcttctcctgtatcgccatcggcatcattactttgtacctcggcgccgtggtccaggcagatatggggtgcgtgattaactggaagggaaaggagttaaaatgcgggagcgggatcttcgtgaccaacgaggtacatacctggaccgaacagtacaagttccaggccgacagtcccaagcgcctcgcgacggccatcgccggcgcgtgggagaacggcgtgtgcgggatccgctcgacaacccgaatggaaaacctgttgtggaagcagatcgcaaacgagctcaactacatcctatgggaaaacaacatcaaactgactgttgtcgtgggggacatcataggcgttcttgagcagggaaaaaggacgctgacaccgcagccgatggagctaaaatactcgtggaaaacctggggcaaggcgaagatcgtcaccgcagagacgcagaacagctccttcatcatcgacggccccaacacccccgagtgccccagcgtatcccgtgcctggaatgtgtgggaggtcgaagactacgggttcggagtgttcaccaccaacatctggctcaagctgcgcgaggtgtacacgcagctgtgcgaccatcggcttatgtcggccgcggtcaaggacgagcgcgcagtccacgccgacatgggctactggatcgagagccagaagaacgggagttggaagctggagaaggcaagcctgatagaggtgaagacgtgtacctggccaaaatcccacacgctctggagcaacggcgtgttagagtcagacatgattatccccaagagcctggccgggcccataagtcagcacaaccaccggccgggctatcacacccagaccgcggggccatggcatctcggcaagcttgaactagacttcaactactgcgagggcaccacggtggtgataacagagaactgcgggacgcgcggaccgagcctccggacaactaccgtctccgggaagctgatccatgaatggtgctgccgcagttgcacgctgcccccgctccggtacatgggcgaggacgggtgctggtacgggatggagatccggcccatctccgagaaggaggagaatatggtcaagagcctcgtgtccgccggctcagggaaggtcgacaacttcaccatgggcgttctatgcctagccatcctgttcgaagaagttatgcgggggaagttcggcaagaagcacatgatcgcaggtgtcttcttcaccttcgtgttactgctctccggccagatcacctggcgcgacatggcccacacgctgatcatgatcggtagcaacgcatccgaccggatgggcatgggcgtgacttacctcgctctcatagccaccttcaagatccagccattcctggccctcgggttctttctgcgcaagttaactagcagggagaatctcctcctgggcgtcggcctcgctatggcgacgactttacagcttccagaagacatcgaacaaatggccaacgggatcgccctgggcttaatggccttaaagctcatcacgcagttcgagacttaccaactgtggacggccctgataagcctaacctgctccaacaccatcttcaccctgacagtagcttggcgcacagccaccctgatcctcgccggtgtaagcctgctgccggtgtgccagtccagctccatgcggaaaacggactggctccctatggccgtggcggccatgggcgtgccgccccttccgctgtttatcttcagtctcaaggacacgcttaagcgacgttcctggccccttaacgagggggttatggccgtcggcctcgtctcaattctggcctcaagcctgctccggaatgatgtgcctatggccggccccctggtggccggcgggctgctcattgcatgctatgtcataaccgggacttccgccgatctaacagtggagaaagctgccgacatcacttgggaggaagaggcggagcagacgggggtgagccacaacttgatgatcaccgtcgacgacgacgggacaatgcgcattaaggacgacgagaccgagaacatcctaacggttcttctgaagactgccctcctgatcgtgtccggaattttcccctatagcatccccgccaccctgctcgtctggcacacctggcagaagcagacccagcggtcaggcgtgctatgggacgttccgtccccgccggagacccagaaggcggaactggaggagggggtatacagaatcaagcagcagggcatatttgggaaaacccaggtaggcgttggggtccagaaggagggcgtgtttcacaccatgtggcacgtgaccaggggcgccgtcctcacatacaacgggaagagactggagcccaattgggcgtccgtgaagaaggatctgatcagctacggcgggggctggcgattatccgcccaatggcagaagggggaggaggttcaggtcatcgccgtagagcccggcaagaaccccaagaacttccagaccatgcccggcaccttccagacgaccacgggggagatcggcgccatcgctctggatttcaagcctggaaccagcggcagcccgatcatcaaccgcgagggcaaagtcgtagggctgtacggcaacggcgtggtgaccaagaacggagggtacgtctccggcatcgcacaaacgaacgccgagccggacggcccgacccccgagttggaggaggagatgttcaaaaagaggaacctcacaattatggacttacaccccggaagcggtaaaacgcgcaagtacctgcccgccatcgtgcgggaggccatcaagcgcagactccgcaccctgatcctagcgcccactcgcgtggtcgcagctgagatggaggaagcgctcaaggggctccccatcagataccagactacggccaccaagtccgagcacactggccgggagatcgtggacttaatgtgccacgcgaccttcacgatgcgcctccttagccccgtgcgggtcccgaactacaaccttatcatcatggatgaggcccacttcaccgaccccgcctccatagccgcgcgagggtacataagcactcgggtcggcatgggcgaggcagccgccatcttcatgaccgccaccccgcccgggaccgcggatgcgttcccacaatccaacgcgcccatacaggatgaggagagagacatacccgagagaagctggaattccggcaacgagtggattactgactttgccgggaagacagtgtggttcgtccccagcatcaaggcgggcaacgacatcgctaactgcctccggaagaacgggaagaaggttatccaactgagcagaaagacgttcgataccgagtaccagaagaccaagttgaatgactgggacttcgtcgtcaccacagacatcagcgagatgggtgccaacttcaaggccgacagagtgatcgatccgcgccggtgcctcaaaccagtaatcctgacagacggccccgagcgcgtaatcctggccggtcccatgccagtgaccgctgcgtccgccgcccagcggcgcggtcgggtgggcagaaacccacagaaggagaacgaccagtacatatttaccggccagcccctcaacaacgacgaggaccacgcccactggaccgaggccaagatgctgttagataacattaacactcccgaggggatcatccctgccctttttgagcccgagcgggagaagtccgccgccatcgacggcgagtacaggctaaagggcgaatcccggaagacctttgttgagctaatgcgccgcggggatctcccggtgtggctggcgcacaaagtcgcgagcgagggcatcaagtacacagaccgcaagtggtgcttcgacgggcagagaaacaaccagatcctggaggagaatatggacgttgagatctggaccaaggagggagagaaaaagaaacttcgcccccggtggctggacgcgcgcatctactcagacccgttggcgctaaaggagttcaaggaattcgccgctggccgcaagtcgatcgctctggatctggtgactgagatagggcgggtcccctcccacctggcccatcgtacgcgcaacgccctggataatctggtcatgctccacaccagcgagcacggcgggcgcgcctaccggcacgccgtggaagagttgcccgaaaccatggagacgctgctcctgctggggctgatgatcctgctcaccggaggcgcgatgctgttcctaatcagcggcaaagggatcggcaagacatccatcgggctgatctgcgtaatcgccagctccggcatgctctggatggcggagataccgctgcagtggattgcaagcgccattgtcctggaattcttcatgatggtgctcctgatcccggaacccgaaaagcagcgcacgccacaggacaaccagctggcctacgtcgtgatcgggattctcaccttagctgccatcatcgcggccaatgaaatgggcctgctcgagacgaccaagagggacctggggatgtccaaggaacctggtgtggtcagccccacctcctacctggacgtggatcttcaccccgcgagcgcctggacgctgtacgccgtggccactaccgtcatcactcccatgctgcgccacacgatcgagaactccactgcgaacgtgtctctcgccgccatcgccaaccaagcagtcgtcctgatgggtctggacaaggggtggcctatttccaagatggacctcggcgtgccgttactggctctagggtgctacagccaggtgaaccccctgaccctaaccgccgccgtactactgctgataacgcactatgcaataataggccccggcctgcaggccaaggcgaccagagaagctcagaaacgaaccgccgccgggatcatgaagaacccgacagtggatggcatcatgacgatagatctggacccagtgatctacgactccaagttcgagaagcagctggggcaggtcatgctccttgttctgtgcgccgtgcaactgctgttgatgcgaacgagctgggctctctgtgaagcactgaccttggcaaccggcccaataacgaccctgtgggagggctcccccgggaagttctggaacaccacgatcgctgtgagcatggcgaacatattccgcggatcgtacctggcgggggccggactggctttcagcattatgaagtccgtggggactggcaagcgggggaccgggtcccaaggcgagaccctcggggagaagtggaagaagaagttaaaccagctaagccgcaaggacttcgacctgtacaagaaatccggcatcacggaggtggaccgtactgaggccaaggaggggctaaagcgcggtgagatcacgcatcacgcggtgagcaggggctctgccaagcttcagtggttcgtggaacgcaacatggtgatcccggaggggcgggtcatcgacttgggctgcggccgtggtgggtggagctactactgcgccgggctgaagaaagtgaccgaggtgagagggtacaccaagggcggtcccgggcatgaagaacccgtccccatgtccacctatggctggaatatcgtgaagctgatgagcgggaaggacgtattctacctcccccccgagaagtgcgataccctactgtgtgacattggcgaatccagcccgtcccccaccgtcgaggagtcccgcacgatccgcgtgctgaagatggtggagccgtggctcaagaacaatcaattctgcatcaaagtcctgaacccttacatgcccacagtgatcgaacacctggaaagattgcagaggaagcacggagggatgctggtacggaaccccttgtcacgcaacagcacgcacgagatgtactggatatcaaatggcaccgggaacatcgtcgcctcagtgaacatggtgtcccggctcctgctgaaccgcttcactatgacccaccggcgccctacgattgagaaggacgtagacctcggcgccggcacccggcacgtgaatgcggagcccgagacgcccaatatggacgtaatcggggagcgcatcaaaagaatcaaggaagagcacaattcaacctggcactacgatgatgaaaacccgtacaagacctgggcctaccacggctcctacgaagtcaaggccacaggcagcgcctcctcgatgatcaacggagtggtcaagctgctgacaaagccatgggacgtggtgcccatggtcacccagatggcaatgacggacacaaccccctttgggcagcagcgcgtcttcaaggagaaggtggacacccggacgccccggagcatgcctgggacccggcgcgtcatggggatcaccgcggagtggctttggcggaccctggggcggaacaagaagccacgactgtgcacgcgcgaggagttcacaaagaaggtgcgtaccaacgccgccatgggcgccgttttcacagaggagaaccaatgggattccgcgaaggccgctgtagaagacgaggacttctggaagctcgtggaccgggagcgagaacttcataagctggggaagtgtggcagctgtgtgtataacatgatggggaagcgggaaaagaaactcggcgaattcgggaaggccaaagggtccagggcgatctggtacatgtggctgggagcacggtacctcgagttcgaggctctcgggttcctgaatgaagaccattggttcagtcgagaaaactcatatagcggcgtagagggggagggcctgcacaagctgggctacatcttgcgggacatctccaagattcccgggggtgccatgtacgccgatgacacggccggatgggatacccgtatcaccgaggacgacctgcacaacgaggagaagatcacccagcagatggacccagagcaccggcagctcgctaacgccattttcaagcttacgtaccagaacaaggtagtgaaggtccagcgccctacccccaccgggaccgttatggacatcatcagccggaaggaccaacgcggctccggccaggtgggcacctatgggctgaacacgttcaccaacatggaggctcagctcatcagacaaatggagggggaaggagtcctgtccaaggccgatctggagaatccccacctcccggagaagaagatcacccagtggcttgaaaccaagggcgtggagcgcctcaagcggatggcaatctctggcgacgattgtgtggtcaaaccaatcgacgacagatttgccaacgcgctcctggccctaaacgatatggggaaagtgcgtaaggacattccccagtggcagcccagcaagggctggcacgactggcagcaggttccgttctgctcgcaccatttccacgagcttatcatgaaggacggtcgtaagctggtcgtgccctgccggccccaggacgagctgatcggccgcgcccggattagccagggtgccgggtggtccctcaaggagacggcatgcttaggcaaagcctatgcccagatgtggtccctgatgtatttccatcgccgcgacctccggctggcgtccaacgctatctgcagcgccgtgcccgtccactgggtgccgacctcccgcaccacctggagcatccacgcccaccaccagtggatgacgacagaggatatgctgaccgtatggaaccgggtctggatcgaggacaacccctggatggaggacaagacgcccgtgacgacctgggagaacgtgccctatctcgggaagcgcgaggaccagtggtgcggaagcctgatcgggctgacctcccgggccacgtgggcacagaacattccaacggctatccagcaagtccgctccttaatcggcaacgaggagtttctggactacatgccctcaatgaaacggttcagaaaggaggaggagagcgagggggccatatggtga

SEQ ID NO: 25809 - RNA, 9873 nt, synthetic construct
  misc_feature 1..9873: note = derived and/or modified CDS sequence (opt11) from DENV-3__GQ199864__SS-prME
  source 1..9873: mol_type = other RNA
acgagcctctgcctaatgatgatactgcccgcagctctggcctttcacctcaccagccgggatggggagcctaggatgatcgtcgggaagaacgaaagaggcaagtccctgctattcaagaccgcctccgggatcaacatgtgcaccctcatcgccatggatctgggggagatgtgcgacgacaccgtcacctacaagtgcccccacatcaccgaggtagagcccgaggacattgattgctggtgcaacctgacctcgacctgggtgacctacgggacgtgtaaccaggccggcgagcaccggcgcgacaagcggtccgtagccctcgctccccacgtgggcatgggtctgaacacccgcacgcagacctggatgagcgccgagggcgcctggcgccaggtggaaaaggtggaaacatgggccctgcgccaccctgggttcaccattctcgcgctgttcctggcgcattacatcgggacctccctcacccagaaggtggtaatcttcatcctgctgatgcttgttacccccagcatgaccatgagatgcgtgggggtcggcaaccgggatttcgtcgaggggctgtccggggctacctgggtggatgtggtcctggagcacggagggtgtgttactacgatggccaagaataaacccacactcgacatcgaactccagaagaccgaggccactcagctggcaacgctgcggaagctgtgcatcgagggtaagataaccaacatcaccaccgactcgcgatgcccaacgcagggcgaagccaccctgcccgaggagcaggaccagaactacgtgtgcaagcacacatacgtcgaccgggggtggggcaacgggtgtggtctctttgggaaaggcagtttagtgacctgcgccaagttccaatgcctggaaccgatcgagggcaaggtagtccagcacgaaaacctcaagtacactgtcatcatcaccgtgcacacaggggaccagcaccaagtgggcaacgagacccagggggtgacggccgagatcacgccccaggcctcaaccaccgaagctatactgccggagtacggcactctggggctcgagtgttcgccgcgcacgggcctggattttaatgagatgatactactcacaatgaagaataaggcatggatggttcacagacagtggttcttcgacctgcccctgccctggacatctggggccaccacggagacccccacctggaaccgcaaggaactcctggtgaccttcaagaacgcacacgccaagaaacaggaggtcgtcgtgttgggttcccaagagggtgcgatgcatacggccctcaccggggcgaccgagatccagaacagcggtgggacttccatcttcgcaggccacctgaagtgccgtctgaagatggacaagttggagctaaagggtatgagctatgcaatgtgcacgaacacatttgtgctcaagaaggaagtatccgagacacaacacgggactatcctcatcaaggtggagtacaagggcgaggacgtaccgtgcaagatcccattttcaacggaggacgggcaaggtaaagcccacaacggccgcctgatcaccgcgaacccggttgtaacgaagaaggaggaacccgtgaacatcgaggccgaaccgccctttggggaaagcaacatcgtcatcggcataggggataatgccttaaagattaactggtacaaaaagggctcctcgataggcaagatgtttgaggctaccgcccgcggggcacggcggatggccatcttaggcgacacagcgtgggattttgggtccgtgggcggcgtgctcaactccctcggcaagatggtccatcagatcttcggatccgcgtatactgccttattcagcggcgtttcctgggtgatgaagatcggcatcggggtactcctgacctggatcggcctgaactccaagaacacatccatgagcttctcctgcatcgcgatagggataatcacgttatacctgggcgccgtggtccaggccgacatggggtgcgtcatcaactggaaaggcaaagagctgaagtgcggctccgggatcttcgtcaccaacgaggtgcacacctggactgagcagtacaagtttcaagccgactcgccaaagcgactcgccaccgccatcgccggggcgtgggagaatggggtctgcggcatccgctcgaccacgcggatggagaacctattgtggaagcaaatcgcgaacgagctcaattacatcctgtgggagaacaatatcaagctgaccgtggtggtcggggatatcatcggcgtcctcgagcagggtaaacgcacgctgacaccccagccgatggagcttaaatacagctggaagacatgggggaaggccaagatcgtaaccgccgagacgcagaacagcagcttcataatcgacggcccaaatacccccgagtgccctagcgtctcccgggcatggaacgtctgggaggtggaagactacgggtttggcgtcttcaccaccaacatctggctcaagctgcgcgaggtgtacacccagctgtgcgaccatcggttaatgagcgcggccgtgaaggacgagcgcgccgtccatgcagacatgggctactggatcgagagccaaaagaacggctcctggaagttagaaaaggctagcctcatcgaggtaaagacgtgcacctggccgaagtcccataccctctggagcaacggggtcttagagtccgacatgatcatccccaagagcctggccgggcccatctcccaacataaccaccggccgggctaccacacccagacggccgggccgtggcacctcgggaagctggagctcgacttcaactattgtgaaggcacaacggtagtgatcaccgagaattgcgggacgcgcgggcccagcctccggaccactacggtttcgggaaaactgatacacgagtggtgctgccgttcttgcacgctgcccccgctccggtacatgggcgaagacgggtgctggtacggcatggagatccgccccatctccgagaaggaggaaaacatggtcaagagcctggtgtccgccgggtcagggaaagtagacaatttcacgatcggcgtgctatgcctggccatcctgttcgaggaggtgatgagaggcaagttcggtaagaagcacatgattgccggggtgttcttcaccttcgtccttctcctgtccggccagatcacctggcgcgacatggcacataccttaatcatgatcggaagcaatgcctcagaccgcatggggatgggcgtaacctacctcgcgctgatcgctactttcaagatccagccctttctggccctcgggttcttcctacgcaagttgactagccgggagaacctgctgctgggcgtgggcttggcgatggccacgaccctgcaactgcccgaggacatcgaacagatggctaacggaatcgccctcggcctgatggccctgaaacttattacgcagttcgagacctaccagctgtggacggcacttatctcactgacctgctccaacacgatcttcacgctgactgtcgcctggcgcacagccacgctgattctcgcaggagtatcgctgttacctgtctgccagagtagctcaatgaggaagaccgactggctccccatggcggtggcagccatgggagttcccccgctcccgctgttcatcttcagcctcaaggacacgttaaagaggcgttcctggcccctgaacgagggggtcatggccgtcggcctcgtaagcattttagcgagcagcctgctaaggaacgacgtccccatggcaggccccttggtggccggtggcttattaatagcatgctatgttattaccgggacgtccgccgacctgacagtcgagaaagccgcggacataacttgggaggaggaggccgaacagacgggcgtgtcgcacaacctgatgataaccgtcgatgatgacggcacgatgcgcatcaaggacgacgaaaccgagaatatcctcacggtcctgctgaaaaccgccttactaatagtgtccggcatcttcccgtacagcatcccggccacccttctagtgtggcacacatggcagaagcagacgcagaggtctggcgtgctgtgggacgtgcccagtccccctgagacccagaaggccgagcttgaggaaggggtgtatcgcatcaaacagcaggggatcttcgggaaaacccaggtgggcgtgggtgtgcaaaaggagggggtcttccatacaatgtggcacgttacgagaggggcggtgctcacctataacggcaagcgcctggagccaaactgggcctccgtgaaaaaggacctgatcagctacggaggagggtggcggctcagcgcccaatggcagaaaggggaagaggtgcaggttatcgcagtagagcctggcaaaaaccccaaaaactttcagaccatgcctgggacctttcaaacgacaacaggggaaatcggggcgattgccttggacttcaagcccgggacatctggcagccccatcattaaccgcgagggcaaagtggtaggtctgtacggtaatggggtcgtaacaaagaatggagggtacgtttccggaatcgcccaaacgaacgccgagccggacgggccaacgcccgagctggaggaggagatgttcaaaaagcggaatctcacaatcatggatctccatccggggagcggaaagacgcgcaagtacctgccggcaatcgttcgggaggcgataaagagacggctccgcaccctgatccttgctcccacacgggtagttgcagccgagatggaagaagccttaaaggggctgcccatccgctatcagaccacggctaccaagtccgaacacacaggccgcgagatcgtggacctgatgtgccacgctaccttcacaatgcggctcctgtcacccgtacgggtgccgaactacaacctgatcatcatggacgaggcgcatttcaccgatcctgcctccatcgccgcgcgcgggtacatctcaacccgggtcggcatgggcgaggccgccgccatcttcatgacagcgacaccgcccggtaccgccgatgccttcccacagtctaacgcgcccatccaggacgaggaacgcgacatccccgagcgcagctggaacagcggcaacgagtggatcactgatttcgccgggaagacggtatggttcgttcccagcatcaaggctggcaacgacatagccaattgtctccggaagaacggaaagaaggtcatccagttgtcccgcaagactttcgacactgagtaccagaagaccaagttaaacgactgggacttcgtcgttacaacggacatttcggagatgggcgcaaacttcaaggccgaccgggtcatagatccgaggcggtgcctcaagcccgtgatcctgaccgacggcccagagcgcgttatcctggccgggcccatgccggtgaccgcggcctccgcagcccagcggcgcggccgggtgggtcgcaacccccagaaagagaacgaccagtacattttcacaggccagcccctgaataacgacgaggaccacgcccactggactgaggctaagatgttactggataacataaacactcccgaggggatcataccggccctcttcgagcccgagcgggagaagtccgcggccatcgacggtgagtaccgactgaagggcgagtcccggaagaccttcgtggagctgatgcggcgcggggatctcccagtctggctggctcacaaggttgcctcggagggcatcaaatacaccgaccgcaagtggtgcttcgacgggcaacgaaacaaccaaatcctggaggaaaacatggacgtcgagatatggacaaaagaaggcgagaagaagaaacttcgccctcggtggctcgacgccaggacgtactccgaccccctcgccctcaaagagttcaaagagttcgccgcgggcagaaaaagcatcgccctagacctggtgaccgagatagggcgggtgccatcacacctcgcccaccgcacccgcaacgccttagataacctggtgatgctgcatacaagcgagcacggcgggcgcgcctaccgacacgctgtagaagaattgcccgaaacgatggagaccctgctactgctgggcctcatgatcctgctgacagggggcgccatgctgttcctgatcagcggcaagggaatcggaaagacctccatcgggctcatttgcgtaatcgctagctccggtatgctctggatggccgagatcccgctgcagtggatcgccagcgcgatcgtcctagagtttttcatgatggtactcctgatccccgagcccgagaagcagcgcacaccccaggataaccaactcgcttacgtggtcattgggattctcaccttggccgccatcatcgccgcaaacgagatgggcctactcgaaaccaccaagcgggatctgggtatgtcaaaggagccgggggtggtaagcccaacgtcctacctggacgtcgatctccacccagccagtgcgtggacactgtatgcagtagccaccacagtcattacacccatgctgagacacaccattgagaactccaccgccaacgtcagcctcgcggcgattgccaaccaggcggtagtactgatgggcctggataaggggtggcctatctctaagatggacctcggcgttcccctcctggccctcgggtgctacagccaggttaatcctctaaccctcacggctgccgtactcctgctgatcacccactacgccatcatcggccctggacttcaggcgaaggctacccgggaggcacagaagcgtacggccgccggaatcatgaagaatcccacagtcgatggtatcatgaccatcgaccttgaccccgtgatctacgactccaagttcgagaagcagctcggacaggtgatgctcctggttctctgcgcggtccagctcctgctgatgcggacctcgtgggccctctgcgaggccctgacactggctacgggccccattaccaccctctgggagggatccccggggaagttctggaacacaacgattgcagtgagtatggccaacatattccgaggctcctacctagccggcgccggcctagccttctcaatcatgaagtccgtcggcaccggcaagcgcggcaccgggagccagggcgagaccctcggggagaagtggaagaagaagctgaatcagttgagccgaaaggacttcgatctatacaagaaatccggcatcaccgaggtcgaccggacggaagcgaaggaggggctgaagcgcggcgagattacccaccacgccgtgagcagaggcagcgccaagctgcagtggttcgttgagcgcaatatggtgatcccggaagggcgggtgatcgacctcggctgcgggcgcgggggatggagctactactgcgccggcctgaaaaaggtcacggaggtgcggggctacacaaagggcgggcccggccacgaggaacccgtgcccatgtccacgtacggctggaacatcgtcaagctaatgagtggtaaagatgtgttttacctccctcccgagaagtgcgacaccctactatgtgacatcggagaatcatctccctctcccaccgtggaggagagccgcaccatccgcgtcctaaagatggttgagccctggctcaagaacaaccagttctgcatcaaggtactgaacccctatatgcccacggtgatagagcacctagagcggctccaacgcaagcacggcgggatgctggtgcggaatcccctgtcgcgcaacagcacccacgagatgtactggatctccaacggcaccggcaacatcgtcgccagtgtgaacatggtgtcccggctcctgctgaacaggtttacaatgacgcaccgcagacccacgatcgaaaaggatgttgacctcggcgcgggcacccgacacgtaaatgccgaacccgagacccccaacatggacgtgattggggagcgcattaaacggatcaaggaggagcacaacagcacatggcactacgacgacgagaacccgtacaaaacttgggcctaccacggctcctacgaggtgaaggccaccgggagcgcctccagcatgatcaacggcgtcgttaagctgctgacaaagccttgggacgtcgtgccgatggtgacgcagatggcgatgaccgatacgacgcccttcgggcagcagcgcgtctttaaggaaaaagtcgacacgcgtaccccgcgcagcatgcccggcacccggcgggtgatgggcatcaccgccgaatggctgtggcgaacgttggggcgcaacaaaaagccccggctgtgtacccgcgaggagtttaccaagaaagtccgcaccaatgccgccatgggcgcggtgtttaccgaggaaaaccagtgggactccgccaaggcagccgtggaagatgaggacttttggaagctcgttgaccgggagcgcgagctgcataagttaggaaagtgtggcagctgtgtttacaacatgatggggaaacgggagaagaagctcggcgagttcggtaaggccaagggatcccgcgcgatctggtacatgtggctgggcgcacggtacctggagttcgaggccctcggattcctgaacgaggaccactggttcagccgcgagaactcatacagcggcgtggagggggagggcctgcacaagctcggctatattctgcgggacatctctaagattcccggaggcgccatgtacgccgacgacaccgcggggtgggatacgcgcattacggaggacgatctgcataacgaggagaaaatcacgcagcagatggacccggagcacagacagctcgccaacgccatcttcaagttaacctaccagaacaaggtggttaaggtccaacgccctactcccaccggcactgtcatggacataataagccgaaaggatcagcgcggctcaggccaggtgggcacgtatgggctgaacacctttacgaacatggaggcccagcttatccgacaaatggagggcgaaggggtgctgagcaaagccgacctggagaatccccatctcccggagaagaagataacccagtggcttgagaccaagggcgtggagcgactgaagcggatggccatctccggcgacgactgcgtggtcaagcccatcgacgaccgctttgctaacgccctcttagccctgaacgacatgggaaaggtcagaaaggacatcccccagtggcagccaagcaagggctggcacgattggcaacaggtcccgttctgcagtcatcactttcacgagctcatcatgaaggacgggcgtaagttagtggtcccgtgtagaccccaggacgagctgatcggccgagcccggatttcacagggggcgggctggtccctcaaggagaccgcctgcctcggcaaggcgtacgcccagatgtggagccttatgtacttccaccggcgcgatctccggctggcgtccaacgccatctgcagcgcagtgccagtgcattgggttccgacttcgcgcacaacgtggtcaatccacgcccatcaccagtggatgaccaccgaggacatgctgaccgtatggaaccgggtctggatcgaggacaatccctggatggaggacaagacgcccgtcaccacctgggagaacgtgccttacctcggaaagagagaggaccagtggtgcggcagcctgatcggactgacttcccgagccacgtgggcgcaaaacattccgaccgccatacaacaggtgagaagcctcatcggcaacgaggagttcctggattacatgccctctatgaagcgattccgtaaggaggaggagtcggaaggggctatttggtga

SEQ ID NO: 25810 - RNA, 9873 nt, synthetic construct
  misc_feature 1..9873: note = derived and/or modified CDS sequence (opt11) from DENV-3__GQ199865__SS-prME
  source 1..9873: mol_type = other RNA
acctccctctgcctcatgatgatcctgcccgccgccctggcgttccatctcaccagccgcgacggtgaaccccggatgatcgtggggaagaacgagcgggggaagagcctactgttcaagaccgcctcggggataaacatgtgcaccctcatcgccatggatctgggcgagatgtgtgacgacaccgtgacctataagtgcccccacataaccgaggtggagcccgaggacatcgactgctggtgcaacctcaccagcacctgggttacctacgggacgtgcaaccaggccggcgagcatcggcgcgacaagcgatccgtcgctctcgcgccccacgtgggcatggggctggacacccgcacccagacctggatgagcgccgaaggcgcttggcgccaagtggaaaaagtcgagacgtgggctcttcgccacccgggcttcaccatcctcgctctgttcctggcacactacatcggcaccagccttacccagaaggtcgtgatattcatcctgctgatgctcgtcacgcccagcatgacaatgcggtgcgtgggggtgggcaatcgcgacttcgtcgagggcctgtcaggggcgacctgggtagatgtggtattggagcacggcgggtgcgtaaccaccatggccaagaacaagcccaccctcgacatcgagctccagaagactgaggccacccagctcgcgacgctccgcaagctgtgcatcgaagggaagataaccaacatcaccaccgatagccgctgccccacgcagggcgaggcgaccctgccggaggagcaggatcagaactacgtgtgcaagcatacctacgtcgaccgaggctggggcaacggctgcggcctttttgggaagggctccctcgtgacttgtgccaaatttcagtgcctagagcccatagagggaaaagtggtccagcacgaaaacctcaagtacacggtgatcatcaccgttcacaccggagaccagcaccaggtcggcaacgagacccagggggtaacggcagagattacgccccaagccagcactaccgaggcgatcttgcctgagtatgggaccctggggctcgagtgctccccgcgcacgggcctggacttcaacgagatgatcctgctcaccatgaaaaacaaagcctggatggttcaccggcagtggttcttcgatctgcccctgccctggaccagcggcgcaaccacggaaacaccaacctggaaccgcaaggagttgcttgtgacctttaagaacgcgcacgcaaagaagcaggaggtggtcgtgctggggtcccaagagggcgcgatgcacacggccctcaccggggccaccgagatacagaacagcggcggaacttctatctttgccggccatctgaagtgcaggctgaagatggacaagctagaactgaagggaatgagctacgcaatgtgtacaaacacctttgtactgaagaaggaggtctccgagacccagcacgggaccattctgatcaaggtggagtacaagggcgaagacgtgccgtgcaagatccccttcagcacggaggacggtcagggcaaggcgcataacggtagactgatcaccgccaatcccgttgttactaagaaggaggaaccggtgaacatcgaagccgagccgcccttcggggagtccaacatcgtcatcggcatcggggacaacgccctgaagatcaactggtacaagaagggctccagcatcgggaagatgttcgaggcgaccgcccggggcgcccgccggatggccatcctgggagatacggcctgggacttcgggtcggtgggcggggtgctcaacagcctgggcaagatggtacaccagatctttgggtccgcgtacaccgctctgttcagcggggtatcctgggtgatgaagatcggcatcggggtcctcctgacttggatcggcttaaacagcaagaacacctccatgagcttctcctgcatcgccatcgggatcatcaccctctacctgggcgctgtggtgcaggccgacatgggatgcgtcatcaactggaagggcaaggagctgaagtgcggcagcggtatcttcgtaaccaatgaggtccacacctggaccgagcagtacaagttccaggcggactcccccaaacgcctagccacggccatcgccggcgcctgggagaacggtgtctgcggcatccgcagcaccacccggatggagaaccttctttggaagcagatcgcgaatgagctcaactacatcctctgggaaaacaacatcaagctgaccgtggtggtcggggacatcatcggcgtgctcgaacagggcaagcgcacgctgactccccagccgatggagctgaagtactcctggaagacctgggggaaggccaaaatcgtgacggcggagacgcagaactcatccttcataatcgacggcccgaatacccctgaatgtcccagcgtctcccgggcgtggaacgtgtgggaggtggaggactacgggttcggcgtcttcaccaccaatatctggctcaagctgagagaagtgtatacccagttgtgcgaccaccggctcatgagtgcggccgttaaggacgaacgcgccgtccatgccgacatgggctactggatcgagagccaaaaaaacggctcctggaagctggagaaggccagcctgattgaagtcaaaacgtgcacctggccgaagtcccacaccctctggagcaacggcgtgctagagagcgatatgatcatccctaaatccctggcgggcccaatatcccaacacaaccaccggccgggctaccacacccagacggccgggccctggcaccttggcaagctggagctggacttcaactattgcgagggcaccaccgtcgtaatcaccgaaaattgcgggacgaggggcccgagcctgcggaccacgacggtgtcagggaagctgatccacgagtggtgctgccgcagctgcacgctgcctccgctccggtacatgggcgaggacgggtgctggtacggcatggagatccgccccatcagcgagaaggaggagaacatggtaaaaagcctggtatccgccggctcggggaaggtggacaacttcactatgggggtcctctgcctcgccatcctgttcgaggaggtgatgcgtggaaagttcggaaagaagcacatgatcgccggggtgttcttcaccttcgtcctgctcctgtccggccagatcacctggagagacatggcgcatacgctgatcatgatcggcagcaacgcctccgatcggatggggatgggcgtgacctacctagccctgatcgcgaccttcaagatccagcccttcctggccctcgggttcttcctacgcaagctgaccagccgggagaacttgctgctgggcgtcggcctcgcgatggccacgaccctgcagctgcccgaggacatcgagcagatggccaacggcatcgcactcggcctgatggcgctgaagctcatcacccagttcgaaacctaccagctgtggacggccttgatcagcctgacctgctccaacaccatattcaccctaacggtcgcctggcgcaccgccaccttaatcttagccggggtgagcctgctgccgatgtgccagtcctcatccatgcggaagaccgactggctccccatggcggtcgccgccatgggcgtgcctcccctcccgctgttcatcttctcgcttaaagacacgctgaagcgccgctcctggcccctgaacgagggtgtgatggccgtcggcctcgtgagcatcctggcttccagcctgcttcggaacgacgtgcccatggcgggccccctggtcgccgggggattactcatcgcgtgttacgtgatcaccgggacctccgcagatctgactgtggagaaggccgcggacattacgtggggtgaggaggccgaacaaaccggggtcagccacatgctgatgatcaccgtggaggatgacggcaccatgcgcataaaggacgacgagaccgagaacatcctaacggtgctgctgaagaccgccctcctgatcgtctcgggcattttcccttacagcatccccgccaccctgctcgtgtggcacacctggcaaaagcagacgcaacggtccggggtgttgtgggacgttccctcaccgcccgagacccagaaggccgagctggaggagggtgtgtatcgcatcaaacagcagggaattttcggcaagacccaggttggcgttggcgtgcagaaggagggcgtgtttcacacgatgtggcatgtcacgcgcggggcagtgctcacctacaacggcaaacgcctggagcccaattgggcctccgtcaagaaggacctgatcagctatgggggcgggtggcgcctctcggcccagtggcagaagggcgaagaggtccaggtgatcgccgtggagcccggcaagaaccccaagaacttccagaccatgcccgggacctttcagacgactaccggcgagatcggggcgatcgccttagactttaagcccggcaccagtggttcgcctatcattaaccgcgaggggaaggtcgttggcctatatgggaacggcgtggtcaccaaaaacgggggttacgtatccggcatagcccagacgaatgccgagccggacggacccaccccagagttggaggaggagatgttcaagaagcggaaccttaccattatggatctacacccgggcagcgggaaaacgcgcaagtacctgcctgctatagtgcgggaggcgatcaaacgccggctccgcaccctgatcctagcccccacccgggtcgtggccgctgagatggaggaagccctcaagggcttaccaatccgctaccagaccacagcgaccaagtccgagcacaccgggcgggagatcgtggacctcatgtgccacgccactttcacgatgcgtctgttgtcacccgtccgggttccgaactacaacctcattatcatggacgaggcccactttaccgaccccgcctccatcgccgcaagagggtatatcagcacgcgggtgggcatgggggaggccgctgccatcttcatgactgcgacaccgcccggcaccgccgacgcattcccgcagtccaacgcccccattcaagatgaagagcgcgacatccccgagcgatcatggaactccgggaacgagtggatcaccgactttgccggtaagaccgtctggttcgtccctagcataaaggctgggaacgatatcgccaattgcctcaggaagaacggcaagaaggtaatacagctgtccagaaagacgttcgacaccgagtatcagaagaccaagctgaacgactgggacttcgtcgtgacgacggacatctctgagatgggcgccaacttcaaagccgaccgggtaatcgacccccgccggtgcctcaagcccgtgatcttgaccgacgggcccgagcgcgtgatcctggccggccccatgccggtgaccgcggcttccgccgcccagaggcgcgggcgggtcggccgcaatccccagaaggagaacgatcaatacatcttcaccggccagcccttaaacaacgacgaggatcacgcccactggaccgaagcaaaaatgctgctggataatatcaacacgcccgaggggatcatcccagccttattcgagcccgagcgggaaaagtccgcagccatcgatggcgagtatcgcctgaagggtgaaagccggaagaccttcgtcgagctcatgcggcggggcgacttgcccgtgtggctcgcgcacaaagtcgcaagcgaggggataaagtatacagaccgcaagtggtgcttcgacgggcagcggaacaaccagatcctggaggagaacatggacgtggagatctggaccaaggagggcgagaagaagaagttacgcccccggtggctggacgcccgaacgtactccgacccgctggcactcaaggagttcaaggagttcgccgctgggcgcaagagcatagccctggacctggtcacggaaatcggccgggttccctcccacctggcccatcgcacccggaacgccctggacaacctggtgatgttacacaccagcgaacacggggggcgcgcttaccgccacgcggtggaggagttaccagaaacgatggagaccctcctcctgctggggttaatgatcttactgaccggcggcgctatgctgtttctgatcagcgggaagggcatcgggaagacaagtatcggcctgatctgcgtgatcgccagctctgggatgctctggatggccgagattccgctgcaatggatcgcctccgcgatcgtgctggaattctttatgatggtcctcctgatccccgagcccgagaagcaacggactccgcaggacaaccagctggcctacgtggtgattggcatcctcaccttggccgccatcatcgccgcgaacgagatggggctgctcgaaaccaccaagagagacctggggatgtccaaggagccgggcgtcgtaagccccacatcctatttggacgtggacctccaccccgccagcgcgtggaccctgtacgccgttgcgacgaccgtgattacgcccatgctgcgacacaccatcgagaactccacagccaacgtgagcctcgccgccatagccaaccaggcagtcgtgctgatggggctggacaagggctggccgatctccaagatggacctcggggtgcccctgctggcgctcggctgctactcccaggtcaaccccttaaccctgacggccgccgtcctcttactcattacccactatgccatcatcggccccgggttacaggcgaaggccacccgggaggcacagaagcgcaccgccgccggcatcatgaagaacccgactgtggacgggatcatgaccatcgacctggaccccgtcatttacgactccaagttcgagaagcaactgggccaggtgatgttactggtgctgtgcgcggtccagctcctcctgatgcggaccagctgggcactatgcgaggccctgaccctggccacgggcccaatcaccaccctctgggaggggtcccccggcaagttctggaacaccacaatcgccgtgtctatggcaaacatatttcgcgggtcctacctggccggcgccgggctggctttcagcattatgaagtccgtgggcaccggcaagcggggtacagggagccagggggagaccctaggagagaagtggaaaaagaagctaaaccaactgagcagaaaggactttgacctctataagaagtccggtatcactgaggtcgaccggacggaggctaaggagggactgaagcgcggcgagatcacccaccacgccgtgagtcggggttccgctaagctgcagtggttcgtggaacgcaatatggtcatcccggagggccgggtaattgatctcgggtgcgggcggggggggtggagctactactgcgccggcctaaagaaggttaccgaggtccggggctacaccaagggcgggcccggccacgaggagcccgtgcccatgtcaacgtacgggtggaacatcgtgaagctgatgagcggaaaagacgtcttctatctcccgcccgagaaatgcgacaccctgctgtgcgacatcggcgagtccagccccagccccacagttgaggagagccgaaccatccgcgtgctgaagatggtcgagccgtggctcaagaacaaccagttctgcatcaaggtgctgaacccctacatgcccacggtgattgagcacctggagcggctacaacgcaagcacgggggcatgctggtccggaatccactgtcccgcaactctacccacgagatgtattggatctccaacgggaccgggaacatagtagccagcgtaaacatggtcagccggctcctgctgaacagattcaccatgacgcacagacgtccgacaatcgagaaagatgtggacctcggggcggggacccggcacgttaatgccgagcccgagacccccaacatggacgtcatcggcgagcgcatcaaacggatcaaagaggagcacaactcaacctggcactacgacgacgagaacccgtacaagacctgggcatatcacgggtcctacgaggtcaaagccaccggcagcgccagtagcatgatcaacggggtggtcaagctgctgacaaagccctgggacgtcgtgcccatggtgacgcaaatggcgatgaccgacaccacccctttcggccagcagcgcgtgttcaaggagaaagtggacacacggaccccgcgcagcatgcccgggacccggcgcgtgatggggatcaccgccgagtggctctggcggacactaggccgcaacaaaaagccaaggctgtgcactagggaagagttcaccaagaaggtccgcaccaacgcagccatgggggcggtcttcacggaggagaaccaatgggattccgccaaggccgccgtggaggacgaggacttctggaagttagtcgaccgggaaagggagttacacaaattgggtaagtgcgggagctgcgtctacaacatgatgggcaaacgggagaagaagttgggcgagtttggaaaagccaagggcagccgcgcgatctggtatatgtggctgggggcccggtacctggagttcgaagccctcggcttcctaaacgaagatcattggttcagccgcgagaactcgtacagcggggttgaaggagaaggcttacacaaactcgggtatattctgcgagacatctcgaagattcccggcggggccatgtacgcggacgacaccgcgggctgggacacccgaataaccgaggacgacctgcacaacgaggagaagatcacgcagcagatggacccggagcaccggcagttagccaatgccatcttcaaactcacctaccaaaacaaggtcgtcaaggtgcagcgccccaccccaaccggcaccgtgatggatatcatcagtcggaaggaccagcgcgggtccggccaggtgggtacgtacggcctgaacaccttcactaacatggaggcccagctgatcaggcaaatggagggggagggcgtcctaagcaaggccgatctggagaacccccatctcccggagaagaagataacccagtggctggaaacgaagggcgtagagcgcctgaagcggatggccatctccggggacgactgcgtcgtgaaacccatcgacgaccgtttcgctaacgccttactggccctgaatgacatgggcaaagtccggaaggacatcccccagtggcagccaagcaaggggtggcacgattggcaacaagtcccgttctgctcacatcacttccacgagctcatcatgaaggacggccgcaagctggtggtgccctgcagaccccaggacgaactgatagggcgtgctcggatctcacaaggcgcgggctggtcccttaaggagaccgcatgccttggtaaagcctacgcccagatgtggagcctgatgtacttccaccgccgcgacctacggctggcgtccaacgccatctgcagcgccgtcccggtgcactgggtaccgacctcccgcaccacatggtcgatccacgcccaccaccaatggatgaccaccgaggacatgcttaccgtctggaaccgggtgtggatcgaggacaacccctggatggaggacaagacgcccgtgacgacttgggagaatgtaccctacttaggtaaacgcgaagaccagtggtgtgggagcttgatcggtctgaccagccgggccacgtgggcgcagaacatcccgaccgccatacagcaagtgcgcagcctcatcgggaacgaggagttcctagattacatgccttccatgaagcgattccgtaaggaggaggagagcgagggtgccatctggtga

SEQ ID NO: 25811 - RNA, 9873 nt, synthetic construct
  misc_feature 1..9873: note = derived and/or modified CDS sequence (opt11) from DENV-3__GQ199870__SS-prME
  source 1..9873: mol_type = other RNA
accagcctctgcctcatgatgatcctgcccgccgccctcgcgttccacctcaccagccgggacggagagccccggatgattgtggggaagaacgagcgcggcaaaagcctgctgttcaagaccgcctccgggatcaacatgtgcacactcatcgcgatggaccttggcgagatgtgtgacgacaccgtgacctacaagtgtccccacatcaccgaggtggagcccgaggacatcgactgctggtgcaacctgacctccacctgggtgacctacgggacctgcaatcaggccggagagcaccggcgcgacaagcgctccgtggccctcgcgccccacgtgggcatggggctggacacccgcacccaaacctggatgagcgccgagggcgcctggcgccaggtggagaaagtagagacgtgggccctgcgccacccggggttcaccatcctggcgctgttcctggcccactacatcggtacctccttgacccagaaggtggtgatcttcatactgctgatgctcgtcacgcccagcatgaccatgcggtgtgtcggggtgggcaaccgagacttcgtggagggactgtccggggccacctgggtggacgttgtcctggagcacggcgggtgcgtgacgacaatggccaagaacaagcccaccctcgacatcgaactgcagaagaccgaggccacccagctggcgactcttcgtaagctgtgcatcgagggcaagatcaccaatatcaccaccgacagccgctgccccactcagggagaggccaccctgccggaggaacaggaccagaactacgtttgcaagcacacctacgtcgaccgggggtggggcaacgggtgcggcctctttggcaagggctccctggtgacctgcgccaagttccagtgcctggagcccattgagggcaaggttgttcagtacgagaacctaaagtacacggtgatcatcaccgtgcacaccggcgatcaacaccaggtcggcaacgagacccaaggggtgacggccgagatcacgccccaggcgagcaccaccgaggcgatactgcccgagtacggcaccctggggctcgagtgctccccgcgcacgggcctggacttcaacgagatgatcttactcaccatgaaaaacaaggcctggatggtccaccggcagtggttctttgacctgcccttgccttggaccagcggcgccaccacggagacccccacctggaaccgcaaagagttactggtgaccttcaagaatgcacacgccaagaagcaggaggtggtcgtgctggggtcccaggagggcgcgatgcatacagccctcaccggggccaccgaaatccagaacagcggcggtacctccatcttcgccggccacctaaagtgccggctgaagatggacaagcttgaactcaagggcatgtcatacgccatgtgcacgaacaccttcgtgttaaagaaggaggtctccgagacccagcacggtaccatccttataaaggtggagtataagggtgaggacgtgccgtgcaagatccctttctcaacggaggacgggcagggtaaggcgcacaacggcagactgataactgcgaaccccgtcgttacgaagaaggaggagcccgttaatatcgaggccgagccgcccttcggggaaagcaacatcgtcatcggcatcggagacaacgccctgaagattaactggtacaaaaagggcagtagcatcgggaagatgttcgaggcaaccgcccgtggcgcccgccggatggccatactgggcgacacggcctgggacttcgggtccgtgggcggtgtgctcaattctctgggcaagatggtccaccagatcttcggttctgcgtataccgccctgttctcgggcgtctcctgggtgatgaagatcggaattggggtcctccttacatggataggcctgaacagcaagaacaccagtatgagcttctcctgcatcgccatcggcatcatcaccctctacctgggcgccgtggtacaggccgatatggggtgcgtcattaactggaagggcaaggagctgaagtgcggaagcgggatcttcgtaaccaatgaggtgcacacctggaccgaacagtacaaatttcaggcggactcccccaagagattagccacggccatcgccggagcctgggagaacggggtctgcggcatccgcagcaccaccaggatggagaacctgctgtggaagcagatcgcgaacgagctcaactatatcttgtgggagaacaacatcaagctgaccgtagtggtcggggacatcatcggcgtgctcgagcagggcaagcgcacacttacgccccagccgatggagctgaagtactcctggaagacctgggggaaagccaagatcgtgaccgccgagacacagaacagctccttcatcatcgacggccctaacacccccgagtgccccagtgtctcccgggcctggaacgtatgggaggtggaggactacgggtttggtgtcttcaccaccaacatctggctcaagctgcgcgaggtctacacccagctgtgtgaccaccggctcatgagcgcggccgtgaaggatgagcgcgccgtccatgccgacatgggctactggatcgagagccagaagaacgggtcctggaagctggaaaaggccagcctgatcgaggtgaagacatgcacgtggccgaagtcacacaccttatggagcaacggcgtgctggagtccgacatgatcatccccaagagcctggcagggcccatctcccagcacaaccaccggccggggtaccacacccagacggccgggccctggcacttaggcaaactggagctggacttcaactactgtgagggaacaaccgtagtgatcaccgagaactgcgggacaagaggccccagcctccggaccacgaccgtgtccgggaagctgatccacgagtggtgctgccgcagctgcacgcttcccccgctccggtacatgggcgaagacggctgctggtacggcatggagattcgccctataagtgagaaggaggagaacatggtcaaaagcttagtgagtgcgggcagcgggaaggtggacaacttcactatgggcgtgctatgccttgccatcctgttcgaggaggtaatgcgtgggaagttcggcaagaagcacatgatcgccggggtgttcttcaccttcgtcctgctcctatctggccagatcacctggcgcgacatggcgcacacgctgatcatgatcggcagcaacgcctccgaccggatggggatgggcgtgacttacctcgcccttatcgccaccttcaagatccagcccttcctggcgttagggttcttcttaagaaaactgacctcgcgggaaaacctcctgctgggcgtgggcctcgcgatggccacgactctgcagctgcccgaagacatcgaacagatggccaacgggatcgcccttggcctgatggcgctgaagttaatcacccagtttgagacgtaccaactgtggacagccctgatctctctgacctgctccaataccatcttcaccctgacggtcgcctggcgcaccgccacactgatcctcgccggggtgagcctgctgccggtctgccagtctagcagtatgaggaagaccgactggctccccatggcagtggcggcgatgggcgtgccacccctcccgctgttcatattcgggctcaaggacacgctcaagcgccgcagttggcccctgaacgagggcgtcatggccgtgggcctcgtgtccatccttgcctcatccctgctccggaacgacgtccccatggcagggcccctggttgccggcgggctgctcatcgcatgctacgtgataaccggcaccagtgccgacctgactgtcgagaaggccgctgacatcacttgggaggaggaggccgagcagaccggggtgtcccacaacctaatgatcaccgtggacgacgacggcaccatgcgcatcaaggatgacgaaaccgagaacatccttacggtcctgctgaaaaccgcccttctgatcgtgagcggcatcttcccgtactccatacccgccaccctgctcgtgtggcacacatggcagaagcagacgcagcggagcggggtcctgtgggacgtgcccagcccgccggagacccagaaggccgagctggaggagggcgtttaccgcatcaagcagcaggggatattcggcaagacccaggtcggggtgggcgttcaaaaggagggggtcttccacaccatgtggcacgtgacgcgcggggccgtgctcacgtataacgggaagcgcctggagcccaactgggccagcgttaagaaggacctgatctcctacgggggcggatggcggctcagcgcccagtggcaaaagggcgaggaggtccaggtgattgccgtggagcccggcaagaaccccaagaacttccagacaatgcccgggacctttcagacgaccaccggagaaatcggcgcgattgccctggacttcaagcccggcaccagtggcagtcccatcattaaccgcgaggggaaggtggtgggcctgtacggtaacggtgtcgtgaccaagaacggcggctacgtgagcggcatcgcccaaaccaacgccgagccggatgggcccacccccgaactggaggaggagatgttcaagaagaggaacctcaccatcatggacctgcaccctggctccgggaagacgcgcaagtacctgccagccatcgttcgggaagcgataaagcgccggctccgcaccctgatcctggcacccacccgggtggtggccgccgaaatggaggaggctctcaaggggctgcccatccgctaccaaaccacggcgaccaagagtgagcacaccgggcgggagatcgtcgatctgatgtgccacgccaccttcacgatgcgccttctatcccccgtgcgcgtgccgaactacaacctgataatcatggacgaggcccacttcacggaccccgcctcaatcgccgcgcgcggctacatctccacccgggtcggcatgggggaggccgccgccatctttatgaccgcgacgccgcccgggaccgccgacgcctttcctcagagcaacgcccccatccaggatgaggagcgcgacatccccgaacgctcctggaacagcggaaatgagtggatcacggattttgccggcaagaccgtgtggttcgtgccctccatcaaggcgggtaacgacatcgccaactgcctacggaagaacgggaagaaggtcatccagctgagccgcaagacgttcgacaccgagtaccaaaagaccaagctgaacgactgggacttcgtggtgaccacggacatctccgagatgggcgccaacttcaaagccgaccgggttatagacccccgccgctgcctcaagccagtgatcctcaccgacgggcccgagcgcgtgatcctggccggccccatgccggtcaccgcggccagcgccgctcagcggcgagggcgggtggggcgcaacccccagaaggaaaacgaccagtacatcttcaccgggcagcccctcaacaacgacgaggaccacgcccactggaccgaggctaagatgctactggacaatatcaatactcccgagggtatcatcccggccctattcgagcccgagcgggaaaagtccgccgccatcgacggcgagtacaggctgaagggggagagtcggaagaccttcgtggagctgatgcgccgaggcgacctccccgtgtggctggcgcacaaggtggcctccgaggggatcaagtacaccgaccgcaagtggtgcttcgacggccagcggaacaaccaaatactggaagagaacatggacgtcgaaatctggaccaaggagggcgagaagaagaagctccgcccccggtggctggacgcccgcacgtactccgacccgctggccctcaaggaattcaaagagttcgccgcggggcgcaagtccatcgccctggacctggtgaccgagatcggcagagtgccctcgcacctcgctcaccgcactcggaacgctttggataacctggtcatgcttcacacctccgagcacgggggccgggcctaccgtcacgcggtggaggaactacccgagacgatggagaccctgctcctgcttgggctcatgatcctgctgacgggcggagccatgttattcctgatctcagggaagggcatcggaaagaccagcatcggcttgatctgcgtgattgcgtccagcgggatgctctggatggccgagatcccgctgcaatggattgcctccgcgattgtccttgagttcttcatgatggtgctcctgatccccgagcccgaaaagcagcgcacgccccaggacaaccagctcgcctatgtggtcatcggcatcctcacccttgccgccatcatagccgcgaacgagatgggcttattagagaccactaagcgagacttagggatgagcaaggagccgggtgtcgtgtcccccacgagctacctggatgtcgacctccacccggcctccgcctggaccctgtatgccgtggcaaccaccgtgatcacgcccatgctccgacacactatcgagaattccaccgcaaacgtctccctcgccgccatagccaaccaggcggtggtgctgatggggttggacaagggatggcccatcagcaagatggacctcggggtccccttgctggccctcggctgctactcccaggtgaaccccctgaccctgacggccgccgtgctactcctgatcacacactacgccatcataggccccgggctccaggccaaggccacccgggaagcccagaagcgcaccgctgctgggatcatgaagaacccgacggtcgacgggatcatgaccatcgacctggaccccgtgatctacgacagcaagttcgagaagcagttgggccaggtgatgctcctggtcctgtgcgcagtgcaactcctgctgatgcggacgagttgggccctgtgcgaggccctgaccctagccacgggaccaatcaccaccctctgggaggggagccccggcaagttctggaacactacgatcgcggtgtccatggccaacatcttccgcgggtcttacctggctggcgccgggctggcgttctccatcatgaaatccgtcggcaccggcaagcgggggacgggctcccagggggaaaccctcggcgagaagtggaagaagaagctgaaccagctgtcccgcaaggacttcgacttgtacaagaagtccgggatcaccgaggtagaccggacggaggcgaaggagggcctgaagaggggcgaaatcacccaccacgccgtgtccagaggtagcgccaaactgcagtggttcgtcgagcgcaacatggtgatcccggagggccgggtgatcgacctcgggtgcggccgcgggggctggtcctactactgcgccggcctgaagaaggtcaccgaggtgagagggtacaccaagggcgggcccggccacgaggagcccgtccccatgagcacgtacgggtggaacatcgtcaagctgatgtccgggaaggacgtgttttacttacctcccgagaagtgcgacactctgctgtgcgacatcggtgagagctcccccagccccacagtggaggagtccagaaccatccgcgtcctgaagatggtggaaccgtggctaaagaacaaccagttctgcatcaaggtgctgaacccctatatgcctacggtcatcgaacacctggagcgattacagcgcaagcacgggggcatgctggtgcggaaccccctgagccgcaactccacccacgagatgtcttggatctccaacgggaccggcaacatcgtggccagcgtcaacatggtgagtcggctcttactgaaccgtagtaccatgacgcaccggagaccgaccatcgaaaaggacgtggacctcggcgcggggcctcgccacgtcaacgccgacccggagccgcccaacatggacgtgatcggcgagcggatcaagcgagtaaaggaggagcataacagtacctggcactacgacgacgagaatccttacaagacctgggcttaccatgggagctacgaggtgaaggccacaggctccgccagcagcatgataaatggggttgtcaagctgctgaccaagccgtgggacgttgtgcctatggtgccccagatggcaatgaccgacaccacgccgttcggccagcagcgcgtattcaaggagaaggtggacacacggaccccccggtccatcccgggcacccggcgcgtcatggggataacggctgagtggctctggcggaccctgggacggaacaagaagccacggctgtgcacccgcgaggaattcaccaagaaggtgcgcacgaacgccgcaatgggggcggtgttcaccgaggagaaccagtgggacagcgccaaggccgccgtcgaggacgaggacttttggaagctcgtggaccgggagcgcgaactccataagctgggcaaatgcgggtcctgcgtgtacaacatgatgggcaagcgggagaagaagctcggcgagttcgggaaagccaagggctctcgcgccatctggtacatgtggctgggggcccggtatctggagttcgaggccctcgggttcctgaacgaggaccactggttctcccgcgagaacagctactccggtgtcgagggcgagggcctacacaagctcgggtacatcctgcgggacatctccaagatccccggcggggccatgtacgctgatgacaccgcgggctgggacacccgcataacggaggatgacctgcacaacgaggagaagatcacacagcagatggaccccgagcaccggcagctcgcaaatgccatcttcaagctgacataccagaacaaggtggtgaaggtccagcgccctacaccgacgggcaccgtgatggacatcatatcccgcaaagaccagcgcgggtctggccaggtggggacttacggcctgaacaccttcactaatatggaggcccagttaatccggcagatggagggggagggcgtcctgtccaaggcggacctggagaacccccatttacccgagaagaagatcacgcagtggctggagaccaagggcgtggagcgcctgaagcggatggcgatcagcggggatgactgtgtggtcaagccaatcgatgaccgcttcgccaatgccctcctggccctgaacgatatggggaaggtgcgtaaggacattcctcagtggcagccatccaaggggtggcacgactggcagcaggtccccttctgcagccaccacttccacgagctcatcatgaaggacggccgcaagctggtagtgccgtgccggccccaggacgagctgatcggacgcgcccggatctcccagggcgcgggctggagcctcaaagagacagcctgcctggggaaggcctatgcccagatgtggtccctgatgtacttccaccgccgcgatttgcggctagcctctaatgccatctgctccgccgtgcccgtccactgggttccaaccagccgcaccacttggagcatccacgcccaccaccagtggatgaccaccgaggacatgctgaccgtgtggaaccgggtgtggatagaggacaatccgtggatggaggacaagacccctgtgaccacgtgggagaacgtgccctacctcggcaaacgcgaggatcagtggtgtgggtccctaatcggactgacgagcagggccacctgggcgcagaacattccgaccgccatccagcaggtccgctccctcatcgggaacgaagagttcctggactacatgcccagcatgaagcggttccgcaaggaggaggagtccgagggggcgatctggtga

SEQ ID NO: 25812 - RNA, 9873 nt, synthetic construct
  misc_feature 1..9873: note = derived and/or modified CDS sequence (opt11) from DENV-3__JF937630__SS-prME
  source 1..9873: mol_type = other RNA
accagcctgtgcttgatgatgatcctgcccgccgccctagcgtttcacctcaccagccgggacggggagccccggatgatcgtgggaaagaacgaacggggcaagagcttgctgttcaagaccgcctccgggatcaacatgtgcactctcatcgccatggacctgggtgaaatgtgcgacgatactgtgacctacaaatgcccacacatcaccgaggtggagcccgaggacatcgattgctggtgcaacctgaccagcacctgggtgacctacgggacctgcaaccaggccggagaacaccggcgcgacaagcggtctgtggctttagcgccccacgtgggtatggggctggataccagaacgcagacctggatgagcgcagagggcgcgtggcgtcaagtggagaaggttgagacgtgggctctgaggcacccagggtttaccatcttagcgctgttcctggcccactacatcggcacctcccttacccagaaggtggtgatattcatcctcctaatgctggtcacgccgagcatgactatgcgatgcgtaggggtcggcaaccgcgacttcgtggagggtctgtccggggccacgtgggtggacgtggtcctagagcacggcgggtgcgtgaccacgatggccaagaacaagcccactctggacattgaattacagaagaccgaggccacccagctagcgacgctccggaagctgtgtatcgagggcaagatcaccaatataaccactgacagccgctgtccaactcagggcgaggcaaccctgccggaggagcaggaccagaactatgtgtgtaaacatacctacgttgaccggggttgggggaacgggtgcggcctcttcgggaagggctccctggttacctgtgccaaattccaatgcctggaacctatcgagggcaaggtggtccagtacgagaacctcaaatacacggtgatcattaccgtgcacaccggggaccagcaccaggtaggaaatgagactcagggggtgacggccgagatcacgccccaggcctctaccaccgaggcgatcctgcccgaatacggcacactcgggcttgagtgctccccgaggacgggcctggatttcaatgagatgatcctgctcaccatgaagaacaaggcctggatggtacaccggcagtggtttttcgacttacccttgccctggacaagcggtgccaccacggagacccctacatggaaccgtaaggagctactggtgaccttcaagaatgcccacgccaagaagcaggaggtggtcgtgctagggagtcaggagggcgcgatgcacacggccctcaccggggctacggagattcagaactctggcgggacctccatcttcgccgggcatctgaagtgtcgactgaaaatggataagctcgagttgaagggaatgagctacgccatgtgtacgaacgcattcgtgctgaagaaggaagtcagtgagacccagcacgggaccatccttatcaaggtggagtacaagggcgaggacgtgccgtgcaaaatccccttcagcaccgaggacgggcagggtaaggcccacaacggccgcctgatcacggctaacccagtcgtcaccaagaaggaggagcctgttaacatcgaagccgagccgcccttcggggaaagcaacatcgtcattggcataggggacaacgctctgaagatcaactggtataagaaaggctcctctattgggaaaatgttcgaggccaccgcgcggggcgcccgccggatggccatcctgggagacacggcgtgggacttcgggtccgtggggggcgttttgaacagcctgggcaagatggtccaccagatcttcgggtccgcctacacggccctttttagcggcgtgtcctgggtgatgaagatcggcatcggcgtcctcctgacatggatagggctgaacagcaagaacacctccatgagcttctcatgcatagccatcgggatcatcaccctctacctgggcgccgtggtgcaagctgacatggggtgcgtcatcaactggaaggggaaggaactgaagtgcggcagcggtatcttcgtgacgaacgaggtgcacacctggacggagcagtacaagtttcaagcagactcccccaaaagacttgccaccgccatcgcgggcgcttgggagaacggtgtctgcggcatccgatcgacaacacggatggagaaccttctgtggaagcagatcgccaatgagctaaattatatcttgtgggagaacaacatcaagctgaccgtggtggtcggggacatcatcggcgtgctcgagcagggcaagagaacactcacaccccagccgatggagctgaaatactcctggaagacctggggcaaggccaaaatcgtgaccgcagagacccagaatagctcatttatcatcgacggcccgaacacacccgagtgcccgagcgtgtcacgggcgtggaacgtgtgggaggtggaggactacgggttcggagtgttcaccaccaacatctggctgaagttgcgcgaagtgtacacccagctctgcgaccacaggctaatgagcgccgcggttaaggacgagcgtgccgtccacgccgacatgggctactggatcgagagccagaagaacggttcctggaaactggagaaggcgagcctgatcgaggtgaaaacatgcacgtggccgaagtcccataccctctggagcaacggcgtcctggaatccgacatgattatccccaagagcctggcaggtcccatctcccaacacaatcaccggcccggttaccacacccagaccgccggcccctggcatctcggcaagctggagcttgattttaattactgcgagggcacgaccgtcgtgatcacggaaaactgtgggacgcgcggccccagtttacggaccactaccgtgtccgggaagctgatccacgagtggtgctgccgcagctgcactctgcccccgctccggtacatgggcgaggatgggtgctggtacggcatggagatacgccccatttccgagaaggaggagaacatggtcaagagcttggtgtccgcgggcagcgggaaagtggacaatttcacaatgggcgttctgtgcctcgccatactgttcgaagaggtgatgcgggggaaattcggtaagaagcatatgatcgcgggggtgttcttcaccttcgtactgctcctatcgggccagattacctggagggatatggcgcacaccctgatcatgatcggctcgaacgcatcagaccggatgggtatgggcgtgacatatcttgccttgatagcgaccttcaagattcagcctttcctggcgctcggtttcttcctgcgaaagctgacaagccgggagaacctcttactcggcgtgggcctagccatggccaccactctacagctgcccgaggacatcgagcagatggccaacgggatagcactgggcctgatggccttgaagctcataacccaattcgagacctaccaactgtggactgccttgatcagcctcacgtgcagcaacaccatcttcacactgaccgtcgcctggcgcacagccactctgatcctagcgggggtgagcctgctgccggtctgccagtccagctccatgcggaaaaccgactggttacccatggctgttgccgcgatgggtgtgccgcccctcccgctttttatctttagcttaaaggatactctcaagcgacggtcctggccactgaatgagggggtcatggccgtaggcctcgttagcatcctggcgtcctccctgctccggaacgacgtacccatggccggccccctggtggccgggggactactaattgcttgttacgttatcaccgggacctccgcggacctgaccgtcgagaaggcggcagacataacctgggaggaggaagcggagcagacgggagtaagccacaatctaatgatcacagtggacgatgatgggacaatgcgcattaaggacgacgagaccgagaacatcttgactgtgctgttgaagacggccctcctgattgtgagtggaattttcccgtattctatcccagccaccttgctcgtgtggcacacgtggcagaagcagacccagcgttccggcgtgttatgggacgtgccgagcccacccgagacacagaaagcggagctggaggagggggtctaccgcatcaagcagcagggcattttcgggaaaacacaagtcggggtgggggtgcaaaaggaaggcgttttccacaccatgtggcacgtgaccagaggcgctgtgctcacgtacaacggtaagaggctggagccgaactgggcctccgtcaagaaggacctgatcagctacggcggtggctggcgtctctccgcccagtggcagaagggggaggaggtgcaagtcatcgctgtcgaacccggcaagaaccccaagaacttccagactatgcccgggaccttccagaccacgaccggggagatcggcgccatcgccctggactttaagcccgggacctcaggatcaccaatcataaatcgcgagggcaaagttgtcggtctgtacggcaacggagtcgtaaccaaaaatggcgggtacgtttcgggcatagcgcagacgaacgccgagccggatggtcctacccccgagttagaggaggagatgttcaagaagagaaatttaaccatcatggacctgcatcccggaagcggcaagacccgtaagtacctgccggcgatcgttcgcgaggccatcaagaggcggctccgcactctgatattagcccccacccgggtagtggccgccgagatggaggaagcgctcaaggggcttcccatccgctaccagaccaccgccacgaaatccgaacacacaggccgggagatcgtcgacctgatgtgccacgccactttcaccatgcgcctactgagtcccgtgcgggtgccgaactacaacctgataatcatggatgaggcccacttcacggacccagcctccatagcggcccgcgggtacatcagtacccgggtcggcatgggcgaggccgccgcgatcttcatgaccgccacgccgccagggacggcagacgccttccctcaaagtaacgcgcccatccaggacgaggagagggatatccccgagcgctcctggaactccggcaacgagtggatcaccgatttcgcgggaaagaccgtgtggttcgtgcccagcatcaaggccgggaacgatattgccaactgcctacggaagaacggtaagaaggtcatccagctgtcccgcaagaccttcgacacggagtaccaaaagacaaagcttaacgactgggacttcgtcgtaaccaccgacatctccgaaatgggcgccaacttcaaagccgaccgggtcatcgacccgcgccggtgcctcaagcccgtgatcctcacggacggccccgagcgagtgatcctggcggggcccatgccggtcaccgccgcttccgccgcacagcggcgaggccgggtcggccgcaacccccaaaaggagaacgaccagtacatcttcaccgggcagcccttaaacaacgacgaggatcacgcgcactggaccgaggccaagatgctgctggacaacatcaacacccccgagggaatcatcccggccctcttcgagcccgaacgggagaagtccgctgcgatcgacggcgagtataggctgaagggcgaatcccggaaaacgtttgtcgagctgatgcgccgcggggatctccccgtctggcttgcccataaggtggctagcgagggcatcaagtacaccgaccgcaagtggtgcttcgacggccaaagaaacaaccagattctggaggagaacatggacgtcgagatctggacaaaggagggcgagaagaagaagctgaggccccggtggctggatgctcgcacctattctgatccgctggccctgaaggagttcaaggaatttgcggcagggcgaaaaagcatcgccctggacctggtgacggagatcgggcgggtgccctcccacttagcccatcgcacccggaacgccctggacaacctggtcatgctccacaccagcgaacacggtggtcgcgcgtatcggcacgccgtcgaggaactgcccgagaccatggagacgctgctcctactgggactcatgatcttactgaccggcggcgctatgctgttcctgatctctggcaaggggatcggtaaaacatccatcggcctaatctgcgtgatcgcctcgagcggcatgctctggatggcagagatcccgctacagtggatagcgagtgccatcgtcctggagttctttatgatggtgctcctgatccccgagcccgagaagcagcgaacgccgcaggataaccagctggcctacgttgtcatcgggatcctcacgttagcagcgatcattgcggccaacgagatgggcttactcgagaccaccaagcgggacctaggtatgtccaaggagccaggtgtggttagccccacctcctacttagacgtcgacctccacccggccagcgcctggacgctatatgcggtcgccaccaccgtgatcacccccatgctacgccatacgatcgagaattccactgcaaacgtcagcttagccgctatcgcgaatcaggccgtagtactgatgggtctggacaaggggtggccgatttccaagatggatctcggcgtacccctgctggcgctcgggtgctatagccaggtgaatccgctgaccctgacggccgccgtgctcctattaatcacgcactacgcgatcatcgggccgggccttcaggccaaggcgacacgggaagcgcagaagcgcaccgccgcgggaattatgaaaaacccgaccgtcgacgggattatgacgatcgacctggaccccgtgatctatgactccaagttcgagaagcagctcggtcaggtgatgctcttggtgctgtgcgctgtgcagctcctgttaatgcggacgagctgggccctctgcgaggccctcaccctggcgaccggcccaatcacgaccctctgggaaggcagccccgggaagttctggaataccaccatcgccgtgtctatggccaacatcttccggggctcctaccttgccggggccggactggcgttttctatcatgaaatccgtcgggacgggtaaacggggtaccgggagccagggcgagaccctcggggagaagtggaagaagaaactgaaccaactgagccgcaaggacttcgacctctacaagaagtccggaatcacagaggtagaccgcaccgaggccaaggaggggctgaagcgcggcgaaattacgcaccatgccgtgagccggggctccgcgaagctgcagtggttcgtcgagcgcaacatggtgatccctgaggggcgggtgatcgacctaggctgcgggcgcgggggatggagctactactgcgccggcctgaagaaggtcaccgaggtgcggggctacaccaaaggcgggccggggcatgaggaacccgtgcccatgtccacctacggctggaacattgtcaaactgatgagcgggaaagacgtgttctacctgccgcccgagaaatgtgacacgttgctgtgcgacatcggagagtccagtcccagtcccacggtggaggagtcacggactatccgcgttttaaaaatggtggagccttggctcaagaacaaccagttttgcatcaaggtgctgaacccatacatgcccaccgtcatcgagcacctggagcgactccagcgcaagcacggcgggatgttagtgcggaacccgctgtcccgcaacagcacgcacgagatgtactggatctccaacggcaccggcaacatagtggcgtccgtcaatatggtgtcccgtctcttactgaaccgcttcaccatgactcaccggcggccgacgatcgagaaggacgtagatttgggcgccggtacccggcacgtcaacgccgagcccgagacacccaacatggacgtaatcggtgagcgcatcaagcgcatcaaggaggagcacaacagcacgtggcactacgatgacgagaacccgtacaaaacgtgggcctaccacggctcctacgaagtcaaggccacggggagcgcttcctcgatgatcaacggagtcgtgaagctgctgacaaagccttgggacgttgtgcccatggtgacccagatggccatgacggacaccacccccttcggccagcaacgcgtcttcaaggagaaggtggacacccggaccccgcgcagcatgcccggaacccgtcgcgtgatgggcataaccgccgagtggctctggcgtactctggggcgcaacaagaaaccccggctgtgcacgcgcgaggagttcaccaagaaggtaagaaccaacgccgcgatgggcgcagtgttcaccgaggagaaccagtgggattccgccaaggccgccgtcgaggacgaggacttctggaaactcgtggaccgagagcgagagctgcataagctggggaagtgtggcagctgcgtgtacaacatgatggggaagcgggagaagaagctcggcgagtttggcaaggcaaaggggagcagggctatctggtacatgtggctgggcgcgcgctaccttgagttcgaggcgttggggttcctcaacgaggaccactggttcagccgcgagaattcttactcgggcgtcgagggggaaggcctgcacaagttgggctatatcctgcgggacatcagtaagatccccgggggagccatgtacgcagacgacacggcggggtgggacaccagaatcaccgaggatgacttgcacaacgaggaaaagatcacccagcaaatggacccggagcaccggcaactcgccaacgcaatcttcaagctaacgtatcaaaacaaggtcgtgaaggtccaacgccccacccccaccggcaccgtcatggacataatcagccggaaagatcagcggggctccggccaggtaggcacctacggattgaacactttcaccaacatggaggcgcagctcatccggcagatggaaggcgaaggtgtgctcagcaaggcggacctggagaacccacacctgccagagaagaagatcacccagtggctggagaccaagggcgtcgagcgcctgaagcggatggccatttccggtgacgattgcgtggtgaaacctatcgacgaccggttcgccaacgccctcctggccctgaacgacatggggaaagtcagaaaagacatcccccagtggcagccctcaaagggctggcacgactggcagcaggtaccgttctgctcccaccactttcacgagttaatcatgaaggacgggcgaaagctggtggtgccctgtcgaccgcaggacgagctgatcggcagagcgcggatcagccagggagccggctggtcccttaaggagacggcctgcctgggcaaggcctacgcccaaatgtggagcctgatgtactttcacagacgagacctccgcctggcatccaacgccatctgctccgctgtccccgtgcactgggtcccgaccagcaggacaacatggtctatccacgcccaccaccagtggatgacaactgaggacatgctgaccgtctggaaccgtgtctggattgaggacaacccttggatggaggacaagacccccgttacgacctgggagaatgtcccctatctgggcaagcgagaggaccagtggtgcggctctctaatcggattaacctcgcgggcgacctgggcacagaacattccgacggccatccaacaggtccgctcattgatcggaaatgaagagttcttagactacatgccctccatgaagaggttccgcaaggaggaggagagcgagggagccatatggtga

SEQ ID NO: 25813 - RNA, 9873 nt, synthetic construct
  misc_feature 1..9873: note = derived and/or modified CDS sequence (opt11) from DENV-3__JN000936__SS-prME
  source 1..9873: mol_type = other RNA
accagcttgtgcctcatgatgatcctgccggccgccctggcgttccacttaaccagccgagacggagagccccggatgatcgtggggaagaacgagcgcggcaagagcctgctgttcaagaccgcctccgggatcaacatgtgcaccctcatcgcaatggacctcggggagatgtgcgacgatacggtgacctacaagtgcccccacatcacagaggtggagccggaggacatcgactgctggtgcaacctcacctcgacctgggtgacctacgggacgtgcaaccaggccggcgagcaccggcgcgataagcggtccgtggcccttgccccccacgtgggtatgggtttggacacccgcacccagacctggatgagcgctgagggcgcctggcgccaggtggaaaaggtggagacctgggccctgcgtcacccggggttcaccatcttagcgctgttcctggcgcactacatcgggacctcactcacccagaaggttgtgatcttcatcctgctgatgctcgtcacgcccagcatgaccatgcggtgcgtgggggtgggcaaccgtgactttgtcgagggcctgtccggggccacctgggtggacgtggtcctggagcacggcgggtgcgtgaccacgatggctaagaacaagcccaccctcgacatcgaactgcagaagaccgaagccacccagctggcgacgttgcggaaactgtgcatcgagggcaagatcaccaacatcaccaccgacagccgctgccccacgcagggcgaggccaccctgccggaggagcaggaccaaaactacgtgtgcaaacacacctatgtagaccgggggtggggcaacgggtgcggcctattcgggaagggctccctggtgacctgcgccaagtttcaatgccttgagcccatcgagggcaaggtggtccagtacgagaacctcaagtacacagtgatcatcaccgtgcacaccggggaccagcaccaggtcgggaacgagacccagggtgtgacggccgaaatcacgccccaggccagcaccaccgaggccatcctgcccgagtacggcacgctggggctcgagtgctccccgcgcacgggccttgacttcaacgagatgatactgctcaccatgaagaataaggcctggatggtccaccggcagtggttctttgacctgcccctgccttggacgagcggcgccaccacggagacccccacctggaaccgcaaggagctcctggtgaccttcaagaacgcgcacgccaagaagcaagaggtggtcgtgctgggcagccaggagggcgcgatgcacacggccctcaccggggctaccgagatccagaacagcggcgggacctccattttcgccggccatcttaagtgccggctgaagatggacaagcttgagctgaagggcatgagctacgccatgtgcacgaacaccttcgtgctgaagaaggaggtctccgaaacccagcacgggacgatccttatcaaggtggagtacaagggcgaggacgtgccgtgcaagatacccttcagcactgaagatgggcagggcaaggcgcataacggccgcctgatcacagccaacccagtcgtgaccaaaaaggaggagcccgtgaacatcgaggcggagccgcccttcggggagagcaacatcgtcatcggcataggggacaacgctctgaagatcaactggtacaagaagggctccagcatcgggaagatgtttgaggccaccgcccggggcgcccggcgcatggcaatcctgggcgacacggcctgggactttgggtccgtgggcggggttctgaacagcctgggcaagatggtccaccagatcttcggatccgcgtacaccgccctattcagcggggtgtcctgggtgatgaaaataggcatcggggttctgctgacatggatcggcctgaacagcaagaacacctccatgagcttctcctgcattgccatcggcatcatcacgctctacctgggcgccgtggtgcaggccgacatggggtgcgtcatcaattggaagggcaaagaactgaagtgcggcagcgggatcttcgtgacaaacgaggtgcacacctggaccgagcagtacaagttccaggcggactccccaaagcgcctcgccacggccatcgccggcgcctgggaaaacggggtctgtggcatccgatccaccacacggatggagaatctcctgtggaaacagatcgcgaacgagctcaactacatcctttgggagaacaacatcaagctgaccgtggtggtcggagacatcattggcgtgctcgagcaaggcaagcgcactcttactccccagccgatggagctgaagtactcctggaagacctgggggaaggccaagatcgtgactgccgaaacgcagaacagctcctttatcatcgacggccccaacacccccgagtgccccagcgtctcccgggcctggaacgtgtgggaggtggaggactacgggttcggcgtctttacaaccaacatatggctcaagctgcgcgaggtgtacactcagctatgtgaccatcggttaatgagcgcggccgtaaaggacgaacgtgccgtccacgccgacatgggctattggatcgagagccagaagaacgggtcctggaagttagagaaggccagcctgatcgaggtgaagacgtgcacctggccgaaaagccacaccttgtggagcaacggcgtgttagagtccgacatgatcatccccaagagcctggcggggcccatctcccagcacaatcaccggcccggctaccacacccagacggccggaccctggcacctcggcaagctggagctggacttcaactattgcgagggcaccaccgttgtgatcaccgagaactgcgggacgaggggccccagcctccggaccaccaccgtgtccgggaagctgatccacgagtggtgctgccgcagctgcacgctgcctccgctccgatacatgggcgaggacgggtgctggtatggaatggagatccgccccatatccgagaaagaagagaacatggtcaagagcctggtgagcgccggcagcgggaaggttgacaatttcaccatgggcgtcctgtgtctcgcgatcctgttcgaggaggtgatgagagggaaattcggaaagaagcatatgattgcaggggtggtgttcaccttcgtgctgctcctgtcaggccaaattacctggcgggacatggctcacacgctgatcatgatcggcagcaacgcctccgaccggatgggtatgggcgtgacctacttagccctgatcgccaccttcaaaatccagccctttctggccctaggattcttcctgcgaaagttaaccagccgggagaatctcctgctgggcgtcggcctcgcgatggccacgaccctgcagctgcccgaagacatcgagcagatggccaacgggatcgccttaggtctgatggcactgaagctcataactcagttcgagatctaccagctgtggacagccctgatctcgctcacgtgctccaacaccatcttcaccctgaccgtagcctggcgcacggccaccctgatcctcgccggggtctcgctgctgcccatgtgccaaagcagctccatgcggaagaccgactggctccccatggcggtggccgccatgggcgtgccgcccctcccgctgttcatcttcagcctcaaggataccctcaagcgacggtcctggcccctgaatgagggggtgatggccgtgggcctcgtgagcatcctggcctcctcgctgctccggaacgacgtccccatggccggccccctggtggccgggggcctgctcatcgcatgttacgtgatcaccgggacctccgctgacctgaccgtcgagaaggccgcggacatcacatgggaggaggaggccgagcagacgggcgtgagtcacaacctgatgatcaccgtggacgatgacgggaccatgcgcataaaggacgacgagaccgagaacatcctaaccgtcctgctgaagacggccctcctcatcgtgtccgggatcttcccgtactccatccccgctaccctgctcgtgtggcacacctggcagaagcaaacccagcgctccggggtcctgtgggacgtgcccagcccacccgagacgcagaaggccgagctggaggagggtgtgtaccgcatcaagcaacagggaatcttcgggaagacccaggtcggcgtgggggtgcagaaggagggcgtcttccacaccatgtggcacgtgacccggggagcggtgctcacgtacaacgggaagcgcctggagcccaattgggcctccgtcaagaaggacctgatcagctacggcgggggctggcggctctccgctcagtggcagaagggggaggaggtccaagtcatcgccgtcgagcccggcaagaatcccaagaacttccagacgatgcccggcaccttccagaccaccacgggggagataggtgccatcgccctggacttcaagcccgggacctctggctcccccatcattaaccgggagggcaaggtggtggggctatacggcaacggggtcgtgaccaagaacggcgggtacgtatccggcatcgcccagacgaacgccgagccggacggacccacccccgagctggaggaggagatgttcaaaaagcggaacctcaccatcatggacttacaccccgggtccggcaaaacacgcaagtacctgccggccatcgtccgtgaggcgattaagcgccggctccgcacgctgatcctggccccgacccgggtggtggccgccgagatggaggaagccctcaaggggctgcccatccgctatcagaccaccgcgacgaagtccgaacacaccggccgggagatcgtcgacctgatgtgccacgccactttcacaatgcgcctcctgagccccgtgcgggtgcctaattacaacctgatcatcatggacgaggcccacttcacggaccccgcgtctatcgccgcgcgagggtacatcagcacccgtgtcggcatgggcgaggccgccgcgatctttatgaccgcgaccccacccggaacggccgatgcattcccgcagtctaacgcccccatccaggacgaggagcgcgacatccccgagcgcagctggaacagcggcaacgaatggatcaccgacttcgccgggaagacggtgtggttcgtgcccagcatcaaagcgggcaacgacatcgccaactgcctcaggaagaacgggaagaaggttatccagctctcccgcaaaaccttcgacacggagtaccagaagaccaagctgaacgactgggacttcgtggtgaccaccgacatcagcgagatgggcgccaacttcaaggccgacagggttatcgacccgcgtcggtgcctaaagcccgtaatcctgacggacggccccgagcgcgtgatcctggcggggcccatgccggtcaccgccgcctcggccgcccagcgacgcggccgggtcgggcgcaacccccagaaggagaatgaccagtacatcttcaccggccagcccttgaacaacgatgaggaccacgcccactggactgaggccaaaatgttactggacaacataaatacccccgaggggataatcccagccctcttcgagcccgaaagagagaagtccgctgccatcgacggcgagtaccgcctgaagggcgagtcccggaagacgttcgttgagttgatgcgccgcggggacctccccgtctggctggcacacaaggtggccagcgagggcatcaagtacaccgaccgcaagtggtgcttcgacgggcagcggaacaaccagatcctggaggagaacatggacgtcgagatctggaccaaggagggcgagaagaagaagttacggccccgttggctggatgcccgcacctactccgatcctctggccctcaaggaattcaaggaattcgcggcgggccgcaagtccatcgccctcgacctggtgactgagatcggccgggtgccctcccacttagcgcaccgtaccagaaacgccctggacaacctggtcatgctccacaccagcgagcacggggggcgcgcctaccggcacgctgtcgaagagctgcccgagaccatggagacgctgctcctgctgggcctcatgatcctgctgaccgggggcgcgatgctgttcttaatctcgggcaaggggattggcaagacctccatcgggttaatctgcgtcatcaccagctccgggatgctctggatggccgagatcccgctgcagtggatcgccagcgcaatcgtcctggagttcttcatgatggtcctcctgatacccgagcctgagaagcagcgcacgccccaggacaaccagctggcgtacgtggtcatcgggatcctcactctggccgccatcatcgccgccaacgagatgggtctgctcgagaccactaagagggacctgggcatgtccaaggagccgggcgtcgtgagccccacgtcctacttagacgtcgacctgcaccccgcgagcgcctggaccttgtacgccgtggctaccacggtgatcacgcccatgctgagacacaccatcgaaaactccaccgcgaacgtcagcctcgccgccatcgccaaccaggccgtggtgctgatgggcctggataaaggttggccgatttccaagatggacctcggcgtccccttgctggcgctgggatgttacagccaggtgaaccccctgaccctgacggccgcggtcctcctgctcatcacccactacgccatcatcggccccggcctccaggccaaggcgacccgtgaggcccagaagcgcacagccgccgggatcatgaaaaacccgacggtcgacgggatcatgaccatcgatctggacccggtgatctacgactccaagttcgagaagcagcttggccaggtgatgctcctggtcctgtgcgccgtgcagctcctcctgatgcggaccagctgggcgctctgcgaggccctgactctggccacgggacccatcaccaccctctgggaaggctcccccgggaagttctggaacaccacaatagccgtgagcatggcgaacatcttcagaggatcctaccttgccggggcgggcttagccttcagcatcatgaagtccgtcgggacgggcaagcggggtacggggagccaaggcgagacccttggggagaagtggaagaagaagttgaaccagctgagcaggaaggacttcgatctctacaagaagtcaggaattaccgaggtggacaggacggaggccaaggaggggctgaagcgcggcgaaatcacccaccacgcggtatcacggggctccgccaagctgcagtggtttgtcgagcgcaacatggtgatcccggagggtcgggtgatcgacctcggctgcgggcgtggcgggtggagctactattgcgccggcctgaagaaggtcactgaggtgcggggctacaccaagggcgggcccggtcacgaggaacctgtgcccatgtccacgtacggctggaacatcgtcaagctgatgagcgggaaggacgtgttttatctcccgcccgagaagtgcgacaccttactgtgcgacattggcgagtccagccccagcccaaccgtggaggagagccgcaccatccgcgtcctgaagatggtggagccatggctcaagaacaaccagttttgcatcaaggtgctgaacccctatatgcccacggtcatcgagcatctggaacgtctccagcgcaagcacggcgggatgctcgtgcggaaccccctgtcccgcaacagcacgcacgaaatgtactggatctctaatggcaccgggaacatcgtggccagcgtaaacatggtatcgcggctacttctcaaccgcttcaccatgacgcaccggcgcccgaccatcgagaaggacgtggacctcggcgccgggacccggcacgtcaacgcggagcccgagacccccaatatggacgtgattggggagcgcatcaagcggatcaaggaggagcacaacagcacgtggcactacgacgacgagaacccgtataaaacctgggcttatcacggaagctacgaggtaaaggccaccgggagcgcctccagtatgataaacggcgtcgtgaagctgctgaccaagccctgggacgtcgtgcctatggtgacgcagatggccatgaccgacacaacccccttcgggcagcagcgcgtcttcaaagagaaggtggacacgcggacgccgcggagcatgcccggcacccgtcgcgtgatgggcatcaccgcggagtggctctggcggactcttgggcgcaacaaaaagccccggctgtgcacccgcgaggagttcaccaagaaggtccgcaccaacgccgccatgggcgcagtgttcacggaggagaaccagtgggactccgcgaaggccgccgtggaggacgaggacttctggaagctagtcgacagagagcgagagctgcacaagctggggaaatgcggctcttgcgtgtacaacatgatggggaagcgggaaaagaaactcggcgagttcggcaaggccaaggggtcccgcgccatctggtacatgtggctgggcgcgcggtacctcgagttcgaggccctcgggttcctgaacgaggaccactggttcagccgcgagaacagttacagcggagtggagggggaaggcctgcacaagctcggctacatattacgggacattagtaagatccccgggggcgccatgtacgctgacgacaccgccgggtgggacacccgaatcactgaggacgacctgcataacgaggagaagattacgcagcagatggacccggagcaccggcagctagccaacgctatcttcaagctgacctaccagaacaaggtcgttaaggtgcagcgccccacccccaccggcaccgtcatggacatcatcagccggaaggaccagcgcgggtccggtcaggtgggcacgtacgggctgaacacgttcaccaacatggaggcccagcttatccgccagatggaaggcgagggggtgctgagcaaggcagacctggaaaacccccacctccccgagaagaagatcacccaatggctggagacgaagggcgtcgagcgccttaagcggatggccatctcaggcgacgactgcgtggtgaagcccatcgacgaccgcttcgcgaacgccctcttagccctgaacgacatgggcaaggtccggaaggatatcccgcagtggcagcccagcaagggctggcacgactggcagcaggtaccgttctgctcccaccacttccatgagctcatcatgaaggacgggcgcaagctggtggtcccatgccggccccaggacgagttaatcggcagagcccggataagccagggggccggctggtccctcaaggagactgcttgcctgggcaaggcctacgcccagatgtggagcctgatgtacttccaccgccgcgaccttcgactggcatccaacgcgatctgtagcgctgtgcccgtgcattgggtccccacctcccgcaccacgtggagcatccacgcccaccaccagtggatgaccaccgacgacatgcttaccgtgtggaaccgtgtgtggatcgaggataacccctggatggaggacaagacgcccgtcaccacctgggagaacgtgccctacctcgggaagcgcgaggaccagtggtgcggctcactgatcgggctgacctcccgggccacatgggcccagaacatcccgaccgcgattcagcaggtccgcagcctcatcggcaacgaggagtttctggactacatgccctctatgaagcggttccgcaaggaggaggagagcgagggtgccatctggtga

SEQ ID NO: 25814 - RNA, 9873 nt, synthetic construct
  misc_feature 1..9873: note = derived and/or modified CDS sequence (opt11) from DENV-3__HQ541796__SS-prME
  source 1..9873: mol_type = other RNA
accagcttatgcctcatgatgatcttacccgcggccctcgctttccatctcacttcgcgagacggcgagccgcggatgatcgtggggaagaatgaacgcggcaaaagcctgctgttcaaaaccgcctctgggatcaacatgtgtaccctcatagccatggacctgggcgagatgtgtgacgacactgtgacctacaaatgcccgcacataaccgaagtcgagcccgaagacattgactgctggtgcaatctgacctcgacctgggttacctacgggacgtgcaaccaggccggcgagcaccggcgcgacaagcgaagtgtggcccttgcgccccacgtaggcatggggctcgacacccgcacacagacgtggatgagtgccgagggggcctggcgacaggtcgagaaggtggaaacctgggccctgcgtcacccggggtttaccattctcgcactcttcttggcccactacatcggcacctccctcacccagaaggtcgtgatcttcatcctgctgatgctcgtcacccccagcatgaccatgcggtgtgttggagtcggtaaccgcgacttcgtcgagggtctgagtggcgcgacctgggtggatgtggtcctcgagcacggtggatgcgtgactacgatggctaagaacaagcccaccctcgacatcgaactgcaaaagaccgaggctacgcaactggcgacgcttcggaagctgtgcatcgaaggaaagataaccaacataaccaccgactctcggtgtcccacgcaaggggaggcaacattgccggaggagcaggaccagaactacgtatgcaagcacacatacgtggaccgggggtggggcaacgggtgtggcctctttggtaaggggtccttagtgacctgcgccaagttccagtgcctcgagcctatcgagggcaaggtggtccaatacgagaacctcaaatataccgtgatcatcacagtacataccggggatcagcaccaggtaggaaacgaaactcagggagtaacggccgagataacgccccaggccagcacgacagaggcgatcctgcccgagtatggcaccctggggctggagtgctccccgcgaacgggtctggacttcaacgagatgatcctgttgaccatgaagaacaaggcttggatggtccatcggcagtggttcttcgacttaccgctgccgtggaccagcggcgccaccaccgaaacccccacctggaaccgaaaggaactcttggtgactttcaagaacgcccacgccaagaagcaggaggtggtcgtcctgggttcgcaagagggcgccatgcacactgccctcaccggggccaccgaaatccaaaactcgggcggaacctcgatcttcgccggtcacttaaagtgccggctgaagatggacaagctcgagctgaagggcatgagctatgccatgtgcacgaacacctttgtcctgaagaaggaggtctccgagacccagcacgggaccatcttaatcaaggttgagtacaagggcgaggatgtgccgtgtaagatccccttcagcacagaggacgggcaaggcaaggcgcacaacggcaggcttataacagccaaccccgtcgttaccaagaaagaggagcccgtgaacatcgaggcagagccacccttcggggagagtaacaccgtgatcggcattggggataacgctcttaaaattaactggtataaaaagggatctagcatagggaagatgtttgaggcgacggcccggggcgcccgccggatggccatcctgggcgacaccgcctgggacttcgggtccgtgggcggggtcctgaacagtctgggcaagatggtccaccagatctttgggtccgcttataccgcgcttttcagcggcgtctcctgggttatgaagataggcataggggttcttctgacctggatcggcctgaactcgaagaacacgtccatgagctttagttgcatagccatcgggatcatcaccttgtacttaggggctgtggtacaggccgacatgggctgcgtcataaactggaagggcaaggagctgaagtgcgggtccggaatttttgtgaccaacgaggtgcatacctggacggagcagtacaagttccaggcggactcccccaagcgcctggcgaccgcaatcgccggtgcatgggaaaacggcgtctgtggcatccgcagcaccacccggatggagaatctgctgtggaagcagatagcgaatgagctcaactacatattgtgggagaacaatattaagctgacggtggtggtcggggacatcatcggcgtacttgagcagggcaagcgcacgctgacgccccagccgatggagctgaagtactcctggaaaacgtgggggaaagccaagatcgtaacggccgagacccagaactcttcctttatcatcgacggccccaacacccccgagtgccccagcgtctcccgtgcctggaatgtgtgggaggtggaggactatgggttcggcgtattcaccaccaacatctggctcaagctgcgcgaggtgtatacgcagctgtgcgaccaccgcctcatgtctgcagccgtgaaggatgaacgagccgtacacgcagacatgggctactggatagagtcacagaagaacggaagttggaagctggagaaggccagcctgatcgaagtgaagacctgcacctggccgaagtcccatactctatggtctaacggcgtgctcgagtccgacatgataataccaaagagtctggcggggccaatctctcaacacaaccacagaccaggctatcacacgcagaccgccgggccgtggcatctcggcaagctggagctggactttaactactgtgaaggcacgaccgtcgtaatcaccgaaaactgcgggacccgcggtccctcgctccggacaaccactgtgtcagggaaactgatccacgagtggtgctgccgtagctgcactttgccgccgctccggtacatgggcgaggacggctgttggtacggcatggaaatccgccccatctccgagaaggaagaaaacatggtgaaaagcctggtgtccgccggtagcgggaaagtggacaacttcactatgggcgtgctttgcctcgccatcctgttcgaggaggtgatgcgaggaaagttcggcaagaaacatatgatcgcgggggtgttcttcaccttcgtcttgttactgtctggccagataacgtggcgcgacatggcgcacactctgatcatgatcggatccaacgcctccgatcggatggggatgggcgtgacctacctcgctctgatcgccacctttaagattcagcctttcctggccctcggcttctttctgcgcaagctgacaagcagggagaacctactgttaggcgtggggctcgcgatggccacgactctgcaactgccagaagacatcgagcaaatggccaacgggatcgccctcggtttaatggcgttaaaactcatcactcagttcgagacgtatcagctttggaccgccttaataagcctgacttgcagcaacaccatattcacgctgactgtcgcctggcgcaccgctaccctgatcctagccggggtgagcctgctgccggtctgtcagtcgagctccatgcggaagacagactggttaccaatggcagtagcagcaatgggagtgccgcccctcccgttattcatcttcgggctcaaggacactctcaaacgccgctcttggcctttaaacgagggcgtcatggccgtcggcctcgtgtccatattggctagctcactgttgcggaacgatgtccccatggcggggcccctggtggcaggcgggctgctcattgcctgttacgtgatcacgggcacctccgccgatttgacggtcgagaaagccgcggatatcacctgggaggaggaggccgagcagaccggggtgtctcataacctgatgatcacagtggacgacgacggtaccatgcgcatcaaggacgacgagacggaaaacattctaaccgtcttgttgaaaaccgcactcctgatcgtctcgggcatcttcccgtactccataccagcgaccctgctcgtttggcacacgtggcagaaacagacgcaacggagcggggtcttgtgggacgtaccgagccctcccgagactcaaaaggcggagctggaagagggcgtgtatcggatcaagcagcaggggatcttcggaaagacccaggttggggtgggcgtgcagaaggagggcgtcttccacacgatgtggcatgtgacccgcggcgctgtgcttacctacaacggtaagcgcctggagccgaattgggccagcgtcaagaaagacctaatttcctacgggggcgggtggcggttgtctgcccagtggcagaagggcgaggaggtacaggtgatcgccgtggagcccggcaagaatcccaagaacttccagacaatgccaggcacgttccaaactaccaccggtgaaatcggggcgatcgcgttggacttcaagcccggtacgagcggtagccccatcatcaaccgcgagggaaaggtggttggcttgtacggcaatggcgttgtgacgaagaacggcggctacgtcagcggtatcgcacagaccaacgccgagcctgacggaccaacacccgagctggaggaagagatgttcaagaaaagaaacctaacgatcatggacttgcaccccggctcagggaagacccgcaagtacctgccggcaatcgtccgggaggcgattaagcgccgcttgcgcaccctgatccttgcccccactcgggtagtggccgcagagatggaagaagcgctcaagggcctgccaatccggtatcaaacgaccgcgaccaagagcgagcacaccgggcgtgagatcgtcgacctgatgtgccacgccactttcaccatgcgcctcctgtccccggtgcgtgtaccgaactataatctcatcatcatggacgaggcacactttacagaccccgccagcatcgccgcgcgtggttacatctccacccgggtcggtatgggcgaagctgctgccatcttcatgacggccacgccacccggcaccgccgatgctttcccgcagagcaacgccccaatacaagacgaggaacgcgacatcccagagcgctcttggaacagcgggaatgaatggatcaccgactttgctggtaaaacggtttggttcgttccctccataaaagcgggaaacgacatcgccaactgtcttcggaagaacggcaaaaaggtcatccagctgtctcgcaagacctttgataccgaataccagaagaccaagctgaatgactgggactttgtggtgacgaccgacatctccgagatgggcgcaaactttaaggcagacagagtaatcgacccccgtcgctgtctcaaaccggtcatcctcaccgacgggcccgagcgcgtgatcctggccggacctatgccggtcactgcggcttctgccgctcaacggcgcgggagggtcggtcgcaacccgcaaaaggagaacgatcagtacatcttcacagggcagccgctcaataacgacgaagatcacgcccactggaccgaggcgaagatgttactggacaacatcaacacaccagaggggatcataccggccctcttcgagccagagcgggaaaagtccgccgccattgatggcgagtacagactgaaaggggagtcacggaagaccttcgtggaactaatgcgccggggcgacctcaccgtctggctggcccataaagtggcctccgaggggatcaagtatacggatcgcaaatggtgcttcgacggccagagaaacaaccagatcctggaggagaacatggatgtcgagatctggaccaaggagggcgagaagaagaagctccgcccccggtggctcgacgcgcgcacctacagcgaccccctggccctcaaagagttcaaggagttcgccgctggtcgcaagtcaatcgccctggacctggtgacggagataggcagggtcccgagccacctcgcccatcgcacgcggaatgccctagacaacctagtcatgctccacacctccgagcacggaggccgcgcctacaggcacgcggtggaggagttacccgagaccatggaaaccttgctactgttggggctcatgatcttgcttacagggggtgccatgcttttcctgatctctggtaaaggaatcgggaagaccagtataggattaatttgcgtcatcgcatccagcgggatgctatggatggccgagattcccttacaatggatcgcttccgcgatagtgctcgagttcttcatgatggtactcctgatcccggagcctgaaaagcaacgcactccacaggacaaccagctggcgtacgttgtcatcggcatcctcactctggcagcgatcatagcggcgaatgagatgggcctgttagagacaaccaaacgggacttgggcatgtcgaaagaacccggagtggtctcccccacgtcgtatctggatgtcgacctccatcctgcctcagcctggacgctgtacgccgtggcgacgaccgtaatcaccccaatgctgcgtcacaccattgagaactcaactgccaacgtcagtttagccgcgattgccaaccaggcggtggtcttaatgggtttagacaaaggctggcccatcagcaaaatggacctcggggtcccgctgctcgccctaggctgctactcccaggtgaaccccctaacactgaccgctgccgtccttctgctgataacccactatgccatcatcggtcccgggcttcaggcgaaggcgacccgggaagcccagaaacgaaccgcagccggcatcatgaagaaccccacagtcgacgggatcatgaccatcgatctggacccggtgatctacgacagcaagttcgagaaacaactgggccaagtaatgttgttggtactgtgtgcggtgcaactcctcctaatgcggacgtcctgggccctctgtgaggccctcaccctggcgaccgggcccattaccacgctctgggaggggagccctggcaaattctggaacaccacaatcgcggtgtccatggccaacatctttcgcggttcgtacttggccggcgccggtctggcctttagcatcatgaagtccgtcggaacgggcaagcgggggaccggctcacagggcgagactctcggcgagaaatggaagaagaaactgaaccagcttagccgcaaggacttcgatctctacaagaagtccgggataaccgaagtggaccggaccgaggctaaagagggcctgaagcgtggcgagataacccaccacgccgtgtcccgggggagcgctaagctccagtggttcgtcgagcggaacatggtgatcccagagggtcgggtcatagacttggggtgtggtcgcgggggctggtcttactattgtgcaggcctgaaaaaggtcacggaggtgcgtgggtataccaagggcgggcctggccatgaggaaccggtccccatgagcacctacggttggaacatcgtaaagctaatgtccggcaaggatgtgttctacctcccgccggagaagtgcgataccctgctatgcgacatcggcgaaagttccccatctccaacggtagaggagtcacgcacgataagggtcctgaagatggtggagccatggttgaagaataaccagttctgcataaaggtcctgaacccctacatgcccaccgtcatcgagcacctggaacggctccaacgcaaacacgggggcatgctggtacggaatcccttatcgcgcaactccacccatgagatgtactggatctctaacgggacagggaacatagtcgcatccgtcaacatggttagcaggctcctgttgaaccgcttcaccatgacccatcgtcgccccacaattgagaaggacgtggaccttggcgcggggacacggcacgtaaacgcggagccggaaacgcccaacatggacgtgatcggcgagcgcattaagcggatcaaagaggaacacaactcaacgtggcactacgacgacgaaaacccatacaagacctgggcctaccacggcagctatgaagtgaaggccacgggctctgcttcatccatgatcaacggggtcgtgaagctcctcaccaagccatgggacgttgtgcccatggtgacccaaatggcgatgacagacacaacgcccttcggccagcagcgcgtctttaaggagaaggtagatacccggacgccgcgaagcatgcctggcacgaggcgcgtgatggggatcacagccgagtggctctggcggaccctgggtcgtaataagaaacctagactgtgtacccgcgaggaatttacgaagaaggtacgcacgaacgcggccatgggagcggtattcaccgaggagaatcagtgggattcagccaaggccgccgtggaggacgaggacttctggaaactggtcgatcgggagcgcgagctgcataagctgggtaagtgcgggtcctgcgtgtacaatatgatgggcaaacgggagaagaaactcggtgagttcgggaaggcgaagggcagccgcgcgatttggtatatgtggctgggggcccggtacttagagttcgaggcactagggttcctcaacgaggaccactggttctcccgagaaaactcttactccggggtggaaggcgagggactgcacaaactcgggtatatcctgagagacatcagcaaaatccccggcggggctatgtacgccgacgacaccgcgggctgggatacacgcattacagaggatgacctgcacaacgaggagaaaatcacccaacaaatggaccccgagcaccgtcagctcgccaacgcgatcttcaagctgacctaccagaataaggtcgtgaaggtgcagcgccctactcccacgggtaccgttatggacatcatctcgcggaaggaccagcgaggtagcggccaggtggggacctatggactgaacaccttcactaacatggaggctcagctcattcggcagatggagggggagggtgttctgtcgaaggccgacctcgagaacccccacctacccgagaagaaaatcacacagtggctggagactaaaggggtggaacgcctgaagcgaatggcgattagcggggatgactgcgtagtgaagccaatcgacgaccgcttcgccaatgccctcttagccctgaatgacatgggcaaggtgaggaaggacatccctcaatggcagccctccaagggttggcacgactggcagcaggtccccttttgcagtcatcatttccacgagttaattatgaaggacggccgcaagctggtagtaccatgtcgtccccaggacgagctcatcggtagagcccgtatttcccagggcgcgggctggagcctcaaggagacggcctgcctcgggaaggcctatgctcagatgtggtccctgatgtacttccaccgccgagacctccggctagccagcaacgccatttgttccgccgtgcccgtgcactgggttccaacaagccgtacgacctggtccatccatgcccaccaccagtggatgaccacggaggatatgctgaccgtgtggaaccgggtgtggatcgaggacaacccgtggatggaggacaagacccccgtcaccacgtgggagaacgtgccctacctcggcaagcgcgaagaccagtggtgcgggtctttgatcggcctgacatctcgggcaacctgggcgcaaaacatccccaccgccatacagcaggtccgctccctaataggtaacgaggagtttctggactacatgccgagcatgaagcgtttccgcaaagaggaagagagcgaaggcgccatatggtga

SEQ ID NO: 25815 - RNA, 9873 nt, synthetic construct
  misc_feature 1..9873: note = derived and/or modified CDS sequence (opt11) from DENV-3__HQ166034__SS-prME
  source 1..9873: mol_type = other RNA
actagcctatgccttatgatgatcctgcccgctgccctggccttccacctcaccagccgtgatggggagcctaggatgatcgtggggaagaacgagcgggggaagagtctgctgtttaagaccgcgtccgggatcaacatgtgcacgctcattgccatggacctgggggagatgtgcgatgacaccgtcacttacaaatgcccccacataacggaggtcgagccggaggacatcgactgttggtgcaacttaacaagcacctgggttacgtacggaacctgtaaccaagccggcgagcaccgacgcgacaagcggtccgtggccctcgctccccacgtcggcatgggcttggacacccgcacccagacctggatgagtgccgaaggcgcctggaggcaagtcgagaaggtcgagacctgggccttgcgccatccggggttcacaatacttgccttgttcctggcgcactacatcgggacctccctcacccagaaggttgtgatatttatcctgctgatgctcgtcacgcccagcatgaccatgcggtgcgtgggggtgggaaacagggacttcgtcgaaggcctgtcaggagccacctgggtggacgtggtcttagagcatggcgggtgcgtgaccacgatggctaaaaacaaacccaccctggacatagaactgcaaaagaccgaggccactcaattggcgacactccggaagctatgtatcgaggggaaaatcaccaacatcacaaccgacagcagatgccccacgcagggcgaggcgaccctgccggaggaacaggatcaaaattacgtgtgcaagcacacatacgttgaccgtgggtggggcaacggttgtggcctcttcgggaagggctcgctagttacgtgtgcaaagtttcaatgcctggaacccatagagggcaaggtagtccagcatgaaaacctcaagtacactgtgatcatcaccgtgcacaccggggatcagcatcaggtcggcaacgagacgcaaggggtgaccgccgaaataacacctcaggcttcgaccaccgaagcaatcctgcccgagtacggtactctcgggctcgagtgttcgcctcgaaccggcctggactttaatgaaatgatcttactcaccatgaagaacaaggcctggatggtccaccggcaatggttcttcgatctgcccctgccgtggacctcgggcgccaccacggaaacccccacgtggaaccgtaaggagttgctggtgaccttcaagaatgcccatgccaagaagcaagaagtagtcgtgctggggtcccaagagggcgcgatgcacacggccttgaccggtgccaccgagatccagaactctggcgggaccagcatctttgccgggcaccttaaatgtcggctgaagatggacaaactggagctgaagggcatgagctacgccatgtgtacgaataccttcgttcttaagaaggaggtcagtgagactcagcatgggaccatcttaataaaggtggagtacaagggagaggacgtgccctgcaagatcccctttagcacggaagatggacagggcaaggcgcacaacgggcgcctgattaccgcgaatcccgtagttaccaagaaggaggagcccgtgaacatcgaggccgagccacccttcggcgagagcaacatcgtcatcggcataggcgacaacgccctgaagataaactggtacaagaaaggctccagcatcgggaagatgttcgaggccaccgctcggggcgcccgtcggatggccatcctgggtgacacggcctgggacttcggatccgtgggcggggtgctgaacagtctgggcaaaatggtccatcagatcttcgggtccgcgtacactgcgctgttcagcggcgtgagctgggtcatgaaaatcggaatcggggtgctcctgacctggatcggattaaacagcaaaaacacctccatgagcttctcctgcatcgccattgggatcatcacgctctacctcggcgccgtggttcaagccgacatggggtgtgtcataaactggaagggaaaagaactgaagtgcggctcggggatcttcgtgaccaatgaggtacacacatggaccgagcagtacaagttccaagcagactcccccaagcgattggccacggccatcgccggcgcctgggagaacggtgtttgtggcatccgcagcactactagaatggagaatctgctgtggaagcaaatcgcaaacgagcttaactacattctgtgggagaataacatcaaactgactgtggtggtcggggacatcatcggcgtgctcgagcaggggaagcgcaccctgacgccccagccgatggagctgaagtactcatggaagacctgggggaaggccaaaatcgttaccgccgaaacacagaacagttcctttatcatcgatggtcccaacacccccgagtgccccagcgtctcgagagcttggaacgtgtgggaggttgaggattacgggttcggcgtattcacaaccaatatctggctcaagctgcgagaggtgtacactcagctgtgcgaccatagactcatgtcagcggccgtgaaggacgagcgcgccgtacacgccgacatgggctactggatcgagagccagaagaacggctcctggaaacttgaaaaagccagtctgatcgaggtgaagacgtgtacctggccgaagtcccacaccctctggagcaacggagtgctggagtccgacatgatcattcccaaatcacttgcgggccctatttcccaacacaaccatcggccgggctaccatacgcagacggccggcccctggcatctcggcaagttagagctggactttaactactgtgagggaaccacagtggtgatcaccgagaactgtgggacgcgcggcccctccctccgcacgactaccgtatccggcaagctgatccacgagtggtgctgcagaagctgtacgctgcccccactccggtacatgggagaggacgggtgctggtacggcatggagattcgcccgatctccgagaaagaagagaatatggtgaaaagccttgtgtccgccggcagcggaaaagtggacaacttcaccatgggcgttctgtgcctcgctatccttttcgaggaggtgatgcggggtaaattcggtaaaaagcatatgatcgcaggagtgttcttcacctttgtcttactcctatcaggccagattacctggcgcgatatggcgcacacgctaataatgatcggcagcaacgcctccgaccggatggggatgggcgtgacttatctcgccctgatcgccacgtttaaaatccagccgttcttggcgctcggcttcttcctgagaaagctgaccagccgggagaacttattgctgggggtggggctcgcgatggccaccacgctgcagctgcccgaggacatcgagcagatggcaaacgggatcgcacttggcctgatggcgctgaaattgatcactcagtttgagatataccaactgtggaccgcgctgattagtctcacttgttcaaacaccatattcaccctgacagtagcctggcgcacggccaccctgatactcgctggagtgagcctgttacccatgtgccagagttccagtatgcgcaagaccgattggctccccatggcggtcgccgccatgggcgtgccgcccctccctctgttcatcttctcgctcaaagacaccctgaaacgccgctcctggcctctgaacgagggggtgatggctgtcggcttggtcagcatcctggcctccagcctgctccggaacgacgttcccatggcaggccccctcgttgccgggggcctgttgatcgcctgctacgtgatcacggggacatccgccgacctgacagtggagaaagcggcggacatcacctgggaggaggaagcagaacagacgggcgtcagccacaacctgatgattacggtcgacgacgatggcacgatgaggatcaaagacgacgagaccgagaatatcctcaccgtgctgcttaagacagcgctactgattgtctccggtatattcccgtacagcattccagccaccctgctcgtgtggcacacctggcagaagcagacccagcgctctggcgtgctttgggacgtcccctccccgcccgagacgcagaaagccgagctggaggaaggggtctaccgcatcaagcagcagggtatcttcgggaagacccaggtgggagtcggggtgcagaaggagggcgtgtttcacaccatgtggcatgtcacgcgcggtgcggtgctcacgtataacgggaagcgcttggagcctaactgggcctccgtaaagaaggatctgattagctacggcggtgggtggcgactcagtgcccagtggcaaaaaggggaggaggtccaggtcatcgcggtggagcctggcaagaaccccaagaactttcagaccatgccaggcaccttccagaccacgactggagagatcggcgctatcgccctggactttaagcccgggaccagtggcagcccaataattaaccgggagggcaaagtcgtggggctgtacggcaacggagtggtcacaaagaacggcggatacgtgtccggcatcgctcaaacaaacgccgagcccgacggtcccaccccagagctggaggaggagatgttcaaaaagagaaacctcaccatcatggacctgcaccctgggagcggaaagacccgaaagtatctgccggccattgttcgggaggcgatcaaaagaagactccgcactctgatcctggcacccacccgtgttgttgccgccgagatggaggaggcattgaaagggctaccgatacgatatcaaaccaccgctacgaagtccgagcacacaggccgggagatcgtggacttaatgtgccatgccacgttcactatgaggctcctaagccccgtgcgggtccccaactacaacctgatcataatggacgaggcccactttactgaccccgcttccatcgcagcgcgaggatacatctcaacccgtgtaggcatgggcgaggccgcagcaatcttcatgaccgcgacgccgcccggcacggccgacgcctttccccagtccaacgcgcccatccaagacgaggagcgcgacatccctgagcgcagttggaactccggcaacgagtggatcaccgatttcgccggaaagacagtctggttcgtgccctcgatcaaggcgggcaatgacatcgccaactgtctcaggaaaaacgggaaaaaggtaattcagctgtcccgcaagaccttcgacacagagtatcagaaaaccaagctgaatgactgggacttcgtggtgaccactgacattagcgaaatgggagcaaacttcaaggccgacagggtgatcgacccgcgccggtgcctgaagcccgttatactgacggacggcccggagagggtgatcctagccgggccaatgccggtaacggctgcctccgcggcgcagcggcgcggccgagtcgggcgcaacccgcagaaagagaatgaccagtacatcttcaccggccagcccctcaataacgacgaggaccacgcccactggaccgaggcgaagatgcttcttgacaacatcaacaccccggaggggataatcccggcgttatttgaacccgaacgggagaagtctgccgccattgatggagagtaccggctgaaaggagagtcccggaagaccttcgtggagctgatgcgccgcggggacctcccggtctggctcgcccacaaggttgccagcgagggaatcaagtacactgacagaaagtggtgcttcgacgggcagcgtaacaaccagatcctggaggagaatatggacgtcgagatctggaccaaggagggcgagaaaaagaagctaagaccacgctggctggacgcccgcacctactcagacccgctggccctcaaggagttcaaggagtttgccgcgggtcgcaagagtatcgccctggacctggtcacggagatcgggcgggtaccttcccacctggctcaccggacccggaacgccctggacaacttggtgatgttacacacgagcgaacacggtgggcgcgcctaccggcatgcggtcgaggagctaccggagaccatggagacgttattgttattaggactcatgattctattaaccggaggggccatgttgttcctgatctccggtaaggggatcggaaaaaccagtatcgggctgatttgtgtcatcgcctcttctggcatgctctggatggctgagatcccgctgcaatggatcgccagcgcgatcgtactggagttcttcatgatggtcctcctcatccccgaacccgaaaaacaacgtacgccccaggacaatcagttagcctacgtggtgatcgggatcctcacactagcagcaatcatcgcagccaacgagatgggcctattggagaccacgaagcgcgacttaggcatgtcaaaggagcccggggtcgtgtcgcccacatcctacctggacgtagacctccatcctgcctctgcctggacgctgtacgccgtcgcgaccacggtgataacacctatgctgaggcataccatcgaaaattccacggctaacgtgagcttggcagccatcgccaaccaagctgtagtgctgatgggtctggacaagggatggccgatttccaagatggacctcggcgtccccctgctggctctcgggtgctacagccaggtcaatcccctgacgctgaccgccgcagttctcctgcttattacgcactacgccatcataggccccgggctacaagcgaaggccacacgggaggcccagaaacggaccgccgccgggattatgaaaaacccgactgtggacggcatcatgaccatagatctggaccccgtaatctatgactccaagttcgaaaagcagctgggacaggtgatgctcctcgtgctgtgcgttgtgcagctcctgttaatgcggaccagctgggcgctctgcgaggccctcaccctggccaccggccccattacgaccctctgggagggctcccccgggaagttctggaacaccacaatcgccgttagcatggcgaacattttccgcgggtcctacctggccggtgccggcctggcgttcagcatcatgaagagtgtcgggacgggaaagcggggcaccggcagccagggcgagacattaggcgagaagtggaagaagaaactgaaccagctcagtcgcaaagacttcgacttatacaagaagtccggcatcaccgaggtcgaccggacagaggccaaggaaggcctgaagcgcggcgagatcacacaccacgcggtgagccggggctccgccaagctgcaatggtttgtcgagcgcaacatggtgattcccgaggggagagtgatagacctcggatgtgggcgcggcggttggagctactactgcgccggcttgaagaaggttaccgaagtgcgaggttacacgaaaggcggacccgggcacgaggagcccgtgccgatgtccacgtacggatggaatatcgtcaaacttatgagcggtaaggacgtgttctacctcccgcccgagaagtgcgacacgctgctgtgtgacataggtgagtctagcccatcccccaccgtggaagagagccgcactatccgcgttcttaaaatggtggagccttggcttaagaacaaccagttctgtataaaggtactgaacccttacatgcccaccgtcatcgagcatctggagcgactccagcgcaaacacggagggatgctggtgagaaaccccctgtcccggaatagtacgcacgagatgtactggatcagcaacggcaccgggaacatagtggcctcagtgaacatggtgtcccggctcctcctgaatcgcttcaccatgactcaccgacgcccgacgatcgagaaggacgtggatctcggtgcgggaacaagacacgttaacgcggagcccgaaaccccaaacatggacgtgatcggggagcgcatcaagcgaattaaggaggagcacaactccacctggcattatgacgatgagaacccgtacaagacgtgggcctaccatggcagttatgaggtaaaggccaccgggagcgcttccagcatgatcaacggcgtcgtcaaactgttgaccaaaccttgggacgtcgtccccatggtgactcaaatggccatgactgacaccaccccctttggtcagcagcgcgtcttcaaggagaaggtggacactagaacgccgcgcagtatgcccggcaccaggcgcgtaatgggaatcacagcagagtggctctggcgcactctggggagaaacaagaagcctcgtctgtgcacgcgggaggagttcaccaagaaggtgcgcaccaacgccgccatgggcgcggtgttcaccgaggagaaccaatgggactccgcgaaggcggccgtcgaggacgaggacttctggaagttagttgaccgcgagcgcgaactgcataagctgggaaagtgcggcagctgcgtgtacaatatgatgggcaagcgggagaagaagctcggcgagttcggcaaagccaaaggttcccgcgccatctggtacatgtggctgggtgcacggtacttggagttcgaggcccttgggttcctaaacgaggaccactggttcagccgcgaaaattcctactcaggcgtggaaggggagggcctgcacaagctaggttacatattacgggacatcagtaagattccaggggccgccatgtacgccgacgacacggcgggctgggataccagaatcacggaagacgaccttcacaacgaggagaagattacccagcagatggacccggagcaccgacaactcgccaatgccatttttaaattgacatatcagaacaaagtcgtgaaggtgcagaggcccacccccaccggtaccgttatggacataatcagcaggaaggatcaacgcggctccggccaggtggggacgtacggcctaaacaccttcaccaacatggaggcccagctcatccgccaaatggaaggggagggtgtgctgtccaaggccgacttagagaacccccacttaccagagaagaaaatcacccaatggcttgagactaagggggtggaacgactgaagaggatggctatctccggcgatgactgcgtggtgaagccgatagacgatcgctttgccaacgccctgttagccctgaatgacatggggaaggttcggaaggatattccccaatggcagcccagcaaggggtggcacgactggcagcaggtcccgttctgttcccaccacttccacgaactcatcatgaaggatggccgcaagctggtggttccgtgccggccccaagacgagctgatcgggcgcgcgcggatctcccaaggcgcggggtggtccctcaaggagacggcctgcttaggcaaagcctacgcccaaatgtggagcctgatgtacttccaccgccgcgaccttcggttggcgtcgaacgccatctgcagcgccgtgccggtgcactgggtgcccacctcccggaccacctggtccatccacgcacatcaccagtggatgaccaccgaggatatgttgaccgtttggaacagggtgtggatcgaggacaatccatggatggaggacaagactcccgtaacgacatgggaaaacgtgccgtatttaggaaagcgcgaggaccagtggtgcggaagcctcattggcctgaccagtcgggccacttgggcgcagaacattccgacggccatccaacaagttcgcagcctcattgggaacgaggagttcctagattacatgccctctatgaagcggttccgcaaagaggaggagtccgagggagctatatggtga

SEQ ID NO: 25816 - RNA, 9873 nt, synthetic construct
  misc_feature 1..9873: note = derived and/or modified CDS sequence (opt11) from DENV-3__HM756274__SS-prME
  source 1..9873: mol_type = other RNA
accagcttgtgcctcatgatgatcctgcccgccgctctggccttccatctcaccagcagggacggggagccccgtatgatcgtggggaagaacgagcggggcaagagcttactgttcaagaccgctagtgggatcaacatgtgtaccctcatcgccatggacctgggggagatgtgcgacgacaccgtgacctacaagtgcccccacataacagaggtggagcccgaggacatcgactgctggtgcaaccttaccagtacctgggtgacctacgggacatgcaaccaggcgggagagcaccggagggacaaacggtccgtggccctggctccccacgttggcatggggcttgacacccggactcagacctggatgagcgcggagggcgcctggcgccaagtggagaaggtggaaacgtgggccctccgccatccagggttcaccatcctcgcgctgttcctggcccactatatcggtacctccctaactcaaaaagtggtgatcttcatcctgttgatgctcgttacgcccagcatgaccatgcggtgcgtgggggtgggcaaccgcgacttcgttgagggcctgagcggggcaacctgggtggacgttgtcctggagcacggcgggtgtgtgactacgatggccaagaacaagcccaccctcgacatcgagctgcagaagacagaggccactcagcttgcgacgttacggaagctgtgtatcgaggggaagattaccaacatcaccaccgacagccgctgccccacgcaaggcgaggccaccctgccggaggagcaagaccagaactacgtttgtaagcatacctacgtcgaccggggatggggcaatgggtgcggccttttcgggaagggctcattagtgacctgcgccaagttccaatgcctggagcccatcgagggcaaggtggtacagtacgagaacctcaagtacacggtgatcatcacagtgcacactggtgaccagcaccaggtcggtaacgaaacccaaggcgtgacggccgagatcacgccccaggccagcactacagaggcgatcctgcccgagtacggcaccctgggattagagtgctcaccccgcacggggcttgacttcaacgaaatgatcctgctcacgatgaagaacaaggcctggatggtccaccggcagtggttcttcgacctgcccctaccgtggacctccggcgccacgaccgagacccccacgtggaaccgcaaagagctgttggtgaccttcaagaacgctcacgccaagaagcaggaggtggtcgtactggggtcccaggagggagcgatgcacaccgccctcaccggggctaccgaaatccaaaacagcggcgggacctccatattcgccggccatctgaagtgtcggttaaagatggacaagctcgagctgaagggaatgagttacgccatgtgcactaatgcgttcgtactgaaaaaggaagtaagcgagacccaacacgggactatcctaatcaaagtggagtacaagggcgaagacgtgccatgcaaaattcccttcagcaccgaggacggacagggcaaagcgcacaacggtcggcttatcacggccaacccagtcgtgaccaagaaggaggagcccgtgaacatcgaggccgaaccgcccttcggggagtccaatatcgtcatcggcatcggagacaatgcgttaaaaatcaactggtacaagaagggctcctcgatagggaagatgtttgaggctacagcccgtggcgcccggcggatggcgatcctgggcgacaccgcctgggactttggatccgtaggcggcgtactaaattcacttggcaagatggtccaccagattttcgggtccgcctacacggccctgtttagtggcgtctcctgggtgatgaaaatcggcatcggggtcctcttgacctggatcggcctgaacagcaagaacacctccatgagcttctcctgcatcgccattgggatcatcactctctatctgggcgccgtcgtgcaggctgacatggggtgcgtcatcaactggaagggcaaggagctgaagtgcggttcggggatatttgtgacgaacgaggtgcacacctggaccgagcagtacaagtttcaggccgactcccccaagcgccttgccaccgccatcgccggagcgtgggagaatggtgtctgcggcatacgcagtacaacgcggatggagaacctgctgtggaagcagatcgccaacgagctcaactatatactgtgggagaacaacatcaaactgaccgtggtggtgggggacataatcggcgtgctcgaacagggcaagcgcaccctgacgccccagccgatggaactcaagtattcctggaagacctggggaaaggccaagatcgtgaccgccgagacacagaacagctccttcatcattgacggccccaatacgcccgagtgcccctccgtcagccgcgcgtggaacgtctgggaagttgaggactatgggttcggcgtcttcacgacaaacatttggttgaagctgcgcgaggtatacacccagctgtgcgaccaccgcttgatgtcagccgcagttaaggacgaacgcgccgtccacgcagacatgggctactggattgagagccagaagaatgggtcctggaagctagaaaaggcgagcctgatcgaggtgaaaacctgcacctggccgaaaagccacaccttatggtcgaatggcgtcctggagtctgacatgatcatccccaagagcctggccgggccaatctcgcagcacaaccaccggccgggctaccacacccagacagccggcccttggcacttaggcaagctggagctggacttcaactattgtgagggaaccaccgtagtgattacggaaaactgcgggacccgcggccccagcctcagaacgaccaccgtctcagggaaactgatccacgagtggtgctgccgcagctgtacactacccccattgcggtacatgggcgaggacggctgctggtatggcatggaaatacggcccatctctgagaaggaggaaaatatggtcaagtcgctggtgtccgccgggtcggggaaggtggacaactttacgatgggtgtgctgtgcctcgcaatccttttcgaggaggtgatgcgggggaaattcggcaagaagcatatgatcgcgggtgtgttcttcaccttcgtcttgctcctgagtggccagattacttggcgtgacatggcccacacactgatcatgataggaagcaacgcttccgaccggatggggatgggcgtgacgtatttggcactcatcgctaccttcaagatacagccctttctggcgttaggattcttcctgcgcaagctgacgagccgagagaatctcctgctgggcgtgggcctcgcaatggcaaccacgctgcagctgcccgaggacatcgagcaaatggccaacggaatcgctctgggtttgatggcactgaagctcatcacccagttcgagacataccaactgtggactgctcttattagcctcacttgctccaacaccatttttaccctgaccgtggcctggcgcacggccacccttatcctcgcgggcgtgagcctgctgccggtttgtcagtccagcagtatgcggaagaccgattggctccccatggccgtggccgcaatgggcgtgccgcccctcccattattcatcttcggtctcaaagacaccctgaaacgtagaagttggcccctgaacgagggcgtcatggccgtgggcctcgtatccatcctggcgagctccctgctccggaacgacgtccccatggccgggcccttagtggcaggagggctgctcatagcctgctacgtgatcacggggactagcgccgacctgaccgtcgagaaggcggcagacatcacctgggaggaggaggcggagcagacgggggtgagccataacctgatgatcaccgtagacgatgacggcacaatgcgcatcaaggacgacgagaccgagaacatcttaacggtcctgctgaagacggccctcctgatcgtgagcggcatcttcccttactccatcccagccaccctgctcgtgtggcacacctggcagaagcagacccagcgcagcggggtactgtgggacgtaccaagcccgcccgagacacagaaggcggagctagaagagggcgtttaccgcatcaaacagcagggtatcttcggcaagacccaggtgggggtgggcgtgcagaaggagggagtattccacaccatgtggcatgtcaccagaggggccgtgctcacacacaatggcaagcgccttgagcccaactgggccagtgtcaagaaggacctgatctcctacgggggcgggtggcggctcagcgcccagtggcagaagggcgaggaggtgcaggttatcgcggtcgagcccgggaagaatcccaaaaacttccagaccatgcccgggacattccagaccacgaccggagagattggggccatcgccctggacttcaagcccggcacctcgggcagcccgatcatcaaccgcgagggaaaggtggtgggcctatatggcaacggcgtcgtgaccaagaatgggggttacgtaagcggcatcgcccagacgaacgccgagccggacgggcctacccccgagctggaggaggagatgttcaagaagcgtaacctcaccatcatggacctgcaccccggctccggcaagacccgcaagtacctgccggcgatcgtccgcgaggccattaaacgccggctccgcactctgatcttggcccccacccgcgttgtagcagccgagatggaagaagcactcaagggcctgcccatccgctaccaaaccacagccaccaagtccgagcataccgggcgggagatcgtcgacctaatgtgccacgctacattcacgatgcgtctcttgtcccctgtgcgggtgccaaattataacctgatcataatggatgaagcccattttacggaccccgccagcatcgcggcccgcgggtacatctccaccagagtcggcatgggtgaggccgccgcgatttttatgactgccacgccgcccggaacggccgacgcctttccgcaatcaaacgcccccatccaggacgaggagcgagatatccccgaacgctcctggaactcagggaacgagtggatcacggacttcgctggaaagaccgtgtggttcgtgccctccatcaaggccggaaacgacatcgccaactgccttcgtaagaacggtaagaaggtcatccaactgagccgcaagaccttcgacacggagtatcagaagacgaaactgaacgactgggacttcgtggtgaccactgacatttccgagatgggcgccaacttcaaggcggaccgcgtcatcgatccgcgtcggtgcctcaaacccgttatcttaacggacggccccgagcgcgtgatcctggcgggacccatgccggtcaccgcagccagcgccgcacagcggcgcggccgggtgggccgcaacccccagaaggagaacgaccaatacatcttcaccggccagcccctcaacaacgacgaagaccacgcgcactggaccgaggctaagatgctgctggataatatcaacactcccgagggtatcatcccggccctcttcgaacccgagcgggaaaagagcgccgcgattgacggcgagtaccgcctgaagggggagagccgaaagacgttcgtggagctgatgcgcagaggggatctccccgtctggttagcgcacaaagtggcttccgagggcatcaagtacaccgaccggaaatggtgcttcgacggccagaggaacaaccaaatcttggaggagaacatggacgtggagatctggaccaaggaaggcgaaaagaagaagctccgcccgaggtggctcgacgcccgcacctacagcgacccgctggccctcaaagagtttaaggagttcgcggccggccgcaaatccattgccctggacctggtgacggagatcggccgcgtacccagccacttggcccacagaacccgtaatgccctggacaatctggtgatgctccatacgtccgaacacgggggccgcgcgtaccggcacgccgtggaggagctgcccgagacgatggagacgctgctactgctggggctcatgatcctgctgaccggcggagccatgctgttcctgatcagcggaaaaggcatcggtaaaaccagcatcggactgatctgcgtgatcgcttccagtgggatgctctggatggccgagatcccgttgcagtggatcgcgtccgccatagtccttgagttcttcatgatggtgctgctgatccccgaacccgagaagcagcgcactccccaggacaaccagctggcctacgtcgtcataggcatattaacgctggccgctataatcgcggccaacgagatgggcctgctcgagaccaccaagcgggacctgggaatgagcaaagagcctggcgtggtgtcccccacatcttacctggacgttgatctccacccagcctccgcctggacgctgtacgcggtagcgacgaccgtgatcactcccatgctgcgccacaccatcgagaacagcaccgccaacgtatccttagctgccattgctaaccaagccgtggtactaatgggactggacaagggctggccgatcagcaagatggacctcggggtcccactgctggccctcggctgctacagtcaggtgaaccccctaacactgacggccgcagtgctcctgctgatcacgcactacgcgatcatcggccctgggctgcaggcgaaagccacccgggaggctcagaagcggaccgccgcaggtatcatgaagaacccaaccgtcgacgggatcatgaccatcgaccttgatccagtgatctacgacagcaagtttgaaaagcagctgggccaggtgatgctgctggtcctgtgtgccgtgcaattattgctgatgcggacctcctgggccctctgcgaggcactgacgttggcgaccggcccaataacgacgctctgggaggggagccccgggaagttctggaacaccaccatcgccgtgtccatggccaacatcttccgcgggagctacctggctggcgccgggttggcgttctccataatgaagtccgtcggcactggcaagcggggtacaggctcccagggcgagaccctcggggaaaagtggaagaagaaactgaaccagctttcccggaaggatttcgacctctacaagaagtccgggattaccgaggtggatcgcaccgaggccaaagaaggcctgaaacggggcgagatcacgcatcatgccgtgtcccgaggaagcgcaaagctgcagtggttcgtggagcgcaacatggtgatcccggagggccgggtgatcgatctcgggtgcggccgcggtggctggtcctactactgtgcaggtctaaagaaggtcaccgaggtgcggggttacaccaagggcgggcccggccacgaggagcctgtccctatgagcacgtacgggtggaacatcgtcaaactgatgtccggtaaggacgtgttctacctccctcctgagaagtgcgacacgctcctgtgtgacataggcgagtcttccccaagccccaccgtggaggagtcccgaaccatccgcgtcctaaaaatggtggagccgtggctcaaaaataaccagttttgcattaaggtgttaaacccctacatgcccaccgtcatcgagcaccttgagcggctccagcggaagcacggcggcatgttggtacggaaccccctgagccgcaactccacgcacgagatgtactggatcagcaacgggaccggcaacatcgttgcttccgtcaacatggttagccgtctactcctcaatcgctttaccatgacccaccggagaccgacgatcgaaaaggacgtcgatctcggcgctgggacccgccacgttaacgccgagcccgagacacccaacatggacgtgatcggcgagcgcatcaagcggatcaaggaagaacacaactccacctggcactacgacgacgagaacccgtacaagacgtgggcctaccacgggagctacgaggtgaaagccaccggctccgcgagctccatgatcaacggggtcgtgaaactgcttactaagccctgggacgttgtgccgatggtgacccagatggccatgacggatacgacccccttcggccagcagcgagttttcaaggagaaagtggacaccagaaccccgcgcagtatgcccggcacccggcgcgtaatggggattacggcagagtggctctggcgcaccctgggcaggaacaaaaagccacggctgtgcacccgcgaggagtttaccaagaaggtacgtacgaatgccgcgatgggggccgtgttcacggaggagaaccagtgggacagcgccaaggctgccgtggaagacgaggacttctggaagctcgtcgaccgggagagggagctgcataagctcggcaagtgcgggtcctgcgtgtacaacatgatgggtaaacgggagaagaagttgggggaatttggtaaggcgaaaggcagccgcgccatatggtatatgtggctgggtgcgcggtacctcgagttcgaggccctcggtttcttgaacgaggatcactggttctcccgagagaatagctactccggggtggaaggagagggcctgcataaactcgggtatatcctgcgcgacatctcgaagatccccggcggggcaatgtacgcggacgacacggccggctgggacacccgcatcacggaggacgaccttcataacgaggagaagataacccagcagatggacccggagcaccggcaactcgccaacgcgatattcaagctgacgtaccagaataaggtagtgaaggtgcaacgccccaccccaaccggcaccgtaatggacattatctcccggaaagaccaacgcgggagcggtcaagtggggacgtacggcctgaacactttcaccaatatggaggcccagctaatccggcaaatggagggcgagggagtgctgtccaaggcggacctggagaacccccatctgcctgagaagaagatcacgcagtggctggagaccaagggcgtcgagcgcctgaagagaatggctatatcgggcgatgactgcgtggtgaagccaattgacgaccgattcgctaacgcacttcttgcactgaacgacatgggcaaggtgcggaaggacattccccaatggcagccgtccaaggggtggcacgattggcagcaggtcccgttttgcagccaccacttccacgagctcataatgaaggacggccgcaagttagtggtcccgtgtcggccccaggacgagctgatcgggcgcgcgcggatatcccaaggcgcgggctggtcactcaaagagactgcgtgtctggggaaggcctacgcccagatgtggtctctgatgtatttccacaggcgcgacctgcggttggccagcaatgccatctgcagtgcggtgcccgtacactgggtcccgacaagccggactacctggtctatccacgcccaccaccagtggatgaccactgaggacatgctgaccgtgtggaaccgggtctggatcgaggacaacccctggatggaggataagacacccgtcacgacctgggagaacgtgccctacctaggcaagcgcgaggaccagtggtgtgggagcctgataggcctgactagccgggcgacttgggcgcagaacatcccgactgccatacaacaggtccgttccctcatcggaaacgaggagttcctggactacatgcctagtatgaagcggttccgcaaggaggaagagtccgagggcgccatctggtga

SEQ ID NO: 25817 - RNA, 9873 nt, synthetic construct
  misc_feature 1..9873: note = derived and/or modified CDS sequence (opt11) from DENV-3__HM756275__SS-prME
  source 1..9873: mol_type = other RNA
acctccctatgcctgatgatgatcctacctgcagccctagccttccacttgacgtctcgggacggagaacctcggatgatagtcggcaaaaacgaaaggggaaaatccctgctattcaaaacagccagtggcataaacatgtgtacactaattgccatggacctcggagaaatgtgtgacgacactgtcacgtacaaatgtcctcacataacagaagtggaacccgaagacatagactgttggtgcaacttgacaagtacgtgggtcacatacggaacatgtaaccaagccggagaacaccgacgagacaaacgatccgtagcactggcgccacacgtaggcatgggcctggatacacgaacacaaacctggatgtcggccgagggtgcatggcgacaagtcgaaaaagtcgaaacctgggcactgcgccacccaggcttcaccatcttagctttgtttctcgcgcactacatcggcacatcacttacccaaaaagtcgtaatcttcatcctcttaatgcttgtgacaccatcaatgacaatgagatgcgtaggagtcggtaaccgcgattttgtagagggactttcaggggcaacgtgggtggacgtcgtgcttgaacacggtgggtgtgtaacaacaatggccaaaaacaaaccaacgctcgacatcgaacttcagaaaactgaagccacacaactcgcaacgttaaggaaattgtgcatcgaaggtaaaatcaccaatataaccaccgactccaggtgcccgactcagggagaggccactctccccgaagaacaagatcaaaattacgtttgcaaacacacatatgtagataggggttggggaaacggctgtggactgttcggcaaaggatccctagtcacttgtgccaaattccaatgcttggaaccgatagagggaaaagttgtccaacacgagaacctaaaatacaccgtaataatcacagtccacacaggggatcagcaccaggtggggaacgaaacgcagggggtcactgcagagataaccccacaagcgtctaccaccgaagccatattaccagagtacggtacactcggcttggaatgcagcccccggaccggcctcgacttcaacgaaatgatcctgcttaccatgaaaaacaaggcttggatggtccaccgtcagtggttcttcgacctgccgctcccatggacaagcggagccaccacggaaacaccgacatggaatcgcaaagaactacttgtcacctttaaaaacgcccatgctaagaaacaagaggttgtagttctaggaagtcaggaaggcgcaatgcacacggcgcttaccggcgcaactgaaattcagaacagcggagggacgtcgatcttcgccgggcacctaaaatgcagactaaaaatggacaagctcgaactcaaggggatgagctacgcgatgtgcacaaataccttcgtactcaagaaagaggtctccgaaacacaacacggaacgatattgatcaaggtggagtacaagggagaagacgttccctgcaaaatccccttctctaccgaagacggccagggaaaggcgcataacggacggctaattaccgccaatccggtggtcaccaagaaagaggagccggtcaacatagaggctgagccccctttcggagaatcaaacatagtcataggcatcggcgataacgcacttaaaattaactggtacaagaaagggtcctccatcgggaaaatgttcgaagcaacggcgcgaggcgcccgccgcatggcaatattaggcgatacagcatgggacttcggcagcgtcggtggcgttctaaactccctaggaaaaatggtccaccaaatttttggctctgcctacactgcactcttcagcggcgtaagctgggtgatgaaaataggaatcggtgttctactgacgtggatcggcctgaacagcaagaatacctccatgagcttcagctgcatcgcgatcggaatcatcacgctctacttaggtgcagtcgtccaagccgacatgggatgcgtgatcaactggaaaggaaaagaactcaagtgcgggtctggcatcttcgtcaccaatgaggtccacacctggaccgaacaatacaaattccaggcagattccccaaagcggctcgcaacagcaatcgccggggcatgggagaacggggtatgtggcatcaggagcactacacggatggaaaatctactctggaaacaaatcgcgaacgaactcaattatatactctgggaaaataacataaagttaacggtcgtagtgggtgatataataggcgtcctcgaacagggaaaacgcacccttacaccccaaccgatggaactcaaatactcgtggaagacctggggcaaggcaaaaatcgtcacagcggaaacccaaaacagcagcttcataatcgatggccctaatacccccgaatgcccaagcgtgagccgcgcgtggaacgtgtgggaagtggaagactatggattcggcgtctttacaacaaacatatggctaaagctccgggaggtctacacgcagctgtgcgatcaccggttaatgtcagccgccgtaaaagatgagcgagccgtccatgcagatatggggtactggatcgaatcccagaaaaatggtagctggaaactagagaaggcatccttaatcgaggtcaaaacttgcacctggcccaaaagccacaccctatggtcaaatggtgtcctcgagtcagatatgatcattccgaaaagtttagcagggcctatctcacaacataaccacaggcccgggtatcatacacaaacggccggaccttggcacctagggaagctagagctcgactttaactactgtgaaggaacaacggtcgtaattaccgaaaactgcggaacacgaggtccttccctgcggacaacgactgtatccggaaagctgatacatgaatggtgctgccgatcctgcaccctacctcccctgcgatacatgggagaagacggatgctggtacggtatggaaatacgtcccatcagcgaaaaggaagaaaacatggtcaaatccctcgtctcggccggaagcggaaaagtagataatttcacgatgggagtcctgtgcctcgcaatactattcgaggaggtaatgcggggaaaattcgggaagaaacacatgattgccggggtcttcttcacattcgttctactactgagcgggcagatcacctggagggacatggcacacaccctaataatgatcgggagtaacgcgtcggatagaatgggcatgggggtcacgtacttagcgctaatcgcgacattcaaaatccagcccttcctagcgctaggcttctttttgagaaagctcacatcgcgagagaacctactcctcggagtcgggctcgcaatggcgacgactcttcaacttccggaagacatcgaacaaatggccaacggaatagccttgggactcatggcccttaaactaataacccaattcgagatctaccaactatggacagccctaataagcctcacctgtagtaacactatctttaccctaactgtggcatggcgcaccgcgacacttatactagcgggtgtgtcactcttgccaatgtgccagtcctcgtccatgagaaagacagattggctcccaatggcggtcgctgcgatgggggtccctccacttccgctgttcattttcagcctgaaagacacgcttaaaagaaggagctggccactgaacgaaggtgtgatggccgtgggactcgttagcatcctcgcttcgagcctactaagaaacgacgtacccatggcgggcccattagtggccggcggcctacttatcgcatgttatgtcataaccggaacaagcgcagacctgacagtagaaaaagcggcagatattacttgggaagaggaagcggagcagacgggcgtaagtcataacctcatgataaccgtagacgacgacggaaccatgcggataaaggacgacgagaccgagaatatactaacagtcctactgaaaacggcactcctaatcgtcagcggaatattcccctactcaatacccgccacacttctggtctggcacacgtggcagaaacagacgcagaggtcaggcgtcctatgggacgtcccttccccacccgagacccagaaggcggagctagaggagggcgtctaccgcataaaacaacagggtattttcggaaagacacaagtcggggttggcgtacaaaaagagggcgtctttcatactatgtggcatgtgacccgcggcgctgtactaacttacaacggaaagcgtctcgagccgaactgggcgtctgtaaagaaagacctcatctcatacgggggtggatggcgactgtccgcgcaatggcaaaaaggtgaagaagtccaggtcattgccgtagaacccgggaaaaaccctaaaaactttcagacgatgccaggaacctttcaaacgacgaccggtgaaatcggagcgatagcacttgatttcaaaccaggaacatcaggatcgcccataatcaaccgtgaagggaaagtggtcggcctgtacggcaatggcgtcgtcaccaaaaacggaggctacgtaagcggtatagcacaaacgaacgctgagcctgatggaccaaccccagagctcgaggaagaaatgttcaagaaaaggaacctaacgataatggatttacacccaggcagcggcaagacacgaaagtacctgcctgcgatcgtccgtgaagccataaagcggcgacttcgcacgctaattctcgctccgacgagagtggtggccgcagaaatggaagaagcactaaaaggcctgccaattagataccaaactaccgccactaagagcgaacataccggacgcgaaattgtagacctgatgtgccacgctaccttcacgatgcgactcctgagtcccgtgcgggtacctaactataatctaataataatggatgaagcccactttacagaccccgccagtatagccgcgagagggtacatatcgacccgggtcggcatgggggaagcagccgccatcttcatgacagccacgccaccaggaacggccgacgccttcccccaaagcaacgcaccaatacaggatgaggagcgagatataccggagcgctcctggaactcgggcaacgagtggatcacagacttcgcgggaaaaacggtgtggttcgttcccagcataaaagccggcaacgatatagctaattgcctacgaaagaacggcaaaaaggttatacagctcagccggaaaacctttgacacagagtaccagaagaccaaactcaacgattgggacttcgtagtgaccaccgacatctcagagatgggcgcaaacttcaaagcagacagggtcatcgatccccgaaggtgcctaaaaccagtcatacttacagatggtccagagcgggtgatactagccgggcccatgcccgtaaccgctgcatctgcagcccaaagacggggtcgcgttggccgcaacccacagaaggaaaacgatcagtacatcttcacgggccaacccctcaacaacgacgaggaccatgcacactggacagaagccaagatgctgctagataacataaacaccccagaaggaataatacccgctctgttcgaaccagagcgcgagaagtcggccgcaattgacggcgaataccggttaaaaggggaaagccgaaagacctttgtagagctaatgcgtagaggggacctacccgtctggctcgcacacaaagttgcaagcgaaggaataaaatacaccgacagaaagtggtgcttcgacggccaaaggaacaaccaaatacttgaagaaaatatggacgtggaaatatggacaaaagagggcgagaagaagaaactgcgtccccgatggctggacgcacggacctatagcgacccgctcgccctgaaagagttcaaagaatttgcagcgggaaggaaaagcatcgccctcgacctggtaacggaaattggacgcgttcccagccatctcgcacaccgcacccggaacgccctagacaacctcgtaatgctacacacaagcgaacacgggggaagggcgtaccgtcatgccgtagaagaacttccggaaacgatggagacgctgttattgctcgggctaatgatactacttaccggtggagcgatgttattcttaatttccggaaagggaataggcaaaaccagcataggattaatatgcgtcattgcatccagtggcatgctttggatggctgagatcccactacagtggatcgccagtgccatcgtactcgaatttttcatgatggtgctgctgatacccgaaccagaaaaacagcgtacaccacaagataatcaattagcatacgtagttataggtatcctaacactcgcggcaatcatcgcagcgaacgaaatggggttattggaaacgacgaaacgtgacttggggatgtccaaagaaccgggagtcgtatctcccacatcttacctcgacgtagacctgcatcccgcttcagcgtggaccctatacgcggtcgcaacaacggtcattacgccaatgctccgtcacaccatcgagaacagcacagcaaacgtctccctagcagcaatcgccaaccaagctgtggtgctgatgggcttggacaaaggatggccaataagtaaaatggacctaggggtcccgctgctcgcacttggatgctatagccaagtaaatcccctaacactgaccgctgccgtcctgctactaatcacccactacgccattatagggcccggcctacaagcgaaggcaacgcgcgaggcgcaaaagcggacggcggctgggatcatgaagaatcctaccgtcgatggaataatgaccatcgacctcgatccagttatttacgattccaaatttgaaaagcaactcggacaagtaatgttactcgtactctgcgtcgttcagctactactcatgcgcacctcgtgggcactgtgcgaagccttgactctggcgaccgggcccataacaacactgtgggaaggctcacccggaaaattctggaacacgaccatcgctgtcagcatggccaatatattccgaggctcctatctagcgggggcagggctagcgttctccattatgaagtcagtgggtacggggaaaagaggaacggggagccaaggggaaacccttggagagaaatggaagaagaaactaaaccagctatcgcgcaaagacttcgatctgtacaaaaagtcaggcatcactgaggtggaccgcaccgaagcgaaagaaggattgaaaagaggggaaatcacacaccatgcagtatcaagaggctcagccaaactgcagtggttcgttgagaggaacatggtaatccccgaagggcgagtcattgatctcggctgtggaagaggagggtggtcctactactgtgccggactcaagaaagtaacagaagtacgaggctacacgaaaggcggccctggacacgaggaaccggtaccaatgagcacctacggctggaatattgtcaaacttatgtccggaaaagacgtattctacctgccaccagaaaaatgcgacacattgctatgcgacattggagaaagctcgccgtcccctactgtcgaagaatcacgtacgatacgagtattaaaaatggtggaaccatggcttaagaataaccagttctgtataaaggtactgaacccatatatgccaaccgtaatcgagcacctcgagcggctgcaacgcaagcacggcgggatgctcgtgcgaaacccgctaagccgcaacagtacgcacgaaatgtactggatcagcaacggaaccgggaacatcgtggcttccgttaacatggtatcgcgcctgctattaaaccgcttcaccatgacccacaggagaccaaccatcgaaaaagacgtcgacctaggggccggaacccgacacgtgaacgccgaacccgagacacccaatatggacgtcataggggagcgaataaaacgaataaaggaagaacataacagcacatggcattacgacgatgagaacccctacaaaacctgggcgtaccacggcagctacgaagtcaaagccaccggatccgcttcaagcatgattaacggagtggttaagctcttaaccaaaccatgggacgtggtcccaatggtaacacaaatggccatgacagacaccacaccgttcggccaacagcgagtctttaaagaaaaggtagatacacgcaccccgaggtccatgcccggcacccgacgtgtgatgggcatcacagccgaatggctatggagaacgctcggcaggaataagaaaccgaggctatgcacacgcgaggagtttacgaagaaagtgagaacaaacgcagctatgggcgccgtattcacagaggaaaaccaatgggactccgcgaaagctgcggtagaggacgaagatttttggaaattagtagaccgagaacgggagttgcacaaactaggtaagtgcgggagctgcgtttacaatatgatgggcaaacgagagaagaaactgggcgagttcggaaaagccaaaggtagtcgcgcaatctggtatatgtggctaggggcaagatacctggagtttgaggcactaggctttctcaacgaagatcactggttcagcagagaaaatagctattccggtgtggaaggagaaggcctacacaaactcggatacatcctacgagacattagcaaaataccaggtggtgcaatgtacgcagacgacaccgcgggatgggatacccgcataacggaagacgatcttcacaatgaggagaaaatcacccaacaaatggacccagaacaccgacaactggcaaacgcaatattcaaactaacataccagaacaaggtggttaaagtgcagcgtcccacccccacggggacagtcatggacataatttctcgcaaagatcaacgaggatccgggcaggtaggtacatacggactcaacacgtttaccaatatggaggcacaactaatccgtcagatggagggggagggtgttctatccaaagcagacctagaaaacccacaccttccagagaagaaaataacgcagtggctagaaacaaagggggtagaaagacttaaacggatggcaatctctggagacgactgcgtagtgaaacccattgatgaccggtttgccaacgcgttactcgctctaaatgacatgggcaaggtacgtaaagacatcccacaatggcaaccaagcaaaggctggcacgattggcagcaagtgccattctgttcccatcacttccacgagctaatcatgaaagacggtcgcaaactcgtcgtaccctgtcgaccccaagacgaattaatcgggagagcccgaatctcgcagggcgcaggatggtcccttaaggaaaccgcgtgtctgggaaaagcctacgcacaaatgtggtcgctcatgtatttccatcgtcgagatctgaggctagcgtcgaacgcaatatgttcagcggttccggtacactgggtcccgactagccgcacgacttggtcaatacacgcgcatcaccaatggatgacaacggaggacatgctgacagtatggaaccgggtgtggatcgaagacaatccatggatggaagacaagacgcccgtcactacttgggaaaatgtcccctatctgggaaagagggaggatcagtggtgcggctcactcattggactaacctcgcgggctacctgggcacagaatatccccacagccatacaacaggtccgatccctaattggaaacgaggagttcctggactatatgccgtccatgaagcgcttccgcaaggaagaagagtcagaaggggctatatggtga

SEQ ID NO: 25818 - RNA, 9873 nt, synthetic construct
  misc_feature 1..9873: note = derived and/or modified CDS sequence (opt11) from DENV-3__JF937632__SS-prME
  source 1..9873: mol_type = other RNA
acaagtctctgcctcatgatgatcctcccagccgccctggcgttccacctcaccagcagggacggcgagccgagaatgatcgtcgggaagaacgagagaggtaagagtctgctgtttaagacggccagcggcatcaacatgtgtactttgatcgcgatggacctgggcgagatgtgcgacgacaccgtgacctacaagtgtccccacatcaccgaggtggaacccgaggacatcgattgctggtgcaacctgaccagcacctgggtgacgtacggaacttgcaaccaggccggcgagcaccggcgtgacaaacgctccgtggccctggccccccacgtgggcatgggactggacaccaggactcagacatggatgagcgccgaaggggcgtggcgacaggtggaaaaggtggaaacgtgggccctgcgtcaccccgggttcaccatcttagcgttattcctagcgcactacatcggcacgtccttaacccaaaaggtggttatattcattcttctgatgctcgtcacgcccagcatgacgatgcggtgcgtgggggtgggcaaccgcgacttcgtcgaaggcctgtccggggccacctgggtggacgtagtcctggagcacggcgggtgtgtaaccacgatggccaagaacaagccaaccttggatatcgaactgcagaagacggaagctacccagctggcgacgctccggaagctttgcatcgaggggaagatcactaacattacgactgacagccgctgccccacgcagggcgaggcgactctcccggaggaacaggatcagaactacgtatgtaagcatacgtacgtcgatcggggttggggaaacgggtgcggcctcttcggtaagggctccctcgtgacatgcgccaaatttcagtgcctggaacctatagagggtaaggttgtccagtacgaaaacctcaagtacacagtgatcatcacggtgcacaccggtgaccagcaccaggtgggcaacgaaacgcaaggtgtcacagcggagataacgccccaagcttcaacaacagaggcgatcctgcctgagtatggtacactggggctcgagtgctccccgcgcacgggtctagacttcaacgagatgatcctgctcaccatgaagaacaaggcctggatggtccaccggcagtggttctttgacctgccccttccgtggacgagcggcgcgaccacggagaccccgacctggaaccgaaaggaactcctggtaaccttcaagaatgcccacgcgaagaagcaggaggttgtcgtgttagggtcacaagagggcgcgatgcacactgcgttaaccggggccaccgagatccagaacagcggagggacctccatctttgcaggccacttgaagtgcaggctgaagatggacaagctcgagctaaaaggcatgtcatacgcgatgtgcactaatacattcgtgctaaagaaggaggtgtccgagacccagcacgggaccatcttaataaaagtggagtacaaaggcgaggacgtgccatgtaagatccccttctcaactgaagacgggcaagggaaggcgcataacggccgccttatcacggccaaccccgttgtcaccaagaaggaggagccggtgaatatagaggctgagccgccgttcggtgagagcaacatcgtcatcggcatcggggacaacgccctgaagatcaactggtacaagaagggatccagcatcgggaagatgttcgaggcgaccgcccggggcgcacgcaggatggctatcctgggcgacacggcctgggacttcggctccgtgggcggggtcctcaattccttgggcaagatggtacaccagatcttcggcagtgcgtatactgccctgttcagcggcgtgagctgggtgatgaagataggcattggggtattgctgacctggatcggcctcaacagcaagaacacctccatgagcttctcctgcatcgccatcggtatcatcaccttgtatctgggagcagtcgtgcaagccgacatggggtgcgtgatcaactggaaagggaaggagctgaagtgtggaagcggaatctttgtgaccaacgaggtgcacacgtggaccgaacagtacaagttccaggcagactctcctaagcgactcgccacggcgattgccggcgcatgggagaacggggtctgtggcatccgaagcaccaccaggatggagaacctgctgtggaagcagatcgcgaacgagttgaactacattctttgggagaataacatcaagctgactgtagttgtcggtgacatcatcggcgtcctcgaacagggcaagcgcacgctcacgccgcagcctatggagctgaaatactcctggaagacctgggggaaggccaaaatagtaacggcggagacgcagaactcttccttcatcatcgacgggcccaacacccccgagtgccccagcgtctcccgtgcgtggaatgtctgggaggtggaggattatgggttcggcgtattcacaaccaacatttggctcaagctgcgcgaggtgtacacccaattatgcgaccaccgcctcatgagcgcggctgtgaaggacgagcgcgccgttcacgcagacatgggatattggatcgagtctcagaaaaacgggtcctggaagctggagaaggcatcactcattgaggtgaagacttgtacctggccgaagtcccacaccctttggagcaatggggtgttggagtccgacatgatcatccccaaaagcttagccgggcccatctcccagcacaaccatcggccgggctaccacactcagaccgccgggccctggcacttgggcaagctggagctggactttaactactgtgaggggaccacggtagtgatcaccgagaactgcgggacgcgtggccccagcctccgtacaacgacagtttctgggaagctgatccacgagtggtgctgccgttcctgcaccctgcccccgctccgatatatcggtgaggatggctgctggtacggcatggaaatccgccctatatccgaaaaggaagaaaatatggtaaagagcctcgtgtccgcaggcagcgggaaggtagacaatttcaccatgggcgttctgtgcttagccatcctgttcgaagaggtgatgcgcgggaagttcgggaaaaagcacatgatagcgggggtcttctttaccttcgtgctactcttatccggccagatcacctggcgcgatatggcgcacactctgattatgatcggaagcaacgccagcgacagaatggggatgggcgtgacctatttggccctgatcgccacctttaagatccagccctttctcgccctcggcttttttctgcgcaagctgacgagccgggagaatttactactgggcgtgggtttagcgatggccacgacactgcagctgcccgaggatatcgaacaaatggccaacgggatcgccctaggcctgatggcccttaaattaatcactcaatttgaaacctaccaactgtggacggccctgatatctctgacctgttccaacaccatcttcacgctgacggtcgcctggcgaacggccacactcattctcgccggggtgagcctgctacctgtctgccagagttcgtcaatgcggaaaaccgactggctaccaatggcggtagccgccatgggcgtaccccccctccccctgttcatattcagtctcaaggacaccctgaagcgccggtcctggcccctgaacgagggggtcatggccgtgggcctcgtgagcatcctggcctccagcctgctccgtaatgacgtcccaatggccggccccctggtggcagggggtcttctcatcgcctgctacgtaattaccggcacctccgcggacctgacggtcgagcgcgccgcggacattacgtgggaagaggaggccgaacagacaggagtaagccacaacctgatgatcaccgtggacgacgatggcaccatgcggatcaaggacgatgagacggagaacatcctgacggttttgctgaagaccgccttactgatcgtgtcaggcatattcccgtacagcatccccgcgaccctgctggtgtggcacacgtggcaaaaacagacccagcgaagcggtgtcctgtgggacgtgcctagcccgcccgagacccagaaggccgaactggaggaaggggtttatcggattaagcagcagggcatcttcgggaagacccaggtcggcgtgggtgtccagaaggagggcgtcttccacacgatgtggcacgtgacgagaggcgcagtgctcacctacaacgggaagcggctggaacccaactgggcgtccgtaaaaaaggatctgatcagctacggcgggggctggcggctctcagcgcagtggcagaaaggggaggaggtccaggtgatcgccgtcgaacccggcaaaaatcccaagaacttccagaccatgcccggcacgttccagaccacaaccggggagatcggcgcgatcgccctggactttaaacccggaaccagcggcagtcccataatcaatcgggagggaaaggtggtggggttgtacgggaacggggtcgtgacgaagaacggcgggtacgtgtccggcattgcccagaccaacgccgagcccgatggacccacccccgaactggaggaggagatgttcaagaagcgcaacctgaccatcatggacctgcaccccggaagcggcaaaacccgtaagtacctgcctgctatagtacgcgaggcgatcaagcggagattacggactcttattctggccccgacccgcgtggtggccgccgagatggaggaggccctaaaggggctgcctattcgctaccagacaactgcgactaagtcggaacataccggccgcgagatcgttgacctcatgtgtcacgccacgttcacgatgcgcctcctaagccccgtgcgcgtcccaaactacaacctcattatcatggacgaggcccacttcacagatcccgcctccatcgccgcgcggggatacatcagtacaagagtcggcatgggcgaggcggccgccatcttcatgaccgcgacgccgcctgggacggccgacgccttcccgcaatccaacgcacccatccaggacgaggagagggacatccccgagcggagctggaactccggcaatgagtggatcaccgattttgccgggaagaccgtgtggttcgtgcccagcatcaaggcgggcaatgatatcgccaattgcctccgcaaaaacgggaagaaggtcatccagctgtctcggaagacgtttgacacggagtaccagaagaccaagcttaacgactgggactttgtggtgacaacagatatcagcgagatgggcgcgaactttaaggccgaccgggtcatcgatccgcggcgctgcctcaaacccgtcatcctgaccgatggccccgagcgcgtaatcctggccggacccatgccggtcacggcggcctccgccgcccaacgccggggccgagtgggccggaacccccagaaggagaacgatcaatatatcttcaccggccagcccctcaacaacgatgaggaccacgcccactggaccgaggcgaagatgctgttggacaacattaacacaccagaggggatcattcccgccctattcgagcccgagagagagaagtccgccgcgatcgacggcgaataccgcctgaaaggcgaatcccgcaagacgttcgttgagctcatgcggagaggggatctcccagtttggttagcgcacaaggtagccagcgagggcattaagtacaccgaccggaagtggtgcttcgacgggcaacgcaacaaccagatccttgaggagaacatggatgtggagatctggactaaggagggcgaaaaaaaaaagctccgtccccgatggctggacgcccggacttactccgacccgctggccctgaaggaattcaaggagttcgccgctggccgcaagtcgatagccctggacctggtgaccgagattggccgcgtgccctcccacctagcccaccggacccgcaacgccttagacaatctggtgatgctgcacacatccgagcacggcgggagggcctaccgtcatgcagttgaagaactgcccgagacgatggagaccctgctgctgctgggcctcatgattctgctgacaggcggcgccatgctgttcctgatttctggcaaagggatcgggaagacctccatcggcctaatctgcgtgatcgccagcagtggcatgctctggatggccgagatcccgctacagtggatcgccagcgcgatcgtcctggagttttttatgatggtgctcttaattcccgagcccgagaagcaacgtacgccccaggacaaccagctcgcatacgtggtcattggcattctcaccttggccgccatcatcgctgcgaacgagatgggcctactcgagactaccaagcgcgacttggggatgtcgaaggaaccgggtgtggtgagcccaacgtcatacctggatgtcgacttgcaccccgcctccgcgtggaccttatacgccgtagccaccaccgtgatcacgcccatgctgcgacacacgatcgagaactccaccgccaatgtcagcctcgccgcaatagcgaaccaggcagtggtgctgatgggtctcgataagggctggcctatctccaagatggacctgggcgttcccctgctggccctcgggtgctacagccaggtgaacccactgacccttacagccgcggtactcctactgataacacattatgccatcattggccccggcctccaggcgaaggccacacgcgaagcccagaagcggaccgccgccgggattatgaagaacccgacggtcgatggcatcatgaccattgacctggaccctgtaatttatgattccaagttcgagaagcagctgggccaggtgatgctcctggttctttgtgcagtgcaattgctgcttatgcgcaccagctgggccctatgcgaggccttgaccctggccacgggtccaatcaccaccttatgggagggatcccccgggaaattctggaataccacgatagcggtgtctatggccaacatcttccgggggtcctatctagccggggccggcctggccttcagcatcatgaagagtgtagggaccggcaagagaggcaccggccctcagggggagaccttgggggagaagtggaagaagaagttgaaccagctgtctcggaaagacttcgacttatacaagaagtcaggtattacggaggtggatcggacggaggcgaaggaggggctgaagcggggcgagatcacacaccatgcggtgtcccgcggtagtgccaagcttcagtggttcgtcgagcgaaacatggtgataccggaggggagggtgatcgatctcggctgcgggcgaggcgggtggtcctactactgcgccggcctgaagaaggtcactgaggtacgcggctacaccaagggcgggcccgggcacgaagaacccgtgccgatgagcacgtatgggtggaatatcgtcaaactgatgtcagggaaggacgtcttctacctgcctcccgagaagtgcgacaccctgctgtgcgacatcggcgaatcctcccctagcccgaccgtggaagagtcacgcaccattagagtcttaaagatggtagagccctggctgaagaataaccagttctgcatcaaagtgctgaacccctacatgcccacggtaatcgagcacctggagcggctccagaggaaacacggcgggatgctggtcagaaatccgctaagcagaaattcgacacacgagatgtactggatcagcaacggcaccgggaatatcgtggcatccgtgaacatggtgagccgcctccttctgaataggtttaccatgacgcaccgcaggcccacaatcgagaaggacgtggacctcggcgcgggcacccgccacgtcaacgcggagcctgagacgccgaacatggacgtcatcggggaaaggataaaacgcatcaaggaggaacacaattcaacttggcactacgacgacgagaacccctacaagacctgggcctaccacggcagctatgaggtgaaggcaacaggatccgccagctctatgatcaatggcgtcgtgaagcttctgaccaagccctgggacgtggttcctatggtgacgcaaatggcgatgacggacactaccccgttcgggcagcagcgggtcttcaaagaaaaggtggacacgcgaactccccgcagcatgcccggcactagacgggttatgggtatcacggccgagtggctctggcgtacgctgggtcggaacaagaagccccgcctgtgcacccgcgaagagttcacaaagaaggtccggaccaacgccgccatgggtgcggtgttcactgaggagaaccagtgggacagcgctaaagccgcggtagaggacgaggacttctggaagctggtcgaccgcgagcgggagttgcataagctggggaagtgcgggtcctgtgtctacaatatgatgggtaagagagagaagaagctcggagagtttgggaaggccaaggggagccgagcgatctggtacatgtggctgggtgcccgctatctggaattcgaggccttggggttcctcaacgaggaccattggttctcgagagaaaacagctactccggtgtggagggggagggcctgcaccgcctcggttacatactgcgggacatcagcaagatcccaggcggtgcgatgtacgccgacgataccgcaggatgggacacccgcattaccgaggacgacttgcataacgaagagaaaatcacgcagcagatggacccagaacacagacagctcgccaatgcaatcttcaagctaacgtaccagaataaggtcgtgaaggtacagcgcccgacacccaccgggaccgttatggatatcatctcccggaaagatcagagaggctccggtcaagtcggcacgtatgggctgaacactttcaccaacatggaggcccagctcatccgccaaatggagggagaaggggtgctgagcaaagccgacctcgagaacccgcacctacccgagaagaagataacccagtggctggagaccaagggtgtggaacgtctgaagcggatggcgatcagcggcgacgattgcgtcgtgaagcccattgacgaccgcttcgctaacgcgttgctagccctaaatgacatgggcaaggttcggaaggacatccctcagtggcagcccagtaagggctggcatgactggcagcaagtccctttctgtagccatcactttcatgagctcatcatgaaagacgggcgcaagctggtggtcccctgccgtccccaggacgagctgatcggccgcgcgcgcatctcacagggggcaggctggtccctcaaggaaacggcctgcctgggtaaagcctatgcccagatgtggtcgctgatgtacttccaccggcgcgacctccgcctggcgtccaacgccatctgttccgctgtgccagtgcactgggtccctacatcgcgcaccacgtggtccatccatgcccaccaccaatggatgaccacggaggatatgttgacggtgtggaaccgggtttggatcgaagacaacccctggatggaggacaagacgcccgtcaccacctgggaaaacgtgccgtacctcgggaagcgcgaggaccaatggtgcggctcccttatcgggttgacaagccgggccacgtgggcgcagaacatccctaccgcgatccagcaagtccgctctctgatcggcaatgaggagttccttgactacatgccctcaatgaaacgcttccgaaaggaagaagagtccgagggagccatttggtga

SEQ ID NO: 25819 - RNA, 9873 nt, synthetic construct
  misc_feature 1..9873: note = derived and/or modified CDS sequence (opt11) from DENV-3__HM756281__SS-prME
  source 1..9873: mol_type = other RNA
accagcctctgcctcatgatgatactacccgccgccctagcgtttcacctcaccagccgggacggggagccccggatgatcgtggggaagaacgagcgcggcaagagcctcttattcaagacagcctccgggatcaatatgtgcaccctgatagcaatggacctgggtgagatgtgtgacgatacggtaacctacaagtgccctcacatcaccgaggtggaacccgaggacattgactgttggtgcaacctgaccagcacctgggttacctacgggacgtgtaaccaagctggcgagcacaggagagacaagcgttccgtggctctggcgccccacgtgggaatgggacttgacacccgcacgcagacctggatgagcgcagagggcgcctggcggcaggtcgagaaggtcgagacgtgggccttacgccaccctgggttcaccatactcgcgctgttcctggcgcactacatcgggacatccttaacccaaaaggtggttatcttcatcctgctgatgctcgtcactccctctatgaccatgcggtgcgtgggggtgggcaacagagacttcgtcgaaggcctgtccggggccacctgggtggacgtggtcctggagcacggcggatgcgtcaccacaatggccaagaataagcccaccctcgacattgaactgcagaagacggaggccacccagctagctacgttacggaagctgtgcatagaaggcaagattaccaatatcaccacggacagcagatgccccacccagggggaggcaaccctgccggaggagcaggatcagaactacgtgtgcaagcacacctacgtcgatcggggctggggaaacgggtgcgggctcttcggtaagggctccctggtgacctgcgccaagtttcagtgtctggagcccatcgagggcaaggtggtccagtatgagaacctcaagtacactgtgattatcaccgtgcacacaggggaccagcaccaggtaggcaatgagacacaaggggtgacggccgaaatcaccccccaggctagcaccaccgaggcgatactgcccgagtatggcaccctagggctcgagtgctcaccgcgcacggggcttgatttcaacgagatgatcctcctcaccatgaagaacaaggcttggatggtccaccggcagtggttcttcgacctgcccctgccttggaccagcggagcgacaacggaaacccccacctggaaccgcaaggaactccttgtgaccttcaaaaatgcccacgcgaagaaacaggaggtggtcgtgctggggtcccaggagggcgccatgcacacagccctcaccggggcgaccgaaatacagaacagtggcggaacctccatcttcgccggccacctgaagtgtcggctgaagatggacaagctagaactgaagggcatgagctacgccatgtgcacgaataccttcgtgctgaagaaggaggtctctgagacccagcatggtaccatattaatcaaagtggagtacaagggcgaggacgtgccgtgcaagatcccgtttagcacggaggacgggcagggcaaagctcacaacgggcgtttgatcaccgcgaaccccgtcgttaccaaaaaggaggagcccgtgaacattgaggccgagccgcccttcggggagtctaacatcgtgattggcattggggacaatgctctgaagatcaattggtacaaaaagggctccagcatcgggaagatgttcgaagcgaccgcgcggggcgcccgccggatggccattctgggagacacagcctgggacttcggatccgtggggggggtactcaacagcctgggcaagatggtccaccagatcttcggctcagcttacaccgccctgttcagcggagtgagctgggtcatgaaaatcggcattggagtcctcttgacctggattggcctgaactccaagaacacctccatgagcttcagctgcatagcgatcgggatcatcacgctctatctgggagcggttgttcaggcggatatggggtgcgtcgtgaactggaagggcaaggaactgaagtgcggcagcgggatctttgtgaccaacgaggtccatacatggacagagcaatacaagtttcaggccgactcgcccaagagactcgccacggctatcgccggcgcctgggagaacggggtgtgcggcatccggagcaccacccggatggaaaacctgttatggaagcagatcgccaacgagctcaactacatcctgtgggagaacaatatcaagctcaccgttgtcgtgggggacatcatcggagtcctcgagcaaggcaagaggaccctgactccccaaccgaaagagctgaagtacagttggaagacatggggcaaggccaagatcgtcaccgctgaaacgcagaatagcagctttattatcgacggacccaacacgcccgagtgccccagcgtatcccgggcctggaacgtgtgggaggtcgaggactacgggttcggcgtcttcaccaccaacatatggcttaagctgcgtgaagtctacacccaactgtgcgaccaccggctcatgagcgcggccgtcaaggacgaacgcgctgtccacgccgacatgggctactggatagagagccagaaaaacgggtcttggaagctggagaaggcttcgctgattgaggtgaaaacgtgcacatggccgaagtcccacaccctatggagcaacggcgtcctggagtccgacatgatcatccccaagtcactggcggggcccatcagccaacacaaccaccggccgggctaccacacgcagactgcaggtccgtggcacttggggaagctggaactagatttcaactattgcgagggaactaccgtggtaatcacagaaaactgtgggacgagaggccccagcctccggactaccaccgtctccgggaaactgatccacgagtggtgctgccgcagctgtactcttccacccctacggtacatgggcgaggacggatgctggtacgggatggagattcgccccatctccgagaaggaggagaacatggtcaaaagcctggtctccgccggcagcggtaaggtggacaatttcaccatgggcgttctgtgcctggcgattctgttcgaggaggttatgcgggggaagttcggaaagaagcatatgatcgccggggtcttctttacctttgtgttactcctgagcggtcagatcacctggcgcgacatggcgcacacacttatcatgatcgggagcaacgccagcgacagaatggggatgggcgtgacatacctcgctctgatcgccaccttcaagatccagccgttcctggcccttgggttctttctgcgcaagctgacaagccgcgagaatctcctgctgggcgtcggcctcgctatggcaacgaccctgcagctgcccgaggacatcgaacaaatggccaacgggatcgcgctcggcctgatggcgcttaaactaatcacccagttcgagacctaccagctttggaccgccctcatcagcctgacctgctccaataccatcttcacacttacggtagcctggcgcaccgctaccttaatcctcgccggagtcagcctgctgccggtgtgccaatccagctccatgaggaagaccgactggctccccatggcggtggcggccatgggcgtgccgccccttccgctgtttatctttagccttaaggatacgctgaagcggcgctcctggcccctaaacgagggggtaatggccgtgggcctggtcagcatcctcgccagtagcctgctccggaacgacgtgcccatggcgggccccctggtcgcaggcgggttgttaatcgcctgctacgtcatcaccgggacgtccgccgacctgaccgtggagaaggcggcggacatcacgtgggaggaggaggccgagcagaccggggtcagccacaacctgatgatcaccgtggacgacgatgggaccatgcgcataaaggacgacgaaaccgaaaacatactcacggtgctgctgaagacagccctcctgatagtgtccggcatcttcccgtactcgattcccgcaaccttgctcgtctggcacacatggcagaagcaaacgcagcggagtggtgtactatgggacgtccccagcccgcccgaaacccagaaagctgagctcgaggagggggtataccgcataaagcagcaggggatcttcggcaagacccaggtgggcgtaggagtccagaaggagggcgtcttccacacgatgtggcacgtgacgcggggcgcggtcctcacctataacgggaagaggctggagcccaactgggcctccgtcaagaaagacctgatcagctatggagggggctggcggctctccgcccaatggcagaagggggaagaggtgcaggtcatagccgtggagccaggcaagaatcccaagaacttccagaccatgcccggcaccttccagaccaccaccggggagattggcgcgatcgccttggactttaagcctgggacatcaggcagccccatcatcaaccgcgaaggcaaagtggtcgggctttacggaaacggcgtcgttactaagaacggcggttacgtcagtggtatcgcgcaaaccaacgcagagccggacggccccacacccgaactggaggaagagatgttcaagaagcgtaacttaactatcatggacttgcaccccgggagcggcaagacacgtaagtatttgccggccattgtgcgggaagcaatcaagcgccggctccgcaccctaatcctggcccccacccgggtggtcgctgcggagatggaggaggccctcaagggcctgccaatccgttaccaaacgactgcgaccaagtccgaacataccgggcgagagatcgtcgacctaatgtgccacgcgaccttcacaatgcgcctcctgagccccgtgcgggtcccgaattataatctgatcatcatggacgaggctcacttcaccgacccagcctccatcgccgcacgcgggtacatcagcacacgggtgggcatgggagaggccgccgctatcttcatgacagccacgcctcccggtaccgccgacgccttcccgcaatccaacgcccctatccaggacgaagagcgcgacatccccgagcgcagctggaattccggtaacgagtggatcaccgacttcgccgggaagaccgtctggttcgtccccagcataaaggctggcaacgacatcgcaaattgcctacgcaaaaacgggaagaaagtgatacagctgtcccgaaagacgttcgacaccgagtaccaaaagaccaagctgaatgactgggacttcgtggtcaccacagacatcagcgagatgggcgccaacttcaaagccgaccgggtgatcgacccgcgccggtgcctcaagcccgtgatcctgacggacggccccgaacgcgtcattctcgccgggcccatgccagtcaccgcggcctccgccgcccaacggcgtggccgggtggggcgcaacccacagaaggagaacgaccaatacatcttcactggccagcccctcaacaacgacgaggaccacgcccactggactgaagcgaagatgctgctggacaatatcaacacgcccgaggggatcatcccggccctcttcgaacccgagcgggagaagtcagctgccatcgatggtgagtaccgcctaaagggcgagtcccggaagactttcgtcgagttaatgcgtcgcggggacctccccgtgtggctggcgcacaaggtcgcttctgagggtatcaaatacaccgaccgcaaatggtgtttcgacgggcagcgtaacaaccagatcctggaagagaacatggacgtggagatctggactaaggagggagagaagaagaagctccgcccacgatggctggacgcccgcacgtactccgatccgctggccctgaaagagtttaaggagttcgccgcgggccgcaagagcatcgctctggacctggtgaccgagatcgggcgggtcccttcccacctcgcccaccgaactcgtaacgccctggataacctggtgatgctccacaccagcgagcacggcggccgcgcctaccggcatgcggtcgaagaattgcccgagacaatggaaaccctgctgcttctgggcctaatgatcctgctgaccggtggggccatgttgttcctgatcagcggcaaggggatcggcaagacttccatcgggctgatctgcgttattgcctcgtccggaatgctctggatggccgagatccccctgcagtggatcgcctccgctattgtcctggagttcttcatgatggtgctcctaatcccagagcccgagaagcagcggacgccccaggacaaccaactggcctacgtcgtgatcggcatcctaaccctggccgccatcatcgccgcgaacgaaatgggccttctcgagaccaccaaacgggacctgggtatgtccaaggagccgggagtcgtgagccccacgtcctacctcgacgtggacctccaccccgcaagcgcctggacactgtacgcggtggctaccaccgtcatcaccccaatgctacgccacaccatcgagaacagcaccgccaacgtgtcactcgcggcgatcgcgaaccaggcggtggtacttatggggctggacaaagggtggccgatctccaagatggacctcggcgtccctctgttggccttagggtgctactcacaggttaaccccctgaccttaacagccgcagtcctcctgcttatcacccattacgctatcatcggccccggcctacaggcaaaggcgaccagggaggcccagaagcgcaccgccgccgggataatgaagaatccgactgtggacggcataatgaccatcgacctggaccccgtaatctacgattccaagttcgagaagcagctgggacaagtcatgctcttagtgctgtgtgcggtccagctcctgctaatgcggaccagctgggccctctgcgaggccctgacattggccaccggcccaatcacgacgctctgggagggctcccccggcaagttctggaatactacgatcgcggtcagcatggccaacatctttcgtggctcctacctggccggggccggcctggccttctcgatcatgaagtccgtagggactggcaaacggggcacagggagccagggagagactcttggggaaaagtggaagaagaagctaaaccaattgtccaggaaggacttcgacctttacaagaaatctggcatcaccgaggtggaccggacggaggcgaaggaggggctgaaacggggcgagataacccaccacgccgtcagcagggggtccgctaagctgcagtggttcgtggagcgcaacatggtgatcccggagggacgtgtcatcgacctcggctgcgggagaggagggtggagctactattgcgccggtctgaagaaggtgaccgaggtgcgtggctataccaagggcgggccgggccacgaggaacccgttcccatgtccacgtacggctggaacatcgtgaaactaatgagcgggaaggacgtgttttacctcccacccgagaaatgcgacaccctactgtgcgacatcggcgagtccagcccctcccccacagtcgaggagagccgcaccatccgcgtgctgaagatggtggagccgtggctcaagaacaaccaattctgcatcaaggtcctgaatccctacatgcccacggtaatcgagcacctggagagactccagcgcaagcacggcggcatgctggtgcgtaaccccctgtcccgcaactccacccacgaaatgtactggatctcgaacggaactggaaacattgtcgccagcgtgaacatggttagccggctcctgctgaaccgcttcaccatgacgcatcgtcgccccaccatcgagaaggacgtcgacctcggcgcgggcacccgtcacgtcaatgccgagccagagacccccaacatggacgtgatcggcgaacgcatcaagcggatcaaggaggagcacaactcaacctggcactacgacgacgagaacccgtacaagacctgggcctaccacggctcttacgaagtcaaggccaccgggagcgcctccagcatgattaacggcgtggtcaaattgctcaccaagccctgggacgtggtgcctatggtcacgcagatggcgatgacggacacaaccccctttgggcagcagcgcgttttccgggagaaagtggatacaaggaccccgcgcagcatgcccggcacgcgtcgggtgatgggaataaccgccgagtggctctggcgcacgctgggccggaacaagaaaccccgcctgtgcacccgcgaggagttcaccaagaaggttagaaccaacgctgctatgggagcggtgttcacggaagaaaaccagtgggacagcgccaaggctgctgtcgaagatgaggacttctggaagttggtggatcgcgagcgggagctgcacaagctggggaagtgcggcagctgcgtgtacaacatgatggggaagcgcgagaagaagttaggcgaattcggcaaggccaaagggtcccgggccatctggtacatgtggttgggtgcccgctacctggagttcgaggccctcgggtttcttaacgaagaccactggtttagccgagagaacagctacagcggcgtagagggggagggccttcacaagctcggttacatcctgcgcgacatctctaaaatcccggggggcgctatgtacgccgacgataccgcgggttgggacacccggatcaccgaggatgacctgcacaatgaggagaaaataacacagcaaatggaccccgagcaccgtcaattagcaaacgccatctttaagttaacttaccaaaacaaggtggtgaaggtccagagacccacccccaccggcaccgtgatggacataatttcacgcaaggaccagcggggctccggccaggtaggtacctacgggctcaataccttcaccaacatggaggctcaactcatccgacagatggagggcgagggcgtcctgagcaaggccgacctggagaacccccacctcccggagaagaagataacccagtggctcgaaacgaagggcgtggagagacttaagcgcatggcgatttccggggacgactgcgtggtcaagcccatagacgatcggttcgccaacgccctgcttgcactgaacgatatggggaaggtaaggaaggacatcccccaatggcagccctctaagggctggcacgactggcaacaggtcccgttttgctcccatcacttccacgaactcatcatgaaagacggccgtaagctggtcgtgccgtgccggccccaggacgagctgattggccgagcccgcatctcccagggggcgggctggagtctcaaggaaacggcctgcctgggcaaggcctacgcgcagatgtggagcctgatgtactttcaccgccgggacctgcgcctggcctccaacgccatctgcagcgccgtgcccgtccactgggtgccgacatcccggaccacgtggtctatccatgcgcaccaccagtggatgacgaccgaggacatgttgaccgtgtggaaccgagtctggatcgaagacaacccttggatggaggacaagacaccggtgactacctgggagaatgtgccctacctcgggaagagggaggaccagtggtgcggatccctgatagggcttacaagccgtgccacgtgggcgcagaacatcccgaccgccatccagcaggtccggagcctcattggtaatgaggaattcctggactacatgccctccatgaaacgattccggaaggaggaggagtcagagggggccatctggtga

SEQ ID NO: 25820 - RNA, 9873 nt, synthetic construct
  misc_feature 1..9873: note = derived and/or modified CDS sequence (opt11) from DENV-3__JF937643__SS-prME
  source 1..9873: mol_type = other RNA
accagcttgtgtctaatgatgatcctccccgcagctctcgcgttccacctcaccagccgggacggcgagccccgcatgatcgtgggcaaaaacgaacgcggaaaatctctgctgttcaagaccgcttccgggatcaacatgtgcaccctgatcgccatggacttaggcgaaatgtgcgacgataccgtgacttataagtgtccacatatcaccgaggtagaacccgaggacatcgattgctggtgcaatctgacctccacttgggtaacatacggtacctgcaaccaggccggagagcaccgccgcgacaagcggtccgtggcgcttgcgcctcacgtgggcatgggactcgatacccgcactcaaacgtggatgagcgcggaaggagcctggcgccaggttgagaaggtcgagacgtgggccctgcgccacccgggattcaccatcctcgcgttattcttagcccactacatcggcaccagtctcacccagaaggtggtaatctttattctcctgatgctcgtcaccccatcaatgaccatgcggtgtgtgggggtgggtaacagagacttcgtcgagggcctttccggggccacctgggtggacgtggtcctggagcatgggggatgtgtgactaccatggcaaagaacaagcccaccctcgacattgagctgcagaaaacggaggccactcagctggcaacgcttcggaagctgtgcatcgagggtaagataactaacatcaccaccgactccaggtgccccactcagggcgaggccaccctgccagaggagcaagaccagaattacgtgtgcaagcacacctacgttgaccgggggtggggcaacgggtgtgggttattcggtaaggggtctctcgtgacatgcgccaagttccaatgtctcgagcccatcgagggcaaggtagtccaatacgagaatctcaagtacacggtgatcatcaccgtgcacaccggtgaccagcaccaggttgggaacgagacccagggcgtgacggctgagatcacaccccaagcgagcaccactgaggcgatactccccgagtacggtactctggggctcgagtgctctccgcgcacgggtcttgatttcaacgagatgatccttctcaccatgaaaaacaaggcttggatggtccatcgacagtggttcttcgacctgcccttaccctggaccagcggcgcaactaccgagacacccacctggaacagaaaggagctcctggtcaccttcaagaacgcgcacgcgaagaagcaggaggtggtcgtcctagggtcccaggagggcgcgatgcacactgccttaaccggggcgacagaaatccagaacagcggcgggacctccatcttcgcgggacatctgaagtgcagactgaagatggataaactagagcttaaaggcatgtcttacgctatgtgcacgaacacctttgtgctgaagaaagaggtctccgagacccagcacgggacaatcttaatcaaagttgagtacaaaggcgaggacgtaccgtgcaagatccccttcagcacggaggacggccagggcaaggcgcacaacggccgcctgattactgccaaccccgtcgttaccaagaaagaggagccggtaaacatcgaagccgaacctcccttcggggagagcaatatcgtaatcggtatcggggacaacgccctgaaaatcaattggtacaagaagggatcctccatcgggaagatgttcgaagctaccgcccggggcgccagacgtatggccatcctgggcgacaccgcctgggattttggctccgtgggcggggtgctcaacagcctggggaagatggtccaccagatcttcgggtcagcgtacaccgctctgttcagtggcgtgtcctgggtgatgaagataggaatcggggtcctcctgacatggataggactgaactcgaagaatacgtccatgagtttctcctgtatagccattgggataatcacgctctacctgggcgcagtggtgcaggcggatatggggtgcgtcatcaactggaagggcaaggagttgaagtgcgggtctgggatcttcgtgaccaacgaggtacacacttggaccgagcagtacaagttccaggccgactcccccaaacgcttggcgacggccattgcgggcgcctgggagaacggagtatgcggaatccgcagcaccacgcggatggagaatctgctgtggaaacagatcgcgaacgagctcaactacatcttatgggaaaacaacatcaagctcacggttgtggttggggacatcattggcgtactcgagcagggcaagcgcactcttacaccccagcctatggaattaaagtactcctggaagacatggggtaaggctaagatcgtgaccgctgagacacagaacagctccttcattatcgacggccccaatacgcccgagtgcccctccgtctcccgggcctggaacgtgtgggaggtggaagactacgggtttggcgtgttcaccaccaatatctggctgaagctgcgggaagtgtatacgcagctgtgcgaccaccggctaatgtcagctgccgtgaaggacgagaaggccgtccacgccgacatgggctactggatcgagagccagaagaacggttcctggaaactggaaaaggcatcgctgatcgaagtgaagacatgcacctggccgaagtcccacactctctggagtaacggcgtgctggaatctgacatgatcatcccaaaaagcctggcggggccgatctcccagcataaccaccgccccggttaccacacccaaacagcagggccatggcatttaggtaagctggagctggatttcaactactgtgagggtacgactgtagtgatcaccgagaactgcgggacccggggccccagcctccgtaccaccaccgtgtccggaaagctaatccacgagtggtgctgccggagctgcaccctgccgcccctccgttacatgggcgaggacggttgttggtacggcatggagatccggccgatctccgagaaggaggagaacatggttaagagcttagtctcggccggaagcgggaaggtcgacaacttcaccatgggggtcttatgcctcgccatcctcttcgaggaggtcatgcgcggcaaattcggcaagaaacacatgatcgccggggtgttcttcacattcgtccttctactgtcgggccagataacctggcgggacatggcccacacccttatcatgataggaagcaacgcttcagatcgcatgggtatgggcgtaacctacctcgccctgatcgccaccttcaagattcagcccttcttggctctgggtttcttcttaagaaaactgacttctcgtgagaaccttctccttggagtggggctcgctatggccacgaccttacagctgcccgaggacatcgagcagatggcgaacgggatcgccctcgggctgatggcgctgaaacttatagcccagtttgagacctaccagttgtggaccgccttgatcagcctaacgtgctccaataccatcttcacgctgaccgtcgcttggcggacggccactctgatcttagcgggtgtatctctgctgccagtctgccaatcctcctccatgcgcaagacagactggctcccgatggctgttgccgcgatgggcgtgccgcctctccctctgttcatcttcagcctcaaggacactctcaagcggcgctcctggcccctgaacgaaggtgtcatggctgtggggctcgttagcattctggcgtcctctctgctccgcaacgacgtccccatggctggccctctggtggctggtggcctgttgatcgcctgctacgtgatcaccggcaccagcgcagacctgaccgtcgagaaggcggccgacatcacctgggaggaggaggctgagcagacgggcgtgagccacaatctaatgatcgcagtggatgacgacgggacgatgcggattaaggacgacgagaccgagaacatccttaccgtcctgctgaagaccgccctcctgatcgtgagcggaatcttcccttactcgatccccgccacgctactcgtctggcacacctggcagaaacagacccaacgctccggcgtgctgtgggacgtgcccagcccgcccgaaacgcagaaggccgagctggaagagggggtctacaggatcaagcagcagggcatttttgggaagacgcaggtcggagtaggggtgcagaaagaaggggtattccatactatgtggcacgtgaccaggggcgccgtgctcacctataacgggaaacgccttgagcccaactgggcctccgtcaaaaaggacctgatctcatatggcggcggctggcgcttaagtgcgcagtggcaaaaaggggaagaagtccaggtgatcgccgtagagcctggcaaaaaccctaagaacttccagacaatgcccggaaccttccaaactacgacgggggagatcggcgctatcgcattagatttcaagcccgggacctcgggatcccctatcatcaaccgagagggcaaagtggtggggctttacggcaacggggtcgtcacgaagaacggcgggtatgtgagcgggatcgcgcagaccaacgcggaacccgacggacccacgcccgaattagaggaagaaatgttcaagaagcgcaacctcaccatcatggacctgcatcccggaagcggcaagacccgaaaatacctaccggcaattgtacgcgaggccataaagcggcgcctgcggaccttgatcttagcccccacgcgggtggtggccgccgagatggaggaggccctaaaggggctgccgatccgataccagaccaccgcaaccaaatctgaacacacgggccgcgaaatcgtcgacctaatgtgccatgccacttttaccatgcgcctcctgagccccgtgcgcgtgccgaactacaacctgatcatcatggatgaggcccactttacagaccctgcgtctatagctgcccggggttacatcagcacgcgtgtcggcatgggagaggctgcggcaatcttcatgaccgccacgccacccgggactgctgacgccttcccacagtctaacgcgcccatccaggatgaggagcgggacataccagagcgtagctggaacagcggaaatgagtggataaccgactttgccgggaaaaccgtctggttcgtgccgagcataaaagccgggaacgacattgcgaactgcctgcgcaagaacgggaagaaggtaatacagttgagtcgaaagaccttcgacacggaataccagaagaccaagctcaatgactgggatttcgtggtgactaccgacatttctgagatgggcgccaacttcaaggcagacagagttattgacccgcgacggtgcctcaaaccggttatcctgacggacggcccagagcgggtcattctggccggtcccatgccggttaccgccgccagcgctgcgcagcggcggggccgcgtgggccggaacccccagaaggagaatgaccagtacattttcactgggcagcccctcaataacgacgaagatcacgcccattggacagaggcaaagatgctactcgacaacataaataccccagaaggaatcatcccggccttattcgagccagagcgcgagaaaagcgcggcaatagatggcgaataccgtttaaagggcgaatcccgcaagaccttcgtggagttgatgcggcgcggtgacctccccgtatggctggctcacaaagtggcctccgaaggcataaaatacacagaccggaagtggtgtttcgacgggcagcgtaacaaccaaatcctggaggagaacatggacgtggaaatctggaccaaagagggggagaagaagaaactgcgtcccagatggctcgatgcccgcacctactccgatcctctggctctcaaagagttcaaggagttcgcagcgggacggaaaagcatagctctggacctggttaccgagatcggacgtgtgcctagccatctcgcacaccggacgcgcaacgcgctggacaacctggtgatgctccacacaagtgagcacggagggcgggcctaccgccacgccgtggaggaactgcccgaaacaatggagacactgttactgctaggcctcatgatcttactcacaggcggtgccatgcttttcctgatcagcgggaaagggatcgggaaaacctccatcgggctgatatgtgtgatcgcctcctcaggaatgctctggatggcggaaatccctcttcagtggatcgcgtctgccatcgtcttggagttctttatgatggtgctcctgatcccagagcccgaaaaacagcggacgccccaggacaaccagttagcgtatgtggtcatcgggatccttaccctggccgcggtaattgcggcgaacgagatgggcctgttggagacgaccaaacgcgacctcggcatgtccaaagagccgggggtggtctcacccacctcctacctggacgtagatctccaccccgcctcagcgtggaccctgtacgccgtagccacgaccgtgatcacccccatgctgcggcacaccatcgaaaactccacggcgaacgtctcactggccgccatcgccaatcaggccgtcgtactgatgggcctggacaaggggtggccgatcagcaaaatggacctcggcgtgcccctgcttgcactcgggtgttactcgcaggttaaccccctcaccttaaccgccgccgtcctcctgctcataacccactacgccatcatcggaccagggctccaagcgaaggccacgcgggaggcccagaagcgaaccgctgcagggatcatgaagaacccgaccgtggacgggatcatgacaatcgatttggaccccgtaatttacgactccaaattcgagaagcagctggggcaggtcatgctcctcgtgctgtgtgctgtccaactcctgcttatgcgcacgagctgggccctatgcgaggctctcaccctggccaccgggcccattaccacgctctgggaggggtcccccgggaagttctggaacaccaccatcgccgtctccatggccaacatcttccggggctcatacctggccggcgccggccttgctttcagcatcatgaagtccgtagggacgggaaaacggggcactggtagccagggcgagaccctcggggagaagtggaagaagaaactgaaccaactgagccggaaggatttcgatctctataagaagtcgggcattaccgaggttgaccgaacggaggccaaagaggggctgaagcgtggcgagatcacccatcacgccgtatcacgcggcagtgcaaagctgcagtggttcgtggagagaaacatggttatcccggaggggcgcgtcatcgacctcggctgtggtcggggcggctggtcgtactactgcgccggcctaaagaaggtaacagaagttagggggtacacaaaaggcgggccagggcacgaggaaccggttcccatgagcacctacggatggaatattgttaaactgatgagcggcaaggacgtgttctacctcccgcccgagaaatgcgacaccctcctgtgcgacatcggggagtccagcccctcccctacggtagaggagagcaggactatcagggtcctgaagatggtcgagccgtggctcaagaataaccagttctgcattaaagtcctcaacccttatatgcccactgtgatcgagcacctcgagcgcctccagcggaagcatggtggaatgctggtgcgcaatccgctgtcccggaatagcacccatgagatgtactggatatccaacggcacggggaacatcgtggccagcgttaacatggtgtcccgcctcctgctaaaccggttcaccatgacccaccgccggccgacaattgagaaagacgtcgaccttggcgccggcacgcggcacgtgaacgctgagcccgagacccctaacatggatgtgatcggcgagaggatcaaaaggatcaaggaggaacacaacagcacctggcattacgacgacgagaacccgtataagacctgggcataccacggtagctacgaagtcaaggcgactggtagcgcttccagcatgatcaacggcgtggtgaaacttctgacaaagccctgggacgtggtgcccatggtcactcaaatggctatgactgatacgacccctttcggtcaacagagggtgttcaaagagaaggtcgatactcggaccccgcggtcgatgcccggcacgcgccgggttatgggcatcactgccgagtggctctggcgcaccctagggcgaaacaagaagccaaggctgtgtacccgggaagagttcacgaagaaggttcgcaccaacgcggccatgggcgcagtgttcaccgaggagaatcaatgggactccgccaaggccgcggttgaggacgaggacttctggaagctggtggaccgcgagcgagagctccacaaactgggaaagtgcggcagctgcgtgtacaacatgatggggaagcgggagaagaaactcggtgagttcgggaaggcgaagggctcccgggccatttggtacatgtggcttggcgccaggtatctggagttcgaggccctcgggtttctgaacgaggatcactggttttctcgggagaactcctattctggcgtggagggggagggcctgcacaagttaggctacatcctgcgggacatctcgaagatcccagggggcgcaatgtacgccgacgataccgccgggtgggacacacggattaccgaagatgaccttcataacgaggagaaaatcacccagcagatggacccggagcaccgccagctcgccaacgccatattcaaactcacataccaaaacaaagtcgtgaaggtccagcggcccacgcctaccggcacggtgatggatatcatttcacgcaaggatcaacggggctccggccaagtgggcacctacgggctgaacaccttcacgaatatggaagcacagctcatccgccagatggagggcgaaggggtgctgagcaaggctgatctcgagaatccccacttgccggagaagaagataactcagtggttagagacgaagggcgtagaacgactgaagcgtatggccatctccggcgacgactgcgtagttaagcccattgacgaccggttcgccaacgccttactggcgttaaacgatatggggaaggtacggaaggacatcccccagtggcagcctagcaaaggctggcatgattggcagcaggtaccgttctgctctcatcacttccacgaactcataatgaaggacgggagaaagctagtcgtgccgtgccgcccccaggacgagctcattggccgggccaggataagccagggggctggctggtcgctcaaagagactgcctgcctcggcaaggcgtacgctcagatgtggtcgctgatgtacttccaccggcgtgacctgcgtctagcctctaacgccatctgcagcgccgttcccgtgcactgggtgccgacgtcccggaccacctggtccatccatgctcaccaccagtggatgaccacagacgacatgctgaccgtgtggaaccgggtctggatcgaggacaacccctggatggaggataaaacccccgtgacaacgtgggagaacgttccctacctagggaagcgggaagaccagtggtgcggaagcctgattgggctgacctcccgcgccacatgggcccaaaatataccgaccgctatccagcaagttcgttcactcattggtaatgaagagtttcttgactacatgccatcgatgaagcgcttccgcaaggaggaggagtcggagggcgccatctggtga

SEQ ID NO: 25821 - RNA, 9873 nt, synthetic construct
  misc_feature 1..9873: note = derived and/or modified CDS sequence (opt11) from DENV-3__HM181972__SS-prME
  source 1..9873: mol_type = other RNA
acctcgctctgcctgatgatgatcctgcctgcggcgcttgcattccatctcaccagccgggacggggagcctcggatgatagtggggaaaaacgagcgaggcaaatctttgttattcaagaccgcgtccgggatcaatatgtgcaccttaatcgcaatggacctgggcgagatgtgcgatgacacagtgacctacaagtgcccccatatcaccgaggtagagcccgaggacatcgattgctggtgcaacctcacaagtacctgggtgacttacgggacgtgcaaccaggcaggcgagcacaggcgagacaagcggtccgtggcgctggcgccccatgtgggcatggggctggacacgagaacccagacctggatgagcgccgagggcgcctggcggcaggtcgagaaggtggaaacgtgggcccttcgccatccgggttttacaatcctcgcactgttcctggcccattacatcgggacctccttaacacagaaagtcgtgatatttattttgctgatgctcgtcacgccgagcatgacaatgcgctgcgttggtgtaggcaaccgcgactttgtcgagggcctgtcaggggcgacctgggtggacgtggtcctcgagcacgggggctgcgtcacaacaatggccaagaacaagcctaccctcgacattgagctgcaaaagaccgaggctacccagttagcaacgctccggaagctgtgcatcgagggcaaaatcaccaacatcactaccgacagccgctgccccacacagggcgaggccactctgccagaggagcaggaccaaaactacgtgtgcaagcacacttacgtcgaccgggggtggggcaacgggtgcggtcttttcgggaaaggctcactggtaacatgcgccaaatttcagtgcctggagcccatagaaggaaaggtggtccagtatgagaacctcaaatatacggtgatcatcacagtgcacaccggggaccaacaccaagtcggcaatgaaacccagggtgtgactgccgaaatcacgccccaggcctcaaccactgaggcgatcctgcccgagtacggcacactggggctagaatgctcgcctcgcaccggcctggacttcaacgagatgatcctgttgaccatgaagaacaaggcatggatggtgcatcggcagtggttcttcgaccttcccctcccctggacaagcggcgcgaccactgaaacaccaacctggaaccgcaaagaactcctggtgacctttaaaaacgcccacgctaagaaacaagaggtggtcgtgctgggttcgcaggagggcgcgatgcacacggccctcaccggggccacggagatacaaaacagtggcgggacctccatctttgcaggccacctgaagtgccgcctgaagatggataagctcgagctgaaaggaatgtcgtatgccatgtgcactaacaccttcgtgcttaagaaggaagtctcagagacacagcatgggaccatcctcatcaaggtggaatacaagggcgaggacgtgccgtgcaagatcccgttctcgacggaggacgggcagggtaaggctcataatggccgcctgatcacggccaaccccgtcgtaaccaagaaggaggagcccgtgaacatcgaagccgagccgcccttcggtgaaagcaacatagtcatcggtatcggggacaacgcccttaagatcaactggtataagaaggggtcgagcatcggaaagatgttcgaggcaaccgcacggggagcccgtcggatggccatcctgggcgacacggcctgggactttgggtcagtgggcggggtactcaacagtctagggaaaatggtccaccagatattcggatccgcgtacaccgcgctcttcagcggcgtgtcctgggtgatgaagataggtatcggggtactcctaacctggatcggtctaaactctaaaaataccagtatgagcttcagctgcatcgcaatcgggataattacgctctacctgggcgccgtagtgcaggcagacatggggtgcgtcatcaactggaagggcaaggagttaaaatgtggaagcgggattttcgtgaccaacgaggtacatacctggaccgaacagtacaagttccaagcggactcccctaagcgcttagccacggccatcgccggggcctgggagaacggggtctgcggcatccgcagcaccacccgcatggagaacctgctgtggaagcagattgcgaacgagctcaattacatcctgtgggagaataacattaaactgaccgtggtggtaggagacatcattggcgtgctcgagcagggcaaaaggacgctgacgcctcagccgatggagctgaaatatagttggaagacttgggggaaggcgaaaatcgtaaccgcagagacgcaaaacagctccttcatcattgacggccctaacacccctgagtgccccagcgtctcacgggcctggaatgtgtgggaggtggaagactacgggttcggcgtctttaccaccaacatttggctcaagctacgcgaggtgtacacccagctatgtgaccatcggctcatgagcgcggccgtgaaggacgagcgcgctgtccacgccgacatggggtactggatcgagagccagaagaacggttcctggaagttagaaaaggcgagcctgatcgaggtgaagacgtgcacctggccgaagtcacataccctgtggagcaacggcgtgctggagtccgatatgatcataccaaagtcgctggcggggcccatttcccaacacaaccaccgacccggctaccacacccagacggctgggccctggcacctcggcaagctggagctggattttaactattgcgaaggcaccaccgtcgtaatcaccgaaaactgcggaacgcgcgggcccagcctgcggaccaccaccgtgagcggaaagctgatccacgagtggtgctgtcgcagctgcaccctaccccctctccggtatatgggcgaagacgggtgctggtatggcatggagatccgccccatcagcgagaaggaggagaacatggtcaagagcctggtgagtgccggcagcggaaaagtggacaatttcaccatgggcgtcctgtgcttggcaatcctgttcgaggaagtgatgaggggaaagtttggcaagaaacacatgatcgccggggtgttcttcacctttgtccttttactgagtggccagattacctggcgggatatggcgcacacgctgatcatgatcgggagcaatgcctcagaccggatggggatgggcgtgacctacctagccctaatagccaccttcaagatccagcccttcctggttctcggattctttctgcgcaagctgacctcgcgggagaaccttttgctgggagtcggcctcgccatggccacgacgctgcagctgcccgaggacattgagcagatggccaatgggatcgcccttggtctgatggccttaaagctcatcacgcagttcgaaacctaccaactctggacggctctgatcagcctgacctgctccaacaccatattcactctgaccgtggcttggagaaccgccacgctgatcttagccggggtcagcctgctgccggtgtgccagtcgagctcgatgcgtaaaaccgattggctccccatggccgtggcggctatgggcgtaccgcccctcccgttgttcatctttagcctaaaggacaccctgaagagacgctcctggccgctgaacgagggggtgatggccgtgggtctcgtcagcattctggcctcctcgctgctccggaatgacgtgccaatggcaggcccgctggtggccggaggattgctcatcgcctgctacgttatcaccggtacctccgccgacctgaccgtggagaaggctgccgacatcacctgggaggaggaggcggagcagactggcgtttcccacaatctgatgatcaccgtcgacgacgacggaacgatgcgcataaaggacgacgagaccgagaacatcctcacggtgctgttaaagaccgccttgctgatcgtatccggcatctttccgtacagcatccccgctactctgttggtctggcatacttggcagaagcagacccagcggtccggcgtcctatgggatgtgcccagcccacccgagacccagaaggcagaactggaggagggagtctatcgcattaagcagcagggcatcttcggcaaaacccaagtgggggtgggggtacagaaggagggcgtattccacaccatgtggcacgtgacgcggggcgccgtcctcacctacaacgggaaacgcctggagccaaactgggcgagtgtgaagaaggacctgataagctatggcggcggctggcggttgtccgcgcagtggcaaaagggggaggaggtgcaagttatcgccgtagagcccggcaagaacccgaagaacttccagaccatgcccggcaccttccagacgacgaccggggagatcggcgccatcgcgctggacttcaaaccagggacctctggcagccccatcatcaatcgcgaaggtaaggtggtcggcttgtacggtaacggggtggtgacaaagaatggcgggtacgtctccggcatcgctcagaccaatgcggagccggacggccccacccccgaactggaggaggagatgttcaagaagcggaacctaactatcatggatcttcacccaggcagcgggaagacgcgcaaatacctgccggcgatcgtgcgggaagccatcaagcgacggttgcgcaccctaatcctggcgcccaccagagtcgtcgcggccgagatggaggaggccctcaagggtctgcccatccgctaccagaccactgccaccaagtctgaacatactggccgtgagatcgtggatctgatgtgccacgcgacattcacgatgcgcctcctgagccccgtgcgggtaccgaactataacctgattatcatggatgaggcccactttaccgaccccgcctccatcgcggcgcgcgggtacatctcaacccgggtaggtatgggagaggctgctgccatcttcatgaccgccactcctccaggaacggcggacgctttcccgcagtccaacgcccctatacaagacgaggagcgcgacatccccgagcgcagttggaactccgggaacgagtggatcaccgattttgccgggaagaccgtgtggttcgtccctagcatcaaggccggaaacgacatcgcgaattgcctccggaagaatgggaagaaagtaatccagctgtcccgaaagaccttcgacaccgagtaccagaagaccaagttgaacgactgggacttcgtggttaccacggatatcagtgagatgggcgccaactttaaggcagaccgtgtgatcgacccgcgccggtgcttaaaacccgtaattctgaccgacggaccagagcgcgtcatccttgccgggccaatgccggtgacagctgcatccgccgcccagcgccgcggtcgcgttgggcgcaacccgcagaaggagaacgaccaatacatcttcaccggccagccgctcaacaacgatgaggaccacgcccactggaccgaggctaagatgctactggacaatatcaacactccagaggggataataccggccttattcgagcccgaacgggagaagtccgccgctatcgacggcgagtaccgattgaagggcgagtcccggaagacgttcgtggagctgatgcgtcgcggcgatctccccgtctggttggcccacaaggtcgcgtctgaaggcattaagtatactgacagaaagtggtgtttcgacggccagcggaacaaccaaatcttggaggaaaacatggacgtggaaatctggaccaaggaaggggaaaagaagaagctccgcccccggtggctagacgccaggacatattccgaccccttggccctgaaggagttcaaggagttcgcagccggccggaagagcatcgccctggatctggtgaccgagatagggcgtgtcccgtcgcacttggctcacagaacgcggaacgcactagataacctggtgatgttacacaccagcgagcacggcggacgagcgtaccggcacgcggtggaggagctacccgagacgatggagaccctgctattactaggactcatgatactactgaccgggggcgcgatgctgtttctgatcagcggcaaggggattggaaagacctccatcgggctgatatgcgtcatcgcctcatcaggcatgctctggatggccgagatcccgctccagtggattgcctcagcaatcgtgctcgagttcttcatgatggtcctcctaatacccgagcctgagaagcagcgcacacctcaggacaaccagctggcgtacgtcgtcatcggtatcctcaccctggccgccatcatagccgcgaacgaaatgggcctgctcgaaaccaccaagcgggaccttgggatgtccaaggagccgggggtcgtcagccccacgagctacctggacgtagaccttcaccccgcgagcgcttggacactgtacgccgtggctaccaccgttatcacgcccatgctacgccataccatcgagaactccacagcgaacgtgtccctcgctgcaatcgcaaaccaagccgtcgtactgatgggcctggacaaggggtggcctatctcaaagatggacctcggcgtgcccctgttggcgctcgggtgctactcacaggtaaaccccctcactttaaccgctgctgtcctcctgctgatcactcactacgccatcattggccccggcctacaagccaaggcaacccgggaggcccagaaacgcaccgccgccggcattatgaagaacccgacggtcgacggcattatgactatagacctggaccccgttatttacgattccaagtttgagaagcagctggggcaggtaatgctcctggtactgtgcgcggtgcagctcttactgatgaggaccagttgggccctatgcgaggccctgactctggctacgggacccatcactaccctctgggagggttcccccggtaagttctggaataccactatcgccgtcagtatggcgaacatctttcgaggttcctatttagccggtgccggtctggccttcagcatcatgaagtcagtgggcaccggcaagcgcggcaccgggtctcagggtgaaaccctcggggagaaatggaagaagaagctgaaccagttaagccgcaaggacttcgacctttacaagaagtcgggcatcaccgaagtcgacagaaccgaggcaaaggagggtttgaagcgcggagagatcacgcaccacgctgtctcgagaggctccgccaagctccagtggttcgtggagaggaacatggtgattccggagggcagagtcatcgacctcggttgcggccggggcgggtggtcatactactgtgccggcttgaagaaagtgacagaggtgagaggctacaccaagggcgggcccggtcatgaagagcccgtccccatgtctacgtatgggtggaacatcgtgaagctgatgagcggcaaggatgtgttctatcttccgcccgagaaatgcgataccttgctgtgcgacatcggcgagtcgagccccagccccacagtagaggagtcgcgcaccatccgcgttttaaagatggtggagccgtggctcaagaacaaccagttctgcatcaaggtactgaacccctacatgcccacggtaatagagcatttagaaaggttgcagcgcaagcacggcgggatgctggtacggaaccccctgtcccgcaactcgacccacgaaatgtactggatctccaatggcaccggtaacatcgtcgccagcgtgaacatggtttcccggttgctgctgaacaggttcacgatgactcatcggcgcccgacaatagagaaggacgtagacctcggcgccggcactcggcacgtaaacgcggagcccgagacccccaacatggacgtgataggggagcgcattaagcggatcaaagaggagcacaacagcacttggcactacgacgacgagaacccgtacaagacttgggcgtatcacggctcctacgaagtcaaggccaccggtagcgcctccagcatgataaacggcgtggtcaagctactgaccaagccctgggacgttgtgcccatggtcacccagatggctatgaccgacactaccccctttggccagcagcgcgtgtttaaagagaaagtggacacgaggacaccgcggagcatgccgggaacccggagagtcatgggcatcaccgcagagtggctctggcgtacgctggggcgcaacaagaagcctcggctgtgcaccagagaagagtttaccaagaaagttcggaccaacgctgctatgggcgccgttttcacggaagagaaccagtgggacagtgcaaaggccgccgtcgaggacgaggacttctggaagttggtggatcgggagcgcgaactccacaagctgggcaagtgcggcagctgtgtgtacaacatgatgggaaagcgggagaagaagctcggcgagttcggcaaagccaagggtagccgagcgatctggtacatgtggcttggggcgcggtacctggagttcgaggcccttggattccttaacgaggaccactggttcagccgtgaaaactcctactcgggcgtcgagggggagggcctgcacaagctcggctacatactgcgggacataagtaagatccccgggggcgccatgtacgccgacgacaccgccgggtgggacaccaggatcaccgaggatgacctccacaacgaggagaagatcacgcagcagatggacccggagcatcggcagctcgcgaatgccatcttcaagttgacctaccagaacaaagtggtgaaggtccaacgccccacccccaccggcaccgtgatggacatcatcagccgaaaggaccaacgcggctctggccaggtgggcacgtacgggttaaataccttcactaatatggaggcccaactcatccggcagatggaaggcgagggggtcctgtcgaaggcggatctggaaaatcctcacctcccggagaagaaaatcacccagtggctggagacgaagggcgttgagcgcctgaaaagaatggccatatccggcgacgattgtgtggtcaagcccatcgacgaccgcttcgcgaacgccctgctcgccctgaatgacatggggaaggttcggaaggatatcccacagtggcaacctagcaagggctggcacgattggcaacaagtcccgttttgctcccaccactttcacgagcttataatgaaggatgggcgcaaactggtcgtcccctgccggcctcaggacgagctaattggccgcgctcggataagccaaggggccggttggtccttaaaggagaccgcttgtctgggcaaggcatacgcccagatgtggagcctgatgtactttcaccgccgggacctgaggctggcaagtaatgcgatttgcagcgccgtccccgttcactgggtgccgacctccaggacaacgtggagtatccatgcccaccaccagtggatgacaaccgaggatatgttgaccgtgtggaacagagtatggatcgaggacaacccctggatggaggacaagactcccgtcaccacctgggggaacgtgccctaccttggcaagcgtgaagaccagtggtgcgggtcgctcatcggcctgacatcccgggcgacgtgggcccagaacattcctaccgctatacagcaggtccgcagcctcatcggtaacgaggagttcctggactacatgcccagcatgaagcggttccgcaaggaggaggagagcgagggcgccatctggtga

SEQ ID NO: 25822 - RNA, 9873 nt, synthetic construct
  misc_feature 1..9873: note = derived and/or modified CDS sequence (opt11) from DENV-3__HM631857__SS-prME
  source 1..9873: mol_type = other RNA
actagcttatgtctcatgatgatcttgcccgccgcactggcgttccatcttaccagccgggacggcgagccaaggatgatcgtggggaagaacgagcgcggcaaatctttgctgttcaagaccgccagcgggataaacatgtgcaccctcatcgccatggacctgggcgagatgtgcgacgacaccgtgacatacaagtgcccgcacatcactgaagtggagcccgaggacatcgattgctggtgcaacctgaccagcacctgggtaacctacgggacctgcaaccaggcaggcgagcacagacgcgacaaacggtccgtggccctcgcaccgcacgtgggcatgggcctggatacccgcacccagacctggatgagcgccgagggagcctggcgccaagtggagaaggtcgagacctgggccctgcgtcatccggggttcaccatactcgcgttattcctggcccactacattggcacatccctcacgcagaaggtagtaatcttcatcctgctgatgctagtgactcccagcatgaccatgcggtgcgtgggggtgggcaatcgtgacttcgtcgagggcctgtccggggcaacctgggtggacgtggtcctggagcacggcgggtgcgtgacgactatggccaagaacaagcccaccctcgatatcgagctgcagaagaccgaggccacccagttggcgacgctaagaaaactgtgcattgagggcaaaattacaaacatcaccaccgatagccgttgccccacacaaggtgaggccacccttccggaagagcaagaccagaactacgtgtgcaagcacacgtacgtcgaccgagggtggggaaacgggtgcggcctattcgggaagggctcccttgtgacctgcgccaagttccagtgcctggagcccatcgagggcaaggtggtccagtacgagaatctcaagtatacagtgatcatcaccgtgcacaccggggaccagcaccaggtcggaaacgaaacccagggggtcaccgccgagatcacgccccaggccagcaccaccgaggcgatcttgcccgagtacggaactctgggcctcgagtgctccccacgcacgggcctggacttcaacgagatgatcctgctcacgatgaagaacaaggcctggatggtccaccggcagtggttcttcgacttacccctgccctggaccagcggcgccaccactgagacgcccacttggaaccgcaaagagctactcgtgaccttcaagaacgcccacgccaagaaacaggaggtggtcgttcttgggtcacaagaaggcgcgatgcacacggccctcaccggtgccaccgagatacagaactccggcggtacctcgatcttcgccggccacctgaagtgccggctgaagatggataaactcgagcttaagggaatgagctacgccatgtgcaccaataccttcgtgctgaagaaggaggtctccgagacccagcacggcaccatcttaatcaaagtagagtacaaaggcgaggacgtgccgtgcaagatccctttcagcacggaggatgggcaggggaaggcgcacaacggtcgcctgatcacggccaacccagtcgtgaccaagaaggaggagccagtaaacattgaggccgagccccccttcggggaaagcaacatcgtcatcggcatcggggacaatgcattaaagatcaactggtataagaaagggtcctcaatagggaagatgttcgaagcgaccgcaagaggagcacgcaggatggccatcctgggcgacacggcctgggactttgggtcagtgggcggggttctcaacagcctgggcaagatggtgcatcaaatcttcggttccgcgtacaccgccctgttctccggcgtgtcctgggtgatgaagatcggcataggggtcctcctgacatggattggcttaaattcaaagaacacctccatgtcattttcctgcatcgccatagggataatcacgctctacctgggcgccgtggtgcaggcggacatgggttgtgtcatcaattggaagggcaaggagctgaagtgcggcagcgggatattcgtgaccaacgaggtgcacacctggaccgagcagtacaagttccaggctgactcccccaagcgactagccacggccatcgccggtgcctgggaaaacggggtctgcggcatccgcagcaccacccgaatggagaatctgctgtggaagcagatcgcgaatgagctcaactacatcctgtgggagaataacatcaagctgaccgtggtggtcggggacataatcggcgtgctggagcagggcaagcgcactctgacgccccagccaatggagttaaagtactcctggaagacctgggggaaggccaaaatcgttaccgcagagacccagaacagcagctttatcatagacggcccgaacacgcccgagtgcccaagcgtctccagggcatggaacgtgtgggaggttgaagactacgggttcggggtgttcaccactaacatctggctcaagcttcgcgaggtatatacccagttgtgcgaccatagactcatgtcagcggccgtgaaggacgagcgcgccgtacacgccgacatgggctactggattgagagccagaagaacgggtcctggaagctggagaaggcctctctgattgaggtgaagacgtgcacatggccgaagtctcacaccctctggagcaacggcgtgctagagtctgacatgatcatccccaaaagcctagctggacccatctcccaacacaaccaccggccggggtaccacacccagacggccggcccctggcacctcggcaagctggagctcgacttcaattattgcgagggcaccaccgtcgtgatcaccgagaactgcggcacccgcggtccttcgctccggacaaccaccgtgtctgggaagctgatccacgagtggtgctgccgcagctgcacgctccccccgcttcggtatatgggcgaggacgggtgctggtacggcatggagatccgccccatcagcgagaaggaggagaacatggtcaagtcattagtgtctgcggggtccgggaaggtggacaacttcactatgggcgtcctttgcctcgccatcctgttcgaggaggtgatgcgcgggaaattcgggaagaagcacatgatcgccggggtattctttaccttcgtcctgctcctgtccggacagatcacctggcgcgacacggctcacaccctgattatgatcggctccaatgcctccgatcggatggggatgggcgtgacctacctcgccctgatcgccactttcaagatccagcctttcctggccctcggcttctttctgcgcaagcttacaagccgagagaacttactgctgggcgtgggcctcgccatggccaccaccctgcagctgcccgaggacatcgagcagatggccaacgggatcgcactcggtctgatggcgctgaagctcatcacgcagttcgagacctaccagctgtggacggccctgatcagcctgacctgttccaacacaatcttcacgttaaccgtcgcgtggcgcaccgccaccctaattctcgccggggtgtctctgctgccggtgtgccagtcctcatccatgcggaagacggactggctccccatggcggtggccgccatgggcgtgccgccactcccgctgttcatcttcggcctcaaggacaccctgaagcgccgcagctggcccctcaacgagggcgtcatggccgtgggcttagtctccatactggcgagctcgctgctccggaacgacgtccccatggcggggccactggtggccggcgggctgctcatcgcctgctatgtgatcaccggcacctcggccgacctgacagtcgagaaggccgcggacattacctgggaggaggaggccgagcagaccggggtgtcccacaacctgatgatcacagtggacgacgacggcaccatgcgcatcaaggacgacgagacggagaacatattgacagtcctgctgaagaccgcgctcctgatagtgagcgggatcttcccgtactccatccccgccaccctgctcgtgtggcacacttggcagaagcagacccagcggagcggcgtcctctgggacgtgcccagcccgcccgagacccaaaaggccgagctggaggagggcgtgtaccgcatcaagcagcaagggatcttcggcaagacgcaggtcggggtgggcgtgcaaaaggagggcgtcttccacacgatgtggcatgtgacccgcggggcggttctcacctacaatggtaagcgtctcgagccaaactgggccagcgtcaagaaggacctgatctcctacgggggcgggtggcgactctcggctcagtggcagaagggcgaagaggtccaggtgatcgccgtcgagcccggtaagaaccccaagaacttccagaccatgcccggtacgttccaaacgaccaccggcgagattggcgccattgccctggactttaagcccggcacgtccggcagccccatcatcaaccgcgagggtaaggtggtgggcttgtacgggaacggggtcgtgactaaaaacgggggctacgtaagcggcattgcccagaccaacgccgagccggacgggccaacacccgagctggaggaggagatgttcaaaaagagaaacctgacgattatggacctgcacccaggctccggtaagacccgcaagtacctgccggccatcgtccgggaggccattaagcgcaggctccgcacccttatcttagcccccacccgggtggtggccgccgagatggaggaggctcttaagggccttcccatccgctaccagactacggcgaccaagagcgagcacaccggacgggagattgccgacctgatgtgccacgccacgttcacaatgcgcttactgtcccccgtccgggtgccgaactacaacctgatcatcatggacgaggcccatttcaccgaccccgcctctatcgccgcaaggggctacatctccacccgggtgggcatgggggaggccgccgctatcttcatgaccgccacgccacccggcaccgccgacgccttcccacagagcaacgcccccatccaggatgaggagcgtgacatccccgagcgctcctggaacagcgggaacgagtggatcaccgacttcgctggcaagacagtatggttcgtgcccagtatcaaggccgggaacgacatagccaactgcctccgtaagaatggaaagaaggtgatccagctgagccgcaagaccttcgatacagagtaccagaagaccaagttgaacgactgggatttcgtggtgacgaccgacatctccgagatgggcgcgaactttaaggctgaccgggtgatcgacccccgccggtgcctaaagcccgtcatcctgaccgacgggcccgagcgcgtgatcttggccggcccgatgccggtgaccgccgccagcgccgcgcagcggcgcggtcgggtcggccgaaacccccagaaggagaatgaccaatacatttttaccgggcagccgcttaacaatgacgaagatcacgcgcactggacggaggcaaagatgctgctggacaacatcaacacccccgagggcattatcccggccttattcgaaccagagcgagagaagtccgccgcgatcgacggcgagtaccgcctgaagggtgagagccggaagacctttgtggaactgatgaggcggggtgacttgcctgtgtggctggcccacaaggtcgcctccgaggggatcaagtacaccgaccgcaagtggtgcttcgacggccagcggaacaaccagatcctggaagagaacatggacgtagagatctggacgaaggagggcgaaaaaaagaagctccggccccggtggctggacgcccgcacctacagcgacccgctggccctcaaggagttcaaggagttcgcggcagggcgcaaatccatcgcgctggacttggtcaccgagatcggccgggtgcccagccacctcgcccatagaacccggaacgcgctggacaatctggtgatgctccatacgtcggagcacggaggccgcgcataccggcacgccgtcgaggagctgcccgagaccatggagaccctgctcctgctagggttaatgatcctgctcacaggaggcgccatgctgttcctgattagcgggaagggaataggaaagacgagcatcggcctgatatgcgtgatcgcctcctccgggatgttgtggatggccgagataccgctgcagtggatcgcgtccgccatcgtcctagagttcttcatgatggtgctcttgatccccgagcccgagaagcagcgcacaccccaggacaatcagctggcttacgtggtaatcggcatcctcaccctggccgccgtcatcgcggccaacgagatgggcctgctcgagaccaccaagcgtgacctggggatgagcaaggaaccgggcgtggtatctcccaccagctacctggacgtcgacctccaccccgcctccgcctggaccctatacgcggtagccacaacggtcatcacccccatgcttcgccacaccatcgagaactccacggccaacgtgtcgctcgcggccatcgctaaccaggccgtggtattaatggggttagacaaaggctggccgatctcaaagatggacttaggggtccccctgctggccctcggctgctactcccaggtgaaccccctgacccttaccgctgctgtgctcctactgatcacacactacgcgatcatcggccccgggctccaggccaaggccacccgggaggcccagaagcgcacggccgcgggcatcatgaagaacccaaccgtggatgggatcatgaccatcgacctggaccccgtgatctacgacagtaaattcgagaagcagctgggccaggtgatgctcctggtcttgtgcgccgtgcagctcctcctgatgcggacctcttgggccctctgcgaagccctgacgctggccaccggacccatcaccaccctttgggaggggagccctggcaaattctggaacacgaccatcgccgtgtccatggccaacatcttccgcgggagctacctggctggcgctgggttggcgttctccatcatgaagtcagtcggcaccggcaagcgggggaccggtagccaaggtgagaccctcggcgagaagtggaagaagaagctgaatcagctgagccgcaaggattttgacctttacaaaaagtccggaatcacggaggtggacaggaccgaggccaaggagggcctgaaacgcggcgaaatcacccatcacgccgtatcccgggggtccgccaagctgcaatggttcgtcgagcgcaacatggtgatcccggaaggccgggtgatcgacctcgggtgcggccgtggcggctggtcatactactgcgccggcctgaaaaaggtcaccgaggtgagaggctacacgaagggcggccccggccatgaagagccggtgcccatgagcacttacgggtggaacatcgtcaagctgatgtccggcaaggacgtgttctacctcccacccgagaagtgcgacaccctgctgtgtgacatcggcgaaagctcccccagccccacggtagaagagagccgcacgatcagggtcttaaagatggtggagccttggctcaagaacaaccagttctgcatcaaggtgctgaacccctacatgcccaccgtcatagaacacctggagcggctccagcgcaagcacggtggcatgctggtgcggaacccactgagccgcaattccacccacgagatgtactggatctccaacgggaccggcaacatcgtagcgtccgttaacatggtgagccggctcctgctgaaccgcttcactatgacccatcggcgccctacgatcgagaaggatgtggacctcggagccgggacccggcatgtaaacgtggagcccgagacccccaacatggatgtgatcggcgagaggatcaagaggataaaggaggagcacaacagcacctggcactacgatgacgagaacccgtacaagacctgggcctaccacgggagctacgaggtcaaggccaccggatccgcaagctccatgatcaatggggtggtcaagctgttaacaaagccctgggacgtggtgcccatggtgacacagatggccatgaccgacacaacgcctttcggccagcagcgcgtgttcaaggagaaggtggacacccggactccacgcagcatgcccggaacccgtagagtaatggggatcacagccgaatggctgtggcggactctgggccgcaacaagaaaccccggctgtgcacccgtgaagagttcactaagaaggtgcgcacaaacgccgcaatgggagcggtgttcactgaggagaaccagtgggactcagctaaggccgccgtcgaggacgaggacttctggaagctcgttgaccgggagcgcgagctgcacaagctgggcaagtgcgggtcctgcgtgtataacatgatgggcaagcgggagaagaagctcggcgaattcgggaaggctaaaggcagccgcgcgatatggtacatgtggctgggggcccggtacttggaattcgaggccctcggcttcctgaacgaggaccactggttctcccgcgagaacagctattccggtgtcgagggcgagggcctgcacaagcttgggtatatcctccgggacatttccaagatccccggcggggccatgtacgccgacgacaccgcgggctgggacacccgcatcacggaggacgacttacataatgaggagaagattacccaacagatggacccggaacaccggcagctcgccaacgccatttttaagctgacatatcagaacaaggtggtgaaggtacagcgccccactcccaccggtacggtgatggatatcatctcccgcaaggaccagcgtggtagcggccaggtgggcacctacggcctgaacaccttcactaatatggaggctcaactcatccggcagatggagggggagggcgtcctgtcgaaggccgacctggagaatccccacctgccggagaagaagatcactcaatggctggagaccaaaggcgtggagcgcctgaagcggatggccatcagcggggacgactgcgtagtaaagcccatagacgaccgctttgctaacgccctcctggcgctcaacgacatgggcaaggtccggaaggatatcccccagtggcagccctccaaggggtggcacgattggcagcaggtaccgttctgcagccaccacttccacgagctcatcatgaaggacggccgcaagctggtcgtgccctgccggccccaggacgagctgatcgggcgcgcccggatctcccagggcgccggttggagcctcaaagagaccgcctgcctggggaaggcctacgcccagatgtggtccctgatgtacttccatcgccgcgacctcagactggcgagcaacgccatctgctccgccgtgcccgttcactgggtgccgaccagccgcacgacctggtccatccacgcgcaccaccagtggatgaccaccgaggacatgcttacggtctggaaccgtgtctggatagaagacaacccctggatggaggataagacgcccgtgaccacctgggaaaacgtgccctatctcggcaagcgcgaggaccagtggtgcgggagccttatcggcctgacgagtcgggctacctgggcgcaaaacatccccaccgcgatccagcaggtccgctccttgatcggtaacgaagagtttctggactacatgcccagcatgaagcggttccgcaaggaagaggagtccgaaggcgctatctggtga

SEQ ID NO: 25823 - RNA, 9873 nt, synthetic construct
  misc_feature 1..9873: note = derived and/or modified CDS sequence (opt11) from DENV-3__HM631860__SS-prME
  source 1..9873: mol_type = other RNA
accagcttatgtctcatgatgatcctgcccgcagcgctggcgttccacctaacgtcgcgggacggcgaaccgcggatgattgtagggaagaatgagcgcggcaaaagcctgctgttcaagacagcctccgggattaatatgtgtactctcattgccatggacctgggcgagatgtgtgacgacaccgtgacatacaagtgcccccacatcaccgaggttgaacccgaggacatagactgctggtgcaacctgacgagcacctgggtgacttatgggacgtgcaaccaggccggcgagcaccgacgcgacaagagaagtgtggcgctcgccccccacgtgggcatgggcctggacacccgcactcagacgtggatgagcgccgaaggcgcctggcggcaggtcgagaaggtcgaaacatgggccctgcgacacccgggcttcaccatcctcgctctgtttctggcccactacatcggcacgtccctcacccaaaaggtcgtgatcttcatactgctgatgctcgtcacgcccagcatgacaatgcggtgcgtcggggtgggcaaccgcgacttcgtcgagggcctgtccggggccacctgggtggacgtcgtcctggagcatggcgggtgcgtgaccacaatggccaagaacaaaccaaccctcgacatcgagctgcaaaagaccgaggccactcagctggcgacgcttcggaagctgtgtatcgagggtaagattaccaacatcaccaccgacagccgctgccccacgcagggcgaggccacgctgcccgaagagcaggaccaaaactacgtttgcaagcacacctacgttgaccgcgggtggggcaacgggtgcgggctcttcggcaagggatccctggtaacctgcgccaagtttcagtgcttggagccgatcgagggcaaggttgtccagtacgagaacctcaagtacacggtgataatcaccgtgcacaccggggaccagcaccaggttggcaatgagacgcaaggggtgacggcggagatcactccccaggcttcaaccaccgaggcgatcctgcccgagtacggcaccctcgggctcgagtgctccccgcgcaccggcctcgacttcaatgagatgattctgctcaccatgaagaataaggcttggatggtccaccgccagtggttcttcgacctgcccctgccctggacgagcggcgccaccactgagacccccacctggaaccggaaggagctcctcgtgacctttaagaatgcccacgccaagaagcaggaggtggtcgttttgggttcccaggagggagcgatgcacacggccctcactggggccaccgaaatccaaaatagcggcgggacctccatctttgccggtcacctgaaatgccggctgaaaatggacaaattggagctgaaggggatgagctacgcaatgtgcacgaacactttcgtgctgaagaaggaggtctccgagacccaacacggcactatcctcatcaaggtggagtacaagggcgaagatgtgccgtgcaagatccccttctctaccgaggacgggcagggcaaggcgcacaacggccggttaataaccgccaaccccgtcgtaacgaagaaagaggaacccgtcaacatcgaggccgaaccgccattcggcgagagcaacatcgtcatcggcatcggggataacgccctgaagatcaactggtacaagaagggctctagcatagggaaaatgttcgaggccaccgcacggggagcgcgccggatggccatcctgggcgacacggcctgggactttgggtccgtgggtggagtgctaaacagcctgggcaagatggtccaccagatctttgggtcggcgtacactgcactgttcagcggcgtgtcgtgggtgatgaagattggcatcggagtcctactgacatggatcggcctgaatagcaagaacacctccatgtctttctcctgcatcgcgatcgggatcatcacgctctacctgggcgctgtcgtgcaggccgacatggggtgcgtcgtgaactggaagggtaaggagctgaagtgcggcagcgggatcttcgtgaccaacgaggtacacacatggaccgaacagtacaagttccaggctgattcacccaagcgcctcgccacggccatcgctggcgcctgggagaacggggtgtgcggcatccgcagcaccacccggatggagaacttgctgtggaagcagattgcgaacgagctcaactacatactgtgggagaacaacatcaagctgactgtggtcgtgggggacatcatcggagtgctagagcagggcaagcgcacgctgacaccccagcccaaagagctcaagtactcctggaaaacttgggggaaggccaagatcgtcaccgctgagacgcaaaattcatccttcatcatcgacggccctaacaccccagagtgcccctctgtgtcccgggcctggaacgtctgggaggtcgaggattacgggttcggcgtgttcaccaccaacatctggctgaagctgcgcgaggtgtacacccagctttgcgaccatagacttatgtcagcggccgtcaaggacgaacgcgccgtgcacgccgacatgggatactggatcgagagccagaaaaacgggtcctggaaactggagaaggccagcctgatcgaggtgaagacgtgcacctggccaaaatcccacaccttgtggagcaacggcgtcctcgagtccgatatgatcatccctaagagcctggccggccccatctcccagcacaaccacaggcccggctatcacacccagacggccgggccctggcacctcggaaagttagagctcgacttcaactattgtgaaggcaccaccgttgtaatcactgagaactgtggtacgcgcgggccttctctgcggaccaccaccgtgtccgggaaactgatacatgagtggtgctgtcgcagctgcacgttgccgccgctccggtacatgggggaggatgggtgctggtacggcatggagatcagacccatctccgagaaggaggagaacatggttaagtcgctggtgtccgccggctccgggaaagtcgacaacttcaccatgggtgtactgtgtttagctatcctgttcgaggaggtgatgcgggggaagttcggcaaaaagcatatgatagccggggtcttcttcacattcgtactgcttttgtccggccagatcacttggagggacatggcgcacacgctgatcatgatcggctcaaacgccagtgacaggatggggatgggtgtgacctatcttgcactgattgccacctttaaaatccagccgttcttagccctcgggttcttcctgcgcaaactcaccagccgtgaaaacctcctgctgggcgttggactcgcgatggctactacattgcagttacccgaggacatcgagcagatggctaatggcatcgccctcggcctcatggccttgaaactgatcacgcagttcgagacctaccagctgtggacggccctgatcagcctgacctgctccaacacgtacttcacattaacggtggcctggcgaacagccaccctgatactcgccggggtcagcctgctgccggtgtgccagtccagctccatgcggaagaccgactggcttcccatggcggtggccgccatgggcgtgccgccacttccgcttttcatcttcagcttaaaggacacgctgaagcgacgctcctggccactgaacgagggggtgatggccgtgggcctcgtgagcatcctagcctcaagcttattgcggaacgacgtcccaatggcgggccccttagtcgcgggcggcctgctcattgcgtgctacgtcatcacggggacctccgccgatctgaccgtggagaaggccgcggacatcacgtgggaggaggaggcggagcagacgggagtgagccacaacttaatgatcaccgtcgatgacgacgggactatgcgaatcaaggacgacgaaaccgagaacatacttacggtgcttctgaagaccgccctcctaatcgttagcggcatcttcccgtacagcatcccggccactctgctcgtctggcacacctggcagaagcagacgcagcggtcaggcgttctgtgggacgtgcccagccctccggagacccagaaagccgagctggaggagggggtataccgcatcaagcagcagggcatcttcgggaagactcaggtgggagtgggggtccagaaggagggcgtgttccacaccatgtggcacgtgacgcggggcgcggtactgacctacaacgggaagagacttgaacccaactgggcgtccgtaaagaaggacttgatcagctacggagggggctggcggctctccgcacaatggcagaagggggaagaggtgcaggtaatcgccgtggagcccggaaagaaccccaagaacttccaaaccatgcccggcaccttccagacgaccaccggggagatcggtgcgattgccctagacttcaagcccgggacctcaggcagccctatcataaaccgcgagggcaaggtggtcgggctatacggcaacggggttgtgacgaagaacggcgggtacgtctccggcatagcccagaccaacgcggagccagacggccccacccccgaactcgaggaggagatgttcaagaagagaaatctcaccatcatggacctgcaccccgggagcggcaagacgcgcaagtaccttccggccatcgtgcgggaggcaatcaagcgacgtcttcgcaccctgatcctggccccaacccgggttgtggcagccgagatggaggaggccctcaaaggattgcccatccgatatcagaccacggcgaccaagtccgaacacacaggccgggagatcgttgacctaatgtgccatgccaccttcaccatgcgcctcctgagccccgtgcgggtgcctaattacaacctgatcatcatggacgaggcccattttaccgaccccgcctccatcgccgctcgtgggtacatcagcacccgggtggggatgggcgaggccgccgccatcttcatgaccgcgacgccgccggggaccgccgatgcattcccgcagtccaacgctccgatccaggacgaggagcgcgacatccccgagcgcagctggaactccggcaacgagtggatcacagactttgcgggtaagacagtgtggttcgtccccagcataaaggcggggaacgacatcgccaactgtctccggaagaatgggaagaaggtgatacagctgtcccgcaagacattcgacacggagtaccaaaagaccaagctgaatgactgggacttcgtcgtcaccacggacatatcagaaatgggcgccaactttaaggccgaccgggtgattgacccgaggcggtgcctcaagcccgtaatcctgaccgacggcccggagcgcgtcatcctggccgggcccatgcctgtgactgcagccagtgcagcccagcggcgcgggcgtgtgggacgcaacccccaaaaggagaacgatcaatacatcttcaccggccagcccctcaacaacgacgaggaccacgcccattggaccgaggctaagatgctgctggacaacatcaacacgccagaggggatcatcccggccctcttcgagcccgagcgagaaaagtccgctgccatcgacggtgagtaccgcctgaagggcgagtccaggaagaccttcgtcgagctaatgcgtcgcggggacttacccgtgtggctcgcgcacaaggtcgccagcgaaggcatcaaatacacagaccgcaaatggtgtttcgatgggcagcggaacaaccaaatcctcgaggaaaatatggacgtggagatttggaccaaggaaggcgagaagaagaaactccgcccccggtggcttgacgcccgcacgtacagcgatccgctggccctgaaggagttcaaggagttcgccgcgggccgcaagagcattgcactggacctggtcactgagattgggcgcgtcccctcccacttggctcaccgcacccgcaacgccctggacaacctggtgatgctccacacctccgagcacggaggacgggcgtaccggcacgcggtggaggaactacctgaaacgatggaaaccctcctcttgctgggcctcatgattctgctgaccggtggcgcaatgctctttttaattagcggaaaggggatagggaagacctccatcgggctgatttgcgtcatcgcctcgtcaggcatgctctggatggccgaaatcccgctacagtggatcgccagcgcgattgtgctggagttcttcatgatggttctcttaatccccgagcccgagaagcagcgcacgccccaggacaaccagctggcgtatgttgtaatcggaatactcacactggccgccatcatcgccgcgaacgagatgggcttgctcgagaccaccaaacgggacctgggcatgtccaaagagcccggggtggtatcccccacgtcatatctggacgtggacctccaccccgccagcgcttggaccctgtacgccgtggccacgaccgttattacgcccatgctacgccacaccatagagaattccacggcgaacgtgtcgctcgctgcgatcgcaaaccaggcagtggtcctgatgggcctggacaaggggtggccgatctccaagatggatctcggcgtacccctgctggccctcgggtgctacagccaggtgaaccccctgaccctgacggccgccgtactccttttaatcacccactacgccatcatcgggcccggcctccaggcgaaggcgacacgggaggcccagaagcgcaccgctgcggggattatgaagaaccccacggtggacggcattatgactatagacctggaccccgtgatctacgattccaagttcgaaaagcagctcggccaagtcatgctcctggtactttgcgcggtgcagctcctgctgatgcggacctcgtgggccctctgcgaggccctcaccctggctacgggccccataaccaccctttgggaaggctcccccggtaagttttggaataccacgatcgcggtatcaatggccaacatattccgcggctcctacctggcaggagccggtctggcttttagcataatgaagtccgtagggaccggaaagcgtggcaccggtagccagggcgaaaccctaggggagaaatggaagaagaagctgaaccaattgagcaggaaggacttcgacctctacaagaagtccggaattaccgaagtggataggacggaggcgaaggaaggactgaagcgcggcgagatcacccatcacgctgtcagtcggggctccgccaagctccagtggttcgtggagcgcaacatggtgataccggaaggacgggtaatagacctcggctgcgggcggggcgggtggagctactattgtgccggcctgaagaaggtgactgaggtacggggctacaccaaaggcggccccgggcatgaagagcccgtccccatgtccacgtacggatggaacatcgtgaagctgatgagcgggaaagatgttttctacctcccgcccgaaaagtgcgacaccctgctgtgtgacattggcgagtccagcccctcgcccaccgtcgaagagtctcgcacaatccgagtgctaaaaatggtggagccgtggctgaagaacaatcagttttgcatcaaagtcctgaacccttacatgcccacggtgatcgaacacctggagcggctgcagcgcaagcatggcggcatgctggtgagaaaccccctttcccgcaacagtacccacgagatgtactggatttccaatgggacagggaacatagtcgccagcgtgaacatggtgtccaggcttttgctgaacagattcacgatgacgcatcggcgccctaccattgagaaggacgtcgaccttggggccggcacccggcacgtgaacgccgaacccgagacccccaacatggacgtgatcggcgagcgcatcaagcgtattaaggaggagcataactcgacgtggcactacgacgacgagaacccatacaaaacttgggcttatcatggctcctacgaggtcaaggccacagggagcgcttccagcatgataaatggggtggtcaagctgctgaccaagccttgggacgtcgtgcccatggtcacgcagatggcgatgaccgacaccacccccttcggacagcaacgcgttttcaaggagaaggtggacacgcgcactccgcggtccatgcctggcacccggagagtcatggggattaccgccgagtggctctggcggacgctagggcgaaacaagaagccccgcctgtgcacccgcgaggagttcaccaaaaaggtgcgcaccaacgccgccatgggcgcggtgttcacggaggagaaccagtgggactccgcgaaggccgccgtcgaggacgaggatttctggaagctcgtggatcgtgagagagagctgcacaagctgggaaagtgcgggtcatgtgtatacaacatgatgggtaagcgggaaaagaagttgggcgagttcggaaaggccaagggatccagggcgatctggtacatgtggttgggcgcacggtacctggagttcgaggctctcggtttcctgaacgaggaccactggttttcgcgcgagaatagctacagcggcgtcgaaggggaaggattgcacaagctgggctacatcctgcgggacataagtaagatccccgggggcgccatgtacgccgatgacaccgcggggtgggacaccagaatcaccgaggacgacctgcacaacgaggagaagatcacgcagcaaatggacccggagcaccggcagctcgcgaacgcgattttcaagttaacataccagaacaaggtggtgaaggtccagcgccccacgccaaccggcacagtgatggacataatatcacggaaggaccagcgcggttcaggccaggtggggacctatgggctaaacaccttcaccaacatggaggctcaactcatccggcagatggagggcgagggggtcctgagcaaggccgacttagagaacccccatctgccggaaaagaagatcacccaatggctggagacgaagggagtggagcgactgaagcggatggcgatctccggcgacgactgcgtggtaaaacctatcgatgaccgattcgccaacgcactgctggcgctgaacgacatggggaaagtgcggaaggacatcccccagtggcagcccagcaagggctggcacgactggcaacaggttccgttctgcagccatcacttccacgagctcattatgaaggacggtcgcaagctggttgtgccctgccggccccaagacgaactgataggacgcgcgcggatctctcagggggcggggtggtccctcaaagagaccgcctgcctgggcaaagcctacgcccagatgtggagcctgatgtacttccaccgccgcgacctccggctagcctcaaacgctatctgtagcgccgtgcccgtccattgggtcccgacctcccgcaccacgtggagcatccacgcgcatcaccagtggatgaccaccgaggacatgttgaccgtgtggaatcgggtctggattgaggacaatccctggatggaggacaagacgcccgtgacaacttgggagaacgtgccctacctcggtaagcgagaggaccagtggtgcggctcactgatcgggctgacatcccgggccacgtgggctcaaaacataccgaccgccatccagcaggtccgctcactcattggcaacgaggagtttctggactacatgccctccatgaagcggttccgcaaggaggaggagagcgaaggggccatctggtga

SEQ ID NO: 25824 - RNA, 9873 nt, synthetic construct
  misc_feature 1..9873: note = derived and/or modified CDS sequence (opt11) from DENV-3__HM181977__SS-prME
  source 1..9873: mol_type = other RNA
actagcctctgtttaatgatgatcctgcccgccgccctggcgttccacctcacgagccgggacggtgagccccggatgatcgtggggaaaaatgagcgcggcaaaagcttactgtttaagaccgcgtcaggaattaacatgtgcaccctcatcgctatggacctcggtgagatgtgtgacgacaccgtgacctataagtgcccccatatcaccgaggtggagcccgaagacatcgactgctggtgcaatctaaccagcacctgggtgacctatggcacgtgtaaccaggccggcgagcaccggcgcgacaagcggtcagtggccctcgcgcctcatgtgggcatggggctggatacccgcacccagacgtggatgagcgcagagggcgcttggcggcaggtagagaaggtcgagacgtgggcgctccgccacccgggcttcacaattcttgcgttattcctggcccactacatcggaacatccctgacccaaaaggtggttatctttatactgttaatgttggtcacgcccagcatgaccatgcggtgcgtgggagtcggcaaccgcgacttcgtcgagggtctttctggcgctacctgggtggacgtggtcctggagcatggcgggtgcgtgaccacgatggcgaagaataagccgaccctcgacatcgaactgcagaaaaccgaggccacccaactggcgaccctacggaagctgtgcattgaggggaagatcaccaacataaccaccgacagccgctgtcccacgcagggcgaagccaccctgccggaggaacaggaccagaattacgtgtgcaagcacacctacgtcgatcgcgggtggggcaacgggtgcgggttattcgggaagggctccctggtgacatgtgccaagttccagtgcttagagcccatagaaggaaaggtggtacaatacgagaacctcaagtacaccgtgatcatcaccgttcacaccggggatcagcaccaggtcggcaacgaaacccaaggtgtgacggccgaaatcacgccacaggccagcaccaccgaggctatcctgcccgagtatggcaccctggggttggagtgctccccgcgcacggggctggactttaatgagatgatcctgctcacaatgaagaataaggcctggatggtacatcggcagtggttcttcgacctgccgctgccctggacctctggggccaccacggagactcccacctggaatagaaaggagctcctggtaacctttaagaacgcccacgcgaagaagcaggaagtggttgtgttaggctcccaggagggtgcgatgcacacggcgctcaccggggctaccgagatccagaatagcggagggacctccattttcgccggccacttaaagtgccggctaaagatggacaagttggagctaaaaggcatgagctacgccatgtgcacgaacacgttcgtacttaaaaaggaggtatccgagacccagcacgggaccattttgatcaaggtggagtacaagggcgaggacgtaccgtgcaagatacccttctcgacggaggatgggcagggtaaggcgcacaacggaaggcttatcaccgccaatcccgtcgtcacaaagaaggaagaaccggtgaacatcgaggcggagccgccgttcggtgagagcaacattgtcattggcatcggggacaacgccctgaagatcaactggtacaagaagggttcctcaattgggaagatgttcgaggccactgcacggggcgcgcgccgtatggccatcttaggcgacacggcctgggacttcgggtccgtgggcggggtacttaactcgctgggcaaaatggtccaccagatcttcgggtccgcgtataccgccctgttcagcggagtgagttgggtgatgaagatcggcatcggggtcctccttacctggatcggcctgaacagcaagaacacttccatgagcttctcctgcatcgccatcggtatcatcacgctctacctcggcgcagtggtgcaggcggacatggggtgcgtcgtgaattggaagggcaaggagctgaagtgcggtagcgggatcttcgtcaccaacgaagtccatacctggaccgagcaatataagttccaggcggactctccgaagcgtctcgccacggccattgccggcgcctgggagaacggggtgtgcggtatccgcagcaccacccggatggagaatctgctttggaagcaaatcgcgaacgagctcaactatatcctgtgggagaacaacataaagctgacggtggttgtgggggacatcatcggcgtcctagaacagggcaagcgcacactgacgccacagccgaaggagctgaagtactcctggaagacttggggcaaggccaagatcgtcaccgcggaaacgcagaacagctccttcatcatcgacggccccaacacccccgaatgcccctctgtgtcccgcgcctggaacgtgtgggaagtcgaggactacgggttcggcgtgttcacaaccaatatatggctcaagctgcgtgaggtgtacacgcagctgtgtgatcaccggctcatgagcgcagctgtcaaggacgagcgcgcagtgcacgccgacatgggttactggatagagtctcagaaaaatggttcctggaagctggagaaggccagcctgatcgaggtaaagacatgcacatggccgaagtcccataccctctggagcaacggagtcctggagtccgacatgatcattcctaagagcctggcggggcccatctcccagcacaaccaccggcccggctaccacacccagacggcagggccttggcacctcggtaagctggagttagacttcaattattgcgagggcaccaccgtagtgatcaccgagaactgtgggacgcgcggcccctcgctccgaactaccaccgtgtccgggaagctgattcacgagtggtgctgccgctcctgcacgctgcccccgctccggtacatgggggaagacgggtgctggtacggcatggagatccgccccatcagtgagaaggaggagaacatggtcaagagcctggtttccgcaggcagcgggaaagtcgacaacttcactatgggcgtgctgtgcctcgccatccttttcgaggaggtgatgagggggaagttcggcaagaagcacatgattgcaggagtcttcttcaccttcgtgctactgttgtccggccagattacctggcgcgacatggcacacaccctgatcatgatcggcagcaacgcctccgaccggatgggtatgggggtaacctacctcgccctgattgccaccttcaagatccagccttttctggccctcgggttcttcctgcgcaagctgacctctcgcgagaacctcctactgggggtcggcctcgcgatggccacgaccctgcagctccccgaagacatcgagcagatggccaatgggatcgccctcgggctgatggcgttgaagttgatcacacaattcgaaacctaccagctgtggacggctctgatcagcctgacctgctccaacaccatcttcacactgacggtggcctggcgaaccgccaccctcatattagccggggtctctttgctgccggtgtgccaatcgagctctatgcgtaagaccgattggctcccgatggctgtggccgccatgggcgtgccgcccctccctttgttcatcttttcactcaaggacaccctgaagcgccgctcctggcccctcaacgagggggtgatggccgtgggcctcgtctccatccttgcatccagcctgctccgaaacgatgtgcccatggcgggccccctggtggccgggggcctgctcatcgcctgctacgtcatcaccgggacgtccgcggacttaaccgtggaaaaagccgcggacataacgtgggaggaggaagcagagcagaccggcgtgagccacaacctgatgatcaccgtagacgatgacgggaccatgcgtatcaaggatgacgagaccgagaatatcctcacggtgctgctaaagacagccctcctgatcgtatccggcatattcccatacagcatccccgccaccctgctcgtctggcacacctggcagaagcagacacagcggtctggggtactttgggacgttccctcgccgcccgagacccagaaggccgagctcgaggagggggtctaccgcataaaacaacaaggaatcttcggaaagacccaggtgggcgtgggtgtccaaaaggagggcgtcttccacaccatgtggcacgtaacgaggggcgcggtcctcacctacaacgggaagcgacttgagcccaactgggcgtccgtgaagaaggatttaataagctacggcggaggctggcggctctcggcccagtggcaaaagggggaggaggtacaggttatcgcggtagagcccggcaaaaatcccaagaacttccaaaccatgcccggcactttccagacgaccaccggggagatcggagcgatcgccttggacttcaagcccgggaccagcgggagccccataatcaaccgcgagggtaaggtggtcgggctgtacggaaatggggtcgtgacgaagaacggcggttacgtttccggaatcgcccagaccaacgcagaaccggatggtcccacacccgagctggaggaggagatgttcaagaagcggaacctcacaataatggacctgcaccccgggagcggcaagacgcgcaagtacctgcccgccattgtgcgggaagcaattaagcgccggctccgcaccctgatcctggcccctacccgcgtggtcgctgccgaaatggaggaagccctgaaggggctgccgatccgctaccagaccacggccaccaagagcgagcacacgggccgggagatagtcgatctgatgtgccacgccacattcacgatgcgtttattaagtcctgtgcgagtccctaactataatctgatcatcatggacgaggctcacttcaccgaccccgcctccatcgccgcgcgcgggtacatcagcacacgtgtgggcatgggagaggccgcggcaatcttcatgaccgcgactccgcccgggacagccgacgccttcccgcagagcaacgccccgatccaagacgaggaacgcgacatccccgagcgcagctggaactctggcaatgaatggatcacggacttcgcagggaagaccgtgtggttcgtccccagcatcaaggcgggcaacgacatagccaactgcctacggaagaacgggaagaaggtgatccagctttcccgcaagacgtttgatacggagtaccagaagactaagctgaatgactgggacttcgtggtcaccactgacatttccgagatgggagcaaatttcaaggccgacagagtgatcgacccgcgacggtgcctaaagccggtgatcttgaccgacggccccgagcgcgtgatactggcaggacccatgccagtgaccgcggcctccgccgcacagcggcgaggtcgagtgggtaggaacccccagaaggagaatgaccagtacatcttcacaggccagccccttaacaacgatgaagaccacgcccactggactgaggcgaagatgctacttgacaacataaacacgcccgaggggatcatcccggcactcttcgagcccgagagagagaagtccgcggcgatcgacggcgagtaccgcctgaaaggcgagtcacggaagactttcgtcgagcttatgagacgcggtgacctcccggtatggctggctcacaaggtcgccagcgagggtatcaagtacaccgaccgcaagtggtgttttgacgggcaacggaacaaccagatcctggaggagaacatggacgtggaaatctggacaaaagaaggcgagaaaaagaagctccgtccccggtggctggacgcccgcacgtactccgaccctctggccctgaaggaatttaaggagttcgccgcaggccgcaagagcatcgccctggacctggtgaccgagatcgggcgggtcccctcccacttagcccaccgaacccgaaatgccctggacaacttggtcatgctccacacgagcgagcacggcgggcgcgcctacagacacgcggtagaggagctgccggagacgatggagaccctgctcttgctgggcctcatgattctgctgacggggggtgccatgctgtttctgatcagcggcaagggcattggcaagacttccatcgggctgatctgcgtcatcgcgtcatccggtatgctctggatggcagagatcccgctgcagtggatcgctagcgcgatagtgctggaattcttcatgatggtactcctgatcccagagccggaaaagcaacgcacgccccaggacaaccagttggcatacgtcgtgatcgggatcttaaccctggctgcaatcatcgccgccaacgagatgggcctgttggagactaccaagcgggatctgggcatgtccaaggagccgggggtggtctcgcccacgtcctatctggacgttgacttacaccctgccagcgcttggacgttgtatgccgtggccaccactgttatcacgcccatgttacgccacaccatcgaaaactccacggccaatgtaagcctggccgccattgcaaaccaggctgtggtcctgatgggactggacaagggctggcccatctccaagatggacctaggcgtgcccctgctggcgcttggttgctacagccaggtgaaccctctgactctgacggccgccgtcctcctgctgattacccactacgccatcatcggccctggcctccaagctaaggccacacgggaggctcagaagcgaacggcggccggcattatgaaaaatcctacagtagacggcatcatgaccatcgacctggacccggtaatctacgactccaaattcgagaagcagctggggcaagtgatgctactggtgctgtgcgcagtccaactcctgctgatgcgcaccagctgggccttatgcgaggccctgaccctggcaacgggtcccataaccaccctctgggaaggctccccggggaaattctggaacaccacgatcgcggtcagcatggctaacatctttcgcggctcctacttagcgggggccggcctggcatttagcatcatgaagtcagtggggaccggaaagcggggcaccgggagccagggcgagaccctcggggagaagtggaagaagaagctgaaccagctctcgcgtaaggacttcgatctctacaagaagtccggcatcaccgaggtggaccggacagaggcgaaggaggggctgaagcgcggggagataacccaccacgctgtatcacggggctcggccaaattacaatggttcgtggagcgcaacatggtgatcccggagggcagggtaatagacctcggctgcgggcgcggcggttggagctactactgcgcaggcctcaagaaagtgactgaggtgcggggatacaccaagggcgggccgggacacgaggaacccgtgccgatgagtacctatggctggaatatcgtgaagctgatgagtggtaaagacgtgttctacctcccgcctgaaaagtgcgataccctgctgtgcgacataggcgagtcctcgccgtcccctaccgtcgaagagagccgcaccatccgcgtgttaaagatggtggagccatggctcaagaacaatcaattctgcatcaaggtcctcaacccctacatgcccacggtgattgaacatctggaacggcttcagcggaagcacggcgggatgctcgtgagaaaccccctgtcccgcaactcgacccacgagatgtactggatctccaacggcacggggaacattgttgccagcgttaatatggtgtcccggctcctgctgaatcgcttcacgatgacgcatcggcgacctaccatagagaaggatgtcgacctcggcgccggcactcggcacgttaacgccgaacccgagacccccaacatggacgtgatcggggaacgtatcaagcggatcaaggaagagcacaacagcacgtggcactacgacgacgagaatccgtacaaaacctgggcatatcacggctcctacgaagtcaaggccaccgggtctgcctcctccatgatcaacggtgtggtcaagctgctcaccaagccctgggacgtggtgcccatggtaacgcagatggcgatgacggatactacaccattcgggcagcagcgcgtgttcaaagaaaaggtggacacacgtaccccgcgcagcatgccaggcacccgacgtgtcatgggcatcaccgccgagtggctctggcggacgctggggcgcaacaaaaaaccccggctttgcacccgcgaggagtttaccaagaaggtgcgaaccaacgccgccatgggcgcggtgttcacagaggagaaccagtgggactcagccaaggccgcagtggaggacgaggacttctggaagctcgtggaccgcgagcgggaactgcacaagctggggaaatgtggcagctgtgtgtacaacatgatgggtaagcgggagaagaagctcggggagttcggcaaagccaagggctctcgcgctatctggtacatgtggctgggcgcccggtacctggagttcgaagctctcgggttcctgaacgaggaccactggttcagccgggagaactcctactcgggagtcgagggggagggcctgcacaagttgggctacatcctgcgggacatttcgaagatccctgggggtgcaatgtacgctgacgacacggcggggtgggacacccgcatcactgaggacgacctccacaacgaagagaaaatcacgcagcaaatggacccggagcaccggcagctcgccaacgccatctttaagttaacctaccagaacaaggtcgtaaaggtccagagaccgacccctaccggcaccgttatggacatcattagccggaaggaccagcgcggctccggccaggtaggcacgtacggtctgaatacctttacaaacatggaggcccagctcatccggcagatggagggcgagggagtcttgagcaaggctgatttagaaaatccacatcttccggagaagaagatcacacagtggcttgagacgaagggcgtggaacgcctgaagcggatggcgatctccggtgacgactgtgttgtcaaacccatcgacgaccgcttcgccaacgccctgcttgccctaaacgacatggggaaggtccggaaggacattccccaatggcaacccagcaagggctggcacgactggcagcaggtcccgttctgctcccaccacttccacgaactcatcatgaaagacggtcgcaagctggtcgtgccctgcaggccgcaggacgaactgatcggccgggcacggatcagtcagggggcgggctggtccctcaaggagaccgcctgcctaggcaaggcctacgcgcagatgtggagcctgatgtacttccaccgtcgggacctcaggctggcgtccaacgccatatgcagcgccgtgcccgtccactgggtgccgacctcccgcacaacgtggagcatccatgctcatcatcagtggatgaccaccgaggacatgctaacggtgtggaacagagtgtggatcgaggataacccctggatggaggacaaaacacccgtaaccacgtgggaaaacgtaccctacctcgggaaacgcgaagatcaatggtgtggatccctgatcggactaacctcccgggcaacgtgggcgcagaatatcccgaccgccatccagcaagtgcgcagcttaatcggtaatgaagagttcctggactacatgccctctatgaagcggttccgcaaagaggaggagagcgagggggccatctggtga

SEQ ID NO: 25825 - RNA, 9873 nt, synthetic construct
  misc_feature 1..9873: note = derived and/or modified CDS sequence (opt11) from DENV-3__HM181978__SS-prME
  source 1..9873: mol_type = other RNA
acgagcctctgtcttatgatgatcctccctgccgccctggcgttccatctcaccagccgggacggggaacccagaatgatagtggggaagaacgaacggggaaagtcactgctgttcaagacggcatccgggatcaacatgtgtacgttgatagctatggacctcggcgagatgtgcgacgacactgtgacctataagtgcccacacatcaccgaggtggagcctgaggatatcgactgctggtgcaacctgaccagcacctgggtgacctacgggacgtgcaaccaggctggcgagcaccggcgagacaagcgatcggtggccctcgcgccccacgtgggcatggggcttgacacccgcacccagacttggatgagcgccgagggtgcctggcgccaggtggaaaaggtggaaacgtgggcactgcgccacccggggttcactatcctcgcgctctttctcgcccactacatcggcacctccctcacgcagaaggttgtgatcttcatcctgcttatgctagtgacacccagcatgaccatgcggtgcgtgggggtgggcaaccgcgacttcgtcgagggcctgtccggggccacctgggtcgatgtggtcctggagcatggcgggtgcgtgaccacgatggccaagaacaagccaacactcgacattgagctgcagaagactgaggccacccagctagcgacgttgcgaaagctgtgcatcgaggggaaaattaccaacatcaccaccgacagccgctgccccacgcagggcgaggccaccctgccggaggagcaggaccagaactacgtgtgcaagcacacctacgtcgaccgcggctggggcaacgggtgcggcctctttgggaaggggtccctggtgacctgcgccaagttccagtgcctggagcccatcgagggcaaagtggtacagtacgagaatctgaagtacacggtgatcatcaccgtgcacaccggggatcagcaccaggttggcaatgagacccagggagtcacggccgagatcacgccccaggccagcaccaccgaggcgatcctccccgagtacggcaccctgggtctcgagtgctccccacgcacgggccttgacttcaatgagatgatcctcctcacaatgaagaacaaggcgtggatggtccaccggcagtggtttttcgatctgcccctgccctggaccagcggcgcgactactgagacacccacgtggaaccgcaaagagctgttagtgaccttcaagaacgcccatgccaagaagcaggaggtggtcgtgctggggtcccaggagggcgcgatgcacactgccctgaccggggccaccgagatccagaacagcggcgggacatccatcttcgccggccatctgaagtgcagactgaagatggacaagctcgagttgaagggaatgagctatgctatgtgcacgaatacgttcgtgctgaaaaaggaggtctccgagactcaacatggcacaatactcatcaaggtggagtacaagggcgaggacgtgccgtgcaagatccccttcagcacggaggacggccagggtaaggcgcacaatggccggctgattaccgctaaccccgtggtgacgaaaaaggaggagcccgtcaacattgaggccgagccacccttcggcgagagcaacatcgttatcggcataggggataacgctctgaagataaactggtacaaaaagggctccagcatcggaaagatgtttgaggcgacggccagaggcgcgcgcaggatggccatcttgggcgacacggcctgggacttcgggtccgtgggtggggttcttaacagcctgggaaagatggtccaccagattttcgggtccgcgtacaccgctctgttcagcggagtctcctgggtgatgaagatagggatcggggtcctccttacgtggattggcctgaacagcaagaacacctccatgtctttctcctgtatcgccatcgggatcattacactctatttaggcgccgttgtgcaggccgacatggggtgcgtcatcaactggaagggcaaggagctgaagtgcggcagcgggatcttcgtgaccaacgaggtgcatacgtggaccgagcaatacaagttccaggcggattcccccaagaggttagccacggccatcgccggcgcatgggagaacggggtctgcggcattcggagcaccacccggatggagaacctgttgtggaagcagatcgcgaacgaactgaactacatcctatgggagaacaatatcaagctgaccgtcgtggtcggcgacatcatcggcgtgctcgagcaggggaagcgaacccttacgccccagcccatggagctgaagtactcttggaagacctgggggaaggccaagatcgtgaccgccgagacgcaaaactcatcattcatcatcgacggcccgaatacccctgagtgtcccagcgtctcccgggcctggaacgtttgggaggtggaggactacgggttcggcgtattcaccaccaacatctggctcaagctgagggaggtttacacccagctgtgcgaccatcggctcatgagcgcggccgtgaaggacgagcgcgccgtccacgcagatatggggtactggatcgagagccagaagaacgggtcgtggaagctcgagaaggccagcctaatcgaggtgaagacgtgcacctggccgaagtcccacaccctctggagcaatggcgtgcttgagtccgacatgatcatccccaagagcctagcggggcccatctcacaacacaatcaccggccggggtaccatacccagacggcagggccatggcacctcggcaagctggagctggacttcaactattgcgagggcaccaccgtcgtgatcaccgagaactgcgggacgcgcggcccctccctccggaccaccaccgtgtccggtaagctgatccatgagtggtgttgccgcagctgcaccctgcccccgctccggtatatgggagaggacgggtgctggtacggcatggagatccgccccatcagcgagaaggaggagaacatggtaaagagcctggtgagcgcgggcagcgggaaggtagacaacttcaccatgggcgtgctgtgcctcgccatcctgttcgaggaggtgatgcgcgggaagttcggcaagaagcacatgatcgcaggggtgtttttcaccttcgtcctgctcctgtccggccagatcacctggagagacatggcgcacacgctcatcatgattgggagcagtgcctctgaccggatgggtatgggcgtgacttacctcgccctgatcgccactttcaagatccaacccttcctggccctcgggtttttcctgcgcaagctgaccagccgggagaacctcttgctgggggtgggcctcgccatggccacgaccctgcagctgcccgaggacatcgagcagatggccaacgggatcgcgctcggcctgatggcgctgaagctcatcacccaattcgagacctaccagctgtggacggcgttgatctccctgacctgttccaacaccatcttcaccctgacggtcgcatggagaaccgccaccctgatcctcgccggggtgtccctgctgccggtctgccagagctccagtatgcggaaaacggactggctcccgatggcggtggccgccatgggcgtgccgccgttgccactcttcattttcgggctcaaggatacactgaagcgccgctcctggccactcaatgagggggtcatggcagtgggcctcgtgagcatcctggcctccagcctgctccggaacgacgtccccatggcggggcccctggtagctggcgggctgttgatcgcctgttacgtgattacaggcacctccgccgacctcaccgttgagaaagccgcggacattacgtgggaggaggaggccgaacagaccggggtgagccacaacctgatgatcaccgtggacgacgacggcaccatgcggatcaaggacgacgagaccgagaacatccttaccgtccttctaaagacagccctcctgatcgtgtccggcatcttcccgtacagcatccccgccacactgctcgtatggcatacctggcagaagcagactcagcggagtggggtgctgtgggacgtgcccagtcccccggagacccagaaagcagaactggaggagggggtgtaccgcatcaagcagcagggtatatttggcaagacgcaagtcggggtgggcgtgcagaaggagggcgtctttcacaccatgtggcacgtgacgcgcggagcggtgctcacctacaacggcaaaagactggagcccaactgggccagcgtcaagaaggacttgatctcgtacgggggcgggtggagactcagtgcccagtggcagaagggcgaggaggtccaggtgatagcagttgagccaggcaagaaccccaagaactttcagaccatgcccgggacgttccagacgaccaccggcgagatcggtgctatcgcactggactttaagcccggaaccagcggcagccccatcataaaccgcgaggggaaggtggttgggctgtatgggaatggcgtcgtgacgaagaacgggggctacgtctcaggcatcgcgcagaccaacgctgagccggacgggcctacccccgagctggaggaggaaatgttcaaaaagcggaacctcaccatcatggacctgcacccaggcagcgggaagacgcgcaagtacctgccggcaatcgtccgggaagctatcaaacgccgtctacgcaccctgatcctggcccccacccgggtggtggctgccgagatggaggaagccctcaagggcctgccgatccgctatcagaccacggcgaccaaatccgagcataccgggcgtgagatcgtcgatctgatgtgccatgccactttcacgatgagactcctgtcccccgtgcgggtgccaaactacaacttaatcattatggatgaagctcacttcacagacccggcctccatcgccgcccgcggctacattagcacccgagtgggcatgggggaggccgccgccatcttcatgaccgcgacgccgcccggaaccgccgacgccttcccacagtccaacgcccccatccaggacgaggaacgcgatattcccgagcgcagctggaactccgggaacgagtggataacggacttcgccggcaagaccgtgtggtttgtgcccagcatcaaggcggggaacgacatcgccaattgcctacgtaagaacggcaagaaggtcatccagctttcccgtaagacgttcgacactgagtatcagaaaaccaagctgaatgactgggatttcgtggtgaccacggacatctcggagatgggcgccaacttcaaagccgaccgggtcatcgacccgcgccggtgcctcaagcccgttattctgaccgacggtcccgaacgcgtgatcctggccggccccatgcctgtcactgcggcctccgccgcccagcggcgcgggcgggtgggccgcaacccccaaaaggagaacgaccagtacatcttcaccgggcaaccactcaacaatgacgaggaccacgcccactggaccgaagcgaagatgctgctcgacaacatcaacacgcccgagggcattattccggctttatttgagcccgagcgagagaaaagcgccgccatcgacggcgagtaccgcctgaagggggagtctaggaagaccttcgtggagctgatgcgccggggcgacctccccgtctggctggcgcacaaggtggccagcgaagggatcaagtacaccgaccgcaagtggtgcttcgatggacaacggaacaaccagatactggaggagaacatggacgttgagatctggaccaaggagggcgagaagaagaagctccgcccccggtggctggatgccagaacgtactccgacccgctagccctcaaagagttcaaggagttcgccgcggggcggaagtcaatcgcgctggacctggtgaccgaaatcggcagggtgccctcccacctcgcccaccgcacccggaacgccctggacaacctggtcatgctccacacctcggagcacggcggccgggcctatcggcacgcggtggaggaactgcccgagactatggagaccctgttgctgctggggctcatgatcctgctgaccggcggtgccatgctattccttatcagcgggaagggcattggcaagacctccataggcctgatctgcgtgatcgccagctccgggatgctctggatggccgagatcccgctacagtggatcgcgagcgcgatcgtcttggagttcttcatgatggtactcctgatccccgagccagagaagcagcgcacgccccaggacaatcagctggcctacgtggttatcggcattcttacgctggccgcgatcatcgccgcgaacgagatgggcctcctcgagaccaccaagcgggacttggggatgtctaaggagccgggcgtagtcagtcccacgtcctacctagatgtcgacctccaccccgccagcgcctggaccctgtacgctgttgcgaccaccgttatcacgcccatgctgcgccacaccatcgagaactccaccgccaatgtcagcctcgcggccatcgccaaccaggcggtggtgctgatggggctggataaaggctggccgatctccaagatggatctcggggtccccctgctggcgttgggttgttacagccaggtgaaccccctgacattgacggccgccgtgttattactgataacccactatgccattatcggccccggactccaggcgaaagccacaagggaggcgcagaagagaaccgccgccggcatcatgaagaatcccacggtcgacgggatcatgaccatcgacctggaccccgtcatctacgattccaagttcgagaagcagctgggccaagtgatgctcctggtcctgtgcgcggtgcagctcctgctgatgcggacctcgtgggcgctctgcgaggccctgaccctggcgacgggccccattaccaccctgtgggaggggtcccccgggaagttctggaataccacgattgcggtaagcatggccaacatcttccgcggatcctatcttgccggcgccgggctggccttcagtatcatgaagtccgtcggcaccggcaagcgggggaccggctcacagggggagaccctcggcgagaagtggaagaaaaagctgaaccagctaagccgcaaggacttcgacctctacaaaaagagcgggatcaccgaggtcgacaggacggaggcgaaggagggcctgaaaagaggcgaaatcacccaccacgccgtgagccgggggtccgccaagctgcagtggttcgtcgagcgtaacatggtgatccccgagggccgggtgatcgacctcgggtgcggccgcgggggttggagctactactgcgccgggctgaagaaggtgaccgaggtgcgggggtacaccaaaggagggcccggtcacgaggaaccggtgcccatgtctacgtacgggtggaacatcgtcaagttgatgagcggaaaggacgtgttctatcttccgccagagaagtgtgacaccctgctgtgcgacatcggagagtccagcccaagccccacagtggaggagagccgcaccatacgcgtcctgaagatggtggagccgtggctcaagaacaatcaattctgcatcaaggtgctgaacccctacatgcccaccgtaatcgagcatctggagcggctacagcgcaagcatgggggtatgctggtgagaaaccccctgtcccgcaactcgacccatgagatgtactggatatccaacgggactggtaatatagtggcctcagtcaacatggtgtcccggcttctactgaaccgctttaccatgacacaccgtcgcccgacgatcgagaaggatgtggacctcggcgcggggacgcggcacgtcaacgccgagccagagacccccaatatggatgtgattggcgagcgcatcaagcggataaaggaggagcacaacagcacgtggcactacgatgatgagaacccgtacaagacgtgggcctaccacgggagctatgaggtgaaggcaaccggcagcgccagtagcatgatcaacggcgtcgtgaagctgctgaccaagccctgggacgtcgtgccgatggtgacgcaaatggcgatgacggacaccaccccctttggtcaacagcgcgtcttcaaagaaaaggtggacacgcggaccccgcgcagcatgcccgggacccgccgcgtgatggggatcaccgccgagtggttgtggcgaacactggggcgcaacaagaagccccggctctgtaccagagaggagtttacaaagaaggtccgcaccaacgccgcaatgggggcggtgttcaccgaggagaatcagtgggactcggccaaagccgcggtagaggacgaagacttttggaagctcgtagatcgagaacgcgagttacacaagctgggcaaatgcggatcctgcgtatacaacatgatgggcaagcgggagaagaagctcggcgagttcgggaaggccaagggttcccgcgcgatatggtacatgtggctgggggctcgatacctggagttcgaggccctcggctttctgaacgaagaccactggtttagccgcgagaactcctacagtggggtggagggtgagggcctgcacaaactcggctacatcctgcgggacatcagcaaaatcccaggcggtgctatgtacgctgacgacaccgcgggctgggatacaaggatcaccgaagacgacctgcacaacgaggagaagattacgcaacagatggacccggagcaccggcaactcgctaacgccatcttcaagctcacgtaccagaacaaggtcgtgaaggtacagcgccccacccccacaggcactgtcatggacatcatcagccgaaaggatcagcgcgggagcggtcaggtgggcacttacggcctgaacactttcactaacatggaggctcaactcatccggcagatggagggagagggcgtgctgtctaaggccgacctggaaaacccccacctcccggagaagaaaatcacccagtggctggagacgaagggtgtcgagagactgaagcggatggcaatttctggggacgactgtgtggtcaagcccatcgacgaccgcttcgccaacgccctcctggccctgaacgacatgggcaaggtccggaaggacatcccccagtggcagcccagtaagggttggcatgattggcaacaggtcccgttctgctcccatcacttccacgagctaatcatgaaggacgggaggaagctggttgtcccctgccggccacaggacgagctgatcgggcgcgcccggatcagccagggcgccggctggtccttaaaggagaccgcttgcttaggtaaggcctacgcccagatgtggtcgctcatgtacttccacagacgcgacttgcggctcgcttcgaacgctatttgctccgccgtgcccgtgcactgggtcccgacctcccgcaccacctggagcatccacgcccatcaccagtggatgaccaccgaggacatgcttaccgtgtggaacagggtctggatcgaggacaacccctggatggaggacaagactcccgtcacaacctgggaaaacgtcccctacctcgggaagagagaggaccagtggtgcgggtctctcatcggcctgacctctcgggccacgtgggcgcagaacatcccgaccgccatccagcaggtccgcagcctgatcggaaacgaggagttcctggactacatgccctccatgaagcggttccgcaaggaggaggagagcgagggcgcgatctggtag

SEQ ID NO: 25826 - RNA, 9873 nt, synthetic construct
  misc_feature 1..9873: note = derived and/or modified CDS sequence (opt11) from DENV-3__JN183884__SS-prME
  source 1..9873: mol_type = other RNA
accagcctgtgcctcatgatgatcctgcccgcagcactagcgttccacctcaccagccgggacggcgagccccgtatgatcgtggggaagaacgagcgtggcaagtctctgctgttcaagaccgcctccgggatcaacatgtgcaccctcatcgccatggacctgggcgagatgtgcgacgacaccgtgacctacaagtgtccccacatcaccgaagtggagcccgaggacattgattgctggtgtaaccttaccagcacctgggtgacctacgggacgtgcaaccaggcgggcgaacaccggcgcgacaagcggtccgtggccctcgcgccgcatgtgggcatggggctggacacccgcacccagacctggatgagcgccgagggcgcctggcgccaggtggagaaggtggagacttgggcgctgcgccacccgggtttcactatcctcgcgctgttcctggcccactacatcggcacctccctcacccagaaggtcgtgatcttcatattgctgatgctcgtcacacccagcatgaccatgcggtgtgtgggcgtgggcaaccgcgacttcgtcgagggcctcagcggcgccacctgggtagacgttgtcttagaacacggcgggtgcgtgaccacgatggccaagaacaagcccaccttggatatagagctgcagaagaccgaggccacccagctggcgacgctccgcaagttatgcatcgagggcaagattaccaacatcaccaccgacagccgctgccccacgcagggggaggccacgctgccggaagaacaggaccagaactacgtgtgcaagcatacttacgtcgaccgggggtgggggaacgggtgcggcctcttcgggaaggggagcctggtgacatgtgcgaagttccagtgcctggagcccatcgagggcaaggttgtgcagtacgagaacctcaagtacacagtgataatcaccgtgcacacaggggatcagcaccaggtcggcaacgagacccagggggtgacggccgagatcacgcctcaggctagcaccacggaggcgatactgcccgagtacggtaccctggggctcgagtgctccccgcgaacgggcctggacttcaacgagatgatcctcctcaagatgaagaacaaggcttggatggtccacaggcagtggttcttcgatctgccgctgccctggacctctggcgccacgaccgagacgcccacgtggaaccgcaaggaactcctggtgacgttcaagaacgcccacgccaagaagcaggaggtggttgtgctggggtcgcaagaaggcgcgatgcacaccgcactcacgggcgccaccgagatccagaacagcggcgggacctccatcttcgcaggccatctgaagtgccggctgaagatggacaagctcgaattaaagggcatgagctatgccatgtgcaccaacacgttcgtgttaaagaaggaagtctccgaaacccaacacggaaccatcctaataaaggtggaatacaagggtgaggacgttccgtgcaagataccctttagcaccgaggacggtcagggaaaggcgcacaacggccgtctcataaccgccaaccccgtcgtgaccaagaaagaggagcccgtgaacatcgaggccgagccgcccttcggcgagagcaatatcgtcataggcatcggagacaacgccctgaaaataaactggtacaaaaagggctcaagcatagggaaaatgttcgaagccactgcgcggggcgcacgccggatggccattcttggcgacaccgcctgggacttcgggtccgtaggaggggtgctcaacagcctgggcaaaatggtccaccagatcttcgggtccgcgtacacagccctgttcagcggcgtgtcctgggtcatgaagattggcatcggggtcctcttgacctggataggcctgaactctaagaacacctccatgagcttctcctgcatagccatcggaatcatcaccctctaccttggagccgttgtgcaagccgacatggggtgcgtgatcaactggaagggcaaagagctgaagtgtggatcggggatcttcgtgactaacgaggtgcacacctggaccgaacagtataagtttcaggcggactcccccaagcggctcgccaccgctatcgccggcgcgtgggagaacggggtatgcggcatccgcagcacaacccggatggagaacctgctgtggaagcagatcgcgaacgagttgaactacattctgtgggagaacaacataaagctgaccgtggttgtcggggacatcatcggcgtgctcgagcagggcaagcgcaccttgacgccccagccaatggagctgaagtactcctggaagacctggggcaaggccaagatcgtgacagccgagacccagaacagctcctttatcatagacggccccaacacgcccgagtgcccttcggtctcccgggcttggaacgtgtgggaggtggaggactacggtttcggcgtctttactaccaatatctggctaaagctacgcgaggtctacacccagctatgcgaccacaggctcatgagcgcggccgtgaaggacgagcgcgccgtccacgcagacatgggctactggattgagagccagaagaacgggtcctggaaactggagaaggccagcttaattgaggtgaagacctgtacgtggccgaagtcccatacactctggagcaatggcgtcctggagtccgacatgatcatccccaagagcctggcggggcccatctcgcagcacaaccataggccgggttaccacacacagacagcggggccctggcacctcggcaagctggagctggacttcaactattgtgaaggaacgactgtcgtgatcacagagaactgcgggacgcgcggccccagcctccggacgaccaccgtgtccggtaaacttatccatgagtggtgctgcaggagctgcaccctgcctccgttacggtacatgggagaggacgggtgctggtacggcatggagatccgccccatctccgagaaggaagagaacatggtcaagagcctggtctccgccggtagcgggaaggtcgacaactttacgatgggcgtcctgtgcctcgccatcctgtttgaggaagtgatgaggggcaagttcggcaagaagcacatgatcgccggtgtgttcttcaccttcgtcctcctcctgtcgggccagatcacctggcgcgacatggcgcacaccttaatcatgataggaagcaacgcatcagacagaatggggatgggagtgacgtacctcgccctgatcgccacctttaagatccaacccttcttggccctcggctttttcctccgcaagctcaccagccgggagaacctcctgttgggggtgggcctcgcgatggccaccacgctgcagctaccagaggacatcgagcaaatggcaaacgggatcgccttgggcttaatggcgctcaagctcataacacagttcgagacctaccagctgtggaccgccttgatcagcctcacttgctctaataccatcttcaccctcaccgtggcgtggcgtacggcgaccttgatactcgcaggggtgagcctgttgccggtatgccagtccagctccatgcggaagaccgactggctccccatggcggttgctgccatgggcgtcccgccgctgccgctgttcatttttgggttgaaggacaccctgaagcgccggtcatggcctctgaacgagggagtaatggccgtcggactcgtgtccatccttgcctcttccctgctccggaatgacgtccccatggcggggcccctggtggccggcgggctgttaatcgcgtgttacgtgatcacgggcaccagtgccgacttaaccgtagagaaggccgcggatatcacctgggaggaggaggccgaacaaacgggagtctcccacaacttaatgatcaccgtggacgacgatggcaccatgcgcatcaaggacgacgagaccgagaatatcctcactgtactactgaagacggcccttttgatcgttagcggcatattcccgtactctattcccgccaccctgctcgtgtggcatacctggcagaagcagacccagcggagcggggttctatgggacgtccccagcccgcccgagacgcagaaggccgaactggaagagggcgtgtatcgcatcaagcagcaggggatcttcggcaagacccaggtcggggtgggcgtgcagaaggagggcgtcttccacacgatgtggcacgtgaccagaggggcggtgctcacgtacaacggcaagcgcttggagccaaactgggccagcgtcaaaaaggacctgatctcctacgggggcgggtggcggctcagcgcccagtggcagaagggtgaagaggtccaggtgatcgccgtcgaacccggcaaaaatcctaagaacttccagaccatgcccggaacctttcagaccacgaccggcgagatcggagcgatagccctggacttcaagcccgggacctccggcagccccataatcaaccgcgaggggaaggtggtcggcctgtacgggaatggcgtcgtgaccaagaatgggggatacgtgagcggcatcgcccagacgaacgccgagcccgacgggcctacccccgagctggaagaggaaatgttcaaaaagcggaacctcaccattatggacctgcaccccggctccgggaaaacccgtaagtacctgcctgcgatcgtccgggaggcgatcaagcgccgcctccgcacgctgatcctggcccccacccgggtcgtggccgccgagatggaggaggccctcaaaggcctgcccatccgctaccagaccaccgccacgaagtccgagcacaccggacgggagatcgtagacctgatgtgccacgccaccttcaccatgcgcctcctgagtccggtgcgtgtgccgaactacaacctcatcatcatggacgaggcccactttacggaccctgcgagcatcgcagcgcgcggctacatctccactcgggtcggcatgggggaggccgccgccatctttatgaccgcgacgccgcccggaacggccgacgcgttccctcagagcaacgcccccatccaggacgaggagcgcgacatcccggagcgctcctggaacagcgggaacgagtggatcactgacttcgcaggaaagaccgtgtggtttgtgccctccatcaaggcggggaacgacatcgccaactgcctccgaaagaacggcaagaaggtcatccagctgagccgcaagaccttcgatacggagtaccagaagaccaaacttaacgactgggacttcgtggtgaccaccgacatttccgaaatgggggccaacttcaaggcagaccgggtaattgacccgcgccggtgccttaagcccgtgatcttaacggacggtcccgagcgcgtgatcctggccggacccatgcccgtcaccgcggcctcggccgcccaaagacgtgggcgggtgggccgaaaccctcagaaggagaacgatcagtacatattcaccggacagccactcaacaacgacgaggaccacgcacactggaccgaggcgaagatgctactggacaacatcaacacccccgaggggatcatccctgccctattcgagcccgagcgggagaagtcggccgccatcgacggcgaataccgcctgaagggggaaagccggaagacattcgtggagctgatgcgtcggggcgacttgcccgtctggctggcgcacaaggtagcctccgaggggatcaagtataccgaccgcaagtggtgcttcgacggccagcggaacaaccagatccttgaggagaatatggacgtcgagatctggaccaaggaaggcgagaagaagaagctccgcccccggtggttagatgcccgcacctactcagacccgctggcactcaaggagttcaaggagttcgccgcggggcgcaagtccatagccctggacctagtgacggaaatcggccgggtgccctcacacctcgcccacaggacccgtaacgccctggataacctagtcatgctccatacctccgaacacgggggccgcgcctaccggcacgcggtggaggagctgccagaaaccatggagacgctgctcttgctggggctcatgatcctgctgaccggaggcgccatgctgttcctgatcagcggaaagggaatcggtaagaccagcatcggcctgatctgcgtgatcgcctcctcggggatgctctggatggccgagatcccgctgcagtggatcgcctccgcgatcgtcctggagttctttatgatggtgctcctgatccccgaacccgaaaaacagcgaacgccacaagacaatcagctggcttacgtggtcattggcatcctcacgctggccgccatcatcgccgcgaacgagatgggcctgctggagacaaccaagcgggacctggggatgagcaaggagccaggagtggtgtcacccacctcttacctggacgtcgacttgcatcccgcaagcgcatggacgctgtacgccgtggcgaccacagtgatcacccccatgctgcgccacacaatcgagaacagcaccgccaacgtctccctcgccgcaatagccaaccaagcagtggtgctgatggggctggacaagggctggccgatcagcaaaatggacctaggggtccccctcctggccctcggatgctactcccaggtgaaccccctgacgcttaccgccgctgtgcttctgctgatcacgcactacgcgatcatcggccccgggctccaggcgaaggcgacccgggaagcccagaagcgcaccgccgccggcatcatgaagaaccctaccgtggacgggatcatgaccatcgacctggaccccgttatttacgacagcaaattcgaaaagcaactaggccaggtgatgctcctggtcctatgcgcggtacagctcttgctgatgcggacctcctgggcgctttgcgaggccctgaccctggccaccggccccatcacgaccctctgggaggggagccccggcaaattctggaacaccaccatcgcggtgtccatggcgaacatcttccgcgggagctacctggctggcgccgggctggccttctccatcatgaagtccgtcggcacggggaaacgggggactggcagccagggggagaccctcggcgagaagtggaaaaagaagctgaaccagctaagcagaaaggacttcgatctgtacaagaagtccgggatcaccgaggtcgatcggaccgaagcgaaggagggtctgaaacgtggcgagataacgcatcacgccgtaagtagggggagtgccaagctgcagtggttcgtcgagcgaaacatggtgataccggaaggccgtgtgatcgacctcggatgtgggcgcggcggctggtcctactactgcgccggcctgaagaaggttaccgaagtgcgggggtacaccaaaggagggcctggtcacgaggaacccgtacccatgagtacctacgggtggaacatcgtcaagctgatgagtggcaaggacgtgttctacctcccgcccgagaagtgcgacacgctgctctgtgacatcggggagagctcaccctcgcctaccgttgaggagtcccggaccatccgcgtcctgaagatggtggagccgtggctcaaaaacaatcaattttgcatcaaagtgctgaatccatacatgccaacagtcatcgaacacctggagcgcctccaacgtaaacacggtggcatgctggtccggaatcccctgtcgcgcaactccacgcacgagatgtactggatcagcaacggaacgggcaacattgtggcctccgtcaacatggtgtcgcggctcctactgaaccgcttcaccatgacccacagaagacctacaatagagaaggacgttgacctcggcgccgggacacggcatgtaaacgccgagccggagacccccaacatggacgtgataggcgagaggatcaagcggatcaaagaggagcacaactccacctggcactacgatgacgagaacccgtacaagacgtgggcctatcacgggtcatacgaggtgaaggccaccggctcggccagcagtatgatcaacggggtcgtgaaactgctgaccaagccctgggacgtcgtgcccatggtgactcagatggcgatgacggacaccacccccttcggccagcagcgtgtctttaaggagaaggtggacacccggacgccgcgcagcatgccaggcacccggcgagttatggggattacagccgagtggttatggcggaccctgggccgcaataagaaaccccggttgtgcacgcgcgaggaatttaccaagaaggtccgcaccaacgccgccatgggggcggtcttcaccgaggaaaaccagtgggatagcgctaaggccgccgtggaagacgaggatttctggaagttggtcgaccgggagcgggagctacacaagctgggcaagtgcggatcctgcgtgtacaatatgatgggcaagcgggagaagaagctcggtgagttcggcaaagcaaagggctcgcgcgcaatctggtatatgtggctaggggcccgttatctggagttcgaggccttaggcttcctgaacgaggaccactggttttcccgcgagaacagctattccggtgtggagggcgagggcctgcacaagctcgggtacatcctgcgggacatcagcaagatccccggcggtgccatgtatgccgacgacacggcgggctgggacacccgtatcaccgaagacgaccttcataacgaggagaagatcacccaacaaatggaccccgagcaccggcagctcgccaacgccatattcaagctgacgtaccagaacaaggtcgtgaaggtgcagcgccccaccccgaccggcaccgtcatggacatcatctcccggaaagaccagagggggagcggccaggtggggacatacggcctgaacacgttcaccaacatggaggctcagctcatccggcagatggagggagaaggagtgctgagcaaagccgacctcgagaacccccacctcccggagaaaaagataacccaatggctggagaccaaaggcgtcgagaggctgaagcggatggcgatctcgggggacgactgcgtcgtaaaacccatcgacgaccgctttgctaatgccctccttgcactgaacgacatgggcaaggtacggaaggacattccccagtggcagccgagtaaggggtggcacgactggcagcaggttcccttctgcagtcaccacttccacgagctcatcatgaaggacggccgcaagctggtggttccctgccggccgcaagacgagctgatcgggcgcgctcgtatctcccagggtgcgggatggagcctcaaggagacggcgtgcctggggaaggcctacgcacagatgtggtccctgatgtactttcaccgcagggacctccggttagcgagcaacgccatttgttccgccgtcccagtacactgggtcccgaccagccgcacaacttggtccatccatgcccaccaccagtggatgacaaccgaggacatgctgacggtatggaaccgggtgtggattgaggacaacccctggatggaggacaagacccccgtcacgacctgggaaaacgtgccctacctcggcaagcgcgaggaccagtggtgcggatctctgatcggcctgacctctcgggcaacctgggcccagaacatcccgactgcgatacagcaggtcagatccctcattgggaacgaagagttcctggactacatgcccagcatgaagaggttccgcaaggaagaggagtccgagggcgccatctggtag

SEQ ID NO: 25827 - RNA, 9873 nt, synthetic construct
  misc_feature 1..9873: note = derived and/or modified CDS sequence (opt11) from DENV-3__HQ541785__SS-prME
  source 1..9873: mol_type = other RNA
acctcactctgcctcatgatgatcttacccgccgccctggcgttccaccttacaagccgggacggggagcctcggatgatagttgggaaaaacgagcggggtaagtcgcttttattcaagaccgcctccgggataaatatgtgcacactcatcgcgatggacttaggggagatgtgcgacgacactgttacgtacaagtgccctcacattaccgaggtggagcccgaggacatcgactgttggtgcaacctgacctccacctgggtcacctacgggacgtgcaaccaggccggcgagcaccggagagacaagcgatccgtggccctggcgccccacgtgggcatggggctggacacgcgcacccagacctggatgagcgccgaaggcgcatggcgccaggtggaaaaagttgagacctgggccctgcgacaccccgggttcaccatcctcgccctgttcctagcacactacatcggcacatccctcacccagaaggttgtgatcttcatccttctgatgctagtcacgcccagtatgaccatgcgttgcgtgggggtgggcaaccgcgacttcgtggagggcctgtccggggccacctgggtggacgtggttctggagcacggcgggtgtgttaccacgatggccaagaacaaacctacactcgacattgaattacagaagaccgaggccacccaactggcgacgctccgtaagttgtgcatcgaaggcaagatcactaacatcacgaccgacagccggtgccccacgcagggcgaggccacactgccggaggagcaggatcagaattacgtatgcaaacacacctacgtcgaccgggggtggggtaacggttgcggcctgttcgggaagggctccctggtaacttgcgccaagtttcagtgcttagaacctatcgagggcaaggttgtccagtacgaaaatttgaagtacactgtgataatcaccgtgcacactggtgaccagcaccaggtcggcaacgagacccagggcgtaacggccgagatcacgccccaagccagcacaaccgaggcgattttgcccgagtatggcacactgggtctggagtgctcgccgcgcacggggctggactttaacgagatgatacttctcaccatgaagaacaaggcatggatggtccatcgacagtggttcttcgacctgcccctgccctggaccagcggtgccaccacggagacgcccacctggaatcgcaaggagctcctggtaactttcaagaacgcccacgccaagaagcaggaggtcgttgtgctgggctcccaggagggcgcgatgcacacggcactcaccggggccacggagatccagaatagcggcgggacctccatcttcgccggccacctgaaatgtcggctgaagatggacaagctcgagttgaagggcatgagctacgccatgtgcacgaacacgttcgtgctcaagaaggaggtgagcgagacccagcatgggacgatactcatcaaggttgagtacaagggcgaggacgtgccgtgcaagatccccttcagcacagaggatgggcagggcaaagcgcacaacggccgcttgatcaccgccaacccggtcgtaaccaagaaggaggagcccgtgaatatcgaggccgagccgcccttcggagaatccaacattgtcattgggataggggacaacgcactgaagatcaattggtataagaagggctccagcatcggaaagatgttcgaggcgactgccaggggggcccgcaggatggcgatactgggcgacaccgcctgggatttcgggtctgttgggggggttttgaatagcctaggcaagatggtccaccaaattttcgggtctgcgtacaccgccttgttctccggagtgtcctgggtcatgaagatcggcatcggggtactcctgacctggatcggtctgaacagcaagaacacctccatgagcttctcctgcatcgccatcgggatcataacgctgtacctgggagccgtggtccaggccgacatggggtgcgtcataaactggaagggaaaggagctgaaatgcggcagcggaatcttcgtgaccaacgaggtgcacacctggacggagcagtataagttccaggcggatagccccaagagactcgctacggccatcgccggcgcctgggagaacggtgtttgcggcatccgcagcaccacccggatggaaaacctgctctggaagcaaatcgcaaacgagctcaactacatcctctgggagaataacataaagctaaccgtcgtcgtcggggacatcatcggcgtcctagagcaggggaagagaacgcttactccccagccaatggagctgaagtactcgtggaagacctgggggaaagccaagatcgtgactgcggagacccagaacagctcctttatcatagacgggcccaatacccccgagtgccccagcgtctctcgcgcctggaacgtgtgggaggtggaggattatggcttcggcgttttcaccaccaatatctggttgaagctgcgcgaggtatacacccagctgtgcgaccatcgattgatgtctgcagccgttaaagacgagcgcgccgtccacgccgacatggggtactggatcgaatcgcagaagaacggttcgtggaagctggagaaggccagtttgattgaggtgaagacatgcacctggcccaagtcccacaccctatggagcaacggcgtcctggagtccgacatgatcatccccaaaagcctggcaggtcctatctcccaacacaaccaccggccgggctaccacacccagaccgccgggccctggcacttaggcaagttggagctcgacttcaactactgcgagggtactaccgttgtgatcaccgagaattgtgggacgagaggccccagcttacggactaccacagtgtcgggtaaactgatccatgagtggtgttgtcgcagctgcactctgccgcctctccggtacatgggcgaggacgggtgctggtacggcatggaaattcgccccatctccgagaaggaggagaacatggtcaagagcttggtatccgccggcagcgggaaagtggacaattttaccatgggcgtactgtgtttagcaattctattcgaggaggtgatgcgcgggaagttcggcaagaagcacatgattgccggggtgttctttaccttcgtactgctactgtctggacagatcacttggcgcgacatggcgcatacgctgataatgatagggagcaacgcctccgaccggatggggatgggagtgacctacctcgctctaatcgccaccttcaagatccagcccttcctggctctcgggttcttcctgcgcaagttgaccagcagagagaacctcctgctaggcgtgggactcgcgatggccacaaccctgcagctgcccgaggacattgagcagatggcgaacgggatcgccctcggcctgatggcgctgaaactcatcacccagtttgagacctaccagctgtggacggcactgatcagcctgacctgcagcaacaccatcttcaccctgacggtcgcctggcgaaccgcaaccctcatcctcgccggcgtaagcctcctgccggtctgccagagtagctctatgcggaagaccgactggcttccaatggcggtggcagccatgggcgtgcctcccctcccgttattcatcttcagcctcaaggatacgctgaaacgcagatcgtggccgctgaacgagggggtcatggctgtgggactcgtgtccatcctcgccagcagcctgctccggaatgacgtccccatggcgggccccctggtggccgggggattactgatcgcctgctacgtgatcaccggtacttccgcagatctgaccgtcgaaaaagccgctgacataacctgggaggaggaggccgagcagaccggcgtgtcgcacaacctaatgatcgccgtcgacgatgacggcacaatgcgcatcaaagacgatgagaccgagaatatcctcaccgtcctgttgaagacagcgctccttatcgtgtccggaatcttcccgtacagcatccccgccacccttctcgtgtggcacacatggcagaagcagacccagcgtagtggagtcttatgggacgtgccaagcccgcctgagacgcagaaggccgagcttgaggagggggtgtatcgtataaagcagcagggaatcttcgggaaaacccaggtcggcgtgggggtccagaaggagggcgtcttccacaccatgtggcatgtgaccaggggcgcagtgctcacgtataacgggaagcgccttgagccgaactgggcctccgtcaaaaaggacctaatcagctacgggggtggctggcgactctccgcacagtggcaaaaaggtgaggaggtccaggtgatcgcggtcgagcccggcaagaaccccaaaaacttccagaccatgccaggcacctttcagaccacgaccggggagataggcgccatcgccttagatttcaagcccgggacctcgggcagtcccattataaacagggagggcaaagtggtggggctttacggcaacggggtagtgaccaagaacgggggctacgtgtcgggcatcgctcagacgaacgccgagcccgacggccccaccccagagctggaggaggaaatgttcaagaagcggaatctcaccatcatggacctgcatcccgggagcggcaagacaagaaagtacctcccggcgatcgtacgggaggccatcaagagacggttgcgcacgctgattctggcccccactcgagttgtggccgccgagatggaggaggcgctcaaagggcttcccatccgctaccaaaccaccgccacgaagtcggagcacaccggcagagagatcgttgacctgatgtgccacgccaccttcactatgcggctcttaagtcccgtgcgggtaccgaactacaacctcatcatcatggacgaggcccacttcacggatcccgcctccatcgcggcacgcgggtatatcagcactcgcgtgggcatgggcgaggccgccgcgatcttcatgaccgctacgccccccgggacggcagacgcattcccgcagtccaacgctcccatccaggatgaggagcgcgacatccccgagcgcagttggaactccggcaacgaatggatcacggactttgcggggaagaccgtgtggttcgttcccagcatcaaggcaggcaacgacatcgccaactgcctccggaagaacggtaagaaggttattcagctatcacgcaagaccttcgatacggagtaccagaagaccaagctgaacgactgggacttcgtagtgaccaccgacatcagcgagatgggagccaacttcaaagccgaccgggtcattgacccacgacggtgtctcaagcctgttatcctgacggacggccccgaaagggtgatcctggcggggcccatgccagtcacagccgcctcagccgcccagcgccgcggccgggtggggcgcaacccccaaaaagagaacgaccagtacatcttcaccggccagccgctcaacaacgacgaggaccacgcgcattggaccgaggccaagatgttactcgataacattaacacacccgaggggatcatccccgcccttttcgagcccgagcgggagaagtccgccgcaattgacggagaatatcgcctcaagggcgagtcccggaaaacattcgttgaactgatgcgccgcggggacctacccgtctggttggcccacaaggtcgctagcgagggtatcaagtataccgaccgcaaatggtgcttcgacggacagcggaataaccagatcctggaggagaacatggacgtggagatctggacgaaggagggcgagaagaagaaactccgcccccgctggctggatgctcgcacctactccgatccgttagctctcaaggagttcaaagagttcgccgcgggccgcaagtctatcgcgctggacctggtgacggagatcgggagggtgcccagtcacctcgcccaccgtacccggaacgccctcgataacctggtcatgctacatacctccgagcatggcggacgcgcttaccgtcatgccgtggaagaactgcccgagaccatggagacgttgctcctattaggcctcatgatcctgttaaccgggggcgccatgctgttcctgatcagcggtaaggggattggcaagacctccatcgggctgatatgcgtgattaccagctccggcatgttatggatggccgagattcccctgcagtggatcgccagcgcgatcgtcctcgagtttttcatgatggtgttactgatccctgagcccgagaagcagcgcactccacaggataaccaactggcctatgttgtcattgggatcctcaccctggccgccattatcgccgcgaatgagatgggcctgctcgagaccacgaagagggacttaggcatgtccaaggagccgggggtagtgagcccaacttcctacctggacgtcgacctccacccggcgagtgcctggaccctgtatgccgtggcgaccaccgttattacgcccatgctgcgccacaccatagagaactccaccgcaaacgtcagcttagccgccatcgccaaccaggccgtggtgctgatgggcctggacaaggggtggcccatttccaagatggacctcggcgtacctctgctggccctcgggtgctacagtcaagtgaatcccctgaccctgacggccgccgtgctactgctgatcacccattacgccattatcggacccggcctccaagcgaaagctacccgggaggcacagaagcgtaccgcggccggaatcatgaagaatcctacggtcgacggcatcatgaccatcgacctggaccccgtgatctatgactccaagttcgagaaacagctgggccaggtaatgctcctggtcctatgcgcggtgcagctcctgttaatgcggaccagctgggccctctgtgaagccctgaccctggccactggacccatcactaccctctgggaggggtcccccggtaagttttggaacacgacgatagctgtctctatggccaacatcttccgcggctcctacctggccggggccggcctggccttctcaatcatgaagtccgtcgggaccggcaagcggggcaccggcagccagggcgagacccttggtgagaagtggaagaaaaagctgaatcagctgagccgcaaagacttcgacctctacaagaagtccggcatcaccgaggtagaccggacagaagcgaaggagggactgaagcgcggcgagatcactcaccacgccgtgagccgggggtccgcgaagctgcagtggtttgtagagcgcaacatggtgatcccggagggaagggtgatcgatctcggctgcgggcgcggcgggtggagctattactgcgccggactaaagaaagtcaccgaggtgcggggctacaccaagggcgggcccgggcacgaggagcccgtgcccatgtccacttacggctggaatatcgtcaagctgatgtcggggaaggatgtgttctacctcccgcccgagaagtgcgacaccctgctgtgcgacataggcgagagtagtccctcccccaccgttgaggagagccggaccatccgcgtcctgaaaatggtggagccgtggctcaaaaataaccagttctgtataaaggtcctgaacccctacatgcccacggtcatcgagcatctggagcgtctacaaaggaagcacggcggaatgctggtgcggaacccgctgtcacgcaattccacccacgagatgtactggatctccaacggcaccgggaacatcgtggccagcgtgaacatggtgtcacgcctcctgctgaaccgctttacaatgacgcaccggcgcccgaccatagagaaggacgtggacctcggcgcgggcacgcggcacgtcaacgctgagcccgagacccccaacatggacgtgatcggggagcgcatcaagcgtatcaaggaagagcacaattcaacatggcactacgacgacgagaacccatacaagacatgggcctaccatggctcctacgaggtgaaggccaccgggtccgcgtccagcatgatcaacggcgtcgtgaagctgctgactaagccctgggatgtcgtgcccatggtgacccagatggcgatgaccgacaccaccccctttgggcagcagcgtgtcttcaaggagaaggtggacacccggaccccgcgctctatgcccggaacccggcgcgtgatgggaatcacggccgagtggttgtggaggacgctgggacgcaacaagaaaccccggctgtgcaccagagaggagttcaccaaaaaggtcaggaccaacgcggccatgggcgcggtgttcacagaggagaaccagtgggactccgcaaaggccgccgtggaggacgaggacttttggaagctcgtcgatcgggagcgcgagctgcacaagctgggcaaatgtggaagctgtgtgtataacatgatggggaagcgcgagaagaaactcggcgaattcgggaaggccaaggggagccgcgcaatctggtacatgtggcttggtgcccggtacctagaatttgaggcgctcgggtttctgaacgaggaccactggttctcgcgcgaaaactcctacagcggagtggagggtgaaggacttcacaagctcgggtacatcctacgggacatcagtaagatccccggtggcgccatgtacgccgacgacaccgccgggtgggacactcgcatcaccgaggacgacctgcacaacgaggagaaaatcacgcagcagatggacccggagcataggcaactcgccaacgccatatttaagctcacctaccagaacaaagtggtgaaggtgcagcgtcccacccccaccggcactgtcatggatattatcagtcggaaggaccagcgcggctccggccaggtgggcacgtacggactaaacaccttcacgaacatggaggcccagctcatccggcaaatggagggcgagggtgtattaagcaaggccgacttagaaaacccccacttgccggagaagaagatcacccagtggctggagacgaagggcgtcgagcgcttaaagcgcatggcgatcagcggtgacgactgcgtggtgaagcccattgacgatcgcttcgccaacgccctattagccttaaacgacatggggaaagtccgtaaagacataccccaatggcagcctagcaagggctggcatgattggcaacaagtgccgttctgttcccaccatttccacgaactcattatgaaggacgggcgaaaactggtggtcccctgccggccgcaggacgagctgatcggccgcgcccggatcagccagggggcgggatggtccctgaaggagaccgcatgcctgggcaaggcgtatgcccagatgtggtcgctgatgtatttccacaggcgcgacctccggctggcatccaacgccatatgctccgcggtgcccgtccactgggtcccgacctcccgcacgacgtggagcatccacgcgcaccaccagtggatgactaccgacgacatgctaaccgtgtggaaccgagtatggatcgaggacaacccctggatggaggacaagactcccgtcaccacctgggagaacgtgccgtaccttggtaaacgcgaggaccagtggtgtggcagcctgatcgggctgacatcgcgggcgacgtgggctcagaacatcccgaccgctatccagcaagtccgcagcctcatcggcaacgaggaattcctggactacatgccctccatgaagagattccgcaaagaggaagagagcgaaggggccatctggtga

SEQ ID NO: 25828 - RNA, 9873 nt, synthetic construct
  misc_feature 1..9873: note = derived and/or modified CDS sequence (opt11) from DENV-3__HM181975__SS-prME
  source 1..9873: mol_type = other RNA
acgagcctatgcctcatgatgatcctaccggccgcgctggcgttccacctcaccagccgggacggcgagcccagaatgatcgtgggcaagaacgagcggggcaagagcctgctgtttaagactgcctccgggatcaacatgtgcaccctcatagctatggacctgggggagatgtgcgatgacaccgtgacgtacaagtgcccccacataaccgaggtggagcccgaggacatagactgctggtgcaacctaacgagcacctgggtgacttacgggacctgcaaccaagccggcgaacaccggcgggataagcgctccgtggcgctcgcgccccacgtgggcatggggctcgacaccagaacccagacctggatgagtgccgagggcgcgtggcgccaggtagaaaaagtggagacttgggccctgcgccacccggggttcaccatcttagctctgtttctggcccattacatcggcacctcactgactcagaaggtggtgatcttcgtcctgctgatgctggtgacgcccagcatgaccatgcggtgtgtgggggtcggcaaccgcgacttcgtggagggtctgtccggggcaacctgggtggacgtagtgctcgaacacggtgggtgcgtgaccactatggccaagaacaagccaaccctcgacatcgagctgcagaagacagaggctacccagttagctacgctcagaaagctgtgcatagaaggcaagatcactaatataaccaccgattcacgctgccccacgcagggcgaggccactttgccggaggagcaggatcagaactacgtctgcaagcacacctacgtggatcgggggtggggcaacggttgcggccttttcgggaagggctccttggtgacctgcgccaagttccagtgcctggagcccatcgagggcaaggtcgtgcagcacgaaaacctcaagtacaccgtgatcatcaccgtacacacaggtgaccagcaccaggtgggcaacgagacccagggggtcacggccgagatcacgccccaggccagcaccacggaagcgatcctgccagaatacggcaccttggggctcgagtgctccccgcgcacgggcctagacttcaacgagatgatcctgctcaccatgaagaacaaggcctggatggtgcaccggcagtggttcttcgacctacccctgccctggaccagtggcgccaccacggagacccccacctggaataggaaggagctcctggtgacctttaagaacgcccacgccaaaaagcaagaggtcgttgtgctggggtcacaagagggcgcgatgcacacggctctcaccggtgccaccgagatccagaacagcggcgggaccagtatcttcgccggccacctgaaatgccggctgaagatggacaaactcgagctgaagggaatgagctacgccatgtgcacgaacacgttcgtcttaaaaaaggaggtgtccgagacccagcacgggactatcctcatcaaggtggagtacaagggcgaggacgtgccgtgcaaaatccccttctcaacggaggacgggcagggcaaggcacacaacggccgcctgatcacagccaaccccgtggttacaaaaaaggaggagcccgtcaacatcgaagcggagccacccttcggggagagcaacatagtgatcggcatcggggataacgccctgaagatcaactggtacaagaaaggctcatccatcgggaagatgttcgaggccaccgccaggggcgcccgcaggatggccatcctgggcgataccgcctgggacttcgggtccgtggggggggtcttgaacagcttgggcaagatggtgcaccagatcttcgggtccgcgtacaccgccctgtttagcggcgtgtcctgggtgatgaagatcggcatcggggtgctcctgacctggatcgggctgaacagcaagaacacctccatgagcttctcctgcatcgccatcgggatcatcactctctatctcggcgcggtggtacaggccgacatggggtgcgtgataaactggaagggaaaggagctgaagtgcggcagcgggatattcgtgacgaacgaggtgcacacctggaccgagcagtacaagttccaggcggactcccctaagcgcctcgccacggccatcgccggcgcctgggagaacggggtgtgcggcatccgcagcaccacccggatggaaaatttattatggaagcagatcgcgaacgagctgaactatattctgtgggagaacaatatcaagctgaccgtggtcgtgggggacatcatcggcgttctcgagcagggcaagcgcacgctgaccccccaaccgatggaattgaagtactcttggaagacctgggggaaggccaagatagtcaccgccgagactcagaacagcagtttcatcatcgacggtcccaatacccccgaatgtccgagcgtttcccgggcctggaacgtgtgggaggtggaggactacggtttcggcgttttcaccaccaacatctggctcaagctgcgcgaggtgtacacccagctatgcgaccatcggctcatgagcgcggccgttaaggacgagagggccgtgcacgccgacatgggctactggatagagagccagaagaacgggtcctggaaactcgagaaagcctcgctgatcgaggtgaagacctgcacctggccgaaatctcacaccctgtggagcaacggtgtacttgagtccgacatgatcatccccaagagcctggcggggcccatctcccagcacaaccaccggccgggctaccacacccagacggccgggccgtggcacctcggtaagctggaactggactttaattactgcgaaggcaccaccgtggttatcaccgagaactgcgggacgcgggggcccagcctccgcaccacgaccgtcagtgggaagctgatccatgagtggtgttgtcgcagctgcacgctgcccccgctcagatatatgggcgaagacgggtgctggtacggcatggagatccgcccgatatccgagaaggaggagaacatggtcaagagcttagtgtccgccggcagcggtaaagtcgataatttcaccatgggggtactatgcctagccatattgttcgaggaggtgatgcggggaaagttcgggaaaaagcacatgatcgccggggtcttcttcaccttcgttttactcctgtccggccagatcacctggcgcgacatggcgcatacgctgatcatgatcggcagcaacgccagtgaccggatggggatgggcgtgacgtacctcgccttaattgccaccttcaagatccaacccttcctggccctcgggttcttcctgcgcaagctgaccagccgtgagaacctcctgctgggcgtcggcctcgcgatggccactaccctccagttgcccgaggacatcgagcagatggccaacgggatcgccctcggcctcatggcgcttaagctcatcacccagttcgagatctaccagctgtggaccgcgttaatctcactcacttgctccaataccatctttaccctaaccgtggcctggcgcacggccaccctgatcctcgcgggggtcagcctgctgccgatgtgtcagtccagctccatgaggaagaccgattggctacccatggcggtggccgccatgggtgtgccgcccctcccgctgtttattttttcgctcaaggacaccctgaagcgccgttcctggccgctgaacgagggagttatggccgttggcctcgtgagcatcctggccagtagcttgctccggaacgacgtccccatggcgggccctctggtggccggggggttactcatcgcctgctatgtgattacggggacctccgccgacctcaccgtcgagaaggccgcggacatcacctgggaagaagaggccgaacagacgggcgtgagccacaacctgatgataaccgtggacgatgatgggaccatgcgaatcaaggacgacgagaccgagaacatccttaccgtcttgctgaagactgccctcctgattgtgtccggcatcttcccgtacagcatccccgccacactgctcgtgtggcacacctggcagaagcagacccagcggtccggcgttttatgggacgtgccctcaccgcccgaaacgcagaaggccgaactggaagaaggggtgtaccgcatcaagcagcagggcatcttcggtaagacccaggtcggcgtcggcgtgcagaaagagggcgtcttccacaccatgtggcacgtgacccggggcgccgtgctcacgtacaacgggaagcgcctcgagcccaactgggccagtgtcaagaaggacttgataagctatggcgggggctggaggctatccgcccagtggcagaagggtgaggaggtccaagtgatcgccgtcgaaccgggaaagaaccccaagaatttccagaccatgcccggcacctttcagaccacgacaggggagatcggtgcgattgcactggacttcaagcccgggactagcggcagccccataattaaccgcgagggcaaggtggttgggctgtacggcaacggggtcgtgaccaagaatggcgggtacgtgagtggcatcgcgcagacgaacgccgagccggacggacccacccccgagttagaggaggagatgttcaagaaacgcaacctaacaatcatggacctgcacccagggagtggaaagacccgcaagtacttaccggccatcgtcagagaggcgataaagcgccggctccgcacgctaatcttggcccccacccgggtggtggcggcagagatggaggaggccctcaaggggctgcccattaggtaccagacaaccgcgacgaagtccgaacacaccggccgggagatcgtcgacctgatgtgccacgccaccttcaccatgcgcttgctgagccccgtgcgggttccaaattacaacttgatcatcatggacgaggcccacttcacggaccccgcctccatcgccgcgcgcggatacatttctaccagggtaggcatgggcgaggccgccgctatcttcatgaccgccactccacccgggacggccgacgcgttcccgcagtcaaacgcccccatccaggatgaggagcgcgacatcccggagcgcagctggaactccggcaacgagtggataaccgacttcgccggcaagaccgtgtggttcgtgccctctatcaaggcgggcaatgacatcgctaactgcctccggaagaacgggaaaaaggtcatccagctgtcccgcaagacgtttgacacggagtaccagaagaccaagctgaacgactgggacttcgtggtgacgaccgatatcagcgagatgggcgcgaacttcaaggccgacagggtcattgacccgagacggtgcctcaagcccgtgattctgacagatggccccgagcgtgtgatcctggccggccctatgccggtaactgcggcctctgccgcccaacggcgcggacgggtggggcgcaatccccagaaggagaatgaccagtatatcttcacaggccagcccctcaacaacgacgaagatcacgcccactggacagaggcgaagatgctgctcgacaacatcaacaccccagaggggatcataccggcactcttcgagcccgagcgcgagaagtccgcagcgatcgacggcgaatatcgcctgaagggcgagtcacggaagacgttcgtcgagcttatgaggcgcggggacctccccgtctggctcgctcacaaggtagcctctgagggcatcaagtacaccgaccgaaagtggtgttttgatggacagcggaacaaccagatcctagaggagaacatggacgtcgagatctggaccaaggaaggcgagaagaagaagctccgcccccggtggcttgacgcccgcacatattccgacccgctggccctcaaggaattcaaagagttcgccgcgggccgaaagagcatagcgctggaccttgtgacggagatcgggcgggtgccctcgcacctcgcccaccgcacccggaatgccctggacaacctggtcatgctacatacctcggagcacggcggacgcgcctaccggcacgctgtggaagagctaccggagaccatggagacgttgctcctgctgggcctcatgatccttctgaccgggggtgccatgctattcctgataagcgggaaggggatcggcaaaacctccatcgggctgatatgcgtaatagcgagctccggtatgctctggatggccgaaatcccgctgcagtggatcgccagcgcgatcgtcctggagttcttcatgatggtgctcctaattcccgagccagagaagcagcgcacgccccaggacaatcagcttgcctacgtggtcatcgggattttaacgcttgccgccatcatcgcggccaacgagatgggcctgctggaaaccacgaaaagggacctgggcatgtccaaggagccgggagtggtgagcccaacctcctatctggatgtcgacctacacccggctagcgcttggacgctgtatgccgttgcgaccaccgtgatcacccccatgctgcgacatacgattgagaactccacagcaaatgtcagcctcgccgccatcgccaaccaggcggtagtgctgatgggcctggataaggggtggccgatctccaagatggacctaggcgtccccctactggcactcggatgctacagccaagtcaaccccctgaccctgaccgctgcagttctcctgctgatcacgcattacgccataatcggccccggcctccaggcgaaagccactcgggaggctcagaagcgcaccgccgccggtatcatgaagaatccgaccgtcgatggcatcatgaccatcgacctggatccggtgatatacgacagtaaatttgagaagcaactgggccaggtcatgctcctggtcctgtgcgtcgtgcaactcctgctgatgcggacctcttgggcgctgtgcgaagccttgaccctggccacaggccccatcacgaccctgtgggagggcagtcccgggaagttttggaacaccacaatcgccgtcagcatggcgaacatttttcgcggctcctacctggccggtgccggtttagccttctcgataatgaagtccgttggcacgggcaagcggggcacggggagccagggagaaactctcggggagaagtggaaaaagaagctcaaccagctgagtcgcaaggacttcgacctctacaagaagtccggcatcactgaggtcgatagaaccgaggccaaggaggggctgaagaggggcgagatcacgcaccacgctgtcagccggggctccgccaagctgcagtggttcgtggaacgcaacatggtcatcccggaggggcgggttatcgacctcggctgcgggcgcggcgggtggagctactactgcgcgggcctgaagaaagtgaccgaggtgcggggctataccaagggcgggcccgggcacgaggagcccgtccccatgtccacctacggctggaacatagtgaaactgatgagcgggaaggacgtgttctatttaccgcccgagaaatgcgatacgctgctgtgcgacatcggcgagtccagcccatcccccacagtcgaggaaagccgcaccatccgcgtcctgaagatggtggagccatggctcaagaacaaccagttctgcataaaggtcctgaacccctacatgcccactgtgatcgaacatctagagcgtctccagcgcaaacacggcgggatgctcgtgagaaaccccttgtcccgaaacagcacgcacgagatgtactggatctccaacggcactgggaatatcgtggccagcgttaacatggtgagtcggctccttctgaacagattcaccatgatccaccggcgcccgaccatcgagaaggacgtcgacctcggggccggtacgcggcatgtgaacgcggagcctgaaacccccaacatggacgtgatcggggagcgcatcaagcgtatcaaggaggagcacaacagcacctggcactacgacgacgagaacccgtataagacttgggcttaccacggttcctacgaggtcaaggccacgggcagcgcctccagcatgatcaatggagtggtcaagctgctgaccaagccctgggatgtggtgccgatggtcacgcagatggccatgaccgacacgactcccttcggtcagcagcgcgtgttcaaagaaaaggtggacacccggaccccgcgctccatgcccggcacgcggcgcgtcatgggcattacagcggagtggctctggagaaccctcgggagaaacaagaagccccgcctgtgcacccgcgaggagttcaccaagaaggtgcgcaccaacgccgccatgggcgctgtgtttaccgaggagaatcagtgggactccgcgaaggccgccgtcgaggacgaggacttctggaagcttgtggaccgggagcgcgagttgcacaagctggggaagtgcggcagttgcgtctacaacatgatgggtaaacgcgagaagaagttgggagagttcggcaaggctaaggggtccagggccatctggtacatgtggctcggcgcacgttatctggaattcgaggccttggggttcctcaacgaagaccactggttcagcagggagaatagttactccggcgtcgagggggagggccttcacaagctcggctacatcctgcgggatatcagcaaaatccccgggggcgccatgtacgccgacgataccgccgggtgggacacgcgcataacagaagacgacctgcacaacgaggagaagatcacccaacaaatggacccggagcatcggcagctcgcaaacgcaatcttcaagctgacctaccagaacaaggtggtgaaagtccagcgccccacgcccaccggaacagtgatggacatcatcagcaggaaagaccagcgcggctccggacaggtggggacctacgggttaaacactttcacgaatatggaggcccagctcatccgccagatggagggcgaaggcgtcttgagcaaggccgatctggagaacccccacctcccggagaagaagatcacgcagtggttagagaccaagggcgtggagcgcctgaagagaatggccatctccggcgacgactgcgtcgttaagccgatcgacgaccgcttcgcgaacgcgctactggctctgaacgacatggggaaggtgcggaaggacatcccccagtggcagcccagcaagggttggcatgactggcagcaagtcccgttctgctcccaccactttcacgagctgatcatgaaggacgggcgcaagctggtcgtgccctgccgcccccaggacgagctgatcggccgggcgcggatcagccagggggccggctggtcgctaaaggagaccgcgtgcctgggcaaagcctacgcccagatgtggtccctgatgtacttccaccgtcgcgacctccggctggcctccaacgcgatatgcagcgccgtgcccgtccactgggtacctacgtcccgcaccacctggagcatccacgcccaccaccagtggatgactaccgaggacatgctgaccgtgtggaatcgggtctggatcgaggacaacccctggatggaagacaagacccctgtgaccacgtgggaaaatgttccctacctcgggaagcgcgaggaccagtggtgcggcagcctgatcgggctgacctccagggccacctgggcccaaaacatcccgaccgcgatccagcaagtacgtagcctaatcggcaatgaagagttcctggactacatgccctcgatgaagcggttccgcaaggaggaggagtcagagggggccatctggtga

SEQ ID NO: 25829 - RNA, 9873 nt, synthetic construct
  misc_feature 1..9873: note = derived and/or modified CDS sequence (opt11) from DENV-3__HM631864__SS-prME
  source 1..9873: mol_type = other RNA
accagcttgtgcctgatgatgatcctacccgcagctctggcattccacttaaccagccgcgatggagaaccgcgaatgatcgtgggtaaaaacgaaaggggtaaaagcctactgttcaaaaccgcaagcggaatcaacatgtgcactctgattgcgatggacctgggcgaaatgtgcgatgacacggtaacttacaaatgcccacatatcactgaagtcgaaccagaggatattgactgctggtgtaaccttaccagcacctgggtaacctacgggacgtgtaatcaagcgggggaacatcgacgagacaaacgaagcgtcgcactggcaccacacgtgggtatgggactagacacccgcacgcagacatggatgagcgcagaaggcgcatggcggcaggtcgagaaagtcgaaacctgggcgctaaggcaccctggattcacaattctagcgctattcctcgcccactacattggaacatctctaacacagaaagtagtgatcttcatcttactgatgctggtgacaccttcgatgacgatgcgctgtgtaggggtagggaacagagatttcgtggaagggctgagcggcgcaacatgggtagacgtcgtcctcgagcacggcggctgcgtaactaccatggccaaaaataaacccacgctcgacatagaactgcagaaaacagaagccacacagctggcaaccctccgcaaattatgtattgagggcaaaattaccaacataacaaccgacagccgctgccctacacaaggagaagccactctgccggaagaacaagatcaaaactatgtctgtaagcacacttacgtggacagaggttgggggaacggctgcgggctatttggaaagggtagtttggtgacatgcgcgaaattccaatgcctagaaccaatagaaggaaaggtggtacaatacgagaatttaaagtacacggtaattatcacagtgcataccggcgatcaacaccaggtcgggaatgaaacgcagggggtcacggccgaaatcacgccacaggccagcaccactgaggcgattctaccggaatacggaaccctcggcttagaatgcagcccgagaacggggcttgacttcaatgaaatgatcttactcaccatgaaaaacaaagcgtggatggtccaccgccagtggttcttcgacctaccactcccgtggaccagcggcgcaacaacagagacaccgacatggaataggaaggaacttttggtaaccttcaaaaacgcccacgccaagaaacaagaggtcgtcgtactcggctcacaggagggcgcaatgcacaccgcgctcaccggcgcgactgaaatccaaaatagtgggggaaccagcatatttgctggacatttgaaatgccgactaaaaatggacaaactagaacttaagggaatgagctatgccatgtgtacgaacacattcgttctcaagaaggaagtaagtgaaacccaacacgggaccattctgatcaaggtcgaatacaaaggcgaggatgtaccttgcaaaatcccattctccaccgaagacggtcaaggcaaagcgcacaatggacggttgataactgcaaatcccgtggtcacaaagaaggaggaacctgtaaatatagaagccgaacccccgttcggtgaaagcaacatagtcataggcatcggcgacaacgctctgaaaataaactggtacaaaaaggggagctctattggaaagatgttcgaggccacggcgcgcggagcgcgccgaatggccatacttggggacaccgcatgggacttcggatctgtcggaggagtactcaattcgttaggaaaaatggtgcatcagatcttcggatcggcttacactgcattattttcgggagtgagttgggtgatgaaaataggaataggagtgctcctaacatggataggtttaaactcaaagaacacgtcaatgtcctttagctgcatagccataggcattataactctttacctcggggcagtagttcaggccgatatgggctgcgtcattaattggaaaggtaaggagctcaaatgcggcagcggcatctttgtcaccaacgaagtccacacatggacggaacaatacaaattccaagcagatagccccaaacgtctggccaccgctatcgcaggagcgtgggaaaacggagtatgtggaatacgttcgacgaccagaatggagaatctactgtggaagcagattgcaaacgagctgaactacatcctatgggaaaacaacataaagctaacggtagtcgtaggagacatcataggggtactcgaacaaggaaaaagaacactcacaccccagcctatggaactaaagtacagttggaagacgtgggggaaggcaaagatcgtcacggccgaaacacaaaattcctcgtttataattgacggaccgaacacgccagagtgcccttcggttagcagagcctggaacgtatgggaagtagaagactatggatttggcgtattcaccaccaatatctggttaaagctccgggaagtatacacacaactgtgcgaccaccggttgatgtctgcagccgtgaaggacgagaaagcggtccatgctgacatgggctattggattgaatcccagaagaatgggtcatggaaattagagaaagcgagcctaatcgaagtaaagacctgcacctggcctaagagccacaccttgtggagcaacggagtcttagaaagcgatatgatcattcctaagagcctcgcaggacccatcagtcagcacaaccaccggccaggataccacacccaaaccgccgggccctggcacctggggaagctcgagctagacttcaattattgcgagggaacgacagtagtgataacagaaaactgcggaacccgcggacccagtctaagaacaacgactgtaagcggcaagctaatacacgagtggtgctgtcggagctgtacactaccaccactccgatacatgggtgaggacgggtgctggtatggcatggaaatacggcccattagtgaaaaagaggaaaacatggtcaaatcattagtatccgctggcagtggaaaggtagacaacagtacgatgggggtgctttgcctagcgatactgttcgaagaagtaatgagaggcaagttcggcaagaagcacatgattgccggggtatttttcacctttgtacttctactgtccggacagatcacgtggagagacatggcgcacacgctgattatgatcggtagcaacgctagcgacagaatgggcatgggcgtcacatacctagcactcatagccacattcaagatccagccctttctcgccttaggattcttcctgcgtaaacttaccagcagggaaaaccttttactaggcgtggggctggcgatggcaacgacactacaactgcctgaggacatagagcagatggccaatggaatagcactcggactcatggcgcttaagttgatcacacaattcgaaacctaccaactatggacagcactaatatccctgacctgctctaacacaatattcactctcacagtggcatggagaacagcgacgctcatcctggcaggagtgagcctcctaccggtatgtcaatcatcatcaatgcggaagacagattggttgcctatggcggtcgcggcgatgggtgtcccaccgctcccactcttcattttctcactcaaagatacgctgaagaggcgtagctggccattgaacgaaggagtcatggcagtcggcctcgtgagcatcctggcgtcatcccttctacggaatgacgttccgatggcaggccccctggtggccggtggtctcctcatagcatgctatgtaataacaggcacgagcgccgaccttaccgtagagaaggcggcagacataacgtgggaggaggaggctgaacaaacgggggtctcacacaacctgatgatcgccgtagacgacgacggtacaatgagaataaaggatgacgaaaccgaaaacatactcacggtactcctaaagacagccctattaatcgtgagcggaattttcccgtacagcataccagcaactctcctagtatggcatacatggcaaaagcagacccaaagatccggggtcctgtgggatgtaccgtcacccccagaaacacaaaaggcagagctcgaggaaggcgtttatcgcatcaaacaacaaggcatattcggcaaaacgcaagtaggcgtgggcgttcagaaagaaggcgtcttccacacgatgtggcacgtaacccgcggcgcggtcctcacttataacggaaagaggctagaaccgaattgggcatccgtaaagaaggacctcatctcgtatggaggcggatggaggttatcggcgcagtggcagaagggagaagaggtccaggtaatcgcagtggagcctggaaagaaccccaaaaatttccaaaccatgcctggtaccttccaaacgaccaccggagaaatcggagctatcgccctggactttaaaccgggaacttccgggagtccgataataaatagagaaggaaaggtcgtcggtctctacggaaacggcgttgtgacgaagaacggaggatacgtatccggaatagcacaaacaaatgcagaaccggatggacctaccccagagctagaagaggaaatgttcaaaaagaggaacctgacaattatggacttacatcctgggagtggtaagacacggaaatatctgcccgcaatagtacgggaagccatcaagcggcgattgaggactctaatactcgcacccacgagagttgttgcggcggaaatggaagaagcattgaagggactaccgatacgctaccagaccacggcaaccaaatcagagcacacggggagagagatagtggacctgatgtgccatgcgaccttcactatgcgccttctgtcgccagtacgtgtacctaactacaatctaatcattatggatgaagcccacttcacggatccggcatctatcgcggcgcgagggtatatcagcacgcgtgtaggaatgggagaagccgccgcgatcttcatgacggcaacgccgccaggcacagccgacgcgttcccacaatcgaacgcgccaatccaagacgaagaacgagatattccggagaggtcctggaacagcggaaacgaatggataaccgacttcgcaggaaagacagtttggtttgtaccaagcataaaggccggcaacgacatcgcgaattgcctaagaaagaacggcaagaaagtgatacaactaagcaggaagacattcgacaccgaataccagaaaacaaaactcaacgattgggacttcgtagtcacaaccgacatcagcgagatgggcgcaaatttcaaagcggaccgagtcatagacccgcgtcggtgcttaaagcccgtaatactaacggatggccctgaacgagtcatcctagcaggacccatgccggtcaccgccgcatcagccgcccagcggaggggccgcgtaggccggaatccccaaaaggagaatgaccaatacattttcacgggacaaccgcttaataacgacgaagatcacgcgcactggaccgaggcgaaaatgctcttggacaatataaacacgccggagggaataatacctgcactgtttgaaccagagagagaaaagagcgcagccatagacggcgaatacagactcaagggagagagcagaaagacattcgtagaactaatgaggaggggcgacctacccgtatggcttgcacacaaggtggccagcgagggaattaaatacaccgatcggaaatggtgcttcgatggtcagagaaacaatcagatactggaagaaaacatggacgtcgagatctggactaaagagggcgagaaaaagaagttaagaccacgatggctagatgcacgcacctactccgatccgttagccctgaaagagtttaaggagtttgctgcggggagaaaatcgatcgcgttagatctagtaacagaaatcggccgcgtgccgtcccacctagcccacagaacacgaaacgcacttgacaacttggtgatgttacatacttctgaacacggaggacgtgcctaccgacacgctgtagaagaactgccggaaacgatggaaacgctcctactactagggctgatgattctactgacaggaggcgccatgctattcctaatcagcggaaagggcatcgggaagacctctataggtctcatctgcgtaattgcaagtagcggaatgctgtggatggccgagatcccactccaatggatagcctcagccatagtcctggagttctttatgatggtccttctaattcctgaaccagaaaaacagcgcacccctcaagacaaccaactagcatacgtcgttatagggatactcacgctcgcggctgtcatagccgccaacgaaatggggctactggaaaccacgaagagggatctgggcatgtctaaagaaccaggcgtagtatctcctacatcgtatctcgacgttgacctccatcccgcctccgcgtggaccctatacgctgtagcgacaaccgttatcaccccgatgctaagacatacgatagagaacagtaccgcgaatgtctccctggcagcaatcgcaaatcaggcagtggtattgatgggactcgacaaaggatggcctattagtaaaatggatctaggggtgccactactcgcactaggatgttactcgcaggtcaaccccctaaccttgacggcagccgttcttctcctgatcacgcactacgccataataggaccaggcctccaagccaaggccacccgagaagcccaaaagcgaacggcagctgggatcatgaagaaccccacagtcgatggaataatgacgatagacctcgaccccgtcatatacgatagtaaatttgaaaaacaactcggccaagtaatgctccttgttctctgcgctgtgcaattactcctaatgcgtacttcctgggcactctgcgaggcgctcacactagcaaccgggccaataaccacactatgggaaggaagcccagggaaattctggaacacgacaatcgccgtaagcatggcgaatatattccggggcagctatctagccggagcaggactcgctttcagtataatgaagtcggtgggaacgggcaaacgaggaactgggtcccagggcgaaaccctcggtgaaaagtggaagaaaaagctaaaccagctaagtcgaaaagacttcgacttgtataagaaaagcggaataaccgaagtagaccgaaccgaggcgaaggaaggcttgaagcgtggcgagatcactcaccacgccgtgtcgcgaggaagcgctaagctacaatggttcgtagagagaaatatggtaatccccgaaggacgagtcatcgaccttggatgcggacgaggcggctggtcctactactgtgcaggcctcaagaaggtgacagaggtgcgcggctacacgaaaggtggcccaggccatgaagaaccagtaccaatgagcacgtacggctggaacatcgtcaaactcatgtcgggaaaagacgtgttttatctccctcctgaaaagtgcgatactttactgtgcgatataggtgagtcctcaccctcgccaaccgtcgaagaaagcaggactatacgcgttctaaaaatggttgagccctggctaaagaacaaccagttttgcataaaagtgctcaacccctatatgccgaccgttatagaacacctggagaggctccaacggaagcacggtggaatgctagtacgtaaccccctatcgcgtaacagtacacacgaaatgtactggattagcaacgggaccggaaatatcgtagcgtccgtaaatatggtaagtaggcttctactaaacaggtttacaatgacacacagacgacctactatcgaaaaagatgtagacctaggagcagggaccagacatgtgaatgccgagccagaaaccccgaatatggacgtaataggggagagaatcaagcggattaaagaagaacacaactccacctggcactacgacgacgaaaacccctacaaaacatgggcctaccacgggtcctacgaagtgaaggcgaccgggtcggcaagctccatgatcaacggggtagtaaagctcctaaccaagccatgggatgtggttccgatggtaacgcaaatggccatgacagacacaactccgttcgggcaacagagagttttcaaagagaaagtggatacaagaacacctcgtagcatgccagggacccgcagagtaatgggaatcacagccgaatggctgtggcggacgctggggaggaacaagaaaccacgcctgtgcacacgcgaagaatttaccaagaaagtaagaacgaacgcggccatgggagccgtattcacggaggaaaatcaatgggatagcgcaaaggcggcagtcgaggacgaagacttctggaaactggttgaccgagaacgagaacttcacaaactaggaaagtgcggatcttgcgtttataacatgatggggaaaagagaaaagaagctcggcgagttcggcaaagctaaaggttcgagagccatatggtacatgtggctcggagcccggtatttagagttcgaagctctgggatttctgaacgaagaccactggttttcgagagagaactcatattcaggtgtggaaggtgaaggactacacaaactaggatacattctgagagatataagcaaaataccaggtggagcgatgtacgcagacgatacggccggatgggatacacgcataacagaagacgacttgcacaacgaagagaaaataacacagcagatggaccccgaacatagacagctagcaaatgccatcttcaaactaacctatcagaacaaggtggtaaaagtacaacgcccgactccaaccggaacagtaatggatattatctccagaaaagaccaacggggcagtggccaagtaggcacctacggattaaatacgtttacgaacatggaagcgcaactgatcagacagatggagggcgaaggtgtgttgagcaaggcggacctcgaaaacccgcacttacccgagaagaaaattacgcagtggctcgagacaaaaggagtcgagcgcctgaaaaggatggcaatctccggggacgactgcgtagtaaaaccaattgacgacagattcgcgaatgcgctgctagccctaaatgacatgggcaaagtccgtaaggacatcccgcaatggcagccgtcaaaagggtggcacgactggcagcaagtgccgttctgttcacaccacttccatgaactcataatgaaagacggtcgtaaacttgtagtcccatgtcgcccacaggacgaactgataggaagggctagaataagccaaggtgcgggttggtcgctaaaggaaaccgcgtgcctggggaaggcgtacgctcaaatgtggtcacttatgtatttccaccgccgagacctgagactggcatcaaacgcgatatgtagcgccgtcccagtgcactgggtaccgactagccggacaacgtggagcatacacgcacaccaccagtggatgaccacagatgacatgcttacagtatggaacagagtctggatcgaggataatccgtggatggaggacaaaacaccggttaccacttgggagaatgtaccgtacctggggaagagggaagaccagtggtgtggctcactgataggacttaccagtagagccacgtgggcacagaacataccaacggcaatacaacaggtccgtagtctaattggtaatgaagagttccttgactatatgccgtcaatgaagcgtttcagaaaggaagaagaatccgagggtgcaatctggtag

SEQ ID NO: 25830 - RNA, 9873 nt, synthetic construct
  misc_feature 1..9873: note = derived and/or modified CDS sequence (opt11) from DENV-3__HM631859__SS-prME
  source 1..9873: mol_type = other RNA
accagtctgtgcctcatgatgattctgccggccgctctggcgttccacctcaccagccgagacggggagccccggatgatcgtagggaagaacgagcggggcaagagcctgctgttcaagacggcatccgggataaatatgtgtaccttgatcgcaatggacctgggggagatgtgcgacgataccgtaacgtacaagtgccctcacattaccgaggtggagcccgaggacatcgactgctggtgcaacctgaccagtacctgggtgacctacgggacctgcaaccaggctggcgagcaccggcgggacaagcggtccgttgctcttgcaccccacgtgggcatggggcttgacacaaggacccaaacatggatgtcagccgagggcgcgtggcgccaggtcgagaaggtcgagacatgggccctgcgccacccagggtttaccatattagctctgttcttagcccactacattggcacctcgcttacgcagaaggtcgtgatctttatactgctgatgctcgtcacgccctccatgaccatgcggtgcgtgggggtgggcaatagagacttcgtcgagggccttagcggcgccacgtgggtggacgtggtcctcgagcacggagggtgtgtgacaacgatggccaagaacaagcccacactggatatcgagctccagaagacggaggccacgcagctggcgacactacggaaactttgtatcgagggcaagatcaccaacatcaccaccgacagccgctgccccacgcagggcgaggcaactttgcctgaggaacaagaccagaactatgtgtgcaagcacacctacgtcgaccggggctgggggaacgggtgcggtttattcggtaagggctccttggtcacatgcgccaagttccagtgtttagaacccatcgagggcaaggtagtccagcacgagaacctcaagtacacggtgatcattaccgtccacaccggagatcagcaccaggttggcaacgagacccaaggggtgacagccgagattacaccccaggccagcaccactgaggctatcctgcccgagtacggcaccctggggctcgagtgctccccgcgcacgggcctggactttaacgagatgatcctgctcacgatgaaaaacaaggcttggatggtccaccggcaatggttcttcgacttaccactgccatggaccagcggagccaccacggaaacccccacctggaaccgcaaagagctcctggtgacctttaagaacgcccacgccaagaagcaagaagtcgtcgttctggggtcccaggaaggtgcgatgcatacagccctcacgggggccaccgaaatccagaacagcggtggcacctcaatatttgccggccacttaaagtgccggctgaaaatggacaaactagagctgaagggcatgagttatgctatgtgtacgaacacattcgtcctgaagaaggaggtctccgagactcagcacggaacgattctcatcaaagtggagtacaagggcgaggatgtgccgtgtaagatccccttctccactgaagatgggcagggcaaggcgcacaacgggcgcctgatcaccgccaaccccgtcgtgactaagaaagaggagcccgtgaatatcgaggccgagccacccttcggagagagcaacatcgtcattgggatcggggacaacgctctaaagataaactggtacaagaaaggctccagcatcgggaagatgttcgaggctaccgccagaggcgcccgccgtatggccatcctgggcgacaccgcttgggactttgggagtgttggcggggtgctcaacagcctgggcaaaatggtccaccaaatcttcggaagtgcttacacggccctgttcagcggcgtctcatgggtgatgaagattggcataggtgtcctcctgacttggatcggcctaaactcgaagaacaccagcatgagtttctcctgcatcgccatcggtatcatcacactctatttgggggcagtggtgcaggcggatatggggtgtgtcatcaactggaaaggcaaggagctgaaatgcggatcagggatcttcgtaactaatgaggtacacacctggaccgagcagtataagttccaagccgactcacccaagcgactcgccacggccatcgcgggcgcgtgggagaacggtgtctgcggtatccgaagcaccacccgaatggagaacctgctgtggaagcagattgcgaacgagctgaactatattctgtgggaaaacaacattaagctgacggtggttgtcggggacatcatcggcgtcctcgagcaagggaaacgcacactgacgccccagcctatggagttgaaatattcctggaagacctgggggaaggccaaaattgtgactgcggaaacccagaacagctccttcatcatcgacggcccaaatacacccgagtgccccagtgtctcccgggcctggaacgtatgggaggtggaggactacgggtttggcgtcttcacaaccaacatatggctaaagctgcgagaggtgtacacccagctgtgtgaccatagactcatgtctgcggccgtgaaggacgaaagggcggtccacgcagacatgggctactggatcgagtcccagaagaatgggtcctggaaactggagaaggccagcttgatagaggtaaagacgtgcacctggccaaaatcccacaccctctggagcaacggagttctggagtccgacatgataatacccaaaagcctggcggggccgatatcccaacacaaccaccgcccaggttatcacacccaaacggccggtccgtggcatttaggcaagctggagctcgattttaactactgcgagggcaccacagttgtgatcacggagaactgcgggacacggggtcccagtctccggactacaaccgtgagtggtaagctgattcacgagtggtgctgtagatcttgcacgttaccgccgttgcggtacatgggcgaagacggctgctggtacggcatggagatacgtcccatctccgagaaggaggagaacatggtcaagtccctagtgtcagccggcagtggaaaggtagacaacttcaccatgggcgtcctgtgcctcgccatcctgttcgaagaggtgatgcgggggaagtttggcaagaagcacatgattgcaggggtgttcttcacattcgtcctgcttctctcgggtcagattacctggcgcgacatggcgcacacgcttatcatgataggcagcaacgcctccgacaggatggggatgggcgtgacctacctcgccttgatcgccaccttcaagatccagcccttcctggccctcgggtttttcctgcggaagctgacctcacgggagaatctcttactgggcgtgggcctcgcgatggccacaaccctgcagttacctgaggacatcgagcagatggcgaacgggatagccctcggcctaatggcgctgaagctcattacccaattcgagatataccaactgtggaccgcactgatctctctcacatgttcgaataccatattcaccctgaccgtcgcttggcgcacggccaccttaattctcgccggggtgtcgctgctgccgatgtgccaatcgagctccatgcgcaagaccgactggctgcccatggcggtcgccgctatgggcgttccccctctccctttgttcatctttagcctcaaggacaccctgaagcgaagatcctggcccctaaacgagggggtgatggccgttgggctcgtgtccatcctcgcctcctcactgctccggaacgacgtgcccatggccgggcccctggtcgccggtggactccttatcgcctgctacgtgataacgggaacaagtgccgatctcaccgtcgagaaggctgcggacataacgtgggaggaagaagcggagcagacgggcgtctctcataatctgatgatcacagtggacgatgacggcaccatgcgcattaaggacgacgaaaccgagaacatcctcaccgtactgctaaagacggccctgctaatcgtaagcggaatctttccctacagcattccggccacactgctcgtgtggcacacttggcagaaacagacacagcgttccggcgtgctgtgggacgttccgtcaccgcccgagacgcagaaggccgaactggaggagggggtgtaccgcataaagcagcagggcatttttgggaagacccaggtgggcgtcggagttcagaaggagggggtgttccacaccatgtggcatgtcaccagaggggcagtgctcacgtacaatggtaagcgcttggagcccaactgggcctctgtcaagaaagacctgatcagctacggagggggctggcggctgtccgcccagtggcagaagggggaggaagtccaggtaatcgccgtggagcccggaaagaacccgaaaaatttccaaaccatgcccggcaccttccagaccacaaccggggagataggggcgatcgcccttgacttcaagcctggcacaagcggcagcccaattatcaaccgcgagggtaaagtcgttggtctgtacggcaatggcgttgttaccaagaatggcggctacgtgtccggaattgcccaaacgaacgctgagccggacggccctacgcccgagcttgaggaagagatgtttaagaagagaaaccttaccattatggacctgcacccggggagcggcaagacccgcaagtacctaccggctatcgtgcgggaagcgatcaagcgccggctgcgtacgctgattttggccccaacccgggtagttgcggcggaaatggaggaagccctcaaggggctgcccattcgctatcagaccaccgcgaccaaatcggagcacaccggacgtgagatcgtggaccttatgtgccacgcaacatttaccatgagactcctgagccccgttcgggtgcctaactataacctgatcatcatggacgaggcgcactttacggaccccgcctccatcgccgcgcgcgggtacatcagcacgcgggtaggcatgggcgaggcagccgctatctttatgaccgcaacaccgcccggcacggccgatgcatttccgcagtctaatgccccaatacaggacgaggaaagagacataccggaacgctcgtggaactccggaaacgagtggatcaccgatttcgccggcaaaacagtctggttcgtaccctcaatcaaagcgggaaacgatatcgccaattgcctccggaaaaacggaaagaaggtgatccagctgtcccgcaagaccttcgacaccgagtaccaaaagaccaagctgaacgactgggacttcgtcgtgacgaccgacatctctgagatgggcgccaactttaaggccgatcgggtaatcgacccgcggaggtgcctcaagcccgtaattctgacggatggccccgagcgtgtgatcctggcggggcccatgccggtgacagccgcctccgcagcacaacgccgcggccgggttgggagaaacccacagaaggagaacgaccagtacatattcacaggccaaccgctcaacaatgatgaggaccacgcccactggactgaggcgaagatgctgctggacaacataaacacccctgaggggatcatcccggctcttttcgagccagagcgcgagaaatccgccgccatagacggcgaataccgactgaagggggaatcccggaaaacattcgtggagctgatgcgccgcggcgacctccccgtgtggctagcgcataaggtcgccagtgaaggcatcaagtatactgaccggaagtggtgcttcgatgggcaaagaaacaaccaaatcttagaggagaatatggatgtagagatctggactaaggaaggcgagaagaagaaactccgtccacggtggctggacgcgcgcacatatagtgatccgctggcactaaaggagttcaaggagtttgccgctggcagaaagtccattgcactggacctggtcacagagatcgggcgtgtgcccagccatctagctcaccgcacgcggaatgccctggataacctggtgatgctacacaccagtgagcacggcgggcgagcctacaggcatgcggtcgaggagctgcctgagaccatggagacgcttctgctgctgggcctcatgatactgttaaccggaggggccatgctgttcctaatcagcggcaaagggatcggcaagacctccatcggcctgatatgtgtgatagcgagcagtggcatgctctggatggccgaaatcccgctgcagtggatcgcctcagcaattgtattggagtttttcatgatggtcctgcttatccccgagcccgagaagcagcgcacgccgcaggacaaccaactcgcatacgtggttatcggaatcctcacgctggccgcaattatcgccgccaatgagatgggccttctggaaaccaccaaaagggacctgggcatgtccaaagagccgggagtcgtgtctcccacctcctatctggacgttgacctccaccctgcctctgcgtggacattgtatgccgtcgccaccaccgtgatcaccccaatgctgcgacacacgatcgaaaattcaacagccaatgtcagtctcgccgccattgctaatcaggcagttgtgctgatgggcctggacaagggatggcccatatccaaaatggacctcggcgtgcctttactggccctcgggtgctattcacaagtcaacccattgactctgacagcggccgtactcctgctcattacgcactatgctatcatcgggccaggcctccaggcgaaggccacccgggaggcacagaagcgcactgccgccggtatcatgaagaacccgactgtggatggaattatgacaatcgacctggaccccgtaatctacgatagtaagtttgaaaaacagctaggccaggtaatgctcctggtactgtgcgtcgtacagctcctgctgatgcgaaccagctgggcgctttgcgaggccctgaccttggccaccggaccgatcacgaccctctgggagggttcccccgggaagttctggaacacaaccatcgccgtcagcatggctaatatattccgtggatcctacctggccggggccggcctggcgttttccatcatgaagtccgtcgggaccggcaaacgcggtaccgggtcacagggcgagactttaggggagaagtggaagaagaaacttaaccagcttagtcgcaaggacttcgacctctacaagaagtccggcatcactgaggtggaccgcaccgaggccaaagaggggctaaaacgaggcgagatcacccatcacgcggtgagccggggaagtgcgaagctgcagtggttcgtagagcgcaacatggtaatcccggaagggcgggtgatcgatctcggatgcgggcgcggcgggtggagctattactgtgccgggctgaagaaggtcacagaagtgcggggatacaccaaaggcggtcctgggcacgaggagcccgtgcccatgtccacgtacggatggaacatcgtcaagttaatgagcgggaaagacgtgttctacctgccgcccgaaaaatgtgacacgcttctttgcgatatcggcgagtcctccccctcacccacagttgaggaatctcggaccattcgcgtcctgaagatggtagagccgtggctcaaaaacaatcagttctgtattaaagtgctgaacccctacatgcccaccgtgatcgagcacctggaaaggctccagcgcaagcacggcgggatgctagtacggaacccactgtctcgcaatagcacccacgagatgtactggatcagcaacggaacggggaacattgtggcgagcgttaacatggtctctcggctcctgctgaacaggttcactatgacccacaggagaccgactatcgagaaggacgtcgacttgggagccggtacgcggcatgtcaatgccgaacccgagacccccaatatggacgtgatcggggagcgcatcaagcggattaaagaagaacacaacagcacctggcactacgacgacgagaacccgtacaagacgtgggcctaccatgggtcctacgaggtaaaggcgaccgggtccgcatcctctatgatcaacggcgttgtcaagttgcttaccaagccctgggacgtggtgcccatggttacacaaatggccatgacggacaccaccccctttgggcaacagcgcgtctttaaggagaaagtggacaccagaactccgcgaagcatgccgggcacccggcgggtaatgggaattaccgcggagtggctctggcggaccctgggaagaaacaagaagccccggctgtgcacccgcgaggagttcaccaagaaggtccgaaccaacgccgccatgggggcggtattcacggaggagaaccagtgggactccgcgaaagctgccgttgaagacgaggacttctggcggctcgttgatcgcgagagagagcttcataagttaggaaagtgtggctcgtgtgtttataacatgatgggaaaacgggaaaagaagctcggagagttcggcaaggcgaaggggtcccgcgccatctggtatatgtggctaggcgcacgctacttggagttcgaggctctcgggttccttaacgaggaccactggttcagcagagaaaattcctacagcggagtggagggggagggactgcataagctcggctatatcctgcgcgacatatccaagatccccgggggcgctatgtacgctgacgacacggccggctgggataccagaataaccgaggacgacttacacaacgaggagaagatcacccagcaaatggacccggagcaccgccagctggcgaacgccatcttcaagctaacataccagaacaaggtcgtcaaggttcagcggcctacccccaccggcaccgtcatggacatcataagcagaaaggatcagcggggttctggccaagtaggtacctacggccttaacacctttaccaacatggaagcccagcttatccggcagatggaaggggagggtgttctgagcaaggccgacctggagaacccacacctcccggagaagaagataacccagtggctggagacaaagggtgtcgagcggctgaagcgcatggccatatccggcgacgattgcgtggtgaagccaatcgacgaccgtttcgcgaatgccctcctggccctgaatgacatggggaaggtccggaaagacatcccccagtggcagccatccaagggctggcacgactggcagcaggtcccgttttgtagtcaccacttccacgagttaatcatgaaagatgggagaaagctggtagtcccgtgtcgcccccaggatgagttgatcggccgggcccgtatcagtcagggagccggttggtccctcaaagagacggcgtgcctgggcaaagcctacgcacaaatgtggagcctgatgtatttccaccgccgcgatctccgcctggcctcgaacgcgatctgcagcgccgtgcccgtgcactgggtgcccacatcgcggacaacctggagcattcacgcccaccaccagtggatgacgaccgaggacatgctgaccgtgtggaatcgcgtgtggatcgaagacaacccctggatggaagacaagacccccgtcacgacatgggagaatgtaccctacctagggaagcgggaagaccagtggtgcggcagcctgatcgggttgacctcccgggccacgtgggcacaaaacatcccgacggcgatccagcaggtcagaagcctcatcggcaacgaagagtttcttgactatatgccctctatgaagcgcttccggaaggaagaagagtccgagggggccatctggtaa

SEQ ID NO: 25831 - RNA, 9870 nt, synthetic construct
  misc_feature 1..9870: note = derived and/or modified CDS sequence (opt11) from DENV-3__HM631856__SS-prME
  source 1..9870: mol_type = other RNA
accagcctgtgtctcatgatgatcctgcccgccgccctggctttccacctcaccagccgggacggggagccccggatgatcgtggggaaaaacgagcgagggaagtcactactgttcaaaactgcctccgggatcaacatgtgtactcttatcgccatggacctgggcgagatgtgcgacgacacagtgacctacaaatgtccccatattacagaagtggagccagaggacattgactgctggtgcaacctgacaagtacttgggtgacttacgggacgtgcaaccaggcaggcgagcaccggcgcgacaagcggagtgtcgccttagcgccccatgtgggaatgggtttagataccagaacccagacctggatgagcgccgagggcgcctggcggcaggtcgagaaggtcgaaacctgggccctgcgtcacccggggttcaccatactcgcgctgttcctggcccactatattggcacgtccctcacccagaaagtcgtgatctttatccttctgatgctggtcacgccctcaatgaccatgcggtgcgtgggagtaggcaaccgtgacttcgtagaaggcctgagcggtgccacctgggttgacgtcgtcttagagcacggcgggtgtgtgaccactatggcaaagaacaagcccacccttgacatcgagctgcagaagaccgaggccacccaactggcgacgctccggaagctttgcatcgaaggcaaaatcaccaacatcaccaccgacagccgctgccccacgcagggagaagccaccctgcctgaggagcaggatcagaactacgtgtgcaagcacacctacgtcgacagagggtggggcaacgggtgcggcctcttcgggaaggggtccctggtgacgtgcgccaagtttcagtgcctagagcccatcgagggcaaagtggtccaatatgagaacctcaagtacactgtgattatcaccgtacacaccggggaccaacatcaggtcggcaatgagacccagggggttacggccgagatcacgccccaggccagcactaccgaggcaatcctgcccgagtacggcaccctggggttggagtgctccccacgcacggggctcgactttaacgagatgatcctgctcaccatgaagaataaggcttggatggtccatcggcaatggtttttcgatctgcccctgccgtggaccagtggcgccactaccgagacccccacctggaacaggaaggagctcctcgtgaccttcaaaaatgcccatgccaagaagcaggaggtggtcgtgctggggtcccaggaaggcgcgatgcacacggccctcaccggggcgacggagatccaaaacagcggcggaacctccatctttgccggccacctgaagtgtcgcctgaagatggacaagctcgagctgaagggtatgagctacgccatgtgtacgaacaccttcgtgttaaaaaaggaagtctccgagacccagcacggaactatcttgatcaaggtggagtacaagggcgaggacgtgccgtgcaagattccctttagcacggaggacgggcaaggcaaggcgcacaacggccgcctcataaccgccaatcccgtcgttaccaaaaaggaggagcccgtgaacatcgaggccgagccgcccttcggggagagcaacattgtcatcggcatcggggacaacgctctcaagatcaactggtacaagaagggctcttccatcgggaagatgttcgaggcgaccgcccggggcgcccgccggatggctattctaggcgacacagcctgggacttcgggagcgtgggcggtgttctcaacagcctggggaagatggtccatcagatcttcggatccgcttataccgctctgttcagcggagtttcctgggtgatgaagatcggcatcggggtgttgctgacatggatcggcctgaacagcaagaacacctccatgagcttttcgtgcatcgcaataggcatcatcacgctctacctgggcgccgtggtgcaggcggacatggggtgtgtcgtgaactggaaaggcaaggaactgaagtgcggtagcggtatcttcgtaacaaacgaggtccacacctggactgagcagtacaagttccaggcggattccccaaagagactagccacggcaatcgccggtgcctgggagaacggagtgtgcggcatacgcagcaccacacggatggagaatctactttggaagcagatcgcgaatgagctcaactacatcctgtgggagaacaatatcaaactgacggtagtcgtgggagacatcatcggcgtgcttgagcaaggaaaacgtacgttaacaccccagccgaaggagctaaagtattcgtggaagacttgggggaaggccaagatcgtcaccgcagaaacccagaacagctccttcatcatcgacggccctaatacccccgagtgtccctccgtttctcgggcctggaacgtgtgggaggtcgaggactacggcttcggcgtattcaccacgaacatttggctaaagctgcgcgaagtatacacccagctgtgcgatcatagactcatgagcgctgcggtcaaagatgagcgtgccgtacacgccgatatgggctattggattgagtcacagaagaacgggtcctggaagcttgagaaggccagtttaatcgaggtgaagacttgcacctggcctaagtcccacactctgtggtccaatggtgtactggagagcgacatgataatccctaagagcctggcagggccgataagccaacataaccaccgcccgggctaccatacccagacggcggggccttggcacctcggtaagctggagctggactttaactactgtgagggcaccaccgtggtgataaccgagaactgcggcacgcgtggcccaagcctccggaccaccacggtgtccggtaaattgatccatgagtggtgctgtcgtagctgcactttgcctccgctccggtatatgggagaggatggctgctggtacggcatggagattcgacccatctcggaaaaggaagagaacatggtcaaatcgctggtctccgccggcagcggtaaggttgacaacttcaccatgggtgtactgtgcctcgccatcctgttcgaggaggttatgagagggaagttcggcaagaagcacatgatcgcaggcgtgttcttcacattcgtcctacttctgtccggccagatcacctggcgtgatatggcgcatactcttattatgatcggtagcaacgcctccgatcggatgggtatgggcgtgacctacctcgccctgatcgccaccttcaagatccagcctttcctagctttagggttcttccttagaaagctaacctcgcgggaaaacctcctcctgggcgtcggcctcgccatggccactaccctgcagttgcccgaggacatagagcagatggccaatgggatcgccttaggtctcatggcgttaaagctcatcactcagtttgagacctaccagctatggacagccctgatcagcctgacctgctctaacaccatcttcacgctaacggtggcgtggcgcaccgccacgctgattctggccggtgttagcctgctgccggtgtgtcagtccagcagcatgcggaaaaccgactggctccctatggcggtggcggcgatgggggtgccgcccctcccgctgtttatcttctcactcaaggacacgctgaagcggcgctcctggcccctgaatgagggtgtaatggccgtaggactcgtcagcatcctggcctccagcctgttgcgaaatgacgtacccatggcgggcccactggtggccgggggcctgctcatcgcctgttacgtgatcaccgggaccagtgccgacctgaccgtagagaaggccgctgacatcacgtgggaggaagaggcggagcagaccggtgtgagccataatctgatgatcaccgtggacgacgacgggaccatgcgcatcaaagatgacgagaccgagaacatcctcacggtgctgttgaagaccgccctattgattgtgtccggcatcttcccgtacagcatccccgccaccctgctcgtctggcatacatggcagaaacagacacagcggtccggcgtcctgtgggacgtacccagccccccggaaacccagaaggccgagctggaggagggggtctacagaataaagcagcagggcatcttcggcaagacccaagttggcgtaggtgtccaaaaggagggcgtgtttcacaccatgtggcacgtaacaaggggcgcggtactcacttacaacgggaaacgcctcgagccaaactgggcctcagtgaagaaggacctgatatcatatggcggcggttggaggctctccgctcagtggcaaaagggagaggaggtgcaggtcatcgcagtggaacccggcaagaaccccaagaatttccagaccatgccaggcaccttccagacaaccactggcgagatcggcgcgatagcccttgacttcaaacctgggaccagcggatctccgatcatcaaccgcgaggggaaagtggtcgggctctacgggaacggggttgtgaccaagaacggggggtacgtctccggtatcgcacaaaccaacgccgaaccggacggcccaactcccgaactggaagaagaaatgttccggaagcgcaacctcaccatcatggacctgcacccaggttccggcaagacgcggaagtacctgcctgccattgtccgggaggcaataaagcggcgcctccggacactgatcctggcacccacccgcgtcgtagccgccgagatggaggaagcactcaaggggctgcccatacgctaccagacaaccgcgaccaagtccgagcacacgggacgggagatcgttgacctgatgtgtcacgctacgttcacgatgcggttactgtcgcccgttcgcgtcccgaattacaacctgataatcatggacgaggcccatttcaccgatcctgcctcaatcgccgcccgggggtacattagcacccgcgtgggcatgggcgaggctgccgccatctttatgaccgcgactccgccagggaccgccgacgcctttccccagagtaatgcccccattcaggacgaggagcgcgacattcccgagcggtcgtggaactccggcaatgaatggataaccgacttcgccgggaagacagtgtggttcgtccccagcatcaaggcaggcaacgacatcgccaactgcctccgcaagaacggaaagaaagttatacagctgtcacggaagacgttcgacactgagtaccaaaaaaccaagctgaacgactgggacttcgtggtcaccactgacatcagcgagatgggcgcgaatttcaaggccgaccgcgtgatcgacccgcggcgctgcctcaagcccgtgattctgaccgacggccccgaaagagtgattctggccgggcccatgcctgtcacagcggcctctgccgcccagaggcggggccgtgtcgggcggaacccccagaaagagaacgaccagtacatcttcaccggccaacccttaaacaacgacgaggaccacgcccactggactgaggcgaaaatgctgttggacaacattaacacgccggaagggatcatcccggccctttttgaacccgaacgcgagaagtccgcagccatcgatggcgagtaccggctaaagggcgagtcccggaaaacctttgtcgaactgatgcgccgcggggacctccctgtttggctggcgcacaaagtcgcctctgagggcatcaagtacaccgaccggaagtggtgcttcgacgggcagcgcaacaaccagatcctggaggagaacatggacgtggagatatggacgaaggaaggggagaagaagaagctccggccccgctggctggatgcccgcacgtactcggacccgctcgcgctcaaggaattcaaggaattcgccgcgggtcgcaagagcatagccctggacttagtgaccgagatcgggcgcgtgccctcccacctggcccacaggacacgaaacgccctagacaacctggtgatgctccacacctctgagcatggtgggagagcctaccgccacgcggtggaagagctgccagagacgatggaaacccttctgctgctgggcttaatgattttactgactgggggcgcaatgttattcttaatcagcggcaaagggatcggcaagacctccatcgggctgatatgcgttatcgcctcctcggggatgctatggatggccgagatcccccttcaatggatcgcaagcgcgattgtgctggagtttttcatgatggtgctcctaataccggagcccgagaaacagcggacgccccaggacaaccagctggcatacgttgtgatagggatcctcaccctggccgcaataatagcggcgaacgagatgggcctgctcgagaccactaagcgggacctggggatgtccaaggagcctggggtagtctcgcccacgagttacctcgacgtagacctccaccccgccagcgcctggacgttgtacgctgtggcgacaaccgtcattacgcccatgctgcggcacactatcgaaaactcgaccgccaatgtctctctcgcagcaatcgccaaccaggcggtagtcctgatgggcctggataaggggtggcccatctccaagatggaccttggcgttccccttctggcgctcgggtgctacagtcaagttaaccctctgaccttaaccgccgccgttctcctgctgatcacccattatgctattataggccccgggctccaggcaaaagcgacccgcgaggcccagaagcggaccgccgccgggataatgaagaacccaacggtggacggcatcatgacaatagacctggaccccgtaatctacgactccaaattcgagaaacagctgggacaggtaatgctcctggtgctgtgcgcggttcagttgcttctgatgcgcaccagctgggcactctgcgaggcattgaccctggccacgggcccaatcaccaccctctgggagggttcacccgggaagttctggaacaccacaatagccgtcagcatggcaaacatctttcggggttcctaccttgccggcgctggtctggccttcagcatcatgaagtccgtcgggaccggcaaacgtggcaccgggtcacagggggaaaccttgggggagaagtggaagaagaagctgaatcaactgtcgcgaaaagacttcgatctatacaagaagtccggcataaccgaggtcgaccgcacggaagcaaaggaagggctgaaacggggcgagatcacgcaccacgccgtcagccgcggctctgccaagctccagtggttcgtggagcggaacatggtgatcccggaggggcgtgtcatcgacctaggttgcgggcggggcggttggagctactactgcgccggcctgaaaaaggttaccgaggtccgcggttacaccaaaggaggtcccgggcatgaggagcccgtccccatgtccacgtacggctggaacattgtgaaactgatgagcgggaaggacgtgttctacctcccacccgagaagtgtgacaccttactgtgtgacattggcgagtcaagccccagccccaccgtcgaggagtcccgcacgatccgggttctgaaaatggtggagccgtggctcaaaaacaaccagttctgcatcaaggtcctgaacccctacatgcccacggttatagagcacttggagcgactccagcggaaacatggcgggatgttggtgcgcaaccccctgtcccggaactcaacgcacgagatgtactggataagcaatggaacagggaacattgtcgcctcagtgaacatggtgtcgcgcctcctcctgaatagatttacgatgacgcaccgccggcctaccatcgagaaggacgtggacttaggcgcggggaccagacatgtgaacgccgagcctgaaacccccaacatggacgtgataggggagcggatcaaacgcatcaaggaggagcacaacagcacgtggcactacgacgacgagaacccgtataagacctgggcgtatcacggttcctacgaagtcaaggctaccgggagcgccagtagcatgataaacggagtagtcaaactgctgacaaagccatgggacgtcgtgcccatggtcacgcagatggcaatgaccgacaccactccctttgggcagcaacgggtgtttaaggagaaggtggatacacgcaccccgcggagtatgcccggcacccgccgggtcatgggtatcaccgccgagtggctctggcgcacgctgggtcggaacaaacctcgcctgtgcacccgcgaggagttcaccaagaaggtgagaacgaacgccgccatgggagcggtgttcaccgaagagaaccagtgggactccgccaaggcggctgtcgaggacgaagacttctggaagcttgtggaccgcgagagggaactgcacaaactgggcaagtgtggcagctgtgtgtataacatgatggggaagcgcgagaaaaagttaggcgagttcggcaaggccaaggggagccgggcgatctggtacatgtggctgggtgcaaggtacctggagttcgaggccctcggttttctgaatgaagaccactggttttcgcgtgagaactcatacagcggagtcgagggtgaggggctgcacaagctcggctacatcctccgcgacatctccaaaatccccggcggtgccatgtacgccgatgacaccgcgggttgggacactcgaatcaccgaggacgacttgcataacgaggaaaagatcacgcagcagatggacccagaacaccgtcagctcgccaacgccatcttcaagctgacctatcagaacaaggtcgtgaaagtccagcggcccaccccgaccggcacagtgatggacatcattagccgaaaggaccaacgcggaagcggccaggtgggtacgtacgggttaaacacctttaccaacatggaggcccagctcatccgccagatggagggcgagggggtgttgagcaaagcagaccttgagaacccccacctcccggaaaagaagatcacccagtggctggagacgaagggggtggaacggctgaagagaatggcgatctcaggcgacgactgcgtggttaagccgattgacgatcgctttgctaacgccctcctcgccctaaatgacatggggaaggtgcgaaaggacatcccccagtggcagccgagcaagggctggcacgactggcaacaggtgccgttctgctcccaccacttccacgagctgatcatgaaggatgggcggaaactggttgtgccctgccgcccgcaggacgagctgatcggacgggcccgtatcagccaaggtgcgggctggtctctcaaggagactgcctgcctggggaaagcctacgcccagatgtggtcgctgatgtactttcaccgacgggatctccgcctggcgtcgaacgctatctgcagcgccgtccccgtccattgggtgccaacctcccggaccacgtggtctatccacgcccaccaccagtggatgaccaccgaggacatgctgaccgtttggaatcgcgtatggattgaggataacccctggatggaggacaagacgcccgtgaccacctgggagaacgttccctacttgggtaagagggaagaccagtggtgtggaagcctgatagggctaacgagtcgagctacttgggcccagaacatccccaccgctatccagcaggtacggagcctaatcggcaacgaagaatttctggactacatgcccagtatgaagcggtttcggaaggaggaggagagcgagggggccatctggtag

SEQ ID NO: 25832 - RNA, 9873 nt, synthetic construct
  misc_feature 1..9873: note = derived and/or modified CDS sequence (opt11) from DENV-3__HM756276__SS-prME
  source 1..9873: mol_type = other RNA
acctcattgtgtctcatgatgatactccccgccgccctggccttccacctcacctcgcgggacggggagccccgcatgattgtggggaagaacgagcgcggcaaaagcctgctgttcaaaactgcatccggaattaacatgtgcaccctcatagccatggacctgggcgagatgtgcgacgataccgtgacctataagtgcccacacatcaccgaggtcgagcccgaggatatcgattgttggtgcaacttaaccagcacgtgggtcacttatgggacgtgcaaccaggccggcgagcaccgccgcgataaaaggtccgtggccctcgctccccacgtgggcatgggactggacactcgaacccagacctggatgagtgctgagggtgcctggcgacaggtggagaaagtcgagacttgggcccttcgccacccggggttcaccatccttgcgttgtttctggcccactacatcggcacctcgttaacccagaaggtggtgattttcatacttttgatgctcgtcaccccctcgatgaccatgaggtgcgtcggggtggggaaccgcgactttgtcgagggcctgtccggggcaacgtgggtggacgtggtcctggagcatggcgggtgtgttaccacgatggccaagaataaacccaccctcgacatcgagctgcagaagacggaagccacccagctcgccacgcttcgcaagttgtgtatcgaggggaagatcaccaacatcaccaccgactcgcgctgtcctactcagggtgaggcaaccctacccgaggagcaagaccaaaactacgtttgcaagcacacctatgtggacagagggtgggggaacgggtgcggcctcttcggtaagggctccctcgtgacctgcgccaagtttcagtgcctggagcccatcgagggcaaggtggtccagtacgaaaacttgaagtacactgtgatcatcacggtgcacaccggggaccagcaccaggtcggcaacgagacccaaggtgtgaccgcggagattactccacaggccagcaccaccgaggcgatcctgcccgagtacggcaccctagggctagagtgcagcccccggacaggccttgacttcaacgagatgatcctgctcacgatgaagaacaaggcttggatggtccaccggcagtggttcttcgacctgcccctgccgtggaccagcggggccaccacggagacccccacgtggaaccgtaaggagctcctggtgacttttaagaacgcgcacgcgaagaaacaggaggtggtagtgctggggtcacaggagggcgcaatgcacacggccttaaccggagccaccgagatacaaaattcaggcgggacctcgatcttcgcgggccacctgaaatgtcggctgaagatggacaagctcgagctcaagggaatgagctacgcaatgtgcacaaataccttcgtactgaagaaggaggtatccgaaactcaacacgggacgatcctcatcaaagtggagtacaagggagaagacgtgccgtgcaagatccccttcagtacggaggacgggcagggaaaggcgcacaacggccgcctgataacggccaacccagtagtgacaaagaaggaggaacccgtaaacatagaggccgagccacctttcggtgagtccaatatagtcatcggcatcggggacaacgcgctgaagatcaattggtacaagaaaggctccagcatcgggaagatgttcgaggcaacagcccggggagcccgccggatggcaatcctgggtgacacggcctgggacttcgggagcgtagggggagttctcaacagtttaggcaaaatggtgcaccagatctttgggtccgcgtacaccgcgcttttcagcggggtctcctgggtcatgaagatcggcatcggggtgctgctgacctggatagggctgaactctaagaacaccagcatgagcttttcatgcatcgcaatcgggatcatcacgctctacctgggagccgtggtgcaggccgacatggggtgcgtcgtcaattggaagggcaaagagttaaagtgcgggagcgggatcttcgtgaccaacgaagtccacacttggaccgagcaatacaagtttcaggccgactctcccaagcgcttggccacggccattgcgggagcctgggagaacggggtttgtggaatccgcagcacaactcggatggagaatctgctgtggaagcaaatcgcgaatgaactaaactatattctatgggagaacaacatcaagctgactgtggtggtgggggatatcatcggcgtcctcgagcagggcaagcgtacgctcaccccgcagccgatggagctgaaatactcctggaagacctgggggaaggccaaaatcgtgaccgccgagacgcagaatagcagttttatcatcgacggccctaacactcctgaatgtcccagcgtgtcccgggcctggaacgtctgggaggtcgaagactacgggttcggtgtgttcaccaccaacatctggctcaaactgcgcgaggtctatacccaactttgtgaccaccggctcatgagcgcggcagtcaaggacgagcgcgcggtgcacgccgatatgggatactggatcgagagccagaaaaacgggtcgtggaaactagagaaggccagcctgatcgaggtgaagacatgcacctggccgaaatcccacaccctctggagcaacggcgtcctggagtcagacatgatcatccccaagtctctggcgggacctatctcccagcacaaccatcggcctggataccatacccaaacggccggcccctggcacctcggtaaacttgagttggactttaattattgtgagggtactacggttgtgatcacggagaactgtgggactcgcggcccgagcctacggacaaccacagtctcggggaagctgatccacgagtggtgttgccgctcctgcacgctgccaccgctgcggtacatgggcgaagatggctgctggtacggcatggagatccgccccatctccgagaaggaggagaacatggtaaagtctctggtgagtgccgggagcgggaaggttgacaacttcaccatgggcgtgttatgcctcgcaatactgttcgaagaggtcatgcgtggcaagttcggtaagaaacatatgattgccggggttttcttcacgtttgtgctgctactgtccggccaaatcacgtggcgcgacatggcgcacacgctgatcatgattggcagcaacgcctcagaccggatgggtatgggcgtgacgtacctcgccttgatcgctacattcaaaatccagccctttcttgccctcgggttcttcctgcgcaaactgaccagccgggaaaacctcctgctcggagttggcctagcgatggccactaccctgcagctgcccgaggatatcgagcagatggccaacgggatagctctcggcctgatggcgctgaagctcataactcagttcgagacttaccagctgtggacagcgctaattagcctgacttgctccaacaccatcttcacactaacagtggcctggcgtaccgcgaccctgatcttggccggggtctcgctgcttccggtctgccagtcctcaagtatgagaaaaacagactggctccctatggccgtagccgcgatgggcgtgcctccattacccctgtttatcttcagtctcaaagacactctgaaacgccgatcatggcctctcaacgagggggtgatggccgtgggcctcgtgtccatcctggcctcgagcttacttcggaacgatgtgcccatggcgggccctctggtggctgggggcttgctcattgcatgctacgtcatcacaggcacgtccgctgacctaaccgtggagaaggccgcggacatcacgtgggaggaagaggctgagcagacaggcgttagccacaatctgatgataactgttgacgacgacggcaccatgcggatcaaggatgacgaaaccgagaacatcctcaccgtacttctgaaaaccgccctcctcattgtgtccggcatcttcccttacagtatcccggccacactcctcgtatggcatacctggcaaaagcagacgcagcgctccggcgtgctgtgggacgtaccaagtcccccggagacccagaaggccgagctggaggagggcgtctaccggatcaagcagcagggtatcttcgggaaaacccaggtaggcgtgggggttcagaaggagggcgtgttccataccatgtggcatgttacgcggggcgcggtgctaacatacaatggcaagcgtcttgagcccaattgggcctccgtaaagaaggatttaatctcttacggcgggggctggcgcctctcagcccagtggcagaagggggaggaagtgcaggtcatcgccgtggagccaggcaagaaccccaaaaacttccagacaatgcccggaacctttcagacgaccaccggggaaattggtgcgatcgcactagacttcaaaccaggcacatcaggatccccaatcatcaaccgcgaaggcaaggttgttggtctgtacgggaacggagtggtgaccaagaacggtgggtacgtatcgggcatcgcccaaaccaatgctgagccggacggtccaacccctgagttggaggaggagatgtttaagaaacggaacctcaccatcatggacctgcatcccgggagcggaaagacgcgcaagtacctacccgcgatcgtgcgggaagcaattaagcgccgactccgcaccctcatcttggccccaacgcgtgtggtcgctgccgagatggaggaggcgctcaaggggctgccaatccgataccaaaccactgctaccaagtccgagcacacgggccgggagatcgtggacctgatgtgccacgccacgttcacgatgcgccttctcagtcctgtgcgtgtcccgaactataacctgatcatcatggacgaggcccacttcaccgaccctgcctctatcgccgcccgtggctacattagcacccgggtgggcatgggcgaagccgccgccatattcatgactgcgacaccgcccgggaccgcagacgccttcccgcaatccaacgccccaatccaggacgaggaacgcgacatccccgagcgcagctggaactctggcaacgagtggattaccgacttcgcaggcaagaccgtttggtttgtcccgagtatcaaagcagggaacgacatcgcgaactgcctccggaagaatgggaagaaagtaatccagctgtccagaaagacgttcgacaccgagtaccagaagactaagttgaacgactgggatttcgtggtcaccaccgacatcagcgagatgggcgccaacttcaaggccgatcgggtgatcgacccaagaaggtgcctcaagcccgtgatcctaaccgatggccctgagcgcgtcatactggccggacccatgccggtcaccgcggcgagtgcggcccagcggcgcggccgggtagggcgcaacccccaaaaggaaaacgatcagtacatctttaccggccagccgctcaacaacgacgaggaccatgcccactggactgaagcgaaaatgctccttgacaatattaatacaccggagggaataattccggcccttttcgagcccgagcgggaaaagtctgcggccatcgatggagagtaccgcctcaagggcgagtcccggaagacgttcgtagagctgatgcgacgcggggacctccccgtgtggctggcgcacaaagtggccagcgagggcattaagtacaccgatcgtaagtggtgctttgacggtcagcggaacaaccagatcctcgaggagaacatggacgtggagatttggaccaaagagggtgagaaaaagaagctcaggccccggtggctcgacgcccgaacgtattccgacccgctggccctaaaggagttcaaagagtttgccgcgggacgcaaaagcatcgccctagacctagtgaccgaaatagggcgggtcccctcccaccttgcccatcgcacacggaacgccctggataacctagtcatgctgcacacaagcgagcacgggggccgcgcgtaccggcatgcggtggaagaactaccggagacgatggagacactattgctgctgggactcatgattctgctgacaggaggcgccatgctgttcctgatcagtggaaaggggatagggaaaacgtctatcggcctgatctgcgttattgcatcctctggcatgctctggatggccgagatcccgctgcagtggatcgcaagcgcgatagttttagagtttttcatgatggtactcctgatccctgagcccgaaaaacagcgaactccccaggacaaccagctggcatatgtcgtgattgggatcttgaccctggccgccataattgcagccaacgagatggggctactcgagaccaccaagcgggacttagggatgagtaaggagccgggggtagtgagccccacctcatacctggacgtggacctccaccccgcctcagcctggaccttgtacgcagtggctaccaccgtcatcacacccatgcttcgacataccatcgaaaattccacggccaatgtgtcactcgccgccatcgccaaccaggcggtggtactgatgggcctggacaaggggtggcctatatccaaaatggaccttggcgtgcccctcctggcgcttgggtgttactcacaagtaaacccccttaccctgaccgccgccgtcctcctcctgatcacccactatgccatcataggccccgggctccaagcaaaggcgacccgggaagcccagaagcggacggcggccgggataatgaagaacccgacggtggacggcatcatgaccatcgatctagacccggttatttacgactctaagttcgagaagcagctagggcaggtcatgttactcgtgctgtgcgctgttcagctcctgctgatgcggaccagctgggcgctctgcgaggccctgaccctggccacgggccccatcacaactctctgggagggctcccccgggaagttctggaataccaccatcgcggtctcgatggccaacatcttcagaggatcctacctggccggggccggcctagccttcagcatcatgaagtctgtagggaccggcaaaagaggtaccggatcccaaggcgagaccttgggggagaagtggaaaaagaagctcaaccagctgtcccgcaaggatttcgacctctacaagaagtccggcataaccgaagtggaccggaccgaggcaaaggaagggttaaagcgaggcgaaatcacccatcacgctgtaagccgtggctcagccaaacttcagtggttcgtagaaagaaatatggtgataccggaggggcgcgtcatcgacttgggttgcggccgcggcggttggagctactactgcgccggcctcaaaaaggttacagaggtgcggggctataccaaaggcggtcctgggcatgaggagcccgtccccatgagcacgtacggctggaatatcgtgaagctgatgtctgggaaggacgtcttttatctacctccggagaaatgcgacacactcctgtgcgacattggggagtcctccccctcaccgacagtcgaggagagtcgcacaatccgcgtgctcaaaatggtcgagccgtggctcaagaacaaccagttctgcatcaaggtgttaaacccctacatgcccacggtgatcgaacacttggagcggctccagcgcaagcatggcggtatgttggtaaggaaccccctttccaggaatagcacacacgaaatgtactggatctccaacgggaccgggaatatcgtcgcgagcgtaaacatggtgtcccgcctcttactgaaccgctttaccatgacgcatcggaggccgaccatcgagaaggacgtcgatcttggcgcgggcaccagacacgtcaacgcagagcccgagacccccaacatggacgtgattggagaacgcataaaacggatcaaggaggaacacaactcaacgtggcactatgatgacgagaacccttataagacctgggcctaccacgggtcctatgaggtcaaggccaccggtagcgcatcctcgatgatcaacggggtcgtaaaactgttaaccaagccctgggacgttgtgcccatggtcacgcagatggctatgaccgacacgaccccctttgggcagcagcgtgtattcaaggaaaaggtggacacgcggaccccgagatcaatgccagggacccggcgcgtcatgggcataaccgccgagtggctctggcgtacgctcgggaggaacaagaagccgcggctatgtacacgcgaggagttcaccaagaaggtaagaaccaacgccgcaatgggcgccgtttttactgaggaaaaccagtgggactccgccaaggccgcagttgaggacgaggacttctggaagctcgtagaccgggagcgcgagctgcataagctgggaaagtgtggaagttgtgtctataacatgatgggaaagcgggagaagaagctcggcgagttcggcaaggccaagggcagccgcgcgatctggtatatgtggcttggcgcccggtacctggagttcgaggcccttggcttcctgaacgaggaccactggtttagccgcgaaaacagctatagcggggttgagggggagggcctgcacaaactcggctacatcttacgggacatcagcaagatcccagggggagccatgtatgccgacgacacggccggctgggacactaggatcaccgaggacgacctgcataacgaggagaagatcacccagcagatggacccggaacatcgacagctcgcaaacgccatcttcaagctgacttaccaaaacaaagtagtgaaagtccaacgccccacgccaacaggtacggtgatggacataatctcccgtaaagaccagcgaggctctggccaggtaggcacttatggcttaaacaccttcaccaacatggaggcccaacttatccggcagatggagggcgagggagtgctgagcaaggccgatctggaaaatccccacctaccggagaaaaagataacccagtggctggagacgaagggcgtggagcgcctgaaaaggatggcgatctccggagatgactgcgtggtcaagcccatcgacgaccgctttgccaatgcccttctggccctgaacgacatggggaaggtgcgaaaggacattccgcagtggcagccctcgaagggctggcatgactggcaacaagtccctttctgctcccaccacttccacgaactcataatgaaagacgggcgcaagctggtggtgccgtgccgcccccaggatgagctgatcggcagggcacggattagccagggggcggggtggtcgcttaaggagacggcctgcctgggcaaggcttatgcccagatgtggagccttatgtatttccaccgccgcgatctccggttggcgtctaacgccatctgttccgccgttcccgtccactgggttccgacctcccgcactacgtggagtatccacgcccaccaccagtggatgacaaccgaggatatgctgaccgtttggaaccgagtatggatagaggacaatccctggatggaggacaaaacgcccgttacgacttgggagaacgtaccctacctcgggaagcgcgaagaccaatggtgcggctctctgatcgggctgacttcccgggcaacgtgggcacaaaacatcccgaccgccatccagcaggtccggagcctcatcggcaacgaggagttcctagactatatgccgtccatgaagcggttccgcaaggaggaagaaagcgagggggccatctggtag

SEQ ID NO: 25833 - RNA, 9873 nt, synthetic construct
  misc_feature 1..9873: note = derived and/or modified CDS sequence (opt11) from DENV-3__HM756279__SS-prME
  source 1..9873: mol_type = other RNA
acatccctctgcctcatgatgatcctgcccgccgccctggcgttccacctcaccagccgggacggggagccacgcatgatcgttggaaagaacgagagggggaaatcactactgttcaagactgcctctgggatcaacatgtgcaccctcattgcgatggatctgggcgagatgtgcgatgacactgttacatacaaatgtccccacatcactgaagtggagcctgaggacattgactgctggtgtaacctgacctcaacctgggtaacatacgggacctgcaaccaagcgggtgagcataggcgcgataagagaagcgtggccttagcgccccatgtgggcatgggtttggacacacgcacccaaacctggatgagcgccgagggagcctggcgccaggtcgagaaagtggagacatgggcactgcgacacccggggttcaccatactggcgctgttcctggcccactacataggcaccagtttgacccagaaggtggtgattttcatcctgctgatgctcgttacgcccagcatgaccatgcggtgcgtcggcgtgggcaaccgggacttcgtcgagggcctatccggggccacatgggtagacgtggtactggaacacggtgggtgcgtcacaacaatggccaagaataagcccaccttagacatcgaacttcaaaaaacggaggccacacagctggcgacgctgcggaagctgtgcatcgaagggaaaattacaaacatcaccacagacagccgatgtcccacacagggcgaggctaccctgccggaggagcaggatcagaattacgtgtgtaagcacacctacgtcgatcggggttggggcaacggatgcggcctcttcgggaaggggtcacttgtgacctgtgccaagtttcaatgcctagagcctatcgagggcaaggtcgtccagtacgagaacctaaagtacacggtgatcatcaccgtacacacaggagaccagcaccaggtcgggaacgaaacgcagggagtaacggccgagatcaccccccaagccagcacgaccgaggccatacttcccgagtacggtaccctggggttggagtgcagtccgcgtaccggcctggacttcaacgagatgatcctgttaaccatgaagaataaggcctggatggttcacagacagtggttcttcgacctgcccttgccctggacctcgggtgccaccacggagacgcccacctggaaccgcaaggaactcctagtgaccttcaagaacgcccacgccaaaaagcaggaggtggttgttctgggctcccaagaaggggcgatgcacacggccctgaccggtgccacggagatccagaacagcggcggcacctccatcttcgccggtcacctgaagtgccggctgaagatggacaaactcgagctgaaaggcatgtcttacgccatgtgcacgaacaccttcgtattgaagaaggaggtctccgagactcagcacgggaccattctcatcaaggtggagtacaagggcgaggacgtaccctgcaagatcccgttcagcacggaggacgggcagggcaaggcgcacaacggacgtctgatcaccgcgaaccccgtcgtgaccaagaaggaggaacccgtcaatatagaggcggaacctcccttcggggagagtaacacggtcatcggcatcggagacaacgcactgaagatcaactggtataagaagggatcctctatcgggaagatgttcgaagcgaccgcccggggcgcccgccgtatggcgatactgggcgacactgcctgggacttcgggtccgtgggcggggtgctcaactcgctggggaagatggtacaccaaatcttcggatccgcgtataccgcgctgttcagcggtgtctcttgggtgatgaaaatcggtataggagtcctcctgacctggattggcctcaacagcaagaacacgtctatgagctttagctgcatcgccattgggatcattaccctatacctgggcgccgtggtgcaggctgatatgggctgcgtgatcaattggaaggggaaggagctaaagtgcggcagcgggatctttgtgacgaacgaagttcacacctggactgaacagtacaaattccaagcggactcccccaagcgcctcgcgactgcgattgccggtgcttgggagaacggggtctgcggtatccgcagcaccacccggatggaaaacctgttatggaagcagatcgctaacgagctcaactacatcctgtgggagaataacataaagctgacggtggttgtcggggacatcatcggcgtgctcgagcagggaaagcgcacactgacaccacaaccgatggaactaaagtactcttggaagacatgggggaaggctaaaatcgtgacggcagagacacaaaacagctcctttattatcgacggccccaataccccagagtgccccagcgtgtcccgggcctggaacgtttgggaggtcgaggactacggcttcggcgttttcaccacaaacatatggctcaagttgcgcgaggtgtacacgcagctgtgcgatcaccggctaatgtccgcggcggtgaaagacgaaagggccgtccacgccgacatgggctactggatcgagagtcaaaaaaatgggagctggaagctggaaaaagcaagcctgattgaggtgaagacctgcacctggccgaagtcgcacactctatggagcaacggcgtgctggagtcagatatgatcatacccaagtcactggcgggtccgatctcccagcataaccaccggcccggctaccacacgcaaaccgccgggccctggcacctcggcaagctggagctggacttcaattattgcgaaggcaccacagtcgtaataacggagaactgcgggacgcgcggccccagcctaaggacgactacggtgtccgggaagctgatccatgagtggtgctgccgcagctgcaccctgcccccgctgcgttacatgggcgaggatggttgctggtatggcatggagatacgacccatctcagagaaggaggagaacatggtcaaaagcctggtgtccgccggcagcgggaaggtagataactttaccatgggcgtcctgtgcctcgccatcctcttcgaagaggtgatgcgggggaagttcggcaagaagcacatgatcgctggtgttttttttactttcgtcctgctgctgtctgggcagatcacgtggcgggacatggcgcacacgttgatcatgattggttcaaacgcctccgaccggatgggtatgggcgttacctatctcgccctaatcgccaccttcaaaatccagccattcctggcgctcgggttcttccttcgcaagctgacgagccgggagaacctgctgcttggcgtgggtctcgcgatggccaccaccttacagctgcccgaggacattgagcagatggctaacggcatcgccctgggcctgatggcactgaagctcatcacccaatttgagacttaccaactgtggaccgcactgataagcctgacttgcagcaacacgatcttcacgttaaccgtcgcttggcgtaccgccacgctgatcctcgcaggggtgagtcttcttccggtttgccaaagtagctcgatgcggaagacagattggctacccatggccgtggctgccatgggagtgccgcctctgccgctgttcatcttcgggctcaaggacaccctgaagcgccgcagttggcccctgaacgaaggcgtcatggctgtcggcctcgtctccatcctggcaagctccctgctccggaatgacgtcccgatggccgggcctctagtggccggggggctgctcatagcttgctatgtgatcaccggcacgtcagccgaccttacggtcgagaaagccgcggacatcacctgggaggaggaggccgaacagaccggggtgagccacaacctgatgatcacggtggacgacgacggcaccatgcgcatcaaagacgatgagactgaaaacatcctcaccgtcctgctgaagactgcgttgctgatcgtgtcagggatcttcccatactccatccccgctaccctgctcgtgtggcatacctggcagaagcagactcagcggtcgggagtactgtgggacgtccccagcccacccgagacacaaaaggccgagcttgaggagggtgtgtaccgaataaagcagcaggggaacttctgggagactcaggtcggcgtcggcgtgcagaaggaaggcgtattccacacgatgtggcacgtgacgcggggcgcggtgctcacatacaacgggaagcgcctggagcccaactgggcctcggtcaagaaggacctgatctcctacggcgggggatggcggctcagcgcccaatggcaaaagggggaggaggtccaggtgattgccgttgagcccggcaagaaccctaaaaatttccagactatgcctgggacgtttcaaaccaccaccggtgagatcggtgcgatcgcccttgattttaagcccgggacgtccggcagccccatcatcaaccgcgagggcaaggttgtagggctatatgggaacggtgtggtgaccaaaaacgggggatacgtgtcggggatcgcccagaccaacgccgaaccggacggccccacccccgagctggaagaggaaatgttcaagaagcggaacctcacgatcatggacctgcaccccgggtccggcaaaactcgcaagtacctgccggctatagttcgcgaagcgatcaagcgccggctccgcaccctgatcctggcccccactcgggtggttgccgccgaaatggaggaagccctcaaagggttacccatccgctatcagaccaccgcgaccaagagcgagcacacaggccgcgaaatcgtcgacttaatgtgccacgccacgttcaccatgcgcctcttgtccccagtgcgggtgccgaactataacctcattatcatggatgaggcccacttcaccgaccccgccagcatcgcggcgcgggggtacatctccacccgcgtcggcatgggcgaagccgcagcgatcttcatgactgcgacgccgcctgggaccgccgacgcctttccgcagagcaacgcccccatccaagacgaggaacgcgacatccccgagcgcagttggaactcaggtaacgagtggatcaccgacttcgctggtaagacggtctggttcgtgccctccataaaagctggcaatgacatcgccaactgcctccggaaaaacggtaagaaagtcatccagctgagtcgcaagaccttcgacaccgagtaccagaaaacaaagctgaacgactgggacttcgtggtaactaccgacatatccgagatgggtgcaaacttcaaggcagaccgggttatcgacccgcgccggtgcctcaaacctgtgatcctgactgacggtcctgagcgcgtgatcctggcgggccccatgccggtcacggcggcctctgccgctcagaggcgtggcagggtcgggaggaacccccaaaaggaaaacgaccagtatatcttcaccggccagcccctcaacaacgatgaggatcacgcccactggactgaggctaaaatgctgctggacaacatcaatacccccgaggggatcataccggccctcttcgaacccgagcgggaaaagagtgcggccatagacggagagtaccgcctgaaaggcgagtctcggaagaccttcgttgagctgatgcgacgcggggacttaaccgtctggctggcgcacaaggtggcctccgagggcatcaaatacacggaccgaaagtggtgcttcgacgggcagcggaacaaccagatcttagaagagaacatggatgtcgagatctggaccaaggagggcgagaagaagaagctccgccccagatggctggacgcccgcacctacagcgaccccctggctctcaaggagttcaaggagtttgcggccggccgcaagtcgattgccttagaccttgtgaccgagatcgggcgggttccgagccacttagcccacaggacacggaacgccctggacaacctggtcatgctccataccagcgaacatggcgggcgggcataccgacatgcggtggaggaactgcccgagaccatggaaaccttactcctgctggggctcatgatcctcttgaccggcggggccatgctatttctaatcagcgggaagggtatcggaaaaaccagtattgggctgatctgcgtaatcgccagcagcggtatgctctggatggccgaaatcccactgcagtggatcgcatccgcgatagttctggagttcttcatgatggtgctgctgatcccggagcccgagaagcagcgcacgccccaggacaatcaattagcctacgtagtcatcgggatcctaacactggccgctatcattgccgcgaatgagatgggactgcttgagactaccaagcgtgacctgggcatgtcaaaggaacccggggtggtgtcccccaccagctacctggacgtcgacctccaccccgcctccgcctggaccctatacgcagtggcgacgactgtaatcaccccaatgctcagacacacgatcgagaatagcacggccaacgtatccctcgccgccatcgcgaaccaggcggtggtgctaatgggcctcgacaaggggtggcccatcagcaaaatggatctcggggtcccgctgttagcccttgggtgttactcccaggtaaaccccctgaccctgacagctgccgtgctcctgctcataacccattacgctatcatcgggccaggcctacaggcgaaggcgacgcgtgaggcccaaaagcggacagctgccgggataatgaaaaaccctaccgtcgacggcatcatgaccatcgacctggacccggtgatatatgacagcaagttcgagaagcagctgggccaggttatgcttttagtcttatgtgcggtacaactacttctgatgcgaacgtcctgggccctgtgcgaggccctgaccctcgccaccggccccatcaccacgctctgggagggatcgcccggtaaattctggaacacgaccatcgcggtctcgatggcaaatatattccgtggcagctacctggctggtgccggcttggccttctcaatcatgaagtcggtaggcaccggtaaacgggggaccggctcccaaggcgagacgctcggggagaaatggaagaaaaagctgaaccagttgtcccgcaaagacttcgacctctacaaaaagagcgggataaccgaggtggaccgcaccgaagcgaaggaagggctgaagcgcggcgagatcacccaccacgccgtgtcccggggtagcgccaaattgcagtggttcgtagagcgtaacatggtgatccctgaggggcgagtgatagacctcggctgcgggcggggcgggtggtcgtactactgcgctggcttgaagaaggtcacggaagtaagggggtataccaagggcgggccggggcacgaggaacccgtacccatgtcgacgtacggctggaacatagtcaagttgatgtccggcaaggacgtgttctacctcccgcccgagaagtgcgatacgctactgtgcgacataggagagagtagcccgagcccgacggtggaggaaagcaggacgattcgcgttttaaagatggtggagccctggctcaagaacaaccagttctgcatcaaagtgctgaatccgtacatgcccaccgtcatcgagcacctggagcggctacaaagaaagcacggcgggatgctggtgcggaaccctctgtctcggaacagtacccacgagatgtattggatcagcaacggcaccgggaacatcgtcgccagtgttaacatggtctccaggttactgctcaatcggttcacaatgacgcatcggcgccccacaatagagaaggatgtggacctcggcgcgggcacgcggcacgtcaacgccgagccagagacccccaacatggacgtgatcggagagagaatcaagcggattaaggaggagcataactccacctggcattatgacgatgaaaacccctacaagacgtgggcgtaccacggtagctacgaggttaaagcgacgggatccgccagctccatgatcaatggtgtcgtgaaattgttaacgaagccgtgggacgtcgtgcccatggtgacccagatggcgatgaccgacacgacccccttcggccagcagcgggtatttaaggagaaggtggacacccggacgcctcggagcatgcctggcacgcggcgcgtgatgggcatcacagccgagtggttgtggcggaccttggggcgcaacaaaaagccccgcttatgcacccgcgaagagtttacgaagaaggtgcgcaccaacgccgccatgggcgcggtcttcaccgaagagaaccagtgggactccgcgaaggccgccgtggaagacgaggacttctggaagctcgtagacagggaacgagagctgcataagctggggaaatgtggctcatgcgtttacaacatgatggggaaacgggagaagaaactcggagagttcggcaaggcaaaggggagtcgagcgatctggtacatgtggctgggcgcccgttaccttgagtttgaggccctcgggttcctgaatgaagaccactggttctcccgtgagaacagctactcaggcgtggagggggagggcttgcacaagctcgggtacatcctgcgggacataagcaagatcccagggggcgccatgtacgctgacgacactgcggggtgggacacacgaattactgaggacgacctccataacgaagagaagattacccagcagatggaccccgagcaccggcagctcgccaacgcgatttttaaactgacataccagaacaaggttgtaaaagttcagagaccgacccccacaggcaccgtcatggacatcatctcccggaaggaccagcgcggcagcggccaggtgggtacctacgggctaaatacctttacaaatatggaggcccagcttatccggcaaatggagggcgagggggtgctgtccaaggccgacctggaaaacccgcacctccccgaaaaaaagatcacccagtggctggagaccaagggtgtcgagcgcttgaagagaatggcgatcagcggcgacgactgcgtagttaagccgatcgacgatcgcttcgcaaacgctctcctggcgttaaacgatatggggaaagtcagaaaggacatccctcagtggcagccttccaaaggctggcatgactggcagcaagtccccttttgttcgcaccacttccacgagctcataatgaaggacgggcgcaagctggttgtcccgtgccggccgcaggatgagcttatcggccgcgcccggatctcccaaggcgcagggtggagcttgaaggagaccgcctgcttgggcaaggcctacgctcagatgtggtccctgatgtactttcacagacgcgatctgcggctggcgagcaacgcaatctgctccgccgtgccggtgcactgggtacccacgtctcgcaccacttggagtatccacgcccaccatcagtggatgaccactgaggacatgttaaccgtatggaaccgcgtgtggatcgaagacaacccgtggatggaggataagacccccgtcaccacctgggagaacgtgccctacctggggaagcgagaggaccagtggtgcggcagtctgatcgggctcaccagtcgggcgacctgggcgcagaacattcccacggccattcagcaggtccgcagcttgatcggcaacgaggaattcttagactacatgcctagcatgaaacggttccgcaaggaagaggaatctgagggggccatttggtga

SEQ ID NO: 25834 - RNA, 9873 nt, synthetic construct
  misc_feature 1..9873: note = derived and/or modified CDS sequence (opt11) from DENV-3__HQ891025__SS-prME
  source 1..9873: mol_type = other RNA
accagcctttgcctcatgatgatcctgcccgccgccctggcgttccacctcacgagccgcgacggcgaaccccggatgatagtgggtaagaatgagcgcggcaaaagcctgttattcaaaaccgcctccgggataaatatgtgcactcttatcgccatggatctgggcgagatgtgcgacgatacagtgacttacaaatgcccccacatcaccgaggtggagcccgaggacatcgactgctggtgcaatttaacaagcacctgggtgacctacgggacgtgcaaccaagccggcgagcaccgcagggacaagcggtctgtggccctcgcaccccacgtgggcatggggctggatacacgcacgcagacctggatgagcgccgagggcgcctggagacaggtggaaaaggtcgagacatgggccctgcgccacccggggttcactattttggcgcttttccttgcccattatatcggcacctccttgactcagaaggttgtaatcttcatcctgctgatgctcgtcactccctcgatgaccatgcggtgcgtgggggtgggcaatcgggacttcgtcgaggggctgtccggggcaacctgggtggatgttgtgctggagcatggtgggtgcgtcaccacgatggcgaagaataagcccaccctcgacatcgagctgcagaagaccgaggctacccagctagccacgctccggaaactgtgcatcgaagggaagatcaccaacatcaccaccgactcacgctgcccaacgcagggcgaggccaccctgccggaggagcaggatcagaactacgtctgcaagcacacctacgtcgatcgggggtgggggaacgggtgtggcttatttggaaagggctccttggtaacatgcgccaagttccagtgtctggagcccatcgagggcaaggttgtccagtatgagaacctcaagtacacggtcatcatcaccgtgcataccggggaccagcatcaggtcgggaatgagacccagggagttacggccgaaatcacaccccaggccagcacaactgaggcaatcctgcccgagtacggcacgttagggctggaatgctccccgcgtacgggcttagacttcaatgagatgatactgctcaccatgaagaacaaggcctggatggtccaccgacagtggttcttcgacttacccctgccctggaccagcggcgctacgactgaaaccccaacctggaaccgcaaggagctcctggtgaccttcaagaacgcccacgccaagaaacaggaggtggtcgtactggggtcccaggaaggcgcgatgcacacggccctcaccggggccacggagattcaaaatagcggcgggacgtccatctttgctggccacctgaaatgccggctgaagatggacaagttggagctgaagggaatgagctacgccatgtgcacgaataccttcgttcttaagaaagaagtctcagagacccagcatgggactatcctcatcaaagtggagtacaagggcgaggacgtgccgtgcaagatccccttcagcacggaggacggacaaggcaaggcgcacaacgggcgcctgataacagccaaccccgtcgtgaccaagaaggaggagcccgtgaatatagaggccgagccgccgttcggggagagcaacattgtaatcggcatcggggacaacgcactgaagatcaactggtacaagaagggctccagtatcggaaagatgtttgaggcaaccgccagaggggcccgccggatggccatcctgggggacacggcctgggacttcgggagcgtgggcggggtgctcaatagcttaggcaaaatggtccaccaaatcttcgggtcggcgtacacggccctttttagcggagtttcatgggttatgaagatcggcataggagtcctccttacctggatcggtctcaacagcaagaacaccagcatgtcattctcctgtatcgcaatcgggatcatcaccctctatctgggtgccgtggtgcaggcagatatggggtgcgttatcaattggaagggcaaggaactgaagtgcggcagcgggatcttcgtcacgaatgaagttcacacctggaccgaacagtacaagttccaggcggactcccccaagcggctagccacggccatcgccggtgcctgggaaaacggggtgtgtggcatccgcagcacgacccggatggagaacctgctgtggaagcagatcgcgaacgagctcaactatatactgtgggagaacaacatcaaactgacagtggttgtcggagacattatcggcgtactcgagcagggtaagcgcacgcttacgccccaaccgatggagctgaagtacagctggaagacctgggggaaggccaagatcgtgacggccgaaacgcagaacagctccttcatcatcgatggcccgaacacccccgagtgccccagtgtttcgcgagcgtggaacgtgtgggaggtggaagactacggattcggcgtcttcaccaccaacatctggctcaagctgcgcgaggtgtacacccagttgtgcgaccaccggctcatgagcgcggccgtgaaggacgaacgggcggtacacgccgatatgggctattggatcgagagccagaagaacgggtcctggaagctggagaaggccagcctgattgaggtgaaaacgtgcacatggccgaaatcccacactctctggagtaacggtgtgctagagtcggacatgatcatccccaaatcactggccggaccaatctcccagcacaaccatcgtccgggctaccacacccagacggctggaccctggcaccttggcaaactggagctcgacttcaactactgcgagggcaccaccgtcgtgataacggagaactgcgggacgaggggccccagccttcggaccaccactgtatccggcaagctgatccacgaatggtgctgccgcagctgtacgttacccccgctccggtacatgggagaagacgggtgctggtacggtatggagatccgccccatctccgagaaggaggagaatatggtcaagagcctggtgtctgccggcagcgggaaggtcgacaacttcaccatgggcgtcctgtgcctggcaatcttgttcgaggaagtgatgcgggggaagttcggcaagaagcacatgatcgccggagtgttcttcacatttgtcctgctcctatctggtcaaatcacctggcgggacatggctcacacactgatcatgatcggcagcaacgccagtgaccggatgggcatgggcgttacctacttagcactgatcgccaccttcaagatccagcccttcctggccttaggcttcttcctgcgcaagctgaccagccgggagaaccttctgctgggcgtgggactcgctatggccacgaccctgcagctccccgaggacatcgagcaaatggccaacgggatcgccctaggtctgatggcgctgaagttaataacccaattcgagacctaccagctgtggacggccctgatcagcctgacttgttccaacaccatcttcacgctcacggtcgcgtggcgcaccgcaaccctgattctcgccggggtgtcactgttacctgtctgccagtccagctccatgcggaagaccgattggttgcccatggcggtggccgcaatgggtgtaccacccctaccgctgttcatcttcggcctcaaagacaccctgaagcgccgctcttggccgctgaacgaaggcgtcatggccgtgggcctcgtgtccatcttggctagctcactgcttcggaacgacgtccccatggcgggccccctggtagccggagggctgctaattgcctgctacgtaatcaccggcaccagcgccgacctgaccgtcgagaaagccgctgacatcacctgggaggaagaggccgagcagacaggtgtgtctcacaacctgatgatcaccgtggacgacgatggcacaatgcgaatcaaggatgacgagacagagaacatcctaacggtactgttgaaaacagccctcctgatcgtttctggcatcttcccctactccattcccgccaccctactcgtgtggcacacttggcagaagcagacgcagcggagtggggtcctatgggatgtgcccagcccgcccgagacccagaaagccgagctggaggagggcgtgtaccgcatcaaacagcaggggatcttcggcaagacccaggtcggggttggtgtgcaaaaggagggggtgttccataccatgtggcacgtaactcgaggggcggttctcacctacaacggaaagcgcctggagccaaactgggcctccgtcaagaaggatctgatttcctacgggggcggctggcggctcagcgcgcagtggcagaaaggcgaggaggtccaagtcatagccgtcgaacccggcaagaaccccaagaatttccaaactatgcctgggaccttccagacgaccacgggcgaaatcggcgcgatcgccctggacttcaagcccggcacatccggctcccccatcatcaacagggaggggaaggtcgtgggcctgtatggcaacggggtcgtcacgaagaacggagggtacgtgagcggcatcgcccagaccaacgcagagccggacgggcctacccccgagctagaggaggaaatgttcaagaagcggaacttaaccatcatggatctgcatcccggctccggtaaaacgcgcaagtatctgccggcgatcgtacgggaagcgatcaagcgccgtctccgcaccctgatcttggcccccactcgggtggtggccgccgagatggaggaggcccttaaaggcctcccaatccgctaccagaccacggcgaccaaaagcgagcacaccgggcgggagatcgtagacctgatgtgccatgccacattcacaatgcgcctcctttcccccgtacgggtgccaaactataacttgattatcatggatgaagcacacttcaccgaccccgcgtccatcgctgcgcgcggctacatctccactagagtgggcatgggggaggctgccgcaattttcatgaccgcgacgccgcccgggaccgccgacgccttcccgcagtccaatgcccctatccaggacgaggagagggatatcccggagcgctcctggaactccggtaacgagtggatcaccgacttcgccggcaagaccgtctggttcgtgccctccatcaaggcggggaacgacatcgccaattgcctccgcaagaacggcaagaaagtcattcagctgagccgcaaaacgttcgatactgagtaccagaagacaaaactgaatgactgggatttcgtggtgaccactgacatctccgagatgggcgccaacttcaaggcagaccgtgtcatcgacccccgccggtgcttgaagcctgtcatcctgaccgacgggcccgagcgcgtgattctcgccggcccgatgccggtgaccgccgcgtccgccgcccaacgccgcggccgggtggggcgcaacccccagaaagagaacgatcagtacatcttcaccgggcagccgctcaacaacgacgaagaccacgcccactggacagaggcaaagatgctgctggacaacataaatacgccagaagggatcattccggccctctttgagccagagagggaaaaatctgccgccatcgacggcgagtaccgactgaagggggaaagccgcaagacattcgtggaactgatgcgccggggcgacctcccggtgtggctggcgcacaaggtggcgtcagaggggatcaagtataccgaccgcaagtggtgcttcgacggccagcgcaacaaccagatcctggaggagaacatggatgtagaaatttggaccaaggagggtgagaagaagaaattgcgcccccgatggctggacgcccgcacgtactctgacccgctggctctaaaggagttcaaggagttcgcagcgggtcgcaaatcaattgcccttgacttggtgaccgaaattggccgagtgcccagccacctcgctcatcgcaccaggaacgcactggacaatctggtgatgctccatacgtccgagcatggcggccgggcgtaccggcacgctgtggaggagctgcccgagactatggagaccctgttgttgctggggctcatgatcctgctgacaggcggcgccatgctgttcctgatcagcgggaaaggtattgggaagaccagcattggcctgatctgcgtgatagcctccagcgggatgttatggatggcggaaatcccgctgcagtggatcgcctccgctatagtcctggagttctttatgatggttctcttaatcccagagcccgagaagcagcgcacgccccaggacaaccagctagcgtacgtggtcatcggtatcctcaccctggcagcaatcatcgccgccaacgagatgggcctgctcgaaaccacaaagcgggacctggggatgagcaaggagccgggtgtcgtatcccccacgagctacctggatgtggacctccatccagcctcggcctggaccttatacgcagtggcgaccaccgttatcacacctatgctccgccacaccattgagaacagcaccgcgaacgtctcactcgccgccatcgccaaccaggcggtggtgctgatggggctggacaaggggtggcccattagcaagatggacctcggggtacccctgctggccctcggctgctattctcaggtgaacccccttaccctgacagcggccgtgctgctactaataacccactacgccatcatcggccccgggctccaggcaaaggcgacccgggaggcccaaaagaggaccgccgccggcataatgaagaacccgacggtagacgggatcatgaccatcgacctggaccccgtgatctacgattcaaagttcgagaaacagctgggccaggtgatgttattggtcctatgcgcggtgcagcttctgctgatgaggacttcctgggccctctgcgaggcactaacactggccactggccccatcacaacactctgggaggggagtccaggaaagttttggaacaccaccatcgcggtgtccatggccaatatcttccgcgggtcctacctggccggcgccgggctggccttctctatcatgaagtcggtcggcaccggcaagcgggggaccggctcccagggggagaccttgggtgagaagtggaaaaagaagctaaaccagctgagtcgcaaggacttcgacttatacaaaaagtccgggatcaccgaggtggaccggacggaggcgaaggaggggcttaagcgtggcgagatcacccaccacgccgtgtcccgggggagcgccaagctgcagtggtttgtcgagcgcaacatggtgatcccagaggggcgggtgatcgatcttgggtgcggacgcggcgggtggtcttactactgcgccggcctgaaaaaggtcacagaggtgcgggggtacaccaagggcgggcccggccacgaggagcccgtgcccatgagcacgtacgggtggaacatcgtcaagctgatgtccggcaaggatgtgttttacctcccgcctgagaaatgcgacaccttactgtgcgacattggggagagctctcccagccccacggtggaggagtcccgaactatacgcgtcttgaagatggtggaaccgtggttgaaaaacaaccagttctgcataaaggtgctgaacccctacatgcccacggtaatagagcacctggagcgtctccagcgcaagcacggtggcatgttggtgcggaaccccctaagccgcaactccacccacgagatgtactggatcagcaacggcacgggcaacatcgtcgcctccgtcaacatggtgagccggctcttactgaaccgcttcaccatgacgcaccggcgcccgaccatcgaaaaggatgtcgacttaggcgcggggacccgacacgtcaacgccgagcccgagacacccaatatggatgttatcggcgagcgcataaagcggatcaaagaggagcataactccacgtggcactacgacgacgagaacccgtacaagacctgggcctaccatgggagctacgaggtgaaggctaccggatccgctagctccatgatcaatggggtcgtcaaactactgactaaaccctgggacgtcgtccctatggtgacgcagatggcgatgacagacactacaccctttggtcagcaacgcgtcttcaaagagaaagttgatacccggaccccgcggagcatgcccggcacccggcgcgtgatggggatcacggccgagtggctctggcggactctgggtcggaacaagaagcctcgtctctgcacgcgcgaggagttcaccaagaaggtccgcacgaatgccgcaatgggggcggtgttcactgaggaaaaccagtgggattccgccaaggccgcggtcgaggatgaggacttctggaagctagtcgatcgggagcgcgagcttcataaactgggcaagtgcggatcctgcgtatacaacatgatggggaagcgagagaaaaagctcggagagttcggaaaggccaaaggcagccgtgctatctggtacatgtggctgggagccagatatctcgagttcgaggccctcggctttctgaacgaggaccactggttctcccgcgagaactcttatagtggggtcgagggcgaggggctgcacaagctcgggtacatccttcgggacattagcaagatcccgggtggagccatgtacgccgacgacacggcgggctgggacacccgcatcaccgaggatgacctgcataacgaggagaaaatcacgcagcagatggaccctgagcaccggcagcttgccaatgccatatttaagctgacgtaccagaacaaggtcgtgaaggtgcagaggcccacacccaccgggaccgtcatggacataatctcgagaaaggaccagagggggtcaggccaggtgggaacttacggcttgaacaccttcaccaacatggaggcgcaactcatcaggcagatggagggggagggcgtgctgtccaaagccgacctggagaacccccacctccccgagaagaagatcactcagtggttggagacgaaaggcgtcgagcgcttgaagcggatggcgatcagcggagacgactgcgtggtgaagcccatcgatgaccgcttcgcgaacgccctccttgccttgaacgacatgggcaaggtccggaaggatatcccccagtggcagccctccaaggggtggcacgactggcagcaggtaccgttctgcagccaccatttccacgagctcattatgaaggacggccgcaagctggtggtcccgtgtcgtccacaggacgagctgataggacgcgcccggatctcccaaggcgcgggctggagcctcaaggagaccgcctgcctggggaaggcctacgcccagatgtggagtctaatgaacttccatcgacgcgacttgcgtttagcgagcaacgccatttgctccgccgtgccggtccactgggtcccaaccagccgcaccacctggtcaatccacgcgcatcaccaatggatgaccaccgaggacatgctgacggtgtggaaccgggtgtggatagaggataacccctggatggaagacaagacgcctgtaaccacctgggagaacgtgccctacctcggcaagcgcgaggaccagtggtgcgggagcttgatcggcctgacaagccgtgccacatgggcgcagaacatcccgaccgcgatacagcaggtccggtcactcatcggtaacgaggagttcctcgactacatgccgtctatgaagagattccgcaaggaagaggagtccgagggggccatctggtga

SEQ ID NO: 25835 - RNA, 9873 nt, synthetic construct
  misc_feature 1..9873: note = derived and/or modified CDS sequence (opt11) from DENV-3__HQ705617__SS-prME
  source 1..9873: mol_type = other RNA
accagcctatgcttgatgatgatactgcccgccgccctggcgtttcacctcaccagccgggacggcgagccgcggatgatcgtgggcaagaacgagaggggcaagagcttgcttttcaagaccgccagtgggatcaacatgtgcaccttaatcgctatggacctcggcgaaatgtgcgacgacaccgtgacctacaagtgcccacacattaccgaggtggagcccgaggatatcgactgctggtgcaatttgaccagcacgtgggtgacctacgggacgtgcaaccaagccggcgagcaccggagggataagcggtccgtggccttggccccgcacgtgggcatggggctagataccagaacccagacctggatgagcgccgagggcgcctggagacaggtggagaaggtggagacgtgggctctgcgccatccgggcttcaccatcctcgcgctgttcctggcccactacatcggcacctccctcacccagaaagtggtgatcttcatcctgctgatgctggtcacgccgagcatgaccatgaggtgcgtgggagtgggcaaccgcgacttcgtagagggcctctccggggccacctgggtcgacgtggtcttagaacacggcgggtgcgtgaccacgatggccaagaacaagcccaccctagacatcgagctgcagaaaaccgaggccacccagctggcgacgctccggaagctgtgcatcgagggcaagatcaccaacatcaccaccgacagtcgctgccccacgcagggcgaggccaccttacctgaggagcaggaccagaattacgtctgcaagcacacctacgtcgaccgagggtgggggaacgggtgcggccttttcggcaagggaagtctggtgacctgcgccaagttccagtgcttggagcccatcgagggtaaggtcgtacagtacgagaacttgaagtatacggtcattatcaccgtgcacacgggggaccagcaccaggtcggaaacgaaacgcagggggtaaccgcggagatcacgccccaggccagcaccaccgaggcgatcctgcccgagtacggcaccctggggctcgagtgctccccgcggacgggcctggacttcaacgaaatgattctgttaaccatgaaaaacaaggcctggatggtccaccggcagtggttcttcgaccttcccctgccctggaccagcggtgccaccaccgagacccctacctggaaccgcaaggagctcctcgtgaccttcaagaatgcccacgccaaaaagcaggaggtagtcgtactggggtcccaggagggcgcgatgcacacggcgctaaccggggccaccgagatccaaaattctggcgggacctccatcttcgccggccacctgaagtgccggttgaaaatggacaaactcgagctgaagggcatgagctacgccatgtgtacgaacacattcgtgttgaagaaggaggtcagcgagacccagcacgggaccatcctcattaaggtggagtacaagggcgaggatgtgccatgtaagatccccttcagcacggaggacgggcagggcaaagcgcacaacggccgcctgatcaccgccaacccagtcgtcaccaagaaggaggagcccgtcaatattgaggcggagccgccgttcggggagagcaatattgtcatcggaatcggggacaatgccctgaaaatcaactggtacaagaagggctccagcatcgggaagatgttcgaggcgaccgcccggggcgcaaggaggatggctattctgggcgacacagcctgggactttggcagtgtcggcggggtactcaatagcctgggcaagatggttcaccagatcttcgggtcggcttacaccgcgctcttcagcggcgtgtcctgggtgatgaagatcggcatcggggtactcctgacgtggatcggcttaaactctaagaacacgtcgatgagcttctcctgcatcgccatcggtattatcaccctctatctgggcgctgtggtgcaggccgacatggggtgcgtcatcaactggaagggaaaagaactgaagtgtggcagcgggatcttcgtgacgaacgaggtgcacacctggaccgagcaatacaagttccaggcggactcgcccaagcgtctcgccaccgccatcgccggcgcctgggagaacggggtctgtggcatccggagcacgacccggatggagaacctgctgtggaagcaaatcgcgaacgaactcaactatatcctgtgggagaacaacattaaactgaccgtggtggtcggtgacatcatcggcgtgctggagcagggcaaacgcacgctgacgccccagccgatggagctgaagtactcctggaagacctgggggaaggccaagatcgtaaccgccgagacgcagaacagttccttcataatagacggccccaacacccccgagtgcccaagcgtctcccgggcctggaacgtgtgggaggtagaggactacggattcggcgttttcacgaccaacatctggctcaagctgcgagaggtatatacccagctgtgcgaccaccggctcatgagcgcggctgtgaaggacgaacgcgccgttcacgcagacatggggtactggatcgagtcgcaaaagaacgggtcctggaagctggagaaggccagcctgatcgaggtgaagacgtgcacctggccgaagtcccacaccctctggagcaatggcgtactggaatccgacatgataatccccaaaagtttggcggggcccatctcccagcacaaccaccggccgggctaccacacccagacggccgggccatggcacctcgggaagctggagctggacttcaactactgcgagggcaccaccgtcgtgatcaccgagaactgcggcacgcgcggccccagcctacgtacgaccacggtgtccgggaagctgatccatgagtggtgctgccgcagctgcacgctgcccccgctccggtatatgggagaggatgggtgctggtacggcatggagatccgccctatctccgagaaggaggagaacatggtcaagtcgttagtgtccgccggcagcggaaaggtggacaacttcaccatgggcgtcctgtgcctggccattctgttcgaggaggtgatgcgggggaaattcggaaagaagcacatgatcgccggggtgttttttacctttgtcttactactgtcaggccagatcacttggcgcgacatggcgcacacgctcatcatgatcggcagcaatgcctccgatcggatggggatgggtgtaacatacctcgccttaatcgccactttcagaatacagcccttcttggccctcggattcttcctgcggaagttaaccagccgcgagaatttgctgctgggcgtgggcctcgcgatggccacgaccctgcagctgcccgaagacatcgaacaaatggcaaacgggatcgccctcggcctgatggcgctaaaactcatcacccagtttgagacctaccagctgtggacagccctgatcagcctgacatgctcgaacaccatcttcaccctgacagtcgcatggcggaccgccaccctgatcctcgccggggtgagtctcttaccggtctgccagtccagctcaatgcgcaagaccgactggctccccatggcggtcgccgccatgggcgttccgcccctgccgttattcatctttgggctcaaggacacgctgaagcgccggagctggcccctcaacgaaggcgtcatggccgtagggctcgtgagcattctggccagcagtcttctccgcaacgacgttcccatggcgggacccctggtggccggcggtctgctcatagcctgctacgtgatcaccggcaccagcgccgacctgaccgtcgagaaggcagctgacatcacgtgggaggaggaggccgagcagaccggggtgtcccacaacttgatgatcaccgttgatgacgacggcaccatgcggatcaaagacgacgagaccgagaacattctcacagtcctgttaaagaccgcactccttatcgtgagcggcatcttcccgtactccattcccgcgaccctactcgtgtggcatacctggcagaagcagacgcaacgcagcggggttctgtgggatgttcccagcccgcccgagacccaaaaggccgaattagaggaaggagtctaccggatcaagcaacaggggatcttcggcaagactcaggttggagtgggcgtgcagaaagaaggagtcttccacaccatgtggcacgtgacgcgcggggcggtgttaacgtacaatggcaagaggctagagcccaattgggccagcgtaaagaaggatctgatctcctacgggggcggttggcgcctcagcgcccagtggcagaagggcgaggaggtccaagtaatcgccgtcgagcccggcaagaaccccaaaaacttccagaccatgcctgggaccttccaaacgacaaccggcgagatcggggcgatcgccctggactttaagccggggacctccggcagccccattatcaaccgggaggggaaggtggtgggattatacgggaacggcgtcgtgacgaagaacggggggtacgttagcggaatcgcccagaccaatgccgagcctgacgggcccacccccgaactggaggaggagatgttcaagaagcgcaacctcaccatcatggacctgcacccaggatccgggaagacgcggaagtacctgcctgccatcgttcgcgaggctatcaaacggcgccttcggaccctgatccttgcccccacccgcgtggtggccgccgagatggaggaggccctcaagggcctccccatcaggtaccagaccacggcgaccaagagcgagcacaccggccgcgagatcgtcgacctgatgtgccacgctactttcacgatgcggctcctgagtcctgtgcgcgtgcccaattacaatttaataatcatggatgaggcccactttaccgaccccgctagcatcgccgcgcgtggctacatctccacccgcgtcggcatgggggaggccgctgccatcttcatgaccgcgacgccgccaggcaccgccgacgccttcccgcaaagcaacgctcccatccaagacgaggaacgcgacatccccgagcggtcctggaatagtgggaacgaatggatcaccgactttgcgggcaaaacggtgtggttcgtcccctccatcaaagctggtaacgacatcgccaattgtctgcgcaagaacggaaagaaggtaatccaattaagccggaagacgttcgacaccgagtaccagaagaccaagctgaacgactgggacttcgttgtgacgacggacatctccgagatgggcgccaactttaaagccgaccgcgtcatcgaccccaggaggtgcctcaaacccgtgattctgaccgacgggcccgaacgggtgatcctggccggccccatgccggtcacagcggccagcgccgcccagcgccgcgggcgtgtgggccggaacccccagaaagagaacgatcagtacatcttcaccggtcagcccctcaacaacgacgaggaccacgcccactggaccgaggcgaaaatgcttctggataacatcaacacgcccgaaggaatcatacccgccctattcgagcccgagcgcgagaagtccgccgccatcgacggcgagtaccggttgaagggtgagagcaggaagaccttcgtggagctcatgcggcggggcgacctcccggtctggctggcacacaaggtggccagcgaggggatcaaatacaccgaccggaaatggtgcttcgacggccagcgaaacaaccagatcctggaagagaacatggacgtcgagatctggactaaggagggcgaaaagaagaagctccggccccgatggctggacgcccgcacgtattctgacccgctggccctcaaggaattcaaggagtttgccgcggggcggaagtccatcgctctggaccttgtgaccgagatcggccgcgtccccagccatctcgcccaccggacccgcaacgccctagacaacctggtaatgctccacaccagcgagcacggcggccgggcctaccggcacgcggtggaggagctgcccgagacgatggaaaccctcctcctgctgggtctgatgatcctgttgaccggcggcgccatgctgttcctgatcagcgggaagggcattgggaagaccagcatcggcctgatttgcgtgatcgcctcaagcgggatgctctggatggccgagataccgctacaatggatcgcttccgcgatcgtgctggagttcttcatgatggtgttgctgatccctgagccagagaagcaaagaacgccccaggacaaccagctggcctacgtggtaatcggcatcctcaccttagccgccataatcgccgcgaacgagatgggcctcttagaaaccactaagcgcgacttggggatgagcaaagagccgggcgtggtatcccccacgtcgtacttagacgtcgacctccaccccgccagcgcctggaccctgtatgccgtggcgactaccgtgatcacgcccatgttacggcataccatcgaaaatagcaccgccaacgtctccctcgccgccatcgcaaaccaggcggtggtgctgatggggctggacaaaggctggcctatcagcaagatggacctcggggtccccctgctggccctcggctgctactcccaggtgaaccccctcaccctgacggccgccgttctcctgctcatcacccactacgctatcatcggccccgggctccaagcgaaggccaccagagaggcccaaaagcgaaccgcagccggcatcatgaagaacccgacggtcgatggaatcatgaccatcgacctggaccccgtgatatacgatagcaagttcgagaagcagctgggccaagtgatgctcctggtcctgtgcgccgtgcagctcctgctgatgcgaacctcctgggcgctctgcgaggccctaacactggccacgggccccataacgactctttgggaggggagcccaggcaagttctggaacaccacgatcgcagtgtccatggccaacatcttccgggggagctacctggccggcgccgggctggccttttccatcatgaaatcggtgggcaccggcaagcgggggaccggctcgcagggagagaccctgggcgagaaatggaagaagaagctgaaccaattgtctcgtaaggacttcgacctttacaagaagtccggcatcaccgaggtcgaccgcacggaggcgaaggaagggctgaagcggggcgagatcacccaccacgccgtgtcgcgcggatccgccaagttgcagtggttcgtcgagcggaacatggtgataccggaaggccgcgtgatcgacctcgggtgcggccgagggggctggtcctactactgcgccggcctgaagaaggtaaccgaggtgcgcgggtacaccaagggaggccccggtcacgaggagcccgtgcccatgtccacttacgggtggaacatcgtcaaactgatgtccggcaaggacgtcttttacctcccgcctgagaagtgcgacaccttgctgtgcgacattggcgagagcagccctagccccaccgtggaggagtcccgtacaatccgggtcctgaagatggtggagccgtggctcaaaaataaccagttctgcatcaaggtgttgaacccctacatgcccacggtcatcgaacatttagagcgcctccagcggaagcacgggggcatgctggtgcgcaacccactatcgcgaaactccacccacgagatgtactggatcagcaacgggaccggcaatatcgtggcttccgtcaacatggtgtcgcgcctcctgctgaaccggttcaccatgacgcaccgccggccgaccatcgagaaggacgtggacctcggcgctgggactcgccacgtcaatgccgagcctgagaccccaaacatggacgtgatcggcgagaggatcaagcgcatcaaggaggagcataactcaacgtggcattacgacgacgaaaatccgtataagacctgggcctaccacgggagctacgaggtgaaggcaacaggctccgccagctccatgatcaatggggtcgtgaagctgctaaccaagccctgggacgtggtgcccatggtgacgcagatggcgatgaccgacaccacccccttcggacagcagcgagttttcaaggagaaggtggatacacgcaccccgcgaagcatgcccggcacccgccgggtgatggggatcacagccgagtggctctggagaacgctgggacggaacaagaaaccgcgcctgtgcacgcgtgaagaatttaccaagaaggtccggaccaacgccgccatgggtgcggtgttcacggaggagaaccagtgggacagcgccaaagcagctgtggaggacgaggacttctggaagctcgtcgacagagagcgggagctgcacaagctgggcaagtgcgggtcttgcgtgtacaatatgatgggcaaacgcgagaagaagctcggcgagttcgggaaggccaagggtagccgggcgatctggtatatgtggcttggggcccgatacctggagttcgaggcgctgggcttcctgaacgaggaccactggttttcaagagagaactcctactccggggtggaaggcgagggactgcacaagctcgggtatattctgcgcgacatcagcaagatccccggcggggccatgtacgccgacgacaccgccggctgggacaccagaatcactgaggacgaccttcacaacgaggaaaagataacgcagcaaatggacccggagcatcgccaactcgccaacgcgatattcaagcttacctaccagaacaaggtcgtgaaggtgcagcggccaactcctaccggcaccgtcatggacatcatcagccgcaaggaccagcgggggagcggtcaggttgggacgtacggtctgaacaccttcaccaatatggaggcccaactcatccgccagatggagggagagggagtgctgtccaaggccgacctggagaacccccacctcccggagaagaaaatcacccagtggctggagacgaagggcgtagaacggctgaagcgcatggcgatcagcggggatgactgcgtggtgaaacccatcgacgatcggttcgccaacgcacttctggccctgaacgacatgggcaaggtccgcaaggacatcccccagtggcagccctccaaagggtggcacgactggcagcaggtgccgttctgcagccaccacttccatgaactcataatgaaggacggccgaaagttagtggtcccctgtcgcccccaggacgaactaatcgggcgggcccgcatttcccagggtgcgggctggagcctcaaggagactgcttgcctgggtaaggcctacgcccaaatgtggtccctgatgtacttccaccgccgggacctccgccttgctagcaacgccatctgctccgctgtgcccgtacactgggtcccgacgagtaggaccacgtggtcaatccatgcccaccaccagtggatgacaaccgaggacatgttgaccgtgtggaaccgcgtgtggatcgaggacaacccctggatggaggacaagactcccgtcaccacctgggagaacgtgccctacctcggcaagcgggaggaccagtggtgcggctctctgataggcctaaccagcagggccacgtgggcgcagaacatccccaccgccatccaacaggtacggtccctcattgggaacgaagagtttttagattacatgcccagcatgaagcgtttcagaaaggaggaggagtccgagggagccatctggtag
